United States Patent 11,332,783 (SAMPLE ANALYSIS, PRESENCE DETERMINATION OF A TARGET SEQUENCE) - sequence listing, part 9

SEQ ID NO: 166856 - DNA, 75 bp, Artificial Sequence
  Synthetic
gttctcatgatcgcggagaccacacagacgtgcgcgtctcccaatggctaggcgttctttttaggtagtaatttt

SEQ ID NO: 166857 - DNA, 75 bp, Artificial Sequence
  Synthetic
tctggcttgatttcttttatctatgatcgattcttctttttctcgggggttgcatcttccgtgaaagtaaagtga

SEQ ID NO: 166858 - DNA, 75 bp, Artificial Sequence
  Synthetic
tgcatcttccgtgaaagtaaagtgacactactctaaatggtaaccatattatctgttgattaggagaaaaaataa

SEQ ID NO: 166859 - DNA, 75 bp, Artificial Sequence
  Synthetic
cgtactgaattttttaacagaattgcttctccgtaactatttccgcagattcagacagattgtcaaaaaaaaaat

SEQ ID NO: 166860 - DNA, 75 bp, Artificial Sequence
  Synthetic
aagaacagataaacctttaataaaaaaaaagtatgtgctcccgacccacggtctgcgtgtctcttttttatgtcc

SEQ ID NO: 166861 - DNA, 75 bp, Artificial Sequence
  Synthetic
gcgttctggccgccggcggggccggggtgttgcggagacggggggtgtgcgggacggtggtggggacggggacgg

SEQ ID NO: 166862 - DNA, 75 bp, Artificial Sequence
  Synthetic
acggcacagaaatagtgggtctgtggcttttggttcgtgtacattcgcgtttgcgtgtcgagatttctacggtat

SEQ ID NO: 166863 - DNA, 75 bp, Artificial Sequence
  Synthetic
accgagtcctcctagttctagtgtatcaacggtaaaatcgactaccagcgtaacaacctccacaacacctacgac

SEQ ID NO: 166864 - DNA, 75 bp, Artificial Sequence
  Synthetic
agtgttgagatatttttgaatgctggttatgttcgattttgtgaggttaaagtgtgtactatttatggtggtgta

SEQ ID NO: 166865 - DNA, 75 bp, Artificial Sequence
  Synthetic
taatcaaaaaacaacagctaggaaatcgagggttactctacgatagagtgtctctacaaagtgaagaatgttacg

SEQ ID NO: 166866 - DNA, 75 bp, Artificial Sequence
  Synthetic
gccggggagtcgcgctgggcacgagggacggggacggcggttgcgtggcggggacgggggactcttgcggcgggg

SEQ ID NO: 166867 - DNA, 75 bp, Artificial Sequence
  Synthetic
tcgaaccttctttaagagctttgtttagtgcaactttaaattacaaggagtagaaagctgaaatgaatctatgaa

SEQ ID NO: 166868 - DNA, 75 bp, Artificial Sequence
  Synthetic
tagaaagctgaaatgaatctatgaaggtgctattctttgaatatcttactttgtacgcttcacattcgttatttg

SEQ ID NO: 166869 - DNA, 75 bp, Artificial Sequence
  Synthetic
tgtgattctctatgagtgttatttttattatccttttggggactacgatttttcttcttgttctacataccacta

SEQ ID NO: 166870 - DNA, 75 bp, Artificial Sequence
  Synthetic
tttcttcttgttctacataccactactactcgtaatcacatacatggacgaaaaaaaaattcgtcaggcagtaga

SEQ ID NO: 166871 - DNA, 75 bp, Artificial Sequence
  Synthetic
tctttttttcttttgagagagtatctgctgagattgtccgtggtgtatctagtcgctatttttgttgttactagt

SEQ ID NO: 166872 - DNA, 75 bp, Artificial Sequence
  Synthetic
agttttgcacacagtttattcagtatagtttttcttcttgccatgatcaattgagcccaccaccttttttttttt

SEQ ID NO: 166873 - DNA, 75 bp, Artificial Sequence
  Synthetic
tttgccatcaagtggtgacgataacccgtcagattgataattggttcctacagaaactattctaaccgcggaaga

SEQ ID NO: 166874 - DNA, 75 bp, Artificial Sequence
  Synthetic
aaaaacatcataacataaaggaccacctacctgggacgcgcagttgggcggcggattggggcggcatgctgcggc

SEQ ID NO: 166875 - DNA, 75 bp, Artificial Sequence
  Synthetic
gatgctgtcggtgatggtctcttcctctctggtcctgatcgtcttttttctaggcgcttccgaggaggcgaagcc

SEQ ID NO: 166876 - DNA, 75 bp, Artificial Sequence
  Synthetic
ttttccgcgtgtcgggtgacgtagttttcctcttgtagcaacgtgaggacgactactccgtgtggctcgacggta

SEQ ID NO: 166877 - DNA, 75 bp, Artificial Sequence
  Synthetic
tttcctcttgtagcaacgtgaggacgactactccgtgtggctcgacggtacggtggtcaaaggctgttggggatg

SEQ ID NO: 166878 - DNA, 75 bp, Artificial Sequence
  Synthetic
attaatgttatatacatatctcctgtatgtgacccatgtgcttatgactctatttctcatgtgtttaggcccgag

SEQ ID NO: 166879 - DNA, 75 bp, Artificial Sequence
  Synthetic
taagacggaattgcatagtatgcgctcgacgctagaatccatctacaaagacatgcggcaatgcgtaagtgtctc

SEQ ID NO: 166880 - DNA, 75 bp, Artificial Sequence
  Synthetic
ctgttaggttgcggagataagtccgtgattagtcggctgtctcaggaggcggaaaggaaatcggataacggcacg

SEQ ID NO: 166881 - DNA, 75 bp, Artificial Sequence
  Synthetic
ggaaaggaaatcggataacggcacgcggaaaggtctcagcgagttggacacgttgtttagccgtctcgaagagta

SEQ ID NO: 166882 - DNA, 75 bp, Artificial Sequence
  Synthetic
cggaaaggtctcagcgagttggacacgttgtttagccgtctcgaagagtatctgcactcgagaaagtagcgttgc

SEQ ID NO: 166883 - DNA, 75 bp, Artificial Sequence
  Synthetic
gttgtttgtgggtgttgctaggcgggctggaaagatgatgtataaatagagtctgcgacggggttcggcgctctg

SEQ ID NO: 166884 - DNA, 75 bp, Artificial Sequence
  Synthetic
gctggaaagatgatgtataaatagagtctgcgacggggttcggcgctctgccggctgcggcggcactcgctccac

SEQ ID NO: 166885 - DNA, 75 bp, Artificial Sequence
  Synthetic
ctggacttttacgaatcctaaccgcatcctgcatcagagcgtcaatcagactttcgacgtgcgccagttcgtctt

SEQ ID NO: 166886 - DNA, 75 bp, Artificial Sequence
  Synthetic
aacccgtttgtcgtaacaatcagcgttatacacgctgtatcggcatcgttttaccggaaagtttatcgtaatgta

SEQ ID NO: 166887 - DNA, 75 bp, Artificial Sequence
  Synthetic
gtggacggcgatggcaaggtgctgcacctcaacaagggctggctctgcgctaccattatgcagcacggcgaggct

SEQ ID NO: 166888 - DNA, 75 bp, Artificial Sequence
  Synthetic
tttgtacgcggcggtatcgtctttaacaaatccgtctcctcggtggtgggctccagcggacccaatgagagcgcg

SEQ ID NO: 166889 - DNA, 75 bp, Artificial Sequence
  Synthetic
cactgtttccgttagaatcccccccgacttttttccaagtagaatgtacgtcagggctccacgttacagttccat

SEQ ID NO: 166890 - DNA, 75 bp, Artificial Sequence
  Synthetic
tactgatcatcatccccgaggccaaaaagggcgaattgcaagctgtagtgttacaaaaaatagtcaagttagtgt

SEQ ID NO: 166891 - DNA, 75 bp, Artificial Sequence
  Synthetic
ggcgggactcgcgacggcccttctgcggaggaacagcaacggcgaaggcaggaacagcgtcacgaagaacggcgc

SEQ ID NO: 166892 - DNA, 75 bp, Artificial Sequence
  Synthetic
gccccagctgaagaaagagcacgtgtactcagtggtctcctgcggcctgagtcccgagataagcagctcttgagc

SEQ ID NO: 166893 - DNA, 75 bp, Artificial Sequence
  Synthetic
acggactgctgcgggatccccggttgatgaaccggcagaaggagcggcggccgcctccctcctccgagaacgacg

SEQ ID NO: 166894 - DNA, 75 bp, Artificial Sequence
  Synthetic
gatgaaccggcagaaggagcggcggccgcctccctcctccgagaacgacggtgagtcccggccctcctcgcgtca

SEQ ID NO: 166895 - DNA, 75 bp, Artificial Sequence
  Synthetic
tgctcagtcccgaaaacgccgtcaccgccatttcctatcactcgatcctggccgatttcaactcatacaaggccc

SEQ ID NO: 166896 - DNA, 75 bp, Artificial Sequence
  Synthetic
gttgtgtggatgataaccatgtgctttttcgtgcgctatgtgtcgtcccgtctgtaggctctcctcccctccggg

SEQ ID NO: 166897 - DNA, 75 bp, Artificial Sequence
  Synthetic
ttttcgtgcgctatgtgtcgtcccgtctgtaggctctcctcccctccgggaggcgaagagacaaaagaccaccgc

SEQ ID NO: 166898 - DNA, 75 bp, Artificial Sequence
  Synthetic
cggcggcagcggccgcatgtcgctgccgctggacacgtctgaagcggtggcctttctcaattactcgtcctcatc

SEQ ID NO: 166899 - DNA, 75 bp, Artificial Sequence
  Synthetic
ctccgcggtctcttcttcctccaacaaccaccaccaccatcatcaccaccataacgccgtgacggacgtggccgc

SEQ ID NO: 166900 - DNA, 75 bp, Artificial Sequence
  Synthetic
gtcacttctttcgctccctcgacccagcagcgcccacagcgcgggcgagacggtgcaggagtccgaggcggcggc

SEQ ID NO: 166901 - DNA, 75 bp, Artificial Sequence
  Synthetic
agcagcgcccacagcgcgggcgagacggtgcaggagtccgaggcggcggcgacggcggcggctgcggggttaatg

SEQ ID NO: 166902 - DNA, 75 bp, Artificial Sequence
  Synthetic
accactccagtctctaactgccgtgttcctccgaattcgcaggaatccgcggcgcctcagcctcctcgcagtccg

SEQ ID NO: 166903 - DNA, 75 bp, Artificial Sequence
  Synthetic
ttcctccgaattcgcaggaatccgcggcgcctcagcctcctcgcagtccgcgttttgatgacattatacagtcat

SEQ ID NO: 166904 - DNA, 75 bp, Artificial Sequence
  Synthetic
agacgtcgggcgggactgtcgtcgtcaaccacagcagcgtcgcgaggaccgccgcagctgtctccacagccggcg

SEQ ID NO: 166905 - DNA, 75 bp, Artificial Sequence
  Synthetic
caaccacagcagcgtcgcgaggaccgccgcagctgtctccacagccggcgttggccccccagcagccgcatgtcc

SEQ ID NO: 166906 - DNA, 75 bp, Artificial Sequence
  Synthetic
accagctgctcctccccggcccgtgtgtgaaatcaagccctacgtggtaaaccccgttgtcgccaccgccgcggc

SEQ ID NO: 166907 - DNA, 75 bp, Artificial Sequence
  Synthetic
tgtgaaatcaagccctacgtggtaaaccccgttgtcgccaccgccgcggctgccagtaactcttcctcgtcttct

SEQ ID NO: 166908 - DNA, 75 bp, Artificial Sequence
  Synthetic
aggaggacaacgaccctctgctccggttgtcgcaagtcgccggcagcggccgccggcgagggccctcgttcctcg

SEQ ID NO: 166909 - DNA, 75 bp, Artificial Sequence
  Synthetic
gttgtcgcaagtcgccggcagcggccgccggcgagggccctcgttcctcgaggacggactcgaaattatcgatcc

SEQ ID NO: 166910 - DNA, 75 bp, Artificial Sequence
  Synthetic
gccctgcgcctgctggcctgtcccgaccgacctattatcggtgacaccggcggcagcagtagctcccaacgcctc

SEQ ID NO: 166911 - DNA, 75 bp, Artificial Sequence
  Synthetic
cgattttttttacaataaagagatagacatcacagttcaccaccttgtctccccggtgtgtctattatcatcaat

SEQ ID NO: 166912 - DNA, 75 bp, Artificial Sequence
  Synthetic
tctcttggtaatgcgtgtccagatacgcgttggccagtataaaatggtcgttgcccacgaaggcgcgggtggtgt

SEQ ID NO: 166913 - DNA, 75 bp, Artificial Sequence
  Synthetic
tgcgcggcgacgggtggcaggatttgagtaccaagtgccgccgtcggtcgatcaggtactcgcaggtgtgcgcgt

SEQ ID NO: 166914 - DNA, 75 bp, Artificial Sequence
  Synthetic
atgctcccggcgctctgacagcctccggatcacatggttactcagcgtctgccagcctaagtgacggtgagatcc

SEQ ID NO: 166915 - DNA, 75 bp, Artificial Sequence
  Synthetic
cggatcacatggttactcagcgtctgccagcctaagtgacggtgagatccaggctgtccgtgcaccacggtgaac

SEQ ID NO: 166916 - DNA, 75 bp, Artificial Sequence
  Synthetic
accgtacgcgccagttcgcgaaacacgttgttgagggagggcggcggcggtcggcccgccagcgtgccgaaggcc

SEQ ID NO: 166917 - DNA, 75 bp, Artificial Sequence
  Synthetic
aggccgctggcgctgccgtcgcagtacgggtcctggcccacgatcaccacgcgcacctgctcgggcggacacaga

SEQ ID NO: 166918 - DNA, 75 bp, Artificial Sequence
  Synthetic
gtgtcgcgcagcagcaccgtgtcgtggtcgggcaagctgaggaagcggatccagtcggcgctcagacaaaacacg

SEQ ID NO: 166919 - DNA, 75 bp, Artificial Sequence
  Synthetic
ggtcgggcaagctgaggaagcggatccagtcggcgctcagacaaaacacgcgagcctgctcgtcgggggttaaca

SEQ ID NO: 166920 - DNA, 75 bp, Artificial Sequence
  Synthetic
acgcgcgtctgcttcagctcgggcggcagtccggcgtagtatttatctaggtggcgtagcagcggcgggtccagc

SEQ ID NO: 166921 - DNA, 75 bp, Artificial Sequence
  Synthetic
gcagtccggcgtagtatttatctaggtggcgtagcagcggcgggtccagctggtgacgcaggcagaattccttca

SEQ ID NO: 166922 - DNA, 75 bp, Artificial Sequence
  Synthetic
agaaaacgccgggaaatataccagacgggaccgttataacggttacgaagaaaattactacgtaacggtattatc

SEQ ID NO: 166923 - DNA, 75 bp, Artificial Sequence
  Synthetic
ggtgcacggacaaaaggccgtgtgcgaactcatcctcacgccggtaacgatggacgttaattacttcaaaatcac

SEQ ID NO: 166924 - DNA, 75 bp, Artificial Sequence
  Synthetic
ggttggtacgcgtggcttcgttgcgtatggccaccaccacgttaaagagagacggtggcaccagctcgaagccta

SEQ ID NO: 166925 - DNA, 75 bp, Artificial Sequence
  Synthetic
ttgacagccggcgacgtcgagagggtaactatgtaccgtgcgggggtgacgctgttagtggtggcggtggtaagt

SEQ ID NO: 166926 - DNA, 75 bp, Artificial Sequence
  Synthetic
gtatgagcctgaagtaagcatggcttacatttatcaatacaatgacactaacttgactattttttgtaacactac

SEQ ID NO: 166927 - DNA, 75 bp, Artificial Sequence
  Synthetic
ccgagctcaacagcgtcagcagggcccgcaattgatccggattgttgtacagcagggccagagtgtccaggaaag

SEQ ID NO: 166928 - DNA, 75 bp, Artificial Sequence
  Synthetic
acttgactattttttgtaacactacagcttgcaattcgccctttttggcctcagggatgatgataagtgccccgt

SEQ ID NO: 166929 - DNA, 75 bp, Artificial Sequence
  Synthetic
agcttgcaattcgccctttttggcctcagggatgatgataagtgccccgttgaaaacacgctttctcaccagcaa

SEQ ID NO: 166930 - DNA, 75 bp, Artificial Sequence
  Synthetic
tgagcttcatctacggcctcaagatcgtgcttatccgcgacacattaacggtgctttatcgctcaccgtcaaatt

SEQ ID NO: 166931 - DNA, 75 bp, Artificial Sequence
  Synthetic
cgtgcttatccgcgacacattaacggtgctttatcgctcaccgtcaaattgctacacggacggcgacctgctgcg

SEQ ID NO: 166932 - DNA, 75 bp, Artificial Sequence
  Synthetic
accgggaacttatgtgaatagcagcgtcacctgctggggctctaacgggacttttggcgccaagactttcttagt

SEQ ID NO: 166933 - DNA, 75 bp, Artificial Sequence
  Synthetic
aaacaatgggcagcagaaggcaacaccacagcagtatcaccggtccaggtgagaaagagaagccgcaatccgggc

SEQ ID NO: 166934 - DNA, 75 bp, Artificial Sequence
  Synthetic
ccacagcagtatcaccggtccaggtgagaaagagaagccgcaatccgggcggcggcacatcaagtctgcggcacg

SEQ ID NO: 166935 - DNA, 75 bp, Artificial Sequence
  Synthetic
gtatccaaactacgccggggccctaggccgcacggcacactggctttttcataaataaaaaaaaacgtttctatc

SEQ ID NO: 166936 - DNA, 75 bp, Artificial Sequence
  Synthetic
ggccgcacggcacactggctttttcataaataaaaaaaaacgtttctatcacctagtctgtcgtactgtcctttg

SEQ ID NO: 166937 - DNA, 75 bp, Artificial Sequence
  Synthetic
attgcatccagcaggtgagccaggctaaacggattcacgtaccaggtttggttacccgcgacgatgacggccaga

SEQ ID NO: 166938 - DNA, 75 bp, Artificial Sequence
  Synthetic
acatgctataagacagccttacagcttttgagtctagacaggggaacagccttcccttgtaagacagaatgaatc

SEQ ID NO: 166939 - DNA, 75 bp, Artificial Sequence
  Synthetic
gttacccgcgacgatgacggccagaccgtgggcgctacagttggagaggttcctgggtacgaaggtaactgagtc

SEQ ID NO: 166940 - DNA, 75 bp, Artificial Sequence
  Synthetic
acatatagctcgtccacacgccgtctcgtcacacggcaacatgtgttccgtactggcgatcgcgctcgtagttgc

SEQ ID NO: 166941 - DNA, 75 bp, Artificial Sequence
  Synthetic
cttcccttgtaagacagaatgaatcttataatgcttattctagccctctgggccccggtcgcgggtagtatgcct

SEQ ID NO: 166942 - DNA, 75 bp, Artificial Sequence
  Synthetic
accgttaccgcctctgcccgatgtttcggagtaccgagtagagtattccgaggcgcgctgcgtgctccgatcggg

SEQ ID NO: 166943 - DNA, 75 bp, Artificial Sequence
  Synthetic
tcggagtaccgagtagagtattccgaggcgcgctgcgtgctccgatcgggcggtcgactggaggctctgtggacc

SEQ ID NO: 166944 - DNA, 75 bp, Artificial Sequence
  Synthetic
attcctcttcgtacaggatgattgacaggttatggctacacaggtcctgggcgggaggacgcgtgggagcgcggg

SEQ ID NO: 166945 - DNA, 75 bp, Artificial Sequence
  Synthetic
gtgccgaccccggtggaggacatctccgaaagcctcgtcgcaaaacgctactggctccgggactatcgtgttccc

SEQ ID NO: 166946 - DNA, 75 bp, Artificial Sequence
  Synthetic
ccgaaagcctcgtcgcaaaacgctactggctccgggactatcgtgttccccaacgcacaaaactcgtgttgttct

SEQ ID NO: 166947 - DNA, 75 bp, Artificial Sequence
  Synthetic
gccacctgcaaagttatcctgttgaataacaccaaaaatccagacattttatcagttacttgttatgcacggaca

SEQ ID NO: 166948 - DNA, 75 bp, Artificial Sequence
  Synthetic
tggggtatcttagcgccttcccccccgataatgaaggtaagtagcacctacctttctgttcaaccccttttcctc

SEQ ID NO: 166949 - DNA, 75 bp, Artificial Sequence
  Synthetic
tgtggagctcgttagaggacatcgaacgactattgttcgaagatcgccgtctaatggcgtactacgcgctcacga

SEQ ID NO: 166950 - DNA, 75 bp, Artificial Sequence
  Synthetic
acgactattgttcgaagatcgccgtctaatggcgtactacgcgctcacgattaagtcggcgcagtatacgctgat

SEQ ID NO: 166951 - DNA, 75 bp, Artificial Sequence
  Synthetic
gttgaagtgacgttaggggaggtagtagtggtaccggtggtggcgacggtagtgtttgtcgtggcggcggcagcg

SEQ ID NO: 166952 - DNA, 75 bp, Artificial Sequence
  Synthetic
ttcggaccagtggtgatatatagactgaagcggggtgcatctcgagtcgctcggaaacgactcaccagacttttt

SEQ ID NO: 166953 - DNA, 75 bp, Artificial Sequence
  Synthetic
tcggaaacgactcaccagactttttgctttaacccgaaaccatgctacgccggggaagcctccggaaccctctcg

SEQ ID NO: 166954 - DNA, 75 bp, Artificial Sequence
  Synthetic
tggtttccaccgcttcacacagtaagcaagagcacagggccaggaaaagcaaccagccccgccatcgccgccgcc

SEQ ID NO: 166955 - DNA, 75 bp, Artificial Sequence
  Synthetic
gcaagagcacagggccaggaaaagcaaccagccccgccatcgccgccgccgcttcatgaggtgggcaggcgaaag

SEQ ID NO: 166956 - DNA, 75 bp, Artificial Sequence
  Synthetic
gcggctgtgttattcaaaatcatgtactgaaaggtgcggtgaaactctatggacaattcccctcgcctaagactt

SEQ ID NO: 166957 - DNA, 75 bp, Artificial Sequence
  Synthetic
aatacgtctggctgcttttctacgatggaagcgcacagggtcacggcgtcaaacaggtctttcttggtggcgccc

SEQ ID NO: 166958 - DNA, 75 bp, Artificial Sequence
  Synthetic
ggacaattcccctcgcctaagactttgcgggccttggcttggctacacgacggtgaaaatcacgaaaggcaccgg

SEQ ID NO: 166959 - DNA, 75 bp, Artificial Sequence
  Synthetic
caccaccggacggatgcagtccagaacgcggttgggatcctggtgaaagaatttgaacgtggctacggcctgtgg

SEQ ID NO: 166960 - DNA, 75 bp, Artificial Sequence
  Synthetic
ccggaaggaaaccgaccccgaaactattctgttaccctaacactcgcctcccgggattgttatgaacgcttcgtg

SEQ ID NO: 166961 - DNA, 75 bp, Artificial Sequence
  Synthetic
atttgaacgtggctacggcctgtggcgtgtgcggcatcgtctgcgtgatgagctgctggcccgctaacacggtga

SEQ ID NO: 166962 - DNA, 75 bp, Artificial Sequence
  Synthetic
ccgggattgttatgaacgcttcgtgtgcccggtatacgattccgggacgccgatgggcgttttgatgaacttgac

SEQ ID NO: 166963 - DNA, 75 bp, Artificial Sequence
  Synthetic
ggtcaatgagcgccatctggtgtcggcataagaacaggcatcaaccccgtggccggcgaggcggtgagcactttt

SEQ ID NO: 166964 - DNA, 75 bp, Artificial Sequence
  Synthetic
cgttgtgcaacttgagcagggcactcttgagggcctggaaagcgttgccgcacgaggcgctgatctgcagctgca

SEQ ID NO: 166965 - DNA, 75 bp, Artificial Sequence
  Synthetic
caagcaacacccccgtccccagcgcaacccccgtccccggtgccaccaccgttcccagcgcaaaagccccccgtc

SEQ ID NO: 166966 - DNA, 75 bp, Artificial Sequence
  Synthetic
aacccccgtccccggtgccaccaccgttcccagcgcaaaagccccccgtcctgggcccgcaaaaggccgccgtct

SEQ ID NO: 166967 - DNA, 75 bp, Artificial Sequence
  Synthetic
cacccgatccctcctcctgatatgtggttattatccacctcgcgaataaaatgatttgttatgatgtcattgttt

SEQ ID NO: 166968 - DNA, 75 bp, Artificial Sequence
  Synthetic
gcgcgtaccgacagtcggccggcaaaatgtaggtggcgttaccgccgttggtggccacggcgggcgcagcggccg

SEQ ID NO: 166969 - DNA, 75 bp, Artificial Sequence
  Synthetic
gtcccttagcgcggtcccgcacacccccgtcccagcgcaacccccgtccccgcaacccccgtctccaacggaatc

SEQ ID NO: 166970 - DNA, 75 bp, Artificial Sequence
  Synthetic
actgaaaaggaatgtgctttcccggcatgggcccgattccgagaaatggtatgatgaatcatgtggtcaggcgct

SEQ ID NO: 166971 - DNA, 75 bp, Artificial Sequence
  Synthetic
cccgcgggcatcccgcacgcccacaaacccccgcgacggcccgaaaagcggagcgccgcgcagaagctgcgcaca

SEQ ID NO: 166972 - DNA, 75 bp, Artificial Sequence
  Synthetic
cggccggtggtggctggtaaggtcgatcatgggcggcgtggtgaccgtggcggtggcgggcgtgacggggtttgc

SEQ ID NO: 166973 - DNA, 75 bp, Artificial Sequence
  Synthetic
cacgacgactgctcctgtggaatggaagtctcccgatcgtcggattccaagcaatattacttgcgctaattactc

SEQ ID NO: 166974 - DNA, 75 bp, Artificial Sequence
  Synthetic
gtttcggtgaccataaccacgtcggggctgacgcggatcggacatcacactgacgtgaggcgctctgtcacctct

SEQ ID NO: 166975 - DNA, 75 bp, Artificial Sequence
  Synthetic
gacaccgtgcacacacccggtgaaacatccctgtccccgaaacaccccggccccagcgccggcccgcaacactcc

SEQ ID NO: 166976 - DNA, 75 bp, Artificial Sequence
  Synthetic
cccgtgccgtactggcgaaacgcagaaagtggccgccgtcccgcgagcaaataccgcgggacggcacgcaccggc

SEQ ID NO: 166977 - DNA, 75 bp, Artificial Sequence
  Synthetic
ggctgacgcggatcggacatcacactgacgtgaggcgctctgtcacctctcgggccgaaccccgtcagcaccccg

SEQ ID NO: 166978 - DNA, 75 bp, Artificial Sequence
  Synthetic
tcctccgccacccatgacgccgccgggcagagcgtcgcccagacagacttccacagtggcgggcgcgctctcggc

SEQ ID NO: 166979 - DNA, 75 bp, Artificial Sequence
  Synthetic
ccacagtggcgggcgcgctctcggcggtcagtacggtttgccgatcgacctcgcgacgaaagctggtgaggaact

SEQ ID NO: 166980 - DNA, 75 bp, Artificial Sequence
  Synthetic
taaagaggcacggtgtttcgactcccgcacacagacgacgcgccgggcggcttcctgcggccggccgcggtgccg

SEQ ID NO: 166981 - DNA, 75 bp, Artificial Sequence
  Synthetic
aatctcccgcagtccgggcccgctaactagtaccgtgggacgacacgcagcggtagtgcgcacaaaggcagccgc

SEQ ID NO: 166982 - DNA, 75 bp, Artificial Sequence
  Synthetic
cgcacacagacgacgcgccgggcggcttcctgcggccggccgcggtgccggcggctatgatcctgtggtctccgt

SEQ ID NO: 166983 - DNA, 75 bp, Artificial Sequence
  Synthetic
tgaccgagtgcgggccgagttatatggaagacgattagcttggagcggagttttgcgtccctagctgacctgcgg

SEQ ID NO: 166984 - DNA, 75 bp, Artificial Sequence
  Synthetic
ggaagacgattagcttggagcggagttttgcgtccctagctgacctgcggatcagcgacgtgccatagggataga

SEQ ID NO: 166985 - DNA, 75 bp, Artificial Sequence
  Synthetic
gtggtggcggggtgtgtcaggggtgtgcgcggctggatggaagcagtgtgccccggggcccgcgagccccccccc

SEQ ID NO: 166986 - DNA, 75 bp, Artificial Sequence
  Synthetic
ggttgtcgtggtccagcgacgagtcgtctgcgtcctcgtcgtctcgtatctgtccgttgtcagatagcaagtccg

SEQ ID NO: 166987 - DNA, 75 bp, Artificial Sequence
  Synthetic
gtctgcgtcctcgtcgtctcgtatctgtccgttgtcagatagcaagtccgtccgtctgccccagtaccctcgcgg

SEQ ID NO: 166988 - DNA, 75 bp, Artificial Sequence
  Synthetic
tggtgggtacgatcttgacgtggttgacgtcctgcccgtccgggggaatacgcaaaaaaccccgccgcggcgcta

SEQ ID NO: 166989 - DNA, 75 bp, Artificial Sequence
  Synthetic
gacgtcctgcccgtccgggggaatacgcaaaaaaccccgccgcggcgctaccacgatggtgcgatgggtctttct

SEQ ID NO: 166990 - DNA, 75 bp, Artificial Sequence
  Synthetic
cgcctggcttgtgcgcggcaacttctccgatacggccccgagagcctacggcacctggggtaacgagcggagcgc

SEQ ID NO: 166991 - DNA, 75 bp, Artificial Sequence
  Synthetic
tccgatacggccccgagagcctacggcacctggggtaacgagcggagcgcgacccatttcaaggtcggcgcaccc

SEQ ID NO: 166992 - DNA, 75 bp, Artificial Sequence
  Synthetic
acgcgcgcgtctgcttctcgccgtgcgcgccgcacgtcgcttttattcgccgtcgccgtcctccgcgaccgccgt

SEQ ID NO: 166993 - DNA, 75 bp, Artificial Sequence
  Synthetic
ttaaccgtttacccctgcagtgcctgtaaccggagcgtgctccattgccggccggcgtccaggctgccctggttg

SEQ ID NO: 166994 - DNA, 75 bp, Artificial Sequence
  Synthetic
tgcttgaagtagggcaccgggtgtttcttttcctcaacgggctcctccagtctcttataggaccagtcccgccgg

SEQ ID NO: 166995 - DNA, 75 bp, Artificial Sequence
  Synthetic
cgcgccagcatgtaggtcacgtataaaagaataattaccatgaacaccaggaaagccagcacgccgtaggccagc

SEQ ID NO: 166996 - DNA, 75 bp, Artificial Sequence
  Synthetic
ctggtgcagtttgtgaaacacgtagccttgttcagcttcggtgtccaggtagcctgctgtgtgtacctgaggtgg

SEQ ID NO: 166997 - DNA, 75 bp, Artificial Sequence
  Synthetic
tcttgataaacacgtaggtggtggtaaaacttcggcccgcgatctgaacgtggagacgcacgacagtatacgtgc

SEQ ID NO: 166998 - DNA, 75 bp, Artificial Sequence
  Synthetic
aaaacttcggcccgcgatctgaacgtggagacgcacgacagtatacgtgccgttgaggtagaagacaaactcgcg

SEQ ID NO: 166999 - DNA, 75 bp, Artificial Sequence
  Synthetic
gctaaagacgattgactggcgaagccgccatgaggcggtggctgcgcctcctcgtcggcctgggctgctgttggg

SEQ ID NO: 167000 - DNA, 75 bp, Artificial Sequence
  Synthetic
cgccatgaggcggtggctgcgcctcctcgtcggcctgggctgctgttgggtaacgctggctcacgccggcaaccc

SEQ ID NO: 167001 - DNA, 75 bp, Artificial Sequence
  Synthetic
ggtgctgttggggtgatagaggctgctaccgttgagcaagcagtgttcgtgttcctgaagcagcacgcggacccg

SEQ ID NO: 167002 - DNA, 75 bp, Artificial Sequence
  Synthetic
ttttgattgtttgtgcttccgaaggctccacaagccggcctgttacttatagcgggctacccaattgtaacacgg

SEQ ID NO: 167003 - DNA, 75 bp, Artificial Sequence
  Synthetic
ggcacgtcagtttcgctttccgccgcttaacaacgtgtccagctatcaggccagctgcgtcgtcaaggacggcgt

SEQ ID NO: 167004 - DNA, 75 bp, Artificial Sequence
  Synthetic
cttaacaacgtgtccagctatcaggccagctgcgtcgtcaaggacggcgtgttggacgctgtgtggcgtgtacag

SEQ ID NO: 167005 - DNA, 75 bp, Artificial Sequence
  Synthetic
ccgtacacggcgtagatgggataggtgaaaaggtcccaagtggcgttgtgatggcggccccagctgaagaaagag

SEQ ID NO: 167006 - DNA, 75 bp, Artificial Sequence
  Synthetic
ccactactacctcccctaacgtcacttcaaccacgagtaacaccgtcaccactcccaccacggtttcctcggtca

SEQ ID NO: 167007 - DNA, 75 bp, Artificial Sequence
  Synthetic
cagcggggactggtgcgaatgctgcgagtgcggcgacgccgggccacggcgtccaccgggtagaaccccgcgggc

SEQ ID NO: 167008 - DNA, 75 bp, Artificial Sequence
  Synthetic
gtccaccgggtagaaccccgcgggccgccgggcgcccctccgggtagcggcaacaacagcaacttttggcacggc

SEQ ID NO: 167009 - DNA, 75 bp, Artificial Sequence
  Synthetic
ctgcaagccccggagtgcctcgtggagaccaccgaagccgtattccgtttgcgccagtgggtgcccacggacttg

SEQ ID NO: 167010 - DNA, 75 bp, Artificial Sequence
  Synthetic
gcctgagtcccgagataagcagctcttgagcagtagcgttgtaggagagatgtagttttcctgtggataaaattc

SEQ ID NO: 167011 - DNA, 75 bp, Artificial Sequence
  Synthetic
cgtgctccaaatgcaaacccatgtggtgccagcctcggtaccatatacgttatttcagctacgggaattcagtgg

SEQ ID NO: 167012 - DNA, 75 bp, Artificial Sequence
  Synthetic
tgctgctgttgggatacgtgctggccaggactgtgtaccgtgtatccagcgctcactatctgcggtggcacgcct

SEQ ID NO: 167013 - DNA, 75 bp, Artificial Sequence
  Synthetic
caggactgtgtaccgtgtatccagcgctcactatctgcggtggcacgcctgtgtaccccaaaagtgtgaaaagtc

SEQ ID NO: 167014 - DNA, 75 bp, Artificial Sequence
  Synthetic
acgaagaggaatctcagagcagcgtagacattgcggtggatgaagaagagccagaactggaggacgacgacgagt

SEQ ID NO: 167015 - DNA, 75 bp, Artificial Sequence
  Synthetic
aaggccgtattcgtcatttgtgtggggaacgggtgtacaaaacggacgggaaaagctaactcgcgtttatatact

SEQ ID NO: 167016 - DNA, 75 bp, Artificial Sequence
  Synthetic
gctgacggcagaagtgacgttattagaggtacttattgacgtagtggacgtgacggtggtattaatgggggaagt

SEQ ID NO: 167017 - DNA, 75 bp, Artificial Sequence
  Synthetic
ggaacgggtgtacaaaacggacgggaaaagctaactcgcgtttatatacttatatccgccaggaacgataaccgt

SEQ ID NO: 167018 - DNA, 75 bp, Artificial Sequence
  Synthetic
tctatcgtcgccacacgtgtggaagacatggcgactttccgcacggaaaagcagtggcagcaggacctgcaatac

SEQ ID NO: 167019 - DNA, 75 bp, Artificial Sequence
  Synthetic
acatggcgactttccgcacggaaaagcagtggcagcaggacctgcaatacagaagggaatttgtaaaaaggcaat

SEQ ID NO: 167020 - DNA, 75 bp, Artificial Sequence
  Synthetic
ataaaagaggcgttaataatgaacactacaaaaaccacttgcgtcaatatgacgatcataaaggctcggtgatcg

SEQ ID NO: 167021 - DNA, 75 bp, Artificial Sequence
  Synthetic
gcgtttggcggtttgagggacaatttaatcctcacatcgcatcagaggtcatccttcatgataccagtggcttgt

SEQ ID NO: 167022 - DNA, 75 bp, Artificial Sequence
  Synthetic
taatcctcacatcgcatcagaggtcatccttcatgataccagtggcttgtataacgtgcctcatgaagtacaaaa

SEQ ID NO: 167023 - DNA, 75 bp, Artificial Sequence
  Synthetic
gccgtttcgttgaccatggattgtactatgaaagtcccggcgccaaaagttccattagagccccagcaagtaacg

SEQ ID NO: 167024 - DNA, 75 bp, Artificial Sequence
  Synthetic
acccgtgcaattgtcttctggacagtacgaatgtcgcccccaattacaactaccctgggttcctcgaccgtcctc

SEQ ID NO: 167025 - DNA, 75 bp, Artificial Sequence
  Synthetic
tacgaatgtcgcccccaattacaactaccctgggttcctcgaccgtcctcattcatgtacgacagctacaggctg

SEQ ID NO: 167026 - DNA, 75 bp, Artificial Sequence
  Synthetic
cggaaggacgatcatcatccctgaggccaaaaagggcgaatcataagctgtcgtgttacaaaaaatagtcaggtt

SEQ ID NO: 167027 - DNA, 75 bp, Artificial Sequence
  Synthetic
tcgtgttacaaaaaatagtcaggttagtatcgttgtgctcatagatataagccatttttacttgaggttcatacc

SEQ ID NO: 167028 - DNA, 75 bp, Artificial Sequence
  Synthetic
tgcattgtccgttttataggtaccaggctgttctatttcctgcagagaaatatcacaattcggtttaccggaaaa

SEQ ID NO: 167029 - DNA, 75 bp, Artificial Sequence
  Synthetic
ggctgttctatttcctgcagagaaatatcacaattcggtttaccggaaaacctacatataatcttttgacctatc

SEQ ID NO: 167030 - DNA, 75 bp, Artificial Sequence
  Synthetic
gcgtcacccccgcacggtacatagttaccctctcgacgtcgccggctgtcaatgacgtgcctgcgtcagtggcta

SEQ ID NO: 167031 - DNA, 75 bp, Artificial Sequence
  Synthetic
tgtgtgaatggaaatacatgatgaatgtcatcatcacgcaaagcagccgtgggaatggtaaagacatcgtcacac

SEQ ID NO: 167032 - DNA, 75 bp, Artificial Sequence
  Synthetic
tgtcatcatcacgcaaagcagccgtgggaatggtaaagacatcgtcacacctatcataaagaatgcaacgctttc

SEQ ID NO: 167033 - DNA, 75 bp, Artificial Sequence
  Synthetic
ttcatgccccgatgaacgctctcgtcaggcttgtcatggtctgtaaaagctgcatgaaaaacacgacgaaagcgt

SEQ ID NO: 167034 - DNA, 75 bp, Artificial Sequence
  Synthetic
caggcttgtcatggtctgtaaaagctgcatgaaaaacacgacgaaagcgttcagtgttggttcagactcacgtca

SEQ ID NO: 167035 - DNA, 75 bp, Artificial Sequence
  Synthetic
catcccgtatcagcagccgtagcgtggcattgatggtcagcggggtaaccaaagaaatcacatagggatgtgtac

SEQ ID NO: 167036 - DNA, 75 bp, Artificial Sequence
  Synthetic
actccttcactatggatctcttgattcgtctcggttttctgttgatgtgtgcgttgccgacccccggtgagcggt

SEQ ID NO: 167037 - DNA, 75 bp, Artificial Sequence
  Synthetic
tcgtctcggttttctgttgatgtgtgcgttgccgacccccggtgagcggtcttcgcgtgacccgaaaacccttct

SEQ ID NO: 167038 - DNA, 75 bp, Artificial Sequence
  Synthetic
cgtactgcgacggcagcgccagcggcctggccttcggcacgctggcgggccgaccgccgccgccctccctcaaca

SEQ ID NO: 167039 - DNA, 75 bp, Artificial Sequence
  Synthetic
ggactgcacagatgcagatgatagctggaaacagctgggtgaggactttgcgcaccaatgcttgcaggcggcgaa

SEQ ID NO: 167040 - DNA, 75 bp, Artificial Sequence
  Synthetic
tggaaacagctgggtgaggactttgcgcaccaatgcttgcaggcggcgaaaaagaggcctaaaacgcacaaatcc

SEQ ID NO: 167041 - DNA, 75 bp, Artificial Sequence
  Synthetic
acttttattaaacagcattctcaccacacgttaatactgtcacggggaatcactatgtacaagagtccatgtctc

SEQ ID NO: 167042 - DNA, 75 bp, Artificial Sequence
  Synthetic
tctttccagtttttcacttactgagacttgttcctcaggtcctggatggctgcctcgatggccaggctcagggtg

SEQ ID NO: 167043 - DNA, 75 bp, Artificial Sequence
  Synthetic
attcatcctagccaccggttgttaacgcttatgaataactgcgtctgtgacggggccgtttggaacgcgtttcgc

SEQ ID NO: 167044 - DNA, 75 bp, Artificial Sequence
  Synthetic
cggggccgtttggaacgcgtttcgcttgatagaacgacacggattcttcgctgtgactttgtatttatgttgcgg

SEQ ID NO: 167045 - DNA, 75 bp, Artificial Sequence
  Synthetic
tgggctgctcaaactgccccacggcgtaggccttcgcggccgtctcgtagataggcagcatgaacccaccctggt

SEQ ID NO: 167046 - DNA, 75 bp, Artificial Sequence
  Synthetic
ttgcggctcctgatgctgtttaatcgtctcaataaaagcgcgttccttcaacacggcattctctacgaacggtat

SEQ ID NO: 167047 - DNA, 75 bp, Artificial Sequence
  Synthetic
gatgatcatgttgcggtaatcggaggaacgggggcataattggtgggtgtgcaattctttgaggctccacgcggc

SEQ ID NO: 167048 - DNA, 75 bp, Artificial Sequence
  Synthetic
ttttttctgtcgcgatagtcggcgatatgtcgcgatagacaactccggtcgctaactgataacgatatgtcgcga

SEQ ID NO: 167049 - DNA, 75 bp, Artificial Sequence
  Synthetic
tgtacgcatgtcgcgacagagaggtgtagcgggctgtcacatcaactctatcgcgacagacatccccctgcacgt

SEQ ID NO: 167050 - DNA, 75 bp, Artificial Sequence
  Synthetic
gtagcgggctgtcacatcaactctatcgcgacagacatccccctgcacgtccatgtcgcgacacgaccactaatc

SEQ ID NO: 167051 - DNA, 75 bp, Artificial Sequence
  Synthetic
ggcgactgacgtgactcttgacgtttataaaccgcatgggaaagtacggtgtcgccaccgttgacgtgggcggcg

SEQ ID NO: 167052 - DNA, 75 bp, Artificial Sequence
  Synthetic
tataaaccgcatgggaaagtacggtgtcgccaccgttgacgtgggcggcgatgaaaacgtcagcggtggcgaaac

SEQ ID NO: 167053 - DNA, 75 bp, Artificial Sequence
  Synthetic
gaacatgcggctcacctcgtcaatcttgacgcgaccccgccgagtctgcacgttgggtgtgcagaagggggtgtt

SEQ ID NO: 167054 - DNA, 75 bp, Artificial Sequence
  Synthetic
cggtttggaaatcccagtacggaaagtaccgtaacgcctcttttggcacgtagttgcctactacgtaggggaaac

SEQ ID NO: 167055 - DNA, 75 bp, Artificial Sequence
  Synthetic
gtaccgtaacgcctcttttggcacgtagttgcctactacgtaggggaaacaacgtcaccaagaaacgctatatat

SEQ ID NO: 167056 - DNA, 75 bp, Artificial Sequence
  Synthetic
aaattaatcgcattataattttattatctacgtcactatcagtaattcgtaatatccggtattcccggaaaatca

SEQ ID NO: 167057 - DNA, 75 bp, Artificial Sequence
  Synthetic
cccatggtggctcgaggtcacggatgctcctccgccactgctgcatttcatctcctcggactcactctccgagtc

SEQ ID NO: 167058 - DNA, 75 bp, Artificial Sequence
  Synthetic
gctcctccgccactgctgcatttcatctcctcggactcactctccgagtccgaagccgaactgcaggaggaggaa

SEQ ID NO: 167059 - DNA, 75 bp, Artificial Sequence
  Synthetic
ccgagcagcggaccttcggagccatgaagccggtgttggtgctcgcgatcctggccgtcttgttcctgagactcg

SEQ ID NO: 167060 - DNA, 75 bp, Artificial Sequence
  Synthetic
ctggccgtcttgttcctgagactcgcggactcggtgccccggcccctggatgtggtggtatcggagatcagatcg

SEQ ID NO: 167061 - DNA, 75 bp, Artificial Sequence
  Synthetic
tgcgtgggagaggtcactcgcggcgtgccgctgccggtggaaggggaagacgcggtagcaccgcgggtttcgact

SEQ ID NO: 167062 - DNA, 75 bp, Artificial Sequence
  Synthetic
cgcggtagcaccgcgggtttcgacttcttcaccctgttcttcctcgctatcagagatcacgatacagccggcggt

SEQ ID NO: 167063 - DNA, 75 bp, Artificial Sequence
  Synthetic
aacttcaccgagaaacactttgtgagcgtgggtatcgtctctcaatcttacatggacagactgcaggtgtccggt

SEQ ID NO: 167064 - DNA, 75 bp, Artificial Sequence
  Synthetic
gcgtgggtatcgtctctcaatcttacatggacagactgcaggtgtccggtgagcagtaccaccatgatgagcgcg

SEQ ID NO: 167065 - DNA, 75 bp, Artificial Sequence
  Synthetic
catgataggcgcgggaggcacgggcggtttaataatcaccttgaaaggacgcgtggttttgcgcggtttcttacg

SEQ ID NO: 167066 - DNA, 75 bp, Artificial Sequence
  Synthetic
ggtttaataatcaccttgaaaggacgcgtggttttgcgcggtttcttacgcgggctgagctcgggagtagcggat

SEQ ID NO: 167067 - DNA, 75 bp, Artificial Sequence
  Synthetic
cgaggtggggagaccccaagaaatatgccgcgtgtgttcctcaggtgaggatggactatagctctcagaccatca

SEQ ID NO: 167068 - DNA, 75 bp, Artificial Sequence
  Synthetic
tgccgcgtgtgttcctcaggtgaggatggactatagctctcagaccatcaactggtaccttcagcgaagcataag

SEQ ID NO: 167069 - DNA, 75 bp, Artificial Sequence
  Synthetic
caagagtgggttgtcagcgtggggccggtgctactggaatcgataccggcatgattgacagcctgggcgaggatg

SEQ ID NO: 167070 - DNA, 75 bp, Artificial Sequence
  Synthetic
cgtaggggtgagcgcccgtctgcgatttatttaacaggtacgaaccagctggtacctgaaacctacctgggctgc

SEQ ID NO: 167071 - DNA, 75 bp, Artificial Sequence
  Synthetic
tcacctgatggtgataagaagacacgggagacttagtacggtttcacaggcgtgacacgtttattgagtaggatt

SEQ ID NO: 167072 - DNA, 75 bp, Artificial Sequence
  Synthetic
tttatttaacaggtacgaaccagctggtacctgaaacctacctgggctgcaaggtacggactctaacacccaggc

SEQ ID NO: 167073 - DNA, 75 bp, Artificial Sequence
  Synthetic
tacaatagtttactggtcagccttgcttctagtcaccatagggtgggtgctcttgcctccagaggcggtgggttc

SEQ ID NO: 167074 - DNA, 75 bp, Artificial Sequence
  Synthetic
tgctcaatgccaccatgaactgacgacggcgtggtatccacgctcgttcaataatctcctgagacacttgaataa

SEQ ID NO: 167075 - DNA, 75 bp, Artificial Sequence
  Synthetic
acggcgtggtatccacgctcgttcaataatctcctgagacacttgaataaataaaccggtttattcgtaactcta

SEQ ID NO: 167076 - DNA, 75 bp, Artificial Sequence
  Synthetic
ggggcaacttcctctatctcagacactggctcagacttgacagacacagtgtcctcccgctcctcctgagcaccc

SEQ ID NO: 167077 - DNA, 75 bp, Artificial Sequence
  Synthetic
ttcaaagacggacacgtttccatatttttcatatgtttgattgtatgaagtattgaaaatctgctgtaacttatt

SEQ ID NO: 167078 - DNA, 75 bp, Artificial Sequence
  Synthetic
acaaccaaaacgtcaggaatctgggaggtggctgggctcacgtcactactctgggatataaattgggaaagagcg

SEQ ID NO: 167079 - DNA, 75 bp, Artificial Sequence
  Synthetic
cactttcttcctgatcactgttctcagccacaattactgaggacagagggatagtcgcgggtacaggggactctg

SEQ ID NO: 167080 - DNA, 75 bp, Artificial Sequence
  Synthetic
agccacaattactgaggacagagggatagtcgcgggtacaggggactctgggggtgacaccagagaatcagagga

SEQ ID NO: 167081 - DNA, 75 bp, Artificial Sequence
  Synthetic
aggtggctgggctcacgtcactactctgggatataaattgggaaagagcgtacagtccacacgctgtttcaccat

SEQ ID NO: 167082 - DNA, 75 bp, Artificial Sequence
  Synthetic
taaagccggggaagacgcgctccggccctggaagtccacggccaagcatccctggtttcaaatcgaggacaaccg

SEQ ID NO: 167083 - DNA, 75 bp, Artificial Sequence
  Synthetic
gtcatccacactaggagagcagactctcagaggatcggcccccagaatgtactgggcaaagaccttcatgcagat

SEQ ID NO: 167084 - DNA, 75 bp, Artificial Sequence
  Synthetic
ccctggaagtccacggccaagcatccctggtttcaaatcgaggacaaccggtgctacattgacaacggcaagttg

SEQ ID NO: 167085 - DNA, 75 bp, Artificial Sequence
  Synthetic
ccgagtccgcacgttcaagaaaagccaccaacctgtgggtctctaacgcagaattcggtcttccaaagtcggaga

SEQ ID NO: 167086 - DNA, 75 bp, Artificial Sequence
  Synthetic
gacagcgattacccaggtagagcacaatcacatagctgatggacgttggttgatccgttgattcccatggacatt

SEQ ID NO: 167087 - DNA, 75 bp, Artificial Sequence
  Synthetic
aaacttgtcggcgttttctccaaagtagctggcattgcgattggttccgttgtagaaaggagaaatgtcaaccac

SEQ ID NO: 167088 - DNA, 75 bp, Artificial Sequence
  Synthetic
gagaacctgtacgtacacgcggacgacgtggagttcgttcccggggagtcgttaaagtggaacgtgcggaactta

SEQ ID NO: 167089 - DNA, 75 bp, Artificial Sequence
  Synthetic
acgtggagttcgttcccggggagtcgttaaagtggaacgtgcggaacttagatgtgatgccgatcttcgagacgc

SEQ ID NO: 167090 - DNA, 75 bp, Artificial Sequence
  Synthetic
atgtagtgaggatatccataaatatgtgatcaatgtgcgtgagcaccttgtctctctcctcatccaaaatcttaa

SEQ ID NO: 167091 - DNA, 75 bp, Artificial Sequence
  Synthetic
ctagcgcgtacatgtggaacatgcagtacgggatggtgcggaagtcatacacgcatgtggcctggacaatagtgt

SEQ ID NO: 167092 - DNA, 75 bp, Artificial Sequence
  Synthetic
gtacgggatggtgcggaagtcatacacgcatgtggcctggacaatagtgttttactccataaacattaccctgtt

SEQ ID NO: 167093 - DNA, 75 bp, Artificial Sequence
  Synthetic
cgcccgggatcgcggtttatttcaataaatctagccacgagtacccattacgtgtgtcctgtcggtttcgtttat

SEQ ID NO: 167094 - DNA, 75 bp, Artificial Sequence
  Synthetic
taaatctagccacgagtacccattacgtgtgtcctgtcggtttcgtttattggaaaaaggttgggagatgcgggg

SEQ ID NO: 167095 - DNA, 75 bp, Artificial Sequence
  Synthetic
ggggcatgcggccttagcggctcgggctggcgtgctgttttccgtgttgccgacggcggcgcggtccgccgagac

SEQ ID NO: 167096 - DNA, 75 bp, Artificial Sequence
  Synthetic
gctggcgtgctgttttccgtgttgccgacggcggcgcggtccgccgagaccggcggaccgcggagcggaggaggt

SEQ ID NO: 167097 - DNA, 75 bp, Artificial Sequence
  Synthetic
attaaaggcgccagtgaatttctcttccgtctgggtatattttttcagcatgtgctccttgattctatgccgcac

SEQ ID NO: 167098 - DNA, 75 bp, Artificial Sequence
  Synthetic
gtccagccttcccatgcgggaactggcctggcggcgggtagccgacgactcgcacgacctatggtgttgctgtat

SEQ ID NO: 167099 - DNA, 75 bp, Artificial Sequence
  Synthetic
gcctggcggcgggtagccgacgactcgcacgacctatggtgttgctgtatggactggaaggcgcacgttgagtac

SEQ ID NO: 167100 - DNA, 75 bp, Artificial Sequence
  Synthetic
gtgcacgctgctcacgacgtatggtgtaactgcggagactggcagggacacgcgctacgtagccggtcgcggacc

SEQ ID NO: 167101 - DNA, 75 bp, Artificial Sequence
  Synthetic
gtaactgcggagactggcagggacacgcgctacgtagccggtcgcggaccacggagtcggggagaagctcctcgt

SEQ ID NO: 167102 - DNA, 75 bp, Artificial Sequence
  Synthetic
cctccttcctcaacatagtctgcaggaacgtcgtggccttggtcacgggtgtctcgggcctaaacacatgagaaa

SEQ ID NO: 167103 - DNA, 75 bp, Artificial Sequence
  Synthetic
gaacgtcgtggccttggtcacgggtgtctcgggcctaaacacatgagaaatagagtcataagcacatgggtcaca

SEQ ID NO: 167104 - DNA, 75 bp, Artificial Sequence
  Synthetic
tcccatcttgggcgcgacgctggacgtagcgacacgactcggaagaacgggcttcgcaacaagcggagaacgaca

SEQ ID NO: 167105 - DNA, 75 bp, Artificial Sequence
  Synthetic
gtagcgacacgactcggaagaacgggcttcgcaacaagcggagaacgacagcacgtcctgacaacatatggactg

SEQ ID NO: 167106 - DNA, 75 bp, Artificial Sequence
  Synthetic
gcaccttggaggaagggccctcgtcaggattatcagggtccatctttctcttggcagaggactccatcgtgtcaa

SEQ ID NO: 167107 - DNA, 75 bp, Artificial Sequence
  Synthetic
tggcctgtggcccgaagatgtacacatatcgaggtacatgtctcgcatattttgtgagagatgggccgcggttct

SEQ ID NO: 167108 - DNA, 75 bp, Artificial Sequence
  Synthetic
ttggcagaggactccatcgtgtcaaggacggtgactgcagaaaagacccatggaaaggaacagtctgttagtctg

SEQ ID NO: 167109 - DNA, 75 bp, Artificial Sequence
  Synthetic
atatcgaggtacatgtctcgcatattttgtgagagatgggccgcggttctatccccgaatttgggcggtggcggc

SEQ ID NO: 167110 - DNA, 75 bp, Artificial Sequence
  Synthetic
cgttgctttggcggcagcggaggtgggccggggcccgttttgcataagcgcggaggtttgtctggcggcttatgt

SEQ ID NO: 167111 - DNA, 75 bp, Artificial Sequence
  Synthetic
cttaagtcttccatctgcgtcagcggtgcgagcccaatctccgagctcattttcagacacataccctaccgccac

SEQ ID NO: 167112 - DNA, 75 bp, Artificial Sequence
  Synthetic
tggaagctccgccgctaccggagaagagcccatgtccggaacacgtacccgagattcgcgtggagatcccacgct

SEQ ID NO: 167113 - DNA, 75 bp, Artificial Sequence
  Synthetic
cgttgtctccggctggagatcaagacgaaattcctcctctctaaaaaaaaaggtggtgggcttaattgatcatgg

SEQ ID NO: 167114 - DNA, 75 bp, Artificial Sequence
  Synthetic
taatggaaagtatcgtcaccaataggggagtggtcaataatggtcaataacccacacctataggctaagctatac

SEQ ID NO: 167115 - DNA, 75 bp, Artificial Sequence
  Synthetic
gggagtggtcaataatggtcaataacccacacctataggctaagctataccatcacctatagcataaggaagcgg

SEQ ID NO: 167116 - DNA, 75 bp, Artificial Sequence
  Synthetic
gggggtgggcctatagagtctataggcggtacttacgtcactcttggcacggggaatccgcgttccaatgcaccg

SEQ ID NO: 167117 - DNA, 75 bp, Artificial Sequence
  Synthetic
ggaaagtcccgttgattttggtgccaaaacaaactcccattgacgtcaatggggtggagacttggaaatccccgt

SEQ ID NO: 167118 - DNA, 75 bp, Artificial Sequence
  Synthetic
aaaacaaactcccattgacgtcaatggggtggagacttggaaatccccgtgagtcaaaccgctatccacgcccat

SEQ ID NO: 167119 - DNA, 75 bp, Artificial Sequence
  Synthetic
cccataaggtcatgtactgggcataatgccaggcgggccatttaccgtcattgacgtcaatagggggcgtacttg

SEQ ID NO: 167120 - DNA, 75 bp, Artificial Sequence
  Synthetic
caagtgggcagtttaccgtaaatactccacccattgacgtcaatggaaagtccctattggcgttactatgggaac

SEQ ID NO: 167121 - DNA, 75 bp, Artificial Sequence
  Synthetic
cgggggtcgttgggcggtcagccaggcgggccatttaccgtaagttatgtaacgcggaactccatatatgggcta

SEQ ID NO: 167122 - DNA, 75 bp, Artificial Sequence
  Synthetic
aacgcggaactccatatatgggctatgaactaatgaccccgtaattgattactattaataactagtcaataatca

SEQ ID NO: 167123 - DNA, 75 bp, Artificial Sequence
  Synthetic
ttggaaaaatggcgatatcagttacacagaaactcacatcggcgacattttcaatatgccatattttcaaatatc

SEQ ID NO: 167124 - DNA, 75 bp, Artificial Sequence
  Synthetic
gatttttccaatatcgccatctctatcggcgataaacaccactatcgcgcgacatgaatttagtcggcgacagaa

SEQ ID NO: 167125 - DNA, 75 bp, Artificial Sequence
  Synthetic
tcggcgataaacaccactatcgcgcgacatgaatttagtcggcgacagaaatctcaaaacgcgtatttcggacaa

SEQ ID NO: 167126 - DNA, 75 bp, Artificial Sequence
  Synthetic
cgctctccaggtactgatccaggcccacgatccgggttatcttgtcgtattccaggttgatccatcgatagggaa

SEQ ID NO: 167127 - DNA, 75 bp, Artificial Sequence
  Synthetic
cgctgccagcggcgcccagcaggtactgcgccttgtcgttcactttgccgcagcgtattcgcccgtcagcttcga

SEQ ID NO: 167128 - DNA, 75 bp, Artificial Sequence
  Synthetic
acttttttttaatgatgttttgtccctctctgtcttactctcccataggctgtaaggccctcgaggaagagactt

SEQ ID NO: 167129 - DNA, 75 bp, Artificial Sequence
  Synthetic
acggattgtagttgcagctcgtcagtttgttgtgtacgacctggcgtgtcagtgaatgggtcatggtggtgacga

SEQ ID NO: 167130 - DNA, 75 bp, Artificial Sequence
  Synthetic
gggactgtagcagacttcgccgtccggacaccgcagcctgtggattcatgaaaatctactctggcattcccgagg

SEQ ID NO: 167131 - DNA, 75 bp, Artificial Sequence
  Synthetic
cggcgtcaggtctttgggactcatgacgcgcggttttcaaaattccctgcgcgcgcgacgggctcaaacgatgag

SEQ ID NO: 167132 - DNA, 75 bp, Artificial Sequence
  Synthetic
cctctctgtcttactctcccataggctgtaaggccctcgaggaagagacttacggattgtagttgcagctcgtca

SEQ ID NO: 167133 - DNA, 75 bp, Artificial Sequence
  Synthetic
gtctggttattggcctcggtgaacgtcaatcgcacctgaaaagacacgctgtagtcccggaagacgtgggcccag

SEQ ID NO: 167134 - DNA, 75 bp, Artificial Sequence
  Synthetic
tctggttgcgaccgctcagataccagatcacctttttcacccaggtggagcttctctccaccaaggtctggcctt

SEQ ID NO: 167135 - DNA, 75 bp, Artificial Sequence
  Synthetic
gcaagggggaccgtgggggcgagggatagagaaaaggacagtaaaacgtcgccgcgtcatgcggtttggaatacg

SEQ ID NO: 167136 - DNA, 75 bp, Artificial Sequence
  Synthetic
cacggagacgccagacagggcgttgcccaaaccgcgcacagaagcaggcagtgaaagtggtgacgaagcagaagc

SEQ ID NO: 167137 - DNA, 75 bp, Artificial Sequence
  Synthetic
ctgaactcgaggctccgggcgtgtggcgccagcgaaccggcggcgttgaacgtggtccttttgttggtgccgccg

SEQ ID NO: 167138 - DNA, 75 bp, Artificial Sequence
  Synthetic
cccccgacacacccggcacacgcccgcgacacacccgacacccaccccacgcacgcacccacccagccgcgcccc

SEQ ID NO: 167139 - DNA, 75 bp, Artificial Sequence
  Synthetic
cgtggtccttttgttggtgccgccgcgacggttctgacgtctaaagtcgctgatgagcaacgacacctcggtcac

SEQ ID NO: 167140 - DNA, 75 bp, Artificial Sequence
  Synthetic
tgatgagcaacgacacctcggtcacgttgattctgcaagcacaggttccgaacgtcatttcacaccccatgcggt

SEQ ID NO: 167141 - DNA, 75 bp, Artificial Sequence
  Synthetic
cctctgttccccggggaatcaaacagacacagacgcgcgtctgcttttcgccgtgcgcgccgcacgccgctttta

SEQ ID NO: 167142 - DNA, 75 bp, Artificial Sequence
  Synthetic
gcacgtcaaagttgtccaagccgtggctcgcatcgtagtggtagttcaacgtgaggtccacgagctgttccacat

SEQ ID NO: 167143 - DNA, 75 bp, Artificial Sequence
  Synthetic
aatgttgtattgcactttgttttgtttttcataaacttaagggttctcctgagaaatcgcgggcacatgtcttgc

SEQ ID NO: 167144 - DNA, 75 bp, Artificial Sequence
  Synthetic
ggttggcggcgggtgtttgcacggagtttctgcggcgtttctacgcagcttttgcgcggcgcttcgcttttcggg

SEQ ID NO: 167145 - DNA, 75 bp, Artificial Sequence
  Synthetic
caccgacgtgcttaatcagtcaaagccagttacgttgtttctgtacggcgttgtctttctcttcggttccatcgg

SEQ ID NO: 167146 - DNA, 75 bp, Artificial Sequence
  Synthetic
ctttattatgagacatcatacacatagtataggcgaggtgatggggcggggaaagagttggaaccgaaagacaaa

SEQ ID NO: 167147 - DNA, 75 bp, Artificial Sequence
  Synthetic
ccatttccgaggcggtcagttcatcgtacaccgagacgtagtacctgatggggtcctcctcattgtccgagaggt

SEQ ID NO: 167148 - DNA, 75 bp, Artificial Sequence
  Synthetic
tctcccataattgggattcacgaacgacgtgtccaagttgccatcctttctgaaatagatgacgttctcaggatc

SEQ ID NO: 167149 - DNA, 75 bp, Artificial Sequence
  Synthetic
gcagtttagctggcagttcatactcgtggtgttggaagtgcgattaacgtccgtgccgtggtacgtacatcggac

SEQ ID NO: 167150 - DNA, 75 bp, Artificial Sequence
  Synthetic
ggcgacgccgggccacggcgtccaccgggtagaaccccgcgggccgccgggcgcccctccgggtagcggcaacaa

SEQ ID NO: 167151 - DNA, 75 bp, Artificial Sequence
  Synthetic
cccgagtttccaaccgctgataagggctcgaggaacaaaatccggcggggatctgagaacctcgtcgggaaccgc

SEQ ID NO: 167152 - DNA, 75 bp, Artificial Sequence
  Synthetic
gctcgaggaacaaaatccggcggggatctgagaacctcgtcgggaaccgctgccaaacgggctgctaccgccact

SEQ ID NO: 167153 - DNA, 75 bp, Artificial Sequence
  Synthetic
tacccagcgacggcgtcgctcccacccgggtttcttctcttgcaggtaccacccgtcgactgtcagcctcgcgag

SEQ ID NO: 167154 - DNA, 75 bp, Artificial Sequence
  Synthetic
ggagtaaactaccgcgatcagtaccgctatgaagctgaaaatggaggtgcctgtcacgatgtagaagaggatagc

SEQ ID NO: 167155 - DNA, 75 bp, Artificial Sequence
  Synthetic
ctatgtccgcgaacgacgtgtgacgaggacgtggtttccgcaagcctctaccgacgccgcgacaccaggtaggtt

SEQ ID NO: 167156 - DNA, 75 bp, Artificial Sequence
  Synthetic
aggacgtggtttccgcaagcctctaccgacgccgcgacaccaggtaggttatcaaaacgcgagcccatatcgccg

SEQ ID NO: 167157 - DNA, 75 bp, Artificial Sequence
  Synthetic
ttgcgggcaagcgcgctttcggtgacagggtgtatcgtacgtagccgcgggtcaggcgcgcgttgtagcggtaca

SEQ ID NO: 167158 - DNA, 75 bp, Artificial Sequence
  Synthetic
cagggtgtatcgtacgtagccgcgggtcaggcgcgcgttgtagcggtacacgcagaaatctatccacaggccaac

SEQ ID NO: 167159 - DNA, 75 bp, Artificial Sequence
  Synthetic
ggccatctcctccaggtagtgggtctgactgcgacgcagcgtccagttcatgtaaaagtcggtctcgccgtgtcc

SEQ ID NO: 167160 - DNA, 75 bp, Artificial Sequence
  Synthetic
tgactgcgacgcagcgtccagttcatgtaaaagtcggtctcgccgtgtccggccacgaagaggctgcttactaaa

SEQ ID NO: 167161 - DNA, 75 bp, Artificial Sequence
  Synthetic
tcgggcgccagagctaggtcaggcgtatcaaattccactgccaggcgacctgattctaacggttccacgatccgg

SEQ ID NO: 167162 - DNA, 75 bp, Artificial Sequence
  Synthetic
aggcggggctaactcggaaaccgacacgataggcagcgtggtcggctccgtcggcgtgcggggtcggggacaggg

SEQ ID NO: 167163 - DNA, 75 bp, Artificial Sequence
  Synthetic
tcgttgaccacgtaggccacgtagaggccaacattttccaccacgggttctagctgcaggcggcacgtaaagctt

SEQ ID NO: 167164 - DNA, 75 bp, Artificial Sequence
  Synthetic
tagctgcaggcggcacgtaaagcttagaaacgacggctgtacggtttggttcccgtgaagctgaagcgtcacttc

SEQ ID NO: 167165 - DNA, 75 bp, Artificial Sequence
  Synthetic
gcaatgcatactgtcccagtcgcgacacgcagcccagcctagctcggtgaagggtcgacgcacacccgagaaagt

SEQ ID NO: 167166 - DNA, 75 bp, Artificial Sequence
  Synthetic
cacgcagcccagcctagctcggtgaagggtcgacgcacacccgagaaagtgtgcttgaagaccagggggtcgcct

SEQ ID NO: 167167 - DNA, 75 bp, Artificial Sequence
  Synthetic
agcgtgaacagcaagcgcaacatgctgcgcgggttaggaaatgcggcgtgtcggccaccgcccgactcataaacg

SEQ ID NO: 167168 - DNA, 75 bp, Artificial Sequence
  Synthetic
acaagtgacgaggagcgtaccgcaaatcactagggaaaaggccagcagagcccgatagtcttgctcttcgcgaac

SEQ ID NO: 167169 - DNA, 75 bp, Artificial Sequence
  Synthetic
taggttcgttgccagatggcaaatgctgtcgacagcagacgtgggcggtcggtgtatttttgtgggttgcggtga

SEQ ID NO: 167170 - DNA, 75 bp, Artificial Sequence
  Synthetic
aaaggctttgtaggccgtagggactggccaggcaccgaactcaatattggtagacactacgtcgtaaatgcgttg

SEQ ID NO: 167171 - DNA, 75 bp, Artificial Sequence
  Synthetic
cggcttgcgcgttaggattgagacacttggttcccttgtcctttaaaatagccagcacttcctgacgattgcagc

SEQ ID NO: 167172 - DNA, 75 bp, Artificial Sequence
  Synthetic
cgacgtcgagccgacgtccactatatagcaacacaacccgcgtcagcgaccacgccgtttacacacgcggacggc

SEQ ID NO: 167173 - DNA, 75 bp, Artificial Sequence
  Synthetic
gtgacaggtatcgtaccgataagcgtttgatgtacgaattcggaatcgaatggtgtaaccatgttaacatgtcga

SEQ ID NO: 167174 - DNA, 75 bp, Artificial Sequence
  Synthetic
ggatagcgtgatccaatacttccatccttcacattccggtgtccacatgggaagcgacgtcacgttagttcccgt

SEQ ID NO: 167175 - DNA, 75 bp, Artificial Sequence
  Synthetic
gtgctcggttcctaggatactcacctctcttctgtacttgtggttcatcgcctttttttgtcaccagtactttgt

SEQ ID NO: 167176 - DNA, 75 bp, Artificial Sequence
  Synthetic
tctcttctgtacttgtggttcatcgcctttttttgtcaccagtactttgtgccataagctactattttgaccttt

SEQ ID NO: 167177 - DNA, 75 bp, Artificial Sequence
  Synthetic
tctctcacaaacgggaggatatggaggatcatgaccaataagaaatagaccgaataaaggattgcggaaaccgtc

SEQ ID NO: 167178 - DNA, 75 bp, Artificial Sequence
  Synthetic
ttaaaaatcgatcacacgtcaattaggtttcaaaatcgatactgtttattatcaggaatctagactaattctaca

SEQ ID NO: 167179 - DNA, 75 bp, Artificial Sequence
  Synthetic
atcaggaatctagactaattctacaatgacagctctgaatttctctctcgtctttcttgtcaggttctcatcatc

SEQ ID NO: 167180 - DNA, 75 bp, Artificial Sequence
  Synthetic
cttaaaattaaccataacgctgggactactgatgaaggagtagtaatgagccaggacgccgtacatcgaaggcaa

SEQ ID NO: 167181 - DNA, 75 bp, Artificial Sequence
  Synthetic
gtggaagccgaggaggccatggcgcggcggcgacagcgcatgctgtggcgtatgttctctcgtggaggcgacggc

SEQ ID NO: 167182 - DNA, 75 bp, Artificial Sequence
  Synthetic
ttatttttcctgacgtcggcaaaaagtacctaaattccccacagatattcagacacggttccgtaaagtgcttct

SEQ ID NO: 167183 - DNA, 75 bp, Artificial Sequence
  Synthetic
gtacctaaattccccacagatattcagacacggttccgtaaagtgcttctttttttagtgcaggaattggaaaaa

SEQ ID NO: 167184 - DNA, 75 bp, Artificial Sequence
  Synthetic
ttttttagtgcaggaattggaaaaaataataaaaaatatgaacagctcatctgtaattatctgtgtgacttcatc

SEQ ID NO: 167185 - DNA, 75 bp, Artificial Sequence
  Synthetic
ggaagcttacagggtgcggtagaaaattttgccgattgagcaacactgttggcatctctcactccgataggcggc

SEQ ID NO: 167186 - DNA, 75 bp, Artificial Sequence
  Synthetic
ttgagggccgtaagcgcggcgccgcgtttgcggcgtgttgtgtccgacgctgcctgcgcactgccggtgcgtgtc

SEQ ID NO: 167187 - DNA, 75 bp, Artificial Sequence
  Synthetic
acttttcccttgtttgacggttacatgtgcggtatgattttgctgtcgttgcttgtgatgttggacacctggagt

SEQ ID NO: 167188 - DNA, 75 bp, Artificial Sequence
  Synthetic
tccccagggacccatgctgccgtcccccgggaacttcctcttttccccggggaatcacacagacacagacacgcg

SEQ ID NO: 167189 - DNA, 75 bp, Artificial Sequence
  Synthetic
tcctagaaacaacacaaacgggacacacgtgaatccctgggtatgtgaagaaccaaagcacgaatgggacacttc

SEQ ID NO: 167190 - DNA, 75 bp, Artificial Sequence
  Synthetic
cagaggcttcatgcctcctaccggaagaataaaaataactcatggggccgaacggtatcatcctctccgcggttt

SEQ ID NO: 167191 - DNA, 75 bp, Artificial Sequence
  Synthetic
cgtgtgtccccagggacccgcgctgccgtcccctgggaacttcctcttttccccggggaatcacacagacacaga

SEQ ID NO: 167192 - DNA, 75 bp, Artificial Sequence
  Synthetic
ccgtcccctgggaacttcctcttttccccggggaatcacacagacacagacacgcgtcttctttgcgacgtgcgc

SEQ ID NO: 167193 - DNA, 75 bp, Artificial Sequence
  Synthetic
tgtgattggaggcttcgagagtgatgtgacagctgtgattacacctgtcgccaaggctgacagcggttacccagg

SEQ ID NO: 167194 - DNA, 75 bp, Artificial Sequence
  Synthetic
cagactgcacggcgccaaggcggcgccagcaagcgccgcacacgtcgctgcctataaaagccaggtgcgtgtctg

SEQ ID NO: 167195 - DNA, 75 bp, Artificial Sequence
  Synthetic
ggcacgtgggcggcacgcgtgttattgttggttcgttggcagatagcaagtgctgtcgacagcagacgttgtggg

SEQ ID NO: 167196 - DNA, 75 bp, Artificial Sequence
  Synthetic
acgggctccaaggtgtagttacggagtctttctatgcaggtagtgttgagatatttttgaatgctggttatgttc

SEQ ID NO: 167197 - DNA, 75 bp, Artificial Sequence
  Synthetic
acattataaaacgtttcagttgtatttaatggatatttattgtaagttgtgtttaaaatccaaggtttaaaccaa

SEQ ID NO: 167198 - DNA, 75 bp, Artificial Sequence
  Synthetic
acacaggtagcataggaaacatacggtgaaaatactccaaaatcccaaaaacgccgcgattccccgagtggccca

SEQ ID NO: 167199 - DNA, 75 bp, Artificial Sequence
  Synthetic
aacaccgcacgcagatggagctcgacgccgcggactacgctgcttgcgcacaggcccgccaacacctctacggtc

SEQ ID NO: 167200 - DNA, 75 bp, Artificial Sequence
  Synthetic
taacgctgtatcactgtccaacagcggtcgggctcctcgtccggacatgcgggtttccagcaatcctcggcgtcg

SEQ ID NO: 167201 - DNA, 75 bp, Artificial Sequence
  Synthetic
gcggtagcagtcgccggggagccggtaacgctgtatcactgtccaacagcggtcgggctcctcgtccggacatgc

SEQ ID NO: 167202 - DNA, 75 bp, Artificial Sequence
  Synthetic
tttgacggcgtccaggatgagctcgtcgctaccgtcgtgggaacgacagaaacgtgcgcgaatggaaaccatggg

SEQ ID NO: 167203 - DNA, 75 bp, Artificial Sequence
  Synthetic
tcgctaccgtcgtgggaacgacagaaacgtgcgcgaatggaaaccatgggccaggagtgtgtcatgaccgtgcag

SEQ ID NO: 167204 - DNA, 75 bp, Artificial Sequence
  Synthetic
cgcgcaaaagctgcgtggaaacgccgcaaaaggcccccgtgcccggccccgccgccaacccccgagcgcccgcaa

SEQ ID NO: 167205 - DNA, 75 bp, Artificial Sequence
  Synthetic
ttttcggcaatgtcagcggtggcgaaggggaacgaagaggaagaatattcgaggagtcgcgggcagctcaacagc

SEQ ID NO: 167206 - DNA, 75 bp, Artificial Sequence
  Synthetic
aggggaacgaagaggaagaatattcgaggagtcgcgggcagctcaacagcacccagaacagccacggcagagttc

SEQ ID NO: 167207 - DNA, 75 bp, Artificial Sequence
  Synthetic
gtgcacaaaaaacaccacacaccacaggccaggtcgtagcgtagttattattccgtagcagcaatgatggtacag

SEQ ID NO: 167208 - DNA, 75 bp, Artificial Sequence
  Synthetic
cgtgtgtcggccgctcaaacgtcgggccggcgtggtggtgaccaccgtgcgacgcagcttctcgcccgggatgcc

SEQ ID NO: 167209 - DNA, 75 bp, Artificial Sequence
  Synthetic
tttttttgtttttgcatcgtttatcgtcaccactagtgcaatattttgatcgtaaggctgaaagagtatcgttat

SEQ ID NO: 167210 - DNA, 75 bp, Artificial Sequence
  Synthetic
gtggaccagcaccgcgcaggaactctcgcgtcgccggcggtacgcgacctgtctcattgctacctcggatgttta

SEQ ID NO: 167211 - DNA, 75 bp, Artificial Sequence
  Synthetic
tcgcgtcgccggcggtacgcgacctgtctcattgctacctcggatgtttaagaaggaacgttcatctgcgtcaca

SEQ ID NO: 167212 - DNA, 75 bp, Artificial Sequence
  Synthetic
tggccgctaccacgtcgggcgggagcggctccggcggaagctcgatgagcagttgctgcgagtctcggcgctcgg

SEQ ID NO: 167213 - DNA, 75 bp, Artificial Sequence
  Synthetic
tcagtgccgggttgtcaaaaccgccatcggacgcgggtgataaaagaacgtacgatgacacgctgttagtacggc

SEQ ID NO: 167214 - DNA, 75 bp, Artificial Sequence
  Synthetic
gaaaacgacgagggtcggcagggcactaccgctgctgccgttttttgcgtcgtgcgggtgcacggtggtagtggc

SEQ ID NO: 167215 - DNA, 75 bp, Artificial Sequence
  Synthetic
cgtttgcccgtccgcccgtccttcgtagccatcatcatcatcatctcaggctctatcggtaccatcgttgtcatc

SEQ ID NO: 167216 - DNA, 75 bp, Artificial Sequence
  Synthetic
tcaacgtgggtttcggtttagcctgcgtcaccgaggcggaggtggaaatgagccgtcctgtgggggagtgtacga

SEQ ID NO: 167217 - DNA, 75 bp, Artificial Sequence
  Synthetic
cgggcggtacgctctctggatctataatatctatagtagctaaacgagactgtgagtacgacgaaccacatcatc

SEQ ID NO: 167218 - DNA, 75 bp, Artificial Sequence
  Synthetic
cgcttttcgtctctccaaggaacactgggtccgctgaaagggaccgtgtaccgaccaaagcaaaaaacacacacg

SEQ ID NO: 167219 - DNA, 75 bp, Artificial Sequence
  Synthetic
gagctggtacctgtagtggtttcactcgccgatgcggcaagtgcaaataaaactaatatccacagcatgttcgtt

SEQ ID NO: 167220 - DNA, 75 bp, Artificial Sequence
  Synthetic
gtgctttttattaacagagcagagggtttacagtagatatatgtttgccagggccaccgttttctaacaccgatc

SEQ ID NO: 167221 - DNA, 75 bp, Artificial Sequence
  Synthetic
accgccaccattaccacccgttgaactccacacccgggagccgcctgatcgccagggactcctcaccgtccatcg

SEQ ID NO: 167222 - DNA, 75 bp, Artificial Sequence
  Synthetic
ccgcttgctgcagatacgcttgggctcgcctccgtgcggacgccgtttcgtgcagacgctgagtagatcgagcag

SEQ ID NO: 167223 - DNA, 75 bp, Artificial Sequence
  Synthetic
aatgtaccatggctacggtggtgaactgcgtcgcggatcccgtcacgggtttcaacagatcgacgtcggtcagcg

SEQ ID NO: 167224 - DNA, 75 bp, Artificial Sequence
  Synthetic
gcaccagtttgaaggtgtcgtgccagtggtaagccagatagcagagaatggccacgatcagcacgagcatcacgc

SEQ ID NO: 167225 - DNA, 75 bp, Artificial Sequence
  Synthetic
cgtagcgggagatacggcgttctcccgcgggccacttacttgcacggtcgcttgaacggcggcttggactgccac

SEQ ID NO: 167226 - DNA, 75 bp, Artificial Sequence
  Synthetic
gcaacagcccgctatcccgcgacgccccgtccccgccgcaaaagcccgcaagtccccgccgccaaccccagcacc

SEQ ID NO: 167227 - DNA, 75 bp, Artificial Sequence
  Synthetic
tctcgtctcgtccaccatttccaccgtgtcgaagcgacagccgctgccgtagtacatagctccgttcaacggccg

SEQ ID NO: 167228 - DNA, 75 bp, Artificial Sequence
  Synthetic
gcgggccgggtcgccgagttccgggtcgggcacatccatggctcgccgtctccttctctgccgctcgtggtgccg

SEQ ID NO: 167229 - DNA, 75 bp, Artificial Sequence
  Synthetic
ccgcaaaatagatcgtggagcatgtctcgccaactgtcctggtgataatatcttaagtacgcgatgagcgcgccg

SEQ ID NO: 167230 - DNA, 75 bp, Artificial Sequence
  Synthetic
atggccataatcataagcgtaagcaaaacggcacagataacgtgaaacaccgcggtcatccaagtcgggcggcgt

SEQ ID NO: 167231 - DNA, 75 bp, Artificial Sequence
  Synthetic
cggtgaatgcgactcagggcctttcgacgccgccatttatttccaacgtccaagtcccacgtcatttctggcatc

SEQ ID NO: 167232 - DNA, 75 bp, Artificial Sequence
  Synthetic
ctttctctctcttagctgcggtgaaaaagagggaaggcgtgtgctgctatacaactgtacaacggacgcgctcgc

SEQ ID NO: 167233 - DNA, 75 bp, Artificial Sequence
  Synthetic
cgactcggcgtccttcatgacgctctgcaccgccttttccaacagttcctcgatgtccgaccatcgaggaggcgg

SEQ ID NO: 167234 - DNA, 75 bp, Artificial Sequence
  Synthetic
ggcagcgtggtcggctccgtcggcgtgcggggtcggggacagggacacgagagtcccaccttcgagagattctcc

SEQ ID NO: 167235 - DNA, 75 bp, Artificial Sequence
  Synthetic
cggcgttttcgggaagggcctgggcgtcaccggcggtgtccagccgaccggcttgggtttcgtgggcggcggtgt

SEQ ID NO: 167236 - DNA, 75 bp, Artificial Sequence
  Synthetic
tttcttggtgggcggcgtgctcaggttcttacgcggcgcgggtatcggcgtcgggggcctgtgcgacgacagccg

SEQ ID NO: 167237 - DNA, 75 bp, Artificial Sequence
  Synthetic
gtaggcggccgcttcttgcgcccgggcggcggaggtggcttccaggatggcggcggctgatgcagtaccgtgtcg

SEQ ID NO: 167238 - DNA, 75 bp, Artificial Sequence
  Synthetic
tcggccgatgctggtcggcgttcccggcgtggatacgtcggggatctcgaaccgcgccggaggaaactcgggttt

SEQ ID NO: 167239 - DNA, 75 bp, Artificial Sequence
  Synthetic
cacccgcatgagccccagttccagatccagcggctcgacgacgtcttctttcggatttcgatagcagcacgcgca

SEQ ID NO: 167240 - DNA, 75 bp, Artificial Sequence
  Synthetic
gccgggagccggcctcgcgacgaagtctcgtcggatcgcttgcggcctcggcgctgggtaaataaggaaatggcc

SEQ ID NO: 167241 - DNA, 75 bp, Artificial Sequence
  Synthetic
tatccacaccatgatcttctctcctgcttggaatctcaaactccgtgtcgggaagggccggtgtacggacattta

SEQ ID NO: 167242 - DNA, 75 bp, Artificial Sequence
  Synthetic
aaagaaaaaatggtgttacacactccttggtactactatgacccgtggtgagatatccgatgatgataatgatgt

SEQ ID NO: 167243 - DNA, 75 bp, Artificial Sequence
  Synthetic
gtcgcgcggcttgttatacgctagcccgtcgccgccttggggcacggtgccctcctacccacgtaacttcctccg

SEQ ID NO: 167244 - DNA, 75 bp, Artificial Sequence
  Synthetic
ccgtcgccgccttggggcacggtgccctcctacccacgtaacttcctccgtgacttaaagtcgcgtgtggtagat

SEQ ID NO: 167245 - DNA, 75 bp, Artificial Sequence
  Synthetic
aatgctacgttgcaacagcttcgacggacggccatcctccctctcatcgcaataataaaacaccagcagcgcgca

SEQ ID NO: 167246 - DNA, 75 bp, Artificial Sequence
  Synthetic
cttggaacgtggagattattaccaatggtactgcttgccgcgtactgttattgtgtttttgggacttgttcaatc

SEQ ID NO: 167247 - DNA, 75 bp, Artificial Sequence
  Synthetic
accagacccacgcagatagccagccccgctagcgtatccagcgccatcccgttcgctcccgtcgtcgtctcctga

SEQ ID NO: 167248 - DNA, 75 bp, Artificial Sequence
  Synthetic
aacatcaggagccgcaacgtcgaattccacgtccagtcgattcgtatgttatgctgcacagcaatgctagaataa

SEQ ID NO: 167249 - DNA, 75 bp, Artificial Sequence
  Synthetic
gcgcttgtcgtctgggttgagatgttctgcctcgtcgccgtagccgtcgtcgagcgcgagatcgcctgggcgctg

SEQ ID NO: 167250 - DNA, 75 bp, Artificial Sequence
  Synthetic
ttgaggatgacgctgagcgtgccgttgtcaatcaggtaatgatgataggtgccgagcttggccaggtagctgaac

SEQ ID NO: 167251 - DNA, 75 bp, Artificial Sequence
  Synthetic
accaccgtcgtcccggtttaaaaaccatcatcgacggccgttataaagccacccggacacgcgccgcggcacttg

SEQ ID NO: 167252 - DNA, 75 bp, Artificial Sequence
  Synthetic
aattgttgattccggagctcgttggcgcggaaatagccggataaggggagcaacaaccgtcggcgaaagccgtcc

SEQ ID NO: 167253 - DNA, 75 bp, Artificial Sequence
  Synthetic
cgctcattcagtccgggtttcgcgtccagtcggacgtgtgaccgttgggcaacggaacggcgtttcactaccaaa

SEQ ID NO: 167254 - DNA, 75 bp, Artificial Sequence
  Synthetic
atcgtatcgggtagtgtacgagacgtcggcggtgcagaatgcgactcgcggcgtagctcgccgtcgctatgcggc

SEQ ID NO: 167255 - DNA, 75 bp, Artificial Sequence
  Synthetic
tattgttggttcgttggcagatagcaagtgctgtcgacagcagacgttgtgggcggttggtgtatttttgcgggt

SEQ ID NO: 167256 - DNA, 75 bp, Artificial Sequence
  Synthetic
tcggagaccgtggacgaaaaagagaacgcagcagctaccgctggcggcggcggcgttaatgctgccgttgatgtt

SEQ ID NO: 167257 - DNA, 75 bp, Artificial Sequence
  Synthetic
atattcgacatgactcgcagaaacacgtacttgttctccgtgtcctgcataggaatcacaagtataatatccatc

SEQ ID NO: 167258 - DNA, 75 bp, Artificial Sequence
  Synthetic
aacgtcacctaaagattataatgtcacgggtttgccaaaaggctttgcggactcgtttaccggtaacgcagaggc

SEQ ID NO: 167259 - DNA, 75 bp, Artificial Sequence
  Synthetic
gctgtggcgtatgttctctcgtggaggcgacggcgaatgcagcagacggtgttcgatggagatggcgtgcgagga

SEQ ID NO: 167260 - DNA, 75 bp, Artificial Sequence
  Synthetic
ggcggtgtccacttgtgcttgtcgcggcagtgcacagacgaagcaacatgtcgctgtgaagagatagagtgtgag

SEQ ID NO: 167261 - DNA, 75 bp, Artificial Sequence
  Synthetic
cccgacgtgacgcgagtattacgtgtcaggggaaaaccccgtcatgacgaacgtgatttgtaagtgacgcggggt

SEQ ID NO: 167262 - DNA, 75 bp, Artificial Sequence
  Synthetic
ccccccgtccccgccgcgaaaggctttcgtccccgcggcaaaagccccccgtacccgcgacgccccgtctgcagc

SEQ ID NO: 167263 - DNA, 75 bp, Artificial Sequence
  Synthetic
cggtcaaacggtgttttacagtttcggggccatttgaacagagaaaggtggggaattttgagggacacggttttg

SEQ ID NO: 167264 - DNA, 75 bp, Artificial Sequence
  Synthetic
ggggccatttgaacagagaaaggtggggaattttgagggacacggttttgtcggatgggggataaaatcacgccc

SEQ ID NO: 167265 - DNA, 75 bp, Artificial Sequence
  Synthetic
aagctgcgtagaaacgccgcacaaacaccgtagaaacacccgccgccaacccccgagcgcccgcaacaccccgtc

SEQ ID NO: 167266 - DNA, 75 bp, Artificial Sequence
  Synthetic
cccggcgccggtccgcgaaacaaaaaacaccgcgggacggcacgcaccggcagtgcgcataaagcgccggacaca

SEQ ID NO: 167267 - DNA, 75 bp, Artificial Sequence
  Synthetic
cggcggcggtcggggtgtgtcgggggcgcggctgggtgggtgtgtgccgggtgtgccgggtgtgtcagggtgtgc

SEQ ID NO: 167268 - DNA, 75 bp, Artificial Sequence
  Synthetic
ggtgtgttggcggggtgtgtcaggggtgtgtcggggtgtgttggcgggccgtgtctgcgtgtgtcctcgacgcgg

SEQ ID NO: 167269 - DNA, 75 bp, Artificial Sequence
  Synthetic
ctaccggaaatatacacctgctgacgtagacgctactcccggatacgcgtcataagctactggaccctagggggg

SEQ ID NO: 167270 - DNA, 75 bp, Artificial Sequence
  Synthetic
gcgtgtgtcctcgacgcgggttgtgccgtacttcgtctgtcgtttcccccgcggtcccctagggacttcctcttt

SEQ ID NO: 167271 - DNA, 75 bp, Artificial Sequence
  Synthetic
gcggtcccctagggacttcctcttttccgcgtcttgccccccctcccttgcgcccccgagcttcctctggccgtt

SEQ ID NO: 167272 - DNA, 75 bp, Artificial Sequence
  Synthetic
tgtattgcgcgtatgcactggtacctgtccaaagcgccggtaattacattcttcctgtattacgcagcgagcagt

SEQ ID NO: 167273 - DNA, 75 bp, Artificial Sequence
  Synthetic
accaaagaaaatgaaaagacccagtagcagcagcagatcccaagggttaaagaccatgttgactattttgttttt

SEQ ID NO: 167274 - DNA, 75 bp, Artificial Sequence
  Synthetic
atatagtggacgtcggaggtgtccgacggccatagcccagcgcaacggcatgtcgccgcgccccccgcccctcgg

SEQ ID NO: 167275 - DNA, 75 bp, Artificial Sequence
  Synthetic
tctatacgcagatgactggaggctaaagttacggatttcatttataaataacagcgagtctagatagtcccacag

SEQ ID NO: 167276 - DNA, 75 bp, Artificial Sequence
  Synthetic
cgcctccagtggaaaaataccggcgcatgcgcacgatgcatgcccagtggaattttaccggcgcatgcgcagggc

SEQ ID NO: 167277 - DNA, 75 bp, Artificial Sequence
  Synthetic
gcgcctcccgcgggtcctggcccgcgcatgcgcaccgggtcccctggtttaaccctctttatatataggctttcc

SEQ ID NO: 167278 - DNA, 75 bp, Artificial Sequence
  Synthetic
taccgtaaatagtgtaaggtgtttcgttacggatcagtacatgcgtgtttttcataaattctgacacggcggtcc

SEQ ID NO: 167279 - DNA, 75 bp, Artificial Sequence
  Synthetic
ggtggagcgccaggcgctgacggagctggaataccaggccatgggcgccgtgtggcgcgcggcgtttttggccaa

SEQ ID NO: 167280 - DNA, 75 bp, Artificial Sequence
  Synthetic
attctacgcgcgggtgacgccgcgcagccagatgaacggcgtgggcgcgacggacctgcgtcagctgtcgccgcg

SEQ ID NO: 167281 - DNA, 75 bp, Artificial Sequence
  Synthetic
atcgtagatgtgggaacccgccttgcggtggttgtaacaccgtaagtcacgttagtagtgacgttgggagcggta

SEQ ID NO: 167282 - DNA, 75 bp, Artificial Sequence
  Synthetic
accgtggtgcacgaggtggaccccgcggccgacccgacggtgggcgacaaggccggccatcccgagggtctgtgc

SEQ ID NO: 167283 - DNA, 75 bp, Artificial Sequence
  Synthetic
tgaacgtggtgaagttaccgcagccttcttcgccggtatcattacgcttggaaacatttaacatctcggataaac

SEQ ID NO: 167284 - DNA, 75 bp, Artificial Sequence
  Synthetic
cgactgcagccgatggtgctgctgggcgcgtggcaagagctggcgcagtacgagccgttcgcgtcggcgccgcac

SEQ ID NO: 167285 - DNA, 75 bp, Artificial Sequence
  Synthetic
gcgcgtggcaagagctggcgcagtacgagccgttcgcgtcggcgccgcaccccgcgtcgctgctgacggccgtgc

SEQ ID NO: 167286 - DNA, 75 bp, Artificial Sequence
  Synthetic
aaacatatttggcaggttttcgaagttgagtgctataaaaatcaaaccacaagtgagttacactttcgtttcgaa

SEQ ID NO: 167287 - DNA, 75 bp, Artificial Sequence
  Synthetic
ttgagtgctataaaaatcaaaccacaagtgagttacactttcgtttcgaataggacccgctaggatatagtacag

SEQ ID NO: 167288 - DNA, 75 bp, Artificial Sequence
  Synthetic
gctctgtaattgctttaaaatttcaattttcaattgttgttctttaagtttccattttaaagagggtactttacc

SEQ ID NO: 167289 - DNA, 75 bp, Artificial Sequence
  Synthetic
tatccagggacgtcctcggggcacgtttaacgcacctttacagtttatgagaaaaataagcaggaatgtagatac

SEQ ID NO: 167290 - DNA, 75 bp, Artificial Sequence
  Synthetic
gtgggtccggcggcgatggcgggtccggcggcgtcggacaccgtgccgcgcgccatgctggtggtgctgctggac

SEQ ID NO: 167291 - DNA, 75 bp, Artificial Sequence
  Synthetic
gagctgggcgccgtgttcgggtactgcccgctggacggacacgtgtacccgctggcggcggagctgtcgcacttt

SEQ ID NO: 167292 - DNA, 75 bp, Artificial Sequence
  Synthetic
gcccgctggacggacacgtgtacccgctggcggcggagctgtcgcactttctgcgcgcgggcgtgctgggcgcgc

SEQ ID NO: 167293 - DNA, 75 bp, Artificial Sequence
  Synthetic
gggagcggccgcgctgggacgcgctgcacctgcacccgcgcgccgcgctgtgggcgcgcgagccgcacgagcagt

SEQ ID NO: 167294 - DNA, 75 bp, Artificial Sequence
  Synthetic
cccctaagtgttggggcccgtaccgttttagaaggttttgtgtgaatgtctttaacttctctgtcccttttctcg

SEQ ID NO: 167295 - DNA, 75 bp, Artificial Sequence
  Synthetic
cggtgaccccataagtgatcccgtcgcatttcgtgtttcggacgctcgaactctcggtctcgacctcaccaccgt

SEQ ID NO: 167296 - DNA, 75 bp, Artificial Sequence
  Synthetic
aaaaaaaactgcctcacccacctgcgtaaaaacaccatctttccggaggtgcggtaagacgggcaaatacggtcg

SEQ ID NO: 167297 - DNA, 75 bp, Artificial Sequence
  Synthetic
atataaaacaacgcagactgctgaaggccactcaacgacgaggcgccgaaatcgacagacccatgcctgtcgtgc

SEQ ID NO: 167298 - DNA, 75 bp, Artificial Sequence
  Synthetic
atgacgacgaagatcctacctacgacgaattgccgtcgcgcccaccccagaaacataagccgccagacaaacctc

SEQ ID NO: 167299 - DNA, 75 bp, Artificial Sequence
  Synthetic
cgaattgccgtcgcgcccaccccagaaacataagccgccagacaaacctccgcgcttatgcaaaacgggccccgg

SEQ ID NO: 167300 - DNA, 75 bp, Artificial Sequence
  Synthetic
caggttactgaatctgccgtcgccgttcgcggaggaggttcctgctccgttcggaatttcaaaaaatggagtact

SEQ ID NO: 167301 - DNA, 75 bp, Artificial Sequence
  Synthetic
ttcgcggaggaggttcctgctccgttcggaatttcaaaaaatggagtactgacggccgtctccagagaagccaca

SEQ ID NO: 167302 - DNA, 75 bp, Artificial Sequence
  Synthetic
tcataaaagacagacccgaccgccaaggccgccaccgcccaaattcggggatagaaccgcggcccatctctcgca

SEQ ID NO: 167303 - DNA, 75 bp, Artificial Sequence
  Synthetic
atgtgtacatcttcgggccacaggccacggccgccagcacctccgcggccgaaaaaatgtcaaacacacgcccct

SEQ ID NO: 167304 - DNA, 75 bp, Artificial Sequence
  Synthetic
gcccgtccttccgagtcgtgtcgctgcgtccagcgtcgcgcccaagatgggaatttgggtctcttcacgcgtagc

SEQ ID NO: 167305 - DNA, 75 bp, Artificial Sequence
  Synthetic
cgtcactaaggaccgacacggaggatgacgaggagcttctccccgactccgcggtccgcgaccggctacgtagcg

SEQ ID NO: 167306 - DNA, 75 bp, Artificial Sequence
  Synthetic
cgacgctgcctgcgcactgccggtgcgtgtcgtcccacggttgttggcgggaccgggctgcgggagtttccacgg

SEQ ID NO: 167307 - DNA, 75 bp, Artificial Sequence
  Synthetic
acaccacacgtcgtgagcagcgtgcacctgctgccgccactgagcctcggcgtgctcaggccacccgccggagcc

SEQ ID NO: 167308 - DNA, 75 bp, Artificial Sequence
  Synthetic
ggggacggaggacttttgcagcggggacgacgttggggacgagggttacgttgaggacggggactccacctcgcc

SEQ ID NO: 167309 - DNA, 75 bp, Artificial Sequence
  Synthetic
cggtctcgacggaccgcgccgtcgtcggcaacacggaaaacagcacgccagcccgagccgctaaggccgcatgcc

SEQ ID NO: 167310 - DNA, 75 bp, Artificial Sequence
  Synthetic
ccacagacacaaacagcacccacaccacgccgcttcacccagaggaccaacacacgttacccttacaccacagca

SEQ ID NO: 167311 - DNA, 75 bp, Artificial Sequence
  Synthetic
caccccgcatctcccaacctttttccaataaacgaaaccgacatgacacacgtaatgggtgctcgtggctacatt

SEQ ID NO: 167312 - DNA, 75 bp, Artificial Sequence
  Synthetic
gagacacctggtcgtagctgtagctggcttcgcaattcacagtatacaggtgcccctctttctgcgtcgtggctg

SEQ ID NO: 167313 - DNA, 75 bp, Artificial Sequence
  Synthetic
gggacgcaacgcagccagatcacatccccttgcagtaccagacgcagggctagcgtctcgaagatcggcatcaca

SEQ ID NO: 167314 - DNA, 75 bp, Artificial Sequence
  Synthetic
tctcccacgccgccataatcggccttcggatcgaagacgaaccgactcatgttgcccacgatgctcccccgagca

SEQ ID NO: 167315 - DNA, 75 bp, Artificial Sequence
  Synthetic
tcggatcgaagacgaaccgactcatgttgcccacgatgctcccccgagcaaacaacttgccgttgtcaatgtagc

SEQ ID NO: 167316 - DNA, 75 bp, Artificial Sequence
  Synthetic
tagtgatgccatcgggcaggcggatcaagggacccatggaggtccaaagacccacccaggctttccagagattgt

SEQ ID NO: 167317 - DNA, 75 bp, Artificial Sequence
  Synthetic
caagggacccatggaggtccaaagacccacccaggctttccagagattgttcatggtgaaacagcgtgtggactg

SEQ ID NO: 167318 - DNA, 75 bp, Artificial Sequence
  Synthetic
ccgataaaaatgcacggagacagtagatagagttacgaataaaccggtttatttattcaagtgtctcaggagatt

SEQ ID NO: 167319 - DNA, 75 bp, Artificial Sequence
  Synthetic
atcgtcagttcatggtggcattgagcagccatagcaccagagtcccggcgcccggtatcagacacgctgacctac

SEQ ID NO: 167320 - DNA, 75 bp, Artificial Sequence
  Synthetic
gagactgaaccggatcgagagtgagcagcagacgtcgtatgagaggaatggtgactgtgagtagcagaagttcca

SEQ ID NO: 167321 - DNA, 75 bp, Artificial Sequence
  Synthetic
cagccatagcaccagagtcccggcgcccggtatcagacacgctgacctaccgggcgcctccgagtccgtatcccg

SEQ ID NO: 167322 - DNA, 75 bp, Artificial Sequence
  Synthetic
aatcgcagacgggcgctcacccctacggtcaggagcacaagaacaaccagagagaacagatatacgagcagggtt

SEQ ID NO: 167323 - DNA, 75 bp, Artificial Sequence
  Synthetic
cggtcaggagcacaagaacaaccagagagaacagatatacgagcagggttctgaacagcagaccccaattgtcgt

SEQ ID NO: 167324 - DNA, 75 bp, Artificial Sequence
  Synthetic
aggatcgcgagcaccaacaccggcttcatggctccgaaggtccgctgctcggctccgctcaccgctccggtctgg

SEQ ID NO: 167325 - DNA, 75 bp, Artificial Sequence
  Synthetic
tcatggctccgaaggtccgctgctcggctccgctcaccgctccggtctggctgcagcagtgcttcgctgagaagt

SEQ ID NO: 167326 - DNA, 75 bp, Artificial Sequence
  Synthetic
aaagaatgtccacgttgaattcaacttagtatttaaggttgcacttctaccagacgtcatgtctacacgatgaaa

SEQ ID NO: 167327 - DNA, 75 bp, Artificial Sequence
  Synthetic
tacgtgccaaaagaggcgttacggtactttccgtaccgggatttccaaaccgggactttccacacggcggtttca

SEQ ID NO: 167328 - DNA, 75 bp, Artificial Sequence
  Synthetic
ggcgatggtgggtccggcggcgtcggggaccgtgccgcgcgccatgctggtggtggtgctggacgagctgggcgc

SEQ ID NO: 167329 - DNA, 75 bp, Artificial Sequence
  Synthetic
ccgatagggcatgaggggacccgggtgtcgcgacatgtcgacgacaggtgcggattagtggtcgtgtcgcgacat

SEQ ID NO: 167330 - DNA, 75 bp, Artificial Sequence
  Synthetic
cactcgcgctacacccgacccacagaaccaccgttgactccccaagccagtttgggacgtgctttgcgacgggac

SEQ ID NO: 167331 - DNA, 75 bp, Artificial Sequence
  Synthetic
cttggacgagactttctgggttctggggagtaaccgtaaaaacgacgtctatcaacgacgttggaagaaaaccgt

SEQ ID NO: 167332 - DNA, 75 bp, Artificial Sequence
  Synthetic
cccgcaacataaatacaaagtcacagcgaagaatccgtgtcgttctatcaagcgaaacgcgttccaaacggcccc

SEQ ID NO: 167333 - DNA, 75 bp, Artificial Sequence
  Synthetic
agcgaaacgcgttccaaacggccccgtcacagacgcagttattcataagcgttaacaaccggtggctaggatgaa

SEQ ID NO: 167334 - DNA, 75 bp, Artificial Sequence
  Synthetic
gagaagggttttcgggtcacgcgaagaccgctcaccgggggtcggcaacgcacacatcaacagaaaaccgagacg

SEQ ID NO: 167335 - DNA, 75 bp, Artificial Sequence
  Synthetic
tacaccgttgtcattacgcttacaagaagactctcagaatctcacaaggatgctagacgcacatataaataccat

SEQ ID NO: 167336 - DNA, 75 bp, Artificial Sequence
  Synthetic
gaggaggctttcgccacacctatcctgaaagcgttgcattctttatgataggtgtgacgatgtctttaccattcc

SEQ ID NO: 167337 - DNA, 75 bp, Artificial Sequence
  Synthetic
ggtgtgacgatgtctttaccattcccacggctgctttgcgtgatgatgacattcatcatgtatttccattcacac

SEQ ID NO: 167338 - DNA, 75 bp, Artificial Sequence
  Synthetic
ataattaatacagttactaccccccccccccccgtcgtttctgcggccttttgccgtcatatgcattatacaagt

SEQ ID NO: 167339 - DNA, 75 bp, Artificial Sequence
  Synthetic
cctaacagtttattagcccttgacaggataggtcaaaagattatatgtaggttttccggtaaaccgaattgtgat

SEQ ID NO: 167340 - DNA, 75 bp, Artificial Sequence
  Synthetic
gtccttgaactcgcacatagacaaacgtgtaactagtaattcgtgtatatgccttttatgtgttttatgtgtttt

SEQ ID NO: 167341 - DNA, 75 bp, Artificial Sequence
  Synthetic
ttatcggcatctttcccatcattgtaacgtttcgtgttacaatggtttacggcattgtatactgcgcatacataa

SEQ ID NO: 167342 - DNA, 75 bp, Artificial Sequence
  Synthetic
aacgtttcgtgttacaatggtttacggcattgtatactgcgcatacataatataattatcgttaaactataccgt

SEQ ID NO: 167343 - DNA, 75 bp, Artificial Sequence
  Synthetic
agtactgtagcagcgtaaccaagtaggtccacatgaacacgtacaaaattatggtaagccatcgtttttcatacc

SEQ ID NO: 167344 - DNA, 75 bp, Artificial Sequence
  Synthetic
cctacattcacacccttcccaataggaacatcgacacacgagtgcacatattatagtcataaatacaagcatagc

SEQ ID NO: 167345 - DNA, 75 bp, Artificial Sequence
  Synthetic
tgacctctgatgcgatgtgaggattaaattgtccctcaaaccgccaaacgctggtcatgtttccaccgtcaatta

SEQ ID NO: 167346 - DNA, 75 bp, Artificial Sequence
  Synthetic
cgcagctgacggtatgagataccacgatgttggacttaggtttgggggctaattgcctttttacaaattcccttc

SEQ ID NO: 167347 - DNA, 75 bp, Artificial Sequence
  Synthetic
ttagcatgacacgggttttgttaggataacaaaactgcgtatctggatatatttcatccccacatcccaccgcct

SEQ ID NO: 167348 - DNA, 75 bp, Artificial Sequence
  Synthetic
ataacaaaactgcgtatctggatatatttcatccccacatcccaccgccttttatgcgacaaatacatccaaaaa

SEQ ID NO: 167349 - DNA, 75 bp, Artificial Sequence
  Synthetic
acgaccccgagctctaagtgtctgtattcatagtgtagtcgtcgcaggttatccactgaattcccgtagctgaaa

SEQ ID NO: 167350 - DNA, 75 bp, Artificial Sequence
  Synthetic
agctgctgccccgtaaagtcaaatggcggcgtggcgtcagtctcccccgattccagcgtctcttcctcctcctct

SEQ ID NO: 167351 - DNA, 75 bp, Artificial Sequence
  Synthetic
tccaagtccgtgggcacccactggcgcaaacggaatacggcttcggtggtctccacgaggcactccggggcttgc

SEQ ID NO: 167352 - DNA, 75 bp, Artificial Sequence
  Synthetic
atgcatacgtaacgtcgaacgcgatctgcggccgggtcgcgcggcagtgacagcttgtgacccgcgctcgtcgtc

SEQ ID NO: 167353 - DNA, 75 bp, Artificial Sequence
  Synthetic
ccctgtacacgccacacagcgtccaacacgccgtccttgacgacgcagctggcctgatagctggacacgttgtta

SEQ ID NO: 167354 - DNA, 75 bp, Artificial Sequence
  Synthetic
acacgccgtccttgacgacgcagctggcctgatagctggacacgttgttaagcggcggaaagcgaaactgacgtg

SEQ ID NO: 167355 - DNA, 75 bp, Artificial Sequence
  Synthetic
aggggttgccggcgtgagccagcgttacccaacagcagcccaggccgacgaggaggcgcagccaccgcctcatgg

SEQ ID NO: 167356 - DNA, 75 bp, Artificial Sequence
  Synthetic
ccagggacgtatccacctcaggtacacacagcaggctacctggacaccgaagctgaacaaggctacgtgtttcac

SEQ ID NO: 167357 - DNA, 75 bp, Artificial Sequence
  Synthetic
agctgaacaaggctacgtgtttcacaaactgcaccagtaccacatagaggaatgtcaggtagcgtctctccgcaa

SEQ ID NO: 167358 - DNA, 75 bp, Artificial Sequence
  Synthetic
cgctgtacaatcttacggttaaagatacgggagtctaccttctacaggatcagtataccggcgatgtcgaggctt

SEQ ID NO: 167359 - DNA, 75 bp, Artificial Sequence
  Synthetic
aaactgcaccagtaccacatagaggaatgtcaggtagcgtctctccgcaaacagccgttccaagtctgagggcgt

SEQ ID NO: 167360 - DNA, 75 bp, Artificial Sequence
  Synthetic
gtaaacggttaacatcacgtaagagagtcgtgcgtccacctgtgggagctcagtttcgtaacgtagagccccgtc

SEQ ID NO: 167361 - DNA, 75 bp, Artificial Sequence
  Synthetic
accacgacaaccggagcgactccttggagcggctcgagagtacacttactgcgatcagacaccagtgccagaaga

SEQ ID NO: 167362 - DNA, 75 bp, Artificial Sequence
  Synthetic
ggtcaccgaaacccacgtttatatggacgttgagagcagcgcctgaccacatgattcatcataccatttctcgga

SEQ ID NO: 167363 - DNA, 75 bp, Artificial Sequence
  Synthetic
gcgacgacggtgttgctggaggtctggcggcagcagtacacgtcgagcgtcatgagggccatgtcgccttggtgg

SEQ ID NO: 167364 - DNA, 75 bp, Artificial Sequence
  Synthetic
ttcgctcgctgcgattggcttaagcaattcggttccgactggcagggtattcaacagaatttggttgttacaacg

SEQ ID NO: 167365 - DNA, 75 bp, Artificial Sequence
  Synthetic
atcgggcccatgccgggaaagcacattccttttcagtaaacaataatgacatcataacaaatcattttattcgcg

SEQ ID NO: 167366 - DNA, 75 bp, Artificial Sequence
  Synthetic
ttttagtatcgccccgtagtcgcctagataccagaggtacgtcaagttcatcaaaacgcccatcggcgtcccgga

SEQ ID NO: 167367 - DNA, 75 bp, Artificial Sequence
  Synthetic
gtcaacaccaccaagtacccctatcgcgtgtgttccatggcccagggtacggatcttattcgctttgaacgtaat

SEQ ID NO: 167368 - DNA, 75 bp, Artificial Sequence
  Synthetic
tccgtgggcagcagaatgtagagcgcctcggtagccgttgcggtgccttccacgaggatgggctgccggtgcctt

SEQ ID NO: 167369 - DNA, 75 bp, Artificial Sequence
  Synthetic
cctcggtagccgttgcggtgccttccacgaggatgggctgccggtgcctttcgtgattttctccgtcgtgtagcc

SEQ ID NO: 167370 - DNA, 75 bp, Artificial Sequence
  Synthetic
tccgccgagcgttcgggcgacagccgcagtcaggccgccacgccggcggctggggcgcgcgttccctcttcgtcc

SEQ ID NO: 167371 - DNA, 75 bp, Artificial Sequence
  Synthetic
gctgccgccaccactcccagccaccacaacaggcaggtcgcgagagggttccggaggcttccccggcgtagcatg

SEQ ID NO: 167372 - DNA, 75 bp, Artificial Sequence
  Synthetic
gtgagtcgtttccgagcgactcgagatgcactccgcttcagtctatatatcaccactggtccgaaaacatccagg

SEQ ID NO: 167373 - DNA, 75 bp, Artificial Sequence
  Synthetic
gtgtgtcttactgacgaagatgccgatgtgtgactaaaaacgtcccagccccagagcgatgtgtttcaataaaaa

SEQ ID NO: 167374 - DNA, 75 bp, Artificial Sequence
  Synthetic
gaaaatgtcggtgcagccaacctttcacatacagcccccaaaacacttgaatcactgccaccatcatcagcgtat

SEQ ID NO: 167375 - DNA, 75 bp, Artificial Sequence
  Synthetic
ctaacgagctccacagaggaacccaaggcacgaggcaccggggttcgcactctacataataagtttggcattggt

SEQ ID NO: 167376 - DNA, 75 bp, Artificial Sequence
  Synthetic
aggcacgaggcaccggggttcgcactctacataataagtttggcattggtggcagggggaaaagtagaacaacac

SEQ ID NO: 167377 - DNA, 75 bp, Artificial Sequence
  Synthetic
caccggcgtcggcactcgatccgcgtagccctccagcgtctggtagtacacccggggtgtcggcgtgggcacgga

SEQ ID NO: 167378 - DNA, 75 bp, Artificial Sequence
  Synthetic
agaggcggtaacggccccgtctccaccaagggcggaggttcattgaaaagagtcaaggataattcaggcatacta

SEQ ID NO: 167379 - DNA, 75 bp, Artificial Sequence
  Synthetic
tgtgaactccacgcgtagaaccaagagaagtacgggcaacacgaccaccctgtcgcctgaaagcgaatctgtacg

SEQ ID NO: 167380 - DNA, 75 bp, Artificial Sequence
  Synthetic
tgtctagactcaaaagctgtaaagctgtcttatagcatgtagtcttgcacgtcacggggaacagggtggtgatct

SEQ ID NO: 167381 - DNA, 75 bp, Artificial Sequence
  Synthetic
tgtcttatagcatgtagtcttgcacgtcacggggaacagggtggtgatctagtgacgtcgggagaatacggtgtt

SEQ ID NO: 167382 - DNA, 75 bp, Artificial Sequence
  Synthetic
tgtgccgtgcggcctagggccccggcgtagtttggataccagatgggggccgtcaggggtactaccacgagcaga

SEQ ID NO: 167383 - DNA, 75 bp, Artificial Sequence
  Synthetic
aaacagaggatggctaaccgtcgttgcatgttccaggccatgagccaggctaggcccgtacaccagacgcagagc

SEQ ID NO: 167384 - DNA, 75 bp, Artificial Sequence
  Synthetic
taggcccgtacaccagacgcagagcatggatgataggacataggcctggattaccacggtgcgatcgaaacacag

SEQ ID NO: 167385 - DNA, 75 bp, Artificial Sequence
  Synthetic
acgttccagccagtacgcgtgacaacgcagagcgcagggtagcagtgtgctccagaagggcagtgtatcgcgcag

SEQ ID NO: 167386 - DNA, 75 bp, Artificial Sequence
  Synthetic
cgcagagcgcagggtagcagtgtgctccagaagggcagtgtatcgcgcaggtagggggtcgttacgcgccacggt

SEQ ID NO: 167387 - DNA, 75 bp, Artificial Sequence
  Synthetic
cagagaaagtgttgaacgctccgcagggtgtcttcatctttggtgattacggtgactcgacggatcggcggtggt

SEQ ID NO: 167388 - DNA, 75 bp, Artificial Sequence
  Synthetic
agttgtgcggctaaccagatcaccatcttcaacctcacgttaaacgactccggtcgttacggagcagaaggtttt

SEQ ID NO: 167389 - DNA, 75 bp, Artificial Sequence
  Synthetic
atgacgggtgctcgacgaacagtcgtcggggctttaggtacccggcaagttttatagagaaagggggacgatggg

SEQ ID NO: 167390 - DNA, 75 bp, Artificial Sequence
  Synthetic
caaagacggtcgtccagggcaggcgccagaggttgggactgagcacgatcagcgtgattttaaacatggtcacca

SEQ ID NO: 167391 - DNA, 75 bp, Artificial Sequence
  Synthetic
ccagaggttgggactgagcacgatcagcgtgattttaaacatggtcaccagtcctacgtagatcagcagcgagcc

SEQ ID NO: 167392 - DNA, 75 bp, Artificial Sequence
  Synthetic
gaccaccgcgtgcgcgtccgcgtttggcacgcaaatcgcgctcccgccggcggcgccgtacggctgcggaggtaa

SEQ ID NO: 167393 - DNA, 75 bp, Artificial Sequence
  Synthetic
gacgatggcgccgtagccgtagagtagaatacgctgatgatggaacacggtctggtcgccgataacccagagcgt

SEQ ID NO: 167394 - DNA, 75 bp, Artificial Sequence
  Synthetic
agaatacgctgatgatggaacacggtctggtcgccgataacccagagcgtgatgaaaaaaacgctggtgagcacc

SEQ ID NO: 167395 - DNA, 75 bp, Artificial Sequence
  Synthetic
agcgtgaggaccagtgtgtagtcgatgaggatggtgggcaggtcggagcaccaggtgtagaaaaccgtggtaacg

SEQ ID NO: 167396 - DNA, 75 bp, Artificial Sequence
  Synthetic
tgaggatggtgggcaggtcggagcaccaggtgtagaaaaccgtggtaacggagaggaggcctacgtagcccatgg

SEQ ID NO: 167397 - DNA, 75 bp, Artificial Sequence
  Synthetic
ttgtatagtaaggtgtcctactaataaagacgaactgattcctaccgtaatgttataccgcacacctagggtgcc

SEQ ID NO: 167398 - DNA, 75 bp, Artificial Sequence
  Synthetic
gcagcagaggggaagattcatgttgacatatgttgtgagaatcggggatacccagccaaatcattccgcagaaag

SEQ ID NO: 167399 - DNA, 75 bp, Artificial Sequence
  Synthetic
acatatgttgtgagaatcggggatacccagccaaatcattccgcagaaagccgtactgatggcgatgtgaaagac

SEQ ID NO: 167400 - DNA, 75 bp, Artificial Sequence
  Synthetic
agtgcaatcggtacagttgtaaagtcccgatacatacgtgccgttggggcaaggggtacacgttacactggtata

SEQ ID NO: 167401 - DNA, 75 bp, Artificial Sequence
  Synthetic
agcccattgcggcgaatgtagcgacggcagcggcgggtccatgaggcgggtgatgcgcccgagtgaacgggtgag

SEQ ID NO: 167402 - DNA, 75 bp, Artificial Sequence
  Synthetic
tgatgcgcccgagtgaacgggtgagcgtctcggtggagtcttcttataaaccagcgggtctcaagcaaccctgct

SEQ ID NO: 167403 - DNA, 75 bp, Artificial Sequence
  Synthetic
gagcttggccaggtagctgaacatttggtcccagcgtgccgaccacaccacgggcgtgagcatcaggagtgtggt

SEQ ID NO: 167404 - DNA, 75 bp, Artificial Sequence
  Synthetic
cgggcgtgagcatcaggagtgtggtgtgatagatgagtgtttcggtggcgtaaagtatcagcgagctgcggatga

SEQ ID NO: 167405 - DNA, 75 bp, Artificial Sequence
  Synthetic
cgcggccgcgaccgaggggcggggggcgcggcgacatgccgttgcgctgggccatggccgccggacacctccgac

SEQ ID NO: 167406 - DNA, 75 bp, Artificial Sequence
  Synthetic
ctgacgttcggcagcatgtccgagcgcaatgccgccgccacggtgcacggacaaaaggccgcgtgcgaactaatc

SEQ ID NO: 167407 - DNA, 75 bp, Artificial Sequence
  Synthetic
cggtatagagacacagcagagtcttatgcaaccaggtgtaagtagaagccaggacgctgaccatcaccgtcaaaa

SEQ ID NO: 167408 - DNA, 75 bp, Artificial Sequence
  Synthetic
caccgcatcttcggaagctgtggacgctgtttccgaataccgggaggagatcgtgcttccctcttccaaggatcg

SEQ ID NO: 167409 - DNA, 75 bp, Artificial Sequence
  Synthetic
gctgtttccgaataccgggaggagatcgtgcttccctcttccaaggatcggaaagtagcgtccgtcgtttccgcg

SEQ ID NO: 167410 - DNA, 75 bp, Artificial Sequence
  Synthetic
ccgcagcgcccggcggcgtatccgcaaggtctcgaagctacagcttgtcagaggaaaagtaggtttgcaaaaagg

SEQ ID NO: 167411 - DNA, 75 bp, Artificial Sequence
  Synthetic
aaggtctcgaagctacagcttgtcagaggaaaagtaggtttgcaaaaaggtgcgcagggtcatgattctcagcac

SEQ ID NO: 167412 - DNA, 75 bp, Artificial Sequence
  Synthetic
gcgtacagccagggccgcttcgtggaaatgcgagacggctagacaggtaatgagcacgctgaaggacaagacgat

SEQ ID NO: 167413 - DNA, 75 bp, Artificial Sequence
  Synthetic
aatgggagggagaggacgtggggctcgagaagaaataaacgccaagctcgattcgaaccaaaaaaccacatgtgt

SEQ ID NO: 167414 - DNA, 75 bp, Artificial Sequence
  Synthetic
gcctacgtcgtgtgatagtgtaatggcaggaagattcttgtttacacaatatacatcgtggatcgtcccgtttat

SEQ ID NO: 167415 - DNA, 75 bp, Artificial Sequence
  Synthetic
aaatgcgagacggctagacaggtaatgagcacgctgaaggacaagacgatcttaaagcaccaggaccaaccacgc

SEQ ID NO: 167416 - DNA, 75 bp, Artificial Sequence
  Synthetic
taggatgtagatcccaggattcagacaagcgcgaacgtaggccaaaaactgaccgacgtatagacagaaagtaat

SEQ ID NO: 167417 - DNA, 75 bp, Artificial Sequence
  Synthetic
ccattccgggccgtgcgttgggtccccgaggggcgggggggtgtttttagcgggggggtgaaatttggagtcttg

SEQ ID NO: 167418 - DNA, 75 bp, Artificial Sequence
  Synthetic
gtacgttcgggagccaacaacgctacgccggtgcagctgagaaaggccagtaaggtgaacaacgcggccgagatg

SEQ ID NO: 167419 - DNA, 75 bp, Artificial Sequence
  Synthetic
catcattatcatcatcggatatctcaccacgagtcatagtagtaccaaggagtgtgtaacaccattttttctttt

SEQ ID NO: 167420 - DNA, 75 bp, Artificial Sequence
  Synthetic
atcaacgtaccgtccaggcagagacatatcacgatcaacggcggcacgtgaagcagcgtgtaaaagagcagaacg

SEQ ID NO: 167421 - DNA, 75 bp, Artificial Sequence
  Synthetic
cgacggtggtttcggcgaacggacacgcgctgtcttccaccgcgctcccgacgacgagcgcgggtcacaagctgt

SEQ ID NO: 167422 - DNA, 75 bp, Artificial Sequence
  Synthetic
ctgggtgaggactccgtgagacacagacgggaatggtgaaaccacgtcgcgggcgccgcgtagcagaaggcgctc

SEQ ID NO: 167423 - DNA, 75 bp, Artificial Sequence
  Synthetic
gacgggaatggtgaaaccacgtcgcgggcgccgcgtagcagaaggcgctcaacaacgcggtcaagccggccagct

SEQ ID NO: 167424 - DNA, 75 bp, Artificial Sequence
  Synthetic
acacacgcagaagaagcgtccggccgaggggaggggggggggtcgcgggccccggggcacactgcttccatccac

SEQ ID NO: 167425 - DNA, 75 bp, Artificial Sequence
  Synthetic
gggtctcttggatcccggggggcacgtagatgaccgtgccatcggtgggtacttgaaaccctttttctcttctca

SEQ ID NO: 167426 - DNA, 75 bp, Artificial Sequence
  Synthetic
acttgaaaccctttttctcttctcatggtgcgttgcgttctctggaaacggctgctctgtccgaaaaccagttcc

SEQ ID NO: 167427 - DNA, 75 bp, Artificial Sequence
  Synthetic
tgggacaggtcgttcggcgttaacgtcatcgcgtcggacgacggtagttctaagagacgtagatcgctcagcagg

SEQ ID NO: 167428 - DNA, 75 bp, Artificial Sequence
  Synthetic
tcatcgcgtcggacgacggtagttctaagagacgtagatcgctcagcaggtcctgacagttgcggattcgcaaga

SEQ ID NO: 167429 - DNA, 75 bp, Artificial Sequence
  Synthetic
ttgtcagcggcacggcgctggggacggggtttcaccgcgctgagggatctctctacgggtgtttccacggcgctt

SEQ ID NO: 167430 - DNA, 75 bp, Artificial Sequence
  Synthetic
gacggacgaaaaggacctgctgcgaaaagtgaccggcgaagataaggcccaccgtgctgtagaagcccaaaagca

SEQ ID NO: 167431 - DNA, 75 bp, Artificial Sequence
  Synthetic
aaagtgaccggcgaagataaggcccaccgtgctgtagaagcccaaaagcagccgcaggggccaagtccagggccg

SEQ ID NO: 167432 - DNA, 75 bp, Artificial Sequence
  Synthetic
ggacggcgtgttgcgggtacggggggcttctgcgctgggaacggggatgtttgcggcggcggggacaggggtggc

SEQ ID NO: 167433 - DNA, 75 bp, Artificial Sequence
  Synthetic
ggtgcagttgtcgcgacagatgaagactacttccgcgcagagcaaggtgatgaccaacgtgagcacaaacgacgt

SEQ ID NO: 167434 - DNA, 75 bp, Artificial Sequence
  Synthetic
actacttccgcgcagagcaaggtgatgaccaacgtgagcacaaacgacgtcaacacctcgcggggctcctggcag

SEQ ID NO: 167435 - DNA, 75 bp, Artificial Sequence
  Synthetic
cggcagcgcgggtgccggtttcgctgagcgagaaccggtcgctcatagcggaaatacacgaagagcgcggaggcc

SEQ ID NO: 167436 - DNA, 75 bp, Artificial Sequence
  Synthetic
gagcgagaaccggtcgctcatagcggaaatacacgaagagcgcggaggccacaggcaccaggaggagcacctcgg

SEQ ID NO: 167437 - DNA, 75 bp, Artificial Sequence
  Synthetic
ccaagacggccaccgccgcggagatttggaagaggagcaagccggcgattcggacgacaacctcgaagcgatgca

SEQ ID NO: 167438 - DNA, 75 bp, Artificial Sequence
  Synthetic
cgcttcatcatagtcgtcgttgttgccgctgtcgaacagccgccgaaacacgatctgtcgctgggtcgcggtggg

SEQ ID NO: 167439 - DNA, 75 bp, Artificial Sequence
  Synthetic
atgtttgggcggcccgcggttctgacaggcttgattggtggagacggccggcgcggcgggtgggggaaacgacga

SEQ ID NO: 167440 - DNA, 75 bp, Artificial Sequence
  Synthetic
caggcttgattggtggagacggccggcgcggcgggtgggggaaacgacgagtttttccgttacgccatggttcgc

SEQ ID NO: 167441 - DNA, 75 bp, Artificial Sequence
  Synthetic
gacgataaccaggtcatccaagcgatgagtttgtctaatgagtcctcggtggtgaagaggataagaatgagcagg

SEQ ID NO: 167442 - DNA, 75 bp, Artificial Sequence
  Synthetic
tgagtttgtctaatgagtcctcggtggtgaagaggataagaatgagcaggtacaagtacaccaggttctcataga

SEQ ID NO: 167443 - DNA, 75 bp, Artificial Sequence
  Synthetic
gcatgaagctgagcgccatggcgtaatagcccaaaaaaagtttgtgccccaacggtacgggctgcaggtaaagtg

SEQ ID NO: 167444 - DNA, 75 bp, Artificial Sequence
  Synthetic
atagcccaaaaaaagtttgtgccccaacggtacgggctgcaggtaaagtgcgatcaagaacgcgataacgccgat

SEQ ID NO: 167445 - DNA, 75 bp, Artificial Sequence
  Synthetic
aaaaagcacgcaagccaagaggcccgagaaggtcaccagcgtagaggaggagcaggcgctggccacgatcaccga

SEQ ID NO: 167446 - DNA, 75 bp, Artificial Sequence
  Synthetic
gccgccaaaaccattaatgcattctgttgatagtgtggttgcacttgtggtattattactggtattagtggaaga

SEQ ID NO: 167447 - DNA, 75 bp, Artificial Sequence
  Synthetic
gacggtgcctttaagatgcggaaaagccagcaccaggcccagacagagcaagaaggtgcaggtgccctgcacggc

SEQ ID NO: 167448 - DNA, 75 bp, Artificial Sequence
  Synthetic
ggcgcacgtcagaatcctcgttagagaccacgcatagaatgccgcgttcacgatcgtcgttgcggtcatcctcgt

SEQ ID NO: 167449 - DNA, 75 bp, Artificial Sequence
  Synthetic
tcgagacggaggaaatcataatgactccgcgcgagggtcgcgggggtgggggcgcccaggccgtcccggtggcct

SEQ ID NO: 167450 - DNA, 75 bp, Artificial Sequence
  Synthetic
gaggggcgcccggcggcccgcggggttctacccggtggacggcgtggcccggcgtcgccgtacccgcagtactcg

SEQ ID NO: 167451 - DNA, 75 bp, Artificial Sequence
  Synthetic
accgtcattcccacacggcgttcccccataaagtcacgtcacactcgagtaagcgtgaaaaagctttattgttga

SEQ ID NO: 167452 - DNA, 75 bp, Artificial Sequence
  Synthetic
ccataaagtcacgtcacactcgagtaagcgtgaaaaagctttattgttgaataaaaaacacgagtacaacaccga

SEQ ID NO: 167453 - DNA, 75 bp, Artificial Sequence
  Synthetic
agcgagcgggagcgtgtcatctcccccatctttttacaacaagctgaggagactcacgccgtcgatgcgtccgcc

SEQ ID NO: 167454 - DNA, 75 bp, Artificial Sequence
  Synthetic
ccatctttttacaacaagctgaggagactcacgccgtcgatgcgtccgccgtgtttctcggcgtactcctgcacc

SEQ ID NO: 167455 - DNA, 75 bp, Artificial Sequence
  Synthetic
ccccggccgacacgcatctggcttttataggcagcgacgtgcacggcgcttgctggcgccgccttggcgccgcgc

SEQ ID NO: 167456 - DNA, 75 bp, Artificial Sequence
  Synthetic
cagacgctgtttttagacagcgttccacgctggtagatgagatccagggtctcgtaaataagcacggccgaagcg

SEQ ID NO: 167457 - DNA, 75 bp, Artificial Sequence
  Synthetic
cacgctggtagatgagatccagggtctcgtaaataagcacggccgaagcggcggtcaccaccaggacgtagagtc

SEQ ID NO: 167458 - DNA, 75 bp, Artificial Sequence
  Synthetic
agccaatcccgatgactttccagcgcgtgggattgttgccggccaggtaggtgagaccgctgcagagaacgaaaa

SEQ ID NO: 167459 - DNA, 75 bp, Artificial Sequence
  Synthetic
aagcccgtgcacacggtgatgccggtgttgatcagcaggcacgccaccgtgagatgagcaaaattggtggtgtgt

SEQ ID NO: 167460 - DNA, 75 bp, Artificial Sequence
  Synthetic
ccgttggcgcactgtccttgcacatcggggaaggcgagccaagccagcaggcagaccgtgagggtacaagccagc

SEQ ID NO: 167461 - DNA, 75 bp, Artificial Sequence
  Synthetic
cggggaaggcgagccaagccagcaggcagaccgtgagggtacaagccagctgccacacgagcccgtgatagacct

SEQ ID NO: 167462 - DNA, 75 bp, Artificial Sequence
  Synthetic
gcacgatggtgaccgtcggcgactcatggtgttcggaaaccgaggcggtgtcgcccatgctgccgcttacgaccg

SEQ ID NO: 167463 - DNA, 75 bp, Artificial Sequence
  Synthetic
aggaaatctaactaggtcaacgcaattttattccaccgttacgcagaatactaacaaaaaaacacacaaatgtaa

SEQ ID NO: 167464 - DNA, 75 bp, Artificial Sequence
  Synthetic
atggtgttcggaaaccgaggcggtgtcgcccatgctgccgcttacgaccgctgtcggtctaaggtaggcgtcgat

SEQ ID NO: 167465 - DNA, 75 bp, Artificial Sequence
  Synthetic
accctgtatccgacccgtcgtcatgggctccacaaccagagcctcagaagatggtacatgccgatgaataaagcc

SEQ ID NO: 167466 - DNA, 75 bp, Artificial Sequence
  Synthetic
accacctccacttcctccacgacctcctcacttaatagaattcccaccgtctcctccgtcgtcgcctgagcccac

SEQ ID NO: 167467 - DNA, 75 bp, Artificial Sequence
  Synthetic
atggtacatgccgatgaataaagccacattttcgacatagaggcgtagcgagggctgaaaactctccgggaaaga

SEQ ID NO: 167468 - DNA, 75 bp, Artificial Sequence
  Synthetic
gagaaagaacggggtcgcggcctgcagcagccaaagtcccagcgccgtagcgcagagcagagacaggaccgacgg

SEQ ID NO: 167469 - DNA, 75 bp, Artificial Sequence
  Synthetic
ccagggacccgcgctgccgtcccctggggacttcttcctcttttccccggggaatcaaacagacacagacgcgcg

SEQ ID NO: 167470 - DNA, 75 bp, Artificial Sequence
  Synthetic
cgagcgacggaccgcgtagcagcaggaacaggcagccgacgggcacgacgaggctgagatgagaaagcggcggtg

SEQ ID NO: 167471 - DNA, 75 bp, Artificial Sequence
  Synthetic
gaacaggcagccgacgggcacgacgaggctgagatgagaaagcggcggtgggtcgtcgtcccgtccccgttcgca

SEQ ID NO: 167472 - DNA, 75 bp, Artificial Sequence
  Synthetic
gctgagggagtgttgcgggacataagtaagcgcggcggcgtcctcagcgcgtttgcggcgtgctgtgtccggcgc

SEQ ID NO: 167473 - DNA, 75 bp, Artificial Sequence
  Synthetic
gacgaggacggaggcgcgcagccataccgccagcctctctaggtaggggactacctcctcgacggtccattctag

SEQ ID NO: 167474 - DNA, 75 bp, Artificial Sequence
  Synthetic
accgccagcctctctaggtaggggactacctcctcgacggtccattctagcgggacgacatgaagcatggcgaca

SEQ ID NO: 167475 - DNA, 75 bp, Artificial Sequence
  Synthetic
cgggcgctcgggggttggcggcgggtgtttctacggtgtttgtgcggcgtttctacgcagcttttgcgcggcgct

SEQ ID NO: 167476 - DNA, 75 bp, Artificial Sequence
  Synthetic
gtgttccttcgggtggctgggctgccgggtggttttccacagccctttagactgcgcggcgccaaggcggcgcta

SEQ ID NO: 167477 - DNA, 75 bp, Artificial Sequence
  Synthetic
cccgttgtccaaagatgcgccgtccgaaagactaatccaacggggacccgagagcatgagcaacaacgtgagaaa

SEQ ID NO: 167478 - DNA, 75 bp, Artificial Sequence
  Synthetic
agagcatgagcaacaacgtgagaaagatggccatgctgtccaggtagagacagacggcatgacggatgcactggt

SEQ ID NO: 167479 - DNA, 75 bp, Artificial Sequence
  Synthetic
acaacgtcactactatcttctgcagccagtcggcgtcgcttagcagagcgagcgtgaggaacgaaagcagcatca

SEQ ID NO: 167480 - DNA, 75 bp, Artificial Sequence
  Synthetic
acccatcgtgtactctcgcaccacccacgaccacagagggaggcgggacgaagaaacgacgcagagcgccatctc

SEQ ID NO: 167481 - DNA, 75 bp, Artificial Sequence
  Synthetic
aaataaatacagggaatgggaaaaacacgcggggggaaaacaaagaagtctctctctagatgcggggtcgactgc

SEQ ID NO: 167482 - DNA, 75 bp, Artificial Sequence
  Synthetic
ccagtcggcgtcgcttagcagagcgagcgtgaggaacgaaagcagcatcaccacgtagacgcagctgatgcattt

SEQ ID NO: 167483 - DNA, 75 bp, Artificial Sequence
  Synthetic
ggaacctactagtacgcggctttcagagcacatttggaagatggccgccgtcaggctgttggccaacagatagat

SEQ ID NO: 167484 - DNA, 75 bp, Artificial Sequence
  Synthetic
cactcgttgttccctccggccgccgacacgcaccccgaagcctcgcacccggccaacacacccccgacacacccg

SEQ ID NO: 167485 - DNA, 75 bp, Artificial Sequence
  Synthetic
tgctcgttgcccaacgtgtacgtgatgaacatgcagacgatgggcacgagcacggtgagaaagaagctgtagttc

SEQ ID NO: 167486 - DNA, 75 bp, Artificial Sequence
  Synthetic
gacacaccccgccaacacacccccgacacacccgacacacgcccgcgacacacccggcacacacccacccaccca

SEQ ID NO: 167487 - DNA, 75 bp, Artificial Sequence
  Synthetic
aagatgaagatggcgtacacacgcagccatacggtgaactttttgaaccactcgagagcctccatgcgggagagc

SEQ ID NO: 167488 - DNA, 75 bp, Artificial Sequence
  Synthetic
gccatacggtgaactttttgaaccactcgagagcctccatgcgggagagcagcagcgcgttagcctcctgcgcct

SEQ ID NO: 167489 - DNA, 75 bp, Artificial Sequence
  Synthetic
cgcttgccgttcgacgatctttagtccggaggacgacggctcgtgtatcttgtgccaattgctgttgctctaccg

SEQ ID NO: 167490 - DNA, 75 bp, Artificial Sequence
  Synthetic
agccacacgcaccggcagcgtgcagaaagcgccgtcgacaacacgccgcagaagcggcggagcgcttacggccct

SEQ ID NO: 167491 - DNA, 75 bp, Artificial Sequence
  Synthetic
tttcggcgacttaagcgcggctgcctctgtgcgcactaccgatgcgtgtcgtcccacggtactagttagcgggac

SEQ ID NO: 167492 - DNA, 75 bp, Artificial Sequence
  Synthetic
ggcacggtgacgtggtcacgccgcggacacgtcgattaggagacgaactggggcgacgccgctgctgtggcagcg

SEQ ID NO: 167493 - DNA, 75 bp, Artificial Sequence
  Synthetic
ctgtgtccacggcgcttagtgcgcgctgcctgtgcgtgccgtcccgcggtatttgctcgcgggaccgggctgagg

SEQ ID NO: 167494 - DNA, 75 bp, Artificial Sequence
  Synthetic
cagtgtgggcgctgccgggctcggagggcatgaagtagagcacggagacaaagaggtacatgaggtccatgtaca

SEQ ID NO: 167495 - DNA, 75 bp, Artificial Sequence
  Synthetic
gaggtttgcgggccgccggtatttgctcgcgggacggagcctgcggcgtgttgcggccggcgcgttctgcatttc

SEQ ID NO: 167496 - DNA, 75 bp, Artificial Sequence
  Synthetic
agcagagcgcgcccgggatataactctcatactcgatgtcgtgcaggatgtcctgcgtatcgcacaccaccgagg

SEQ ID NO: 167497 - DNA, 75 bp, Artificial Sequence
  Synthetic
tcgggaaaaagagaaaatacggcgaacagtaagagaatcagcgtggatgcgcccgtcaatagggaacgctgtaat

SEQ ID NO: 167498 - DNA, 75 bp, Artificial Sequence
  Synthetic
agacgtattttgcgggttttctaagctgggtactataaaaatcgaaccacagataggttatactatcatttcgaa

SEQ ID NO: 167499 - DNA, 75 bp, Artificial Sequence
  Synthetic
ggacgggggtttttggacgtggtggccgccggcggggacggcgtgttgcggggacggggtgttgtggggacgggg

SEQ ID NO: 167500 - DNA, 75 bp, Artificial Sequence
  Synthetic
atgactgaacgatgactaaagtggaagcctgacgccgtgacagccacgctggtaagcaacgtgtacgtcagtaag

SEQ ID NO: 167501 - DNA, 75 bp, Artificial Sequence
  Synthetic
agcctgacgccgtgacagccacgctggtaagcaacgtgtacgtcagtaagatccatacgtttttgggaaagttgg

SEQ ID NO: 167502 - DNA, 75 bp, Artificial Sequence
  Synthetic
tattgaagtattttgtataaggttccctttctaattgttttaaaatctctaacttgaatttatctagtttttgct

SEQ ID NO: 167503 - DNA, 75 bp, Artificial Sequence
  Synthetic
taaccagtaacgtcccggtggtctgacgaccttacagtttattatagaaaataacaggacagttagtgatataat

SEQ ID NO: 167504 - DNA, 75 bp, Artificial Sequence
  Synthetic
agagctgctccagccggtgcggcaacaccagccagcaaaaggcgcagacgctcataaggatgaggcattgcaccc

SEQ ID NO: 167505 - DNA, 75 bp, Artificial Sequence
  Synthetic
caccagccagcaaaaggcgcagacgctcataaggatgaggcattgcacccagataaggatgtagatgcgcagcag

SEQ ID NO: 167506 - DNA, 75 bp, Artificial Sequence
  Synthetic
accccaactacacgcataccccaacgccaaccctcaggaaagcgctcatttttccacagaaaatcaacatcaact

SEQ ID NO: 167507 - DNA, 75 bp, Artificial Sequence
  Synthetic
tctaaatacacgaagcgaactagaaaacgcacacacgttatttgcaaaaagaaagcagctgccggcttattattt

SEQ ID NO: 167508 - DNA, 75 bp, Artificial Sequence
  Synthetic
gggaaagggaatctgcttttagggacccgggtctagtccgtcgtctcccatctggtcgggttcggggatggggac

SEQ ID NO: 167509 - DNA, 75 bp, Artificial Sequence
  Synthetic
acccgccacacgcccgcgacacacccggcacgacacacccggcacacgcccgcgacacaccctgacacaccctgc

SEQ ID NO: 167510 - DNA, 75 bp, Artificial Sequence
  Synthetic
tctggtcgggttcggggatggggacctgtttcagcgtgtgtccgcgggcgtgcatggcttttgctcgccggccgc

SEQ ID NO: 167511 - DNA, 75 bp, Artificial Sequence
  Synthetic
tgcatggcttttgctcgccggccgcgctgtaaccaggcctctttctctgtggtcggcgagtcttccgacgggtag

SEQ ID NO: 167512 - DNA, 75 bp, Artificial Sequence
  Synthetic
cgtgtcgtcctcgttttcgctattacacggggtttctggagtatcgcctatacggttggcgattctccgggggcg

SEQ ID NO: 167513 - DNA, 75 bp, Artificial Sequence
  Synthetic
tcgccgcccggtaattcgacgccgcattcgttgtacggagcgcggcacatgggcggcggaaagaacttgggcatg

SEQ ID NO: 167514 - DNA, 75 bp, Artificial Sequence
  Synthetic
cgaaagcagcgttgtccatccacggtctgcgtggtttcatcgttatcctcccataatcccccctgtagcgccggt

SEQ ID NO: 167515 - DNA, 75 bp, Artificial Sequence
  Synthetic
agcgtttcgacgctgtgagaggggaaggcccagttctggttgtcttgcagcgcgcccgtgggcagtaggtccgtg

SEQ ID NO: 167516 - DNA, 75 bp, Artificial Sequence
  Synthetic
gtaccttgtcagtgccgcgagtaggtcgcagaaaccagtccagagcgctctctagctgcgagcgtgtgatggtgc

SEQ ID NO: 167517 - DNA, 75 bp, Artificial Sequence
  Synthetic
tcgcagaaaccagtccagagcgctctctagctgcgagcgtgtgatggtgcccagtgcgccgtgccagcgcagcac

SEQ ID NO: 167518 - DNA, 75 bp, Artificial Sequence
  Synthetic
tgccgtggaaaacccgtgaaccgatacgggtgcagacggccgaaaaaattcgagacggcaatacgacggcagggc

SEQ ID NO: 167519 - DNA, 75 bp, Artificial Sequence
  Synthetic
gcagagaccacgcagtttaagcagaccgcacttgagaaacatgtgaaaattatcggcaatgcgatacaggtctga

SEQ ID NO: 167520 - DNA, 75 bp, Artificial Sequence
  Synthetic
ccgcacttgagaaacatgtgaaaattatcggcaatgcgatacaggtctgagtcctcgatcttgtgtaggtagacc

SEQ ID NO: 167521 - DNA, 75 bp, Artificial Sequence
  Synthetic
gggacgggggttgcgctggggccggggctgttcgcgccgcgtaggggaggttacgttggggacggggacagtttg

SEQ ID NO: 167522 - DNA, 75 bp, Artificial Sequence
  Synthetic
acgacgtaccactcgcagcacaagcgttgacgaataaagttcagaagatcgcgaaagtccgcggccggcatgtgg

SEQ ID NO: 167523 - DNA, 75 bp, Artificial Sequence
  Synthetic
acctcgcctatttaacctccacccactacaacacacacatgccgcacaatcatgccagccacagacacaaacagc

SEQ ID NO: 167524 - DNA, 75 bp, Artificial Sequence
  Synthetic
cggctccacctcggtgcgacccggcgtgcggatgaccaggttgagaccgctcatttcgcgagccgtcttggccac

SEQ ID NO: 167525 - DNA, 75 bp, Artificial Sequence
  Synthetic
ttgtgggtgccgatacacatattcgcaccagagtaggccgttcttggaaaaggctttgatatcactggccacctc

SEQ ID NO: 167526 - DNA, 75 bp, Artificial Sequence
  Synthetic
caccagagtaggccgttcttggaaaaggctttgatatcactggccacctcgtagagcccgtcggtctcccagtcg

SEQ ID NO: 167527 - DNA, 75 bp, Artificial Sequence
  Synthetic
agatcgctgtcgggtggacgtacggctagtacaccgacggcttccagggtgtcatcgcagcagagatagtcggcg

SEQ ID NO: 167528 - DNA, 75 bp, Artificial Sequence
  Synthetic
ctagtacaccgacggcttccagggtgtcatcgcagcagagatagtcggcggccagagaacgtgcgtaaatctgcg

SEQ ID NO: 167529 - DNA, 75 bp, Artificial Sequence
  Synthetic
gctgcacgtaggttttcagcgccggaggatcgtactggcgcagatagaggccttgcagcatcgataacgtctttt

SEQ ID NO: 167530 - DNA, 75 bp, Artificial Sequence
  Synthetic
aggatcgtactggcgcagatagaggccttgcagcatcgataacgtcttttgaaagacggtgtttctaaattggaa

SEQ ID NO: 167531 - DNA, 75 bp, Artificial Sequence
  Synthetic
tgcgtgtgtgctttgttttccgttcccacccgcgtccccaccgcagtcccgcacacagcccccgtccccgccgcc

SEQ ID NO: 167532 - DNA, 75 bp, Artificial Sequence
  Synthetic
ggcggctttggtgagtagggacatgccggcaaagccgtctcgacagcgagtcggataaagcgcgctgcgcgaaag

SEQ ID NO: 167533 - DNA, 75 bp, Artificial Sequence
  Synthetic
ccggcaaagccgtctcgacagcgagtcggataaagcgcgctgcgcgaaagcttaatataggagcagcgtcagacg

SEQ ID NO: 167534 - DNA, 75 bp, Artificial Sequence
  Synthetic
cgcgctggcgcttacgtccctgaaacctccccgagccctgtcccgcaccggcgccggtcggggcgtgtggggggt

SEQ ID NO: 167535 - DNA, 75 bp, Artificial Sequence
  Synthetic
actccggagacaaatccgtattcagattgatgcgtcgcgcttccacttcggcttccgaaacctcggcctccgtcc

SEQ ID NO: 167536 - DNA, 75 bp, Artificial Sequence
  Synthetic
attgatgcgtcgcgcttccacttcggcttccgaaacctcggcctccgtccggtaggcgttaacgatacgctgacc

SEQ ID NO: 167537 - DNA, 75 bp, Artificial Sequence
  Synthetic
atactatagtcatcatcctaaaattcagatataaggtgctaaaacaaatctgtatattgatcttatacgttctat

SEQ ID NO: 167538 - DNA, 75 bp, Artificial Sequence
  Synthetic
gtgtgttggctgggtgtgtcaggggagtgtcggcggcgcgtgccgggtgtgtcgcgggcgtgtggcgggtgtgtc

SEQ ID NO: 167539 - DNA, 75 bp, Artificial Sequence
  Synthetic
gtcgcgggcgtgtggcgggtgtgtcaggggtgtgtcggcggggcgtgcgcgcggctggatggaagcagtgtgccc

SEQ ID NO: 167540 - DNA, 75 bp, Artificial Sequence
  Synthetic
gtcctcctcaaggtcaaagcctaggtcttcccactcgtcgtcatcgctctcgtggccggcggccatacgcgcggc

SEQ ID NO: 167541 - DNA, 75 bp, Artificial Sequence
  Synthetic
cctccttcgtttccagacgtaacgttacacagcgtcagatgcacatgactgcaattgcacacgccaccgaccgat

SEQ ID NO: 167542 - DNA, 75 bp, Artificial Sequence
  Synthetic
ttacggaggctgctgttgtaggtgcactgggtggtgttttcacgcaggaagcggatgggtctcccgtaggtgttg

SEQ ID NO: 167543 - DNA, 75 bp, Artificial Sequence
  Synthetic
gcaattgcacacgccaccgaccgatcccaacgtaacattgttaacgcctgtcacagtacaaaccgtagtttcatt

SEQ ID NO: 167544 - DNA, 75 bp, Artificial Sequence
  Synthetic
ccgcgcgccgtcgcctcttctgcgtgtgtcctcgacgcgggtctgcagcttcctcttttgcggactgtcctcggg

SEQ ID NO: 167545 - DNA, 75 bp, Artificial Sequence
  Synthetic
tcctcatcgtccgccaaggcgtcgtggattacctccaggttctgattgtcgggtacgacgtggttatcttcgtcg

SEQ ID NO: 167546 - DNA, 75 bp, Artificial Sequence
  Synthetic
ttcttcctcctcttttccccggggattcaaagacacgcaacatcaaagacacgcaggacaggcgcgcggctgctt

SEQ ID NO: 167547 - DNA, 75 bp, Artificial Sequence
  Synthetic
gccgtcgtttccttcgtcttcctcttcaccgtctcccaaggaacgcggtcgacgacgttccgcgaagtcgccgcg

SEQ ID NO: 167548 - DNA, 75 bp, Artificial Sequence
  Synthetic
gaatggatgtcgggcgtccacctaggtgggtgcgcgctcgagaggtggctgtgcgctccggtactgcgggtctgt

SEQ ID NO: 167549 - DNA, 75 bp, Artificial Sequence
  Synthetic
gcctcgacagagccagcgaaactgccgcgcgtagtcgcggtctacgccgctgtcgaacatggtaaagtgaagacg

SEQ ID NO: 167550 - DNA, 75 bp, Artificial Sequence
  Synthetic
tgtcgaacatggtaaagtgaagacgcgccgcctcgcccatgtgtacgcagcctccgttgcgttccagcctggccg

SEQ ID NO: 167551 - DNA, 75 bp, Artificial Sequence
  Synthetic
acgtcatatgtatgattacatgcactgatacaaacagtaatgtttgacgctacaacaccagtaccattaaaccgt

SEQ ID NO: 167552 - DNA, 75 bp, Artificial Sequence
  Synthetic
tgtcgtcactagaaccacctccgatctttttccaggtagaatacacgtcaggattccacgttactgttccagtac

SEQ ID NO: 167553 - DNA, 75 bp, Artificial Sequence
  Synthetic
ccacgtaaaaacgacagaaacggtcgaagatgatgaggaatgacgtgtcaaagaaaccaccggcgcggtaggagc

SEQ ID NO: 167554 - DNA, 75 bp, Artificial Sequence
  Synthetic
aagaaaccaccggcgcggtaggagcccacggcgcccagcaggtaccagcggcaacgcagttgcagcgtgacgtac

SEQ ID NO: 167555 - DNA, 75 bp, Artificial Sequence
  Synthetic
ctggcgctacctcgaagggccagcagtccgtcaagcagccgaaactggtcaggagtttcaacgttttggcatggc

SEQ ID NO: 167556 - DNA, 75 bp, Artificial Sequence
  Synthetic
agcgttcccaggcaaaagcaaacgcgacgtccgtttagatcaaaagtcacgtatatagcgacgctgtttccactc

SEQ ID NO: 167557 - DNA, 75 bp, Artificial Sequence
  Synthetic
ctccgtacaacgaatcagtctgctgcgtcatattgcaaagcacaagcgacgtatgcgaacaacttgaaacacaga

SEQ ID NO: 167558 - DNA, 75 bp, Artificial Sequence
  Synthetic
cgtgacgcagcagcatcgctaccacgtcgtgcggtacccgcgtagcaaacggcgtctgtggctgacggtatacgg

SEQ ID NO: 167559 - DNA, 75 bp, Artificial Sequence
  Synthetic
cttcggtgtacatcataccgtaacgcgccagctcgtccagatgacgcgcgcacagcagcagaatctcttgcgagg

SEQ ID NO: 167560 - DNA, 75 bp, Artificial Sequence
  Synthetic
tgcgtggtattcagtttcttcatatccataccctggattccatcattaaaccccaatattaagcacgttattagt

SEQ ID NO: 167561 - DNA, 75 bp, Artificial Sequence
  Synthetic
tgatcacgcacttgcctagcacgataaggcgttcggggcaacaaatcacgtcgtccagcagttggtcgcgcagct

SEQ ID NO: 167562 - DNA, 75 bp, Artificial Sequence
  Synthetic
gtaaacgtgggagctccgtcttcccagcgtgtacgccacatgtcaaaagaggccgccagctagacaccccagaaa

SEQ ID NO: 167563 - DNA, 75 bp, Artificial Sequence
  Synthetic
tgcgacacgttttattccgcgtcctccgctcgacgctcaaatctggatgtactcgcgcacacccgtcaggctctt

SEQ ID NO: 167564 - DNA, 75 bp, Artificial Sequence
  Synthetic
gcggagacggggacgggagtggggacggtggtgaggacggggacgggggcctttcgcggcggggacggggagttg

SEQ ID NO: 167565 - DNA, 75 bp, Artificial Sequence
  Synthetic
taagggaaaagggtccgagtacgtcactaaccgcgactgatgcaccagggcggtaatcacccgctctgcgccctc

SEQ ID NO: 167566 - DNA, 75 bp, Artificial Sequence
  Synthetic
ctttcgcggcggggacggggagttgcgggatggcgggctgttgcgtggcggggacgggggactcttgcggcgggg

SEQ ID NO: 167567 - DNA, 75 bp, Artificial Sequence
  Synthetic
gcgcgtcgacgaacgcgtcgtcaccaggcagtgcagccgcgggcccgtatcgtcctgatgaccagcggcctcgcg

SEQ ID NO: 167568 - DNA, 75 bp, Artificial Sequence
  Synthetic
acggggaacacagacggcacgcacacgcagctcgcctatttaacctccacccactacaacacacacatgccgcac

SEQ ID NO: 167569 - DNA, 75 bp, Artificial Sequence
  Synthetic
gctttgggagggccgcgatccgccggactccgtgacggcggtgttgagtgagctgcctcagctgttaccgcgtct

SEQ ID NO: 167570 - DNA, 75 bp, Artificial Sequence
  Synthetic
taacgtgttggggtccagacgctcccacgcgccctcgtgcgggtcaaaacgctccgttaaacagagccagtcata

SEQ ID NO: 167571 - DNA, 75 bp, Artificial Sequence
  Synthetic
cgctcacgtcgctcatcgggcaacgcggcgtcttcgttgaagagaatgtcccgcttgtggtctacggcacgctcg

SEQ ID NO: 167572 - DNA, 75 bp, Artificial Sequence
  Synthetic
cgcgcttggacatttgggtttccacccctttcggtgtgtgtctatatatattgtggtcactgatttttttttaca

SEQ ID NO: 167573 - DNA, 75 bp, Artificial Sequence
  Synthetic
cacttcggccacaaagctgcgtcccggtcgcggacgtcccgtcacgcctagcacataccacggcgtggccagatt

SEQ ID NO: 167574 - DNA, 75 bp, Artificial Sequence
  Synthetic
gcacataccacggcgtggccagattagcacggacagcccaccaccaacgacggctctccacctcggtgagcgcac

SEQ ID NO: 167575 - DNA, 75 bp, Artificial Sequence
  Synthetic
catagagtagccttcgaacgggcccatgtgtttgaaactcacaatagcgaacatgatggactcggtgactgaggt

SEQ ID NO: 167576 - DNA, 75 bp, Artificial Sequence
  Synthetic
gcaacttcacgtcgcaacccaggattcgttcggccgtggcgtacgagccctcaggcgtggtgtcattgagaaaca

SEQ ID NO: 167577 - DNA, 75 bp, Artificial Sequence
  Synthetic
gtcattctccgcaaagtggtgtgaatcacgtcgcgatacgcaatctccgaacgtgacacaccgtaacgtgccagt

SEQ ID NO: 167578 - DNA, 75 bp, Artificial Sequence
  Synthetic
ccatgtacttttcacgggtgtcgtaggcgtagacgcgagaaaagcgacccataaaaaccacgtacggggtagcca

SEQ ID NO: 167579 - DNA, 75 bp, Artificial Sequence
  Synthetic
ggcgtagacgcgagaaaagcgacccataaaaaccacgtacggggtagccaccatgccatcatggtgatcgcgacg

SEQ ID NO: 167580 - DNA, 75 bp, Artificial Sequence
  Synthetic
ctgtttggcggcggtaatgatcccgtcctccgtacgtaacatcacatgccagcccttggggggacccaaggacag

SEQ ID NO: 167581 - DNA, 75 bp, Artificial Sequence
  Synthetic
tcctccgtacgtaacatcacatgccagcccttggggggacccaaggacagacagcgtccctcgttacgatgaacg

SEQ ID NO: 167582 - DNA, 75 bp, Artificial Sequence
  Synthetic
gttccccagagttatactatagtcatcatcctaaaattcagatataaggtgctaaaacaaatctatacgttgatc

SEQ ID NO: 167583 - DNA, 75 bp, Artificial Sequence
  Synthetic
atgggatcctcggccgccacaggcagcgcggggagctccggcggcacaactgcagcgccgtcagggccagaaccc

SEQ ID NO: 167584 - DNA, 75 bp, Artificial Sequence
  Synthetic
gcagccggatccatcattgcgcgacactctcagccggacaaccggcgtcactgacagaagccgaaccaaatacag

SEQ ID NO: 167585 - DNA, 75 bp, Artificial Sequence
  Synthetic
gcagatattgctgttcgtgcacaaagacgggcacgtcgcgacccagcttgccgaccagcagacgtcgactccaga

SEQ ID NO: 167586 - DNA, 75 bp, Artificial Sequence
  Synthetic
cgttgatttgcctcggtctgagaaccgacctagcgttcggaccggtgcgcagaaacagccggcggtccgagccac

SEQ ID NO: 167587 - DNA, 75 bp, Artificial Sequence
  Synthetic
cgacctagcgttcggaccggtgcgcagaaacagccggcggtccgagccactgagcggttcacagccccggccgcc

SEQ ID NO: 167588 - DNA, 75 bp, Artificial Sequence
  Synthetic
agctacagcgaaaccgagtccagtgaccgataaccacgtgcaaccctgcgtatgtaccagtccaagtacgtccgg

SEQ ID NO: 167589 - DNA, 75 bp, Artificial Sequence
  Synthetic
ttatactctccgacgtcccgtccaacgcgcctgtggagggccaatcggaccgcgggagctctccaagtggatgac

SEQ ID NO: 167590 - DNA, 75 bp, Artificial Sequence
  Synthetic
cgcgcctgtggagggccaatcggaccgcgggagctctccaagtggatgacaggcacagccgggtggccgaccgtg

SEQ ID NO: 167591 - DNA, 75 bp, Artificial Sequence
  Synthetic
cgacggggccttcccaagcggcaatctcacgactcacgtcgtcggccagacgcggcaacagctgagggagctcac

SEQ ID NO: 167592 - DNA, 75 bp, Artificial Sequence
  Synthetic
ccatctggctccctgctgttggctacctctcggatttcaaaaaagagcacgtgccgatgacggtgcacaggaaag

SEQ ID NO: 167593 - DNA, 75 bp, Artificial Sequence
  Synthetic
cctctcggatttcaaaaaagagcacgtgccgatgacggtgcacaggaaagagccaaagtgtcacagcgtcttttt

SEQ ID NO: 167594 - DNA, 75 bp, Artificial Sequence
  Synthetic
cggcggcttccaaatcggagagtacacagtcgtacgtcggatacaccgtcacgttttccaaagcgttgaccacgc

SEQ ID NO: 167595 - DNA, 75 bp, Artificial Sequence
  Synthetic
acaggatgaggcatggtaggtttgggcgcggggcggccctccagcacggcggcccgggccgcccggcgggtgagc

SEQ ID NO: 167596 - DNA, 75 bp, Artificial Sequence
  Synthetic
gcgcggggcggccctccagcacggcggcccgggccgcccggcgggtgagcacccggcgttgcgccgtatctatct

SEQ ID NO: 167597 - DNA, 75 bp, Artificial Sequence
  Synthetic
cgccctccagggatcctggggaggagggagtcctagtgaggcttccaatgttgttttgtggattttcggtttcct

SEQ ID NO: 167598 - DNA, 75 bp, Artificial Sequence
  Synthetic
gggagtcctagtgaggcttccaatgttgttttgtggattttcggtttcctcttcttggtcgtcatcgtcggacgt

SEQ ID NO: 167599 - DNA, 75 bp, Artificial Sequence
  Synthetic
aataaagagtagcggcggttctgatagggcgaccgctgaagcgagctgcgtgtgcgtgccgtctgtgttccccgc

SEQ ID NO: 167600 - DNA, 75 bp, Artificial Sequence
  Synthetic
caggttctgacggggaatccgctgttgtagacgtttaaccgcccgttccaggcgagagctcatgccgcaccagac

SEQ ID NO: 167601 - DNA, 75 bp, Artificial Sequence
  Synthetic
ggcgagagctcatgccgcaccagacgctgtaacgccgcacgggcccgtagcgggctgtttgttcgcgtacatgat

SEQ ID NO: 167602 - DNA, 75 bp, Artificial Sequence
  Synthetic
cccaactgacatcggcggtgccagagacttcgtccagactgttacgcatagagcaccagtcgggtcggacgataa

SEQ ID NO: 167603 - DNA, 75 bp, Artificial Sequence
  Synthetic
gagcaccagtcgggtcggacgataaacctgtccttgcggattaaccatttataacgtagttcgtgatggcgtgta

SEQ ID NO: 167604 - DNA, 75 bp, Artificial Sequence
  Synthetic
aatggttccggtacggttctccaggctggctttattcctcggaaccaatatgcaccgttaccagcaattatcatc

SEQ ID NO: 167605 - DNA, 75 bp, Artificial Sequence
  Synthetic
tccagacgttcggcgtcgtccacggcgtagtgaaaacgccggccggcctggtaaattttgagcagacccacggtt

SEQ ID NO: 167606 - DNA, 75 bp, Artificial Sequence
  Synthetic
cgtagtgaaaacgccggccggcctggtaaattttgagcagacccacggttaacaacatatccacgctgtcagcca

SEQ ID NO: 167607 - DNA, 75 bp, Artificial Sequence
  Synthetic
cgtgaaagacgccggagggtagcgactcgcccaccacacccattatcatggtttcacagcataagcggtccacaa

SEQ ID NO: 167608 - DNA, 75 bp, Artificial Sequence
  Synthetic
ctcgcccaccacacccattatcatggtttcacagcataagcggtccacaaagaacttcaacaggtcgttgaattg

SEQ ID NO: 167609 - DNA, 75 bp, Artificial Sequence
  Synthetic
cacgtcgctgtttttgttcacaactcaaggaggttcatcgaacgccgtcgaaccaaccaaaaaacccctaaagct

SEQ ID NO: 167610 - DNA, 75 bp, Artificial Sequence
  Synthetic
catctcgcctggagtgcgcagaggcacgcattcgccgcgataacgacaggtcacacgctgcagttcgctgatgct

SEQ ID NO: 167611 - DNA, 75 bp, Artificial Sequence
  Synthetic
acgcattcgccgcgataacgacaggtcacacgctgcagttcgctgatgctgttgtcgtgcaggcgaaggtcgcag

SEQ ID NO: 167612 - DNA, 75 bp, Artificial Sequence
  Synthetic
tggttttatcggtagtggcaagttccaacaatacgtcgactgctagcacaccgcgtccctctagttctactcacg

SEQ ID NO: 167613 - DNA, 75 bp, Artificial Sequence
  Synthetic
aatttcctctacatatacgaaaaagtcgtcatcgtccgagtcctcgtcctcagaagaggaccgcggcccgtgtac

SEQ ID NO: 167614 - DNA, 75 bp, Artificial Sequence
  Synthetic
actcttcgcagcagatgagctgaccccagggcgtttcgggcccgtcggtgacagccgcgctgccaaagatgtcct

SEQ ID NO: 167615 - DNA, 75 bp, Artificial Sequence
  Synthetic
ccttcgcaacgatatggcgcggacgccgcatccgaagcgctggaccctcacgcatttcacctactactcaacacc

SEQ ID NO: 167616 - DNA, 75 bp, Artificial Sequence
  Synthetic
agactggcgcatggtgccgcggcgtggagcggcacttggcagcctattttatggagtttcttcagtgacgtggct

SEQ ID NO: 167617 - DNA, 75 bp, Artificial Sequence
  Synthetic
agcagtttctgaaccaggtagatctgaccgaaaccctagaaagataccaacagagacttaacacctacgcattgg

SEQ ID NO: 167618 - DNA, 75 bp, Artificial Sequence
  Synthetic
ggagcggcacttggcagcctattttatggagtttcttcagtgacgtggcttgttcacgtcgttcgtgggctgcgg

SEQ ID NO: 167619 - DNA, 75 bp, Artificial Sequence
  Synthetic
ccaccgtgccaccgcccattgatctgtcaatacctcacgtttggatgccaccccaaaccactccacacgactgga

SEQ ID NO: 167620 - DNA, 75 bp, Artificial Sequence
  Synthetic
acatcggccacactttaaccagacctgtatcctctttgatggacacgatctgcttttcagcaccgttacgccctg

SEQ ID NO: 167621 - DNA, 75 bp, Artificial Sequence
  Synthetic
cgtagatgtggcaacccgcgttacagcagcggtagcactataagtcacgttagtggtgacgttgaaagcggtaga

SEQ ID NO: 167622 - DNA, 75 bp, Artificial Sequence
  Synthetic
tcggactttctcgacgccgcactcgacttcaactacctggacctcagcgcactgttacgtaacagctttcaccgt

SEQ ID NO: 167623 - DNA, 75 bp, Artificial Sequence
  Synthetic
tatgccaagcatcaccccaaactcagccgagaggtggtttgttcgggactcaacgcttgtttctacatctgtctt

SEQ ID NO: 167624 - DNA, 75 bp, Artificial Sequence
  Synthetic
actgttacgtaacagctttcaccgttacgctgtagacgtactcaaaagcggtcgatgtcaaatgttggaccgccg

SEQ ID NO: 167625 - DNA, 75 bp, Artificial Sequence
  Synthetic
gccgagaggtggtttgttcgggactcaacgcttgtttctacatctgtctttttgccggcgtttgttttctcatca

SEQ ID NO: 167626 - DNA, 75 bp, Artificial Sequence
  Synthetic
ctatgtacagttttgtgttccaacgtggtacgttgaaaaacataggattaaacgtggtgaaattaccgcaacctt

SEQ ID NO: 167627 - DNA, 75 bp, Artificial Sequence
  Synthetic
tggtacgttgaaaaacataggattaaacgtggtgaaattaccgcaacctttttcgccggtatcattgcgtttgga

SEQ ID NO: 167628 - DNA, 75 bp, Artificial Sequence
  Synthetic
gtcatcttcgactataaggatcgcgaccgagtcttcggccatgctaaacgctaccctgtgtggctggtatgtaac

SEQ ID NO: 167629 - DNA, 75 bp, Artificial Sequence
  Synthetic
ggccgtgtgattatattcggaatatacgtacttggctggttttcggagttgagtactgtaaaagtcaaaccacat

SEQ ID NO: 167630 - DNA, 75 bp, Artificial Sequence
  Synthetic
acgtacttggctggttttcggagttgagtactgtaaaagtcaaaccacatatgggtaatgctatcatttctaatg

SEQ ID NO: 167631 - DNA, 75 bp, Artificial Sequence
  Synthetic
tttgcggctacctggcgcccatcgtgctgatggcgtacacgtacaaccgtatggtgcggtttatcattaactacg

SEQ ID NO: 167632 - DNA, 75 bp, Artificial Sequence
  Synthetic
tacattaaaaaccggtatccgtcagatgatgtagacatcaatcgttttaagatatcttccttctgtttcttcaga

SEQ ID NO: 167633 - DNA, 75 bp, Artificial Sequence
  Synthetic
tcctctggagtttaccaatacattacaatttatgagggaaaggagcaagaacgttatagagatcaggagcataat

SEQ ID NO: 167634 - DNA, 75 bp, Artificial Sequence
  Synthetic
aaatggaagcgaataagcgcgaccggcagcaccagttggccacgaccacgaatcaccgtcggcggggcggactgc

SEQ ID NO: 167635 - DNA, 75 bp, Artificial Sequence
  Synthetic
ttagcgcgtgacctgttacgagaagaaatggaagcgaataagcgcgaccggcagcaccagttggccacgaccacg

SEQ ID NO: 167636 - DNA, 75 bp, Artificial Sequence
  Synthetic
tgctgcgtgaagcaggagataccttaccaggacattgatattgagctacaaaaggacatacaaagaagggccaaa

SEQ ID NO: 167637 - DNA, 75 bp, Artificial Sequence
  Synthetic
accaggacattgatattgagctacaaaaggacatacaaagaagggccaaacacaccaaacgtacccattatgaca

SEQ ID NO: 167638 - DNA, 75 bp, Artificial Sequence
  Synthetic
catctatttttgctaattgcacgtttcttcgtggtcacgtcggctcgaagaggttggtgtgaaaacgtcatctcg

SEQ ID NO: 167639 - DNA, 75 bp, Artificial Sequence
  Synthetic
accaaaccggacgctgcctcagtctctcggtgcgtggaccagacggcgtccatgcaccgagggcagaactggtgc

SEQ ID NO: 167640 - DNA, 75 bp, Artificial Sequence
  Synthetic
atcacctggcgacgtcggattcaatgctccggcgatgtttactttatcaacctcgcggccgccgatttgcttttc

SEQ ID NO: 167641 - DNA, 75 bp, Artificial Sequence
  Synthetic
gctccggcgatgtttactttatcaacctcgcggccgccgatttgcttttcgtttgtacactacctctgtggatgc

SEQ ID NO: 167642 - DNA, 75 bp, Artificial Sequence
  Synthetic
atgatgtccgtctacgcgctatcggccatcatcggcatctatctgctctaccgcatgctcaagacatgctgactg

SEQ ID NO: 167643 - DNA, 75 bp, Artificial Sequence
  Synthetic
ttgccagtttgtgttttatcacggaaattgcactcgatcgctactacgctattgtttacatgagataccggcctg

SEQ ID NO: 167644 - DNA, 75 bp, Artificial Sequence
  Synthetic
aattgcactcgatcgctactacgctattgtttacatgagataccggcctgtaaaacaggcctgccttttcagtat

SEQ ID NO: 167645 - DNA, 75 bp, Artificial Sequence
  Synthetic
gaccgactacgactacttagaggtcagttacccgatcatcctcaacgtagaactcatgctcggtgctttcgtgat

SEQ ID NO: 167646 - DNA, 75 bp, Artificial Sequence
  Synthetic
aactcatgctcggtgctttcgtgatcccgctcagcgtcatcagctactgctactaccgcatttccagaatcgttg

SEQ ID NO: 167647 - DNA, 75 bp, Artificial Sequence
  Synthetic
aatcagcagtgagtacacgcaggcaagccaaaccacaaggcagacggacggtgcggggtctcctcctctgtcatg

SEQ ID NO: 167648 - DNA, 75 bp, Artificial Sequence
  Synthetic
agccaaaccacaaggcagacggacggtgcggggtctcctcctctgtcatggggagaaaagagatgatggtgagag

SEQ ID NO: 167649 - DNA, 75 bp, Artificial Sequence
  Synthetic
aagcgctttataatcgtccttggaggggcttggtactgtctaagataggcaaatataaattagatcagcttaagt

SEQ ID NO: 167650 - DNA, 75 bp, Artificial Sequence
  Synthetic
tagaaattttgagacaactagaaacgactatttctacaaaatacaatgtaagtaaacaaccggttaaaaatctca

SEQ ID NO: 167651 - DNA, 75 bp, Artificial Sequence
  Synthetic
ggtttgatttttatagtacccagcttagaaaacccgcaaaatacgtttactcacagtacaatcatacggctaaaa

SEQ ID NO: 167652 - DNA, 75 bp, Artificial Sequence
  Synthetic
tggtactgtgccttccatgacttgtctttccgaaatgctaaacgtttccaaacgtaatgatactggcgaacaagg

SEQ ID NO: 167653 - DNA, 75 bp, Artificial Sequence
  Synthetic
cccgtgcccgatatatacgatattaaacccacgaccatttccgtgcgattagcgaaccggaaaagtttatgggga

SEQ ID NO: 167654 - DNA, 75 bp, Artificial Sequence
  Synthetic
ctgtttgattccccggggaaaagaggaagaagtccccaggggacggcagcgcgggtccctggggacacacgaaga

SEQ ID NO: 167655 - DNA, 75 bp, Artificial Sequence
  Synthetic
ctacgaagaagtcctcggtcagtgtgattttaacgtaacgtagttcgtcgatgaggtaaaagccttggtgcaaac

SEQ ID NO: 167656 - DNA, 75 bp, Artificial Sequence
  Synthetic
gacggtgggtttcgtcgcgcccacggtccgggcacaatcaaccgtggtccgctctgagccggctccgccgtcgga

SEQ ID NO: 167657 - DNA, 75 bp, Artificial Sequence
  Synthetic
tcacgtttggatgtgctcggaccgtgacggtgggtttcgtcgcgcccacggtccgggcacaatcaaccgtggtcc

SEQ ID NO: 167658 - DNA, 75 bp, Artificial Sequence
  Synthetic
ttcgcgtccccaagtatattaacggcaccaagttaaaaaacactatgcgaaaactaaaacgtaaacaagcgcccg

SEQ ID NO: 167659 - DNA, 75 bp, Artificial Sequence
  Synthetic
caccaagttaaaaaacactatgcgaaaactaaaacgtaaacaagcgcccgttaaggaacaattcgaaaaaaaagc

SEQ ID NO: 167660 - DNA, 75 bp, Artificial Sequence
  Synthetic
agtggaccgtcaatttcgacggaccacgtacgaccgttgggacggtcgacgttggctgcgcacccgctacgggaa

SEQ ID NO: 167661 - DNA, 75 bp, Artificial Sequence
  Synthetic
gacttatagtattactaccgccgcaaggcgggtttccacgtctacaattgcttatcgtcctgatagcagctttat

SEQ ID NO: 167662 - DNA, 75 bp, Artificial Sequence
  Synthetic
caatggagcaccaacttttttttctctcagtgtgagcactaccctagtttcgtgaaactcaacggggtgcagcgc

SEQ ID NO: 167663 - DNA, 75 bp, Artificial Sequence
  Synthetic
aggcgggtttccacgtctacaattgcttatcgtcctgatagcagctttatgaagtccattatggccacacagtta

SEQ ID NO: 167664 - DNA, 75 bp, Artificial Sequence
  Synthetic
tggacacctgttcggagacctatgggcgaggttgcctactacgggggttgttgtatggtgggcgggggtaatcgt

SEQ ID NO: 167665 - DNA, 75 bp, Artificial Sequence
  Synthetic
accgccgtgtcagaatttatgaaaaacacgcacgtactaatccgtaacgaaacgccgtacactatttacggtact

SEQ ID NO: 167666 - DNA, 75 bp, Artificial Sequence
  Synthetic
aactgcacggcgccgaaacgcacctaccctcggcgcctggaactgcacgatggccgcacagaccctagccgttgc

SEQ ID NO: 167667 - DNA, 75 bp, Artificial Sequence
  Synthetic
accctcggcgcctggaactgcacgatggccgcacagaccctagccgttgcgatccctaccaagtgtatttctacg

SEQ ID NO: 167668 - DNA, 75 bp, Artificial Sequence
  Synthetic
acgcccgcgacacacccggcacacacccacccagccgcgccccgacacacccaacccgacgccggtgcgggacgg

SEQ ID NO: 167669 - DNA, 75 bp, Artificial Sequence
  Synthetic
acacctacgtcaccatcaatggggtttcagagaacatttatagatcccctgtgggactatctagactcgctgctg

SEQ ID NO: 167670 - DNA, 75 bp, Artificial Sequence
  Synthetic
gctggggacggggtttcaccgcgctgagggatctctctacgggtgtttccacggcgcttctacgcggcgcttcgc

SEQ ID NO: 167671 - DNA, 75 bp, Artificial Sequence
  Synthetic
gtcccaccccgtcccggccccaccggcatgacttggagaacgagctacatggtctgtgtgtggatcttctggtgt

SEQ ID NO: 167672 - DNA, 75 bp, Artificial Sequence
  Synthetic
gcatgacttggagaacgagctacatggtctgtgtgtggatcttctggtgtgcgtccttttattagctctgctgct

SEQ ID NO: 167673 - DNA, 75 bp, Artificial Sequence
  Synthetic
gccgccggcgggaacggcgtgttgcggggacgggggttgcgctggcccggggtgttgcacggacggaggtggcgg

SEQ ID NO: 167674 - DNA, 75 bp, Artificial Sequence
  Synthetic
gcctttggtggtggttgcagtaaagttctggaagcagcaatgtcgtagtacaatacaaaaagctcccatgagaat

SEQ ID NO: 167675 - DNA, 75 bp, Artificial Sequence
  Synthetic
ttccaaggtggatcgcgccgtcaagctgtgtcttcggcgcatgctgggtctgccgccgccaccgtcagtcgcacc

SEQ ID NO: 167676 - DNA, 75 bp, Artificial Sequence
  Synthetic
tacgttcaggacggggactcaccctcgcctatttaacctccacccacttcaacacacacatgccgcacaatcatg

SEQ ID NO: 167677 - DNA, 75 bp, Artificial Sequence
  Synthetic
cttgtaaaaatcatcgttcgcatgtcgtctcatcacattaggatcgtgggtggtagaactgagtttagtgctagt

SEQ ID NO: 167678 - DNA, 75 bp, Artificial Sequence
  Synthetic
tacaagagactagacaacagatgaccgagactagcgagcggctggatcgctcgctgcgccaggatcccgggagca

SEQ ID NO: 167679 - DNA, 75 bp, Artificial Sequence
  Synthetic
gctcaggcggccttgtcgccgccactgaccacctggtcactaccgccgtttccgtccacgcggatacctgacagt

SEQ ID NO: 167680 - DNA, 75 bp, Artificial Sequence
  Synthetic
ttgttagtttggtagttgatacgctagcagaagactttgatgtagttgcagaggttgacgtggatgaattgttac

SEQ ID NO: 167681 - DNA, 75 bp, Artificial Sequence
  Synthetic
cacgctgctgttatatacgtcatccgacatcggtgacacagcttcagaaacaacgtgtgtggcgcacgctactta

SEQ ID NO: 167682 - DNA, 75 bp, Artificial Sequence
  Synthetic
gacatcggtgacacagcttcagaaacaacgtgtgtggcgcacgctacttatggggaacccccggagcccgctcga

SEQ ID NO: 167683 - DNA, 75 bp, Artificial Sequence
  Synthetic
tctgaaggccaagaccatggagatgcggttcaccatagcctggatgtggtttcccagtgtgctgctgatactggg

SEQ ID NO: 167684 - DNA, 75 bp, Artificial Sequence
  Synthetic
cggttcaccatagcctggatgtggtttcccagtgtgctgctgatactggggttgttgacgcctccgagtaacggt

SEQ ID NO: 167685 - DNA, 75 bp, Artificial Sequence
  Synthetic
acacgcagaggcgatcgcccaggggaggggggggggtcgcggaccccggggcacactgcttccatccagccgcgc

SEQ ID NO: 167686 - DNA, 75 bp, Artificial Sequence
  Synthetic
ttgagtatacggttaatgtatcctggggaaaaaaatacacaacagctgttgggttctgatttcagttgcgaacgt

SEQ ID NO: 167687 - DNA, 75 bp, Artificial Sequence
  Synthetic
gtcctcagcgcttttgtggtgtggatcggatccggcctcaatatcatctggtggaccggcatcgtgcttctggcg

SEQ ID NO: 167688 - DNA, 75 bp, Artificial Sequence
  Synthetic
ccgggataaacatcacgcatcgcgaaccgcggcgctccagtgtcaacgcgacatgttacttcggcaacgtcgacg

SEQ ID NO: 167689 - DNA, 75 bp, Artificial Sequence
  Synthetic
accgcggcgctccagtgtcaacgcgacatgttacttcggcaacgtcgacgggctcggcggctgcacgcagtttct

SEQ ID NO: 167690 - DNA, 75 bp, Artificial Sequence
  Synthetic
acacatcagctgattgtgctgccccctcctgtagcgtcagctcctcctgcagttccctcgcagccccccgagtat

SEQ ID NO: 167691 - DNA, 75 bp, Artificial Sequence
  Synthetic
gtgggcggccccgggctgagggcgttttgcgctgaggcagctagggggttttgcgggcgtgctgggcgccgaccg

SEQ ID NO: 167692 - DNA, 75 bp, Artificial Sequence
  Synthetic
caagttcgatctcatgtcgctcttggagcgcgaagagagttggcgtcgcgtagtcgactactcgcacaacctgtg

SEQ ID NO: 167693 - DNA, 75 bp, Artificial Sequence
  Synthetic
gagcgcgaagagagttggcgtcgcgtagtcgactactcgcacaacctgtggtgtacgtgcggtaactggcagagc

SEQ ID NO: 167694 - DNA, 75 bp, Artificial Sequence
  Synthetic
ttgcgggcgtgctgggcgccgaccggaccgagcgcactgccggtgcgtgccttcgtgcgcactgccgctgcgtgt

SEQ ID NO: 167695 - DNA, 75 bp, Artificial Sequence
  Synthetic
cagtggcaggcccgggttcgcgattctcacgatcgctggtgtctctgcaacgcctggcgtgatcacgccttgcgc

SEQ ID NO: 167696 - DNA, 75 bp, Artificial Sequence
  Synthetic
ctcacgatcgctggtgtctctgcaacgcctggcgtgatcacgccttgcgcggccgttggggtacggcgtattcct

SEQ ID NO: 167697 - DNA, 75 bp, Artificial Sequence
  Synthetic
cttgtcgtttcggcagtacggcgcgggatctttctgcgggagtttgcacggcgcttttgcgcgaccctcggtctt

SEQ ID NO: 167698 - DNA, 75 bp, Artificial Sequence
  Synthetic
cccggcgctggttgtttcgccgccggcgagctcgatacactccgtctaactgtggggaaagtagcactagcagcg

SEQ ID NO: 167699 - DNA, 75 bp, Artificial Sequence
  Synthetic
gcgagctcgatacactccgtctaactgtggggaaagtagcactagcagcggccagagtagcggtgacgagagtaa

SEQ ID NO: 167700 - DNA, 75 bp, Artificial Sequence
  Synthetic
ctacatcaaccggatatctgcggggatttaaaaagacgacccgttgtcatccggcttagagcaaaccgtcctttt

SEQ ID NO: 167701 - DNA, 75 bp, Artificial Sequence
  Synthetic
tcaggactggaagtgtcacgcgttatacgccgagtgggacggtaaagaatccgacgacgagtcgtcggcgtcttc

SEQ ID NO: 167702 - DNA, 75 bp, Artificial Sequence
  Synthetic
acgagcacgcctccgagggctggcggttttgcagtcgacgggaacggcgagaggacgatcttcgcacgcgggctg

SEQ ID NO: 167703 - DNA, 75 bp, Artificial Sequence
  Synthetic
ccaaacgcgtgcgggtgcatgacccgttgggattgacgcggtttatcatgaggcaactcatgatgtacccgctgg

SEQ ID NO: 167704 - DNA, 75 bp, Artificial Sequence
  Synthetic
gttgggattgacgcggtttatcatgaggcaactcatgatgtacccgctggtgttgccgtttacttttccgtttta

SEQ ID NO: 167705 - DNA, 75 bp, Artificial Sequence
  Synthetic
acgtcaataccacgtcaaaccaccgtgacttggctgaacgttgaaacataaagccaaagcgccgtcggcacttgg

SEQ ID NO: 167706 - DNA, 75 bp, Artificial Sequence
  Synthetic
aagccaaagcgccgtcggcacttggcttcagagcagcgcctcggggcgatgcgacggcgatgaacttagagcaac

SEQ ID NO: 167707 - DNA, 75 bp, Artificial Sequence
  Synthetic
atcatctgtaagttatgaaatgttcaatacgacaattaataatacacaagaccgtgataaatgccaactaataaa

SEQ ID NO: 167708 - DNA, 75 bp, Artificial Sequence
  Synthetic
tcgtttatcgtgagcttcatgatttctacgggtatctgcagctggaccttctgggaccagtggtggcggggaatc

SEQ ID NO: 167709 - DNA, 75 bp, Artificial Sequence
  Synthetic
gtatcggggctccgacgccttatccgccggcttgtatcgtcccgaagaagaggtgttcctcctcttgaaccgctg

SEQ ID NO: 167710 - DNA, 75 bp, Artificial Sequence
  Synthetic
cttcaatgtcggtgattttcacggagcgtcatgggaaaacggtaccgctcccgatggagagcccggggtatgctg

SEQ ID NO: 167711 - DNA, 75 bp, Artificial Sequence
  Synthetic
gttttgttcaccgtcgctgtgcaacgcgtgaaacaagagcgtgatgcgcaccttcggcggtatgaagaacggtta

SEQ ID NO: 167712 - DNA, 75 bp, Artificial Sequence
  Synthetic
atgccgatgtgtgactaaaaacgtcccagccccagagcgatatgtttcaataaaaaaatatgtagtatcatatta

SEQ ID NO: 167713 - DNA, 75 bp, Artificial Sequence
  Synthetic
taaaaaaatatgtagtatcatattatgcgtgtcctggtttttcatttttggatgtatgtatcgcataaagggtgg

SEQ ID NO: 167714 - DNA, 75 bp, Artificial Sequence
  Synthetic
cgaggtgtgaggatgaaacatatgcagatacgcagttttgttatccgaacgaaacccgtgtaatgcgtacaacgg

SEQ ID NO: 167715 - DNA, 75 bp, Artificial Sequence
  Synthetic
tttgccgttgggcgtacgctacgtttgtatttctgactataatgtgtgcggtcatgtgtcgatgttcctattggg

SEQ ID NO: 167716 - DNA, 75 bp, Artificial Sequence
  Synthetic
gtcatgtgtcgatgttcctattgggaagggtgtgactgtagggtgtataacgtacggtgggacgcagagggacat

SEQ ID NO: 167717 - DNA, 75 bp, Artificial Sequence
  Synthetic
tgatagaaacaggttgagcgctgtacgagtttcacacgctgaatcggcgccaagaataaaacagtggttattcgt

SEQ ID NO: 167718 - DNA, 75 bp, Artificial Sequence
  Synthetic
tttttgtgttcaatggttacattgtcaccacttttaacctctactttattgaaacccgcaccttcatgtataaac

SEQ ID NO: 167719 - DNA, 75 bp, Artificial Sequence
  Synthetic
acggttgttagatgcattgcgtatcggtattagtagttttgcaagccgtggtgcgtgttattgtgacgtagcaat

SEQ ID NO: 167720 - DNA, 75 bp, Artificial Sequence
  Synthetic
tatcgtattgtgcatgtgtcgttcatcacagagtttagtatactaatatgaagcgtcgcgagtattaaagtaatt

SEQ ID NO: 167721 - DNA, 75 bp, Artificial Sequence
  Synthetic
gcttgcagccagaaccagcttatgtaccagccacgataacatccggtgattgtttccacaggaaatcctaccagg

SEQ ID NO: 167722 - DNA, 75 bp, Artificial Sequence
  Synthetic
tcgaaacataacgacagctgcaaaagaaaaccagtttattgagcattgtaatggtagtgtgtggctacattagaa

SEQ ID NO: 167723 - DNA, 75 bp, Artificial Sequence
  Synthetic
gtaggtgctacttacctttatcgtcggaggggaaagcgctaagataccccacctgagtgaaaggacctttgcagt

SEQ ID NO: 167724 - DNA, 75 bp, Artificial Sequence
  Synthetic
cagaggaactatctcaagggtaattgcactcaatggtccgtcatatatagcgggtttcagacccccgtcacccac

SEQ ID NO: 167725 - DNA, 75 bp, Artificial Sequence
  Synthetic
gagacggagcatatagtccagtatccagcggttcctgagtagcaccacccatcaactgaatgccctcatgagtaa

SEQ ID NO: 167726 - DNA, 75 bp, Artificial Sequence
  Synthetic
tatcatctggccgccggcctccataaccaccgtggccaagtccagtcccagagcttgagcgtcggcgcggcgtcg

SEQ ID NO: 167727 - DNA, 75 bp, Artificial Sequence
  Synthetic
accaccgtggccaagtccagtcccagagcttgagcgtcggcgcggcgtcgggcgtcttgcaggtagtcttccaca

SEQ ID NO: 167728 - DNA, 75 bp, Artificial Sequence
  Synthetic
gctaactgcccgtgcggctcgcgcgcccacagcgcggcgcgcgggtgcaggtgcagcgcgtcccagcgcggccgc

SEQ ID NO: 167729 - DNA, 75 bp, Artificial Sequence
  Synthetic
cccacagcgcggcgcgcgggtgcaggtgcagcgcgtcccagcgcggccgctcccactgctcgcggtccagctcgg

SEQ ID NO: 167730 - DNA, 75 bp, Artificial Sequence
  Synthetic
gcagaaagtgcgacagctccgccgccagcgggtacacgtgtccgtccagcgggcagtacccgaacacggcgccca

SEQ ID NO: 167731 - DNA, 75 bp, Artificial Sequence
  Synthetic
gctcgtccagcagcaccaccagcatggcgcgcggcacggtgtccgacgccgccggacccgccatcgccgccggac

SEQ ID NO: 167732 - DNA, 75 bp, Artificial Sequence
  Synthetic
cggggtgcggcgccgacgcgaacggctcgtactgcgccagctcttgccacgcgcccagcagcaccatcggctgca

SEQ ID NO: 167733 - DNA, 75 bp, Artificial Sequence
  Synthetic
ggatcagcgtgttgttcgccaggtcgtacacgaacacgcggaacccggcgcccagcgccaggtacagtccgtcct

SEQ ID NO: 167734 - DNA, 75 bp, Artificial Sequence
  Synthetic
gaatccgtacggccgtccgagcggcagcagcgtgcccgcgtcgcgctgcgaccacttgcgcatggcgcggcccgt

SEQ ID NO: 167735 - DNA, 75 bp, Artificial Sequence
  Synthetic
agcagcgtgcccgcgtcgcgctgcgaccacttgcgcatggcgcggcccgtgctgttggccaaaaacgccgcgcgc

SEQ ID NO: 167736 - DNA, 75 bp, Artificial Sequence
  Synthetic
ctcgccacccggcaccagcagggtggagtagcagaggttgtgagccatgatgatggaagggtagaggctggcaaa

SEQ ID NO: 167737 - DNA, 75 bp, Artificial Sequence
  Synthetic
tgttgttgccgctacccggaggggcgcccggcggcccgcggggttctacccggtggacggcgtgggccggcgtcg

SEQ ID NO: 167738 - DNA, 75 bp, Artificial Sequence
  Synthetic
gacatgccgttgcgctgggctatggccgtcggacacctccgacgtccactatataggaagcaaacccgcgtcagc

SEQ ID NO: 167739 - DNA, 75 bp, Artificial Sequence
  Synthetic
cagcaaccacaagagaagaccgacgaacacaaggaagaacacaccaaagaaaatgaaaagacccagtaacagcag

SEQ ID NO: 167740 - DNA, 75 bp, Artificial Sequence
  Synthetic
agcgcgcggaaacaccgtcccgcagcccggtgccgccaacaaataccgtgggacgacacgcaccggcagtgcgca

SEQ ID NO: 167741 - DNA, 75 bp, Artificial Sequence
  Synthetic
aggtaaaaacaacgtgtgtgataaacgtgggtttttacctatgggaaaggggagggtgtaaacatgagtctccgt

SEQ ID NO: 167742 - DNA, 75 bp, Artificial Sequence
  Synthetic
cggtgtttctgttcgatgtacgtaccacggtacggacattaacgtcacttccaacgccacgagtatgaactgcct

SEQ ID NO: 167743 - DNA, 75 bp, Artificial Sequence
  Synthetic
cacggtacggacattaacgtcacttccaacgccacgagtatgaactgcctgttaaactgcacgtgcaatcatacg

SEQ ID NO: 167744 - DNA, 75 bp, Artificial Sequence
  Synthetic
cagtggcacagcgtcatgctcacgtttggttttcagtaccacctggaaggctggtttcccctgcgcatcctgaac

SEQ ID NO: 167745 - DNA, 75 bp, Artificial Sequence
  Synthetic
ttggttttcagtaccacctggaaggctggtttcccctgcgcatcctgaacgagagccgcgatatcaacgtcaccg

SEQ ID NO: 167746 - DNA, 75 bp, Artificial Sequence
  Synthetic
gccgcagttacgtattgcgagcactggcgcgcacgagtccgtttgagtcatccgtaaattgggaggaaaccaacg

SEQ ID NO: 167747 - DNA, 75 bp, Artificial Sequence
  Synthetic
ggcgcgcacgagtccgtttgagtcatccgtaaattgggaggaaaccaacgtcaccgacaacgtgacttcttcaga

SEQ ID NO: 167748 - DNA, 75 bp, Artificial Sequence
  Synthetic
tccgcgatttctcaagaggagcgttaagcttacaaaaaacaataaaaaaaacacaacgtttacgggaactaacat

SEQ ID NO: 167749 - DNA, 75 bp, Artificial Sequence
  Synthetic
cgacggccagagacaagacgcggaaaagaggaagtccccggggacggtcgcgcgcggaaaaggggaagcgctcgg

SEQ ID NO: 167750 - DNA, 75 bp, Artificial Sequence
  Synthetic
tttgcttgataccttgccagaacaccaccagaccgcctgtggtttcaaaaaccgacacgttaccgtacttttcgt

SEQ ID NO: 167751 - DNA, 75 bp, Artificial Sequence
  Synthetic
cgagtactgcgggtacggcgacgccgggccacggcgtccaccgggtagaaccccgcggcccgccgggcgcccctc

SEQ ID NO: 167752 - DNA, 75 bp, Artificial Sequence
  Synthetic
ctgccggtgcgtgcggctctgagggagtgttgcggggacataagtaagcgcggcggtgtcctcagcgcgtttgcg

SEQ ID NO: 167753 - DNA, 75 bp, Artificial Sequence
  Synthetic
tatcatttgtctacaagcacctcgaaaagtctacgatcgctggaaagacagtaaacagtacggacaagtgtttgt

SEQ ID NO: 167754 - DNA, 75 bp, Artificial Sequence
  Synthetic
gaccgagtcttcggacatggtaagagccacccaatgtggctggtatgtagcgtatccggtttggaatcgttcggc

SEQ ID NO: 167755 - DNA, 75 bp, Artificial Sequence
  Synthetic
ataaatgaattgctagatacagggttctttgtgtactagcccaatcatgtcaatacaatgtgtacagaaaaaaga

SEQ ID NO: 167756 - DNA, 75 bp, Artificial Sequence
  Synthetic
ccctgccgtcatattgtcgtctcgatttttttcggccgtctgcacccgtatcggttcacgggttttccacggcaa

SEQ ID NO: 167757 - DNA, 75 bp, Artificial Sequence
  Synthetic
gggccggcttgtcggcgattgtcgcgacatatcgttatcagttagcgaccggagttgtctatcgcgacatatcgt

SEQ ID NO: 167758 - DNA, 75 bp, Artificial Sequence
  Synthetic
gtacggcacaacaacccgcgtcgaggacacacgcacaagaagctcgcgggcgcaagggaggggggggggagtcgc

SEQ ID NO: 167759 - DNA, 75 bp, Artificial Sequence
  Synthetic
tgccgtcgagccggggcgtcgcccgtccccaccaccgtccacccggcccacctaccgtcgtcgtcggccgaccgc

SEQ ID NO: 167760 - DNA, 75 bp, Artificial Sequence
  Synthetic
gacacacgcacaagaagctcgcgggcgcaagggaggggggggggagtcgcgggccccggggacacacgcagacac

SEQ ID NO: 167761 - DNA, 75 bp, Artificial Sequence
  Synthetic
acgctgggcttgacggcggggtgtgcggggccggggggtgtgcgtgggtgtgcggggccgggggtgtgcagggac

SEQ ID NO: 167762 - DNA, 75 bp, Artificial Sequence
  Synthetic
cagaatagatacgtacgtttatttttcagatcactgtttgaataccgtaagcataatgacgtgcatgtacgtgat

SEQ ID NO: 167763 - DNA, 75 bp, Artificial Sequence
  Synthetic
acgaagcagcagggcggaacggtttatgataaaaagtcacaggaaagtgtgttgttttttaatgtaccaagaata

SEQ ID NO: 167764 - DNA, 75 bp, Artificial Sequence
  Synthetic
gtgcggccgcccagtggaaaaataccggcgcatgcgcacggcgcacatctagtggaattttaccgacgcatgcgc

SEQ ID NO: 167765 - DNA, 75 bp, Artificial Sequence
  Synthetic
gggcgaccctcccgcgggccctggcccgcgcatgcgccccggggcccctggttcacccctccttatatataggtt

SEQ ID NO: 167766 - DNA, 75 bp, Artificial Sequence
  Synthetic
atacatacacgcgtgcatgctgcatgggtggatggtccgaccgggagacgcggaagagaaactcacataaaaagg

SEQ ID NO: 167767 - DNA, 75 bp, Artificial Sequence
  Synthetic
acacccctgacacacccgccacacgcccgcgacacacccggcacgcgccgccgacactcccctgacacacccagc

SEQ ID NO: 167768 - DNA, 75 bp, Artificial Sequence
  Synthetic
ttaaagtgattaacgtatgatatttgttccccagagttatactatagtcatcatcctaaaattcagatataaatg

SEQ ID NO: 167769 - DNA, 75 bp, Artificial Sequence
  Synthetic
gacgggggtgtgcgggacgggggtgtgcgggacgggggtgtgcgggacgggggtgtgcggggacggggggtgtgc

SEQ ID NO: 167770 - DNA, 75 bp, Artificial Sequence
  Synthetic
ttttatcattaaaccccaatattaaacacttttttagtaccccccacccaccaaaaaatgtgactggaccggttc

SEQ ID NO: 167771 - DNA, 75 bp, Artificial Sequence
  Synthetic
ggttgaaccacagctacagcgaaaccgagtccagtgaccggtaaccacgtccagcccctgcgtatgtaccagtcc

SEQ ID NO: 167772 - DNA, 75 bp, Artificial Sequence
  Synthetic
cgagtccagtgaccggtaaccacgtccagcccctgcgtatgtaccagtccaagcacgtccggtcattgttctaca

SEQ ID NO: 167773 - DNA, 75 bp, Artificial Sequence
  Synthetic
ttagcagtcaaataccataattcaccgctgtactcgtctctattctctccaaaccaacgaccaagatcgacaacg

SEQ ID NO: 167774 - DNA, 75 bp, Artificial Sequence
  Synthetic
atcccaatggctccatctagtagtcatcggatcttttttgtgttcaatggttacattattaccactggtaacttc

SEQ ID NO: 167775 - DNA, 75 bp, Artificial Sequence
  Synthetic
aggaaagcgcggcggtccagcaactggccgcggaaacactgccgcatacgctgcagaaagtcatgacccagcagt

SEQ ID NO: 167776 - DNA, 75 bp, Artificial Sequence
  Synthetic
gtgaggtgttcacatttcgtggaccaggcggttgtggcgtaactgttgaagatcatgagagagatgtaaggtgtc

SEQ ID NO: 167777 - DNA, 75 bp, Artificial Sequence
  Synthetic
aggcggttgtggcgtaactgttgaagatcatgagagagatgtaaggtgtctgtagcgctacgaaggagatgagca

SEQ ID NO: 167778 - DNA, 75 bp, Artificial Sequence
  Synthetic
tttttcctgtccatcttgtttagcaactcgtaaactgtcagtctagccacgtccgtttagatcaaaagtcacgta

SEQ ID NO: 167779 - DNA, 75 bp, Artificial Sequence
  Synthetic
agaaccacgtcatcatgatcacgggtgcggcgccccacaccagcgtcagaagcaccttccacgaaagtagtactg

SEQ ID NO: 167780 - DNA, 75 bp, Artificial Sequence
  Synthetic
tgcggcgccccacaccagcgtcagaagcaccttccacgaaagtagtactgtgtgcacctcgtcggccacaaagta

SEQ ID NO: 167781 - DNA, 75 bp, Artificial Sequence
  Synthetic
agccgcgggcatggaaaaaattagcccggcgagccatgtcaatatcaaaattgtataggtggagcggtacgattg

SEQ ID NO: 167782 - DNA, 75 bp, Artificial Sequence
  Synthetic
ccggcgagccatgtcaatatcaaaattgtataggtggagcggtacgattggcgtgcgtaaattcgcttgtgaagg

SEQ ID NO: 167783 - DNA, 75 bp, Artificial Sequence
  Synthetic
caattacatatgccaccgaccgatcccaacgtaaaattgtttacgcctgtcacggtacaaaccgtggtctcatta

SEQ ID NO: 167784 - DNA, 75 bp, Artificial Sequence
  Synthetic
aggaatttgcacgaggccacgccggccggtagcagccactgattgctgagcacgataaagggtaacacggtaagc

SEQ ID NO: 167785 - DNA, 75 bp, Artificial Sequence
  Synthetic
agttgcgtgaccaacactatagcgttgagcggaccgcccacgaagatgataagcgtattgagcacggcttcggtg

SEQ ID NO: 167786 - DNA, 75 bp, Artificial Sequence
  Synthetic
tgagcggaccgcccacgaagatgataagcgtattgagcacggcttcggtggtgcggatggcgaacagcggccccg

SEQ ID NO: 167787 - DNA, 75 bp, Artificial Sequence
  Synthetic
cagtaaaccgcgcttgcacccagaaccagcttatgtatcagccacaataacatccggttattgtttccacaggaa

SEQ ID NO: 167788 - DNA, 75 bp, Artificial Sequence
  Synthetic
gtcggggagagggcctgtcggagatggccgtgaggcatcacgtacggcagctgaggagaaacggagaagaaagga

SEQ ID NO: 167789 - DNA, 75 bp, Artificial Sequence
  Synthetic
aagagccgccgtgccgccggttggtggctggcggcatctagagacatggtttggggggacaggcggcgcgaaaaa

SEQ ID NO: 167790 - DNA, 75 bp, Artificial Sequence
  Synthetic
tgcggtttgtgtttcccgccgcaaaagccccccgtccccgccgccaacccccgttgtcgcccgcaaaagcccccc

SEQ ID NO: 167791 - DNA, 75 bp, Artificial Sequence
  Synthetic
ggcgggtgtgtcagggtgtgtcgcgggtgtgttggcggggtgtgtcaggggtgtgtcggggtgtgttggcgggcc

SEQ ID NO: 167792 - DNA, 75 bp, Artificial Sequence
  Synthetic
atagtcttgctcttcgcgaacgatctcgtccggttcctcgcagtcttcgtggtccacagaagatgaggagcagga

SEQ ID NO: 167793 - DNA, 75 bp, Artificial Sequence
  Synthetic
gtcgcgggtgtgccgcgggcgtgtgccgggtgtgtcgggggtgtgcgcggctggatggaagctgtgcccggggcc

SEQ ID NO: 167794 - DNA, 75 bp, Artificial Sequence
  Synthetic
ccgggtgtgtcgggggtgtgcgcggctggatggaagctgtgcccggggcccgcgcgcccccccccccactgtccc

SEQ ID NO: 167795 - DNA, 75 bp, Artificial Sequence
  Synthetic
tcttcttcctcttttccccggggattcaaagacacgcaagatcaggcgcgcggctgcttttcgccgtgcgcgccg

SEQ ID NO: 167796 - DNA, 75 bp, Artificial Sequence
  Synthetic
cccccgccgaaaacacccccccgcccctcggggacccagcacgggggccggaatggatgacggccgtccacctag

SEQ ID NO: 167797 - DNA, 75 bp, Artificial Sequence
  Synthetic
tacggaacctttgttgttgacggtggacggagatttggaataaaagatgcgcgtcaaccgtcaaagacgcaacaa

SEQ ID NO: 167798 - DNA, 75 bp, Artificial Sequence
  Synthetic
cctcaaacaccatatccagcactacaaatacattgaccgcatattctataactacgttaaacacctcgacttcat

SEQ ID NO: 167799 - DNA, 75 bp, Artificial Sequence
  Synthetic
cattggataatacaactacagacataacgtccagcgaaagttcaatcaacgtgtcgacagtttacaacaccacgt

SEQ ID NO: 167800 - DNA, 75 bp, Artificial Sequence
  Synthetic
aacgtccagcgaaagttcaatcaacgtgtcgacagtttacaacaccacgtacattcctgtaacatcgcttgctat

SEQ ID NO: 167801 - DNA, 75 bp, Artificial Sequence
  Synthetic
ttattactaccgttcaggtaaactgtatctccctgagttaccgtgatgggtctttctacatgttgactttgcgta

SEQ ID NO: 167802 - DNA, 75 bp, Artificial Sequence
  Synthetic
cttgttcatgtaaaagtaccggaactaaaatgctagttagaatggttgcagttgctattagcgcggctagtaaca

SEQ ID NO: 167803 - DNA, 75 bp, Artificial Sequence
  Synthetic
tgtgaaatcaacttcactaacggcagaagaaggaacaaatattacaatacatggcaatgacacgtgggattgtcc

SEQ ID NO: 167804 - DNA, 75 bp, Artificial Sequence
  Synthetic
taaaatgctagttagaatggttgcagttgctattagcgcggctagtaacagtagtttagtgttacattgtatacc

SEQ ID NO: 167805 - DNA, 75 bp, Artificial Sequence
  Synthetic
atggcaatgacacgtgggattgtcccgacgtggtttggtatcgacattataattggtctacacatggacaccaca

SEQ ID NO: 167806 - DNA, 75 bp, Artificial Sequence
  Synthetic
ttggctaaaaataaaaacaaaagtttattgatgtgcatgttaggttttagtctaaaattcatctgggtcgtattt

SEQ ID NO: 167807 - DNA, 75 bp, Artificial Sequence
  Synthetic
acgtcacatcctatatgttattctgatcgctcatcacctaccgcgtatcatgatctatgccgttcatgtaataaa

SEQ ID NO: 167808 - DNA, 75 bp, Artificial Sequence
  Synthetic
atcgctcatcacctaccgcgtatcatgatctatgccgttcatgtaataaaacagaactacgcctttacgatttaa

SEQ ID NO: 167809 - DNA, 75 bp, Artificial Sequence
  Synthetic
tctaaaattcatctgggtcgtatttgggaagttttgtataacgcggtcttctggggacgcgacggctacccatgt

SEQ ID NO: 167810 - DNA, 75 bp, Artificial Sequence
  Synthetic
atttcggactaactgtaaatcccaggaacaacactgacaattataccatcccagtatgtcccagatacgtagaaa

SEQ ID NO: 167811 - DNA, 75 bp, Artificial Sequence
  Synthetic
ttacagtttttattacattgtcccacgttctgctattatgctggtctgattcctcttttgttttacatttatcag

SEQ ID NO: 167812 - DNA, 75 bp, Artificial Sequence
  Synthetic
cgttctgctattatgctggtctgattcctcttttgttttacatttatcaggtataggagacgatgttgcagttcc

SEQ ID NO: 167813 - DNA, 75 bp, Artificial Sequence
  Synthetic
gaacaacactgacaattataccatcccagtatgtcccagatacgtagaaacacaatcacaggaagatgaacaaga

SEQ ID NO: 167814 - DNA, 75 bp, Artificial Sequence
  Synthetic
ggtagttacgttgtatatagtgagagaggtcttattgcagtctaaacacatgccgttcagtggggaagttgaata

SEQ ID NO: 167815 - DNA, 75 bp, Artificial Sequence
  Synthetic
gccgaagagagacgtcttccgacacgctgtccgacgaggcgtgtcgcgtctcacaaattataccgtaataaaaaa

SEQ ID NO: 167816 - DNA, 75 bp, Artificial Sequence
  Synthetic
gaggtcttattgcagtctaaacacatgccgttcagtggggaagttgaataataatgtccaatgctgcacagttgg

SEQ ID NO: 167817 - DNA, 75 bp, Artificial Sequence
  Synthetic
cacgcacactacatgggctcttatactaatttgcatagcctgcatgcttcttttttttgttcgacgagccctcaa

SEQ ID NO: 167818 - DNA, 75 bp, Artificial Sequence
  Synthetic
ctgacgtttccggacatgcaacacataaaattaagtaacatatctaccatgaagtacagcaaatatctactaatg

SEQ ID NO: 167819 - DNA, 75 bp, Artificial Sequence
  Synthetic
tatccaccgacatatcctgttacattaattacttcgtaatttaaattagagtgtttataaacggtgtacaaactg

SEQ ID NO: 167820 - DNA, 75 bp, Artificial Sequence
  Synthetic
taattacttcgtaatttaaattagagtgtttataaacggtgtacaaactgccattgcaagttatgttgctggtat

SEQ ID NO: 167821 - DNA, 75 bp, Artificial Sequence
  Synthetic
aatgttgtaaccaaacttgtccgtgttcctgcgtttgtgtcaattctacaacagtcaacatatccacaaatgaaa

SEQ ID NO: 167822 - DNA, 75 bp, Artificial Sequence
  Synthetic
ttcctgcgtttgtgtcaattctacaacagtcaacatatccacaaatgaaacaacgtctaaagccatcactccaac

SEQ ID NO: 167823 - DNA, 75 bp, Artificial Sequence
  Synthetic
ttgaagtggttgctgatgcgactgaagaagcggtagagggtttgtgcgtggttccatttgcgatagctgaagtgc

SEQ ID NO: 167824 - DNA, 75 bp, Artificial Sequence
  Synthetic
agaagcggtagagggtttgtgcgtggttccatttgcgatagctgaagtgctgttagcatcggtgacagagttaga

SEQ ID NO: 167825 - DNA, 75 bp, Artificial Sequence
  Synthetic
cgtgtctactgcagcttcatcaaccatactatctcaaaccaatcgcagtcatacaagtaatgtcatcacaacccc

SEQ ID NO: 167826 - DNA, 75 bp, Artificial Sequence
  Synthetic
atactatctcaaaccaatcgcagtcatacaagtaatgtcatcacaaccccaaaaacgcggtttgaatataatatc

SEQ ID NO: 167827 - DNA, 75 bp, Artificial Sequence
  Synthetic
atatcgtaatcatcagtaacgtccacttaaccgtaaatctccagtccataacgttattaaatttcggttaacggg

SEQ ID NO: 167828 - DNA, 75 bp, Artificial Sequence
  Synthetic
cttaaccgtaaatctccagtccataacgttattaaatttcggttaacgggcattgatgtttcttcggacgttgtt

SEQ ID NO: 167829 - DNA, 75 bp, Artificial Sequence
  Synthetic
agttctccaggctggctttattcctcggaaccaatatgcaccgttaccaacagttatcatcatactttccctcgt

SEQ ID NO: 167830 - DNA, 75 bp, Artificial Sequence
  Synthetic
tcaggattgtatcgaactatgaattctgattcacttatatcgtcacttaatggatgatattttttatttagagct

SEQ ID NO: 167831 - DNA, 75 bp, Artificial Sequence
  Synthetic
ctgattcacttatatcgtcacttaatggatgatattttttatttagagctcgtcggacgaaaaataggagaatgc

SEQ ID NO: 167832 - DNA, 75 bp, Artificial Sequence
  Synthetic
acagccatagttaccaacaggacgtgtgatagaagacaaacaaaaaatacagacactactaaccatggaatcggg

SEQ ID NO: 167833 - DNA, 75 bp, Artificial Sequence
  Synthetic
ataaatgatctatagatgatgtggctgtattgtcttcataattggtcggtttatgagaagtgtcccattcgtgct

SEQ ID NO: 167834 - DNA, 75 bp, Artificial Sequence
  Synthetic
tgtattgtcttcataattggtcggtttatgagaagtgtcccattcgtgctttggttcttcacatacccagggatt

SEQ ID NO: 167835 - DNA, 75 bp, Artificial Sequence
  Synthetic
agttttataacatcgaaagctatatttaccagaatgagtaaaattaagaccgtacagagataaagataaattacg

SEQ ID NO: 167836 - DNA, 75 bp, Artificial Sequence
  Synthetic
ttaccagaatgagtaaaattaagaccgtacagagataaagataaattacgatcgcatgtaaaacataaatcatag

SEQ ID NO: 167837 - DNA, 75 bp, Artificial Sequence
  Synthetic
aaacctgatatgcacatcaataaacttttttgtatctttagttattaatgtctgtgtgtttattcagaataactc

SEQ ID NO: 167838 - DNA, 75 bp, Artificial Sequence
  Synthetic
tttccatttcttatgttgggatgggtgtattttccgtgtgtggatatattaaaatgtctaagccaggctgttttg

SEQ ID NO: 167839 - DNA, 75 bp, Artificial Sequence
  Synthetic
tgtattttccgtgtgtggatatattaaaatgtctaagccaggctgttttgtagcacgatgtgatggttaggttgt

SEQ ID NO: 167840 - DNA, 75 bp, Artificial Sequence
  Synthetic
agccgtattagcaattatcccagctggcattctagtacaggcaatttcacatgagcaaaaaacatcctaccggca

SEQ ID NO: 167841 - DNA, 75 bp, Artificial Sequence
  Synthetic
ggcattctagtacaggcaatttcacatgagcaaaaaacatcctaccggcaacttttgctgcaaagtgaacgtgtg

SEQ ID NO: 167842 - DNA, 75 bp, Artificial Sequence
  Synthetic
tgttaggcgatgagcaagttggaagcggtgtagtgacgttttcatttgcatttatcatagtagtagtgttggttg

SEQ ID NO: 167843 - DNA, 75 bp, Artificial Sequence
  Synthetic
cggtgtagtgacgttttcatttgcatttatcatagtagtagtgttggttgataatgatatagtttgcaaagtcac

SEQ ID NO: 167844 - DNA, 75 bp, Artificial Sequence
  Synthetic
tattggaatcacaataattgtgaactttgcggttggacaccgtttttctttgaatatgctggatatactgaaaac

SEQ ID NO: 167845 - DNA, 75 bp, Artificial Sequence
  Synthetic
tttgcggttggacaccgtttttctttgaatatgctggatatactgaaaacacgtcgtgtcacccacgatttacct

SEQ ID NO: 167846 - DNA, 75 bp, Artificial Sequence
  Synthetic
tgtagatgtttgggtagatatggtggaaatagttgaggtcacgtctgtgccttttacagagcttgcagtgaatcc

SEQ ID NO: 167847 - DNA, 75 bp, Artificial Sequence
  Synthetic
tagatacgcagttttattattcgagcaaagcttgtgtgatgcaaaaaacggtactgcaggatgaaagtcccgttg

SEQ ID NO: 167848 - DNA, 75 bp, Artificial Sequence
  Synthetic
atcactgtgatattccatgtaacatcagcgatgatcgtaaatataacgtagatgacattgataactgcaacgcta

SEQ ID NO: 167849 - DNA, 75 bp, Artificial Sequence
  Synthetic
cagcgatgatcgtaaatataacgtagatgacattgataactgcaacgctactataaatgtaaccgactatattat

SEQ ID NO: 167850 - DNA, 75 bp, Artificial Sequence
  Synthetic
ctttcctgccaattcctcccgtaaacttatgattatcctagcccattcccgataaaaatacacggagacagtaga

SEQ ID NO: 167851 - DNA, 75 bp, Artificial Sequence
  Synthetic
gaaatagttgaggtcacgtctgtgccttttacagagcttgcagtgaatcctgtggatgtgttgacgttgccattg

SEQ ID NO: 167852 - DNA, 75 bp, Artificial Sequence
  Synthetic
gtgggtgtaatcgacgtggaagtattggcgatagtggtgttgttacacttgcttttctgcagaatccaaaaaata

SEQ ID NO: 167853 - DNA, 75 bp, Artificial Sequence
  Synthetic
ggtgacaatagtatttatctgtgttttaacttgcattaacgtctcagcaactctaaggcacagactacgaactag

SEQ ID NO: 167854 - DNA, 75 bp, Artificial Sequence
  Synthetic
aaacaacgttaacagcataacgtgattacaaagtatcaacgctagtttatccaagagaaactttcatgaaggatc

SEQ ID NO: 167855 - DNA, 75 bp, Artificial Sequence
  Synthetic
ccagtgcgccaacaaagatcatcagtcccgaaacccaggcgcaatggagtgagaggccggaccactggcgtttta

SEQ ID NO: 167856 - DNA, 75 bp, Artificial Sequence
  Synthetic
ggatctgcgagtggaatttccctcattacccccgtgtgtcggcatacagtgcgctgcataagaacacgcatgaca

SEQ ID NO: 167857 - DNA, 75 bp, Artificial Sequence
  Synthetic
gatcctgcaggaggtagactcccgtatctttaaccgtaagattgtacagcgtgagattttggcgcgtgcacgtga

SEQ ID NO: 167858 - DNA, 75 bp, Artificial Sequence
  Synthetic
ccagactacgctgtgatggctagtgttaagcctggtaaccagagtacgtgtacggtcctcgcaggtggcgcggta

SEQ ID NO: 167859 - DNA, 75 bp, Artificial Sequence
  Synthetic
cgggggatagtgaggaattctcaggggacgatatgggacccaatgactggataaaagaagggtttttcccagtaa

SEQ ID NO: 167860 - DNA, 75 bp, Artificial Sequence
  Synthetic
tcgtggcgcacacctttaaggtacgggtctaccaaaaggttttgacgtttcgtcgtagctacgcttacatctaca

SEQ ID NO: 167861 - DNA, 75 bp, Artificial Sequence
  Synthetic
agacgtcgtcgtcctcgtcctcttcgtcgtctgtgcccgtcggttcgatcaacggggagttatctttctgtctgg

SEQ ID NO: 167862 - DNA, 75 bp, Artificial Sequence
  Synthetic
gtcgtctgtgcccgtcggttcgatcaacggggagttatctttctgtctggagggtcggtatggaatccgttcgta

SEQ ID NO: 167863 - DNA, 75 bp, Artificial Sequence
  Synthetic
tcgtcatgcaaccgctggttctctcagcggaggaactatcgtctctgctgatttgcaaatacatcccaccttaag

SEQ ID NO: 167864 - DNA, 75 bp, Artificial Sequence
  Synthetic
ctcggtgcccgtgttgtttttctcctcctcgcgcgcgtaaattacgaagaagaccaccagcaggactatcagcgt

SEQ ID NO: 167865 - DNA, 75 bp, Artificial Sequence
  Synthetic
aaccggtggctaggatgaatatccaaatcacagggcagtagccgactgactcgttggcaggtcagcctaccctca

SEQ ID NO: 167866 - DNA, 75 bp, Artificial Sequence
  Synthetic
tacatgttaggtgggtattttctgttttcacgagacaattggtggtaaccgtgttttcggcgcaaacggccacgt

SEQ ID NO: 167867 - DNA, 75 bp, Artificial Sequence
  Synthetic
gcacaccgcgtgcattacacgcggatacatattaaaacaccgtgttccacaagcaccgcacacgtcgatcctccc

SEQ ID NO: 167868 - DNA, 75 bp, Artificial Sequence
  Synthetic
aacactctgtagtactctgtctcggcttccggtccccatgtcctaatcataacaaaacaccgtgtcactgtccat

SEQ ID NO: 167869 - DNA, 75 bp, Artificial Sequence
  Synthetic
gcggctcttggattcggcattggtgcgccgcgtcttggcctgcatgatcatcgtcatcatgatcgccattagcat

SEQ ID NO: 167870 - DNA, 75 bp, Artificial Sequence
  Synthetic
cgccgcgtcttggcctgcatgatcatcgtcatcatgatcgccattagcatctggatcctgacctacgtgctgttt

SEQ ID NO: 167871 - DNA, 75 bp, Artificial Sequence
  Synthetic
ctcacggccatctccgacaggccctctccccgacctcctggacatgtgagggcttgttgctcctcctgggattgc

SEQ ID NO: 167872 - DNA, 75 bp, Artificial Sequence
  Synthetic
agtctgaatatcactcataggaccagaagaagtacgagtgacaataatacaactcatttgtccagcatggaatcg

SEQ ID NO: 167873 - DNA, 75 bp, Artificial Sequence
  Synthetic
ctccccgacctcctggacatgtgagggcttgttgctcctcctgggattgctggtgctcttctttcaccaccacaa

SEQ ID NO: 167874 - DNA, 75 bp, Artificial Sequence
  Synthetic
gtccaatacctccatccttcgcattccggtgtccacatgggaagcgatgtcatgttagttcccgtaaacgttgtg

SEQ ID NO: 167875 - DNA, 75 bp, Artificial Sequence
  Synthetic
tgcagcgttgcgtgtagaagcggggggattaagacgttaataaagaatagcggcggttctgatagggcgaccgct

SEQ ID NO: 167876 - DNA, 75 bp, Artificial Sequence
  Synthetic
caaccggacgcgagtgtcccataaaagccgggcgctccggcgagaccatgccatcctcgccttcggacgccccgc

SEQ ID NO: 167877 - DNA, 75 bp, Artificial Sequence
  Synthetic
agccgggcgctccggcgagaccatgccatcctcgccttcggacgccccgctcctcttctctctcctctcctcccc

SEQ ID NO: 167878 - DNA, 75 bp, Artificial Sequence
  Synthetic
ccccgtccccaccatggtccccgccgcaatcaacgcccgtgtccccgcaagtccccgccgcaagcagccccccgt

SEQ ID NO: 167879 - DNA, 75 bp, Artificial Sequence
  Synthetic
ccgcagctgtagcagttaacgtcgccggccttcaggaggagatggcgctctgcgtcgtctcttcgtcccgcctcc

SEQ ID NO: 167880 - DNA, 75 bp, Artificial Sequence
  Synthetic
tgcaggtcctgctgccactgcttttccgtgcggaaagtcggcacgtcttccgcatgtttagcgacgatagacgcc

SEQ ID NO: 167881 - DNA, 75 bp, Artificial Sequence
  Synthetic
tgcgtcgtctcttcgtcccgcctccctctgtggtcgtgggtggtgcgagagtacacgatgggtggctctcgtctc

SEQ ID NO: 167882 - DNA, 75 bp, Artificial Sequence
  Synthetic
gctccccgtccccaacggcgcacaaaaacccccgtggccgccgcaaacgcggcgccgcgcaaaagctccgtgcaa

SEQ ID NO: 167883 - DNA, 75 bp, Artificial Sequence
  Synthetic
ttgtatcgcttaatttgtttagagccgcacgcttgacaacgccttgtatagccttatttatcccgatgacttttt

SEQ ID NO: 167884 - DNA, 75 bp, Artificial Sequence
  Synthetic
cgcacgcttgacaacgccttgtatagccttatttatcccgatgacttttttctccgtacaagaaatggacgtcac

SEQ ID NO: 167885 - DNA, 75 bp, Artificial Sequence
  Synthetic
aaccaagaccgtgagaccccacgcaccggcagcgtgcacaaagcgcagcgcaaaagctccgtgcaaacacccgcg

SEQ ID NO: 167886 - DNA, 75 bp, Artificial Sequence
  Synthetic
cgcatgcgagtctcattaggacaccgtgtagcgtttggctgttcttggaaaacattttttatttataacgtttct

SEQ ID NO: 167887 - DNA, 75 bp, Artificial Sequence
  Synthetic
gaaagtagcggtggcacttactatcaaaaaggttacaactgcaccgacaaacatataacactatcttgtttcaac

SEQ ID NO: 167888 - DNA, 75 bp, Artificial Sequence
  Synthetic
aaagtaaaagatgaccgcgccctcggagtccttttttccttttcaatcatgaaagcaagaggcagccgagagaat

SEQ ID NO: 167889 - DNA, 75 bp, Artificial Sequence
  Synthetic
gaaagcaagaggcagccgagagaatgccagtaagagacgaccatcgcagacacagtacgatactcatcttagaac

SEQ ID NO: 167890 - DNA, 75 bp, Artificial Sequence
  Synthetic
cagcgcaaaactccctcagcccggtcggcgcgctggcgcttacgtccctgacaactccccgagccctgtcccgca

SEQ ID NO: 167891 - DNA, 75 bp, Artificial Sequence
  Synthetic
atcgtttttgcgaacttttaggaaccagcaagtcaacaaaagactaacaaagaaaaaccatcttggaattaaaaa

SEQ ID NO: 167892 - DNA, 75 bp, Artificial Sequence
  Synthetic
cagcaagtcaacaaaagactaacaaagaaaaaccatcttggaattaaaaaaagtagcatcgttaccttatgaacc

SEQ ID NO: 167893 - DNA, 75 bp, Artificial Sequence
  Synthetic
gggtgtgtcgcgggcgtgtgccgggtgtgtcgcgggcgtgtgccgggtgtgtcgggggtgtgtcggcggggtgtg

SEQ ID NO: 167894 - DNA, 75 bp, Artificial Sequence
  Synthetic
tttttccctagggacgagtggcggcggcgcgcgcttcgtcttctccgcgtgtcctcgacggggacttcctctttt

SEQ ID NO: 167895 - DNA, 75 bp, Artificial Sequence
  Synthetic
tttgtaaattcaattgttgaaagtctctccctgggggaattgcatatcttattgatgaagaagaaatccctgcca

SEQ ID NO: 167896 - DNA, 75 bp, Artificial Sequence
  Synthetic
aggccgtcagcgcggcgcgctggtaacgggctgtccgcacgttccgggatgtttccacgggtgtgcgggtcgtga

SEQ ID NO: 167897 - DNA, 75 bp, Artificial Sequence
  Synthetic
gggactccccttcttcttcctcttttccccggggattcaaagacacgcaacagcaaagacagacacgcaagacag

SEQ ID NO: 167898 - DNA, 75 bp, Artificial Sequence
  Synthetic
gcgggcgctcggggggctttcgcggcgggtctttgcacggagtttctacgcagcttttgcgcggcgcttcgcttt

SEQ ID NO: 167899 - DNA, 75 bp, Artificial Sequence
  Synthetic
tgaactcccggtggtctgtgtgtatatttctgttggtggtcggttgtctgaacccgggtgggttgttcggaaacg

SEQ ID NO: 167900 - DNA, 75 bp, Artificial Sequence
  Synthetic
aacccgggtgggttgttcggaaacggcgggacggggaaacgggtggaaacagcgtcgctatatacgtgacttttg

SEQ ID NO: 167901 - DNA, 75 bp, Artificial Sequence
  Synthetic
ggggccggggggtgtgcgggcccggggggtgtgcggggccgggggccttttgcggcggggacggtggtggggacg

SEQ ID NO: 167902 - DNA, 75 bp, Artificial Sequence
  Synthetic
ttgcctggtaggatttcctgtggaaacaatcaccggatgttatcgtggctggtacataagctggttctggctgca

SEQ ID NO: 167903 - DNA, 75 bp, Artificial Sequence
  Synthetic
actgcgcggcgccaaggcggcgccagcaagcgccgtgcacgccgctgcctataaaagccaggtgcgtgtcggccg

SEQ ID NO: 167904 - DNA, 75 bp, Artificial Sequence
  Synthetic
ttggcagcattccattgtgggggggggggtacttatagcgtgtttcatgacggtgtttatacatgaaggtgcggg

SEQ ID NO: 167905 - DNA, 75 bp, Artificial Sequence
  Synthetic
ggggtacttatagcgtgtttcatgacggtgtttatacatgaaggtgcgggtttcaataaagtagaggttaaaagt

SEQ ID NO: 167906 - DNA, 75 bp, Artificial Sequence
  Synthetic
aaaagtaacgttacggggaacgccagtttagcaccacaactacgtgccgtcgctggattctccaatcagacgcct

SEQ ID NO: 167907 - DNA, 75 bp, Artificial Sequence
  Synthetic
tgtaatgtaacagggagacatgcacctctagtgaataatggatcaagcgtttgtgtaacgaattgtactcataca

SEQ ID NO: 167908 - DNA, 75 bp, Artificial Sequence
  Synthetic
acaacacgcacctggccttggtaggtgttgtcgtgtttttaattctgatagttgtttgtattatggggtggtgga

SEQ ID NO: 167909 - DNA, 75 bp, Artificial Sequence
  Synthetic
tctttagatctgtgcaatatcacgaagggtaacgatggcgttgtcgaccttggtcgttggttcggagagaataaa

SEQ ID NO: 167910 - DNA, 75 bp, Artificial Sequence
  Synthetic
gctccagataaaagaggcgttaataatgaacaccacaaaaaccacttgcgtcagtatgacaatcataaaggctcg

SEQ ID NO: 167911 - DNA, 75 bp, Artificial Sequence
  Synthetic
gttagatttcctgtgtagaacaatgaccggacgtgcttggactggtacatacgcaggggctggacgtggttaccg

SEQ ID NO: 167912 - DNA, 75 bp, Artificial Sequence
  Synthetic
accggacgtgcttggactggtacatacgcaggggctggacgtggttaccggtcactggactcggtttcgctgtag

SEQ ID NO: 167913 - DNA, 75 bp, Artificial Sequence
  Synthetic
acgcattactcttggatgctgattatcgttatcattttcatcatttttattatcatctgtctacgagcacctcga

SEQ ID NO: 167914 - DNA, 75 bp, Artificial Sequence
  Synthetic
actaaaaaagtgtttaatattggggtttaatgataaaatccaggttatggatatgaggaaactgaatacctcgca

SEQ ID NO: 167915 - DNA, 75 bp, Artificial Sequence
  Synthetic
ggcggcgtctcaccattcccgtttggagcacgccgagctgaggctggagcgcaaccgacacctgggtgcgtttca

SEQ ID NO: 167916 - DNA, 75 bp, Artificial Sequence
  Synthetic
gacggatacagaactgtaatatactatgatgtctaagaagtgtttgcggttatttccatggatgacaattttgtt

SEQ ID NO: 167917 - DNA, 75 bp, Artificial Sequence
  Synthetic
caggggaaaccagccttccagatgatactgaaaaccaaatttaagcatgacgctgtgccattgccgtcgtgattg

SEQ ID NO: 167918 - DNA, 75 bp, Artificial Sequence
  Synthetic
aactatatgacaataccatgcgttcttaaaattggacgcggcggtcaaaatatgagtttgcctccccttaacaat

SEQ ID NO: 167919 - DNA, 75 bp, Artificial Sequence
  Synthetic
tcattgtacggaaacgatatttttcaatggtatacagacagaccgacagtcaccaacacgttatgtctttatcaa

SEQ ID NO: 167920 - DNA, 75 bp, Artificial Sequence
  Synthetic
cagcagactgattcgttgtacggagtgggtcatcggttgaatgacgaagaagatggtgaactgtggagagtttcg

SEQ ID NO: 167921 - DNA, 75 bp, Artificial Sequence
  Synthetic
tgggtcatcggttgaatgacgaagaagatggtgaactgtggagagtttcggtttcttaataatcccatacgacat

SEQ ID NO: 167922 - DNA, 75 bp, Artificial Sequence
  Synthetic
ttccgaaatgtgtcctgggactacgatcgatgtttcggccgaaagttcctccgtcctctgcaccgacggcgaaaa

SEQ ID NO: 167923 - DNA, 75 bp, Artificial Sequence
  Synthetic
gtgccaaacgcggacgcgcacgcggcggtcggaacggatgcggcggcggcagcagcggcggcgccgacggtgatg

SEQ ID NO: 167924 - DNA, 75 bp, Artificial Sequence
  Synthetic
tttaagttacgccgttaggaaaagaaaatcagtccgaatgaagcatagtcagccgaatgatacagcaatagcttg

SEQ ID NO: 167925 - DNA, 75 bp, Artificial Sequence
  Synthetic
aaatcagtccgaatgaagcatagtcagccgaatgatacagcaatagcttgtttacaacgtgttcttttttacatt

SEQ ID NO: 167926 - DNA, 75 bp, Artificial Sequence
  Synthetic
tcttaaaactcttgggcaaggaataccgagaccgagcagcttatgttataatgttagtgtacaccttacccacca

SEQ ID NO: 167927 - DNA, 75 bp, Artificial Sequence
  Synthetic
aacacattgtcatacaaccacattatccctgtatccacctacacctgtacacaattcattaacaatatcaccgtc

SEQ ID NO: 167928 - DNA, 75 bp, Artificial Sequence
  Synthetic
acaattcattaacaatatcaccgtcattagcttcaaccaactttacacatgttgcggtccatcatgccgcaggta

SEQ ID NO: 167929 - DNA, 75 bp, Artificial Sequence
  Synthetic
taaaccgtatgtgctccaaaccgcatctcctcatcgtcacgtgaaataccatgggaccccttttcgtcacacacg

SEQ ID NO: 167930 - DNA, 75 bp, Artificial Sequence
  Synthetic
tctcctcatcgtcacgtgaaataccatgggaccccttttcgtcacacacgtctttccgcttactcaacgcgtcag

SEQ ID NO: 167931 - DNA, 75 bp, Artificial Sequence
  Synthetic
ggatcatacccctagttatcgttataacaatcatcgttttaatttgtttcaagttcccccaaaaagcttggaata

SEQ ID NO: 167932 - DNA, 75 bp, Artificial Sequence
  Synthetic
ctccagaagccccggcgggcgaatcggccggctggtcggtcggcgctcggacggatggggagaacggcggtgact

SEQ ID NO: 167933 - DNA, 75 bp, Artificial Sequence
  Synthetic
ggccggctggtcggtcggcgctcggacggatggggagaacggcggtgacttagccgcccgtggccgggagaagat

SEQ ID NO: 167934 - DNA, 75 bp, Artificial Sequence
  Synthetic
tcgttttcttttttcaaccgctctttttatcacctttttatgtgagtttctcttccgcgtctcccggccgtacca

SEQ ID NO: 167935 - DNA, 75 bp, Artificial Sequence
  Synthetic
tttatcacctttttatgtgagtttctcttccgcgtctcccggccgtaccatccacccatgcagcatgcacgcgtg

SEQ ID NO: 167936 - DNA, 75 bp, Artificial Sequence
  Synthetic
ctgccgtcgccaccgcgttatccgttcctcgtaggctggtcctggggaacgggtcggcggccggtcggcttctgt

SEQ ID NO: 167937 - DNA, 75 bp, Artificial Sequence
  Synthetic
cttctcctttccttaatctcggattatcatttccctctcctacctaccacgaatcgcagatgataaacaagaggg

SEQ ID NO: 167938 - DNA, 75 bp, Artificial Sequence
  Synthetic
taaaaagaaaaaagctacagacatttgggtacctcagctttccgataactcgaagaattcaaagtcgacgattcc

SEQ ID NO: 167939 - DNA, 75 bp, Artificial Sequence
  Synthetic
tgggtacctcagctttccgataactcgaagaattcaaagtcgacgattcccaacgagagaaaacagaacaaaaac

SEQ ID NO: 167940 - DNA, 75 bp, Artificial Sequence
  Synthetic
gcaagggtgttcctgccccctcgacgcgcctgtcgcgatcctcatggcgaggaccgcgatctccgtataggtaga

SEQ ID NO: 167941 - DNA, 75 bp, Artificial Sequence
  Synthetic
gcgcctgtcgcgatcctcatggcgaggaccgcgatctccgtataggtagatgaaattatcccgtgtccggtcctg

SEQ ID NO: 167942 - DNA, 75 bp, Artificial Sequence
  Synthetic
tgaaaaaaaaaacccggagaagacagagaggacgagcgtccacacaccgctttggtcgtagacgcatttttattc

SEQ ID NO: 167943 - DNA, 75 bp, Artificial Sequence
  Synthetic
aaaagatcatctctctcggtgtatagcaacaccaacaacaaccgcatcgcaacatcttcatccgcaagacggaaa

SEQ ID NO: 167944 - DNA, 75 bp, Artificial Sequence
  Synthetic
aacatcttcatccgcaagacggaaagaaaacaacaataatgagaatgaaatcaccacaaccaagccagatttcac

SEQ ID NO: 167945 - DNA, 75 bp, Artificial Sequence
  Synthetic
tgtttgaatatagggacagtccctacggaacctgagaacatgtggaaatcacctgtggtagaatgctgttcaggt

SEQ ID NO: 167946 - DNA, 75 bp, Artificial Sequence
  Synthetic
gaaaccacaaacgactactagtactccaatcttagatgtatatgctcctagataagatttagtattaccataatc

SEQ ID NO: 167947 - DNA, 75 bp, Artificial Sequence
  Synthetic
ccaatcttagatgtatatgctcctagataagatttagtattaccataatcatcgaagaatgaaagacgacgatga

SEQ ID NO: 167948 - DNA, 75 bp, Artificial Sequence
  Synthetic
gttgaacgcggtagatgttctttcccctcgcgatcaagttcgttggtcatacggtccaggcgggcaaggctacat

SEQ ID NO: 167949 - DNA, 75 bp, Artificial Sequence
  Synthetic
cggcgtcggcatgccgctgatcgcagtggccccacctcggcatgccggcgccgggcgaggaattgctcatgaaaa

SEQ ID NO: 167950 - DNA, 75 bp, Artificial Sequence
  Synthetic
gtcagtctagccacgtccgtttagatcaaaagtcacgtatactgcgacgttgtttccacccgtttccccgtcccg

SEQ ID NO: 167951 - DNA, 75 bp, Artificial Sequence
  Synthetic
aagtatctttctgtaaaaaaagaaaacaatacatgattaaccgaaaagaaaccaacaaaaagaacccgagatcag

SEQ ID NO: 167952 - DNA, 75 bp, Artificial Sequence
  Synthetic
catggaagatttcttgaaaaaagaaaagagaaagagaccaccttcccggcggcggacacgctcctctccgtcgcc

SEQ ID NO: 167953 - DNA, 75 bp, Artificial Sequence
  Synthetic
aagagaaagagaccaccttcccggcggcggacacgctcctctccgtcgccgttctgcaccatgattcgatcaata

SEQ ID NO: 167954 - DNA, 75 bp, Artificial Sequence
  Synthetic
tccatttttatcctcgcacttcttcgctctcaaagccgcctttaaagttgaaatgaaaggatggaaacatggaat

SEQ ID NO: 167955 - DNA, 75 bp, Artificial Sequence
  Synthetic
gctctcaaagccgcctttaaagttgaaatgaaaggatggaaacatggaatacagttttaattgcacgtatcacca

SEQ ID NO: 167956 - DNA, 75 bp, Artificial Sequence
  Synthetic
aggttcccggctctcctgtcagcatgtgtgtcagttggtgggtataattctgtttaatgttttccatgtcctcgc

SEQ ID NO: 167957 - DNA, 75 bp, Artificial Sequence
  Synthetic
tttttgaaacagttcagccaatgcaatcttgtctcggcataatcactctttctgcatataatagtagtagtagat

SEQ ID NO: 167958 - DNA, 75 bp, Artificial Sequence
  Synthetic
atcttgtctcggcataatcactctttctgcatataatagtagtagtagatttattcacatcaacacagcgaaaaa

SEQ ID NO: 167959 - DNA, 75 bp, Artificial Sequence
  Synthetic
agattaccgtccttacgagaaaacagatactcggatataggaatcaagacagctctgcactgaaaacacactctc

SEQ ID NO: 167960 - DNA, 75 bp, Artificial Sequence
  Synthetic
gatactcggatataggaatcaagacagctctgcactgaaaacacactctcctgtcacgacaccgcgccacaccag

SEQ ID NO: 167961 - DNA, 75 bp, Artificial Sequence
  Synthetic
ttggaccacagttgtcgattcttgaagacaatattctcgtgagaactttgagattcgcacttgaaacctcttagg

SEQ ID NO: 167962 - DNA, 75 bp, Artificial Sequence
  Synthetic
agacaatattctcgtgagaactttgagattcgcacttgaaacctcttaggatccacaaaaacaacaacctctgta

SEQ ID NO: 167963 - DNA, 75 bp, Artificial Sequence
  Synthetic
tttggtcgggatcgctcccgcatttgcccgtctacgatgtgcgttccccgcggccgttgagaccgccgtcatcac

SEQ ID NO: 167964 - DNA, 75 bp, Artificial Sequence
  Synthetic
atttgcctccttataacaaaagaagcacaagctcggtcgcacggattattccttctgctaatctattattttgtt

SEQ ID NO: 167965 - DNA, 75 bp, Artificial Sequence
  Synthetic
ccttctgctaatctattattttgttccttttttttttgtttgccttcacccccttcactccctgtagcaacacag

SEQ ID NO: 167966 - DNA, 75 bp, Artificial Sequence
  Synthetic
agtctttggtccaacaccgagagggcgcaagagattctaagtctccctgggttgggggagcagatgtaagccccg

SEQ ID NO: 167967 - DNA, 75 bp, Artificial Sequence
  Synthetic
gggatggatggacgtggggacggattcctgaggctacaaagatacgcggagacgtcgtggcgaggggatgggttt

SEQ ID NO: 167968 - DNA, 75 bp, Artificial Sequence
  Synthetic
ttgtgagccatgatgatggaagggtagaggctggcaaagtcgaacacggccacggggtcgttgtaataacccacc

SEQ ID NO: 167969 - DNA, 75 bp, Artificial Sequence
  Synthetic
tcctgaggctacaaagatacgcggagacgtcgtggcgaggggatgggtttattggatatcggtgaagcagcgtgg

SEQ ID NO: 167970 - DNA, 75 bp, Artificial Sequence
  Synthetic
aaatgtttcggccggcatccacgcgccacgttcaccgcgtcgtgcccagcgccatgtgcgggtcgtttcggcgtg

SEQ ID NO: 167971 - DNA, 75 bp, Artificial Sequence
  Synthetic
cccgtccccgcaacaccctgtctgcagcgcaacacccgttgccgtccctcagcgcggtccccgccaccgccggtc

SEQ ID NO: 167972 - DNA, 75 bp, Artificial Sequence
  Synthetic
agcgcaacacccgttgccgtccctcagcgcggtccccgccaccgccggtcccgcaaaagcccccgtccctgcaaa

SEQ ID NO: 167973 - DNA, 75 bp, Artificial Sequence
  Synthetic
cgtccccgcaacaccccgtccccgttcccagcagcgtgtcgcatgccccccgtcccgcgcggaccccgtcccctg

SEQ ID NO: 167974 - DNA, 75 bp, Artificial Sequence
  Synthetic
gatgggggtgatccggatgcgtggcaataggcctcgagcttgggcttctcccgcggatggacgttctaactgtac

SEQ ID NO: 167975 - DNA, 75 bp, Artificial Sequence
  Synthetic
aataggcctcgagcttgggcttctcccgcggatggacgttctaactgtacacggcggccgtggcctccgagtaaa

SEQ ID NO: 167976 - DNA, 75 bp, Artificial Sequence
  Synthetic
gcgcaacactcgttcccgtccccgcgccgcgaaaagctccgtacagaaacccgtggaaagatccccgagcgtgcg

SEQ ID NO: 167977 - DNA, 75 bp, Artificial Sequence
  Synthetic
acgacgttccagtcagcgaggccgtcgcgttggcgcgccaacagtaaggtcacgataggttggcggcccatggtt

SEQ ID NO: 167978 - DNA, 75 bp, Artificial Sequence
  Synthetic
ccacacggccttgacaccgtcgttacaagcatcggccgtgcgctgcgccacatcaggagggtgtgtcacaggcat

SEQ ID NO: 167979 - DNA, 75 bp, Artificial Sequence
  Synthetic
gtcccgcaccggcgccgggttgggtgtgtcgggggcgcggctgggtgggtgcgtgcgtggggtgggtgtcgggtg

SEQ ID NO: 167980 - DNA, 75 bp, Artificial Sequence
  Synthetic
gggtgctgtttgtggctgtggctggcatgattgtgcggcaggtgtgtgttgaagtgggtggaggttaaataggcg

SEQ ID NO: 167981 - DNA, 75 bp, Artificial Sequence
  Synthetic
ccgcaacacccgcgtcgccaacgtaacccccgtacccgcaacgccccggccctaccgccgtcacgcacacccccc

SEQ ID NO: 167982 - DNA, 75 bp, Artificial Sequence
  Synthetic
cctaccgccgtcacgcacaccccccggcccgcagcccggtacccagcgcgcccaaaaagcgccgtggagacaccc

SEQ ID NO: 167983 - DNA, 75 bp, Artificial Sequence
  Synthetic
gcgtcgggttgggtgtgccgggggcgcggctgggtgggtgcgtgcgtgccgggtgtgtcgcgggcgtgtgtcggg

SEQ ID NO: 167984 - DNA, 75 bp, Artificial Sequence
  Synthetic
gcggctgggtgggtgcgtgcgtgccgggtgtgtcgcgggcgtgtgtcgggtgtgtcggtcgggtgtgtcggtcgg

SEQ ID NO: 167985 - DNA, 75 bp, Artificial Sequence
  Synthetic
gtccggcaagatgctcgggatacgggctatgctggtgatgctggattactactggatacagttgataacgaacaa

SEQ ID NO: 167986 - DNA, 75 bp, Artificial Sequence
  Synthetic
acaacaccatctacgatgctgaaagtttttccaggacagaacaaaatggtcagccatattcacagtctacctttt

SEQ ID NO: 167987 - DNA, 75 bp, Artificial Sequence
  Synthetic
ccttaatacaagccatccacatctcccgcttatcctcgggtacaatgtagttctcatacatgctctgcatagtta

SEQ ID NO: 167988 - DNA, 75 bp, Artificial Sequence
  Synthetic
ccaaaccggacgctgcaacgatgcccccaccgctcagtgctcaggcaagcgtcagccacgcgctccgatacgatg

SEQ ID NO: 167989 - DNA, 75 bp, Artificial Sequence
  Synthetic
actgaaagtatataacgccgatcatgtccgaggaactgttaataaaacgccatgatgacaatgtggtgtctgacg

SEQ ID NO: 167990 - DNA, 75 bp, Artificial Sequence
  Synthetic
agttttaaataaaaacattttatttacatctgtacagggatcatataaaagtctatatatccagtccattgtcag

SEQ ID NO: 167991 - DNA, 75 bp, Artificial Sequence
  Synthetic
gctgaagcggattcggttacgaaattcgtgggtagcgtcagaagacgagctagatgtgagtcgcagggacgcgtg

SEQ ID NO: 167992 - DNA, 75 bp, Artificial Sequence
  Synthetic
aaaaagaggaagttgcggtaaaaccacgtcaataaagacgtcaatgacacctcaatgttgcgttggaacggtctt

SEQ ID NO: 167993 - DNA, 75 bp, Artificial Sequence
  Synthetic
gatgttttgtccctctctgtcttactctcccataggctgtaaggccctcaggaagagacttacggattgtagttg

SEQ ID NO: 167994 - DNA, 75 bp, Artificial Sequence
  Synthetic
gggcgaccggggatcccccacccagctccccttcccggcccgccccgctggcttttgggcccctccgggcttttt

SEQ ID NO: 167995 - DNA, 75 bp, Artificial Sequence
  Synthetic
ctagagggagggggggtagtttaatagcggaggcggatacgcggttttcacccgggcgccgctgacttgtttctt

SEQ ID NO: 167996 - DNA, 75 bp, Artificial Sequence
  Synthetic
ctagctacggcagcgacgtcgaagacccgcgggacgatctggccgaaaacctacggcatctctgaacgcggtttt

SEQ ID NO: 167997 - DNA, 75 bp, Artificial Sequence
  Synthetic
cgtaatcttccagctctagaagacggacaactagaggacatacgacaaataatatatatgcggtcaaagacaggt

SEQ ID NO: 167998 - DNA, 75 bp, Artificial Sequence
  Synthetic
atcgtaccgataagagtttcatatgcgagttcggaatcgtaaggtgtagccatgttagcatctctaaaacactgt

SEQ ID NO: 167999 - DNA, 75 bp, Artificial Sequence
  Synthetic
cgagttcggaatcgtaaggtgtagccatgttagcatctctaaaacactgttatctttttccataaaaatcttatt

SEQ ID NO: 168000 - DNA, 75 bp, Artificial Sequence
  Synthetic
catgttagcatctctaaaacactgttatctttttccataaaaatcttattaaccgtcacgtgtatgaatatcact

SEQ ID NO: 168001 - DNA, 75 bp, Artificial Sequence
  Synthetic
accacctcccgttgttaccacaactttgtaccatgagttactattttgagcatccaaccattttgataaatggtg

SEQ ID NO: 168002 - DNA, 75 bp, Artificial Sequence
  Synthetic
gggtggatcacgaccaaccagaaatacaccgctgagaggattgcgtaaaccattactaccacatggacaacgcaa

SEQ ID NO: 168003 - DNA, 75 bp, Artificial Sequence
  Synthetic
tcaggcttggttatcagaggccgcttggccagcatcacactagtctcctctaagatatagcagcacagcacccga

SEQ ID NO: 168004 - DNA, 75 bp, Artificial Sequence
  Synthetic
ccggtaacattcaccaacgggcgcagccaactttcatactcgtcaccctgaaacacctcacccaacaggcatcgg

SEQ ID NO: 168005 - DNA, 75 bp, Artificial Sequence
  Synthetic
cggcgtgttgtgtccgacgctgcctgcgcactgccggtgcgtgtcgtcccacggtatttgttggcggcaccgggc

SEQ ID NO: 168006 - DNA, 75 bp, Artificial Sequence
  Synthetic
gcgcactgccggtgcgtgtcgtcccacggtatttgttggcggcaccgggctgcgggacggtgtttccgcgcgctg

SEQ ID NO: 168007 - DNA, 75 bp, Artificial Sequence
  Synthetic
aagactacgcgcagcttagtgacgtgatctactgggccgtcagtcaaaactacgactacgcgctctacgcgagca

SEQ ID NO: 168008 - DNA, 75 bp, Artificial Sequence
  Synthetic
cagaaggggagggggaagtagcgttcgtaccgatggttgtggtattattattccctgtgtttcttgtttcagaaa

SEQ ID NO: 168009 - DNA, 75 bp, Artificial Sequence
  Synthetic
cggggactccacctcgcctatttaacctccacccactacaacacacacatgccgcacaatcatgccagccacaga

SEQ ID NO: 168010 - DNA, 75 bp, Artificial Sequence
  Synthetic
gttcctttgtaaaggtatcctctggtgtcccatttctctcggagtctttgaggaatcttgaagaaaaatagaatg

SEQ ID NO: 168011 - DNA, 75 bp, Artificial Sequence
  Synthetic
cagtttatggtaaaaagtcacaagaaagtatgtgtttgctttttaatgtaccaagaataaaaagtacgtctacga

SEQ ID NO: 168012 - DNA, 75 bp, Artificial Sequence
  Synthetic
caccccgtgtctccgtccccacccccgtccccgtatccgcaaaagcccgcaagtccccgccgctaacccccccgt

SEQ ID NO: 168013 - DNA, 75 bp, Artificial Sequence
  Synthetic
cttatgtttaacgtgtgttccgtcacgttatgtgtgtcgttaaaagacggcgtctgtacagtatggctttgagtt

SEQ ID NO: 168014 - DNA, 75 bp, Artificial Sequence
  Synthetic
tgaggcacagttgtggtgtacacgggctccaaggtgtagttacggagtctttctatgcaggtagtgttgagatat

SEQ ID NO: 168015 - DNA, 75 bp, Artificial Sequence
  Synthetic
gtattctacaggttgtgggatgaccgtagtcgcgttgctgaggttcactgcagtctccgtgtttttcaatagcaa

SEQ ID NO: 168016 - DNA, 75 bp, Artificial Sequence
  Synthetic
tccgtcataattttctgacgcagatagtcccgggctagtcattgttggcacaaaaccttctccctgataaaaagc

SEQ ID NO: 168017 - DNA, 75 bp, Artificial Sequence
  Synthetic
gcccgcgagcccccccccctcccctcggccggacgcttcttctgcgtctgtcctcgacgcgggttgtgccgtacc

SEQ ID NO: 168018 - DNA, 75 bp, Artificial Sequence
  Synthetic
taacggcgacagtacagctcccgttaaacattagattaatagacgctagtggatgacagcatgttattcgcccaa

SEQ ID NO: 168019 - DNA, 75 bp, Artificial Sequence
  Synthetic
cgggcgtccacctaggtgggtgcgcgctcgggaggcggctttgctttgcgctccggggctgcgggcctgtcgcgc

SEQ ID NO: 168020 - DNA, 75 bp, Artificial Sequence
  Synthetic
aagtgaagttggataccagggtaacgttccctccctgtggcccggacacgtagatgacggattccagaatcacgg

SEQ ID NO: 168021 - DNA, 75 bp, Artificial Sequence
  Synthetic
aggcgtccgcgtgtgtaaacggcgtggtcgctgacgcgggtttgcttcctatatagtggacgtcggaggtgtccg

SEQ ID NO: 168022 - DNA, 75 bp, Artificial Sequence
  Synthetic
tttattgtacacataatgcactctgcagcgaaatcgtgtaaccgtcagaggatgagaacccacgtcggaagccat

SEQ ID NO: 168023 - DNA, 75 bp, Artificial Sequence
  Synthetic
ggcggcaaacagcagcatcgcaacgccccagctgccataggtgaatgccaagttagttatgttcttggataacgt

SEQ ID NO: 168024 - DNA, 75 bp, Artificial Sequence
  Synthetic
gccggtatagtttaacgatgattatattatgtatgcgcagtatacaatgccctaaaacgtaacagtatgggatga

SEQ ID NO: 168025 - DNA, 75 bp, Artificial Sequence
  Synthetic
aaagctggaacaacacgcggctaaaaagcagaacatctacgaacggattccataccgaccctccagacagaaaga

SEQ ID NO: 168026 - DNA, 75 bp, Artificial Sequence
  Synthetic
gatcccgtcacgggtttcaacagatcgacgtcggtcagcggcgccgtcaccgccatgtccggcggaggcacgctg

SEQ ID NO: 168027 - DNA, 75 bp, Artificial Sequence
  Synthetic
aatgtatactttccctgaattacgttatcataaactgtaccgtccaggggtacgctatgtgtcacgcgtgttctc

SEQ ID NO: 168028 - DNA, 75 bp, Artificial Sequence
  Synthetic
ggcgctaagataccccacctgagtgaagggacccttgcagtctgtccgtgcataacaagtaactgataaaatgtc

SEQ ID NO: 168029 - DNA, 75 bp, Artificial Sequence
  Synthetic
ccagccgcacccggcacacacccacccagccgcacccccgacacaccccgaccgccgccggtgcgggacagggct

SEQ ID NO: 168030 - DNA, 75 bp, Artificial Sequence
  Synthetic
aaatacaaacgttgagactaccacatgtaccaacaccaccacgaccgttacttgtgatggtttcaattatacagt

SEQ ID NO: 168031 - DNA, 75 bp, Artificial Sequence
  Synthetic
ttgcgtgtctttgaatccccggggaaaagaggaggaagaagaggtcccaaggggacggcagcgcgagtccctggg

SEQ ID NO: 168032 - DNA, 75 bp, Artificial Sequence
  Synthetic
aaagaggaggaagaagaggtcccaaggggacggcagcgcgagtccctggggacgcgcagagcaactcccgggggt

SEQ ID NO: 168033 - DNA, 75 bp, Artificial Sequence
  Synthetic
gacgcgcagagcaactcccgggggtgagggacggcggcggccagacgcggaaaaaaagaggaagtccccgaggcg

SEQ ID NO: 168034 - DNA, 75 bp, Artificial Sequence
  Synthetic
cccgcgacacacccggcacacccagccgcacccggcacacacccacccagccgcacccccgacacacccaaaccg

SEQ ID NO: 168035 - DNA, 75 bp, Artificial Sequence
  Synthetic
ccgcacccccgacacacccaaaccggcgccggtgcgggacagggctcggggagttttcagggctgggggctgagg

SEQ ID NO: 168036 - DNA, 75 bp, Artificial Sequence
  Synthetic
ctttctgcgggtgtttgcacggagcttttgcgcggcgccgcgtttgcggcggccacgggggtttttgtgcgccgt

SEQ ID NO: 168037 - DNA, 75 bp, Artificial Sequence
  Synthetic
ttttgcgcggcgccgcgtttgcggcggccacgggggtttttgtgcgccgttggggacggggggccgggggttgcg

SEQ ID NO: 168038 - DNA, 75 bp, Artificial Sequence
  Synthetic
tgcggcggggacggactgagggacggcggtggggacttgcgaggacgggagttgcggggacgggaggggggtggc

SEQ ID NO: 168039 - DNA, 75 bp, Artificial Sequence
  Synthetic
gttgcggggacgggaggggggtggccgggacagggtgttgcgaaacccgtccttgcggcgggaacggggcgttgc

SEQ ID NO: 168040 - DNA, 75 bp, Artificial Sequence
  Synthetic
tactacttataacgaatatgaaatactcaattacttcgataactgtaactacaccataaatagcaccaagcatat

SEQ ID NO: 168041 - DNA, 75 bp, Artificial Sequence
  Synthetic
gtggccgttagataccttacgtgtctgtattggtacatttgcgacttgtcgggtacgacggtatagtttaactat

SEQ ID NO: 168042 - DNA, 75 bp, Artificial Sequence
  Synthetic
aatggttgacgcttgtgaggtgacagatgtgtgtggcgtcgttgatgtgttgttattcggagttgaatatatgtt

SEQ ID NO: 168043 - DNA, 75 bp, Artificial Sequence
  Synthetic
cccccgtccccgccgcgaaaggcccccgtccccgtcctcaccaccgtccccactcccgtccccgtctccgcaacg

SEQ ID NO: 168044 - DNA, 75 bp, Artificial Sequence
  Synthetic
tttatgcaacatacaaaatactataattgtatacactgtttgcctgtatgtaaagttatcgcatcttcgacaggt

SEQ ID NO: 168045 - DNA, 75 bp, Artificial Sequence
  Synthetic
ccagactacgctgtgatggctagtgttaagcctggtaaccagcgtgcgtgtacggttttcgcaagtggcgcggta

SEQ ID NO: 168046 - DNA, 75 bp, Artificial Sequence
  Synthetic
attgttctacacaggaaatctaactaggtcaacgtaattttattccaccgttacgcagaatactaacaaaaaact

SEQ ID NO: 168047 - DNA, 75 bp, Artificial Sequence
  Synthetic
cgacgtcaccgtctgcgctcgggcggacgcgtgcggcgtcgcgactcgcttgcccagcaccggtttctggctcgt

SEQ ID NO: 168048 - DNA, 75 bp, Artificial Sequence
  Synthetic
gccgagtatgcgcctagcatggtaatgggttctgtgacccggcatttgcacatcgcgtggcacttgctgccattg

SEQ ID NO: 168049 - DNA, 75 bp, Artificial Sequence
  Synthetic
catcgcgtggcacttgctgccattggtagatgtactattcggattgcacttacatgctaggtgggtattttctgt

SEQ ID NO: 168050 - DNA, 75 bp, Artificial Sequence
  Synthetic
aaggtaggtgtcggggccggagcgggggccgtggaaggattgacaggcgtcggcgtgaggatggcagcgccggcg

SEQ ID NO: 168051 - DNA, 75 bp, Artificial Sequence
  Synthetic
ggtggataataaccgcatatcaggaggagggatcgggtgatgacgcaggccccgcaaaacagtccgaaataaatt

SEQ ID NO: 168052 - DNA, 75 bp, Artificial Sequence
  Synthetic
ggagattggcgtcatcatcaaactccaacgacggcgagcgcgcgcccaaaaaggtgtgcgccgactgcgggaagc

SEQ ID NO: 168053 - DNA, 75 bp, Artificial Sequence
  Synthetic
agcaaaagactagcagcagccaaaataaacctgatgaaatctttaactgaactcccggtggtctgtgtgtatatt

SEQ ID NO: 168054 - DNA, 75 bp, Artificial Sequence
  Synthetic
cagcagctaccgctggcggcggcggcgttaatgcagccgttgatgttcgacgttgtgagtactcggaaacagcgg

SEQ ID NO: 168055 - DNA, 75 bp, Artificial Sequence
  Synthetic
aggagtgtgtaacaccattttttcttttctttgtaacgggataagggacagcaatcatcacgcacaacacccttc

SEQ ID NO: 168056 - DNA, 75 bp, Artificial Sequence
  Synthetic
tgttttttcgccccgtgtgctgttccgcccagacccgcaacaacactcctccgcacatcaatgacacttgcaaca

SEQ ID NO: 168057 - DNA, 75 bp, Artificial Sequence
  Synthetic
tccacatctccacgcccaaaaccaccccagcccaccacatccaccgcatcgcacccacatgctacggctcggcca

SEQ ID NO: 168058 - DNA, 75 bp, Artificial Sequence
  Synthetic
gctgctcacgaatcgcgtgcttggctattcgacgcccaccatttacatgaccaacctctactctactaattttct

SEQ ID NO: 168059 - DNA, 75 bp, Artificial Sequence
  Synthetic
gttacaatgttactgtatattccatatatcaaacacacatccacacaactatattgctctatccgcctacatcca

SEQ ID NO: 168060 - DNA, 75 bp, Artificial Sequence
  Synthetic
ccatcgggtgggaaagatgggatgacggtggatggtctctatgcaatgtgactagtaatggtacaacggtcgtca

SEQ ID NO: 168061 - DNA, 75 bp, Artificial Sequence
  Synthetic
tctatcggtgatctactactcaagctgcacagtgggctttgccaccgtagctctgatcgccgccgatcgttatcg

SEQ ID NO: 168062 - DNA, 75 bp, Artificial Sequence
  Synthetic
tgcacagtgggctttgccaccgtagctctgatcgccgccgatcgttatcgcgtccttcataaacgaacatacgca

SEQ ID NO: 168063 - DNA, 75 bp, Artificial Sequence
  Synthetic
tgacgctcgacgtgtactgttgccgccagacctccaacaacaccgtcgtcgcgttctcgcatcatcctgccgata

SEQ ID NO: 168064 - DNA, 75 bp, Artificial Sequence
  Synthetic
gctgtttacaccacggtggtgatgcatcacgatgccaacgataccaataatactaatgggcacgccacctgtgta

SEQ ID NO: 168065 - DNA, 75 bp, Artificial Sequence
  Synthetic
atcacgatgccaacgataccaataatactaatgggcacgccacctgtgtactgtacttcgtagctgaagaagtgc

SEQ ID NO: 168066 - DNA, 75 bp, Artificial Sequence
  Synthetic
gaccgctgaagcgagttgcgtgtgcgtgcggtgtgtggttccaagcgcaaaagctccccgtccccgcaagaggcc

SEQ ID NO: 168067 - DNA, 75 bp, Artificial Sequence
  Synthetic
cccccccccctcacggtgttttcacgcttaatcaccgctttattcatgacgctgctcaggtggggctagcacaac

SEQ ID NO: 168068 - DNA, 75 bp, Artificial Sequence
  Synthetic
tctacgcattcttctactcaaccgtacagcgcacgtcacagaaacaaaggagtcgtaccttaacctttgttagcg

SEQ ID NO: 168069 - DNA, 75 bp, Artificial Sequence
  Synthetic
gaagccccccgttcccgcaacccccggccccagcgcacaccccccgtccctcagtccggtcccgcaacacgtccc

SEQ ID NO: 168070 - DNA, 75 bp, Artificial Sequence
  Synthetic
ggccccagcgcacaccccccgtccctcagtccggtcccgcaacacgtccccagcacgctcaaaaacccccgtcct

SEQ ID NO: 168071 - DNA, 75 bp, Artificial Sequence
  Synthetic
atcttcaacagttatgccacaaccgcctggcccatgcagtgtgaacacctcacactgcgacgcaccattggcacg

SEQ ID NO: 168072 - DNA, 75 bp, Artificial Sequence
  Synthetic
acagcgtcgtactggcgaaacgacggagaccgcgtgccgcactgccgaaacgcacaaagcgccggacgaaacacg

SEQ ID NO: 168073 - DNA, 75 bp, Artificial Sequence
  Synthetic
accactgttgtacgagtgtcacaattccacattaagcattcttcatgtaaacgtctcagatcccaaaaactattg

SEQ ID NO: 168074 - DNA, 75 bp, Artificial Sequence
  Synthetic
agacacagacacgcgtcttctttgcgacgtgcgccgcgcacgtcgcttttattcgccgtcgccgtcctccgcgac

SEQ ID NO: 168075 - DNA, 75 bp, Artificial Sequence
  Synthetic
tatctacatcagtttccacgacgcatgcattctggtacctgctaaagtaggtactaacgtcacattgaacgcggt

SEQ ID NO: 168076 - DNA, 75 bp, Artificial Sequence
  Synthetic
aggagggtgcacgctcggggacccaggcgcctatgcgctccggtgccgcgggcctgttgcgcgtgttcctccggt

SEQ ID NO: 168077 - DNA, 75 bp, Artificial Sequence
  Synthetic
caacggcggcaacgagctcggatgctgcagcacaacggcccccagcagtctcaccagtaagcaggggtaaacaaa

SEQ ID NO: 168078 - DNA, 75 bp, Artificial Sequence
  Synthetic
gagtctgatccaacactgaacgctttcgtcgtgtttttcatgcagcttttacagaccatgacaagcctgacgaga

SEQ ID NO: 168079 - DNA, 75 bp, Artificial Sequence
  Synthetic
ccttcgggggttgcctcctctctttcttcttcttgtgcgccgatgggagcgacgtcaacagcggggactgctgcg

SEQ ID NO: 168080 - DNA, 75 bp, Artificial Sequence
  Synthetic
gaggtggtgtgcgatcccttccagtcgtgtggagtggtttggggtggcatccaaacgtgaggtattgacagatca

SEQ ID NO: 168081 - DNA, 75 bp, Artificial Sequence
  Synthetic
gcattcctgcgggcagaaccctccgtctccaacgacgacggcaacggcggcgaacgctgcgacacgctagcgacc

SEQ ID NO: 168082 - DNA, 75 bp, Artificial Sequence
  Synthetic
gttcgtaaacttatccgtttccccggtccgcggtgtctcctcgcgaggctgacagtctacgagtggtacctgcaa

SEQ ID NO: 168083 - DNA, 75 bp, Artificial Sequence
  Synthetic
ggtggctgggctgcgcggcggggccggcgacagggacggcggcggggacgacggcgatggcgacggggacgacgt

SEQ ID NO: 168084 - DNA, 75 bp, Artificial Sequence
  Synthetic
accgttcgctcccaacggatgacacaaagtatccgaataaccaccacacccattcaatccgcatattttaatcac

SEQ ID NO: 168085 - DNA, 75 bp, Artificial Sequence
  Synthetic
cgcacgcggtgctcggggcggacgcgacggcggcggcagcggcagcagcggcggcgccgacggtgatggtgggtc

SEQ ID NO: 168086 - DNA, 75 bp, Artificial Sequence
  Synthetic
accgccgttcggctctcctccgagccaaaagtcgcgccttgggacactgggcgttgttgagcatatgtactgtgg

SEQ ID NO: 168087 - DNA, 75 bp, Artificial Sequence
  Synthetic
ccgccgcggcggatttccgcgcgggggacggggtagccgagcgctgcgccttcgccaatgttgtgaagtagatgc

SEQ ID NO: 168088 - DNA, 75 bp, Artificial Sequence
  Synthetic
ggttgtgtttgagcgtagaggtgttggcgggcctgcgcgcaagcagcgtaatccgcggcgtcgagctccatctgc

SEQ ID NO: 168089 - DNA, 75 bp, Artificial Sequence
  Synthetic
tgtgttgctgtggtgtaagggtaacgtgtgttggtactctgggtgaagcggcgtggtgtgggtgctgtttgtgtc

SEQ ID NO: 168090 - DNA, 75 bp, Artificial Sequence
  Synthetic
gtcgatggagtgctgggtccgcgtcggcttccagcttgtctgacttggcgggcgaggccgttggagaattggtgg

SEQ ID NO: 168091 - DNA, 75 bp, Artificial Sequence
  Synthetic
tccctcagcccgggtccgcgagtccccgttcccagcgtaatccccgtacccgcaacgccccggccccaccgccgt

SEQ ID NO: 168092 - DNA, 75 bp, Artificial Sequence
  Synthetic
ccctcagcgcggtgaaaccccgtccccagcgccgtgccgctgacaaagaccatgggacgacacgcacaggcagcg

SEQ ID NO: 168093 - DNA, 75 bp, Artificial Sequence
  Synthetic
gattaatagacgctagtggatgacagcatgttatttgcccaaatgtgatcgtggttatactttcttgttttttgc

SEQ ID NO: 168094 - DNA, 75 bp, Artificial Sequence
  Synthetic
cggttctgatagggcgaccgctgaagcgagctgcgtgtgcgtgcggtttgtgtttcccgctgcaaagggcccccg

SEQ ID NO: 168095 - DNA, 75 bp, Artificial Sequence
  Synthetic
cccctcgttccccgctgcaaaagccacccgcgtgcgcagcgcgaaagcaccgccgtccctcagtgcggtcccgcg

SEQ ID NO: 168096 - DNA, 75 bp, Artificial Sequence
  Synthetic
aggggcggcatgccgttggcggcgccgggaataatgtgccgtcgaccgacgtcgcacaccttgaaacgccgtcgg

SEQ ID NO: 168097 - DNA, 75 bp, Artificial Sequence
  Synthetic
cgccgtccctcagtgcggtcccgcgcggcccccgtccccaccaccgtccccgccgcaatcaacacccgcgtctcc

SEQ ID NO: 168098 - DNA, 75 bp, Artificial Sequence
  Synthetic
aaagccccccgtccccgcaacgccccgtccccgtccctgagcgcaacccccgtccctgcaagtccccgccgcaag

SEQ ID NO: 168099 - DNA, 75 bp, Artificial Sequence
  Synthetic
aggcgcttcctcttttccgcccgtccccctggggacttcctcttttccgcgtcgtttccgcgtccctggccgtcg

SEQ ID NO: 168100 - DNA, 75 bp, Artificial Sequence
  Synthetic
gcacgaaggcacgcaccggcagtgcgctcggtccggtcggcgcccagcacgcccgcaaaaccccctagctgcctc

SEQ ID NO: 168101 - DNA, 75 bp, Artificial Sequence
  Synthetic
tgcctaggctgcgtcacttcgcccaggtttctggagattgtgcgccgcgcttcggaaaagtccgagctggtttcg

SEQ ID NO: 168102 - DNA, 75 bp, Artificial Sequence
  Synthetic
gcatgtttttgtatataatacagcattttatataacctttccctgtcttttctactcgtaaactgtgtacttcgc

SEQ ID NO: 168103 - DNA, 75 bp, Artificial Sequence
  Synthetic
ggaagcgtagccccgcttggtcacctcggccgacaggctctccacgtcaccgcggtagagcatgacggcgttcca

SEQ ID NO: 168104 - DNA, 75 bp, Artificial Sequence
  Synthetic
ttgaaagtcagcgagaatatttggccgagatgcaattgcgagaaattccaagtggcgtacggcaggcggtactgg

SEQ ID NO: 168105 - DNA, 75 bp, Artificial Sequence
  Synthetic
gtacaacgtgtggaaaacgcgttgcgtcgcagagtccgccacgtccctgtcttgtcgctccccaatcgtctcccg

SEQ ID NO: 168106 - DNA, 75 bp, Artificial Sequence
  Synthetic
ttccagatgatactgaaaaccaaatttaagcatgacgctgtgccacacccgccgtgattgccgaaacgttacgtt

SEQ ID NO: 168107 - DNA, 75 bp, Artificial Sequence
  Synthetic
tgtgtcggcatacagtgcgctccatgaaaagacgcgtgatacatagcgtactccaggacggtacagtttatgaga

SEQ ID NO: 168108 - DNA, 75 bp, Artificial Sequence
  Synthetic
cggcgaataaaagcgacgtgcgcggcgcacgtcgcaaagaagacgcgtgtctgtgtagaggaagttcccagggga

SEQ ID NO: 168109 - DNA, 75 bp, Artificial Sequence
  Synthetic
gcttcttctacctggctggcgcagtgcgccgagcggccgttgcccgggaacgtacctagctactttggaatcacg

SEQ ID NO: 168110 - DNA, 75 bp, Artificial Sequence
  Synthetic
cgcgaagaccgctcaccgggggtcggcaacgcacacatcaacagaaaaccgagacggatcaagaggtccatagtg

SEQ ID NO: 168111 - DNA, 75 bp, Artificial Sequence
  Synthetic
aagcggggggattaagacgttaataaagagtagcggcggttctgatagggcgaccgctgaagcgagctgcgtgtg

SEQ ID NO: 168112 - DNA, 75 bp, Artificial Sequence
  Synthetic
gtcctcaccactgtccccgccgcaaaagcccgcaagtccccgccgctaacccccccgggctcgtacaccccccgt

SEQ ID NO: 168113 - DNA, 75 bp, Artificial Sequence
  Synthetic
cctcttttccccggggaatcacacagacacagacacgcgtcttcttttcgccgcacgtcgcttttattcgccgtc

SEQ ID NO: 168114 - DNA, 75 bp, Artificial Sequence
  Synthetic
tcttgactgcttgcagcttcctcttttgtctgcccgccgtccctcacccccgggagttgttggtctccgcgtccc

SEQ ID NO: 168115 - DNA, 75 bp, Artificial Sequence
  Synthetic
ggggatagaaggaggagaacgaccccagggccagaatgcccacagtgtacatggcccaggtctccagaccgaacg

SEQ ID NO: 168116 - DNA, 75 bp, Artificial Sequence
  Synthetic
aaactcctgatcctcatacacaggagtccaagcgtcagaagtaaagtccgcggagccataaccgcgcaagtgaag

SEQ ID NO: 168117 - DNA, 75 bp, Artificial Sequence
  Synthetic
tgaaatctctgaaaactacctcagctaataacgtaacaaccatcgttacaacgacgccgacggtgactggcgcgg

SEQ ID NO: 168118 - DNA, 75 bp, Artificial Sequence
  Synthetic
tgctcgtaggtggggggcgcgtcgtcgtgatcccgctcgcggagcatcggcgtgggctccatgtcggtggcagtg

SEQ ID NO: 168119 - DNA, 75 bp, Artificial Sequence
  Synthetic
tggtctcgcggtgcaagttgctgcgttttacgtgtattgttacacgggtcgcgtatccctataatcggatgtgtg

SEQ ID NO: 168120 - DNA, 75 bp, Artificial Sequence
  Synthetic
gggaagcccgtggaaatgcacccggcagccgacggcgcactggactggcaaaggcagcccgagcgagaacccatc

SEQ ID NO: 168121 - DNA, 75 bp, Artificial Sequence
  Synthetic
cctgcagtacgccgagggcctgcgccagctcaagggcgccctggtggactttgattttctgcgtctgccgcgcgg

SEQ ID NO: 168122 - DNA, 75 bp, Artificial Sequence
  Synthetic
ggtgcggtgtggtgcggtggggacggcggtcgcggaggccggcgacggcgaataaaagcgacgtgcgccgcgcac

SEQ ID NO: 168123 - DNA, 75 bp, Artificial Sequence
  Synthetic
ggaagttcccaggggacggcagcgcgggtccctggggacacacgcaaaacaacggccagagacaagacgcggaaa

SEQ ID NO: 168124 - DNA, 75 bp, Artificial Sequence
  Synthetic
gggcacacactcgttcctgcgaagccgcacaccccgaagccgcgcacaccgccgacacaccccgccaccacaccc

SEQ ID NO: 168125 - DNA, 75 bp, Artificial Sequence
  Synthetic
agccgttttgttttccacgaacatggtttcgttgtaatataaggagctcatatcaagagtaccgtaaatagtgta

SEQ ID NO: 168126 - DNA, 75 bp, Artificial Sequence
  Synthetic
cactgacgtgaggggcgattcacgtcactgacggctgacgggaataagacgggtgagggatttccacctttttct

SEQ ID NO: 168127 - DNA, 75 bp, Artificial Sequence
  Synthetic
ccattccgggccgcgtggtgggtccccgaggggcgggggggtgtttttagcgggggggtgaaaattggagttgcg

SEQ ID NO: 168128 - DNA, 75 bp, Artificial Sequence
  Synthetic
gtgtgctgcggtgcggttgagacggcgacggcgaataaaagcgacgtgcggcgaaaagaagacgcgtgtctgtgt

SEQ ID NO: 168129 - DNA, 75 bp, Artificial Sequence
  Synthetic
tcgttgccagatggcaagtgctgtcaacagcagacgttgtgggcggtcggtgtatttttgtgggttgcggtgaga

SEQ ID NO: 168130 - DNA, 75 bp, Artificial Sequence
  Synthetic
cgtgctgggcgccggcgctagtaacgggagttacgctggggacggggacggggtttgcggcggggacgggggggt

SEQ ID NO: 168131 - DNA, 75 bp, Artificial Sequence
  Synthetic
tgccaacacacccccgacacacccgacacacgcccgcgacacacccggcacacacccacccagccgcgccccgac

SEQ ID NO: 168132 - DNA, 75 bp, Artificial Sequence
  Synthetic
atagatatccttttctagttgtttcaaaatctctaatttgaacttgtctagtctttgcttgcctatcgtagacag

SEQ ID NO: 168133 - DNA, 75 bp, Artificial Sequence
  Synthetic
atgccagccacagacacaaacagcacccacaccacgccgcttcacccagaggaccaacacacgttacccttacac

SEQ ID NO: 168134 - DNA, 75 bp, Artificial Sequence
  Synthetic
ggatgaagacgttaataaagaatagcggcggttctgatagggcgaccgctgaggcgagctgcgtgtgcgtgtgat

SEQ ID NO: 168135 - DNA, 75 bp, Artificial Sequence
  Synthetic
cggcggttctgatagggcgaccgctgaggcgagctgcgtgtgcgtgtgatttgtgttccccgcagcgcaaaagcc

SEQ ID NO: 168136 - DNA, 75 bp, Artificial Sequence
  Synthetic
gacgccttgcgtgtcgtcgtattctagcagggcgctttggcaaaaggcgcagttttctagcgaaatgttgagcgc

SEQ ID NO: 168137 - DNA, 75 bp, Artificial Sequence
  Synthetic
cccgcagcgcaaaagccccccggtcccgcagcgcaaaagccccccggtctcgcagcgcaaaagccccccggtccc

SEQ ID NO: 168138 - DNA, 75 bp, Artificial Sequence
  Synthetic
ccgcagcgcaaaagccccccggtctcgcagcgcaaaagccccccggtcccgcaacgccccgtccccgtccctcag

SEQ ID NO: 168139 - DNA, 75 bp, Artificial Sequence
  Synthetic
ccgcgagtcgcaacccccgtccccgcaacaccccgtacccagcgcagaaacccccgaaacgacagagaccgtggg

SEQ ID NO: 168140 - DNA, 75 bp, Artificial Sequence
  Synthetic
caacaccccgtacccagcgcagaaacccccgaaacgacagagaccgtggggcgcgcagaagcgccgtgaaaaccc

SEQ ID NO: 168141 - DNA, 75 bp, Artificial Sequence
  Synthetic
ctttatactagaacttttaaaactttcaacttcaaggcataatgccaaaattaagcacgttattagtcccccccc

SEQ ID NO: 168142 - DNA, 75 bp, Artificial Sequence
  Synthetic
cgcaaaacccccagcccagttccgcaccgtcccgcctacagcacgccgcaaacacccgcagcccggtccgtccct

SEQ ID NO: 168143 - DNA, 75 bp, Artificial Sequence
  Synthetic
aacacccgcagcccggtccgtccctcaaaactcccgctggtcccgccaacagataccgtgggacggcgcgctcac

SEQ ID NO: 168144 - DNA, 75 bp, Artificial Sequence
  Synthetic
gtgtgtcgggggtgtgttgggcgggtgtgtcgggggtgtgttggccgggtgtgtcgcgggcgtgtgccgggtgtg

SEQ ID NO: 168145 - DNA, 75 bp, Artificial Sequence
  Synthetic
tgtgtcgggggtgtgttggccgggtgtgtcgcgggcgtgtgccgggtgtgtcgggtgtgtcgcgggcgtgtaccg

SEQ ID NO: 168146 - DNA, 75 bp, Artificial Sequence
  Synthetic
cccccccccccgacgcgggtctgcagcttcctcttttccctagggacgagtcgcggcggcgcgcgcttcgtcttc

SEQ ID NO: 168147 - DNA, 75 bp, Artificial Sequence
  Synthetic
accagatcgtaacctccttcatttacagacgtaacgttacacagcgttaaatgcacatgactgcaattacatatg

SEQ ID NO: 168148 - DNA, 75 bp, Artificial Sequence
  Synthetic
cttcctctttttccgcgtctggccgccgtccctcaccccccgagagtcgatcttcgcgtccccagggactcgcgc

SEQ ID NO: 168149 - DNA, 75 bp, Artificial Sequence
  Synthetic
cacacccgccacacgccctgacacacccgccacacgcccgcgacgcacgcacccacccagccgcgcccccgacac

SEQ ID NO: 168150 - DNA, 75 bp, Artificial Sequence
  Synthetic
tgctgcgtgtgtgctttggcagacgcggtggcagtttgcggtctgcggtaagtgaggatgtcgccgagcaagcgc

SEQ ID NO: 168151 - DNA, 75 bp, Artificial Sequence
  Synthetic
cactgccggtgcgtgtcgtcccgcggtgttcgttagcgtgccgacgccggggacggggtgttgcggccgctcggg

SEQ ID NO: 168152 - DNA, 75 bp, Artificial Sequence
  Synthetic
tttaatcccgtatcgcgcggacgcctagtgtccgtttcccatcaccagggtcctctgtttagagatcgccgcaga

SEQ ID NO: 168153 - DNA, 75 bp, Artificial Sequence
  Synthetic
cgtctgtgctgcggctggctggcgctgggcgcggtgctgcccgcgcggtggctgggctgcgcggcggggccggcg

SEQ ID NO: 168154 - DNA, 75 bp, Artificial Sequence
  Synthetic
gtgtaacaacaccactatcgctaatacttccacgtcaattacactcacaagcttgatatctactgcacaactaac

SEQ ID NO: 168155 - DNA, 75 bp, Artificial Sequence
  Synthetic
cgaacgcgccgccgcgcttacgccccgccaacctccctcacccccgtcccgcaccggcgtcgggttgggtgtgtc

SEQ ID NO: 168156 - DNA, 75 bp, Artificial Sequence
  Synthetic
attcactgcaagctctgcaaaaagcacagacgtgatctcaactatttccaccatacccactcaaacatctacaat

SEQ ID NO: 168157 - DNA, 75 bp, Artificial Sequence
  Synthetic
acagacgtgatctcaactatttccaccatacccactcaaacatctacaattaacgcgactgtaatgacaacctca

SEQ ID NO: 168158 - DNA, 75 bp, Artificial Sequence
  Synthetic
ccaatcaatactagtacaatggtaacaaatacaactcaaaacatcagtacaccactcccaacttgctcatcatct

SEQ ID NO: 168159 - DNA, 75 bp, Artificial Sequence
  Synthetic
ccccccccctcccctcggccggacgcttcttctgcgtgtgtgctcgacgcgggttgtgccgtactttgtctgttg

SEQ ID NO: 168160 - DNA, 75 bp, Artificial Sequence
  Synthetic
accactcccaacttgctcatcatctaatagcacattcaatgatacatcaaacaaccgtacttgtcatgaaaacag

SEQ ID NO: 168161 - DNA, 75 bp, Artificial Sequence
  Synthetic
tggcttagacattttaatatatccacacacagaaaatacacccatcccaacataaagagtggaaaatttagtaac

SEQ ID NO: 168162 - DNA, 75 bp, Artificial Sequence
  Synthetic
ccctggggacttccttttttccgcgtcgtttccgcgtcgctggcccctgggaggcgttcttcgtgtgtccccagg

SEQ ID NO: 168163 - DNA, 75 bp, Artificial Sequence
  Synthetic
gtccctgcacacccccggccccgcacacccacgcacaccccccggccccgcacaccccgccgtcaagcccagcgt

SEQ ID NO: 168164 - DNA, 75 bp, Artificial Sequence
  Synthetic
tgttttacatgcgatcagaatttatctttgtctctgtacggtcttaattttactcactctggtaaatatagcttt

SEQ ID NO: 168165 - DNA, 75 bp, Artificial Sequence
  Synthetic
ctttgtctctgtacggtcttaattttactcactctggtaaatatagctttcgatgttacaaaagtggccatccct

SEQ ID NO: 168166 - DNA, 75 bp, Artificial Sequence
  Synthetic
tatgcgaagaaccaaagcacgaatgggatactttggctgctacatctgataaaccgaccagtcataaagacgata

SEQ ID NO: 168167 - DNA, 75 bp, Artificial Sequence
  Synthetic
gtcgagtgcgtcgtcgcctgccgggtggttttccacggccttccagactgcacggcgccaaggcggcgccagcaa

SEQ ID NO: 168168 - DNA, 75 bp, Artificial Sequence
  Synthetic
ataccgctataataatcattccaacacatcacacggcagacacactacgtggactttagtgttaatttgtatagc

SEQ ID NO: 168169 - DNA, 75 bp, Artificial Sequence
  Synthetic
tggcgggtgtgtcagggtgtgccgcgggtgtgccgcgggcgtgtgtcgggtgtgtcagggcgtgtgtcgggtgtg

SEQ ID NO: 168170 - DNA, 75 bp, Artificial Sequence
  Synthetic
agaattcatagttcgatacaatcctgagcatgaggattaagcaacgtttccggataaacatcttatgagaccaca

SEQ ID NO: 168171 - DNA, 75 bp, Artificial Sequence
  Synthetic
gcgactcccccccccctcccttgcgcccgcgagcttcttgtgcgtgtgtcctcgacgcgggttgttgtgccgtac

SEQ ID NO: 168172 - DNA, 75 bp, Artificial Sequence
  Synthetic
gttatggactggcagtttacggttaagtggaggttactgatcatcacgttatctgaaggttgtaatgatacatgc

SEQ ID NO: 168173 - DNA, 75 bp, Artificial Sequence
  Synthetic
agtggaggttactgatcatcacgttatctgaaggttgtaatgatacatgcccttgttcgtgcaactgcctcacct

SEQ ID NO: 168174 - DNA, 75 bp, Artificial Sequence
  Synthetic
cgtcttgtctctggccgtcgtcccccacccccgggcgttgctcttcgtgtgtccccagggacccgcgctgccgtc

SEQ ID NO: 168175 - DNA, 75 bp, Artificial Sequence
  Synthetic
ccccctggggacttcctcttttccgcgtcttgtctctggccgtcgtcccccacccccgggcgttgctcttcgtgt

SEQ ID NO: 168176 - DNA, 75 bp, Artificial Sequence
  Synthetic
ccacgcacaaaccctctaccgcctcgtcagatacatcaacaattactccaacgctgttggaatcaccgtcaagcg

SEQ ID NO: 168177 - DNA, 75 bp, Artificial Sequence
  Synthetic
cgcgactccaattttcacccccccgctaaaaacacccccccgcccctcggggacccaccacgcggcccggaatgg

SEQ ID NO: 168178 - DNA, 75 bp, Artificial Sequence
  Synthetic
gtcagatacatcaacaattactccaacgctgttggaatcaccgtcaagcgttacgcgaatattaacaacgttctc

SEQ ID NO: 168179 - DNA, 75 bp, Artificial Sequence
  Synthetic
ccattccgggccgcgtggtgggtccccgaggggcgggggggtgttttcagcggggggggtgaaatttggagttgc

SEQ ID NO: 168180 - DNA, 75 bp, Artificial Sequence
  Synthetic
cactactacattgactacagatctttcatctacatatcaaatatcatctgcatcaacttcaacacctatttctaa

SEQ ID NO: 168181 - DNA, 75 bp, Artificial Sequence
  Synthetic
acaatctaatttaaattacgaggtaattaacgtaacagcgtatgtcggtggatacgtcactctgcaaaattgcac

SEQ ID NO: 168182 - DNA, 75 bp, Artificial Sequence
  Synthetic
attaacgtaacagcgtatgtcggtggatacgtcactctgcaaaattgcactagaacggatacatggtatgatgta

SEQ ID NO: 168183 - DNA, 75 bp, Artificial Sequence
  Synthetic
acacctgggcgcgtttcacctgccggcgatccgccacctcacggccggcgacgtggcccgcgtccaggacagcgt

SEQ ID NO: 168184 - DNA, 75 bp, Artificial Sequence
  Synthetic
aattttaagcacatcaacggaaactaacgttggctctacggaaataaacgttacttccatgaatacttcagcaac

SEQ ID NO: 168185 - DNA, 75 bp, Artificial Sequence
  Synthetic
ggcatgtgtctagactgtaacagaacctctctcaccatctacaacgtaaccgtcgaacacgctggaaaatacgtt

SEQ ID NO: 168186 - DNA, 75 bp, Artificial Sequence
  Synthetic
ttacatcgctacattgacggtaaaaaggaaaactactatctaactgtattatggggaaccacaacatcgtctcct

SEQ ID NO: 168187 - DNA, 75 bp, Artificial Sequence
  Synthetic
atagtatcatattatgcgtgtcctggtttttcatttttggatgtatttgtcgcataaaaggcggtgagatgtggg

SEQ ID NO: 168188 - DNA, 75 bp, Artificial Sequence
  Synthetic
gaattcatgctgtatgggcgggtgtagtcgtatctgtggcacttgtagccttatacatgggtagccgtcgcgctt

SEQ ID NO: 168189 - DNA, 75 bp, Artificial Sequence
  Synthetic
aataaacttttgcttttctttttagccaataatatgtttccgtgtggtttttataggttaaccacttatggtgta

SEQ ID NO: 168190 - DNA, 75 bp, Artificial Sequence
  Synthetic
ccaataatatgtttccgtgtggtttttataggttaaccacttatggtgtaaagtaggatattcatagttattgaa

SEQ ID NO: 168191 - DNA, 75 bp, Artificial Sequence
  Synthetic
caataccaacggtatctggatatgtccacgacctacaaaagacgaagcccaagaaaacaaccagagtgaagaaaa

SEQ ID NO: 168192 - DNA, 75 bp, Artificial Sequence
  Synthetic
gctccggtacttttacatgaacaagaaaaggcattttaccgacaactttttgcgcaaagtcaacatgtaaaaaca

SEQ ID NO: 168193 - DNA, 75 bp, Artificial Sequence
  Synthetic
gtttcccataaacgaaaccattacccaagaacttcccaccgcagtgcctggactgttacgttgctttgtgtcgcc

SEQ ID NO: 168194 - DNA, 75 bp, Artificial Sequence
  Synthetic
aaaaggcattttaccgacaactttttgcgcaaagtcaacatgtaaaaacacccatcacggtagttcagggagata

SEQ ID NO: 168195 - DNA, 75 bp, Artificial Sequence
  Synthetic
gaatttattgtacggtataacccagagcatgaagattgatctacgtttccgagaagtttatgaacctggacaaaa

SEQ ID NO: 168196 - DNA, 75 bp, Artificial Sequence
  Synthetic
gatggaacggatacatacaaagacaatatcacgaaaacaaatcgtgctctccacgatttacatgttttaatgaca

SEQ ID NO: 168197 - DNA, 75 bp, Artificial Sequence
  Synthetic
gagaagtttatgaacctggacaaaaaagcaaagcaccctaaagaactcacagcgttcaaagagatacctatgccc

SEQ ID NO: 168198 - DNA, 75 bp, Artificial Sequence
  Synthetic
gcggggacgggggccttttgcggcagggacggggcgttgcggagacggggacgggagtggggacgctggtgagga

SEQ ID NO: 168199 - DNA, 75 bp, Artificial Sequence
  Synthetic
ccacgatttacatgttttaatgacaccaaaggtcttagactacataacgttacgtttagcgattcaggaacatac

SEQ ID NO: 168200 - DNA, 75 bp, Artificial Sequence
  Synthetic
cacttcagaatcccttgacaccactactcgtacagattgttcaactacagctgcacaaaccaccgtttctacaga

SEQ ID NO: 168201 - DNA, 75 bp, Artificial Sequence
  Synthetic
cgcataccccgctcaactgcgttttgccacccctgtcagtgctctcgctcgagcaccaccccgcatctcccaacc

SEQ ID NO: 168202 - DNA, 75 bp, Artificial Sequence
  Synthetic
aaacgttacatgtgatggtttgaattatacagttcataaaacatgcggtcgtagctacgaagtaatcaatgtaac

SEQ ID NO: 168203 - DNA, 75 bp, Artificial Sequence
  Synthetic
gggacacgttggtagcaacgttactctgaaaaaatgtaatcacacaatatggcacaatgtggattggattaaata

SEQ ID NO: 168204 - DNA, 75 bp, Artificial Sequence
  Synthetic
gtgtcggcatacaatgcgcttcacgggaagatgcgtgatacatagcgtacccccagacggtacggcttatgagaa

SEQ ID NO: 168205 - DNA, 75 bp, Artificial Sequence
  Synthetic
ctgggaattcatgctgtgtgggcgggtatagtggtatcagtggcacttatagcgctgtacatgggtagccgtcgc

SEQ ID NO: 168206 - DNA, 75 bp, Artificial Sequence
  Synthetic
atccctagaaagccgcgttataccagacttcccaaacatgatccagatgagttttggactaaaacctaacatgca

SEQ ID NO: 168207 - DNA, 75 bp, Artificial Sequence
  Synthetic
tccggtttggaatcgttcggctccggctcgggggatagtgaggaattctcaggggacgatatgggacccaatgac

SEQ ID NO: 168208 - DNA, 75 bp, Artificial Sequence
  Synthetic
tcggtgaagttgcccgacatcctccccttgaagtacagcatgcccatatggaaccagcattggttctcctccacc

SEQ ID NO: 168209 - DNA, 75 bp, Artificial Sequence
  Synthetic
tgtaacattgaacgattcaggaacatataccgaggacgtttacgagtgcgaccttttatgtaacattactaactg

SEQ ID NO: 168210 - DNA, 75 bp, Artificial Sequence
  Synthetic
tctgcgttctgatttactttaacgttccaacaaccctaagacacaaactacaaactagaaacaacgtaaaccgca

SEQ ID NO: 168211 - DNA, 75 bp, Artificial Sequence
  Synthetic
taccagcaagccacgcagcaaaacgagggtcgcctcacgcagatccacgacctgcttcatgtcatcgagacgctg

SEQ ID NO: 168212 - DNA, 75 bp, Artificial Sequence
  Synthetic
ttccctcgttacccccgtgtatcggcgtacagtgtgcttcatgggaagacacatgacacataacgtatccccgga

SEQ ID NO: 168213 - DNA, 75 bp, Artificial Sequence
  Synthetic
cacccgacacacgcccgcgacacacccggcacacacccacccagccgcgccccgacacacccaaaacaccgccgg

SEQ ID NO: 168214 - DNA, 75 bp, Artificial Sequence
  Synthetic
gcacgtacaccttcatgaggccggcgcgaaagagttcctctaggctgtcggccagacggtagatttcaccggcta

SEQ ID NO: 168215 - DNA, 75 bp, Artificial Sequence
  Synthetic
gaacacgtacaaaattatggtaagccatcgtttttcgtgccacagcctgtagctgtcgtacatgaatgaggacgg

SEQ ID NO: 168216 - DNA, 75 bp, Artificial Sequence
  Synthetic
tgtttgagcatgactgtttccaaaccgtaacgtggtaaataaatcatggcttccgacgtgggttctcatcctctg

SEQ ID NO: 168217 - DNA, 75 bp, Artificial Sequence
  Synthetic
cggcgtgttgtccacggcgctttctgcgcgctgccggtgcgtgtggctccacagcacttgtcgttccgccagtcc

SEQ ID NO: 168218 - DNA, 75 bp, Artificial Sequence
  Synthetic
cgttcctggcggatataagtatataaacgcgagttagcctttcccgtccgttttgtacacccgttccccacacaa

SEQ ID NO: 168219 - DNA, 75 bp, Artificial Sequence
  Synthetic
cgccgggacgaggggtgtgcgggacggtgggtgtgcggggacgggggtgtgcggggacggggggtgtgcggggac

SEQ ID NO: 168220 - DNA, 75 bp, Artificial Sequence
  Synthetic
gaggacggggacggggacggtggtggggacggcgcgttgcggggcgtcgcgggatggcggggacgggggcctttc

SEQ ID NO: 168221 - DNA, 75 bp, Artificial Sequence
  Synthetic
cacaagccggcctgttacttatagcgggctacccaattgtaacacggtgactaaaacaacgggtcaagacgctga

SEQ ID NO: 168222 - DNA, 75 bp, Artificial Sequence
  Synthetic
acgcgtacaaatagcagtgactgggtaacgttaggaaccagtacgccattgttgggaagcacggagactgcgatc

SEQ ID NO: 168223 - DNA, 75 bp, Artificial Sequence
  Synthetic
aactatagcggtatttattatcgaaaaggtgataactgtaccaatcaaagtacaacactatcttgttttaaccta

SEQ ID NO: 168224 - DNA, 75 bp, Artificial Sequence
  Synthetic
aaggtgataactgtaccaatcaaagtacaacactatcttgttttaacctaacggtggttcctggagcggtccaaa

SEQ ID NO: 168225 - DNA, 75 bp, Artificial Sequence
  Synthetic
aaaagaccggaggcggggtgtttttagagcaaaaccttacagctttttaataaaaaacaaggtagtcaacataat

SEQ ID NO: 168226 - DNA, 75 bp, Artificial Sequence
  Synthetic
tcttttgtggttgctgatgttcgctgccatctccgtctgtaatcaaaacgtcatactccccggagtaatcttcgt

SEQ ID NO: 168227 - DNA, 75 bp, Artificial Sequence
  Synthetic
ctgattaactatatcgtgagtcatggcctttttccatggtccgtcatgaccgcaatgatactttacaggtattcc

SEQ ID NO: 168228 - DNA, 75 bp, Artificial Sequence
  Synthetic
tatagtaatgtgctttttatcagggagaaggttttgtgccaacaatgactagcccgggactatctgcgtcagaaa

SEQ ID NO: 168229 - DNA, 75 bp, Artificial Sequence
  Synthetic
tactgggttgttccaccgtcacgctgcaaaaacacgataaccgcgttcacaatcacgttattttttgtatttctt

SEQ ID NO: 168230 - DNA, 75 bp, Artificial Sequence
  Synthetic
tatgaacaagtgtataacaagttacacattacacgacaatgtcttagaaatcatacattacttcttattaatttg

SEQ ID NO: 168231 - DNA, 75 bp, Artificial Sequence
  Synthetic
atcacgtacaagacgatacatcaaggacagccgactctgcattagtctccaccgcctttggcgggtccgtctttc

SEQ ID NO: 168232 - DNA, 75 bp, Artificial Sequence
  Synthetic
gatggccttggtggcggcctccgtgtcgtacggatcgacgcccagcatgcaggaggcgcgtccgcgcgggttgtt

SEQ ID NO: 168233 - DNA, 75 bp, Artificial Sequence
  Synthetic
ccgcgtgcggataggcacctggacttcaatgtccttgtacgttaacaatttttctttttcctcctcttcctcagt

SEQ ID NO: 168234 - DNA, 75 bp, Artificial Sequence
  Synthetic
gtttgaataccgtacgcataatgacgtgcatgtacgtgattatacaacaagtgttcatattatgcggcgactgat

SEQ ID NO: 168235 - DNA, 75 bp, Artificial Sequence
  Synthetic
gacatggttatcatccaggacaaagagtacactggtataaccagtcatgcgtcggaatcggcaatggcgaaaatg

SEQ ID NO: 168236 - DNA, 75 bp, Artificial Sequence
  Synthetic
cactgttgtacgagtgttacaattccacattaagtattcttcatgtaaacgtttcagataccaaaaactattgta

SEQ ID NO: 168237 - DNA, 75 bp, Artificial Sequence
  Synthetic
tttcccaacgactgaattctgacagtgtcgtgagaagcattagtaacccaatctttccatagctggcacatgccg

SEQ ID NO: 168238 - DNA, 75 bp, Artificial Sequence
  Synthetic
tgtcgtgagaagcattagtaacccaatctttccatagctggcacatgccgaagaagagatatcccgaaactgtat

SEQ ID NO: 168239 - DNA, 75 bp, Artificial Sequence
  Synthetic
gccagatggtagttagataggactcaccgcggttgatgcaactctccgttaggttagtcacgctccaattaccct

SEQ ID NO: 168240 - DNA, 75 bp, Artificial Sequence
  Synthetic
gtaacgcagaggcacagcgagcaaaagatgccgcacacagcgcatggattcttattgtcatcatcattatcatag

SEQ ID NO: 168241 - DNA, 75 bp, Artificial Sequence
  Synthetic
gacccccgatggctgtgcgagtaactccgttggccccggtaaggagagatacaaagatggtatcggtattgttgc

SEQ ID NO: 168242 - DNA, 75 bp, Artificial Sequence
  Synthetic
gccgtgctagccttacatatagttaccgtcatgggtaaagcaggcattaagcacaaaaaacaccgtggggggggg

SEQ ID NO: 168243 - DNA, 75 bp, Artificial Sequence
  Synthetic
gaaccggcgcgggtttcaacacgaaaccgcgtcactcacggacgtaggttatttcgaaaacctacgttaatcctg

SEQ ID NO: 168244 - DNA, 75 bp, Artificial Sequence
  Synthetic
gccccagacgcgtagcggtaggactggcgcatggtgccgcggcgtggagcggcacttggcagcctattttatgga

SEQ ID NO: 168245 - DNA, 75 bp, Artificial Sequence
  Synthetic
tccgcgacgtcaccccgtgtctccgtcgccacctcccgtccccaccaccgtccccggccccgcaacgcgccgtcc

SEQ ID NO: 168246 - DNA, 75 bp, Artificial Sequence
  Synthetic
tcgccacctcccgtccccaccaccgtccccggccccgcaacgcgccgtccccaccaccgtccccaccaccgtccc

SEQ ID NO: 168247 - DNA, 75 bp, Artificial Sequence
  Synthetic
cgggacgacacgcaccggcagcgcgcagaaagcgccggccacaggacgtcagaaaagtcacgacccgcacacccg

SEQ ID NO: 168248 - DNA, 75 bp, Artificial Sequence
  Synthetic
actgccgctaccgcgtccgcgaaagtagcggatggcgcggcacgtcgtaaacatggcccatatgaaaaagagcat

SEQ ID NO: 168249 - DNA, 75 bp, Artificial Sequence
  Synthetic
acggccttccagactgcgcggcgccaaggcggcgccagcaagccccgtgcacgtcgctgcctataaaagccaggt

SEQ ID NO: 168250 - DNA, 75 bp, Artificial Sequence
  Synthetic
cccccgacacaccccgaccgccgccggtgcgggacagggctgaggggaggttacgttggagacggggacagtttt

SEQ ID NO: 168251 - DNA, 75 bp, Artificial Sequence
  Synthetic
acagctcacctagccgcgaccgcttcgtgcagctgcttttctatatgtgggccggcaccggcgtcatgagcacca

SEQ ID NO: 168252 - DNA, 75 bp, Artificial Sequence
  Synthetic
cagacaaccgaccaccaacagaaatatacacacagaccaccgggagttcagttaaagatttcatcaggtttattt

SEQ ID NO: 168253 - DNA, 75 bp, Artificial Sequence
  Synthetic
ggactcctttgtacagaagtaaatgtgagaacactactaatgcttcatccaccgctgaatctacaagcattatca

SEQ ID NO: 168254 - DNA, 75 bp, Artificial Sequence
  Synthetic
gagtggtttggggtggcatccaaacgtgaggtattgacaggtcaatgggcggtggcacggtggtgggctgttcac

SEQ ID NO: 168255 - DNA, 75 bp, Artificial Sequence
  Synthetic
aggtctttggataccagcgcgtaggtgttaagtctctgttggtatctttccagggtttcggtcagatctacctgg

SEQ ID NO: 168256 - DNA, 75 bp, Artificial Sequence
  Synthetic
cgtgttggtactgtgggcttggttgtaacggtgtttccgctgctgtggctcctaaaccgacgtgaagttctacgt

SEQ ID NO: 168257 - DNA, 75 bp, Artificial Sequence
  Synthetic
tagtggtggtcgttgtcgtgctcgtggtggttgttttctttgttgtggtggtagttgtcgttctcgtggtcgtag

SEQ ID NO: 168258 - DNA, 75 bp, Artificial Sequence
  Synthetic
ggtggttgttttctttgttgtggtggtagttgtcgttctcgtggtcgtagtgggttttttggtggtggtagtggg

SEQ ID NO: 168259 - DNA, 75 bp, Artificial Sequence
  Synthetic
atgggactgatgtacgaatgtggtcatggtgcgatagtaatcagtatattcttccgttacattgatgagaaggag

SEQ ID NO: 168260 - DNA, 75 bp, Artificial Sequence
  Synthetic
cactggacacaggtgacaacgaacaatgacgcccgaaataataatacagataccatctttgtatctctccttacc

SEQ ID NO: 168261 - DNA, 75 bp, Artificial Sequence
  Synthetic
cattaatctattagctccacctccaccaaaagaccagtacacatagtcaccgtcatgcacatgtaccgcgttcaa

SEQ ID NO: 168262 - DNA, 75 bp, Artificial Sequence
  Synthetic
ccaaaagaccagtacacatagtcaccgtcatgcacatgtaccgcgttcaatgtgacgttagtacctactttagca

SEQ ID NO: 168263 - DNA, 75 bp, Artificial Sequence
  Synthetic
acgtgggttggtcactgacgtgcaggatgttacgcgagtcagagaatcgcataagaacggggtggtgagcgggtt

SEQ ID NO: 168264 - DNA, 75 bp, Artificial Sequence
  Synthetic
ccgatgcgcgtgatgctggcggcgatgggcagacacggcatcatgccgttgaccacgccggtaaaaccgtagaaa

SEQ ID NO: 168265 - DNA, 75 bp, Artificial Sequence
  Synthetic
caaatcgccggtaattacattctccctgtattacgcagcgagcagttacttgagtctgtaataggacgcattacc

SEQ ID NO: 168266 - DNA, 75 bp, Artificial Sequence
  Synthetic
acgtatatgtacgtcattatgtttacggtattcaaacagtgagctgaaaaataaacgtacatggccattcttttt

SEQ ID NO: 168267 - DNA, 75 bp, Artificial Sequence
  Synthetic
aagtcaacatatagacgcacctattacagtaattcagggagatacagtttatctcaacgctagtaacaatccctg

SEQ ID NO: 168268 - DNA, 75 bp, Artificial Sequence
  Synthetic
ttgtatgtggggtggcagtatcgtgttgtgcttcaacgttaccggcggcatagtggaccgcggtatgtgttaagt

SEQ ID NO: 168269 - DNA, 75 bp, Artificial Sequence
  Synthetic
tgtgtgtttgatatatggaatatacagtgacattgtaacatagaggtgtccgtaatacccaaccatatgtgtata

SEQ ID NO: 168270 - DNA, 75 bp, Artificial Sequence
  Synthetic
agtgacattgtaacatagaggtgtccgtaatacccaaccatatgtgtatagagaatcgaagtagtaaatcccgct

SEQ ID NO: 168271 - DNA, 75 bp, Artificial Sequence
  Synthetic
tatttcttcaagtttttcagtataataacataacatgttaagggctttaagtgaatctttataccatgaaaaagt

SEQ ID NO: 168272 - DNA, 75 bp, Artificial Sequence
  Synthetic
taacataacatgttaagggctttaagtgaatctttataccatgaaaaagtatagtctttagatgataatgcatta

SEQ ID NO: 168273 - DNA, 75 bp, Artificial Sequence
  Synthetic
atgttcctattgggaagggtgtgaatgtacgaggtataaagaatggtgggacgcaggaagacatcgctagacaca

SEQ ID NO: 168274 - DNA, 75 bp, Artificial Sequence
  Synthetic
tgatagaactgttgtatacgaagcaatattgttatccaccaaagcagccacgtgtatctatacattgtagttcat

SEQ ID NO: 168275 - DNA, 75 bp, Artificial Sequence
  Synthetic
gggcaggaggcttggtggcggtgttcattaaatgcattacgtgtatttattggtacagttgcaaacatccgggtg

SEQ ID NO: 168276 - DNA, 75 bp, Artificial Sequence
  Synthetic
atattgttatccaccaaagcagccacgtgtatctatacattgtagttcatcacagctccgtgtccgtcataaata

SEQ ID NO: 168277 - DNA, 75 bp, Artificial Sequence
  Synthetic
tattgtatatgtgccgtgcaaagtgtcctagaatattatgatgcgaagcgttgcaataacaggaaaaatgctaaa

SEQ ID NO: 168278 - DNA, 75 bp, Artificial Sequence
  Synthetic
tgatgagaattatggcaataattagcatccaagaataatgtgttttcgttctttgatattgtacttccccagctg

SEQ ID NO: 168279 - DNA, 75 bp, Artificial Sequence
  Synthetic
catccaagaataatgtgttttcgttctttgatattgtacttccccagctgggtattccacaggttgtggagtaac

SEQ ID NO: 168280 - DNA, 75 bp, Artificial Sequence
  Synthetic
aggatacgtgttgtaatacaggttaccgtgtactggtgcgcgagttacgatgtcagtacttcgtcggtgtaattg

SEQ ID NO: 168281 - DNA, 75 bp, Artificial Sequence
  Synthetic
gtcactgctatttgtacgtgctgtattggcggcttccgtaagttcataatttccgttataattttccgatgcata

SEQ ID NO: 168282 - DNA, 75 bp, Artificial Sequence
  Synthetic
ccgtgtactggtgcgcgagttacgatgtcagtacttcgtcggtgtaattggatattggttacgtatctgtgtgtc

SEQ ID NO: 168283 - DNA, 75 bp, Artificial Sequence
  Synthetic
ttggcggcttccgtaagttcataatttccgttataattttccgatgcatatagcccagggttagtcattgttggc

SEQ ID NO: 168284 - DNA, 75 bp, Artificial Sequence
  Synthetic
atacaaacaactattagagctataaatacgataacacctaccaaggccaggtgcgtgttgttttcccgaggcgtc

SEQ ID NO: 168285 - DNA, 75 bp, Artificial Sequence
  Synthetic
atacgataacacctaccaaggccaggtgcgtgttgttttcccgaggcgtctgatttaagaatccagcgacggcac

SEQ ID NO: 168286 - DNA, 75 bp, Artificial Sequence
  Synthetic
agaagaaggagaggaggcaacccccgaaggccctccggccccgcggccgcgaccgaggggcggggggcgcggcga

SEQ ID NO: 168287 - DNA, 75 bp, Artificial Sequence
  Synthetic
tggttgttacgttactagctgtagtagtttccaaaggtttcggtttcacggtcaaattataccacaggaacgttt

SEQ ID NO: 168288 - DNA, 75 bp, Artificial Sequence
  Synthetic
cgttccctccctgtggcccagacacgtagatgatggattccagaatcacgggggtaaacaacgccaaaatcaaca

SEQ ID NO: 168289 - DNA, 75 bp, Artificial Sequence
  Synthetic
ccaacaccaaaagttccgttagagccccagcaagtgacacttccattcacgtaggttcccggtgcccctgtcagc

SEQ ID NO: 168290 - DNA, 75 bp, Artificial Sequence
  Synthetic
tgatttatttaccacgttacggtttggaaacagtcatgctcaaacagtgccttttatttcctacattaacaaacc

SEQ ID NO: 168291 - DNA, 75 bp, Artificial Sequence
  Synthetic
tattgtgtgttctttgatgtactgatcatcatccccgaggccaaaaagggcgaattgcaagctgtagtgttacaa

SEQ ID NO: 168292 - DNA, 75 bp, Artificial Sequence
  Synthetic
cgctggaatttgtcgtcagtctcgacgcaacaagtgacacactgaatgtggagtttgtaaccaccgtgggtgtca

SEQ ID NO: 168293 - DNA, 75 bp, Artificial Sequence
  Synthetic
cgcaacaagtgacacactgaatgtggagtttgtaaccaccgtgggtgtcattacggtggttgtgctttgaaccgc

SEQ ID NO: 168294 - DNA, 75 bp, Artificial Sequence
  Synthetic
tgcggttgggacggcggcggcgaataaaagcggcgtgcggcgcgcacggcgaaaagcagacgcgtgtctgtgtct

SEQ ID NO: 168295 - DNA, 75 bp, Artificial Sequence
  Synthetic
agtgccaccactactttcagaaacgttataaataaaaaatgttttccaagaacagccaaacgctacacggtgtcc

SEQ ID NO: 168296 - DNA, 75 bp, Artificial Sequence
  Synthetic
ttataaataaaaaatgttttccaagaacagccaaacgctacacggtgtcctaatgagactcgcgtgcgtgatccc

SEQ ID NO: 168297 - DNA, 75 bp, Artificial Sequence
  Synthetic
gccggaccgtgcaattcagcgtcttgacccgctgttgtagttatcgtgctacagttaggcagtcgattggatgtc

SEQ ID NO: 168298 - DNA, 75 bp, Artificial Sequence
  Synthetic
gccgtcgtccccgccgccgtccctgtcgccggccccgccgcgcagcccagccaccgcgcgggcagcaccgcgccc

SEQ ID NO: 168299 - DNA, 75 bp, Artificial Sequence
  Synthetic
aggcacaaaccatcaaaatcagaaccagcgcgtatctggaaacccagactttattaaaaaggcagctcggcacgc

SEQ ID NO: 168300 - DNA, 75 bp, Artificial Sequence
  Synthetic
ccgcgacacacccgaccgacacacccgcgacacaccctgacacaccccgccaacacacccccgacacacccgaca

SEQ ID NO: 168301 - DNA, 75 bp, Artificial Sequence
  Synthetic
catcttagcatgcattacccgtaaaagtccctcccaccccgtttcagactctctgactgaaaacaaatatgcaaa

SEQ ID NO: 168302 - DNA, 75 bp, Artificial Sequence
  Synthetic
acggtctttgtcagcggcacggcgctggggacggggtttcaccgcgctgagggatgtctctacgggtgtttccac

SEQ ID NO: 168303 - DNA, 75 bp, Artificial Sequence
  Synthetic
gggatgtctctacgggtgtttccacggcgcttctgcgcggcgcttcgctgtggacgggggtttttggacgtgctg

SEQ ID NO: 168304 - DNA, 75 bp, Artificial Sequence
  Synthetic
cgcggtgttgcggggacggggcttgcgctgggacgggggttgcgctggggccgggggttgcgctggggccggggt

SEQ ID NO: 168305 - DNA, 75 bp, Artificial Sequence
  Synthetic
acacgttaccgtacttttcgtatgtttgattgtacgaggcgttgaagatctgttgtagcttatttagagcctgat

SEQ ID NO: 168306 - DNA, 75 bp, Artificial Sequence
  Synthetic
agggacgcttaacatttcaaaagcaacgtaaacacaatagctacagccacgcggctctgtggaacttcacgtgcg

SEQ ID NO: 168307 - DNA, 75 bp, Artificial Sequence
  Synthetic
tacactgcctcatcaatcccattctgtacgcgctgctgggtcatgactttttgcagcgcatgcggcagtgtttcc

SEQ ID NO: 168308 - DNA, 75 bp, Artificial Sequence
  Synthetic
ccggcattctcgagacgtggcgacgtggatttcttgttatgtccgcgaacgacgtgtgacgaggacgtggtttcc

SEQ ID NO: 168309 - DNA, 75 bp, Artificial Sequence
  Synthetic
ttgtagcgtgtaatttaggttgcactcagcctcgaagtagagggggaaccacagttcgtcgtactcgtcgtcgtc

SEQ ID NO: 168310 - DNA, 75 bp, Artificial Sequence
  Synthetic
gcatcttcccttttaaaatagtactttccgctgttttccgtcgtcagatttagcaacgtcaagcggttataggtg

SEQ ID NO: 168311 - DNA, 75 bp, Artificial Sequence
  Synthetic
gaacagatggacttatgaccccaccctaacaaccagtgcaaaaagtcttccgttttgttctgaagacctcgaaat

SEQ ID NO: 168312 - DNA, 75 bp, Artificial Sequence
  Synthetic
ataacagtacgcggcaagtagtaccattggtaataatctccacgttctaagcatcataaccatactcagcctcac

SEQ ID NO: 168313 - DNA, 75 bp, Artificial Sequence
  Synthetic
ctttcaccgtacccggacaacggtgctttatggactcatcgcttaaggtgggatgtatttgcaagccaacagaga

SEQ ID NO: 168314 - DNA, 75 bp, Artificial Sequence
  Synthetic
ttcatttatacatatccagacctcatgtgatacgaggatcatcttacggggaaaaacccttctcttatccagtca

SEQ ID NO: 168315 - DNA, 75 bp, Artificial Sequence
  Synthetic
ttgggtcccgtatcccttgagaattcctcactatcccccgagctggagcagaacaattccaaaccggatacgcta

SEQ ID NO: 168316 - DNA, 75 bp, Artificial Sequence
  Synthetic
acgcatatccgtcgttcggcaccctacccgcctcgcacgctcagtacggctttcgactactgcgcggcatatttt

SEQ ID NO: 168317 - DNA, 75 bp, Artificial Sequence
  Synthetic
tttcgactactgcgcggcatatttttgattacgctcgtcatctggaccgtagtgtggctcaagctgcttcgagac

SEQ ID NO: 168318 - DNA, 75 bp, Artificial Sequence
  Synthetic
gcacaacgggatgacctggtggccttcggtagtgaagcgttggtcgtaacattcttcaggcacgacaggcatggg

SEQ ID NO: 168319 - DNA, 75 bp, Artificial Sequence
  Synthetic
attcttcaggcacgacaggcatgggtctgtcgatttcggcgcctcgtcgttgagtggccttcagcagtctgcgtt

SEQ ID NO: 168320 - DNA, 75 bp, Artificial Sequence
  Synthetic
tctgtcgatttcggcgcctcgtcgttgagtggccttcagcagtctgcgttgttttatatcgtcgggtcggctgtc

SEQ ID NO: 168321 - DNA, 75 bp, Artificial Sequence
  Synthetic
aacaacgttactttgtatacaacagttccatcaatggtggaacccagatacaacgttatgcattccgaaaacggg

SEQ ID NO: 168322 - DNA, 75 bp, Artificial Sequence
  Synthetic
gagacggagtaagaacacaacgacgtttaaagtaaatacaaatgaggcacatgatgcaaataaagatgatacata

SEQ ID NO: 168323 - DNA, 75 bp, Artificial Sequence
  Synthetic
tttaaagtaaatacaaatgaggcacatgatgcaaataaagatgatacatagcagtattctattgcgatccttcat

SEQ ID NO: 168324 - DNA, 75 bp, Artificial Sequence
  Synthetic
ctcgtcatcgtatcggagcgcgtagctgacgcttgcctgagcactgagcggtgggggcatcgttgcagcgtccgg

SEQ ID NO: 168325 - DNA, 75 bp, Artificial Sequence
  Synthetic
tcctaatctgatagaaaccgatatacttttcgggcaattgactttgacgctctgtcatgacggtggtgaggtcga

SEQ ID NO: 168326 - DNA, 75 bp, Artificial Sequence
  Synthetic
gtgtcgatactttgtaatcacgctatgcgatttacgttgtttctagttcgtagtttgtgtctcagagttgccgga

SEQ ID NO: 168327 - DNA, 75 bp, Artificial Sequence
  Synthetic
attggcttaagcaattcggttccgactggcagggtattcaacagaatttggttgttacaacgacaacgccgatcg

SEQ ID NO: 168328 - DNA, 75 bp, Artificial Sequence
  Synthetic
tgcgatttacgttgtttctagttcgtagtttgtgtctcagagttgccggaacgttaaagtggatcaaaacgtaga

SEQ ID NO: 168329 - DNA, 75 bp, Artificial Sequence
  Synthetic
accgatgaaagtttaacgtacgaattagaaatcgaatggtgtaaccatgttagcatcatatcaaaaacattactt

SEQ ID NO: 168330 - DNA, 75 bp, Artificial Sequence
  Synthetic
gtgaagacaccacggtgataatatgcttggtgctatttatggtgtagttacagttatcgaagtaattgagtattt

SEQ ID NO: 168331 - DNA, 75 bp, Artificial Sequence
  Synthetic
tagaaatcgaatggtgtaaccatgttagcatcatatcaaaaacattactttttttgtaaaaacttcgttaggcat

SEQ ID NO: 168332 - DNA, 75 bp, Artificial Sequence
  Synthetic
cttggtgctatttatggtgtagttacagttatcgaagtaattgagtatttcatattcgttataagtagtaatgtt

SEQ ID NO: 168333 - DNA, 75 bp, Artificial Sequence
  Synthetic
tttgtggtccattattaccgtttgtcgttatgaacactttgtaccacgagttgctgttttgtccatcaagccatt

SEQ ID NO: 168334 - DNA, 75 bp, Artificial Sequence
  Synthetic
acctttagtttcgtttatgcacatgaattgcggggaacacgatgtgtttgtgtagtaatgtgtaacattgcgtag

SEQ ID NO: 168335 - DNA, 75 bp, Artificial Sequence
  Synthetic
aattgcggggaacacgatgtgtttgtgtagtaatgtgtaacattgcgtagatatccgttccatccacaaagttcg

SEQ ID NO: 168336 - DNA, 75 bp, Artificial Sequence
  Synthetic
attcaggaggctttggtgggtcacgaccaatccaaaatacaccacctatgggacgatttaaaacattatgggtac

SEQ ID NO: 168337 - DNA, 75 bp, Artificial Sequence
  Synthetic
gttactgtaatgggtgcttctacatgttgactttgcagaaaaagtcgccagtaaaacgcctttttttgttcatgt

SEQ ID NO: 168338 - DNA, 75 bp, Artificial Sequence
  Synthetic
gtaaaacgcctttttttgttcatgtaaaagtatgggcactagagtaccaattaggatgattacaaccggtattag

SEQ ID NO: 168339 - DNA, 75 bp, Artificial Sequence
  Synthetic
cgtcctcctggctcatttatcgctatctcaatgccccgctcacatgcaagagttaatcttcactctatctgacat

SEQ ID NO: 168340 - DNA, 75 bp, Artificial Sequence
  Synthetic
tggtgtggggcgccgcgcccgtgatcatgatgacgtggttctacgccttcttctactcgaccgtacaacgcacgt

SEQ ID NO: 168341 - DNA, 75 bp, Artificial Sequence
  Synthetic
tttatatcataggttgttaacaaaaaaaaacagagacatgttattggttaaaaaaagtttattgatgtgcatgtt

SEQ ID NO: 168342 - DNA, 75 bp, Artificial Sequence
  Synthetic
aaaaacagagacatgttattggttaaaaaaagtttattgatgtgcatgttaagccttagtccaaaattcatctgg

SEQ ID NO: 168343 - DNA, 75 bp, Artificial Sequence
  Synthetic
cactgataccactacgcctgcccatacagcatgaattcccaggggaatgttagctttctcaatggtttttatgat

SEQ ID NO: 168344 - DNA, 75 bp, Artificial Sequence
  Synthetic
acagcatgaattcccaggggaatgttagctttctcaatggtttttatgatgttacttccaatggtgttttcagtg

SEQ ID NO: 168345 - DNA, 75 bp, Artificial Sequence
  Synthetic
tagtaattttcttcttgaccgttatcacggtgatgcctggtatattttccagcgtttcttgtggttaagttgtag

SEQ ID NO: 168346 - DNA, 75 bp, Artificial Sequence
  Synthetic
caaaacatatgtcgtgccgtggtgttgtttggtgatagttgcctaattcgcacattttatgcgtggggtactcat

SEQ ID NO: 168347 - DNA, 75 bp, Artificial Sequence
  Synthetic
tgttacgttgattacctcgtaactgcggtcgcatcttttatggactgtataattgaaaccatcacaagtaacggt

SEQ ID NO: 168348 - DNA, 75 bp, Artificial Sequence
  Synthetic
cggtcgcatcttttatggactgtataattgaaaccatcacaagtaacggtcgtggtggtgttggtacatgtggta

SEQ ID NO: 168349 - DNA, 75 bp, Artificial Sequence
  Synthetic
ggtgcagttgcagtagagcaatttatagattctgaagtgcttttattgctgataactgttgtactgtatgttgat

SEQ ID NO: 168350 - DNA, 75 bp, Artificial Sequence
  Synthetic
ggtccagcatttgacatcgaccgcttttgagtacgtctacagcgtaacggtgaaagctgttacgtagcagtgcgc

SEQ ID NO: 168351 - DNA, 75 bp, Artificial Sequence
  Synthetic
ttgacaggaacaggtttgattgcagctttctgataacgcggatattagtatcgtccacataaccgtaaatcgcca

SEQ ID NO: 168352 - DNA, 75 bp, Artificial Sequence
  Synthetic
ccaggatagagccccgctcgttttgttcctgaccattttgtttagcagctcgtaaactgtcagcctagcgacgac

SEQ ID NO: 168353 - DNA, 75 bp, Artificial Sequence
  Synthetic
gtccattgcaatattagttctcgctcaatgggcattaatattcctttgaacgctgagccttacagaatgttttag

SEQ ID NO: 168354 - DNA, 75 bp, Artificial Sequence
  Synthetic
tttattgttcagcttcataagatgtctgcccggaaacgtagctcaatcttcatgttctgtgtgatatcgaacaat

SEQ ID NO: 168355 - DNA, 75 bp, Artificial Sequence
  Synthetic
ctgcccggaaacgtagctcaatcttcatgttctgtgtgatatcgaacaatgaattctgattcactgacggtgtct

SEQ ID NO: 168356 - DNA, 75 bp, Artificial Sequence
  Synthetic
gtttacacacgcggacgtctccgttgtccgtgtgccacggccgacacgcacctggcttttataggcagcgccgtg

SEQ ID NO: 168357 - DNA, 75 bp, Artificial Sequence
  Synthetic
gcgacgcgcagtctggaagcccgtggaaaaccacccggcaggcgacgacgcactcgactgggaaaggcagacgcc

SEQ ID NO: 168358 - DNA, 75 bp, Artificial Sequence
  Synthetic
agccacagtatagcgagcctaagagaccgcacacggtccctgctggaaacacagtaccacatcgatttgccgtgc

SEQ ID NO: 168359 - DNA, 75 bp, Artificial Sequence
  Synthetic
atggtccatacggtgcggcttctttgcgagctatgatagagattacgtttgtggtgatgtgtattgttagtatgt

SEQ ID NO: 168360 - DNA, 75 bp, Artificial Sequence
  Synthetic
gcgagctatgatagagattacgtttgtggtgatgtgtattgttagtatgttgacttcctttctctctatcttcat

SEQ ID NO: 168361 - DNA, 75 bp, Artificial Sequence
  Synthetic
cgtcgatatcaataaaaataccgtcgacgtggttttctaacagtgtggttttctttattgaccagcggagtacac

SEQ ID NO: 168362 - DNA, 75 bp, Artificial Sequence
  Synthetic
ataggtagaaattttcatcttcgtgatgtcctgtgaagtaattttctttaaaacaacgtctgctgtacctgccgg

SEQ ID NO: 168363 - DNA, 75 bp, Artificial Sequence
  Synthetic
atgtcctgtgaagtaattttctttaaaacaacgtctgctgtacctgccggaattggtgatatttagatcgtacag

SEQ ID NO: 168364 - DNA, 75 bp, Artificial Sequence
  Synthetic
ggaagtccccaggggacgacggcagcgcgggtccccggggacacacgaagaacgcctcccaggggccagcgacgc

SEQ ID NO: 168365 - DNA, 75 bp, Artificial Sequence
  Synthetic
cgcgggtccccggggacacacgaagaacgcctcccaggggccagcgacgcggaaacgacgcggaaaagaggaagt

SEQ ID NO: 168366 - DNA, 75 bp, Artificial Sequence
  Synthetic
agtatgagaggtaaggatgcgtaaccaataccaagattgggtatgtgcgttcttacgatgacctagatgatgtcc

SEQ ID NO: 168367 - DNA, 75 bp, Artificial Sequence
  Synthetic
agaggaagcgcgcggcgccgcgcgaccctggggagcgcgggggaagcaacggccgcaaagtacggcacaacccgc

SEQ ID NO: 168368 - DNA, 75 bp, Artificial Sequence
  Synthetic
caataccaagattgggtatgtgcgttcttacgatgacctagatgatgtccgtgtgtggatcgattgtaatgtcgt

SEQ ID NO: 168369 - DNA, 75 bp, Artificial Sequence
  Synthetic
ttagtttctttgaaacgtatgattgttgtctctgtgtgacaagcgttggaagagttagtacggttgtacgtggtg

SEQ ID NO: 168370 - DNA, 75 bp, Artificial Sequence
  Synthetic
ttgtctctgtgtgacaagcgttggaagagttagtacggttgtacgtggtgtacgttgtggcgctgcaatttgtaa

SEQ ID NO: 168371 - DNA, 75 bp, Artificial Sequence
  Synthetic
gacacaccctgacacaccccgccaacacacccccgacacacccggcacacgcccgcgacacacccgacacccacc

SEQ ID NO: 168372 - DNA, 75 bp, Artificial Sequence
  Synthetic
ttgttgtgttataagatgatgtagcgtttgctgttacgttggtaaaagataatatagtgttggtatttgttgaaa

SEQ ID NO: 168373 - DNA, 75 bp, Artificial Sequence
  Synthetic
gggagggggggggggtccaggaccccggggcacactgcttccatccagccgcgcacgacacacccctgacacacc

SEQ ID NO: 168374 - DNA, 75 bp, Artificial Sequence
  Synthetic
gtttgctgttacgttggtaaaagataatatagtgttggtatttgttgaaatcaattctgtagtggcagccgtatt

SEQ ID NO: 168375 - DNA, 75 bp, Artificial Sequence
  Synthetic
gatgttgccaatggttgacgcttgtgaggtgacagatgtgtgtggcgtcgttgatgtgttgttattcggagtaga

SEQ ID NO: 168376 - DNA, 75 bp, Artificial Sequence
  Synthetic
gaggtgacagatgtgtgtggcgtcgttgatgtgttgttattcggagtagaaaatacgctggtcacaaaggtggta

SEQ ID NO: 168377 - DNA, 75 bp, Artificial Sequence
  Synthetic
aatattatgattgtatacgccgtatgcctgtacgtgagatggtgaggtcttcggcaggcgacacgcatcttttac

SEQ ID NO: 168378 - DNA, 75 bp, Artificial Sequence
  Synthetic
ccgggacacacgcaaaacaacggcaagacgcggaaaagaggaaagaacagacacacgcagaagctcgcgggcgca

SEQ ID NO: 168379 - DNA, 75 bp, Artificial Sequence
  Synthetic
tcctggaggccgtgagcgcggcgcggcgtgtgtgccgttctgtccacggcgccccacgctatttgttcgcgggac

SEQ ID NO: 168380 - DNA, 75 bp, Artificial Sequence
  Synthetic
ccgcggtctttgtcagcggcacggcgctggggacgggatttcaccgcgctgagggatgtctctacgggtgtctct

SEQ ID NO: 168381 - DNA, 75 bp, Artificial Sequence
  Synthetic
aaacagcgacgtgactatgacaagcgtgaggggggtgctgtaggtctgcatggtgcaaaacacgttctcgccttc

SEQ ID NO: 168382 - DNA, 75 bp, Artificial Sequence
  Synthetic
cggggcgttgcggggccgggggttacgttggcgacgggggtggcgggggtgtttgcggcgaggacgggggtggcg

SEQ ID NO: 168383 - DNA, 75 bp, Artificial Sequence
  Synthetic
ggggtgtttgcggcgaggacggggtgtttcggggccagggacgagggaaacgttggggacgggggttgattgcgg

SEQ ID NO: 168384 - DNA, 75 bp, Artificial Sequence
  Synthetic
ggcagggacggggggtgtgcgggggggcttttgcggcggggacgggggcctttcgcggcggggaacacagagtga

SEQ ID NO: 168385 - DNA, 75 bp, Artificial Sequence
  Synthetic
ccattgccggtattagatgatgtgttattcggactgcacttgcacgtcaaatgggtatcttctgatttcacgaga

SEQ ID NO: 168386 - DNA, 75 bp, Artificial Sequence
  Synthetic
cgaccggcagggtattcaacagaatttggttgttacaacgacaacgcttgtcgtaatcttccaattctaaaagat

SEQ ID NO: 168387 - DNA, 75 bp, Artificial Sequence
  Synthetic
tgggtgtgcgaaacaggtgtggaagccgaggaggccatggcgcggcggcgacagcgcatgctgtggcgtatgttc

SEQ ID NO: 168388 - DNA, 75 bp, Artificial Sequence
  Synthetic
acagctgcacggcgttatgatgtttaaaattaaccataacgctggggctactgatggagtagtaatgagccagga

SEQ ID NO: 168389 - DNA, 75 bp, Artificial Sequence
  Synthetic
ggggctcgcgagcccccccccctcccctcggccggacgcttcttctcacccccggccgttgcttttcgtgtgtcc

SEQ ID NO: 168390 - DNA, 75 bp, Artificial Sequence
  Synthetic
ggggctttgcctggtaggatttcctgtggaaacaataaccggatgtgattgtggctggtacataagctggttctg

SEQ ID NO: 168391 - DNA, 75 bp, Artificial Sequence
  Synthetic
gggggggggtacttatagcgtgcctagctatgacgttgatatatgtggatgcggataatactcgtaatgagctaa

SEQ ID NO: 168392 - DNA, 75 bp, Artificial Sequence
  Synthetic
agctatgacgttgatatatgtggatgcggataatactcgtaatgagctaaaagcgacgactggtagtaattttac

SEQ ID NO: 168393 - DNA, 75 bp, Artificial Sequence
  Synthetic
aatgcgcgaccgcctgcgtcgtctatgcttcgcgcgtcaccacgacaccttccttgaagtggtagacgtcttcgg

SEQ ID NO: 168394 - DNA, 75 bp, Artificial Sequence
  Synthetic
caacgttacgggtataggtaatgctactgtgaatagtaacgcaactatttgtgtgtcgagctgtggtcataatac

SEQ ID NO: 168395 - DNA, 75 bp, Artificial Sequence
  Synthetic
actgtgaatagtaacgcaactatttgtgtgtcgagctgtggtcataatacgttggatttatgtaatttaaagtcg

SEQ ID NO: 168396 - DNA, 75 bp, Artificial Sequence
  Synthetic
ttggaagtcagctaaatgttgtatcgcttagtgaattggtgttcttacagttttcatgtaataaactacgtgtaa

SEQ ID NO: 168397 - DNA, 75 bp, Artificial Sequence
  Synthetic
ggtacaacggtcgtcaatacaacagcctgtgtttcaagttgttcgcatacgtcgcttgtgctttgcaatatgacg

SEQ ID NO: 168398 - DNA, 75 bp, Artificial Sequence
  Synthetic
acagcttaacgttgctgaacctgacgacagaaaatagcggaaagtattatttcaaaagagaagatgtgaattcga

SEQ ID NO: 168399 - DNA, 75 bp, Artificial Sequence
  Synthetic
tcacgtgaccatcagcgcaggaagcgaggcccgtagaaccgcccaagaggcggtgccagatgccaacgtcataat

SEQ ID NO: 168400 - DNA, 75 bp, Artificial Sequence
  Synthetic
aagcgacgtatgcgaacaacttgaaacacagactgtggtattaacgaccgttgtaccattactagtcacattgca

SEQ ID NO: 168401 - DNA, 75 bp, Artificial Sequence
  Synthetic
acacagactgtggtattaacgaccgttgtaccattactagtcacattgcatagagaccctccatcgttatcccat

SEQ ID NO: 168402 - DNA, 75 bp, Artificial Sequence
  Synthetic
ttcaggaccgttatcaactctccgctttaaatcataagatccttcgttgccttgcgttacattgcaaaacgtcaa

SEQ ID NO: 168403 - DNA, 75 bp, Artificial Sequence
  Synthetic
tttaaatcataagatccttcgttgccttgcgttacattgcaaaacgtcaatcctgtatgactacaattacacaca

SEQ ID NO: 168404 - DNA, 75 bp, Artificial Sequence
  Synthetic
gaaataaaaagcactgtttgagcgtgactgttttcaaaccgtaacatggtaaataaatcatggctttcaacgtgg

SEQ ID NO: 168405 - DNA, 75 bp, Artificial Sequence
  Synthetic
ccccccccccacaatggaatgctgccaaactggttctttcccgttatagccatagcgttcccaagcaaaagctaa

SEQ ID NO: 168406 - DNA, 75 bp, Artificial Sequence
  Synthetic
cgtcatctacgtgtatgcgccagagggagggaacgttaccctggtgtctaacttcacttcaaacatcagcgtacg

SEQ ID NO: 168407 - DNA, 75 bp, Artificial Sequence
  Synthetic
ctgtcagcctagcgacgtccgtttagatcaaaagtcacgtatatcgcgacgctgtttccacccgtttccccgtcc

SEQ ID NO: 168408 - DNA, 75 bp, Artificial Sequence
  Synthetic
ccccccaccctccccggccgaggcccggcgccggtccgtccgcgggcccgtcccaccgccctggagcaccatccg

SEQ ID NO: 168409 - DNA, 75 bp, Artificial Sequence
  Synthetic
cggtgtcacggtggtaagtatggatacagaaggggagggggaagtagcgttcgtaccgatggttgtggtattatt

SEQ ID NO: 168410 - DNA, 75 bp, Artificial Sequence
  Synthetic
caacacgcacctggccttggtaggtgttgtcgtgtttttagctctaatagttgtttgtattatggggtggtggaa

SEQ ID NO: 168411 - DNA, 75 bp, Artificial Sequence
  Synthetic
gaagttggacggcgtagtttcggggattgtgaaccgtggctgagggtgtagatgggacaggaaaaagcgtgtgat

SEQ ID NO: 168412 - DNA, 75 bp, Artificial Sequence
  Synthetic
aggccgccaatacaacacgtacaaatagcagtgactgggtaacgtcaggaaccagtgcgtcgctgttaggaagcg

SEQ ID NO: 168413 - DNA, 75 bp, Artificial Sequence
  Synthetic
aatatcaaagaacgacaacgcattattcttggatgctgattattgtcatcattcttatcatttttattatcatct

SEQ ID NO: 168414 - DNA, 75 bp, Artificial Sequence
  Synthetic
tacgtactaaccaaaagcaacaaaagcagcaggtaaataagagaaggagtccagataatgtccagccgctagcgg

SEQ ID NO: 168415 - DNA, 75 bp, Artificial Sequence
  Synthetic
ttcttggatgctgattattgtcatcattcttatcatttttattatcatctgtctgcgagcacctagaaaggtcta

SEQ ID NO: 168416 - DNA, 75 bp, Artificial Sequence
  Synthetic
cgctgtcggcccagtcgccaccgccgcggcggatttccgcgcgggggacggggtagccgagtgctgcgccctcgc

SEQ ID NO: 168417 - DNA, 75 bp, Artificial Sequence
  Synthetic
tggttgtttttatggataacaattttgacttacgtacaaagatcttatcattggaactatataagaacacagtgt

SEQ ID NO: 168418 - DNA, 75 bp, Artificial Sequence
  Synthetic
tgacttacgtacaaagatcttatcattggaactatataagaacacagtgtactcctaaaattggacacggtaatc

SEQ ID NO: 168419 - DNA, 75 bp, Artificial Sequence
  Synthetic
tgtttgatcgtagaggtgttggcgggcctgtgcgcgagcagcgtagtctgcggcgtcgagctccatctgtgtgcg

SEQ ID NO: 168420 - DNA, 75 bp, Artificial Sequence
  Synthetic
ccgttactaatatattatgtatttattatcataatgagtacagagtaaaatccaatgaagacattttatacatca

SEQ ID NO: 168421 - DNA, 75 bp, Artificial Sequence
  Synthetic
ttatcataatgagtacagagtaaaatccaatgaagacattttatacatcaagtggcaatgtacagagaatcatac

SEQ ID NO: 168422 - DNA, 75 bp, Artificial Sequence
  Synthetic
gcctgtgcgcgagcagcgtagtctgcggcgtcgagctccatctgtgtgcggtgttcttcgtcggcgtgtttgtcc

SEQ ID NO: 168423 - DNA, 75 bp, Artificial Sequence
  Synthetic
aatactgaaaccgaacactttatgttataaagttagcctgcattctacacatcaaatacactatcatacgaccac

SEQ ID NO: 168424 - DNA, 75 bp, Artificial Sequence
  Synthetic
ggagggtccaggcacgggccgaggagaccacgaccgtcccacccggcgtgtcgacccgtccgagacccgggaagg

SEQ ID NO: 168425 - DNA, 75 bp, Artificial Sequence
  Synthetic
tcaaagactccgagataaatgggacaccaggggatacctttacaaaggaaccgacggcctgcccactacggacta

SEQ ID NO: 168426 - DNA, 75 bp, Artificial Sequence
  Synthetic
aatctcgacgagtctggccgagcggcgccatcttggaggaggggcgagtcgcgggcaccgcctcggtaccccctg

SEQ ID NO: 168427 - DNA, 75 bp, Artificial Sequence
  Synthetic
agtgcgcaggcagcgtcggacacaacacgcttacggccctcaacactccctcgaggacccaccacgcggcccgga

SEQ ID NO: 168428 - DNA, 75 bp, Artificial Sequence
  Synthetic
gtttccagttatcgcttatttctagaacgactaccaaaaaacccggacaaaaaactacgtcaccgcgattaaaaa

SEQ ID NO: 168429 - DNA, 75 bp, Artificial Sequence
  Synthetic
ccgtccccgccgcgaaaggcccccgtccccgccgcgaaaggcccccgtccccgccgcgaaaggcccccgtccccg

SEQ ID NO: 168430 - DNA, 75 bp, Artificial Sequence
  Synthetic
cacgcttacggccctcaacactccctcgaggacccaccacgcggcccggaatggacccaccacgcggcccggaat

SEQ ID NO: 168431 - DNA, 75 bp, Artificial Sequence
  Synthetic
ccgccgcgaaaggcccccgtccccgcacaccccccgtccccgcacacccccgtcccgcacacccccgtcccgcac

SEQ ID NO: 168432 - DNA, 75 bp, Artificial Sequence
  Synthetic
ttttaacggtaacaatacagctcccgttaaacattagattaatagacgttagtggataacagcatgttattcgcc

SEQ ID NO: 168433 - DNA, 75 bp, Artificial Sequence
  Synthetic
gattacggagtctttgaagaattcccggtaacggatgagatacgcgcagaggaaaatcatgaaaacagaacagcc

SEQ ID NO: 168434 - DNA, 75 bp, Artificial Sequence
  Synthetic
accgtacacgtactctggttaccaggcttaacactagccatcatagcgtggtctggcaacgctacgatatctatg

SEQ ID NO: 168435 - DNA, 75 bp, Artificial Sequence
  Synthetic
tttatccatcttgtgtgaaaatattgagatatgcgatgaatgttttcgctatctatattataaagcgtttcagtg

SEQ ID NO: 168436 - DNA, 75 bp, Artificial Sequence
  Synthetic
gtatacaatgccctaaaacattgtaacacgaaacgttacaatgatgggaaagatgccgataaaaaacacataaaa

SEQ ID NO: 168437 - DNA, 75 bp, Artificial Sequence
  Synthetic
ctttttgtcggtctgaatcgacccgggatacgtaagagagcggccctacatcggggggcgctcgagaccgacgac

SEQ ID NO: 168438 - DNA, 75 bp, Artificial Sequence
  Synthetic
attaattatacgtcttgtagtacacgttaccgtgtactggtgcgcgtattacgacacaaaccacatagcgctata

SEQ ID NO: 168439 - DNA, 75 bp, Artificial Sequence
  Synthetic
caaaaaccacttgcgtcagtatgacaatcataaaggctcggtgattgctacgcctaaagtacgcgggattatcca

SEQ ID NO: 168440 - DNA, 75 bp, Artificial Sequence
  Synthetic
gacgcgctgcacctgcacccgcgcgccgcgctgtgggcgcgcgagccgcacgggcagttggcttttttgctacgt

SEQ ID NO: 168441 - DNA, 75 bp, Artificial Sequence
  Synthetic
ctaatcgtcccccgcacaccccccgcggcacccagagggcgggtgagccaagtatttttaaggccgttctctgtt

SEQ ID NO: 168442 - DNA, 75 bp, Artificial Sequence
  Synthetic
gttatgtttcgaaaacttgttttacaatgttataacgacgccagtgataagtaccagacatccaattacaccgat

SEQ ID NO: 168443 - DNA, 75 bp, Artificial Sequence
  Synthetic
aatgttataacgacgccagtgataagtaccagacatccaattacaccgatgtggaactgttgcgacaatacgcgt

SEQ ID NO: 168444 - DNA, 75 bp, Artificial Sequence
  Synthetic
gctttcgcgtcttttttctcgttgtacgcattacacaggtgttgttagactagcacagagacaccaattgcttta

SEQ ID NO: 168445 - DNA, 75 bp, Artificial Sequence
  Synthetic
acgcattacacaggtgttgttagactagcacagagacaccaattgctttaatactcgcgacgcttcatattagta

SEQ ID NO: 168446 - DNA, 75 bp, Artificial Sequence
  Synthetic
aaaactactaatacagatacgcaatgcatctaacaaccgtcgacaacatcccccccccccccatacttttacgaa

SEQ ID NO: 168447 - DNA, 75 bp, Artificial Sequence
  Synthetic
gcatctaacaaccgtcgacaacatcccccccccccccatacttttacgaataaccactgttttattcttggcgcc

SEQ ID NO: 168448 - DNA, 75 bp, Artificial Sequence
  Synthetic
caccctacagtcacacccttcccaataggaacatcgacacatgaccgcacatattatagccagaaatacaaacgt

SEQ ID NO: 168449 - DNA, 75 bp, Artificial Sequence
  Synthetic
taggaacatcgacacatgaccgcacatattatagccagaaatacaaacgtagcgtacgcccaacggcaaacgcaa

SEQ ID NO: 168450 - DNA, 75 bp, Artificial Sequence
  Synthetic
ggataacaacactgcgtatctgcatatgtttcatcctcacacctcgccaccctttatgcgatacatacatccaaa

SEQ ID NO: 168451 - DNA, 75 bp, Artificial Sequence
  Synthetic
cggggacggggtgttgcgggcgctcgggggttggcggcggatgtttcgcgggtgtttgtgcggcgtctctccgca

SEQ ID NO: 168452 - DNA, 75 bp, Artificial Sequence
  Synthetic
tgctggcgccgccttggcgccgcgcagtctggaacgccgtggaaaacccaaaggcagacgcgcggcaggccaaca

SEQ ID NO: 168453 - DNA, 75 bp, Artificial Sequence
  Synthetic
ttttatcgtaggctgtcagcgttgctgggtccgtcctgctttccatatttgcgcattgctcatcggtgggatgaa

SEQ ID NO: 168454 - DNA, 75 bp, Artificial Sequence
  Synthetic
cggttttgatagggcgaccgctgaggcgaggcgcgtgtgcgtgtggtgtctgctccccgtccctccgtcgcaaaa

SEQ ID NO: 168455 - DNA, 75 bp, Artificial Sequence
  Synthetic
cggcaccttctcagaaatcgaagcgcaggtaaacggaatctggggaactcaacacaggtaagaaatacaaaaaat

SEQ ID NO: 168456 - DNA, 75 bp, Artificial Sequence
  Synthetic
cgccaccttccttgtctgcgcaacacccccgtccccgttcccgtcgcaaacagcgccgccacccctgtccccgcc

SEQ ID NO: 168457 - DNA, 75 bp, Artificial Sequence
  Synthetic
cgcgcagaagcgccgtggaaacacccgtagagagatccctcagcgcggtgaaaccccgtccccagcgccgtgccg

SEQ ID NO: 168458 - DNA, 75 bp, Artificial Sequence
  Synthetic
aaaccccgtccccagcgccgtgccgctgacaaagaccgtgggacgacacgcatcggcagcgggcactaagcgccg

SEQ ID NO: 168459 - DNA, 75 bp, Artificial Sequence
  Synthetic
gggtgtgtcgcgggtgtgtcggtcgggtgtgtcggtcggctgtgtcgcgggcgtgtggcgggtgtgtcaggggtg

SEQ ID NO: 168460 - DNA, 75 bp, Artificial Sequence
  Synthetic
ctccgccggcaaccgcgtcgtcgttgctatcgtcgccggtttcgggcgatgacagcgccggcggcgcgggtctcg

SEQ ID NO: 168461 - DNA, 75 bp, Artificial Sequence
  Synthetic
gcgcgcttcctcttttccgcgcgccgcgcgcttccccctggggacttcctcttttccgcgtcttttccgcgtctc

SEQ ID NO: 168462 - DNA, 75 bp, Artificial Sequence
  Synthetic
ggggttggcggcggggccgggcacgggggccttttgcggcgtttccacgcagcttttgcgcggcgcttcgctttt

SEQ ID NO: 168463 - DNA, 75 bp, Artificial Sequence
  Synthetic
agcttttgcgcggcgcttcgcttttcggggcggcgccggcgaggacgggggtttttgggcgtgcgggatgtccgc

SEQ ID NO: 168464 - DNA, 75 bp, Artificial Sequence
  Synthetic
gcacaaaccccgacacgtaccgtggcaccttggaggaagggccctcgtcaggattatcagggtccatctttctct

SEQ ID NO: 168465 - DNA, 75 bp, Artificial Sequence
  Synthetic
tgttacgacatcaccgaggcggagagtaacaaggctatatcaagggacgaagcagcattcacctccagcgtgagc

SEQ ID NO: 168466 - DNA, 75 bp, Artificial Sequence
  Synthetic
acggcggtttctccacatcatggatagcgtgatccaatacttccatccttcgcattgcggtgtccacatgggaag

SEQ ID NO: 168467 - DNA, 75 bp, Artificial Sequence
  Synthetic
gaattcccggtaacggatgaggtacgcgcagaggaaaatcatgaaaacagaacagccgaccacggctgcaatgcc

SEQ ID NO: 168468 - DNA, 75 bp, Artificial Sequence
  Synthetic
cacgcacatatgtagcactcaacatgttagcttttgcccgcacgccccggggcatgccgagctgcctttttaata

SEQ ID NO: 168469 - DNA, 75 bp, Artificial Sequence
  Synthetic
cgttatttttatcctctttcccgtcttcgtcttcctctgtgtcgcgctcgtcccggtaatcgagatagtcgtcgt

SEQ ID NO: 168470 - DNA, 75 bp, Artificial Sequence
  Synthetic
ctccaaagcagcgtcaacaacagccacacagacacctacgtggggacgacacgggactttttattgacggagact

SEQ ID NO: 168471 - DNA, 75 bp, Artificial Sequence
  Synthetic
gtcatcttcatcggagtctgtctggtggccctgatgtactttacgcagcagcaggcacgcaacgggggcagcagc

SEQ ID NO: 168472 - DNA, 75 bp, Artificial Sequence
  Synthetic
atttttattatcatctgtctgcgagcacctcgaaaagtttacgatcgctggaaagacagtaaacagtatggacaa

SEQ ID NO: 168473 - DNA, 75 bp, Artificial Sequence
  Synthetic
ttgcacaaccactgatcaccattgttaccaaaaacggttttccacttagttgtcaacggatctttcctatgcgta

SEQ ID NO: 168474 - DNA, 75 bp, Artificial Sequence
  Synthetic
taacccccgtccccgcaaacatccccgccggcccagcgcaaacacccccgtccccgcaacaccccgtccccacaa

SEQ ID NO: 168475 - DNA, 75 bp, Artificial Sequence
  Synthetic
cgcaaaagcgccgtggaaacacccgtagagacatccctcagcacgcccaaaaccccgtccccagcgccgtgccgc

SEQ ID NO: 168476 - DNA, 75 bp, Artificial Sequence
  Synthetic
ccgcaaacctccctcagcccggtcccgcgagcaaataccgcgggacggcacgcacaggcagcgcgcactaagcgc

SEQ ID NO: 168477 - DNA, 75 bp, Artificial Sequence
  Synthetic
tgatgtgtttattgtaaaaggccagctgcgtgtggcattgtttgacgatgaaactggaaggcatccacttgtagg

SEQ ID NO: 168478 - DNA, 75 bp, Artificial Sequence
  Synthetic
agggggcccgggtgtcgcgacatgtcgacgacaggtgcggattagtggtcgtgtcgcgacatggacgtgcagggg

SEQ ID NO: 168479 - DNA, 75 bp, Artificial Sequence
  Synthetic
cttttccgcgtcgtttccgcgtcgctggcccctgggagtcgtccgttctgcgtgtgtccccagggacccgcgctg

SEQ ID NO: 168480 - DNA, 75 bp, Artificial Sequence
  Synthetic
atggttgctgactaattgagatgcatgctttgcatacttctgcctgctggggagcctggggactttccacacctg

SEQ ID NO: 168481 - DNA, 75 bp, Artificial Sequence
  Synthetic
gcgtcgtcggctgccgggtggttttccacggccttccagactgcgcggcgccaaggcggcgccagcaagcgccgt

SEQ ID NO: 168482 - DNA, 75 bp, Artificial Sequence
  Synthetic
ccgtaaatagtgtacggtgtttcgttacgaatcagtacgtgcgtgtttttcataaattctgacacggcggtacgg

SEQ ID NO: 168483 - DNA, 75 bp, Artificial Sequence
  Synthetic
gggccccggggcacactgcttccatccacccgcgacacacccgccacacgcccgacacacgcccgagactcaccc

SEQ ID NO: 168484 - DNA, 75 bp, Artificial Sequence
  Synthetic
gtgctcgtcatcccctccttaatcagttgttcatgtaggcgtgtggcggggtgaggggcggcatggcgttggcgg

SEQ ID NO: 168485 - DNA, 75 bp, Artificial Sequence
  Synthetic
tcgcgttatccacggacatggtttcgttgcaatataaggaactcatgtcaagagtaccataaatagtgtacggtg

SEQ ID NO: 168486 - DNA, 75 bp, Artificial Sequence
  Synthetic
tggaaagtaacacatatgcggtcaaatacaggtatcgtaccgataagagtttgacgtgcgaatttggaatcggat

SEQ ID NO: 168487 - DNA, 75 bp, Artificial Sequence
  Synthetic
tcacgttagtagtgacgttgagagcggtagacgttgtataggacaaatatggcgtagtagtactctgagatttct

SEQ ID NO: 168488 - DNA, 75 bp, Artificial Sequence
  Synthetic
ccattacaagttccgtaaaaagcacagatgtaagttctatttccaccacacctaccacaacatcgatgactaatg

SEQ ID NO: 168489 - DNA, 75 bp, Artificial Sequence
  Synthetic
agatgtaagttctatttccaccacacctaccacaacatcgatgactaatgcaactgtaatgacaatctcaccaaa

SEQ ID NO: 168490 - DNA, 75 bp, Artificial Sequence
  Synthetic
atacaggtatcgtaccgataagagtttgacgtgcgaatttggaatcggatgatatgaccatgttggcctcatatc

SEQ ID NO: 168491 - DNA, 75 bp, Artificial Sequence
  Synthetic
tattaaggttatatttacttgtcccgggcctcgtccccccgttcgtcgtcctggttgtttcgttatattaacatt

SEQ ID NO: 168492 - DNA, 75 bp, Artificial Sequence
  Synthetic
gggcctcgtccccccgttcgtcgtcctggttgtttcgttatattaacattataccacctgccatcgttatgtgta

SEQ ID NO: 168493 - DNA, 75 bp, Artificial Sequence
  Synthetic
tactatcataataaatacaactgaaaacagtacgccgttctcaaattgctcgtcacctaatagcacattgagtac

SEQ ID NO: 168494 - DNA, 75 bp, Artificial Sequence
  Synthetic
aacagtacgccgttctcaaattgctcgtcacctaatagcacattgagtacgatgttacaagaatctgaaacacta

SEQ ID NO: 168495 - DNA, 75 bp, Artificial Sequence
  Synthetic
ccaacgcggtacattgaaaaacataggattgaacgtggtgaagttaccgcagccttcttcgccggtatcattacg

SEQ ID NO: 168496 - DNA, 75 bp, Artificial Sequence
  Synthetic
aataagtattgatacccattgcacccgggaccaccggattcgcgatgagtccaaaaatcacccaacataattctt

SEQ ID NO: 168497 - DNA, 75 bp, Artificial Sequence
  Synthetic
cgggaccaccggattcgcgatgagtccaaaaatcacccaacataattcttgtacgcggtaattttttatcaccgg

SEQ ID NO: 168498 - DNA, 75 bp, Artificial Sequence
  Synthetic
cttagacattttaatatatccacacatggaaaatacacccattcaaaaataaaaaatggaagatattataactat

SEQ ID NO: 168499 - DNA, 75 bp, Artificial Sequence
  Synthetic
atggaaaatacacccattcaaaaataaaaaatggaagatattataactattcattaaaaattcttcattcgcgta

SEQ ID NO: 168500 - DNA, 75 bp, Artificial Sequence
  Synthetic
ggattgaacgtggtgaagttaccgcagccttcttcgccggtatcattacgcttggaaacgtttagcatttcagaa

SEQ ID NO: 168501 - DNA, 75 bp, Artificial Sequence
  Synthetic
gagtatacatatttggctggtttcctaaactgtgtgctatagaaatcataccacaaatgagttacactttcgttg

SEQ ID NO: 168502 - DNA, 75 bp, Artificial Sequence
  Synthetic
taaactgtgtgctatagaaatcataccacaaatgagttacactttcgttgcgaataggacctgctaaaatataat

SEQ ID NO: 168503 - DNA, 75 bp, Artificial Sequence
  Synthetic
tgtctctgtacggtctcaattttactcattctgggaaatatagctttcgatgttacaagtatgatcatccctctg

SEQ ID NO: 168504 - DNA, 75 bp, Artificial Sequence
  Synthetic
tcattctgggaaatatagctttcgatgttacaagtatgatcatccctctgaacaaaatcaaaactttaatctaca

SEQ ID NO: 168505 - DNA, 75 bp, Artificial Sequence
  Synthetic
gaataggttctagttgtcttaaaatttctaattttaattgctttagcttttttaataccgtgggatgccatatcc

SEQ ID NO: 168506 - DNA, 75 bp, Artificial Sequence
  Synthetic
taggacgaaatggtgctcgttgtgatcgcgcactcttacattttatgaaaaagaacaacaggaaagttagccata

SEQ ID NO: 168507 - DNA, 75 bp, Artificial Sequence
  Synthetic
gactttggctgccacgtctcgtaaaccaaccagtcataaaaactatacaaccacatcatctacagatcatctgta

SEQ ID NO: 168508 - DNA, 75 bp, Artificial Sequence
  Synthetic
ccaaccagtcataaaaactatacaaccacatcatctacagatcatctgtaccgtcataacaaccattctaacaca

SEQ ID NO: 168509 - DNA, 75 bp, Artificial Sequence
  Synthetic
gctttaaacaaaaaatatcatccactgagggacgatataagtgaatcagaatttatagttcgctacaatccagag

SEQ ID NO: 168510 - DNA, 75 bp, Artificial Sequence
  Synthetic
tgagggacgatataagtgaatcagaatttatagttcgctacaatccagagcacgaggactaagcaccgtttccgg

SEQ ID NO: 168511 - DNA, 75 bp, Artificial Sequence
  Synthetic
ccgttaaccgaaattcaataacgttatggactggcagtttacggttaagtggacgttactgataatcacgttatc

SEQ ID NO: 168512 - DNA, 75 bp, Artificial Sequence
  Synthetic
atggactggcagtttacggttaagtggacgttactgataatcacgttatctgaaggttgcaatcatacgtgcccc

SEQ ID NO: 168513 - DNA, 75 bp, Artificial Sequence
  Synthetic
gcatgttttgagcatgcggtagagcagatagatgccgatgatggccgatagcgcgtagacggacatcatgaggag

SEQ ID NO: 168514 - DNA, 75 bp, Artificial Sequence
  Synthetic
acctcagttatcacaactgaaaccacgcagaaaccctctgccacctcttcaactgcatcagcaatcacttcaagg

SEQ ID NO: 168515 - DNA, 75 bp, Artificial Sequence
  Synthetic
cgcagaaaccctctgccacctcttcaactgcatcagcaatcacttcaaggatttcaaaatcaccaagtgttacgc

SEQ ID NO: 168516 - DNA, 75 bp, Artificial Sequence
  Synthetic
ccatctataagcagtctaatttaaactacgaagtaatcaacgtaacaggatatgtcggtggatacgttactctta

SEQ ID NO: 168517 - DNA, 75 bp, Artificial Sequence
  Synthetic
ctacgaagtaatcaacgtaacaggatatgtcggtggatacgttactcttaaaaactgcactagaacggatatatg

SEQ ID NO: 168518 - DNA, 75 bp, Artificial Sequence
  Synthetic
tcctctaaacggcatgtgtttagactgcaacatgacttctctcaccatatacaacataaccgttgaacacgctgg

SEQ ID NO: 168519 - DNA, 75 bp, Artificial Sequence
  Synthetic
tgcaacatgacttctctcaccatatacaacataaccgttgaacacgctggaaaatacgttctgcaacgctacggt

SEQ ID NO: 168520 - DNA, 75 bp, Artificial Sequence
  Synthetic
aaaagagaggagtcgaaccagcacaatccaggctcatgggaagatgtaataagaactgtaaaaaatactaacatt

SEQ ID NO: 168521 - DNA, 75 bp, Artificial Sequence
  Synthetic
cactattctctgtacacacttttgtaactttttgtcctgatccgcatggcgggcagcactgattacccagcttca

SEQ ID NO: 168522 - DNA, 75 bp, Artificial Sequence
  Synthetic
atccaggctcatgggaagatgtaataagaactgtaaaaaatactaacattcctctgggaatccatgctgtatggg

SEQ ID NO: 168523 - DNA, 75 bp, Artificial Sequence
  Synthetic
ccaaacttcccaaatacgatccagatgagttttgaactaaaaactaacatgcacatcaataaacttgtattttta

SEQ ID NO: 168524 - DNA, 75 bp, Artificial Sequence
  Synthetic
aagcgccggacacagcacgccacaaacgcgctgaggacgccgccgcgcttacttatgtcccgcaacactccctca

SEQ ID NO: 168525 - DNA, 75 bp, Artificial Sequence
  Synthetic
tgagttttgaactaaaaactaacatgcacatcaataaacttgtatttttagccaataatatgtctacgtgtattc

SEQ ID NO: 168526 - DNA, 75 bp, Artificial Sequence
  Synthetic
actaaactgctgttactagccgtactaatagcgattgcgatcatcctaaccggtatcctagttccggaaatttta

SEQ ID NO: 168527 - DNA, 75 bp, Artificial Sequence
  Synthetic
taatagcgattgcgatcatcctaaccggtatcctagttccggaaattttacatgaacgaaaaagggcactacatg

SEQ ID NO: 168528 - DNA, 75 bp, Artificial Sequence
  Synthetic
cgtggtgcgtggtggtgtttgtgagaggcaggtgatcataaattcttgtatttgtaagagtgcggcctggcggtc

SEQ ID NO: 168529 - DNA, 75 bp, Artificial Sequence
  Synthetic
ctagtaataatccctgcaactattccagcttctggaaatacgatgattgtgaactttgtggatggaacgaataca

SEQ ID NO: 168530 - DNA, 75 bp, Artificial Sequence
  Synthetic
cagcttctggaaatacgatgattgtgaactttgtggatggaacgaatacatacaaaaacaataccatgagaacaa

SEQ ID NO: 168531 - DNA, 75 bp, Artificial Sequence
  Synthetic
tccagcatctgacatcgaccgctcttgagtacatccacggcgtaacggtgaaagctgttacgtagtagtgcgctg

SEQ ID NO: 168532 - DNA, 75 bp, Artificial Sequence
  Synthetic
aggaacatacacggaatacatctacgaatgtcatctttcatgtaatacaatcgattataatgaatacaacatgct

SEQ ID NO: 168533 - DNA, 75 bp, Artificial Sequence
  Synthetic
gaatgtcatctttcatgtaatacaatcgattataatgaatacaacatgctagattattttgacaattgtacctac

SEQ ID NO: 168534 - DNA, 75 bp, Artificial Sequence
  Synthetic
actcacgttagttggacagccgccatagtaacggttattataatttccgtcctaatttgctttaaccttccagca

SEQ ID NO: 168535 - DNA, 75 bp, Artificial Sequence
  Synthetic
cctaatttgctttaaccttccagcaaccctaaggcacaggctgcgaactttaaacgtcaactggataacgtgatt

SEQ ID NO: 168536 - DNA, 75 bp, Artificial Sequence
  Synthetic
cttccaaactgcgcggcgccaaggcggcgccagcaagcgccgtgcacgtcgctgcctataaaagccagctgcgtg

SEQ ID NO: 168537 - DNA, 75 bp, Artificial Sequence
  Synthetic
gtaaaagccttggtgcaaacaaggtgtgacggtgctgaatagtagatcgtgtccatcaaagaggatacaggtctg

SEQ ID NO: 168538 - DNA, 75 bp, Artificial Sequence
  Synthetic
cttttccaatccatcatgaagaatcgcaataaactacttatgtgtatcatttttatttttaccatgtgcctcatt

SEQ ID NO: 168539 - DNA, 75 bp, Artificial Sequence
  Synthetic
gcaataaactacttatgtgtatcatttttatttttaccatgtgcctcatttgtctttactttaaacaccgttgta

SEQ ID NO: 168540 - DNA, 75 bp, Artificial Sequence
  Synthetic
gcgctgcatggaaaaacgcgtgatatatggcgtaccccttaacggtagttcatgagaaaaccattcaagaaaagt

SEQ ID NO: 168541 - DNA, 75 bp, Artificial Sequence
  Synthetic
catgagaaaaccattcaagaaaagtagttttctatcgatatgtcacagaagatcacggaatacaaaagttttgtg

SEQ ID NO: 168542 - DNA, 75 bp, Artificial Sequence
  Synthetic
ttccatttcgcaggagctgctgctcggcgtggtcaacgctttggaaaacgtgacggtgtatccgacgtacgactg

SEQ ID NO: 168543 - DNA, 75 bp, Artificial Sequence
  Synthetic
taaaggctccacgagctctgtgataattcacaggccactcaactgcagcacggtgactagaacagcaggacaaaa

SEQ ID NO: 168544 - DNA, 75 bp, Artificial Sequence
  Synthetic
ccaggttgtaacgtgacccagtggggacgttacgaaaatgggagcacgttggggccgtggtgtaccctatgggga

SEQ ID NO: 168545 - DNA, 75 bp, Artificial Sequence
  Synthetic
ccaggtgcgcgacgacgtgctttctctctggagccgacgtctgctggtcggcaagctgggtcgcgacgtgcccgt

SEQ ID NO: 168546 - DNA, 75 bp, Artificial Sequence
  Synthetic
ctcagagcacaaccaccgtagtaacacccacggtagttacaaacgccacggcaaatgtatcacccattacgtcga

SEQ ID NO: 168547 - DNA, 75 bp, Artificial Sequence
  Synthetic
gggaactcccggtgatgtgcacattatactctttcattctggggtttcccaatgacgtaaaaatttccactacac

SEQ ID NO: 168548 - DNA, 75 bp, Artificial Sequence
  Synthetic
atgcaccagagggagggaacgttaccctggtgtctaacttcacttcgaacatcagcgtacggtggtttcgctgga

SEQ ID NO: 168549 - DNA, 75 bp, Artificial Sequence
  Synthetic
acgcgtacaaataccagtgactggataacgttaggaagcagtgcatcgctgttgaaaagcacggagactgcagtc

SEQ ID NO: 168550 - DNA, 75 bp, Artificial Sequence
  Synthetic
atttcgtacgtcggttggtgcaggcgttgaagcgggctatgtatagcgtggagctggccgtgtgttacttttcta

SEQ ID NO: 168551 - DNA, 75 bp, Artificial Sequence
  Synthetic
aaaaatatgccgcgcagtagtcgaaagccgtactgagcgtgcgaagcgggtagggtgccgaacgacggatatgcg

SEQ ID NO: 168552 - DNA, 75 bp, Artificial Sequence
  Synthetic
gcaagttaaaatgtcgattatggaatctttgaaaaattcccggtagcggatgaggtacgcgcagaggaaaatcat

SEQ ID NO: 168553 - DNA, 75 bp, Artificial Sequence
  Synthetic
caccgtgcggggcgacacggtacgccgggtagccgcgcaggtcaacaaccagagccgttcggggcgtgcggccgc

SEQ ID NO: 168554 - DNA, 75 bp, Artificial Sequence
  Synthetic
gtgtggacgaatagttgcgtgcgctgcggtgcggtggggacggggacggcgaataaaagcgacgtgcggcgcgca

SEQ ID NO: 168555 - DNA, 75 bp, Artificial Sequence
  Synthetic
agcgtcgtgagcacgctgtaaatggtgagcaggcccgggctcggcggcgacgtgaacgatccctcgtcgcgtttg

SEQ ID NO: 168556 - DNA, 75 bp, Artificial Sequence
  Synthetic
caggacatctttttcggggttctcgttgcaatcctcggtcacttgttcaaaggttttgagggattcttcggccaa

SEQ ID NO: 168557 - DNA, 75 bp, Artificial Sequence
  Synthetic
ccaaataaacatacgcagcacaaaagatccacgcgaagaacgtcacctaaagattacaatgtaacgggtctgccg

SEQ ID NO: 168558 - DNA, 75 bp, Artificial Sequence
  Synthetic
aggtggcggatcgccggcaggtgaaacgcgcccaggtgtcggttgcgctccagcctcagctcggcgtgctccaaa

SEQ ID NO: 168559 - DNA, 75 bp, Artificial Sequence
  Synthetic
ggtggtggcggtggtagaaacagccggcggcaggccgcatcgtcgtcgtcctcctcctctcggagatcgcgacgg

SEQ ID NO: 168560 - DNA, 75 bp, Artificial Sequence
  Synthetic
caactcccgtcctcgcaagtccccaccgccgtccctcagtccgtccccgccgcacacagctcccgtccctcaccc

SEQ ID NO: 168561 - DNA, 75 bp, Artificial Sequence
  Synthetic
gcggtgtccgaaaccacaatgacaacagagctgaagcgttctgtacatcttacgggttctttccagggaaaatta

SEQ ID NO: 168562 - DNA, 75 bp, Artificial Sequence
  Synthetic
acacagctttattgtgctagcttcattcagcgtcatgggtaaaacggtgatgaagcataaaaacaccgtgggggg

SEQ ID NO: 168563 - DNA, 75 bp, Artificial Sequence
  Synthetic
ttcagcgtcatgggtaaaacggtgatgaagcataaaaacaccgtggggggggggggggcggaggcttggtggcgg

SEQ ID NO: 168564 - DNA, 75 bp, Artificial Sequence
  Synthetic
ggccgccgcaaacgcggcgccgcgcaaaagctccgtgcaaacacccgcagaaagatctctgcgcaaacaaagacc

SEQ ID NO: 168565 - DNA, 75 bp, Artificial Sequence
  Synthetic
actccccgagccctgtcccgcaccggcgccggtttgggtgtgtcgggggtgcggctgggtgggtgtgtgccgggt

SEQ ID NO: 168566 - DNA, 75 bp, Artificial Sequence
  Synthetic
attatattgtgtatgcgccgcgcggcatgccctagaagattataacacgaaacgttgtaataacaggaaatatgg

SEQ ID NO: 168567 - DNA, 75 bp, Artificial Sequence
  Synthetic
caattaaaaacacataagagcacatacatatgtggaatagcaaacacaaatgagtttctatgctggcgcgacaat

SEQ ID NO: 168568 - DNA, 75 bp, Artificial Sequence
  Synthetic
gtcgcggccgtgtggcgggtgtgtcaggggtgtgttgggggtgtgcgcgcctggatggaagcagtgtgccccggg

SEQ ID NO: 168569 - DNA, 75 bp, Artificial Sequence
  Synthetic
aagtatgcattttgcggtaccggttactgtatattggtgcacgtactacgatataagtattcaatcgctgtaatt

SEQ ID NO: 168570 - DNA, 75 bp, Artificial Sequence
  Synthetic
cctcacccccgggagttgctctgcgcgtccccagggactcgcgctgccgtccccttgggacctcttcttcctcct

SEQ ID NO: 168571 - DNA, 75 bp, Artificial Sequence
  Synthetic
cgtccccagggactcgcgctgccgtccccttgggacctcttcttcctcctcttttccccggggattcaaagacac

SEQ ID NO: 168572 - DNA, 75 bp, Artificial Sequence
  Synthetic
aatcgttttcgtaagcagaattagacctgtgtgtatgttgcgtaaagtgtgttaaaacaatgtaacatgaaacgt

SEQ ID NO: 168573 - DNA, 75 bp, Artificial Sequence
  Synthetic
tataagtatggaacggatgtcgatgaagaacatataaaagaaagatatatgtcaggtcccagacacaactgtgtt

SEQ ID NO: 168574 - DNA, 75 bp, Artificial Sequence
  Synthetic
aagaacatataaaagaaagatatatgtcaggtcccagacacaactgtgtttatgcttgtcaaatgacacgtggac

SEQ ID NO: 168575 - DNA, 75 bp, Artificial Sequence
  Synthetic
agccgcgttctccgttacgttgtttatatccagcgtcggctcgaacgtgagttctggcagatgcagcgccagaca

SEQ ID NO: 168576 - DNA, 75 bp, Artificial Sequence
  Synthetic
gcacagccgtcgggggtctgtattcaaactacaccaacttaactgaggtattcggctttactcaagcaaacacaa

SEQ ID NO: 168577 - DNA, 75 bp, Artificial Sequence
  Synthetic
acttgcatcaatcgcggtgagtcctatctgactaccatttggcttctgagttgtgctcagaatacttcctattgg

SEQ ID NO: 168578 - DNA, 75 bp, Artificial Sequence
  Synthetic
cgaacgttgaaagcggcgcagcatcgaggccgagagccccagatcgcgcgccgtgcgcagcaccagggaatgctt

SEQ ID NO: 168579 - DNA, 75 bp, Artificial Sequence
  Synthetic
ggcatgtgcaaactatgggaaagttgggtcgctaatgatacttctcataacactaccagaatcgagttgctgaaa

SEQ ID NO: 168580 - DNA, 75 bp, Artificial Sequence
  Synthetic
aacgaaacacgctgcacgctgcccgctaaacagtataccctcaacgccacggtggaatggtacaacaaatctgaa

SEQ ID NO: 168581 - DNA, 75 bp, Artificial Sequence
  Synthetic
agaggatagccagcactttcatgatctcgtcattgcgcgcgttgtgaacggaagactcgtgggtggtggtcatgt

SEQ ID NO: 168582 - DNA, 75 bp, Artificial Sequence
  Synthetic
ccacccccgtacctagcccgtccccgccgcaagagtcccccgtccccgccacgcaaccgccgtccccgtccctcg

SEQ ID NO: 168583 - DNA, 75 bp, Artificial Sequence
  Synthetic
ggtgacataccaaaggaattcatgaattatgctatcctgaattccgtggcggtgcttacatgcggacttcaggaa

SEQ ID NO: 168584 - DNA, 75 bp, Artificial Sequence
  Synthetic
acgcaaccgccgtccccgtccctcgtgcccagcgcgactccccggccccgcaacgcgccgtccccaccctcgtcc

SEQ ID NO: 168585 - DNA, 75 bp, Artificial Sequence
  Synthetic
tgagtcccgagataagcagctcttgagcagtagcgttgtaggagagatgtagttttcctgtggataaaattaatg

SEQ ID NO: 168586 - DNA, 75 bp, Artificial Sequence
  Synthetic
gcgctccgggccgtgccaaaagttgctgttgttgccgctacccggaggggcgcccggcggcccgcggggttctac

SEQ ID NO: 168587 - DNA, 75 bp, Artificial Sequence
  Synthetic
gaaggtcccggcaccaaaagtcccgttagagccccagcaagtgacactgccattcacgtaggttcccggtgccgc

SEQ ID NO: 168588 - DNA, 75 bp, Artificial Sequence
  Synthetic
ttagagccccagcaagtgacactgccattcacgtaggttcccggtgccgctgtcagcatatatgtcatctggtga

SEQ ID NO: 168589 - DNA, 75 bp, Artificial Sequence
  Synthetic
tgacgtaacttacatcaattcgtaatatccggtattcccggaaaatcactcaaaactgcgtccatgacacatcaa

SEQ ID NO: 168590 - DNA, 75 bp, Artificial Sequence
  Synthetic
ccattccgggccgtgtgctgggtccccgaggggcgggggggtgttttcatcgggggggtgaaatgtgggaatttg

SEQ ID NO: 168591 - DNA, 75 bp, Artificial Sequence
  Synthetic
tgtccgtgcaccgtggcggcggcattgcgctcggacatgctgccgaacgtcagcatggagatggtctccgtgtct

SEQ ID NO: 168592 - DNA, 75 bp, Artificial Sequence
  Synthetic
ggaagttggcggtggcgggggacggcgacggcgaataaaagcgccgtgcggcgcgcacggcgaaacccagacgcg

SEQ ID NO: 168593 - DNA, 75 bp, Artificial Sequence
  Synthetic
ctggggacgcgaagatcggacgcggaaaagaggaagtccccggggacggccacaggcggaaaaaaaaaacgagga

SEQ ID NO: 168594 - DNA, 75 bp, Artificial Sequence
  Synthetic
cgcgccggggcggggggggggatcgcgggccccggggcacactgcttccatctggccgcgcgcacaccccgccga

SEQ ID NO: 168595 - DNA, 75 bp, Artificial Sequence
  Synthetic
cgggccccggggcacactgcttccatctggccgcgcgcacaccccgccgacacacccctgacacacccgcgacac

SEQ ID NO: 168596 - DNA, 75 bp, Artificial Sequence
  Synthetic
gctgaggggggtgtaagcgccttgacgcgcggcgctatggcactgcgtgccacggtattggttggcgggacgagg

SEQ ID NO: 168597 - DNA, 75 bp, Artificial Sequence
  Synthetic
ctgaggggggtttgcgggacgtaagcgcgacgccgagtttgcggcgtgctgtggcgcgctcaaggctagggacgg

SEQ ID NO: 168598 - DNA, 75 bp, Artificial Sequence
  Synthetic
cgcgacgccgagtttgcggcgtgctgtggcgcgctcaaggctagggacgggggccgcgcgtagcttttcggcggc

SEQ ID NO: 168599 - DNA, 75 bp, Artificial Sequence
  Synthetic
taacgtcgttctccccccgcttctacacgcggaccgctgcagacggctatgctcagactgtttctcttgacggcg

SEQ ID NO: 168600 - DNA, 75 bp, Artificial Sequence
  Synthetic
acatgtgtttgcgtctgtgcggcgcggcgacggccgcaagcggacgacgccgcctgccaccacacgtggcccacg

SEQ ID NO: 168601 - DNA, 75 bp, Artificial Sequence
  Synthetic
tgagtactttagcgatgtccgcggggacgctacgtttcaccgtgacggtgagaacttgaccgtcgttttgtactt

SEQ ID NO: 168602 - DNA, 75 bp, Artificial Sequence
  Synthetic
ccgctgacgttttcatcgccgcccacgtcaacggtggcgacaccgtactttcccatgcggtttataaacgtcaag

SEQ ID NO: 168603 - DNA, 75 bp, Artificial Sequence
  Synthetic
gtgctactttccactcccgggtgcgtgtcgcccaaaagcgcaaccacgagtacgatcgccagtacgggacacatg

SEQ ID NO: 168604 - DNA, 75 bp, Artificial Sequence
  Synthetic
actttcttgttttttgctcatatgctgtaaggtgttcgaggatcgtggggagtatatgtgttgaatcggaatcat

SEQ ID NO: 168605 - DNA, 75 bp, Artificial Sequence
  Synthetic
cgctatggcctgcctgccgcgcgacctcagcctgcacctggacgactatccttacctgatggtggaaatcggacg

SEQ ID NO: 168606 - DNA, 75 bp, Artificial Sequence
  Synthetic
ctccatcatgaaggatcgcaatagaatactgctatgtatcatctttatttgcatcatgtgcctcatttgtattta

SEQ ID NO: 168607 - DNA, 75 bp, Artificial Sequence
  Synthetic
tttgccgacacggacacggtgtggagaaaccttttctacgtttattatgaactagctcgggatctggggtcccat

SEQ ID NO: 168608 - DNA, 75 bp, Artificial Sequence
  Synthetic
cgctatccgccatccgcactacagaagccgtgatcaacacgttcatcattttcgtgggcggcccgctcaatgcca

SEQ ID NO: 168609 - DNA, 75 bp, Artificial Sequence
  Synthetic
cgcggtagaatacagcgatccctagtgaagccacacccattacgtgtagccatatccgcttacgtatacatccac

SEQ ID NO: 168610 - DNA, 75 bp, Artificial Sequence
  Synthetic
ggaacaacctggaggagtcgcggcatgacggcgcccaagtgtgtcaccaccactacttatctggtcaagaccaag

SEQ ID NO: 168611 - DNA, 75 bp, Artificial Sequence
  Synthetic
cccagggctgctccaactttgtggggctgctcaactttggcgtgcccagccccgtatacgcgctggaggccctgg

SEQ ID NO: 168612 - DNA, 75 bp, Artificial Sequence
  Synthetic
gggtccctcggcctagccgccggctctcggtccgccttatcctgggcgttggccggtcccgtgacgctcccctcc

SEQ ID NO: 168613 - DNA, 75 bp, Artificial Sequence
  Synthetic
tgggaaatgaaatacgctgcatgctgctccctagacagtataccctcaacgccacggtggaatggtacaacaaat

SEQ ID NO: 168614 - DNA, 75 bp, Artificial Sequence
  Synthetic
taacgttaaacgattctggaaagtacgttgtcaagagaacacgtcatgacaatcaatacgaagaagcatgctaca

SEQ ID NO: 168615 - DNA, 75 bp, Artificial Sequence
  Synthetic
taccacccccgctgcctccacgacctccccacttaatagaattcccgccgtctcctccgccgtcgcctgggccca

SEQ ID NO: 168616 - DNA, 75 bp, Artificial Sequence
  Synthetic
atcgaggaggccgcactggacgacgtcaacatcatcagcgccgtgctcagcggcgtgtacagctacctcatgacg

SEQ ID NO: 168617 - DNA, 75 bp, Artificial Sequence
  Synthetic
gatcaccgtgctcgtcgtcccctccttaatcagttgttcatgtaggcgtgtggcggggtgaggggcggcatgccg

SEQ ID NO: 168618 - DNA, 75 bp, Artificial Sequence
  Synthetic
tggcggggtgaggggcggcatgccgttggcggcgccgggaataatgtgccgtcgaccgacgtcgcacaccttgaa

SEQ ID NO: 168619 - DNA, 75 bp, Artificial Sequence
  Synthetic
atcgccgtcggacccaccatcgccgccggacccaccatcaccgtcggcgccgccgctgctgccgctgccgccgcc

SEQ ID NO: 168620 - DNA, 75 bp, Artificial Sequence
  Synthetic
gttccgtcacgttatgtgtgtcgttaaaagacggcgtctgtacagtatggctttgagttgtatcttgaattgtta

SEQ ID NO: 168621 - DNA, 75 bp, Artificial Sequence
  Synthetic
cacctgttgccgtccctcagcgcggtccccgccaccgccggtcccgcgagtccccgtcctcaacgtaaccctcgt

SEQ ID NO: 168622 - DNA, 75 bp, Artificial Sequence
  Synthetic
cggcgcttgctggcgccgccttggcgccgcgcagtctggaaggccgtggaaaaccacccggcagccgacgacgca

SEQ ID NO: 168623 - DNA, 75 bp, Artificial Sequence
  Synthetic
tatgctcaacaacgcccagtgtcccaacgcgcgacttttggctcggagcagagccgaacggcggtttctccacat

SEQ ID NO: 168624 - DNA, 75 bp, Artificial Sequence
  Synthetic
gctataaccggatgtatggtatttatatgtgcgtctagcatccttgtgagattctgagagtcttcttgtaagcgt

SEQ ID NO: 168625 - DNA, 75 bp, Artificial Sequence
  Synthetic
aagaatagcggcggttctgatagggcgaccgctgaagcgagctgcgtgtgcgtgcggtttgtcgtccccgctgca

SEQ ID NO: 168626 - DNA, 75 bp, Artificial Sequence
  Synthetic
ccagaaaacccggacaaaaaactacgttgtcgcgattaaaaaccacgccaaataaacatacgcagcacaaaagat

SEQ ID NO: 168627 - DNA, 75 bp, Artificial Sequence
  Synthetic
cacgcccgcgacacacccggcacacacccacccacccagccgcgcccccggcacacccaatccggcgccggtgcg

SEQ ID NO: 168628 - DNA, 75 bp, Artificial Sequence
  Synthetic
cgggggggtgaaatttggagtcttggagtcgcgtgtgctgtggaggacggtgacggtggtaagagtgtgctgcgg

SEQ ID NO: 168629 - DNA, 75 bp, Artificial Sequence
  Synthetic
cgaggacacacgcagaagaggagccgcgcacaccgcacccgacacacccacaacacacccgccacacgcccgaca

SEQ ID NO: 168630 - DNA, 75 bp, Artificial Sequence
  Synthetic
gggtgcggtgtgcgcggctggatggaagcagtgtgccccggggtccgcgaccccccccctcccctgggcggtccc

SEQ ID NO: 168631 - DNA, 75 bp, Artificial Sequence
  Synthetic
ggcgttgctcttcgcgtgtctgccgtccctcttttccgcgtcttgtctcttcgtgtgtccccagggacccgcgct

SEQ ID NO: 168632 - DNA, 75 bp, Artificial Sequence
  Synthetic
ctttgtggcgtgttgcccacggcgctgtctgcgcgacgccggtgcgtgtcgtcccacggcatttgttcgcgggac

SEQ ID NO: 168633 - DNA, 75 bp, Artificial Sequence
  Synthetic
tggacgtgggttttcgggcgtgctggccgccggcggggacggcgtgttgcggggacgggggttgcgctggcccgg

SEQ ID NO: 168634 - DNA, 75 bp, Artificial Sequence
  Synthetic
cgcgcacggcgtcggcagagttttccgtgacttggggcggtgggtccgagctgcggtatgggtcacggcggcgtg

SEQ ID NO: 168635 - DNA, 75 bp, Artificial Sequence
  Synthetic
gccgccggcggggacggcgtgttgcggggacgggggttgcgctggcccggggtgttgcggggacgggggttgcgc

SEQ ID NO: 168636 - DNA, 75 bp, Artificial Sequence
  Synthetic
gtgaaaaacacacaccacacgtcacgacaccgatcgattttctttattcttagtgtgatgataggtaagggcact

SEQ ID NO: 168637 - DNA, 75 bp, Artificial Sequence
  Synthetic
ccagtcgaaccgccatctcctgtccagccgcctgcgcttccagcgtcgccgtccgttctccccgcggaatcaccg

SEQ ID NO: 168638 - DNA, 75 bp, Artificial Sequence
  Synthetic
tggtggtggtggtggtggtagtggtggcggcggcggggccggcgcttgtgcggtcgagacgagcgcgtcagcagg

SEQ ID NO: 168639 - DNA, 75 bp, Artificial Sequence
  Synthetic
ggggggggacacgcaccccgaggccgacacaccctgaccaacacacccccgacacacccgcgacacacccgccac

SEQ ID NO: 168640 - DNA, 75 bp, Artificial Sequence
  Synthetic
aagagtagcggcggttgtgatagggcgaccgctgaggcgagctgcgtgtgcgtgccgtctgtgttccccgtcccc

SEQ ID NO: 168641 - DNA, 75 bp, Artificial Sequence
  Synthetic
acgcaacagcccgccatcccgcaactccccgtccccgccgcgaaaggcccccgtccccgtcctcaccaccgtccc

SEQ ID NO: 168642 - DNA, 75 bp, Artificial Sequence
  Synthetic
cactcccgtccccgtctccgcaacgccccgtccccgccgcaaaaggcccccggccccgcaacgcatcgtccccgc

SEQ ID NO: 168643 - DNA, 75 bp, Artificial Sequence
  Synthetic
tgaaacagcctgaaactgcccaaaccggcactgtgccgcgacacggtgtccatctcgcgccacagcgcgttcctg

SEQ ID NO: 168644 - DNA, 75 bp, Artificial Sequence
  Synthetic
aaacaccgcgggacgacacgcaccggcagtgcgcacaaagcgccggacacagcacgccgcaaacgcgctgaggac

SEQ ID NO: 168645 - DNA, 75 bp, Artificial Sequence
  Synthetic
acggactcgtatgtgctaccgcttgcaacacgtaactgtggccggtgaagttgagcatcaattgtcccacggtaa

SEQ ID NO: 168646 - DNA, 75 bp, Artificial Sequence
  Synthetic
gtcctcaccagcgtccccactcccgtccccgtctccgcaacgccccgtccctgccgcaaaaggcccccgtccccg

SEQ ID NO: 168647 - DNA, 75 bp, Artificial Sequence
  Synthetic
caaagaaatcaggtagatttcaataaagtgagtctagatggcgccgataactacggtttataaagtctgtgtgcg

SEQ ID NO: 168648 - DNA, 75 bp, Artificial Sequence
  Synthetic
tgttttgagtgcaacgacacttctctgaccatctacaatctaactgcagaaaacgccgggaaatataccagacgg

SEQ ID NO: 168649 - DNA, 75 bp, Artificial Sequence
  Synthetic
agtgttgatcacgcagctgctcacgaatcgcgtgcttggctattcgacgcccaccatctacatgaccaacctcta

SEQ ID NO: 168650 - DNA, 75 bp, Artificial Sequence
  Synthetic
aaactctacaaaatctagacgccatccgggtggcgctgaaacgggaaggctaatgttcatatcagcatagctacg

SEQ ID NO: 168651 - DNA, 75 bp, Artificial Sequence
  Synthetic
ccaccgtcatcccatctttcccacccgatggaaaaccgtcttctatcatcaactatggtaagatttcgaccctgc

SEQ ID NO: 168652 - DNA, 75 bp, Artificial Sequence
  Synthetic
ttgttctttgacgggcgcttgtttacgttttagttttcgcatagtgtttttcaacttggtgccgttaatatactt

SEQ ID NO: 168653 - DNA, 75 bp, Artificial Sequence
  Synthetic
acacacccgacacacgcccgcgacacacccggcacgcacgcacccacccagccgcgcccccggcacacccaaccc

SEQ ID NO: 168654 - DNA, 75 bp, Artificial Sequence
  Synthetic
tttgcatcgcttatcgccactatcagtgcaatattttgattgtgagactgaaagagtatcgttatgatgcttaga

SEQ ID NO: 168655 - DNA, 75 bp, Artificial Sequence
  Synthetic
accgcctgacgttgctgaatctgacgacggaaaacagcggaaagtattatttcaaacgagaagatgtgaattcca

SEQ ID NO: 168656 - DNA, 75 bp, Artificial Sequence
  Synthetic
tatgatatagatgcaacgtatgcaatggccattagccaatattgatttacgctatataaccaatgactaatatgg

SEQ ID NO: 168657 - DNA, 75 bp, Artificial Sequence
  Synthetic
ccattccgggccgtgtgctgggtccccgaggggcgggggggtgtttttagcgggggggtgaaatttggagttgcg

SEQ ID NO: 168658 - DNA, 75 bp, Artificial Sequence
  Synthetic
gccgtctgtgttccccgtccccgccatcccgcacacccccgtccccggcgccaccctcgtccccgtccgcgacgt

SEQ ID NO: 168659 - DNA, 75 bp, Artificial Sequence
  Synthetic
gcttacttatgtcccgcaacactcccttagccctgtcccgtgctgtggagacacacgcaccggcagcacgcagaa

SEQ ID NO: 168660 - DNA, 75 bp, Artificial Sequence
  Synthetic
aataggactgagggctggacagggctgcgggagttttgtccacgtagctttctgcgcgctgccggtgcgtgtggc

SEQ ID NO: 168661 - DNA, 75 bp, Artificial Sequence
  Synthetic
gcgcccgcgagcttctgcgtgtgtctgttctttcctcttttccgcgtcttgccgttgttttgcgtgtgtcccggt

SEQ ID NO: 168662 - DNA, 75 bp, Artificial Sequence
  Synthetic
gccgttgttttgcgtgtgtcccggtgtgtcaggggtgcggtgtgcgcggctggatggaagcagtgtgccccgggg

SEQ ID NO: 168663 - DNA, 75 bp, Artificial Sequence
  Synthetic
cccgcccgtcgacttccagcggcccgtcttcaaaacgctgctagatcagcaggccgacgcggcccggaaagcgct

SEQ ID NO: 168664 - DNA, 75 bp, Artificial Sequence
  Synthetic
gccacgggggccttttgcgacggggacgatggtggggacggcgcgttgcggggccggggacggtggtggggacgg

SEQ ID NO: 168665 - DNA, 75 bp, Artificial Sequence
  Synthetic
acgatggtggggacggcgcgttgcggggccggggacggtggtggggacggggggtggcgacggagacacgggcgt

SEQ ID NO: 168666 - DNA, 75 bp, Artificial Sequence
  Synthetic
gggtgtggtggcggggtgtgtcggcggtgtgcgcggcttcggggtgtgcggcttcgcaggaacgagtgtgtgccc

SEQ ID NO: 168667 - DNA, 75 bp, Artificial Sequence
  Synthetic
ggtgtgcgcggcttcggggtgtgcggcttcgcaggaacgagtgtgtgccccgggggcccgcgagccccccccccc

SEQ ID NO: 168668 - DNA, 75 bp, Artificial Sequence
  Synthetic
aaactaccccagttagtaacgtaacaaccatcgtcacgacgataccgacggtgaccggcacaaaaagtaacgtta

SEQ ID NO: 168669 - DNA, 75 bp, Artificial Sequence
  Synthetic
cgtacctcgcggccgttatttctcccgcggtccccagggacgagtggcgccgcgcgcggccgtcctcctggggac

SEQ ID NO: 168670 - DNA, 75 bp, Artificial Sequence
  Synthetic
tgttaacaacctatgatataaagcggtatattcaatcattactaaacaaaaaaacatgggcatgcaatgcaacac

SEQ ID NO: 168671 - DNA, 75 bp, Artificial Sequence
  Synthetic
ataccgcggtccactacgccgccggtaacgttgaagcacaacacgacactgccacttcacatacaatgtggatca

SEQ ID NO: 168672 - DNA, 75 bp, Artificial Sequence
  Synthetic
cggacgcttccttgtcacccccgggcagcggcccctcctcgagctcgctgtcatctcccccgatagtatcagcgg

SEQ ID NO: 168673 - DNA, 75 bp, Artificial Sequence
  Synthetic
gacaagacgcggaaaagaggaagtccctaggggaccgcgagggcaacgacagacgaagtacggcacaacccgcgt

SEQ ID NO: 168674 - DNA, 75 bp, Artificial Sequence
  Synthetic
gccgcgcacaccgcacccctgacacaccccgccagcacacccccgacacacccgccacacgcccgcgacacaccc

SEQ ID NO: 168675 - DNA, 75 bp, Artificial Sequence
  Synthetic
cacgcacacgcagctcgcttcagcggtcgccctatcagaaccgccgctactctttattaacgtcttaatcccccc

SEQ ID NO: 168676 - DNA, 75 bp, Artificial Sequence
  Synthetic
tgttgccgctacccggaggggcgcccggcggcccgcggggttctacccggtggacgccgtggcccggcgttgccg

SEQ ID NO: 168677 - DNA, 75 bp, Artificial Sequence
  Synthetic
ggggaccgcccaggggagggggggggtcgcggaccccggggcacactgcttccatccagccgcgcacaccgcacc

SEQ ID NO: 168678 - DNA, 75 bp, Artificial Sequence
  Synthetic
ccatttccccatcccgccattcccgagcaacccacccgagtcccgacaaccaaccaccaacagaaaacatacaca

SEQ ID NO: 168679 - DNA, 75 bp, Artificial Sequence
  Synthetic
tccgcgcaaacgagctccggaataaacaatttatgggctatggaacagagaacggccttaagaacacttgtctca

SEQ ID NO: 168680 - DNA, 75 bp, Artificial Sequence
  Synthetic
gcgtgtctctctattcggtggtccacggcgtcgcgatcggcaggcgggccggctgcggcgctcggagctgtagcc

SEQ ID NO: 168681 - DNA, 75 bp, Artificial Sequence
  Synthetic
ccttggtcttgaccagataagtagtggtggtgacacacttgggcgccgtcatgccgcgactcctccaggttgctc

SEQ ID NO: 168682 - DNA, 75 bp, Artificial Sequence
  Synthetic
aagttatagtgatgtgctttttatcagggagaaggttttgtgccaacaatgactaacccggggctatatgcatcg

SEQ ID NO: 168683 - DNA, 75 bp, Artificial Sequence
  Synthetic
cagcgcccaggcgatctcgcgctcgacgacggctacggcgacgaggcagaacatctcaacccagacgacaagcgc

SEQ ID NO: 168684 - DNA, 75 bp, Artificial Sequence
  Synthetic
acatctcaacccagacgacaagcgccaggaggtagagcacggccggaaagaccgcgggcgttagcatttggtcgc

SEQ ID NO: 168685 - DNA, 75 bp, Artificial Sequence
  Synthetic
cagcgaatattttttctggacctggcatcgcggctgtggtcgtctgttccgttttcatgattttcctctgcgcgt

SEQ ID NO: 168686 - DNA, 75 bp, Artificial Sequence
  Synthetic
acgccccattggcattgccacgaaggatcgtgcacgtcgcaacccatcgctactgcgttctcccacaaacgccat

SEQ ID NO: 168687 - DNA, 75 bp, Artificial Sequence
  Synthetic
cacggtccccgacgccgccggacccgccatcgccgtcggacccaccatcaccgtcggcgccgccgctgctgccgc

SEQ ID NO: 168688 - DNA, 75 bp, Artificial Sequence
  Synthetic
cgccaacccccgagcgcccgcaacaccccgtacccagcgccggcccgcgaacaaacaccgcagaactccctcacg

SEQ ID NO: 168689 - DNA, 75 bp, Artificial Sequence
  Synthetic
cccccggggggacttcctctttttcgcgtcttgactgcttgcagcttcctcttttgtctgcccgccgtccctcac

SEQ ID NO: 168690 - DNA, 75 bp, Artificial Sequence
  Synthetic
tggatccagacatgataagatacattgatgagtttggacaaaccacaactagaatgcagtgaaaaaaatgcttta

SEQ ID NO: 168691 - DNA, 75 bp, Artificial Sequence
  Synthetic
tacgacgcccatatcccacggctgttcaatccaggtatcttgcgggatatcaacaacatagtcatcaaccagcgg

SEQ ID NO: 168692 - DNA, 75 bp, Artificial Sequence
  Synthetic
tcaatccaggtatcttgcgggatatcaacaacatagtcatcaaccagcggacgaccagccggttttgcgaagatg

SEQ ID NO: 168693 - DNA, 75 bp, Artificial Sequence
  Synthetic
acgatgaagccttcgccatcgccttctgcgcgtttcagcactttaagctcgcgctggttgtcgtgatcgtagctg

SEQ ID NO: 168694 - DNA, 75 bp, Artificial Sequence
  Synthetic
ctgcgcgtttcagcactttaagctcgcgctggttgtcgtgatcgtagctggaaatacaaacggtatcgacatgac

SEQ ID NO: 168695 - DNA, 75 bp, Artificial Sequence
  Synthetic
cgtcccacgctatttgtttgcgggaccggactgcgggaggtttgcgggccgtcagcgcggcgcggcgtgtgtggc

SEQ ID NO: 168696 - DNA, 75 bp, Artificial Sequence
  Synthetic
gggagcggcggtcagcactcctcggactccgccaacggactgctgcgggatccccggttgatgaaccggcagaag

SEQ ID NO: 168697 - DNA, 75 bp, Artificial Sequence
  Synthetic
gttcagaaggcatcagtcggcttgcgagtttacgtgcatggatctgcaacatgtcccaggtgacgatgtattttt

SEQ ID NO: 168698 - DNA, 75 bp, Artificial Sequence
  Synthetic
cgaagtggacctgggaccgcgccgccccgactgcatctgcgtgttcgagttcgccaatgacaagacgctgggcgg

SEQ ID NO: 168699 - DNA, 75 bp, Artificial Sequence
  Synthetic
ggacggggcgttgtggagacgggggttacgttggcgacggggactcgcggaaccgggctgagggacgggggtggc

SEQ ID NO: 168700 - DNA, 75 bp, Artificial Sequence
  Synthetic
cactcccccacaggacggctcatttccacctccgcctcggtgacgcaggctaaaccgaaacccacgttgaatctg

SEQ ID NO: 168701 - DNA, 75 bp, Artificial Sequence
  Synthetic
accgccggcgccgtgactgtcgttggaaacgccgacgccgccactactgccggagccgacgctgaaaacgccgac

SEQ ID NO: 168702 - DNA, 75 bp, Artificial Sequence
  Synthetic
caaccacctcggttttttacgccacgtccgacgaaacggcggacaccgagcgccgagactcgcagcaactgctca

SEQ ID NO: 168703 - DNA, 75 bp, Artificial Sequence
  Synthetic
cgagaccggaaaaattatgaaacaggacgcgcttggacatttgggtttccaccccttttggtgtgtgtctatata

SEQ ID NO: 168704 - DNA, 75 bp, Artificial Sequence
  Synthetic
tatcatcaatcacccacagagtcgccagtccatggtctcttggtaatgcgtgtccagatacgcgttggccagtat

SEQ ID NO: 168705 - DNA, 75 bp, Artificial Sequence
  Synthetic
tgcattacgtgtatttattgttacatttgcaaatcgccgagtataccggtataatgtggcaataatcgtattatg

SEQ ID NO: 168706 - DNA, 75 bp, Artificial Sequence
  Synthetic
ggtgcgcgtactacgacacgaactgcatagcgctataaccgggtgtatggtatttatatgtgcgtctagcatcct

SEQ ID NO: 168707 - DNA, 75 bp, Artificial Sequence
  Synthetic
ggtccggcaccgttaagctgtaatgtgacccagtggggacgttacgagaatggaagcacacccgtattatggtgc

SEQ ID NO: 168708 - DNA, 75 bp, Artificial Sequence
  Synthetic
ctacgtggcgcaaaagaaagcgcgccacatgatggaggccatacggaccaccgtgcggggcgacacggtacgccg

SEQ ID NO: 168709 - DNA, 75 bp, Artificial Sequence
  Synthetic
agatgctgcgcccgtatgacagtcgcgtgaggtcgtagccgcggcacaggtcgtccacgcacgtgtacacggccg

SEQ ID NO: 168710 - DNA, 75 bp, Artificial Sequence
  Synthetic
atagggacatgatcaccagcgcagtctgaagtagtggtagttcagtttcttggcgtatttccagagaaaggcttt

SEQ ID NO: 168711 - DNA, 75 bp, Artificial Sequence
  Synthetic
cttttataggcagcgacgtgcacggcgcgtgctagcgccgccttggcgccgcgcagtctaaaaggccgtggaaaa

SEQ ID NO: 168712 - DNA, 75 bp, Artificial Sequence
  Synthetic
tctgtgtctgtgtgattccccggggaaaagaggaagttcccaggggacggcagcgcgggtccctggggacacacg

SEQ ID NO: 168713 - DNA, 75 bp, Artificial Sequence
  Synthetic
ggaatacccagctggggaagtacaatatcaaagaacgaaaacacattattcttggatgctaattattgccataat

SEQ ID NO: 168714 - DNA, 75 bp, Artificial Sequence
  Synthetic
gcgttcctaagcaagagctaacgccgaacctaatgcagtaaaaagcgcttgcagccagaaccatcttatgtacca

SEQ ID NO: 168715 - DNA, 75 bp, Artificial Sequence
  Synthetic
tccacaggaaaccctaccagggtagagccccgcttgttttttcctgtccatcttgtttagcaactcgtaaactgt

SEQ ID NO: 168716 - DNA, 75 bp, Artificial Sequence
  Synthetic
taccgttcggccccatgagttatttttattcttccggtaggaggcatgaagcctctggtgatgcttattttgctg

SEQ ID NO: 168717 - DNA, 75 bp, Artificial Sequence
  Synthetic
cgacacacccgaccgacacacgcccgagacacacccggcacacacccacccagccgcgccccagacacacccaac

SEQ ID NO: 168718 - DNA, 75 bp, Artificial Sequence
  Synthetic
cccccatgtaaacaaggatatcgtgttacaggacaatgtacgcaatatacgagtacaacatgtacactttgccct

SEQ ID NO: 168719 - DNA, 75 bp, Artificial Sequence
  Synthetic
aactgcacttccactaataacaccgtatgcgcatctaagaattatacgtcgttgtccgttccaggcgtccaacat

SEQ ID NO: 168720 - DNA, 75 bp, Artificial Sequence
  Synthetic
ctttatagtcatatcacgcagcaccttgacgctggtttggttgatggtcacacagctggccagacccaggacatc

SEQ ID NO: 168721 - DNA, 75 bp, Artificial Sequence
  Synthetic
ttgacgctggtttggttgatggtcacacagctggccagacccaggacatcgcccatgaaacgcgcggcaattggt

SEQ ID NO: 168722 - DNA, 75 bp, Artificial Sequence
  Synthetic
gaaaagaggaagttcccaggggacggcacgcaaaacaacggccagagacaagacgcggaaaagaggaagtcccca

SEQ ID NO: 168723 - DNA, 75 bp, Artificial Sequence
  Synthetic
tgatccacgcaccaggcttcggcgatctgtgccagcgcccggttaatgtagttgcgcaacgtgtcgtaggtaaac

SEQ ID NO: 168724 - DNA, 75 bp, Artificial Sequence
  Synthetic
tggacaaggtgttgcggggacggggtgttgcggggacggggtgttgcggggacggggattacgttggggacgggg

SEQ ID NO: 168725 - DNA, 75 bp, Artificial Sequence
  Synthetic
tgcagctgggcgtaaagcacacttcgtaccgaatcgttctccagcgatagggtagtcgtattgtttgtgcttctc

SEQ ID NO: 168726 - DNA, 75 bp, Artificial Sequence
  Synthetic
tgttgcggggacggggtgttgcggggacggggattacgttggggacggggtgttgcgcggacggggtgttgcggg

SEQ ID NO: 168727 - DNA, 75 bp, Artificial Sequence
  Synthetic
gcgggggtgtttgcggcgaggacggggtgttgcggggacggggtgttgcggggacgggagttaattgcgctgggg

SEQ ID NO: 168728 - DNA, 75 bp, Artificial Sequence
  Synthetic
ggtgttgcggggacggggtgttgcggggacgggagttaattgcgctggggacggagttggcgggggtgtttgcgg

SEQ ID NO: 168729 - DNA, 75 bp, Artificial Sequence
  Synthetic
ggcgctttgtgcgcactgccggtgcgtggcgtcccgcggtgttttttgtttcgcggaccggcgccggggacgggg

SEQ ID NO: 168730 - DNA, 75 bp, Artificial Sequence
  Synthetic
acgatctggacgtggtcctgggagaacatgaccatcgccgtcaacgctcagcggggggacgggttgggaacacag

SEQ ID NO: 168731 - DNA, 75 bp, Artificial Sequence
  Synthetic
caaccacgtcacccgtggaagtggcgaagaaatgataaggatacttggagcgcgcggcggtcatggtcaccatac

SEQ ID NO: 168732 - DNA, 75 bp, Artificial Sequence
  Synthetic
tctcagctaaaaacagcggacagtcccacgctgtttctgttgtggctctctccagtttcctcatcgccgtcccgg

SEQ ID NO: 168733 - DNA, 75 bp, Artificial Sequence
  Synthetic
tccgccgcttctgcggcgtgttgtccacggcgctttctgcgcgctgccggtgcgtgtggctccacagcacttgtc

SEQ ID NO: 168734 - DNA, 75 bp, Artificial Sequence
  Synthetic
ccaccaccaaaaaacccactacgaccacgagaacgacaactaccaccacaacaaagaaaacaaccaccacgagca

SEQ ID NO: 168735 - DNA, 75 bp, Artificial Sequence
  Synthetic
acggctataggaactatagcactgggcaaacttgttgatgtgatgaatctcccacataggaggcgccacgtattc

SEQ ID NO: 168736 - DNA, 75 bp, Artificial Sequence
  Synthetic
cggtttgctgattggtcttgtaatcgtgtatacgtattattatgaagtacaaagtacggaactacgttgcccatg

SEQ ID NO: 168737 - DNA, 75 bp, Artificial Sequence
  Synthetic
gtgtatacgtattattatgaagtacaaagtacggaactacgttgcccatgcactaatggtttacacgatccttta

SEQ ID NO: 168738 - DNA, 75 bp, Artificial Sequence
  Synthetic
cccaaaggtaaagctgtatgcttaggtccacatcatcatttatcaatatggctcaatggtcaaaatagtagttta

SEQ ID NO: 168739 - DNA, 75 bp, Artificial Sequence
  Synthetic
gtccacatcatcatttatcaatatggctcaatggtcaaaatagtagtttatggcacaaagtgctggtgacgggaa

SEQ ID NO: 168740 - DNA, 75 bp, Artificial Sequence
  Synthetic
gtcatggctgaccgtttgagaagaagttacgtggtgagagactgaaccggattgagaccgagcggcagacgtcgt

SEQ ID NO: 168741 - DNA, 75 bp, Artificial Sequence
  Synthetic
atatggatatatacgatagctgataaattttccacgaaaaaggataacgcaatatgtttttgatatggtgctaac

SEQ ID NO: 168742 - DNA, 75 bp, Artificial Sequence
  Synthetic
aattttccacgaaaaaggataacgcaatatgtttttgatatggtgctaacatggttacatcattcgattataaac

SEQ ID NO: 168743 - DNA, 75 bp, Artificial Sequence
  Synthetic
cagaaaggtaggtgctacttaccttcattatcggggggaaaagcgctaagataccccacctgagtgaagggacct

SEQ ID NO: 168744 - DNA, 75 bp, Artificial Sequence
  Synthetic
tgcgtcgtggctatcacggaggtggaggcggacgtggaggtagaggtttgtaccgtggtggtgacagcagaagtg

SEQ ID NO: 168745 - DNA, 75 bp, Artificial Sequence
  Synthetic
gggtttccagcaatcctcggcgtcggcgcggccgatatagaagtagttgcgttgaaaaccgcggtacgtcccgca

SEQ ID NO: 168746 - DNA, 75 bp, Artificial Sequence
  Synthetic
acgttgttagaggtacttattgacgtagtagacgtgacggtggtattactaagggaagtgacggcgcctgtggtg

SEQ ID NO: 168747 - DNA, 75 bp, Artificial Sequence
  Synthetic
ccaagaaacttaattaccactactttagactgcgttggtgatcatgtccctattttaccgtgcggtagccctggg

SEQ ID NO: 168748 - DNA, 75 bp, Artificial Sequence
  Synthetic
gtatcatttttaccgtcaaaaaacgaccaaatcgttttcaggttagcactaacggttttatcatcaccggtcttt

SEQ ID NO: 168749 - DNA, 75 bp, Artificial Sequence
  Synthetic
taatgaagaccacaaaaaccacttgagtcagtatgacaatcataaaggctcggtgattgctgcgcctaaagtatg

SEQ ID NO: 168750 - DNA, 75 bp, Artificial Sequence
  Synthetic
tggattgcactaggaaagtcccggcgccgaaaattccgttagagccccagcaagtaacgctgccgttcacgtagg

SEQ ID NO: 168751 - DNA, 75 bp, Artificial Sequence
  Synthetic
ttcccggatcacccgttagcatatatgtcagttggtgggtatagtttttcctgatattattcatgtcattactat

SEQ ID NO: 168752 - DNA, 75 bp, Artificial Sequence
  Synthetic
cgtttcaccgctttctgcatggccgctaccacgtcgggcgggagcggctccggcggaagctcgatgagcagttgc

SEQ ID NO: 168753 - DNA, 75 bp, Artificial Sequence
  Synthetic
acccgtaagccgttctcgctgccgtcgccgtcctgcccattcgcccctccccctaccactttcttgcctcctcca

SEQ ID NO: 168754 - DNA, 75 bp, Artificial Sequence
  Synthetic
aaagaaatcacatagggatgtgtacaggaagtgcagtgacgggtatccgtgagatgtaagtcatcaccctcctca

SEQ ID NO: 168755 - DNA, 75 bp, Artificial Sequence
  Synthetic
aacacaaaagcactgacgtttatttgttgaattatcaacgttacttagttacaataagaaaccaggtatccactt

SEQ ID NO: 168756 - DNA, 75 bp, Artificial Sequence
  Synthetic
gccgccactttgcatcattacagacgcctataaagaaaccacgcgtcagggtggcgcaactttcacgtgcacgcg

SEQ ID NO: 168757 - DNA, 75 bp, Artificial Sequence
  Synthetic
aacggaacactacatctctacggtgtaaacacaactcattcaggtagatatactgcacgttgtcatatttatgaa

SEQ ID NO: 168758 - DNA, 75 bp, Artificial Sequence
  Synthetic
cctcaatgcggcgcttcatgacattgataacctcaggcttggttatcagaggccgcttggccagcaacacactag

SEQ ID NO: 168759 - DNA, 75 bp, Artificial Sequence
  Synthetic
ctcaggtacaatgtagttctcatacatgctctgcatagttagcccaatacatttcatctcctcgaaaggctcatg

SEQ ID NO: 168760 - DNA, 75 bp, Artificial Sequence
  Synthetic
agacacataccctaccgccacggccttgtgcggcacattggtggtggtgggcatcgtgctgtgcctaagtctggc

SEQ ID NO: 168761 - DNA, 75 bp, Artificial Sequence
  Synthetic
gtgtcttctatggaggtcaaaacagcgtggatggcgtctccaggcgatctgacggttcactaaacgagctctgct

SEQ ID NO: 168762 - DNA, 75 bp, Artificial Sequence
  Synthetic
cttcagagactgacacggactctgtatttttacaggatggggtcccatttattatttacaaattcacatatacaa

SEQ ID NO: 168763 - DNA, 75 bp, Artificial Sequence
  Synthetic
tggcctcatatcgtctgtcacctatatcgaaactgcgatatttgcgacacacagaatcgcccaagtcgccaaagt

SEQ ID NO: 168764 - DNA, 75 bp, Artificial Sequence
  Synthetic
agtcctctgccaagagaaagatggaccctgacaaccctgacgagggcccttcctccaaggtgccacggtacgtgt

SEQ ID NO: 168765 - DNA, 75 bp, Artificial Sequence
  Synthetic
caacccccggccccagcgcaacccccgtcccagcgcaagccccgtccccgcaacaccgcgggccagcgcaaacac

SEQ ID NO: 168766 - DNA, 75 bp, Artificial Sequence
  Synthetic
cagaagcgccgtggaaacacccgtagagacatccctcagcgcggtgaaaccccgtccccagcgccgtgccgctga

SEQ ID NO: 168767 - DNA, 75 bp, Artificial Sequence
  Synthetic
cctgagccctgtcccgcaccggcgccggtcggggtgtgtcgggggcgcggctgggtgggtgtgtgccgggtgtgt

SEQ ID NO: 168768 - DNA, 75 bp, Artificial Sequence
  Synthetic
tggtctcgcaacctcaatcgccgctatcaccaccgattttcgctgcgctccgccgacaaaacgccgtacaagcta

SEQ ID NO: 168769 - DNA, 75 bp, Artificial Sequence
  Synthetic
accacagaacgcagacaatcatgaaaatacgtacgcgacggtgaagcgattgcacattttgaaatcgtaacagcg

SEQ ID NO: 168770 - DNA, 75 bp, Artificial Sequence
  Synthetic
tgtcatcattcttatcatttttattattatttgcctgcgagcacctcgaaaactctacgatcgctggaaagacag

SEQ ID NO: 168771 - DNA, 75 bp, Artificial Sequence
  Synthetic
cttcggggttgtgccgtactgtgcggccgttacttcccccgcggtccccagggtggcgcggcgccgcgcgcttcc

SEQ ID NO: 168772 - DNA, 75 bp, Artificial Sequence
  Synthetic
tagcagccacaacgctgtcaagaacggcgtcaggtctttgggactcatgacgcgcggttttcaaaattccctgcg

SEQ ID NO: 168773 - DNA, 75 bp, Artificial Sequence
  Synthetic
ttggatgaggagagagacaaggtgctcacgcacattgatcacatatttatggatatcctcactacatgtgtggaa

SEQ ID NO: 168774 - DNA, 75 bp, Artificial Sequence
  Synthetic
cctcttttccgcgtcgctggcccctgggaggcgttcttcgtgtgtccccagggacccgcgctgccgtcgtcccct

SEQ ID NO: 168775 - DNA, 75 bp, Artificial Sequence
  Synthetic
gcaacgtgtcataggtgaactgcagctgggcgtagaccagattgtgcaccgattccatgttggataaatgagttg

SEQ ID NO: 168776 - DNA, 75 bp, Artificial Sequence
  Synthetic
acaaaaaataacgtgattgtgaacgcggttatcgtgtttttgcagcgtgacggtggaacaacccagtaccagcgc

SEQ ID NO: 168777 - DNA, 75 bp, Artificial Sequence
  Synthetic
tctccagcttcatcacacacatctgataacgtgtgccatcgttgacgacgaagcgtagcagcttggtctgcttgg

SEQ ID NO: 168778 - DNA, 75 bp, Artificial Sequence
  Synthetic
ataacgtgtgccatcgttgacgacgaagcgtagcagcttggtctgcttgggcaccatgtgcgctccaaaaatctt

SEQ ID NO: 168779 - DNA, 75 bp, Artificial Sequence
  Synthetic
cacgcgactccaagactccaaatttcacccccccgctaaaaacacccccccgcccctcggggacccaacacacgg

SEQ ID NO: 168780 - DNA, 75 bp, Artificial Sequence
  Synthetic
accaccgtcaccgtcctccacagcacacgcgactccaagactccaaatttcacccccccgctaaaaacacccccc

SEQ ID NO: 168781 - DNA, 75 bp, Artificial Sequence
  Synthetic
cgcccctcggggacccaacacacggcccggaatggatgtcgggcgtccacctaggtgggtgcgcgctcgggaggc

SEQ ID NO: 168782 - DNA, 75 bp, Artificial Sequence
  Synthetic
ccacggccttccagactgcgcggcgccaaggcggcgctagcaagcgccgtgcacgtcgctgcctataaaagccag

SEQ ID NO: 168783 - DNA, 75 bp, Artificial Sequence
  Synthetic
atttttcagctcactgtttgaataccgtaagcaaaataacgtacatatacgtgataatacaacaggtgttcatgt

SEQ ID NO: 168784 - DNA, 75 bp, Artificial Sequence
  Synthetic
cggtgcgcatgcgcgggccaggacccgcgggaggcgcgccctgcgcatgcgccggtaaaattccactgggcatgc

SEQ ID NO: 168785 - DNA, 75 bp, Artificial Sequence
  Synthetic
aagcctagtcgtactcgggatctctgagcgagacgggttgcatggcaactttcattagtttgggaatctgccagc

SEQ ID NO: 168786 - DNA, 75 bp, Artificial Sequence
  Synthetic
gtccggcggcgtcggggaccgtgccgcgcgccatgctggtggtggtgctggacgagctgggcgccgtgttcgggt

SEQ ID NO: 168787 - DNA, 75 bp, Artificial Sequence
  Synthetic
tttccggctgggggtcgcggcggccggccgacgacggtaggtgggccgggcggacggtggtggggacgggcgacg

SEQ ID NO: 168788 - DNA, 75 bp, Artificial Sequence
  Synthetic
taaactaccgcgatcagtaccgctatgaagctgaaaatggaggtgcctgtcacgatgtagaagaggatagccagc

SEQ ID NO: 168789 - DNA, 75 bp, Artificial Sequence
  Synthetic
gtgagcatagctgcatgcagcgttgcgtgtagaagcggggagatgaagacgttaataaagagtagcggcggttct

SEQ ID NO: 168790 - DNA, 75 bp, Artificial Sequence
  Synthetic
actgtgagtttcccacgtgttttcagttatcgcttatttctagaacgacgaccaccaaaaaacccggacaaaaaa

SEQ ID NO: 168791 - DNA, 75 bp, Artificial Sequence
  Synthetic
aaaaggctttgcggactcgtttaccggtaacgcagaggcacatagagccaaagatgccgcacacagcgcatggat

SEQ ID NO: 168792 - DNA, 75 bp, Artificial Sequence
  Synthetic
ggtagaatgctgttcaggtacatcacctttcatcgcgaaaaggtactttacctaacggctgcatgcatctttggt

SEQ ID NO: 168793 - DNA, 75 bp, Artificial Sequence
  Synthetic
agtaataccaccgccacatccactacgtcaataagtacctctaacaacgtcacttctgctgtcaccaccacggta

SEQ ID NO: 168794 - DNA, 75 bp, Artificial Sequence
  Synthetic
gtatatggatgtataatcgaatgatgtactagtttcataacttataagatcttgacgtaggttatttttacaccg

SEQ ID NO: 168795 - DNA, 75 bp, Artificial Sequence
  Synthetic
gtactagtttcataacttataagatcttgacgtaggttatttttacaccgttggtctcaagttatgtttgcgttg

SEQ ID NO: 168796 - DNA, 75 bp, Artificial Sequence
  Synthetic
gcatgacactgttataaaaattatcaaacgaagtcgtaaaagatatatgtgaataaaacacaacacaaattaaga

SEQ ID NO: 168797 - DNA, 75 bp, Artificial Sequence
  Synthetic
ataaactcatttttttacactaaactagtcactattttccactagaaaaggtaggcttagtacttcctttacgtg

SEQ ID NO: 168798 - DNA, 75 bp, Artificial Sequence
  Synthetic
taatcattggatattttcttgtgctgttaaaagtaacttcaaaccattcatgtttgtcacattttgacataaatt

SEQ ID NO: 168799 - DNA, 75 bp, Artificial Sequence
  Synthetic
gttaaaagtaacttcaaaccattcatgtttgtcacattttgacataaatttttgaccaaaaggattatgaacatg

SEQ ID NO: 168800 - DNA, 75 bp, Artificial Sequence
  Synthetic
agaccccacggctcccgccatcgcgcacggcgcgtccccgccggcggcctccgtctccgtgccgctcgcccccgg

SEQ ID NO: 168801 - DNA, 75 bp, Artificial Sequence
  Synthetic
cccagtccgactgatctagcttacggagcatctcaacaggcatgagctgcagggccacggctgtcacggcactgt

SEQ ID NO: 168802 - DNA, 75 bp, Artificial Sequence
  Synthetic
cgcggcaatcggtttgttgtagatggccgagagaatggctgacgggttgatcttgctgagttccttgaagacctc

SEQ ID NO: 168803 - DNA, 75 bp, Artificial Sequence
  Synthetic
ccccagtttgcccttgcagcggcagtaagggggtgacgtgtcaacggaagacgttgttttttgaaaaacgccgtt

SEQ ID NO: 168804 - DNA, 75 bp, Artificial Sequence
  Synthetic
tcatagtagtaccaaggagtgtgtaacaccattttttcttttctttgtaacgggataagggacagcaatcatcac

SEQ ID NO: 168805 - DNA, 75 bp, Artificial Sequence
  Synthetic
ggaatttgggaagttggcggtggcgggggacggcgacggcgaataaaagcgccgtgcggcgcgcacggcgaaacc

SEQ ID NO: 168806 - DNA, 75 bp, Artificial Sequence
  Synthetic
gggccgtgtgtgctgctgtgattggacgttttgtgagctaggtaacagctgtgatttcacctgtcgccaagactg

SEQ ID NO: 168807 - DNA, 75 bp, Artificial Sequence
  Synthetic
aataacacagccgcacgtaaagtaggtcggttctctcgtctcctccgtggctgccgccaccactcccagccacca

SEQ ID NO: 168808 - DNA, 75 bp, Artificial Sequence
  Synthetic
ggttatgttcgattctgtgaggttaaagtgtgtactatttatggcggtgtaatttagacggtcttgccatcctga

SEQ ID NO: 168809 - DNA, 75 bp, Artificial Sequence
  Synthetic
gcaagtgtgattctcttgcagagattttatccatcttgtgtgaaaatattgagatacgcgatgaatgttttcgct

SEQ ID NO: 168810 - DNA, 75 bp, Artificial Sequence
  Synthetic
tttatccatcttgtgtgaaaatattgagatacgcgatgaatgttttcgctatctatattgtaaagcgtttcggtg

SEQ ID NO: 168811 - DNA, 75 bp, Artificial Sequence
  Synthetic
acgccatctccatcgcacaccgtgtgctgcattcgccgtcgcctccacgagagaacatccgccacagcatgcgct

SEQ ID NO: 168812 - DNA, 75 bp, Artificial Sequence
  Synthetic
gctgcattcgccgtcgcctccacgagagaacatccgccacagcatgcgctgtcgccgtcgcgccatggcctcctc

SEQ ID NO: 168813 - DNA, 75 bp, Artificial Sequence
  Synthetic
gttcgaggatgacgtacgcgacgagcgagcccaccaattctcccacggcctcgcccgccaagtcagacggtggtg

SEQ ID NO: 168814 - DNA, 75 bp, Artificial Sequence
  Synthetic
ctgtgggtgattgatgataatagacacaccggggagacaaggtggtgaactgtgatgtctatctctttattgtaa

SEQ ID NO: 168815 - DNA, 75 bp, Artificial Sequence
  Synthetic
cggacgcttccttgtcacccccgggcagcggcccctcctcgagctcgctgtcatctcccccggtagtatcagcgg

SEQ ID NO: 168816 - DNA, 75 bp, Artificial Sequence
  Synthetic
cagtaattcgtaatatccggtattcccggaaaatcactcaaaactgcgtccatgacacatcaattcccgataact

SEQ ID NO: 168817 - DNA, 75 bp, Artificial Sequence
  Synthetic
ctttgcgatgtagccatcaacacggcgtatgccccatagttcgcgtgatacgacgcatgatgggttaaacgttcc

SEQ ID NO: 168818 - DNA, 75 bp, Artificial Sequence
  Synthetic
cgctggatccaagcgcagcggagcagcttacggaacacgtcgttgttccaaaagtagagcataaagagaaagaaa

SEQ ID NO: 168819 - DNA, 75 bp, Artificial Sequence
  Synthetic
caacaaaagcagcaggtaaataagagaaggagtccagataatgtccagccgctagcggcaaggagcgcgagttgt

SEQ ID NO: 168820 - DNA, 75 bp, Artificial Sequence
  Synthetic
gaaggagtccagataatgtccagccgctagcggcaaggagcgcgagttgtgggactgtccaattactgccgccag

SEQ ID NO: 168821 - DNA, 75 bp, Artificial Sequence
  Synthetic
catgcgccggggatgccgcatggaaagcctatatataaggaggggtgaaccaggggccccggtgcgcatgcgcgg

SEQ ID NO: 168822 - DNA, 75 bp, Artificial Sequence
  Synthetic
ccactggatgtgcgccgtgcgcatgcgccggtatttttccactgggcggccgcacctagggagcgcgagccccgt

SEQ ID NO: 168823 - DNA, 75 bp, Artificial Sequence
  Synthetic
ccgatgatgggtaacccgacgttcagcggcagatcgtccatggtgaccgtcctctgtccggatctacgtcccagt

SEQ ID NO: 168824 - DNA, 75 bp, Artificial Sequence
  Synthetic
catgcaccgcatccatccattccggcagcagtgcgttcggtgacgtcgtacgagtcgcgggtgatgttaccccgc

SEQ ID NO: 168825 - DNA, 75 bp, Artificial Sequence
  Synthetic
cggggtaagatttccatacgcgggtaactggaggctaaagttacggattttatctagaaacagcagcgagtctag

SEQ ID NO: 168826 - DNA, 75 bp, Artificial Sequence
  Synthetic
tgaacagcctggcacgttttggaaaacgtacgtgatcacggacacgacgagtacggggtttctcatagacgtact

SEQ ID NO: 168827 - DNA, 75 bp, Artificial Sequence
  Synthetic
tgtgtcagggtgtgtcagggtgtgtcggtcgggtgagtctcgggcgtgtgtcgggcgtgtggcgggtgtgtcgcg

SEQ ID NO: 168828 - DNA, 75 bp, Artificial Sequence
  Synthetic
cgctttttcttttccgcgcgcggccgtccccctggggacttcctcttttccccggggaatcacacagacacagac

SEQ ID NO: 168829 - DNA, 75 bp, Artificial Sequence
  Synthetic
ggtaacagctcatccacgtcaacctccgcaactacgttaaaatcgtccagttctagcgtgtcaacaagcaaattg

SEQ ID NO: 168830 - DNA, 75 bp, Artificial Sequence
  Synthetic
actcacgaccctaatgtgatgaaacgacatactcacgatgatttttacaaggcacattgcacatcgcatatgtat

SEQ ID NO: 168831 - DNA, 75 bp, Artificial Sequence
  Synthetic
aaaccgggggactctcgactatctcgcagatcaccctgtcgggatcgtcgccgtgtccgggacgccgtcgatgac

SEQ ID NO: 168832 - DNA, 75 bp, Artificial Sequence
  Synthetic
aatacatcccaccttaagcgacgagtccataaagcaccgttgtccgggtacggtgaaagtgacccggattgtagc

SEQ ID NO: 168833 - DNA, 75 bp, Artificial Sequence
  Synthetic
aaatagtgtacggtgtttcattacggattagtacgtgcgtgtttttcataaattctgatacggcggttcggttgc

SEQ ID NO: 168834 - DNA, 75 bp, Artificial Sequence
  Synthetic
gcattggcacgaaggatcttgcacatcgcaacccatcgctactgcgttctcccacaaacgccatcgcactattta

SEQ ID NO: 168835 - DNA, 75 bp, Artificial Sequence
  Synthetic
accaccaccacgacgatgaaacaaaacgctcaaccaaacattgtgtaaccgctacgcgtccgtggccgcggccgg

SEQ ID NO: 168836 - DNA, 75 bp, Artificial Sequence
  Synthetic
gtatagggagaatatggcgtagtagtactttgagatttcttactctttttttctgattgttctttgactggagct

SEQ ID NO: 168837 - DNA, 75 bp, Artificial Sequence
  Synthetic
gatgtcctagtaacactcgtccgacacttccaccatctccagctcggccggcggttcggcatcctccaccagcgg

SEQ ID NO: 168838 - DNA, 75 bp, Artificial Sequence
  Synthetic
cggctcatggcgttaaccaggtagaaactgtgcgtacagttgcgttgcgcgtaacgtagaagcaaggcggttagg

SEQ ID NO: 168839 - DNA, 75 bp, Artificial Sequence
  Synthetic
ccacaggtacacgtgcagacctgcgaacaggactacggaggtcatgaccaccacgacgcacacgggaatccaggg

SEQ ID NO: 168840 - DNA, 75 bp, Artificial Sequence
  Synthetic
tcatcatcatcatctcaggctctatcggtaccatcgttgtcatctgaaaaaactgcctcacccacctgcgtaaaa

SEQ ID NO: 168841 - DNA, 75 bp, Artificial Sequence
  Synthetic
acttagccggttttcgaagctgagtgctataaaaatcgaaccaaagataggtaacactgttattttgaatgggtc

SEQ ID NO: 168842 - DNA, 75 bp, Artificial Sequence
  Synthetic
gctataaaaatcgaaccaaagataggtaacactgttattttgaatgggtcccgctaaaatgtaataccgtggaaa

SEQ ID NO: 168843 - DNA, 75 bp, Artificial Sequence
  Synthetic
atatgctgttccacctagatccgcaataccagcaccccgcacgtcaacagcacctgtaacatgactgagccgctg

SEQ ID NO: 168844 - DNA, 75 bp, Artificial Sequence
  Synthetic
ttcgccattcgcaccaccgaagccgtgatcaacgcgctcattatctttgtgggcggcccgcttaacgctatagtg

SEQ ID NO: 168845 - DNA, 75 bp, Artificial Sequence
  Synthetic
tgatcaacgcgctcattatctttgtgggcggcccgcttaacgctatagtgttggtcacgcaactactcacgaacc

SEQ ID NO: 168846 - DNA, 75 bp, Artificial Sequence
  Synthetic
agggacccaccgaagcaactaccggaacaacctggaggagtcgcggcatgacggcgcccaagtgtgtcaccacca

SEQ ID NO: 168847 - DNA, 75 bp, Artificial Sequence
  Synthetic
tacccttcattgtgctgagcaaccagtggctactgcccgccagtgtgtcttcgtgtaaattcctatcggtggttt

SEQ ID NO: 168848 - DNA, 75 bp, Artificial Sequence
  Synthetic
gtggctactgcccgccagtgtgtcttcgtgtaaattcctatcggtggtttactactcgagctgcacagtgggctt

SEQ ID NO: 168849 - DNA, 75 bp, Artificial Sequence
  Synthetic
ttccacttacatagttttgacgctgacttggcttgctggactgattttttctatgcccgcggctgtttacaccac

SEQ ID NO: 168850 - DNA, 75 bp, Artificial Sequence
  Synthetic
ctatgcccgcggctgtttacaccaccgtggtaatacaccacgaagctaatgatatcaataataccaacggacacg

SEQ ID NO: 168851 - DNA, 75 bp, Artificial Sequence
  Synthetic
gacgggttgttgctttaccggacgacggtcagccgcggggttgatacccagcgacggcgtcgctcccacccgggt

SEQ ID NO: 168852 - DNA, 75 bp, Artificial Sequence
  Synthetic
gtacaggtgttggccgttgtgcccggacgggagatcgagtcccgtgatcggatcgccaagatatgcgacaatttt

SEQ ID NO: 168853 - DNA, 75 bp, Artificial Sequence
  Synthetic
gatcgccaagatatgcgacaattttgctattagcaaagtagcccgggatatggagcagttgttggccaccaaaaa

SEQ ID NO: 168854 - DNA, 75 bp, Artificial Sequence
  Synthetic
gctattagcaaagtagcccgggatatggagcagttgttggccaccaaaaatttggagaagccactggagcagccg

SEQ ID NO: 168855 - DNA, 75 bp, Artificial Sequence
  Synthetic
gtcattggccgctgcgaagggagaagaggggacacgcgagtaagccatgccgtccgggctgtctcttatacacat

SEQ ID NO: 168856 - DNA, 75 bp, Artificial Sequence
  Synthetic
ctcaaggaaccactcctcgtaaaagtgcgacttattcagacaacggtgagtggttccagtggaaacaaatgatat

SEQ ID NO: 168857 - DNA, 75 bp, Artificial Sequence
  Synthetic
atcctctagagtcccgggagggttcgagaagggggggcaccccccttcggcgtgcgcggtcacgcgcacagggcg

SEQ ID NO: 168858 - DNA, 75 bp, Artificial Sequence
  Synthetic
gagaagggggggcaccccccttcggcgtgcgcggtcacgcgcacagggcgcagccctggttaaaaacaaggttta

SEQ ID NO: 168859 - DNA, 75 bp, Artificial Sequence
  Synthetic
tgcgacttattcagacaacggtgagtggttccagtggaaacaaatgatataacgcttacaattcttggaaacaaa

SEQ ID NO: 168860 - DNA, 75 bp, Artificial Sequence
  Synthetic
ttttgcagaaaataaataaatttcatttaactcgcgaacatgttgaagatatgaatattaatgagatgcgagtaa

SEQ ID NO: 168861 - DNA, 75 bp, Artificial Sequence
  Synthetic
tggattttctgcctgtggacagcccctcaaatgtcaataggtgcgcccctcatctgtcagcactctgcccctcaa

SEQ ID NO: 168862 - DNA, 75 bp, Artificial Sequence
  Synthetic
ctcaaatgtcaataggtgcgcccctcatctgtcagcactctgcccctcaagtgtcaaggatcgcgcccctcatct

SEQ ID NO: 168863 - DNA, 75 bp, Artificial Sequence
  Synthetic
tttaactcgcgaacatgttgaagatatgaatattaatgagatgcgagtaacattttaatttgcagatggttgcca

SEQ ID NO: 168864 - DNA, 75 bp, Artificial Sequence
  Synthetic
gaaagcgccgtgttgtgagcagacgacgttggatgcgggacgttggagcacatgggccatgtgtggtggcagatg

SEQ ID NO: 168865 - DNA, 75 bp, Artificial Sequence
  Synthetic
tcttcctgaccaacatgacctttcaaaacgtctttgccacgataaatgtaagtcttgtttagaatacatttgcat

SEQ ID NO: 168866 - DNA, 75 bp, Artificial Sequence
  Synthetic
actcgcgtaaaatcaggcgttttcgccgatttgcgaggctggccagctccacgtcgccggccgaaatcgagcctg

SEQ ID NO: 168867 - DNA, 75 bp, Artificial Sequence
  Synthetic
ccgatttgcgaggctggccagctccacgtcgccggccgaaatcgagcctgcccctcatctgtcaacgccgcgccg

SEQ ID NO: 168868 - DNA, 75 bp, Artificial Sequence
  Synthetic
caacgccggcggccggccgcggtgtctcgcacacggcttcgacggcgtttctggcgcgtttgcagggccatagac

SEQ ID NO: 168869 - DNA, 75 bp, Artificial Sequence
  Synthetic
ctcgcacacggcttcgacggcgtttctggcgcgtttgcagggccatagacggccgccagcccagcggcgagggca

SEQ ID NO: 168870 - DNA, 75 bp, Artificial Sequence
  Synthetic
ttttgctttgccacggaacggtctgcgttgtcgggaagatgcgtgatctgatccttcaactcagcaaaagttcga

SEQ ID NO: 168871 - DNA, 75 bp, Artificial Sequence
  Synthetic
cgttgtcgggaagatgcgtgatctgatccttcaactcagcaaaagttcgatttattcaacaaagccgccgtcccg

SEQ ID NO: 168872 - DNA, 75 bp, Artificial Sequence
  Synthetic
atgaaactgcaatttattcatatcaggattatcaataccatatttttgaaaaagccgtttctgtaatgaaggaga

SEQ ID NO: 168873 - DNA, 75 bp, Artificial Sequence
  Synthetic
ggattatcaataccatatttttgaaaaagccgtttctgtaatgaaggagaaaactcaccgaggcagttccatagg

SEQ ID NO: 168874 - DNA, 75 bp, Artificial Sequence
  Synthetic
cccgtaactgtcacgttatgttttgttttgtttctcgtgagcttaacggtcctcttgagaaatcgcgggcacatg

SEQ ID NO: 168875 - DNA, 75 bp, Artificial Sequence
  Synthetic
aaaataaggttatcaagtgagaaatcaccatgagtgacgactgaatccggtgagaatggcaaaagtttatgcatt

SEQ ID NO: 168876 - DNA, 75 bp, Artificial Sequence
  Synthetic
caccatgagtgacgactgaatccggtgagaatggcaaaagtttatgcatttctttccagacttgttcaacaggcc

SEQ ID NO: 168877 - DNA, 75 bp, Artificial Sequence
  Synthetic
gaaatacgcgatcgctgttaaaaggacaattacaaacaggaatcgaatgcaaccggcgcaggaacactgccagcg

SEQ ID NO: 168878 - DNA, 75 bp, Artificial Sequence
  Synthetic
acaattacaaacaggaatcgaatgcaaccggcgcaggaacactgccagcgcatcaacaatattttcacctgaatc

SEQ ID NO: 168879 - DNA, 75 bp, Artificial Sequence
  Synthetic
gatcgatcctaggcctccaaaaaagcctcctcactacttctggaatagctcagaggccgaggcggcctcggcctc

SEQ ID NO: 168880 - DNA, 75 bp, Artificial Sequence
  Synthetic
acggataaaatgcttgatggtcggaagaggcataaattccgtcagccagtttagtctgaccatctcatctgtaac

SEQ ID NO: 168881 - DNA, 75 bp, Artificial Sequence
  Synthetic
agaggcataaattccgtcagccagtttagtctgaccatctcatctgtaacatcattggcaacgctacctttgcca

SEQ ID NO: 168882 - DNA, 75 bp, Artificial Sequence
  Synthetic
tcgcgagcccatttatacccatataaatcagcatccatgttggaatttaatcgcggcctcgagcaagacgtttcc

SEQ ID NO: 168883 - DNA, 75 bp, Artificial Sequence
  Synthetic
tcccccgcggtcccctagggacgagtcgcgccgagcgcttccccttttccgcgcgcgaccgtccccggggacttc

SEQ ID NO: 168884 - DNA, 75 bp, Artificial Sequence
  Synthetic
ctcagaaggtacctaaccaagttcctctttcagaggttatttcaggccatggtgctgcgccgaattgttaattaa

SEQ ID NO: 168885 - DNA, 75 bp, Artificial Sequence
  Synthetic
ctcttcgtgtgtccccagggacccgcgctgccgtcccctggggacttcttcctcttttccccggggaatcaacca

SEQ ID NO: 168886 - DNA, 75 bp, Artificial Sequence
  Synthetic
tttttatcttgtgcaatgtaacatcagagattttgagacacgacctgcaggcatgcaagcttgccaacgactacg

SEQ ID NO: 168887 - DNA, 75 bp, Artificial Sequence
  Synthetic
tctttcagaggttatttcaggccatggtgctgcgccgaattgttaattaagacaataagtctacgtagaagacta

SEQ ID NO: 168888 - DNA, 75 bp, Artificial Sequence
  Synthetic
aagtgtagcggtcacgctgcgcgtaaccaccacacccgccgcgcttaatgcgccgctacagggcgcgtcccattc

SEQ ID NO: 168889 - DNA, 75 bp, Artificial Sequence
  Synthetic
ataatggacttcataaagctactatcaggacgataagcaattgtagacgtggaaacccgccttgcggtggtagta

SEQ ID NO: 168890 - DNA, 75 bp, Artificial Sequence
  Synthetic
accaccacacccgccgcgcttaatgcgccgctacagggcgcgtcccattcgccattcaggctgcgcaactgttgg

SEQ ID NO: 168891 - DNA, 75 bp, Artificial Sequence
  Synthetic
tgggtaacgccagggttttcccagtcacgacgttgtaaaacgacggccagtgagcgcgcgtaatacgactcacta

SEQ ID NO: 168892 - DNA, 75 bp, Artificial Sequence
  Synthetic
agcaagcgccgtacacgtcgctgcctataaaagcctgctgcgtgtcggccgtggcacacggacaacggagacgtc

SEQ ID NO: 168893 - DNA, 75 bp, Artificial Sequence
  Synthetic
acggcgcgggcgaggtggtgcggctgtaccgctgcaaccggctgggcgtgggcaccccgcgcgcgacgctgctgc

SEQ ID NO: 168894 - DNA, 75 bp, Artificial Sequence
  Synthetic
ctgcacccgcgcgccgcgctgtgggcgcgcgagccgcacgggcagtgggagttcatgtttcgcgaacaacgcggt

SEQ ID NO: 168895 - DNA, 75 bp, Artificial Sequence
  Synthetic
acagagcgtcaaagtcaattgcccgaaaagtatatcggtttctatcagattaggaaacctccttggctcatggaa

SEQ ID NO: 168896 - DNA, 75 bp, Artificial Sequence
  Synthetic
gtagatagtctcgttggctctatgactgacggcttcagaagacgttacgtgttgagaagagactgaccgggtttg

SEQ ID NO: 168897 - DNA, 75 bp, Artificial Sequence
  Synthetic
tcgtcggctacccgccgccaggccagttcccgcatgggaaggctggacacgccgaccgagaggtcaccgagcccg

SEQ ID NO: 168898 - DNA, 75 bp, Artificial Sequence
  Synthetic
acacgtacccgagattcgcgtggagatcccacgttatgtttaataaaaactgcgggcactggggacggtggtgtt

SEQ ID NO: 168899 - DNA, 75 bp, Artificial Sequence
  Synthetic
tcagacgttctcttcttcgtcagagtctttcaagtgtcggtagccgtttttgcgatgtcgcagccggtctagcag

SEQ ID NO: 168900 - DNA, 75 bp, Artificial Sequence
  Synthetic
cacttcttgtttcttagacagaaaagttgcagtcattttggcagaagaaaagtggtacgagtcttcggcttcgga

SEQ ID NO: 168901 - DNA, 75 bp, Artificial Sequence
  Synthetic
tttcttggggtctccccacctcgtagacaacgtgatgtccaccatatccacggtgtgcgtcaccgggtgcccacc

SEQ ID NO: 168902 - DNA, 75 bp, Artificial Sequence
  Synthetic
cggtgtgcgtcaccgggtgcccaccgatgttccactcgaaataggctccgcgctcatcatggtggtactgctcac

SEQ ID NO: 168903 - DNA, 75 bp, Artificial Sequence
  Synthetic
catgcccatatggaaccagcattggttctcctccacccgaaagtgggccgatttgatctccgataccaccacatc

SEQ ID NO: 168904 - DNA, 75 bp, Artificial Sequence
  Synthetic
acgcttttttctcgctacttggggccagtcgctcggcagcgcccgtcatgtatcccggcgccgtagcggcccctc

SEQ ID NO: 168905 - DNA, 75 bp, Artificial Sequence
  Synthetic
tgcagggggatgtctgtcgcgatagagttgatgtgacagcccgctacacctctctgtcgcgacatgcgtacacaa

SEQ ID NO: 168906 - DNA, 75 bp, Artificial Sequence
  Synthetic
ggtctctccctaccgaagccttagcctctacggtgttttatgatcaacgtgtctacgaacgtcattgtgaaagtg

SEQ ID NO: 168907 - DNA, 75 bp, Artificial Sequence
  Synthetic
tttgctctctgactcggaggagttgccgcagcagctgcagattttacgtactagccaaaagcagcaaaagcagca

SEQ ID NO: 168908 - DNA, 75 bp, Artificial Sequence
  Synthetic
cggacgggatttgtgcgttttaggcctctttttcgccgccagcaagcattcgtgcgtaaagtcctcacccagctg

SEQ ID NO: 168909 - DNA, 75 bp, Artificial Sequence
  Synthetic
ctcttttttttctacatcatgataccctaataaagcacaccgcggttattatcaacgtctctgtttttattattt

SEQ ID NO: 168910 - DNA, 75 bp, Artificial Sequence
  Synthetic
aaattatggtaagccatcgtttttcgtaccacagcctgtagctgtcgtacatgaatgaggacggtttagggatcc

SEQ ID NO: 168911 - DNA, 75 bp, Artificial Sequence
  Synthetic
ctatttaatacgatgtcattggccgctgcgaagggagaagaggggacacgcgagtaagccatgccgtccgggtgt

SEQ ID NO: 168912 - DNA, 75 bp, Artificial Sequence
  Synthetic
acacggaactggagacacggtagccggacacgtccccgaacccgcgagggtactggggcagacggacggacttgc

SEQ ID NO: 168913 - DNA, 75 bp, Artificial Sequence
  Synthetic
atgcgtggtagccgcagcaggtgaggttggggcggacaacgtgttgcggatcgtggcgagaacgtcgtcctcccc

SEQ ID NO: 168914 - DNA, 75 bp, Artificial Sequence
  Synthetic
gacggggttcggcccgagaggtgacggagcgcctcacgtcagtgtgatgtccgatccgcgtcagccccgacgtgg

SEQ ID NO: 168915 - DNA, 75 bp, Artificial Sequence
  Synthetic
tgctcatatgctgtaaggtgttcgaggatcgtggggagtatacgtgttgaatcagaatcatttttactgaccgcg

SEQ ID NO: 168916 - DNA, 75 bp, Artificial Sequence
  Synthetic
gcctagataccagaggtacgtcaagttcatcaaaacgcccatcggcgtcccggaatcgtatactgggcacacgaa

SEQ ID NO: 168917 - DNA, 75 bp, Artificial Sequence
  Synthetic
agaggaaccaacccccgaaggccctccggctccgcggccgcgaccgaggggcggggggcgcggcgacatgccgtt

SEQ ID NO: 168918 - DNA, 75 bp, Artificial Sequence
  Synthetic
tagttacggagtctttctatgcaggtagtgttgagatatttttgaatgttggttatgttcgattctgtgaggtta

SEQ ID NO: 168919 - DNA, 75 bp, Artificial Sequence
  Synthetic
acctccctcagccccgtcccgcaccggcggtgttttgggtgtgtcggggcgcggctgggtgggtgtgtgccgggt

SEQ ID NO: 168920 - DNA, 75 bp, Artificial Sequence
  Synthetic
acgggtgtaggcgactgagcggcgcgccctctccggccgccgccttacataggcaggcgaccagacgcggaaccc

SEQ ID NO: 168921 - DNA, 75 bp, Artificial Sequence
  Synthetic
cggcagcgcgggtccctggggacacacgaagagcaacgcccgggggtgggggacgacggccagagacaagacgcg

SEQ ID NO: 168922 - DNA, 75 bp, Artificial Sequence
  Synthetic
acggtgagcgataaagcaccgttaatgtgtcgcggataagcacgatcttgaggccgtagatgaagcttacagtca

SEQ ID NO: 168923 - DNA, 75 bp, Artificial Sequence
  Synthetic
tcggggacgggggcctttcgcggcggggaacacagacggcacgcacacgcagctcgcctatttaacctccaccca

SEQ ID NO: 168924 - DNA, 75 bp, Artificial Sequence
  Synthetic
ggagtccagataatgtccagccgctagcggcaaacagcgcaagttgcgcgactgtccaattactgccaccaaagg

SEQ ID NO: 168925 - DNA, 75 bp, Artificial Sequence
  Synthetic
tggcgcacaggttgagcccggcggtggtgaacgacagaagcgccacatacagcgcaaacaccaggccgttgctgg

SEQ ID NO: 168926 - DNA, 75 bp, Artificial Sequence
  Synthetic
cgtcgcggcactcgtagcccagcgaggggtaacccagccaaaccagcgcgctaatgagtacgctaaaagcggttt

SEQ ID NO: 168927 - DNA, 75 bp, Artificial Sequence
  Synthetic
tgccaattgctgttgctctaccgcgacggcgaatggatcctctgtctttgctgcaacggccgttatcaaggccac

SEQ ID NO: 168928 - DNA, 75 bp, Artificial Sequence
  Synthetic
aatgaacaccacaaaaaccacttgcgtcagtatgacaatcataaaggctcggtgattgctgcgcctaaagtacgc

SEQ ID NO: 168929 - DNA, 75 bp, Artificial Sequence
  Synthetic
aggtcccgcttttccactccgtcatgaaggatcgcaataaaatactgctatgtatcatcttcatttgcattatgt

SEQ ID NO: 168930 - DNA, 75 bp, Artificial Sequence
  Synthetic
cacacccgcggcacacccgaccgacacacccgcgacacacccgccacgcgcccgacacacgcccgcgacacaccc

SEQ ID NO: 168931 - DNA, 75 bp, Artificial Sequence
  Synthetic
ccccggcctgcgaaagcgagtcgttgggcaaatgcggttggcccgaagtcagatgggccttgtacgagttgaaat

SEQ ID NO: 168932 - DNA, 75 bp, Artificial Sequence
  Synthetic
gtacggcggcgccttgcgtagcagtgtctgtaaaaagctgtgaatcaagccgcgctccatggcgtcggccgtgtt

SEQ ID NO: 168933 - DNA, 75 bp, Artificial Sequence
  Synthetic
tattaataactagtcaataatcaatgtcaacatggcggtcatattggacatgagccaatataaatgtacatatta

SEQ ID NO: 168934 - DNA, 75 bp, Artificial Sequence
  Synthetic
gtcattttggcagaagaaaagtgatacgagtcctcggcttcggaacgaatggtgcgttccgaggcttcccagaaa

SEQ ID NO: 168935 - DNA, 75 bp, Artificial Sequence
  Synthetic
ggtgtgcaagtggtggaacacgacgaagatatcatcgcgccgcagagtttgtggtgcacggcgttcaaggaagcc

SEQ ID NO: 168936 - DNA, 75 bp, Artificial Sequence
  Synthetic
agcccggtcccgccaacaaataccgtgggacgacacgcaccggcagtgcgcaggcagcgtcggacacaacacgcc

SEQ ID NO: 168937 - DNA, 75 bp, Artificial Sequence
  Synthetic
tgggacgacacgcaccggcagtgcgcaggcagcgtcggacacaacacgccgcaaacgcggcgcggcgcgctcacg

SEQ ID NO: 168938 - DNA, 75 bp, Artificial Sequence
  Synthetic
gcgcgcgctgtcctaccacgttctcgaaaaccacgtggccacgcatgtgttacgcggattgctctcgctgacgga

SEQ ID NO: 168939 - DNA, 75 bp, Artificial Sequence
  Synthetic
acacagacacgcgtcttcttttcgccgcacgtcgcttttattcgccgtcgccgtctcaaccgcaccgcagcacac

SEQ ID NO: 168940 - DNA, 75 bp, Artificial Sequence
  Synthetic
ctaaaaacacccccccgcccctcggggacccaccacgcggcccggaatggatgtcgggcgtccacctaggtgtgt

SEQ ID NO: 168941 - DNA, 75 bp, Artificial Sequence
  Synthetic
aagggcaacgtaactccatactttcaactttatagtacaacacgatcaaaagaccaaacagactaaaaataaatc

SEQ ID NO: 168942 - DNA, 75 bp, Artificial Sequence
  Synthetic
agcgtgatgttgcccaccttgtagaagtcggtgaccacaaagtcctgcttcatttcgttcaccgtgcgcgggacc

SEQ ID NO: 168943 - DNA, 75 bp, Artificial Sequence
  Synthetic
gcgcctcgtccaccagcagcaagtggaagttttgtcctcggatgctctgtgtagaggagacagaaaagggactct

SEQ ID NO: 168944 - DNA, 75 bp, Artificial Sequence
  Synthetic
tgagactggtctggcccgacggcagctatcgtgactgggaatttttagcgcgtgacctgttacgagaagaaatgg

SEQ ID NO: 168945 - DNA, 75 bp, Artificial Sequence
  Synthetic
catgcggaaaaactccgtgatggtgttggcaacgcgccgcacgtagtggttggggtcgtccatctggatggcgta

SEQ ID NO: 168946 - DNA, 75 bp, Artificial Sequence
  Synthetic
aaaaaaattcgagacgacaatacgacggcagggcgtgattttctcccccatccgacaaaaccgtgtcccttaaaa

SEQ ID NO: 168947 - DNA, 75 bp, Artificial Sequence
  Synthetic
gtcacaagctgtcactgccgcgcgacccggccgccgatcgcgttcgacgttacgtgtgcattatctcgcgtctca

SEQ ID NO: 168948 - DNA, 75 bp, Artificial Sequence
  Synthetic
tcggagcgaaaaaatgatagccctgaaaatctcgacgagtctggccgagcggcgccatcttggaggaggggcgag

SEQ ID NO: 168949 - DNA, 75 bp, Artificial Sequence
  Synthetic
cccgcgggagggtcgccctgcgcatgcgccggtaaaattccactgggtgtgtgtcgtgcgcatgcgccagtattt

SEQ ID NO: 168950 - DNA, 75 bp, Artificial Sequence
  Synthetic
ggctctatctcctctacgtagacaaaaaagtcgtcgtcgtctgaatcctcgtcctcggaagaggatcgcggcccg

SEQ ID NO: 168951 - DNA, 75 bp, Artificial Sequence
  Synthetic
taagccaagggacggtggaactgtatgtgaggaacctgggtgcttagacgactaacgtgtaatgctttttacagg

SEQ ID NO: 168952 - DNA, 75 bp, Artificial Sequence
  Synthetic
tgtgaggaacctgggtgcttagacgactaacgtgtaatgctttttacaggactgttcgacaggtgatagtacctg

SEQ ID NO: 168953 - DNA, 75 bp, Artificial Sequence
  Synthetic
agatatatgtttgccagggccaccgttttctaacaccgatcaccgccaccattaccacccgttgaactccacacc

SEQ ID NO: 168954 - DNA, 75 bp, Artificial Sequence
  Synthetic
agctgcggtatgggtcacggcggcgtgtgtcttactgacgaagatgccgatgtgtgactaaaaacgtcccagccc

SEQ ID NO: 168955 - DNA, 75 bp, Artificial Sequence
  Synthetic
tggggatgaaacatatgtagatacgcagttttattatccgaacaaagctcgtgtgatgcgaaaaacggtactgca

SEQ ID NO: 168956 - DNA, 75 bp, Artificial Sequence
  Synthetic
acgtccacccacccccgggacaaaaaagcccgccgcctccttgcccttttaactcataaactttcaggtctcgcg

SEQ ID NO: 168957 - DNA, 75 bp, Artificial Sequence
  Synthetic
gaggtagaggtttgtaccgtggtggtgacagcagaagtgacgttgttagaggtacttattgacgtagtagacgtg

SEQ ID NO: 168958 - DNA, 75 bp, Artificial Sequence
  Synthetic
cgttgtctttctcttcggttccatcggcaacttcttggtgatcttcaccatcacctggcgacgtcggattcaatg

SEQ ID NO: 168959 - DNA, 75 bp, Artificial Sequence
  Synthetic
caagaactgcactgtctgctggccgagtttcgccagcgactgttttcccgcgatgtatcctggtaccacagcatg

SEQ ID NO: 168960 - DNA, 75 bp, Artificial Sequence
  Synthetic
tgtgattccccggggaaaagaggaagttcccaggggacggcagcgcgggtccctggggacacacgaaaagcaacg

SEQ ID NO: 168961 - DNA, 75 bp, Artificial Sequence
  Synthetic
ccattccgggccgtgtgctgggtccccgaggggcggggggtgttttttgcgggggggggtgaaaattggagttgc

SEQ ID NO: 168962 - DNA, 75 bp, Artificial Sequence
  Synthetic
ggcgccagttcggcgttacggtcagtcgcacggcccagtagtgagccgtgcggcggatgatggcgcgcgcctcca

SEQ ID NO: 168963 - DNA, 75 bp, Artificial Sequence
  Synthetic
cgacacacccgacacccaccccacgcacgcacccacccagccgcgcccccgacacaccccgaccgccgccggtgc

SEQ ID NO: 168964 - DNA, 75 bp, Artificial Sequence
  Synthetic
gcgacttcggttccatctcagcggactcgggtgtcctacaaaggaaaatacaagaaaagacaatgaaagcgacgt

SEQ ID NO: 168965 - DNA, 75 bp, Artificial Sequence
  Synthetic
cggcgtgttttccacggcgctttctgcgtgctgccggtgcgtgtgtctccacagcacgggacagggctaagggag

SEQ ID NO: 168966 - DNA, 75 bp, Artificial Sequence
  Synthetic
gcacgtcttctacatacagcgtcctcagcgcttttgtagtgtggatcggatccggcctcaatatcatctggtgga

SEQ ID NO: 168967 - DNA, 75 bp, Artificial Sequence
  Synthetic
gagacgggggtttttgggcgtactggggacggggggtgtgcggggccggggggtgtgcggggacgggggggttag

SEQ ID NO: 168968 - DNA, 75 bp, Artificial Sequence
  Synthetic
acggcgaagacggtgaggtaggaggggaggccgggccgcatagcgcggccgcgccgctgggttcagcggcgtgat

SEQ ID NO: 168969 - DNA, 75 bp, Artificial Sequence
  Synthetic
aacttacgtgtaagaacacggcgtgataataaacaacatagcgtaaatccccgtgtgatgtgtgtgattgacgtt

SEQ ID NO: 168970 - DNA, 75 bp, Artificial Sequence
  Synthetic
acgataactggtcagcaattctggcccatattggtaagcccgaagaactggatacttcggcacgtaatgccgggg

SEQ ID NO: 168971 - DNA, 75 bp, Artificial Sequence
  Synthetic
ccccagcgtaactcccgttaccggcgccggcgcccagcacgcccggaaacaccgccgtcgccgccccgaaaagcg

SEQ ID NO: 168972 - DNA, 75 bp, Artificial Sequence
  Synthetic
ttggtttacaaaaaggttcatctcgatagcgcagagtagtatacacccacgtcgctagatcccttaactgcgtgg

SEQ ID NO: 168973 - DNA, 75 bp, Artificial Sequence
  Synthetic
ccatattggtaagcccgaagaactggatacttcggcacgtaatgccggggctctaacccgccgccgcgaaattcg

SEQ ID NO: 168974 - DNA, 75 bp, Artificial Sequence
  Synthetic
tgacgtgcaggatgttacgcgagtcagagaatcgcataagaacggggtggtgagcgggttcccacaggagtctct

SEQ ID NO: 168975 - DNA, 75 bp, Artificial Sequence
  Synthetic
ggctcagctccatgacgttgcaacattatctgacgtggctctcctgaagcggctgcggaatgccgccgactggtt

SEQ ID NO: 168976 - DNA, 75 bp, Artificial Sequence
  Synthetic
ttatctgacgtggctctcctgaagcggctgcggaatgccgccgactggtttggcatacttgccgcacaaacactt

SEQ ID NO: 168977 - DNA, 75 bp, Artificial Sequence
  Synthetic
cccgggggcggcagcgctgaatggcgactacatatgggatatgatcctcatacctgtcagttcactgattttgag

SEQ ID NO: 168978 - DNA, 75 bp, Artificial Sequence
  Synthetic
gactacatatgggatatgatcctcatacctgtcagttcactgattttgagctaaccgacagcagagacgctgaac

SEQ ID NO: 168979 - DNA, 75 bp, Artificial Sequence
  Synthetic
gggtgtgtcggtcggatgtgtcgcgggcgtgtgtcgcgggcgtgtgtcgggcgtgtgtcgggcgtgtggcgggtg

SEQ ID NO: 168980 - DNA, 75 bp, Artificial Sequence
  Synthetic
tccgctcacttgcttttggagaagctgattatatcgtccgggttcactggcgaggattgcgctggttaactgcag

SEQ ID NO: 168981 - DNA, 75 bp, Artificial Sequence
  Synthetic
tgattatatcgtccgggttcactggcgaggattgcgctggttaactgcagaaggaatgcgctttgacatgatggg

SEQ ID NO: 168982 - DNA, 75 bp, Artificial Sequence
  Synthetic
cggagctccctttccggcacgtctcattgccgtatcacttcctcccgaaaaagcattaatcagtaaaacccgact

SEQ ID NO: 168983 - DNA, 75 bp, Artificial Sequence
  Synthetic
attgccgtatcacttcctcccgaaaaagcattaatcagtaaaacccgactgctcagcgagaatcgtcgaaaagga

SEQ ID NO: 168984 - DNA, 75 bp, Artificial Sequence
  Synthetic
tcagcagagcaagtggctgattgttaccgtctgcgatggcaaattgaactggcttttaagcggctcaaaagtttg

SEQ ID NO: 168985 - DNA, 75 bp, Artificial Sequence
  Synthetic
accgtctgcgatggcaaattgaactggcttttaagcggctcaaaagtttgctgcacctggatgctttgcgtgcaa

SEQ ID NO: 168986 - DNA, 75 bp, Artificial Sequence
  Synthetic
catcgctggatttcccccccagaagtgccggatccgaaaagaagaactaactcgttgtggagaataacaaaaatg

SEQ ID NO: 168987 - DNA, 75 bp, Artificial Sequence
  Synthetic
gtcatctggagcttacaggtggccattcgtgggacagtatccctgacagcctacaaaacgcaattgaagaacgcg

SEQ ID NO: 168988 - DNA, 75 bp, Artificial Sequence
  Synthetic
aaattatgtagtatcatattatgcgtgtcctggtttgtcattttttggatgtatttgtcgcataaaaggcggtgg

SEQ ID NO: 168989 - DNA, 75 bp, Artificial Sequence
  Synthetic
aaaacggtgataaagcgtcaaaataccgtagggggggggggcgggaggctcggtggcgatgttaattaaatgcat

SEQ ID NO: 168990 - DNA, 75 bp, Artificial Sequence
  Synthetic
ccgtgcgcgatggcgggagccgtggggtccgctgtacctgtgcctccgcagccgtacggcacctccgccggcggg

SEQ ID NO: 168991 - DNA, 75 bp, Artificial Sequence
  Synthetic
tcccttgcgcccgcgagcttctgcgtgtgtctgtgttttcccctggggacttcctcttttccgcgtcttgtctct

SEQ ID NO: 168992 - DNA, 75 bp, Artificial Sequence
  Synthetic
acccgaacacggcgcccagctcgtccagcaccaccaccagcatggcgcgcggcacggtccccgacgccgccggac

SEQ ID NO: 168993 - DNA, 75 bp, Artificial Sequence
  Synthetic
ccaaatttcacccccccgctaaaaacacccccccgcccctcggggacccagcacgcggcccggaatggagcccgg

SEQ ID NO: 168994 - DNA, 75 bp, Artificial Sequence
  Synthetic
cttgtgtcaattgctgttgctccaccgcgatggcgaatggatcctctgtctctgctgcaacggccgttatcaagg

SEQ ID NO: 168995 - DNA, 75 bp, Artificial Sequence
  Synthetic
tttgaacaccaaagttaacatttgcggctacctggcgcccatcgcgctgatggcgtacacgtacaaccgtatggt

SEQ ID NO: 168996 - DNA, 75 bp, Artificial Sequence
  Synthetic
taaaaggatgggcgatcggccttttgctgaaaaaaaaccagactgggcaccacgctccaaacttgaccgccaccg

SEQ ID NO: 168997 - DNA, 75 bp, Artificial Sequence
  Synthetic
acgcgcgtctgtgtctgtttgattccccggggaaaagaggaagaagtccccaggggacggcagcgcggggccctg

SEQ ID NO: 168998 - DNA, 75 bp, Artificial Sequence
  Synthetic
caggggacggcagcgcggggccctggggacacacgaagagacaagacgcagaaaagaggaagtccccggggaaaa

SEQ ID NO: 168999 - DNA, 75 bp, Artificial Sequence
  Synthetic
gggacacacgaagagacaagacgcagaaaagaggaagtccccggggaaaacgcagaagcgatcgcccaggggaga

SEQ ID NO: 169000 - DNA, 75 bp, Artificial Sequence
  Synthetic
gcacacggcttccatccagccgcgcacaccgcacccctgacacaccccgccagaggaagttcgcaaaacaacggc

SEQ ID NO: 169001 - DNA, 75 bp, Artificial Sequence
  Synthetic
cgacggggacggggcgttgcggagacggggacgggagtggggacggtggtgaggacggggacgggggcctttcgc

SEQ ID NO: 169002 - DNA, 75 bp, Artificial Sequence
  Synthetic
cgctgcttgcgcacaggcccgccaacacctctacggtcaaacacaaccccaactacacgcataccccaacgccaa

SEQ ID NO: 169003 - DNA, 75 bp, Artificial Sequence
  Synthetic
ttgggtgtgtcggggcgcggctgggtgggtgtgtgccgggtgtgtcgcgggcgtgtgtcgggtgtgtcgggggtg

SEQ ID NO: 169004 - DNA, 75 bp, Artificial Sequence
  Synthetic
taaaacggtacgggccccaacacttaggggcactcttgctcgttgtaataaagtacacgccacacggtgtgatgg

SEQ ID NO: 169005 - DNA, 75 bp, Artificial Sequence
  Synthetic
gtacacgcaggcaagccaaaccacaaggcagacggacggtgcggggtctcctcctctgtcatggggagaaaagaa

SEQ ID NO: 169006 - DNA, 75 bp, Artificial Sequence
  Synthetic
gtcgttagaccaccgggacgttactggttaggtacagtactttctacgataggcaagcaaaaactagataaattc

SEQ ID NO: 169007 - DNA, 75 bp, Artificial Sequence
  Synthetic
tgacaggttatggctacaaaggtcctgggcgggaggacgcgtgggagcgcgggtggtggtaatgttttccaggtc

SEQ ID NO: 169008 - DNA, 75 bp, Artificial Sequence
  Synthetic
cctcttttccccggggaatcacacagacacagacacgcgtcttcttttcgccgtgcgcgccgcacgtcgctttta

SEQ ID NO: 169009 - DNA, 75 bp, Artificial Sequence
  Synthetic
aaagggaaccttatacaaaatacttcaatatgactaggcaacacgttaaaaatcttactatgaatatgacccagt

SEQ ID NO: 169010 - DNA, 75 bp, Artificial Sequence
  Synthetic
ggatgtggggatgaaacacattcagatacgcagttttgttatcgtaacaaaacccgtgtcatgcgaaacacgata

SEQ ID NO: 169011 - DNA, 75 bp, Artificial Sequence
  Synthetic
gtaacgaaacaccgtacactatttacggcactcttgacatgagctccttatattacaacgaaaccatgtccgtgg

SEQ ID NO: 169012 - DNA, 75 bp, Artificial Sequence
  Synthetic
acgaggtttcagaaaacgtttatagatcccctatgggactatctagactcgctgctgtttctagataaaatccgt

SEQ ID NO: 169013 - DNA, 75 bp, Artificial Sequence
  Synthetic
cgtagtacgatacaaaaggctcccatcagaatgagagcgttaagcatagtccaccaggctgcaaagctggacagt

SEQ ID NO: 169014 - DNA, 75 bp, Artificial Sequence
  Synthetic
agcatgtggtctcatcacgttggggtcgtgagtggtggaaccgggtttggtactagtcgtcgatgaagtacttgt

SEQ ID NO: 169015 - DNA, 75 bp, Artificial Sequence
  Synthetic
acagccgttgacttcacggttgttgaggtgcgagtagagctagaaggactcggtgtgctagcagtcgacgtattg

SEQ ID NO: 169016 - DNA, 75 bp, Artificial Sequence
  Synthetic
tgcgcgtgttacgatggcagtactttgtcggtgtaattgcatatcgattaattatgcgtgtgtctgacacctccg

SEQ ID NO: 169017 - DNA, 75 bp, Artificial Sequence
  Synthetic
gcggccgtcgtttccttcgtcttcctcttcaccgtctcccagggaacgcggtcgacggcgttccgcgaagtcgcc

SEQ ID NO: 169018 - DNA, 75 bp, Artificial Sequence
  Synthetic
atgcctgtcgtgcccgaagaatgttacgaccaacgcttcactaccgaaggccaccaggtcatcccgttgtgcgcg

SEQ ID NO: 169019 - DNA, 75 bp, Artificial Sequence
  Synthetic
agaagagcggcggttttgatagggcgaccgctgaggcgagccgcgtgtgcgtgtggtgtctgctccccgtccccg

SEQ ID NO: 169020 - DNA, 75 bp, Artificial Sequence
  Synthetic
gtccttgccgcaagcgtccccgtcctgaacgtcacccccgttcccgccacaccccgtccgcgcaacaccccgtcc

SEQ ID NO: 169021 - DNA, 75 bp, Artificial Sequence
  Synthetic
ccaacgtaatccccgtccccgcaacaccccgtccccgcaacaccccgtccccgcaacaccttgtccacgccggcg

SEQ ID NO: 169022 - DNA, 75 bp, Artificial Sequence
  Synthetic
ctatagtcatcatcctaaaattcagatataaggtgctaaaacaaatctatacgttgatcctacacgttctacgat

SEQ ID NO: 169023 - DNA, 75 bp, Artificial Sequence
  Synthetic
ggccctcaaacctccctcagccccgtcccgcaccggcgccgggttgggtgtgtctggggcgcggctgggtgggtg

SEQ ID NO: 169024 - DNA, 75 bp, Artificial Sequence
  Synthetic
aaccctgcgtatgtaccagtccaagtacgtccggtcattgttccacacaggaaatctaactaggtcaacggacaa

SEQ ID NO: 169025 - DNA, 75 bp, Artificial Sequence
  Synthetic
tacgtccggtcattgttccacacaggaaatctaactaggtcaacggacaaaaccaaattgtcaatccaccatatg

SEQ ID NO: 169026 - DNA, 75 bp, Artificial Sequence
  Synthetic
cagactgcgcggcgccaaggcggcgccagcaagcgccgtacacgtcgctgcctataaaagcctgatgcgtgtcgg

SEQ ID NO: 169027 - DNA, 75 bp, Artificial Sequence
  Synthetic
ctaggggaccgcgagggaaacgacagacgaagtacggcacaacccgcgcagaggcgatcgcccgggggggggggg

SEQ ID NO: 169028 - DNA, 75 bp, Artificial Sequence
  Synthetic
caccccacgcacgcacccacccagccgcgcccccgacacaccccgaccgccgccggtgcgggacagggctgaggg

SEQ ID NO: 169029 - DNA, 75 bp, Artificial Sequence
  Synthetic
cgggggttgcgccggggacggggggtgtgcgggcccgggcacgggggccttttgcggcggggacggtggtgggga

SEQ ID NO: 169030 - DNA, 75 bp, Artificial Sequence
  Synthetic
cggagacacggggtgacgtcggggacgggggtgtgcggggccggggacgggggccttttgcggcggggacggggg

SEQ ID NO: 169031 - DNA, 75 bp, Artificial Sequence
  Synthetic
cacgcacacgcagctcgcctatttaacctccacccactacaacacacacatgccgcacaatcatgccagccacag

SEQ ID NO: 169032 - DNA, 75 bp, Artificial Sequence
  Synthetic
tgttctgcgtaaagtgcattcaaacaacgtaacagtatgggatgaatgccaataaataacatataaaagccagct

SEQ ID NO: 169033 - DNA, 75 bp, Artificial Sequence
  Synthetic
tggttaccaggcttaacactagccatcacagcgtagtctggcaacgttatgatatctacagcagatacatgcgtc

SEQ ID NO: 169034 - DNA, 75 bp, Artificial Sequence
  Synthetic
atctgggaccaccagattcgcgatgaaaccaaaaattacccaacataattgttttgggcggcagttttttaccat

SEQ ID NO: 169035 - DNA, 75 bp, Artificial Sequence
  Synthetic
cgcgccaaaatctcacgctgtacaatcttacggttaaagatacgggagtctacctcctgcaggatcagtataccg

SEQ ID NO: 169036 - DNA, 75 bp, Artificial Sequence
  Synthetic
agcactacaaatacattggccgcatcttctataactacgttaaacacctcgactaacactacgtcttatacagct

SEQ ID NO: 169037 - DNA, 75 bp, Artificial Sequence
  Synthetic
tggggcggacaacgtgttgcggatcgtggcgagaacgtcgtcctccccttcttcaccgccccacccaccctcggt

SEQ ID NO: 169038 - DNA, 75 bp, Artificial Sequence
  Synthetic
tcgttggataatacgactacagacataacgtccagcgaaagttcgattaacgcgtcaaccattcataacactacg

SEQ ID NO: 169039 - DNA, 75 bp, Artificial Sequence
  Synthetic
taacgtccagcgaaagttcgattaacgcgtcaaccattcataacactacgtacagtcctgtaacatcgattgctg

SEQ ID NO: 169040 - DNA, 75 bp, Artificial Sequence
  Synthetic
gtgttaaatcaactacattaacggcagaagaaggaaaaaacattacgatacagggcaattcaacatggaactgcc

SEQ ID NO: 169041 - DNA, 75 bp, Artificial Sequence
  Synthetic
agaagaaggaaaaaacattacgatacagggcaattcaacatggaactgccccaatgtagtttggtaccgacatta

SEQ ID NO: 169042 - DNA, 75 bp, Artificial Sequence
  Synthetic
aacatcacatcccatatgtcatcctgacgtctcatcacctgcggcgtaccacgatctatgccgttcgtgtaataa

SEQ ID NO: 169043 - DNA, 75 bp, Artificial Sequence
  Synthetic
gacgtctcatcacctgcggcgtaccacgatctatgccgttcgtgtaataagacagaactacgtatatacgattta

SEQ ID NO: 169044 - DNA, 75 bp, Artificial Sequence
  Synthetic
aatttcggactaactgtaaatcccagaaacgacactaacaatcataccaccccactatgtcccagatacgtagga

SEQ ID NO: 169045 - DNA, 75 bp, Artificial Sequence
  Synthetic
tggcaggcggcgtcgtccgcttgcggccgtcgccgcgccgcacagacgcaaacacatgtcgccgtcaagagaaac

SEQ ID NO: 169046 - DNA, 75 bp, Artificial Sequence
  Synthetic
gccgtcgccgcgccgcacagacgcaaacacatgtcgccgtcaagagaaacagtctgagcatagccgtctgcagcg

SEQ ID NO: 169047 - DNA, 75 bp, Artificial Sequence
  Synthetic
caccgtgacatctcacatggcacgcgcactacatgggctcttacactaatctgcatagcctgcatacttctgttt

SEQ ID NO: 169048 - DNA, 75 bp, Artificial Sequence
  Synthetic
gagctgcgtgtgcgtgcctgttttgttccccgtcgccgccgaaaagctacgcgcggcccccgtccctagccttga

SEQ ID NO: 169049 - DNA, 75 bp, Artificial Sequence
  Synthetic
tatcatcctgaacatgaagactgacgtttccggacacgcaacacatgaaattaagtaacatatctaccatgaaat

SEQ ID NO: 169050 - DNA, 75 bp, Artificial Sequence
  Synthetic
gtttccggacacgcaacacatgaaattaagtaacatatctaccatgaaatacagcaaagatatactaatgtctat

SEQ ID NO: 169051 - DNA, 75 bp, Artificial Sequence
  Synthetic
ggcgtcgcgcttacgtcccgcaaacccccctcagcctcgtcccgccaaccaataccgtggcacgcagtgccatag

SEQ ID NO: 169052 - DNA, 75 bp, Artificial Sequence
  Synthetic
tacaaccaaacttgtccgtgcccctgcatttgtgtcaattctacaacagttagcatatccaccagtgaaacaacg

SEQ ID NO: 169053 - DNA, 75 bp, Artificial Sequence
  Synthetic
cgccggccccgccgcgcagcccagccaccgcgcgggcagcaccgcgcccagcgccagccagccgcagcacagacg

SEQ ID NO: 169054 - DNA, 75 bp, Artificial Sequence
  Synthetic
gcatttgtgtcaattctacaacagttagcatatccaccagtgaaacaacgtctaaaaacatcactccaactacca

SEQ ID NO: 169055 - DNA, 75 bp, Artificial Sequence
  Synthetic
tatgacgaccgctttttccttgtttgacggttatatgtgcggtatgattttgctgtcgttgcttgtgatgttgga

SEQ ID NO: 169056 - DNA, 75 bp, Artificial Sequence
  Synthetic
ggctgggtgggtgtgtgccgggtgcggctgggtgtggcgggtgtgtcgcgggtgtgtcggctggctgtgtggcgg

SEQ ID NO: 169057 - DNA, 75 bp, Artificial Sequence
  Synthetic
ctactgcagcgtcgtcaaccataatatctcaaaccaaccgcagtcatacgagtaatgctatcacaaccccgaaaa

SEQ ID NO: 169058 - DNA, 75 bp, Artificial Sequence
  Synthetic
cgcggccagatggaagcagtgtgccccggggcccgcgatccccccccccgccccggcgcgggcgcttcttctgcg

SEQ ID NO: 169059 - DNA, 75 bp, Artificial Sequence
  Synthetic
ccggggcccgcgatccccccccccgccccggcgcgggcgcttcttctgcgtgtgtcctcgacgcgggtctgtgcg

SEQ ID NO: 169060 - DNA, 75 bp, Artificial Sequence
  Synthetic
ttcctcttttccgcgtccgatcttcgcgtccccagggagtcgcgccgccgtcccctcgggaccgcttcctctttt

SEQ ID NO: 169061 - DNA, 75 bp, Artificial Sequence
  Synthetic
ccacccgcgcacaccccgccgacacacccctgacacacccggcacacgcccgcgacacacccgaccgacacaccc

SEQ ID NO: 169062 - DNA, 75 bp, Artificial Sequence
  Synthetic
acagacgcgcgactgaaagagacgcaagacacacgcgcgtctgggtttcgccgtgcgcgccgcacggcgctttta

SEQ ID NO: 169063 - DNA, 75 bp, Artificial Sequence
  Synthetic
acacacccacccagccgcaccccccacacaccccgaccgccgccggtgcgggacggggctgagggggtgttgcgg

SEQ ID NO: 169064 - DNA, 75 bp, Artificial Sequence
  Synthetic
cgtcgcagacccaggaaaccgcgttataccagacttcctaaatacgatccagatgagtcttggactaaaacctaa

SEQ ID NO: 169065 - DNA, 75 bp, Artificial Sequence
  Synthetic
cagcacttgtcatgttgcgcgttgcaggcgctctggggttggcggcgggtgtttctacggtgtttctgcggcgtt

SEQ ID NO: 169066 - DNA, 75 bp, Artificial Sequence
  Synthetic
aggcgctctggggttggcggcgggtgtttctacggtgtttctgcggcgtttctacgcagcttcggccgtgttttc

SEQ ID NO: 169067 - DNA, 75 bp, Artificial Sequence
  Synthetic
gtcgggatatccatagacatttaaaaacatgggtgtacaatgtaacagtaaactgctgctactagccgtactaat

SEQ ID NO: 169068 - DNA, 75 bp, Artificial Sequence
  Synthetic
aacatgggtgtacaatgtaacagtaaactgctgctactagccgtactaataacaattatcctatctagcattctg

SEQ ID NO: 169069 - DNA, 75 bp, Artificial Sequence
  Synthetic
atcacagtagccgaaggagatacaatttgctttaacgttagtgataacccctgcaacttttctagttactggaat

SEQ ID NO: 169070 - DNA, 75 bp, Artificial Sequence
  Synthetic
tttgctttaacgttagtgataacccctgcaacttttctagttactggaatcacaataactgcgaactttgcggtt

SEQ ID NO: 169071 - DNA, 75 bp, Artificial Sequence
  Synthetic
tttgcggcggggacggggacgggggcctttcgcggcggggacgggggcctttggcggagacggggagctttcgcg

SEQ ID NO: 169072 - DNA, 75 bp, Artificial Sequence
  Synthetic
atactaaaggtctgaaactacacaacgtaactacaaatgattcaggaatttatacccgaaacgtttattactgtg

SEQ ID NO: 169073 - DNA, 75 bp, Artificial Sequence
  Synthetic
cgtaactacaaatgattcaggaatttatacccgaaacgtttattactgtgacattccatgcaacatcagcgatga

SEQ ID NO: 169074 - DNA, 75 bp, Artificial Sequence
  Synthetic
gtcttcacgttattctaaacgcaccaattcccacgtagccactcacgttggttggacagccaccgtggtgataat

SEQ ID NO: 169075 - DNA, 75 bp, Artificial Sequence
  Synthetic
tatctgcgttttaacttacgttaacgttacaacaaccctgaagcacagactacgaactagaaacaacgtcaacca

SEQ ID NO: 169076 - DNA, 75 bp, Artificial Sequence
  Synthetic
acacccaccccacgcacgcacccacccagccgcgcccccgacacaccccgaccgccgccggtgcgggacggggct

SEQ ID NO: 169077 - DNA, 75 bp, Artificial Sequence
  Synthetic
cggggggggggtgaaatttggagttgcgtgtgtggacggcgacggcgaatagttgcgtgtggtgcggtggggacg

SEQ ID NO: 169078 - DNA, 75 bp, Artificial Sequence
  Synthetic
tcggcgtacagtgcgctgcatagaaagacgcgtgacacataccgtacccctggacggtacagtctatgataacgt

SEQ ID NO: 169079 - DNA, 75 bp, Artificial Sequence
  Synthetic
tcgaagcagcttgagccacactgcggtccaaatgacaagcatgatcaaaaatatgctgcgtagcagtcgaaagcc

SEQ ID NO: 169080 - DNA, 75 bp, Artificial Sequence
  Synthetic
cgggggggtgttttcagcgggggggtgaaatttggagtcttggagtcgcgtgtgctgtggaggacggtgacggtg

SEQ ID NO: 169081 - DNA, 75 bp, Artificial Sequence
  Synthetic
ccagccgcgcccccgacacaccccgatcgccgccggtgcgggacagggctcagggggtgttgcgggccgtcgttg

SEQ ID NO: 169082 - DNA, 75 bp, Artificial Sequence
  Synthetic
gacgcgtgtctgtgtctgtttgattccccggggaacagaggaagtccccagggaacgacggcagcgcgggtccct

SEQ ID NO: 169083 - DNA, 75 bp, Artificial Sequence
  Synthetic
tctctcggcgaagaaactgtcgtctctactgatttgcaaatacatcccgccttaagcgataagtccataaaacac

SEQ ID NO: 169084 - DNA, 75 bp, Artificial Sequence
  Synthetic
cgccggcgccggtaacgggagttacgctggggacggggacgggggttgcgccggggacggggggtgtgcggggac

SEQ ID NO: 169085 - DNA, 75 bp, Artificial Sequence
  Synthetic
gctggggacggggacgggggttgcgccggggacggggggtgtgcggggacgggggggtgtgcgtggacggccacg

SEQ ID NO: 169086 - DNA, 75 bp, Artificial Sequence
  Synthetic
aactaggaaagtcctggcgccgaaaattccgttagagccccagcaagtgacactgccgttcacgtaggttcccgg

SEQ ID NO: 169087 - DNA, 75 bp, Artificial Sequence
  Synthetic
cactgccgttcacgtaggttcccgggtcacccgacagcatgtatttcagttggtgggtatagtttttcctgatat

SEQ ID NO: 169088 - DNA, 75 bp, Artificial Sequence
  Synthetic
ccattccgggccgtgtgttgggtccccgcgggccgggggggtgtttttagcgggggggtgaaatttggagtcgga

SEQ ID NO: 169089 - DNA, 75 bp, Artificial Sequence
  Synthetic
gacgggggcctcctgcggcagggacggggcgttgcggggccgggggcgtttgcggcggggacgggggcctttcgc

SEQ ID NO: 169090 - DNA, 75 bp, Artificial Sequence
  Synthetic
gtgtgtctgtttgattccccggggaacagaggaagtgcccaggggacgacggcagcgcgggtccctggggaaacg

SEQ ID NO: 169091 - DNA, 75 bp, Artificial Sequence
  Synthetic
cacaagccgcgtcgagagaagaggcgtccggccgaggggagggggggggctcgcggaccccggggcacacttgtt

SEQ ID NO: 169092 - DNA, 75 bp, Artificial Sequence
  Synthetic
gtccggccgaggggagggggggggctcgcggaccccggggcacacttgttgttccctccggccgccgacacgcac

SEQ ID NO: 169093 - DNA, 75 bp, Artificial Sequence
  Synthetic
tatctaataccagcaatggcagcaagtgccacgcggtgtgcaaatgccgagtcacagaacccattaccatgctag

SEQ ID NO: 169094 - DNA, 75 bp, Artificial Sequence
  Synthetic
ggcgaataaaagcgacgtgcggcgcgcacggcgaaaagaagacgcgtgtctgtgtctgtgtgattccccggggaa

SEQ ID NO: 169095 - DNA, 75 bp, Artificial Sequence
  Synthetic
ctgacacacccgacacacgcccgcgacacacccggcacgcacgcacccacccagccgcgcccccgacacacccaa

SEQ ID NO: 169096 - DNA, 75 bp, Artificial Sequence
  Synthetic
ggagtcgtctcatcatcactaagcagttctacggaggcctgattttccacaccacctgggtcaccggcttcgtcc

SEQ ID NO: 169097 - DNA, 75 bp, Artificial Sequence
  Synthetic
cgcgggaccggactgcgggaggtttgcgggacgtaagcgcggcgcggcgtgtgtggcgttctgtccacggcgctt

SEQ ID NO: 169098 - DNA, 75 bp, Artificial Sequence
  Synthetic
cagcctgtttcgcgtaccgcaatccatctgtcgtttctgcatagaccgtctccgggacatcgcccgtcctctgaa

SEQ ID NO: 169099 - DNA, 75 bp, Artificial Sequence
  Synthetic
gggacgggggtgttgcgcagacgaggaaggtggcggcaaacttctgcagcggggatgggggtgtttgcgctgggg

SEQ ID NO: 169100 - DNA, 75 bp, Artificial Sequence
  Synthetic
ggacgctgaacagctgcggacggacctggatacggaacctctgttgttgacggtggacggggatttggagtaaaa

SEQ ID NO: 169101 - DNA, 75 bp, Artificial Sequence
  Synthetic
ctgctgtttgccgccgtgatggtgctcgttgatttgggtttgcctcaatcggcttggcgacgctggcgaagccac

SEQ ID NO: 169102 - DNA, 75 bp, Artificial Sequence
  Synthetic
tggggaattttaagggacacggttttgtcggatgggggagaaaatcacgccctgccgtcgtattgtctcgaattt

SEQ ID NO: 169103 - DNA, 75 bp, Artificial Sequence
  Synthetic
cacatccaccgcatcgcaccacccacatgctacggctctgccaaatcacacgctctttcccgtctcttctacacc

SEQ ID NO: 169104 - DNA, 75 bp, Artificial Sequence
  Synthetic
ggaatccgtcatctacgtgtccgggccacagggagggaacgttaccctggtatccaacttcacttcaaacatcag

SEQ ID NO: 169105 - DNA, 75 bp, Artificial Sequence
  Synthetic
ggtctcctgcggtctgagtcccgagataagcagctcttgagccgtggcattgtaggacagatgtagttttcctgt

SEQ ID NO: 169106 - DNA, 75 bp, Artificial Sequence
  Synthetic
gcattattcttggatgctaatcattgtcatcattctcatcatttttattatcatctgtctacgagcacctcgaaa

SEQ ID NO: 169107 - DNA, 75 bp, Artificial Sequence
  Synthetic
aaacagtacggacaagtgtttatgacagacacggaactgtgacagtgatgtctaagcgtttgcaggtatttccat

SEQ ID NO: 169108 - DNA, 75 bp, Artificial Sequence
  Synthetic
tccggggccgtgggccgggcaccgggcgcggcccgctccggacctcggccgggggtccctcccataagcgctaac

SEQ ID NO: 169109 - DNA, 75 bp, Artificial Sequence
  Synthetic
gatacggcagtcataatattagcttgcatccgcttaataactcattatttcaagacgatgtttttgaatggtaca

SEQ ID NO: 169110 - DNA, 75 bp, Artificial Sequence
  Synthetic
ttttgtaggctgtcagggatactgtcccacgaatggccacctgtaagctccagatgaccatttttgttattctcc

SEQ ID NO: 169111 - DNA, 75 bp, Artificial Sequence
  Synthetic
cccacgaatggccacctgtaagctccagatgaccatttttgttattctccacaacgagttagttcttcttttcgg

SEQ ID NO: 169112 - DNA, 75 bp, Artificial Sequence
  Synthetic
aatcagaattcattgttcgatatcacccagaacatgaagattgagctacgtttccgggcagacatcttatgaagc

SEQ ID NO: 169113 - DNA, 75 bp, Artificial Sequence
  Synthetic
caaatattatgtggcagtgcacagataatcgtacactaattctcatgaacttaaccacaacatacagtagaaact

SEQ ID NO: 169114 - DNA, 75 bp, Artificial Sequence
  Synthetic
taatcgtacactaattctcatgaacttaaccacaacatacagtagaaactattattttcaatcttttaaatatct

SEQ ID NO: 169115 - DNA, 75 bp, Artificial Sequence
  Synthetic
ttaaccacaacatacagtagaaactattattttcaatcttttaaatatctcggacaaggagtaccaaaaccgaat

SEQ ID NO: 169116 - DNA, 75 bp, Artificial Sequence
  Synthetic
caaatatccacgctttcgcgagttcaggttcctttgcacgcaaagcatccaggtgcagcaaacttttgagccgct

SEQ ID NO: 169117 - DNA, 75 bp, Artificial Sequence
  Synthetic
aggttcctttgcacgcaaagcatccaggtgcagcaaacttttgagccgcttaaaagccagttcaatttgccatcg

SEQ ID NO: 169118 - DNA, 75 bp, Artificial Sequence
  Synthetic
cctacatctgtacacgattcattagaaatatcacagtcattcacctcaaccaacttcacacataccgcggtccac

SEQ ID NO: 169119 - DNA, 75 bp, Artificial Sequence
  Synthetic
cgctgcttccagcgtttccgcctgaactactcgtccttttcgacgattctcgctgagcagtcgggttttactgat

SEQ ID NO: 169120 - DNA, 75 bp, Artificial Sequence
  Synthetic
ccaccgccgcggcccatgcccggcacggggctcgcgctccctaggtgcggccgcccagtggaaaaacaccggcgc

SEQ ID NO: 169121 - DNA, 75 bp, Artificial Sequence
  Synthetic
actactcgtccttttcgacgattctcgctgagcagtcgggttttactgattaatgctttttcgggaggaagtgat

SEQ ID NO: 169122 - DNA, 75 bp, Artificial Sequence
  Synthetic
gttataacaatcatcgttttaatttgtttcaagttcccccaaaaagcttggaataaattcacacaataccgatac

SEQ ID NO: 169123 - DNA, 75 bp, Artificial Sequence
  Synthetic
ccgttcttaccgcaatccagcccgcgcagaaaacccatcatgtcaaagcgcattccttctgcagttaaccagcgc

SEQ ID NO: 169124 - DNA, 75 bp, Artificial Sequence
  Synthetic
catgtggcctgtacgcacgaaaaagttgtttccgaagccgtagcacagggccatggctaccacggtggtgttgaa

SEQ ID NO: 169125 - DNA, 75 bp, Artificial Sequence
  Synthetic
gcagaaaacccatcatgtcaaagcgcattccttctgcagttaaccagcgcaatcctcgccagtgaacccggacga

SEQ ID NO: 169126 - DNA, 75 bp, Artificial Sequence
  Synthetic
tctcgtctgccgtttgcgcaaatcggtccagccgttcagcgtctctgctgtcggttagctcaaaatcagtgaact

SEQ ID NO: 169127 - DNA, 75 bp, Artificial Sequence
  Synthetic
gtccagccgttcagcgtctctgctgtcggttagctcaaaatcagtgaactgacaggtatgaggatcatatcccat

SEQ ID NO: 169128 - DNA, 75 bp, Artificial Sequence
  Synthetic
gcttgtacaacccgtaactgcggcgcgtacagcaagtgtttgtgcggcaagtatgccaaaccagtcggcggcatt

SEQ ID NO: 169129 - DNA, 75 bp, Artificial Sequence
  Synthetic
cgtacagcaagtgtttgtgcggcaagtatgccaaaccagtcggcggcattccgcagccgcttcaggagagccacg

SEQ ID NO: 169130 - DNA, 75 bp, Artificial Sequence
  Synthetic
gccagccccagacgtagcagagttgcagcatcacgaatttcgcggcggcgggttagagccccggcattacgtgcc

SEQ ID NO: 169131 - DNA, 75 bp, Artificial Sequence
  Synthetic
gaagtatccagttcttcgggcttaccaatatgggccagaattgctgaccagttatcgtgagagtaattcatcggc

SEQ ID NO: 169132 - DNA, 75 bp, Artificial Sequence
  Synthetic
acacatgagggggagaaggacaagtatccgggaccacccgcacccccacatcacgagaccagagacggagatgta

SEQ ID NO: 169133 - DNA, 75 bp, Artificial Sequence
  Synthetic
atgccgcgcagtagtcgaaagccgtattgagcgtgcgaggcgggtagagtgccgaacgacggatatccgtcgtca

SEQ ID NO: 169134 - DNA, 75 bp, Artificial Sequence
  Synthetic
aatttttcatgtctaagcaattacagccttctcctcattaacgttaccacgcagtatagcaccacctatcgtact

SEQ ID NO: 169135 - DNA, 75 bp, Artificial Sequence
  Synthetic
aaaagggcgaatcgcaagctgtagtgttacagaaaatagtcaggttagtgtcattatgctcatacatataagcca

SEQ ID NO: 169136 - DNA, 75 bp, Artificial Sequence
  Synthetic
ggtggcagtggccgttagataccttacgtgtctgtattggtacatttgcgaatcgtcaggtgcgacggtatagtt

SEQ ID NO: 169137 - DNA, 75 bp, Artificial Sequence
  Synthetic
atatcaaccgcctcaaacaccatatccagcactacaaatacattggccgcatcttctataactacgttaaacacc

SEQ ID NO: 169138 - DNA, 75 bp, Artificial Sequence
  Synthetic
aaatgtaacagcactgataccaataattctacatccacttctccacacagtacaacttctaatactactgtatat

SEQ ID NO: 169139 - DNA, 75 bp, Artificial Sequence
  Synthetic
attctacatccacttctccacacagtacaacttctaatactactgtatattccactctaaacacatctaatttca

SEQ ID NO: 169140 - DNA, 75 bp, Artificial Sequence
  Synthetic
cttctgttactacactcaatacctcaattaacattacacaccatacatctgcaacaaccgccgctttttccagta

SEQ ID NO: 169141 - DNA, 75 bp, Artificial Sequence
  Synthetic
aattaacattacacaccatacatctgcaacaaccgccgctttttccagtactaatactaggttcacaacattatt

SEQ ID NO: 169142 - DNA, 75 bp, Artificial Sequence
  Synthetic
gtggctggtatgtagcgtatccggtttggaattgttctgctccggctcgggggatagtgaggaattctcagggga

SEQ ID NO: 169143 - DNA, 75 bp, Artificial Sequence
  Synthetic
gaatgcatcaactatggataacactacgtccaaccctagaacatcatttgctgttaattacaccattacaatcaa

SEQ ID NO: 169144 - DNA, 75 bp, Artificial Sequence
  Synthetic
acgtccaaccctagaacatcatttgctgttaattacaccattacaatcaacgggacaaacagctctagtttcaac

SEQ ID NO: 169145 - DNA, 75 bp, Artificial Sequence
  Synthetic
cgggccaattccacatggagttgtcccttggtaacctggatacggcattataacttaaccacacatggtcatcac

SEQ ID NO: 169146 - DNA, 75 bp, Artificial Sequence
  Synthetic
ccttggtaacctggatacggcattataacttaaccacacatggtcatcacatatatccttatgtacaccgccaaa

SEQ ID NO: 169147 - DNA, 75 bp, Artificial Sequence
  Synthetic
atctgtgccgctcatgcaataaaacagaattgcacctttacgacctgaatacaactaactctggcagatatagcc

SEQ ID NO: 169148 - DNA, 75 bp, Artificial Sequence
  Synthetic
agaattgcacctttacgacctgaatacaactaactctggcagatatagccgccgttgctacaaagattacaatgg

SEQ ID NO: 169149 - DNA, 75 bp, Artificial Sequence
  Synthetic
ccccaaatcatcgaattcagaaaatgacgatgaatatgattacacagcaagcaccattagaaatgctaatcatcg

SEQ ID NO: 169150 - DNA, 75 bp, Artificial Sequence
  Synthetic
gacgatgaatatgattacacagcaagcaccattagaaatgctaatcatcgacataaaacgaactatcgtgatagc

SEQ ID NO: 169151 - DNA, 75 bp, Artificial Sequence
  Synthetic
gcctttaataaaaagtaccatcaattgcaagacgacattagtgaatcacactttattgtgtattacaatccagag

SEQ ID NO: 169152 - DNA, 75 bp, Artificial Sequence
  Synthetic
tgcaagacgacattagtgaatcacactttattgtgtattacaatccagagcatgaagattaaataacgtttccgg

SEQ ID NO: 169153 - DNA, 75 bp, Artificial Sequence
  Synthetic
ccattatccgaaaaacgttatcatcatggactggcaacttacggttatatggacgatactgatgttcacgttgtt

SEQ ID NO: 169154 - DNA, 75 bp, Artificial Sequence
  Synthetic
atggactggcaacttacggttatatggacgatactgatgttcacgttgttagaaggatgcaatcatacgtgctct

SEQ ID NO: 169155 - DNA, 75 bp, Artificial Sequence
  Synthetic
atggtgctcattgatttgggtttgcctcaatcggcttggcgacgctggcgaagccacgtggacgatgaagaacgt

SEQ ID NO: 169156 - DNA, 75 bp, Artificial Sequence
  Synthetic
agcgcatcaatcaccatcagtgaaagtacctccgaatcccccaccaccgtcactggtaccagtcctaattcaacc

SEQ ID NO: 169157 - DNA, 75 bp, Artificial Sequence
  Synthetic
gtacctccgaatcccccaccaccgtcactggtaccagtcctaattcaaccgctgtgatcacatcaacgtcaaaag

SEQ ID NO: 169158 - DNA, 75 bp, Artificial Sequence
  Synthetic
gcactaccaacgtcacatgcaacggcactttatacactattcataaattgtgtaaccttggctataaagaggtaa

SEQ ID NO: 169159 - DNA, 75 bp, Artificial Sequence
  Synthetic
cactttatacactattcataaattgtgtaaccttggctataaagaggtaattaacgtaacagcatatgtcggtgg

SEQ ID NO: 169160 - DNA, 75 bp, Artificial Sequence
  Synthetic
gcttttataggcagcgacgtgtacggcgcttgctggcgccgccttggcgccgcgcagtctggaaggccgtggaaa

SEQ ID NO: 169161 - DNA, 75 bp, Artificial Sequence
  Synthetic
gccgcagttatgcagcgtgggacattaccgcgttacatcgccacgtaatgacatgtgtttcgaatgcaacgagac

SEQ ID NO: 169162 - DNA, 75 bp, Artificial Sequence
  Synthetic
ggaatactattacttgacagtatcaactggaggagtaaccccggtgccccatccaacaggaaaatgtcaaaagac

SEQ ID NO: 169163 - DNA, 75 bp, Artificial Sequence
  Synthetic
tatgtgaatttgtaaataataaatgagaccccatcctgtaaaaatacagagtccgtgtcagtctctgaaggacag

SEQ ID NO: 169164 - DNA, 75 bp, Artificial Sequence
  Synthetic
tatggggtggtggaagttgttgtgtagtaaaccagagttatagtaatgtgttttttatcagggagaaggttttgt

SEQ ID NO: 169165 - DNA, 75 bp, Artificial Sequence
  Synthetic
atgccccgctcacatgcaagagttaatctttactctatctgacatacacaagtaaatccacgtcccatgcaggtt

SEQ ID NO: 169166 - DNA, 75 bp, Artificial Sequence
  Synthetic
ttttttttttctgctaacaacctatgatataaagcaatatattcagtcattagtagacaaaaaaatatgggcatg

SEQ ID NO: 169167 - DNA, 75 bp, Artificial Sequence
  Synthetic
tagtcgcattaatactgattgcaataatcctaactggtaccctagtgccgatacttttacatgaacaaaaaaaag

SEQ ID NO: 169168 - DNA, 75 bp, Artificial Sequence
  Synthetic
actgttaacctccttcctcaacatagtctgcaggaacgtcgtggccttggtcacgggtgtctcgggcctaaacac

SEQ ID NO: 169169 - DNA, 75 bp, Artificial Sequence
  Synthetic
ggtaactgcgaactttgtgggtggaacagatatctacgcaatgttacacaatattacacaaacacatcgtgttat

SEQ ID NO: 169170 - DNA, 75 bp, Artificial Sequence
  Synthetic
atattacacaaacacatcgtgttatccgcaattcacctgcataaacgaaaccaagggtctgcaattgtataatat

SEQ ID NO: 169171 - DNA, 75 bp, Artificial Sequence
  Synthetic
aactgtacctacaccataaatagcaccaagcatattatcaccgtggtgtcttcacgttattctaaacacaccgag

SEQ ID NO: 169172 - DNA, 75 bp, Artificial Sequence
  Synthetic
aaacgaggcggcggaggaaactgccgcgggagaagcctctgcggtagcggcggcggccgtctctgaggaagagca

SEQ ID NO: 169173 - DNA, 75 bp, Artificial Sequence
  Synthetic
aacgttccagcaaccctaagacgcagactacgaactagaaacaacgttaaccgcataacgtgattataaagtact

SEQ ID NO: 169174 - DNA, 75 bp, Artificial Sequence
  Synthetic
gactacgaactagaaacaacgttaaccgcataacgtgattataaagtactaacgctatttaggataaattttgac

SEQ ID NO: 169175 - DNA, 75 bp, Artificial Sequence
  Synthetic
tgtattatatttatttttaccatgtgcttcatttgtctttactttaaacggcgttgtattcctactccgtctcca

SEQ ID NO: 169176 - DNA, 75 bp, Artificial Sequence
  Synthetic
gcttcatttgtctttactttaaacggcgttgtattcctactccgtctccagataaggcggatctgcgagtggaat

SEQ ID NO: 169177 - DNA, 75 bp, Artificial Sequence
  Synthetic
cgttacagtttatgataacacaatttaaggaaagtacagattcctaccgacatgttatcacagaagatcacgaaa

SEQ ID NO: 169178 - DNA, 75 bp, Artificial Sequence
  Synthetic
taaggaaagtacagattcctaccgacatgttatcacagaagatcacgaaacactgttttctacgtgtgtttttat

SEQ ID NO: 169179 - DNA, 75 bp, Artificial Sequence
  Synthetic
tgcggggacgggggccttttgcggcggggacagtggtggggttgtcggcggggacgggggcctttcgcggcgggg

SEQ ID NO: 169180 - DNA, 75 bp, Artificial Sequence
  Synthetic
agtcgaaagccgtactgagcgtgcgaggcgggtaaagtgccgaacgacggatacgcatcgtcatcatcttcaact

SEQ ID NO: 169181 - DNA, 75 bp, Artificial Sequence
  Synthetic
aggcgggtaaagtgccgaacgacggatacgcatcgtcatcatcttcaactataaggatcgcgaccgagtcttcgg

SEQ ID NO: 169182 - DNA, 75 bp, Artificial Sequence
  Synthetic
tgcccagttgcacttcattatgctgacacactttagtcactccaagctgcaataatatcacagcaaagcagatga

SEQ ID NO: 169183 - DNA, 75 bp, Artificial Sequence
  Synthetic
cgcgggcgtgtggcgggtgtgttggcggggtgtgtcaggggtgtgtcggggtgtgttggcgggccgtgtctgcgt

SEQ ID NO: 169184 - DNA, 75 bp, Artificial Sequence
  Synthetic
acacacgcaactccaaatttcacccccccgctaaaaacacccccccgcccctcggggacccagcacacggcccgg

SEQ ID NO: 169185 - DNA, 75 bp, Artificial Sequence
  Synthetic
cgccggcgggcacgcggtgtgcgtgccgaacgcggacgcgcacacggtggtcggggcggacgcggcggcggcggc

SEQ ID NO: 169186 - DNA, 75 bp, Artificial Sequence
  Synthetic
ctgcgttttccccggggacttcctcttttctgcgtcttgtctcttcgtgtgtccccagggacccgcgctgccgtc

SEQ ID NO: 169187 - DNA, 75 bp, Artificial Sequence
  Synthetic
acgttaccctggtatccaactttacctcaaacatcagtgtacggtggtttcgttgggatggcaaccacagtaatc

SEQ ID NO: 169188 - DNA, 75 bp, Artificial Sequence
  Synthetic
caatgttgcgttggaacggtctttatatatacaaacgccgttatgttcagtgtccggcaagatgctcgggatacg

SEQ ID NO: 169189 - DNA, 75 bp, Artificial Sequence
  Synthetic
tgtccggcaagatgctcgggatacgggctatgctggtgatgctggattactactggatacagttgacaacgctca

SEQ ID NO: 169190 - DNA, 75 bp, Artificial Sequence
  Synthetic
accactccagctagtaacataacaaccatcgtcacaacgataccgacggtgactggcgcgaaaagtaacgttaca

SEQ ID NO: 169191 - DNA, 75 bp, Artificial Sequence
  Synthetic
tgcatcaaccgcggtgagtcctatctgactaccctctggcttctgaactgcactcaaaacaatacttattggtat

SEQ ID NO: 169192 - DNA, 75 bp, Artificial Sequence
  Synthetic
tgtagtaaaccagaattatagtaatgtgctttttatcaggaagaaggttttgtaccaacaatgactagctcgggc

SEQ ID NO: 169193 - DNA, 75 bp, Artificial Sequence
  Synthetic
gaaatatctcttttccggcatgtgccagctatggaaaaattggatcaatattacttttaataacactatcaaagt

SEQ ID NO: 169194 - DNA, 75 bp, Artificial Sequence
  Synthetic
gactggataacgttaggaaccagtgcgtcgttgttgaaaagcacggaaactgcggccaacctcggcaacgcgacc

SEQ ID NO: 169195 - DNA, 75 bp, Artificial Sequence
  Synthetic
cgtcgttgttgaaaagcacggaaactgcggccaacctcggcaacgcgaccacggtcattcctaaacctgtggaat

SEQ ID NO: 169196 - DNA, 75 bp, Artificial Sequence
  Synthetic
tgttctccgtgtcctgcgcgggaatcacaggtaccgtatctattatactcgtctccctatcgctgctcatcctca

SEQ ID NO: 169197 - DNA, 75 bp, Artificial Sequence
  Synthetic
cactcggagccgttaacatgttatgttattataatgaaaaacgtgaagaagtacatagcaggttagacattatac

SEQ ID NO: 169198 - DNA, 75 bp, Artificial Sequence
  Synthetic
ttattataatgaaaaacgtgaagaagtacatagcaggttagacattatacgacaatgcctagagaatcgcacatt

SEQ ID NO: 169199 - DNA, 75 bp, Artificial Sequence
  Synthetic
tgagcccacgcacatggtaatctgcataccatcatgacggactttggactgagccccaagcggtacggactatat

SEQ ID NO: 169200 - DNA, 75 bp, Artificial Sequence
  Synthetic
atggaaaccagatgtatgttacaatgtcactgtgcactcgacatatcaaacatacatccacacaactatatcgtt

SEQ ID NO: 169201 - DNA, 75 bp, Artificial Sequence
  Synthetic
ctattaacagcattagcgtcactcacctcaacaaacatcacacataccgcggtctactatgccgccagtaacgtt

SEQ ID NO: 169202 - DNA, 75 bp, Artificial Sequence
  Synthetic
ggggttgctgcggaggtcggtcgatgacgatgtcgatctccatcggcagatccggcaacatctcttcgtctccct

SEQ ID NO: 169203 - DNA, 75 bp, Artificial Sequence
  Synthetic
tctgctgggcagcaacacggaatacgtggcgcctcctatgtgggagattcatcatatcaacaggcacagtcagtg

SEQ ID NO: 169204 - DNA, 75 bp, Artificial Sequence
  Synthetic
tggcactcatagcactatatatgggtaaccgtcgtagacccaggaaaccgcgttataccagacttcctaaatacg

SEQ ID NO: 169205 - DNA, 75 bp, Artificial Sequence
  Synthetic
catgcaattaatgctcgacgattattccaacacccacagcacccgttacgtgacggtcaaggatcagtggcacag

SEQ ID NO: 169206 - DNA, 75 bp, Artificial Sequence
  Synthetic
accgcacacccagggtgccgtttacaaacacggaaatgtttccgttacaaaccacgttggcagatgaattagatt

SEQ ID NO: 169207 - DNA, 75 bp, Artificial Sequence
  Synthetic
gtagtaataccacccccagcaagaacgtaactctcagtcagggggggtccaccaccgacggagacgaagattact

SEQ ID NO: 169208 - DNA, 75 bp, Artificial Sequence
  Synthetic
aacgcgttcaggattaacgtaggttttcgaaataacctacgtccgtgagtgacgcggtttcgtgttgaaacccgc

SEQ ID NO: 169209 - DNA, 75 bp, Artificial Sequence
  Synthetic
gatcaggctctaaataagctacaacagatcttcaacgcctcgtacaatcaaacatacgaaaagtacggtaacgtg

SEQ ID NO: 169210 - DNA, 75 bp, Artificial Sequence
  Synthetic
agatcttcaacgcctcgtacaatcaaacatacgaaaagtacggtaacgtgtcggtttttgaaaccacaggcggtc

SEQ ID NO: 169211 - DNA, 75 bp, Artificial Sequence
  Synthetic
agcgcgggtccctggggacacacgaagagacaagacgcggaaaagagggacggcagacacgcgaagagcaacgcc

SEQ ID NO: 169212 - DNA, 75 bp, Artificial Sequence
  Synthetic
attcgaaatcggatgatgtaaccatgttaacatcatatcgaaaacatattgcgttatcgtttcttgtaaaaattt

SEQ ID NO: 169213 - DNA, 75 bp, Artificial Sequence
  Synthetic
gttaacatcatatcgaaaacatattgcgttatcgtttcttgtaaaaattttatcaactatacacatattactgat

SEQ ID NO: 169214 - DNA, 75 bp, Artificial Sequence
  Synthetic
ttcgctggtcttacggtcccggtggggcaggctacatgctatgtgtttacactggtagttggacagaatacaaaa

SEQ ID NO: 169215 - DNA, 75 bp, Artificial Sequence
  Synthetic
actccacgcgtagaaccaagagaagtacgggcaatacgaccaccctgtcgcttgaaagcgaatctgtacgaaatg

SEQ ID NO: 169216 - DNA, 75 bp, Artificial Sequence
  Synthetic
atcaaataacagtcttcttttaattaacgtaaccgtaaattacaccaacacttaccgtactttgacatcgttaaa

SEQ ID NO: 169217 - DNA, 75 bp, Artificial Sequence
  Synthetic
ttttgttcttaataacactttgtgccatgtgttacttgatttgccatgaagccatttagataacacatgatcagg

SEQ ID NO: 169218 - DNA, 75 bp, Artificial Sequence
  Synthetic
gccatttagataacacatgatcaggagacaaacacacaggtttacctttaggaggcaataaaaaatgttgcggct

SEQ ID NO: 169219 - DNA, 75 bp, Artificial Sequence
  Synthetic
attatatccaatccaaaaaaagccacctattggatagcttagaccattactaccacaagggcaacgtaactccac

SEQ ID NO: 169220 - DNA, 75 bp, Artificial Sequence
  Synthetic
gcgcactgccggtgcgtgccgtcccgcggtgtttttggtttcgcggaccggcgccggggacggggtgttgcgggc

SEQ ID NO: 169221 - DNA, 75 bp, Artificial Sequence
  Synthetic
gggttccgatgtcggtgctggcggctgcggtgggatgacgggctggtgggactcctccgacggcggggggacgga

SEQ ID NO: 169222 - DNA, 75 bp, Artificial Sequence
  Synthetic
tccaaaatcctttggggtcgctggttggaaaagtctctgacacgatccaggcaccccgtacccagtccgactgat

SEQ ID NO: 169223 - DNA, 75 bp, Artificial Sequence
  Synthetic
acggggacgatggtggggacggcgtgttgcggggccggggacggtggtggggacggggacggaggtagcgtcggg

SEQ ID NO: 169224 - DNA, 75 bp, Artificial Sequence
  Synthetic
agtagacggcggtgtcctcgcgtacatagcaaaaaacatagccctcgtccgagatgaggcacacagcggtcttct

SEQ ID NO: 169225 - DNA, 75 bp, Artificial Sequence
  Synthetic
tatatactcgacatgactcgcagaatcacgtacttgttctccatgtcctgcataggaatcacaagtataatatcc

SEQ ID NO: 169226 - DNA, 75 bp, Artificial Sequence
  Synthetic
cactaacccgcatactgcaaagtccacctacgacgctgaaagtttttccaggacagaacaggatagtcagccatc

SEQ ID NO: 169227 - DNA, 75 bp, Artificial Sequence
  Synthetic
cgggtcagcgtggccgacaatctgggcttcgagcccagcgtggtcgcgccgcagcacgtcgagtatctcaaattc

SEQ ID NO: 169228 - DNA, 75 bp, Artificial Sequence
  Synthetic
ataaattttgaatccatgtcaaggaacgcgtgttttgtatttattgggaatattggcggggataaaccggtttcg

SEQ ID NO: 169229 - DNA, 75 bp, Artificial Sequence
  Synthetic
attgctgtgctagtctcatataattaacgttatataaacgataatgaaacatgaaaacaccgtgggggggggggg

SEQ ID NO: 169230 - DNA, 75 bp, Artificial Sequence
  Synthetic
gtccatgcaccgagggcagaactggtgctatcatgacaccgacgacgacgaccgcggaactcacgacggagtttg

SEQ ID NO: 169231 - DNA, 75 bp, Artificial Sequence
  Synthetic
gaacttggttaggtaccttctgaggcggaaagaaccagctgtggaatgtgtgtcagttagggtgtggaaagtccc

SEQ ID NO: 169232 - DNA, 75 bp, Artificial Sequence
  Synthetic
cggaaagaaccagctgtggaatgtgtgtcagttagggtgtggaaagtccccaggctccccagcaggcagaagtat

SEQ ID NO: 169233 - DNA, 75 bp, Artificial Sequence
  Synthetic
cagttccgcccattctccgccccatggctgactaattttttttatttatgcagaggccgaggccgcctcggcctc

SEQ ID NO: 169234 - DNA, 75 bp, Artificial Sequence
  Synthetic
ggctgactaattttttttatttatgcagaggccgaggccgcctcggcctctgagctattccagaagtagtgagga

SEQ ID NO: 169235 - DNA, 75 bp, Artificial Sequence
  Synthetic
ctgaccgtacaccaaaatttgcctgcattaccggtcgatgcaacgagtgatgaggttcgcaagaacctgatggac

SEQ ID NO: 169236 - DNA, 75 bp, Artificial Sequence
  Synthetic
cattaccggtcgatgcaacgagtgatgaggttcgcaagaacctgatggacatgttcagggatcgccaggcgtttt

SEQ ID NO: 169237 - DNA, 75 bp, Artificial Sequence
  Synthetic
ttaataaagaatagcggcggttttgatagggcgaccgctgaggcgagccgcgtgtgcgtgtggtgtctgctcccc

SEQ ID NO: 169238 - DNA, 75 bp, Artificial Sequence
  Synthetic
atagggcgaccgctgaggcgagccgcgtgtgcgtgtggtgtctgctccccggccccagcgtaaccccctgtcccc

SEQ ID NO: 169239 - DNA, 75 bp, Artificial Sequence
  Synthetic
ggtttcccgcagaacctgaagatgttcgcgattatcttctatatcttcaggcgcgcggtctggcagtaaaaacta

SEQ ID NO: 169240 - DNA, 75 bp, Artificial Sequence
  Synthetic
tcgcgattatcttctatatcttcaggcgcgcggtctggcagtaaaaactatccagcaacatttgggccagctaaa

SEQ ID NO: 169241 - DNA, 75 bp, Artificial Sequence
  Synthetic
ccgcagcaccccggccgtgccggcgcttagcatgcccgaaaacccccgtccccggcgcgaaagctgcgtacaaag

SEQ ID NO: 169242 - DNA, 75 bp, Artificial Sequence
  Synthetic
cttagcatgcccgaaaacccccgtccccggcgcgaaagctgcgtacaaagcggcgcacagacacccgcagaaaga

SEQ ID NO: 169243 - DNA, 75 bp, Artificial Sequence
  Synthetic
aaaagaaaacgttgatgccggtgaacgtgcaaaacaggctctagcgttcgaacgcactgatttcgaccaggttcg

SEQ ID NO: 169244 - DNA, 75 bp, Artificial Sequence
  Synthetic
cgtgcaaaacaggctctagcgttcgaacgcactgatttcgaccaggttcgttcactcatggaaaatagcgatcgc

SEQ ID NO: 169245 - DNA, 75 bp, Artificial Sequence
  Synthetic
acgccgcgccgcgctgatggcccgcaaacctccctcagcccggtcccgcgaacaaatgccgtgggacgacacgca

SEQ ID NO: 169246 - DNA, 75 bp, Artificial Sequence
  Synthetic
atcagggttaaagatgtaagtatcaaggttacaagacaggtttaaggagaccaatagaaactgggcttgtcgaga

SEQ ID NO: 169247 - DNA, 75 bp, Artificial Sequence
  Synthetic
aggttacaagacaggtttaaggagaccaatagaaactgggcttgtcgagacagagaagactcttgcgtttctgat

SEQ ID NO: 169248 - DNA, 75 bp, Artificial Sequence
  Synthetic
ttaatccatattggcagaacgaaaacgctggttagcaccgcaggtgtagagaaggcacttagcctgggggtaact

SEQ ID NO: 169249 - DNA, 75 bp, Artificial Sequence
  Synthetic
tgtgtcagggtgtgccgggtgtgtcgcgggcgtgtgtcgggtgtgtcgggggtgtgttggcggcgtgtgtcgggc

SEQ ID NO: 169250 - DNA, 75 bp, Artificial Sequence
  Synthetic
cgctggttagcaccgcaggtgtagagaaggcacttagcctgggggtaactaaactggtcgagcgatggatttccg

SEQ ID NO: 169251 - DNA, 75 bp, Artificial Sequence
  Synthetic
gtgtgttttattgacgaagatgccgatgtgtgactaaaaacgtcccagccctagagcgatgtgtttcaataaaaa

SEQ ID NO: 169252 - DNA, 75 bp, Artificial Sequence
  Synthetic
ccaccagccagctatcaactcgcgccctggaagggatttttgaagcaactcatcgattgatttacggcgctaagg

SEQ ID NO: 169253 - DNA, 75 bp, Artificial Sequence
  Synthetic
cctggaagggatttttgaagcaactcatcgattgatttacggcgctaaggatgactctggtcagagatacctggc

SEQ ID NO: 169254 - DNA, 75 bp, Artificial Sequence
  Synthetic
ctcttttccgcgtcgtttccgcgtcgctggcccctgggaggcgttcttcgtgtgtccccagggacccgcgctgcc

SEQ ID NO: 169255 - DNA, 75 bp, Artificial Sequence
  Synthetic
gcaagctggtggctggaccaatgtaaatattgtcatgaactatatccgtaacctggatagtgaaacaggggcaat

SEQ ID NO: 169256 - DNA, 75 bp, Artificial Sequence
  Synthetic
aacatgaagactaacgtttccggacatgcaacacataaaattaagtaacatatctaccatgaagtacagcaaata

SEQ ID NO: 169257 - DNA, 75 bp, Artificial Sequence
  Synthetic
aatattgtcatgaactatatccgtaacctggatagtgaaacaggggcaatggtgcgcctgctggaagatggcgat

SEQ ID NO: 169258 - DNA, 75 bp, Artificial Sequence
  Synthetic
gagtgtacgaccctgtagtgcccatgggtaacgttgcgtcggaagaagtgaatgcggcattggtgtacgcgtggg

SEQ ID NO: 169259 - DNA, 75 bp, Artificial Sequence
  Synthetic
ccgccgtcccaaccgcaccgcagcacactcttaccaccgtcaccgtcctccacagcacacgcgactccaagactc

SEQ ID NO: 169260 - DNA, 75 bp, Artificial Sequence
  Synthetic
acggaaaatatgtagtgctgtctgtaagcactaatattcagtcgccagccgtcattgtcactgtaaagctgagcg

SEQ ID NO: 169261 - DNA, 75 bp, Artificial Sequence
  Synthetic
aagcactaatattcagtcgccagccgtcattgtcactgtaaagctgagcgatagaatgcctgatattgactcaat

SEQ ID NO: 169262 - DNA, 75 bp, Artificial Sequence
  Synthetic
gcgcggttttgctaaagtgatgtctgagtttggcgaactcttgggtaaggttggaattgtcgaggctgggtgtgg

SEQ ID NO: 169263 - DNA, 75 bp, Artificial Sequence
  Synthetic
ctgctggtgctagtagggacttttgtgctgctggtcacattcgtagcgtcgctgaggtctatctgaaacagcaac

SEQ ID NO: 169264 - DNA, 75 bp, Artificial Sequence
  Synthetic
tgctgctggtcacattcgtagcgtcgctgaggtctatctgaaacagcaacccgaacgcgaccagggccaggaatg

SEQ ID NO: 169265 - DNA, 75 bp, Artificial Sequence
  Synthetic
gagtttggcgaactcttgggtaaggttggaattgtcgaggctgggtgtggcggaccgctatcaggacatagcgtt

SEQ ID NO: 169266 - DNA, 75 bp, Artificial Sequence
  Synthetic
gcggggacggggactcaccctcgcctatttaacctccacccacttcaacacacacatgccgcacaatcatgccag

SEQ ID NO: 169267 - DNA, 75 bp, Artificial Sequence
  Synthetic
tcccgattcgcagcgcatcgccttctatcgccttcttgacgagttcttctgaggggatcggcaataaaaagacag

SEQ ID NO: 169268 - DNA, 75 bp, Artificial Sequence
  Synthetic
tatcgccttcttgacgagttcttctgaggggatcggcaataaaaagacagaataaaacgcacgggtgttgggtcg

SEQ ID NO: 169269 - DNA, 75 bp, Artificial Sequence
  Synthetic
ggttcctctccttcttcttcttgtgtgtcgatgggagcgacgtcaacagcggggactagtacgagtactgcgggg

SEQ ID NO: 169270 - DNA, 75 bp, Artificial Sequence
  Synthetic
ccggcacggcctgggtaaccaggtattttgtccacataaccgtgcgcaaaatgttgtggataagcaggacacagc

SEQ ID NO: 169271 - DNA, 75 bp, Artificial Sequence
  Synthetic
gcacaccgaggttactccgttctacaggttacgacgacatgtcaatacttgcccttgacaggcattgatggaatc

SEQ ID NO: 169272 - DNA, 75 bp, Artificial Sequence
  Synthetic
ataatcagaccgacgatacgagtgggaccgtggtcccagactaataatcagaccgacgatacgagtgggaccgtg

SEQ ID NO: 169273 - DNA, 75 bp, Artificial Sequence
  Synthetic
gttccagactaataatcagaccgacgatacgagtgggaccgtggtcccagtctgattatcagaccgacgatacga

SEQ ID NO: 169274 - DNA, 75 bp, Artificial Sequence
  Synthetic
aaagacagataaacgtagactaaaacgtggtcgcatcagggtgctggcttttcaagttccttaagaatggcctca

SEQ ID NO: 169275 - DNA, 75 bp, Artificial Sequence
  Synthetic
cgtggtcgcatcagggtgctggcttttcaagttccttaagaatggcctcaattttctctatacactcagttggaa

SEQ ID NO: 169276 - DNA, 75 bp, Artificial Sequence
  Synthetic
ccccgtacagctcgcaacagcggatcagccagcggtagctcagaaacatgcgcaccagtttgaaggtgtcgtgcc

SEQ ID NO: 169277 - DNA, 75 bp, Artificial Sequence
  Synthetic
tgttcctgctccgtgtgtcggccgctcaaacgtcgggccggcgtggtggtgaccaccgtgcgacgcagcttctcg

SEQ ID NO: 169278 - DNA, 75 bp, Artificial Sequence
  Synthetic
ttggcttaagcaattcagttccgactggcagggtattgagcagaatttggttgttacaacgacagcgccgatcgt

SEQ ID NO: 169279 - DNA, 75 bp, Artificial Sequence
  Synthetic
gtgagcttaaactagttcttgatgcagatgacgttttaagcacagaagttaaaagagtgataacttcttcagctt

SEQ ID NO: 169280 - DNA, 75 bp, Artificial Sequence
  Synthetic
agatgacgttttaagcacagaagttaaaagagtgataacttcttcagcttcaaatatcaccccagcttttttctg

SEQ ID NO: 169281 - DNA, 75 bp, Artificial Sequence
  Synthetic
ccgataaaagttttatgcgtctatttgtaacaacacaacgtatcgttagtgtcatctttaaaacgatacaatgta

SEQ ID NO: 169282 - DNA, 75 bp, Artificial Sequence
  Synthetic
tgtaacaacacaacgtatcgttagtgtcatctttaaaacgatacaatgtattatattataaatttatatgacatt

SEQ ID NO: 169283 - DNA, 75 bp, Artificial Sequence
  Synthetic
ccgggcagatagttcaccggggtgagaaaaaagagcaacaactgatttaggcaatttggcggtgttgatacagcg

SEQ ID NO: 169284 - DNA, 75 bp, Artificial Sequence
  Synthetic
gaaaaaagagcaacaactgatttaggcaatttggcggtgttgatacagcgggtaataatcttacgtgaaatattt

SEQ ID NO: 169285 - DNA, 75 bp, Artificial Sequence
  Synthetic
tgcgaaatttatagattcaccaagtataattggttaacttggtggagtaaacgattttgatactaccttggtatt

SEQ ID NO: 169286 - DNA, 75 bp, Artificial Sequence
  Synthetic
ataattggttaacttggtggagtaaacgattttgatactaccttggtattttgtgggcccttaaattctatttga

SEQ ID NO: 169287 - DNA, 75 bp, Artificial Sequence
  Synthetic
taagcacttgttgggcgataatcgttacccaatctggataatgcagccatctgctcatcatccagctcgccaacc

SEQ ID NO: 169288 - DNA, 75 bp, Artificial Sequence
  Synthetic
tacccaatctggataatgcagccatctgctcatcatccagctcgccaaccagaacacgataatcactttcggtaa

SEQ ID NO: 169289 - DNA, 75 bp, Artificial Sequence
  Synthetic
gttggctgttcacctaatttcatcaaaacgtctcctcttggacaatgtggacctgggggtcgatgtcctagccaa

SEQ ID NO: 169290 - DNA, 75 bp, Artificial Sequence
  Synthetic
ttgcggcgtgctgtgtccggcgctttgtgcgcactgccgttgcgtggcgtcccgcggtgttttttttcgcggacc

SEQ ID NO: 169291 - DNA, 75 bp, Artificial Sequence
  Synthetic
tctgttgaccagtcagtagaaaagaagggatgagatcatccagtgcgtcctcagtaagcagctcctggtcacgtt

SEQ ID NO: 169292 - DNA, 75 bp, Artificial Sequence
  Synthetic
agggatgagatcatccagtgcgtcctcagtaagcagctcctggtcacgttcattacctgaccatacccgagaggt

SEQ ID NO: 169293 - DNA, 75 bp, Artificial Sequence
  Synthetic
caaatcgatgataccccacgcacgtacaacgtccgttaccttcactgcctaaaccggcgttacatgtatgtgcaa

SEQ ID NO: 169294 - DNA, 75 bp, Artificial Sequence
  Synthetic
attaccgcgagccattactcctacgcgcgcaattaacgaatccaccatcggggcagctggtgtcgataacgaagt

SEQ ID NO: 169295 - DNA, 75 bp, Artificial Sequence
  Synthetic
cgcgcaattaacgaatccaccatcggggcagctggtgtcgataacgaagtatcttcaaccggttgagtattgagc

SEQ ID NO: 169296 - DNA, 75 bp, Artificial Sequence
  Synthetic
cattgcagacaggttcccaaatagaaagagcatttctccaggcaccagttgaagagcgttgatcaatggcctgtt

SEQ ID NO: 169297 - DNA, 75 bp, Artificial Sequence
  Synthetic
aagagcatttctccaggcaccagttgaagagcgttgatcaatggcctgttcaaaaacagttctcatccggatctg

SEQ ID NO: 169298 - DNA, 75 bp, Artificial Sequence
  Synthetic
cgcgccccccgcccctcggtcgcggccgcggagccggagggccttcgggggttggttcctctcgttcttcttctt

SEQ ID NO: 169299 - DNA, 75 bp, Artificial Sequence
  Synthetic
ccgcgacagcggggaatactgttgctgatggtgggacgaagcagcagggcggaacggtttatgataaaaagtcac

SEQ ID NO: 169300 - DNA, 75 bp, Artificial Sequence
  Synthetic
ctccatccacggggactgagagccattactattgctgtatttggtaagcaaaatacgtacatcaggctcgaaccc

SEQ ID NO: 169301 - DNA, 75 bp, Artificial Sequence
  Synthetic
ttactattgctgtatttggtaagcaaaatacgtacatcaggctcgaaccctttaagatcaacgttcttgagcaga

SEQ ID NO: 169302 - DNA, 75 bp, Artificial Sequence
  Synthetic
tcagcagcacatacgacattaatcgtgccgatacccaggttaggcgcgctgtcaataactatgacatcatagtca

SEQ ID NO: 169303 - DNA, 75 bp, Artificial Sequence
  Synthetic
tgccgatacccaggttaggcgcgctgtcaataactatgacatcatagtcatgagcaacagtttcaatggccagtc

SEQ ID NO: 169304 - DNA, 75 bp, Artificial Sequence
  Synthetic
tacaattatagtattttgtatgttgcataaagttacatgcaacagtactgctaacagtactgcatccattacgct

SEQ ID NO: 169305 - DNA, 75 bp, Artificial Sequence
  Synthetic
gagccagacaggaaggaataatgtcaagccccggccagcaagtgggctttattgcataagtgacatcgtcctttt

SEQ ID NO: 169306 - DNA, 75 bp, Artificial Sequence
  Synthetic
aagccccggccagcaagtgggctttattgcataagtgacatcgtccttttccccaagatagaaaggcaggagagt

SEQ ID NO: 169307 - DNA, 75 bp, Artificial Sequence
  Synthetic
cacgagcaaaacacgtagccccttcagagccagatcctgagcaagatgaacagaaactgaggttttgtaaacgcc

SEQ ID NO: 169308 - DNA, 75 bp, Artificial Sequence
  Synthetic
agagccagatcctgagcaagatgaacagaaactgaggttttgtaaacgccacctttatgggcagcaaccccgatc

SEQ ID NO: 169309 - DNA, 75 bp, Artificial Sequence
  Synthetic
gtataaccaacacgttgctcaacccgtcctcgaatttccatatccgggtgcggtagtcgccctgctttctcggca

SEQ ID NO: 169310 - DNA, 75 bp, Artificial Sequence
  Synthetic
gtcctcgaatttccatatccgggtgcggtagtcgccctgctttctcggcatctctgatagcctgagaagaaaccc

SEQ ID NO: 169311 - DNA, 75 bp, Artificial Sequence
  Synthetic
gtgcaatggcgatagccttcgtcatttcatgaccagcgtttatgcactggttaagtgtttccatgagtttcattc

SEQ ID NO: 169312 - DNA, 75 bp, Artificial Sequence
  Synthetic
gtcccgaggggacggcggcgcgactccctggggacgcgaagatcggacgcggaaaagaggaagtccccggggacg

SEQ ID NO: 169313 - DNA, 75 bp, Artificial Sequence
  Synthetic
ttcatgaccagcgtttatgcactggttaagtgtttccatgagtttcattctgaacatcctttaatcattgctttg

SEQ ID NO: 169314 - DNA, 75 bp, Artificial Sequence
  Synthetic
gtttaaaataagagcaacactacaaaaggagataagaagagcacatacctcagtcacttattatcactagcgctc

SEQ ID NO: 169315 - DNA, 75 bp, Artificial Sequence
  Synthetic
aaggagataagaagagcacatacctcagtcacttattatcactagcgctcgccgcagccgtgtaaccgagcatag

SEQ ID NO: 169316 - DNA, 75 bp, Artificial Sequence
  Synthetic
tttgaaataccgctatcaacgtctcgtcgccaccgtgtagctagttagccagctgtgtatagtttgttgtgtttt

SEQ ID NO: 169317 - DNA, 75 bp, Artificial Sequence
  Synthetic
caccgtgggaaaaactccaggtagaggtacacacgcggatagccaattcagagtaataaactgtgataatcaacc

SEQ ID NO: 169318 - DNA, 75 bp, Artificial Sequence
  Synthetic
ggtacacacgcggatagccaattcagagtaataaactgtgataatcaaccctcatcaatgatgacgaactaaccc

SEQ ID NO: 169319 - DNA, 75 bp, Artificial Sequence
  Synthetic
ccgaggggcgggggggtgttttcggcgggggggtgaaatttggagttgcgtgtgtggacggcgaataaaagcgac

SEQ ID NO: 169320 - DNA, 75 bp, Artificial Sequence
  Synthetic
taaaaattacagttcaaaaagtatgagaaaatccatgcaggctgaaggaaacagcaaaactgtgacaaattaccc

SEQ ID NO: 169321 - DNA, 75 bp, Artificial Sequence
  Synthetic
agaaaatccatgcaggctgaaggaaacagcaaaactgtgacaaattaccctcagtaggtcagaacaaatgtgacg

SEQ ID NO: 169322 - DNA, 75 bp, Artificial Sequence
  Synthetic
ggagtcgcgggcgtggacggcgacggcgaataaaagcgacgtgcgcggcgcacgtcgcaaacaagacgcgtgtct

SEQ ID NO: 169323 - DNA, 75 bp, Artificial Sequence
  Synthetic
ctgtaagactcagcgttcaaaggaatattaatgcccattgagcgaaaactaatattgcaatggactggcgattta

SEQ ID NO: 169324 - DNA, 75 bp, Artificial Sequence
  Synthetic
acgatatgagtcgtctggcggcctttctttttctcaatgtatgagaggcgcattggagttctgctgttgatctca

SEQ ID NO: 169325 - DNA, 75 bp, Artificial Sequence
  Synthetic
tctttttctcaatgtatgagaggcgcattggagttctgctgttgatctcattaacacagacctgcaggaagcggc

SEQ ID NO: 169326 - DNA, 75 bp, Artificial Sequence
  Synthetic
cgatgcctgagccatccggcttacgatactgacacagggattcgtataaacgcatggcatacggattggtgattt

SEQ ID NO: 169327 - DNA, 75 bp, Artificial Sequence
  Synthetic
atactgacacagggattcgtataaacgcatggcatacggattggtgatttcttttgtttcactaagccgaaactg

SEQ ID NO: 169328 - DNA, 75 bp, Artificial Sequence
  Synthetic
ccccggggcgcactgcacaatccgcgtcgaggacacacgcagatacggcccgccaacacaccccgacacacccct

SEQ ID NO: 169329 - DNA, 75 bp, Artificial Sequence
  Synthetic
tggactgtgcgcacgtttgataaaccaaggaaaagattcatagcctttttcatcgccggcatcctcttcagggcg

SEQ ID NO: 169330 - DNA, 75 bp, Artificial Sequence
  Synthetic
caaggaaaagattcatagcctttttcatcgccggcatcctcttcagggcgataaaaaaccacttccttccccgcg

SEQ ID NO: 169331 - DNA, 75 bp, Artificial Sequence
  Synthetic
gccggtgcgtgtggctccacagcacttgtcgttccgccagtccggcactggacagggctgagggagtgttgcggg

SEQ ID NO: 169332 - DNA, 75 bp, Artificial Sequence
  Synthetic
acatggatctcgcagataccgtcatgttcctgtagggtgccatcagattttctgatctggtcaacgaacagatac

SEQ ID NO: 169333 - DNA, 75 bp, Artificial Sequence
  Synthetic
gttcctgtagggtgccatcagattttctgatctggtcaacgaacagatacagcatacgtttttgatcccgggaga

SEQ ID NO: 169334 - DNA, 75 bp, Artificial Sequence
  Synthetic
tctactcgcagttcggggacgcaacgcagccagatcacatccccttgcagtattaattaagggccggccgcatca

SEQ ID NO: 169335 - DNA, 75 bp, Artificial Sequence
  Synthetic
ccgctgtttccgccatgacagatccatgtgaagtgtgacaagtttttagattgtcacactaaataaaaaagagtc

SEQ ID NO: 169336 - DNA, 75 bp, Artificial Sequence
  Synthetic
atgtgaagtgtgacaagtttttagattgtcacactaaataaaaaagagtcaataagcagggataactttgtgaaa

SEQ ID NO: 169337 - DNA, 75 bp, Artificial Sequence
  Synthetic
gatttgtcacactgaaagggcaatttgtcacaacaccttctctagaaccagcatggataaaggcctacaaggcgc

SEQ ID NO: 169338 - DNA, 75 bp, Artificial Sequence
  Synthetic
tgtcacaacaccttctctagaaccagcatggataaaggcctacaaggcgctctaaaaaagaagatctaaaaacta

SEQ ID NO: 169339 - DNA, 75 bp, Artificial Sequence
  Synthetic
ccgcggtccatcatgccgccagtaacgttgaagcacaacacgatactgccaccccacatacaatgtggatcatac

SEQ ID NO: 169340 - DNA, 75 bp, Artificial Sequence
  Synthetic
taagcagaatatataagtgctgttccctggtgcttcctcgctcactcgagggcttcgccctgtcgctcgactgcg

SEQ ID NO: 169341 - DNA, 75 bp, Artificial Sequence
  Synthetic
cctggtgcttcctcgctcactcgagggcttcgccctgtcgctcgactgcggcgagcactactggctgtaaaagga

SEQ ID NO: 169342 - DNA, 75 bp, Artificial Sequence
  Synthetic
atcgtcatcttcatcggagtctgtctggtggccctgatgtactttacgcagcggcaggcgcagaccagcggcggc

SEQ ID NO: 169343 - DNA, 75 bp, Artificial Sequence
  Synthetic
caccgcacgaagatttctattgttcctgaaggcatattcaaatcgttttcgttaccgcttgcaggcatcatgaca

SEQ ID NO: 169344 - DNA, 75 bp, Artificial Sequence
  Synthetic
ctgaaggcatattcaaatcgttttcgttaccgcttgcaggcatcatgacagaacactacttcctataaacgctac

SEQ ID NO: 169345 - DNA, 75 bp, Artificial Sequence
  Synthetic
ctgcctgtgtgcgcactaccggtgcgtggcgtcccacgctatttgttcgcggcaccgggctgagggacggctttg

SEQ ID NO: 169346 - DNA, 75 bp, Artificial Sequence
  Synthetic
tggataacagccagcttctctgtttaacagacaaaaacagcatatccactcagttccacatttccatataaaggc

SEQ ID NO: 169347 - DNA, 75 bp, Artificial Sequence
  Synthetic
aacagacaaaaacagcatatccactcagttccacatttccatataaaggccaaggcatttattctcaggataatt

SEQ ID NO: 169348 - DNA, 75 bp, Artificial Sequence
  Synthetic
gatgcagccgctggttctctcggcgaagaaactgtcgtctttgctgacttgcaaatacatcccgccttaagcgat

SEQ ID NO: 169349 - DNA, 75 bp, Artificial Sequence
  Synthetic
aaaccttcgtgtagacttccgttgaactgatggacttatgtcccatcaggctttgcagaactttcagcggtatac

SEQ ID NO: 169350 - DNA, 75 bp, Artificial Sequence
  Synthetic
actgatggacttatgtcccatcaggctttgcagaactttcagcggtataccggcatacagcatgtgcatcgcata

SEQ ID NO: 169351 - DNA, 75 bp, Artificial Sequence
  Synthetic
agtatcgttatgatgcttagaacgtggagattattacagatggtactgcttgccgcgtactgttattatgttttt

SEQ ID NO: 169352 - DNA, 75 bp, Artificial Sequence
  Synthetic
tgccgcgtactgttattatgtttttgcgacttgttcaatcagcacgacgactgctcctgtggaatggaagtctcc

SEQ ID NO: 169353 - DNA, 75 bp, Artificial Sequence
  Synthetic
cccaatccaggtcctgaccgttctgtccgtcacttcccagatccgcgctttctctgtccttcctgtgcgacggtt

SEQ ID NO: 169354 - DNA, 75 bp, Artificial Sequence
  Synthetic
tccgtcacttcccagatccgcgctttctctgtccttcctgtgcgacggttacgccgctccatgagcttatcgcga

SEQ ID NO: 169355 - DNA, 75 bp, Artificial Sequence
  Synthetic
ggccaacttttggcgaaaatgagacgttgatcggcacgtaagaggttccaactttcaccataatgaaataagatc

SEQ ID NO: 169356 - DNA, 75 bp, Artificial Sequence
  Synthetic
gttgatcggcacgtaagaggttccaactttcaccataatgaaataagatcactaccgggcgtattttttgagtta

SEQ ID NO: 169357 - DNA, 75 bp, Artificial Sequence
  Synthetic
tcggtgtatttttgcggggtgcggtgagagtgggcacccggcgtcttctgagtcatgttaaccatctgtgttgtt

SEQ ID NO: 169358 - DNA, 75 bp, Artificial Sequence
  Synthetic
tggcatcgtaaagaacattttgaggcatttcagtcagttgctcaatgtacctataaccagaccgttcagctggat

SEQ ID NO: 169359 - DNA, 75 bp, Artificial Sequence
  Synthetic
catttcagtcagttgctcaatgtacctataaccagaccgttcagctggatattacggcctttttaaagaccgtaa

SEQ ID NO: 169360 - DNA, 75 bp, Artificial Sequence
  Synthetic
gtatggcaatgaaagacggtgagctggtgatatgggatagtgttcacccttgttacaccgttttccatgagcaaa

SEQ ID NO: 169361 - DNA, 75 bp, Artificial Sequence
  Synthetic
ggtgatatgggatagtgttcacccttgttacaccgttttccatgagcaaactgaaacgttttcatcgctctggag

SEQ ID NO: 169362 - DNA, 75 bp, Artificial Sequence
  Synthetic
ctatttccctaaagggtttattgagaatatgtttttcgtctcagccaatccctgggtgagtttcaccagttttga

SEQ ID NO: 169363 - DNA, 75 bp, Artificial Sequence
  Synthetic
aatatgtttttcgtctcagccaatccctgggtgagtttcaccagttttgatttaaacgtggccaatatggacaac

SEQ ID NO: 169364 - DNA, 75 bp, Artificial Sequence
  Synthetic
gttcatcatgccgtttgtgatggcttccatgtcggcagaatgcttaatgaattacaacagtactgcgatgagtgg

SEQ ID NO: 169365 - DNA, 75 bp, Artificial Sequence
  Synthetic
tttgtggtgcacggcgttcaaggaagccttgtgggatgtggccctgctggaagttccgcgttgggcgtggcacgg

SEQ ID NO: 169366 - DNA, 75 bp, Artificial Sequence
  Synthetic
actccttcgtgtccagggagtcgactactgcaacgctgattgattaaaagatggtctccgatgatgatgttgtta

SEQ ID NO: 169367 - DNA, 75 bp, Artificial Sequence
  Synthetic
aataagcggatgaatggcagaaattcgatgataagctgtcaaacatgagaattggtcgacggcccgggcggccgc

SEQ ID NO: 169368 - DNA, 75 bp, Artificial Sequence
  Synthetic
caacgcaattaatgtgagttagctcactcattaggcaccccaggctttacactttatgcttccggctcgtatgtt

SEQ ID NO: 169369 - DNA, 75 bp, Artificial Sequence
  Synthetic
gtgtggaattgtgagcggataacaatttcacacaggaaacagctatgaccatgattacgccaagctatttaggtg

SEQ ID NO: 169370 - DNA, 75 bp, Artificial Sequence
  Synthetic
cgccgtgttgtgagcagacgacgttggatgcgggacgtcggagcacatgggccatgtgtggtggcagatggcggt

SEQ ID NO: 169371 - DNA, 75 bp, Artificial Sequence
  Synthetic
agcagggacgttaactccggcgccgaacgtcaacgtcggttgctcgaacttgtacgcggtggtgacgggcggttt

SEQ ID NO: 169372 - DNA, 75 bp, Artificial Sequence
  Synthetic
gccatgtgtggtggcagatggcggtgggcacttgtgtgtgtcgcgacagtgcgcagacgaagcaacatgtcgctg

SEQ ID NO: 169373 - DNA, 75 bp, Artificial Sequence
  Synthetic
cagatagccagccccgctagcgtatccagcgccatcccgttcgctcccgtcgtcgtctcctgaacaaagcaactc

SEQ ID NO: 169374 - DNA, 75 bp, Artificial Sequence
  Synthetic
ccgcaacaccccccggccccagcgtaacccccgtccccaacgtaatccccgtccccgcaacaccccgggccagcg

SEQ ID NO: 169375 - DNA, 75 bp, Artificial Sequence
  Synthetic
gagcaccatccggggccgtgggccgggcaccgggcgcggcccgctccggacctcggccgggggtccctcccctcc

SEQ ID NO: 169376 - DNA, 75 bp, Artificial Sequence
  Synthetic
aacaccccccgtcccgcagcctggtccccagcgcgcccaaaaagcgccgtagagacacccgtagagacatccctc

SEQ ID NO: 169377 - DNA, 75 bp, Artificial Sequence
  Synthetic
cgccgcagacgccgcgccgcgctggcggcccgcaaacctcccgcagtgcggtcccgcgaacaaatagcgtggggc

SEQ ID NO: 169378 - DNA, 75 bp, Artificial Sequence
  Synthetic
ccgaacaacccacccgggtccagacaaccaaccaccaacagaaacatacacacagaccaccaggagttcagttaa

SEQ ID NO: 169379 - DNA, 75 bp, Artificial Sequence
  Synthetic
cgggcgtgtgtcgggcgcgtggcgggtgtgtcgcgggtgtgtcaggggtgtgtcggcggtgtgcgcggcttcggg

SEQ ID NO: 169380 - DNA, 75 bp, Artificial Sequence
  Synthetic
tgcttcccccgcgctccccagggtcgcgcggcgccgcgcgcttcctcttttccgcctgcgcccgtccccggggac

SEQ ID NO: 169381 - DNA, 75 bp, Artificial Sequence
  Synthetic
gggacttcctcttttccgcgtcgtgcttcgtgtgtccccagggacccgcgctgccgtcgttccccggggaatcaa

SEQ ID NO: 169382 - DNA, 75 bp, Artificial Sequence
  Synthetic
ccaacacacggcccggaatggaggtcgggcgtccacctaggcgggtgcgcgctccagggccgccgcgctcttggc

SEQ ID NO: 169383 - DNA, 75 bp, Artificial Sequence
  Synthetic
agtccactgcgtcgtctgctgccggctgctgttccacagacttccagactgcgcggcgccaaggcggcgccagcc

SEQ ID NO: 169384 - DNA, 75 bp, Artificial Sequence
  Synthetic
gagggggggtagtttaatagcggaggcggatacgcggttttcttttaagcgccgctgacttgtttcttctgtttt

SEQ ID NO: 169385 - DNA, 75 bp, Artificial Sequence
  Synthetic
gtcggaggtgtccggcggccatggcccagcgcaacggcatgtcgccgcgccccccgcccctcggtcgcggccgcg

SEQ ID NO: 169386 - DNA, 75 bp, Artificial Sequence
  Synthetic
agtcgtcattctatttttcttcaagattcctcaaagactccgagagaaatgggacaccagaggatacctttacaa

SEQ ID NO: 169387 - DNA, 75 bp, Artificial Sequence
  Synthetic
cccccccccacaatggaatgctgccaaaccggttatttcccgttatagccatggcgttcctaagcaagagctaac

SEQ ID NO: 169388 - DNA, 75 bp, Artificial Sequence
  Synthetic
cggcttccagcttgtctgacttggcgggcgaggccgttggagaattggtgggatcggtcgtcgcgtacgtgatcc

SEQ ID NO: 169389 - DNA, 75 bp, Artificial Sequence
  Synthetic
tgtcctttaaaatagccagcacttcctgacgattgcagctttcgctcgctgcgattggcttaagcaattcagttc

SEQ ID NO: 169390 - DNA, 75 bp, Artificial Sequence
  Synthetic
ggactgatgatctttgttggcgcactggtcatctgctttctgcggtcgcaacgaatcggggaacaggacgttgaa

SEQ ID NO: 169391 - DNA, 75 bp, Artificial Sequence
  Synthetic
catgcagacctacagcaactccctcacgcttgtcatagtcacgtcgctgtttttattcacagctcagggaagttt

SEQ ID NO: 169392 - DNA, 75 bp, Artificial Sequence
  Synthetic
aaaagcgaagcgccgcgcaaaagctgcgtggaaacgccgcaaaaggcccccgtgcccggccccgccgccaacccc

SEQ ID NO: 169393 - DNA, 75 bp, Artificial Sequence
  Synthetic
gggacgtcggagcacatgggccatgtgtggtggcagacggcgttggccattggtgcctgtcgtggcaccgcacag

SEQ ID NO: 169394 - DNA, 75 bp, Artificial Sequence
  Synthetic
caagacgcccgacgccgcgccgacgctcaagctctgggactggacttggccacggtggttatggaggccggcggc

SEQ ID NO: 169395 - DNA, 75 bp, Artificial Sequence
  Synthetic
cgtaaaaacgacgtgtatcaacgacgttggaaaaaaaccgtgttacgctgtggtttggagattgatcgtcccatg

SEQ ID NO: 169396 - DNA, 75 bp, Artificial Sequence
  Synthetic
gttggaaaaaaaccgtgttacgctgtggtttggagattgatcgtcccatgccaacggtccccaagggctgccgcc

SEQ ID NO: 169397 - DNA, 75 bp, Artificial Sequence
  Synthetic
gcaacccccgtctccaacggaatccccgtccccgcaacaccccccgtccctcagcccggtccccagcgcgcccaa

SEQ ID NO: 169398 - DNA, 75 bp, Artificial Sequence
  Synthetic
ccgtccccgcaacaccccccgtccctcagcccggtccccagcgcgcccaaaaagctccggacaaacacccgcaga

SEQ ID NO: 169399 - DNA, 75 bp, Artificial Sequence
  Synthetic
ttctggatactacataaagtcatatgtaacagcaccgctactaatactgcacctattacgacacctaacactgct

SEQ ID NO: 169400 - DNA, 75 bp, Artificial Sequence
  Synthetic
ctccgtctcacgttacttctgcttttgttccatctgtgtacatgcctcccaccgtaccctaccccgaccccgctg

SEQ ID NO: 169401 - DNA, 75 bp, Artificial Sequence
  Synthetic
tgttccatctgtgtacatgcctcccaccgtaccctaccccgaccccgctgccagattgtgtcgcgacatgcgacg

SEQ ID NO: 169402 - DNA, 75 bp, Artificial Sequence
  Synthetic
tccctcagcccgggctcgcgaacaaatgccgagggaggaaacgcaccggcagtgcgaacaaaggcacgcagtggc

SEQ ID NO: 169403 - DNA, 75 bp, Artificial Sequence
  Synthetic
gacaacgctacacacatccgtcatctcacaaacgtcagctaatggcaacatcactaacgttacatcaggcctgag

SEQ ID NO: 169404 - DNA, 75 bp, Artificial Sequence
  Synthetic
atgcttacgagaattctttttcataatactataacaacgccgcgaatgagtaacacacatccgattatagggata

SEQ ID NO: 169405 - DNA, 75 bp, Artificial Sequence
  Synthetic
atactataacaacgccgcgaatgagtaacacacatccgattatagggatacgcgacccgtgtaacaatacacgta

SEQ ID NO: 169406 - DNA, 75 bp, Artificial Sequence
  Synthetic
gaattgattacaacatataccaacacaactatctcatcttttaccaacgtaacgccaaatgctacatcatcttat

SEQ ID NO: 169407 - DNA, 75 bp, Artificial Sequence
  Synthetic
cgcggggaaaccccgtccccagcgccgtgccgctgacaaatgtcgagggaggaaacgcaccggcagtgcgcacaa

SEQ ID NO: 169408 - DNA, 75 bp, Artificial Sequence
  Synthetic
cgtcaaatgaaactttacacaacgtatctgccaatacctcatttatgagcacgccatggcctacaaattgcaacg

SEQ ID NO: 169409 - DNA, 75 bp, Artificial Sequence
  Synthetic
tttcgcatcctttttctggttgcatggattgtacaagtgccgttgggctagcacagaaacaaacctgtgtctagc

SEQ ID NO: 169410 - DNA, 75 bp, Artificial Sequence
  Synthetic
cacgccgcgccgcgctgacggcccgcaaacctcccgcagtccggtcccgcaaacaaatagcgtgggacgccacgc

SEQ ID NO: 169411 - DNA, 75 bp, Artificial Sequence
  Synthetic
gcacagaaacaaacctgtgtctagcaacccttgtatgtatacttctggcttttatatgttatttattggcattca

SEQ ID NO: 169412 - DNA, 75 bp, Artificial Sequence
  Synthetic
aagaaaccaacacaacgggaatagaagggagcaacgttactattaagggtaattctacgtggcactgtcgttcag

SEQ ID NO: 169413 - DNA, 75 bp, Artificial Sequence
  Synthetic
agggagcaacgttactattaagggtaattctacgtggcactgtcgttcagtcacttgggtacgacactacaacag

SEQ ID NO: 169414 - DNA, 75 bp, Artificial Sequence
  Synthetic
cgtcccaccattctttatacctcctacattcacacccctcccaataggaacatcgacacacgactgcacatatta

SEQ ID NO: 169415 - DNA, 75 bp, Artificial Sequence
  Synthetic
acattcacacccctcccaataggaacatcgacacacgactgcacatattatagtcacaaatacaagcatagcgta

SEQ ID NO: 169416 - DNA, 75 bp, Artificial Sequence
  Synthetic
tcattcccatcaccaatatcctacatcatatcatgatttatgccgttcatgcaataatacagagttgcatctata

SEQ ID NO: 169417 - DNA, 75 bp, Artificial Sequence
  Synthetic
tcatatcatgatttatgccgttcatgcaataatacagagttgcatctatacgatctcaacaccacaaactccggt

SEQ ID NO: 169418 - DNA, 75 bp, Artificial Sequence
  Synthetic
ttgcatcacacgagctttgttcggataacaaaactgcgtatctagatatgtttgatccccacatcccaccgtctt

SEQ ID NO: 169419 - DNA, 75 bp, Artificial Sequence
  Synthetic
taacaaaactgcgtatctagatatgtttgatccccacatcccaccgtcttttatgcgacaaatacatcaaaaaat

SEQ ID NO: 169420 - DNA, 75 bp, Artificial Sequence
  Synthetic
aaacctagagctgaatataactataccaaaattactgacaccactccagtctgttacagaacaaacaccaatagc

SEQ ID NO: 169421 - DNA, 75 bp, Artificial Sequence
  Synthetic
ctgttacagaacaaacaccaatagcgaaaacgacctatctaatacatacaaaaacaatacacatcataaacgcaa

SEQ ID NO: 169422 - DNA, 75 bp, Artificial Sequence
  Synthetic
tagtcacacatcggcatcttcgtcaataagacacacgccgccgtgacccataccgcagctcggacccatcgcccc

SEQ ID NO: 169423 - DNA, 75 bp, Artificial Sequence
  Synthetic
cttcataccgccgaaggtgcgcatcacgctcttgtttcacgcgttgcacagcgacggtgaacaaaacgacgtaga

SEQ ID NO: 169424 - DNA, 75 bp, Artificial Sequence
  Synthetic
gcgacggtgaacaaaacgacgtagacgatgaaccgtacgaatcgcggcacaacgactggacgacgtcgtttacga

SEQ ID NO: 169425 - DNA, 75 bp, Artificial Sequence
  Synthetic
aacgactggacgacgtcgtttacgaaattttaagaggaatttcagcataccccgggctctccatcgggagcggta

SEQ ID NO: 169426 - DNA, 75 bp, Artificial Sequence
  Synthetic
ctaatattgcaatggactggcgagttacggttacttggacgatactaatgtcaacgttgtcagaaagctgcaacc

SEQ ID NO: 169427 - DNA, 75 bp, Artificial Sequence
  Synthetic
tcagtcagacaagcgtttttcggcgttgacagtggcccatggcagcggttcaagaggaggaacacctcttcttcg

SEQ ID NO: 169428 - DNA, 75 bp, Artificial Sequence
  Synthetic
aaacctgtccttgtctatgttcctgtaatactaccgccagttattccactaatagcactgagacaaccacttcaa

SEQ ID NO: 169429 - DNA, 75 bp, Artificial Sequence
  Synthetic
gctggctggcgctgggcgcggtgctgccgtcgcggtggctgggctgcgcggcggggccggcgacagggacggcgg

SEQ ID NO: 169430 - DNA, 75 bp, Artificial Sequence
  Synthetic
gacaggtaagatgtagctagtattaaggcctgaacgccgagcgaaggtccctctggctcggtccgcctgctctct

SEQ ID NO: 169431 - DNA, 75 bp, Artificial Sequence
  Synthetic
ccaccaacgtttctacaaagtcgtcggcaataaccacacagatacccacaacgacaaacacgaaagtccagacca

SEQ ID NO: 169432 - DNA, 75 bp, Artificial Sequence
  Synthetic
ctctggctcggtccgcctgctctctccaggtccggactgagcgattccccgccaccactggtcccagaaggtcca

SEQ ID NO: 169433 - DNA, 75 bp, Artificial Sequence
  Synthetic
ccaggtccggactgagcgattccccgccaccactggtcccagaaggtccagctgcagatacccgtagaaatcatg

SEQ ID NO: 169434 - DNA, 75 bp, Artificial Sequence
  Synthetic
ggcaataaccacacagatacccacaacgacaaacacgaaagtccagaccaccccatgtactaacatcaccaggac

SEQ ID NO: 169435 - DNA, 75 bp, Artificial Sequence
  Synthetic
accaaggacgttgatgagttgctctaagttcatcgccgtcgcatcgccccgaggcgctgctctgaagccaagtgc

SEQ ID NO: 169436 - DNA, 75 bp, Artificial Sequence
  Synthetic
acacgttggtggtaacataactctaaaaaaatgcaatcagactgagaaatggcacaatgtagaatggattcatta

SEQ ID NO: 169437 - DNA, 75 bp, Artificial Sequence
  Synthetic
aagttcatcgccgtcgcatcgccccgaggcgctgctctgaagccaagtgccgacggcgctttggctttatgtttc

SEQ ID NO: 169438 - DNA, 75 bp, Artificial Sequence
  Synthetic
ctgcaacgatacctccctgaccatctacaacttaaccacagaaaacgctggaaaatacacaaggcgttgccgtaa

SEQ ID NO: 169439 - DNA, 75 bp, Artificial Sequence
  Synthetic
caattatcagcgtcaccactaacgtgctaggaccgcggtacgtaaaacggaaaagtgaacggcaacaccagcggg

SEQ ID NO: 169440 - DNA, 75 bp, Artificial Sequence
  Synthetic
gctaggaccgcggtacgtaaaacggaaaagtgaacggcaacaccagcgggtacatcatgagttgcctcatgataa

SEQ ID NO: 169441 - DNA, 75 bp, Artificial Sequence
  Synthetic
cgtcatccattcttggcacatgccctatgagatatgaagatgaatctaggaacaccgaaaacaccatcggaagta

SEQ ID NO: 169442 - DNA, 75 bp, Artificial Sequence
  Synthetic
ccctctcggggaacctgaggctcatggtgcttttgcgccagagactcctgtgggaacccgctcaccaccccgttc

SEQ ID NO: 169443 - DNA, 75 bp, Artificial Sequence
  Synthetic
tgggaacccgctcaccaccccgttcttatgcgattctctgactcgcgtaacatcctgcacgtcagtgaccaaccc

SEQ ID NO: 169444 - DNA, 75 bp, Artificial Sequence
  Synthetic
atgtttattgtcacgccgtgttcttacacgtaagtttcccggtgacggcgaggaggtactccccctaactggaac

SEQ ID NO: 169445 - DNA, 75 bp, Artificial Sequence
  Synthetic
aggaggtactccccctaactggaacaccacgcggtccggctcagcccgcgtgcgaagatcgtcctctcgccgttc

SEQ ID NO: 169446 - DNA, 75 bp, Artificial Sequence
  Synthetic
aggggcggggggcgcggcgacatgccgttgcgctgggccatggccgccggacacctccgacgtccactatatagg

SEQ ID NO: 169447 - DNA, 75 bp, Artificial Sequence
  Synthetic
cagaccccggttaatgcggtgatggtaggcccgcgagaaggctcgcacggtcttccaagcggggacctgttgctc

SEQ ID NO: 169448 - DNA, 75 bp, Artificial Sequence
  Synthetic
taggcccgcgagaaggctcgcacggtcttccaagcggggacctgttgctctggcgcttcgcccgaggaagacgcc

SEQ ID NO: 169449 - DNA, 75 bp, Artificial Sequence
  Synthetic
cacagacggtgtaaccgccgcatctgtcgccgccaattggcggccctccgttcggctcgggtcgtgggtcgtcgc

SEQ ID NO: 169450 - DNA, 75 bp, Artificial Sequence
  Synthetic
gtcgccgccaattggcggccctccgttcggctcgggtcgtgggtcgtcgctgaaaatggctgtcgtacacacaat

SEQ ID NO: 169451 - DNA, 75 bp, Artificial Sequence
  Synthetic
cggattcggatgtgtacatagccatggcgacggaagatgataaaaggacggtttgctctaagccggatgacaacg

SEQ ID NO: 169452 - DNA, 75 bp, Artificial Sequence
  Synthetic
ggcgacggaagatgataaaaggacggtttgctctaagccggatgacaacgggtcgtctttttaaatccccgcaga

SEQ ID NO: 169453 - DNA, 75 bp, Artificial Sequence
  Synthetic
ccgtcgacgtggtttttttaacagtgtggttttctttattgactagcggagtacacagtttacgagtagaaaaga

SEQ ID NO: 169454 - DNA, 75 bp, Artificial Sequence
  Synthetic
ggtgcgtagactgcagttactctcgtcaccgctactctggccgctgctagtgctactttccccacagttagacgg

SEQ ID NO: 169455 - DNA, 75 bp, Artificial Sequence
  Synthetic
tcaccgctactctggccgctgctagtgctactttccccacagttagacggagtgtatcgggctcgccggcggcga

SEQ ID NO: 169456 - DNA, 75 bp, Artificial Sequence
  Synthetic
gaggccgaggaacccgaggaatacgccgtaccccaacggccgcgcaaggcgtgatcacgccaggcgttgcagaga

SEQ ID NO: 169457 - DNA, 75 bp, Artificial Sequence
  Synthetic
ccgtaccccaacggccgcgcaaggcgtgatcacgccaggcgttgcagagacaccagcgatcgtgagaatcgcgaa

SEQ ID NO: 169458 - DNA, 75 bp, Artificial Sequence
  Synthetic
gaatttccctcgttacccccgtgtattggcatacagtgcgctgcatgagaacacgcgtgacacatagcgtacccc

SEQ ID NO: 169459 - DNA, 75 bp, Artificial Sequence
  Synthetic
aataccactcgtaacaaggacgtaactctcagtcagggggggtccaccaccgacggagatgaagattactccggg

SEQ ID NO: 169460 - DNA, 75 bp, Artificial Sequence
  Synthetic
cctgaatctcaacgtggctctgccagttaccgcacgtacaccacaggttgtgcgagtagtcgactacgcgacgcc

SEQ ID NO: 169461 - DNA, 75 bp, Artificial Sequence
  Synthetic
gttaccgcacgtacaccacaggttgtgcgagtagtcgactacgcgacgccaactctcttcgcgctccaagagcga

SEQ ID NO: 169462 - DNA, 75 bp, Artificial Sequence
  Synthetic
tgagacgctgaaggccgcgatcagcctcccgtctctttatttttatacaggcggaaacacagacgaatactcggg

SEQ ID NO: 169463 - DNA, 75 bp, Artificial Sequence
  Synthetic
ctcccgtctctttatttttatacaggcggaaacacagacgaatactcggggggctgcgagggaactgcaggagga

SEQ ID NO: 169464 - DNA, 75 bp, Artificial Sequence
  Synthetic
agagcagactgtcgtttcttctcttcctgcagtttgccttcagaaacggcgtgcagccgccgagcccgtcgacgt

SEQ ID NO: 169465 - DNA, 75 bp, Artificial Sequence
  Synthetic
cctgcagtttgccttcagaaacggcgtgcagccgccgagcccgtcgacgttgccgaagtaacatgtcgcgttgac

SEQ ID NO: 169466 - DNA, 75 bp, Artificial Sequence
  Synthetic
cggggccgggcacgggggccttttgcggcggggacggtggtggggacggcgcgttgcggggccggggacggtggt

SEQ ID NO: 169467 - DNA, 75 bp, Artificial Sequence
  Synthetic
ctgccgcccgcgcggacgacgctgaaggatgtttccttgaacttcataacctctgtgttgtgggtccagaaggcg

SEQ ID NO: 169468 - DNA, 75 bp, Artificial Sequence
  Synthetic
gcccgagagcgtccgccgccagaagcacgatgccggtccaccagatgatattgaggccggatccgatccacacca

SEQ ID NO: 169469 - DNA, 75 bp, Artificial Sequence
  Synthetic
cacgatgccggtccaccagatgatattgaggccggatccgatccacaccacaaaggcgctgaggacgccgtatgt

SEQ ID NO: 169470 - DNA, 75 bp, Artificial Sequence
  Synthetic
actgaaatcagaacccaacagctgttgtgtatttttttccccaggatacatcaaccgtatactcaaatgctgatt

SEQ ID NO: 169471 - DNA, 75 bp, Artificial Sequence
  Synthetic
tcaaccgtatactcaaatgctgattacgaataccgtacttggtgtcgccggtttgtatatatagagcccagcgaa

SEQ ID NO: 169472 - DNA, 75 bp, Artificial Sequence
  Synthetic
gacggtgaggtaggaggggaggccgggccgcatagcgcggccgcgccgctgggttcagcggcgtgatccaggtgg

SEQ ID NO: 169473 - DNA, 75 bp, Artificial Sequence
  Synthetic
ggacacccgagtccgctgagatgaaaccgaagtcgctgccgttcgccagtaatatcgacgtcttcgtagtccaac

SEQ ID NO: 169474 - DNA, 75 bp, Artificial Sequence
  Synthetic
aatatcgacgtcttcgtagtccaactccacgacgacgggcccactgaagttaccttcgatgtctcccttggagaa

SEQ ID NO: 169475 - DNA, 75 bp, Artificial Sequence
  Synthetic
cggaggcgtcaacaaccccagtatcagcagcacactgggaaaccacatccaggctatggtgaaccgtatctccat

SEQ ID NO: 169476 - DNA, 75 bp, Artificial Sequence
  Synthetic
gtcgttgttgacgatgccgcaatttggggcggtaagaacggcacattcctgaaccgtagccgtcgatcgagcggg

SEQ ID NO: 169477 - DNA, 75 bp, Artificial Sequence
  Synthetic
atataacagcagcgtgggtaccgtcactagtgacgtggcgtgacgaagctggtacggtggcggcggactgtcagg

SEQ ID NO: 169478 - DNA, 75 bp, Artificial Sequence
  Synthetic
actagtgacgtggcgtgacgaagctggtacggtggcggcggactgtcaggtatccgcgtggacggaaacggcggt

SEQ ID NO: 169479 - DNA, 75 bp, Artificial Sequence
  Synthetic
gacggtggcggcggcagacccagcatgcgccgaagacacagcttgacggcgcgatccaccttggaagtggacggc

SEQ ID NO: 169480 - DNA, 75 bp, Artificial Sequence
  Synthetic
tgcgccgaagacacagcttgacggcgcgatccaccttggaagtggacggcgataacgccacgcgtcgccagaaaa

SEQ ID NO: 169481 - DNA, 75 bp, Artificial Sequence
  Synthetic
gatccacacacagaccatgtagctcgttctccaagtcatgccggtggggccgggacggggtgggacgagagccgg

SEQ ID NO: 169482 - DNA, 75 bp, Artificial Sequence
  Synthetic
agttcccgtaactgttttgtttcttgtcctgtttttcgtaagcttaagacttcttctgatgaatcgcggacacat

SEQ ID NO: 169483 - DNA, 75 bp, Artificial Sequence
  Synthetic
gttctccaagtcatgccggtggggccgggacggggtgggacgagagccggtaggacagcggcgcatacccacgcc

SEQ ID NO: 169484 - DNA, 75 bp, Artificial Sequence
  Synthetic
agggtctgtgcggccatcgtgcagttccaagcgccgagggtaggtgcgtttcggcgccgtgcagttgccgcgccc

SEQ ID NO: 169485 - DNA, 75 bp, Artificial Sequence
  Synthetic
tccaagcgccgagggtaggtgcgtttcggcgccgtgcagttgccgcgcccaaaattcacgcgtaaagcgttgccg

SEQ ID NO: 169486 - DNA, 75 bp, Artificial Sequence
  Synthetic
tagtaggcaacctcgcccataggtctccgaacaggtgtccagcgctgcaccccgttgagtttcacgaaactaggg

SEQ ID NO: 169487 - DNA, 75 bp, Artificial Sequence
  Synthetic
tccgaacaggtgtccagcgctgcaccccgttgagtttcacgaaactagggtagtgctcacactgagagaaaaaaa

SEQ ID NO: 169488 - DNA, 75 bp, Artificial Sequence
  Synthetic
cccaacggtcgtacgtggtccgtcgaaattgacggtccactgaggtggcaggggacacggaagaatggaaagagg

SEQ ID NO: 169489 - DNA, 75 bp, Artificial Sequence
  Synthetic
aaattgacggtccactgaggtggcaggggacacggaagaatggaaagaggtgctgctgaagtaagacgtgtcatt

SEQ ID NO: 169490 - DNA, 75 bp, Artificial Sequence
  Synthetic
gacgaaacccaccgtcacggtccgagcacatccaaacgtgagccaccaccacccactgtagagccaccatcggaa

SEQ ID NO: 169491 - DNA, 75 bp, Artificial Sequence
  Synthetic
gcacatccaaacgtgagccaccaccacccactgtagagccaccatcggaaacaccgcatgtttttctacatgatc

SEQ ID NO: 169492 - DNA, 75 bp, Artificial Sequence
  Synthetic
gtatatcgggcacggggaaaagaggggcggacacggggtttatatgaaaaggccgaggtagcgcttttttattac

SEQ ID NO: 169493 - DNA, 75 bp, Artificial Sequence
  Synthetic
cggtccattatgccgccggtaacgttgaagcacaacacgatactgccaccccacatacaatgtggatcatacccc

SEQ ID NO: 169494 - DNA, 75 bp, Artificial Sequence
  Synthetic
ggtataatttgcgagacgcgacacacctcgtcggacagcgtgtcggaagatgtctctcttcgactcggcgagctc

SEQ ID NO: 169495 - DNA, 75 bp, Artificial Sequence
  Synthetic
accaggatacatcgcgggaaaagagtcgctggcgaaactcggccagcagacagtgcagttcttgccgaaacttgg

SEQ ID NO: 169496 - DNA, 75 bp, Artificial Sequence
  Synthetic
actataagtcacgttagtagtgacgttgagagcggtagacgttgtataggacaaatatggcgtagtagtactctg

SEQ ID NO: 169497 - DNA, 75 bp, Artificial Sequence
  Synthetic
cagtgcagttcttgccgaaacttggtgcccacgaagacgtacagcagcggattgagacaacagtgacaaaaggcg

SEQ ID NO: 169498 - DNA, 75 bp, Artificial Sequence
  Synthetic
tgcccacgaagacgtacagcagcggattgagacaacagtgacaaaaggcgagcgactcggtcaagatgagcgcac

SEQ ID NO: 169499 - DNA, 75 bp, Artificial Sequence
  Synthetic
ggtggtacggcagccaaaagatgataaagacaagcacgaccgctataagtacccgtacaatgcgacctttgtggc

SEQ ID NO: 169500 - DNA, 75 bp, Artificial Sequence
  Synthetic
aaagacaagcacgaccgctataagtacccgtacaatgcgacctttgtggcgcgactgagacaccgcaacgattct

SEQ ID NO: 169501 - DNA, 75 bp, Artificial Sequence
  Synthetic
ccgaattgtgatatttctctgcaggaaatagaacagcctggtacctatgaaacggacaatgcagtactgtagcag

SEQ ID NO: 169502 - DNA, 75 bp, Artificial Sequence
  Synthetic
gatgatcgggtaactgacctctaagtagtcgtagtcggtcatacattgattgtcttttttggttaccaccataaa

SEQ ID NO: 169503 - DNA, 75 bp, Artificial Sequence
  Synthetic
tagtcgtagtcggtcatacattgattgtcttttttggttaccaccataaagtgtggaatggcgatgatcacggca

SEQ ID NO: 169504 - DNA, 75 bp, Artificial Sequence
  Synthetic
cgatcgagtgcaatctccgtgataaaacacaaactggcaaacatagccacgtagaaacaggcagtgagtaacgta

SEQ ID NO: 169505 - DNA, 75 bp, Artificial Sequence
  Synthetic
aacacaaactggcaaacatagccacgtagaaacaggcagtgagtaacgtacacggcacgctggctagggagttgt

SEQ ID NO: 169506 - DNA, 75 bp, Artificial Sequence
  Synthetic
aaacatcgccggagcattgaatccgacgtcgccaggtgatggtgaagatcaccaagaagttgccgatggaaccga

SEQ ID NO: 169507 - DNA, 75 bp, Artificial Sequence
  Synthetic
acgtcgccaggtgatggtgaagatcaccaagaagttgccgatggaaccgaagagaaagacaacgccgtacagaaa

SEQ ID NO: 169508 - DNA, 75 bp, Artificial Sequence
  Synthetic
atggtattaccgtatgtcaattagaaagttgagcggacacggttatcgttcctggcggatataagtatataaacg

SEQ ID NO: 169509 - DNA, 75 bp, Artificial Sequence
  Synthetic
cgtcgtgagttccgcggtcgtcgtcgtcggcgtcatgatagcaccagttctgccctcggtgcatggacgccgtct

SEQ ID NO: 169510 - DNA, 75 bp, Artificial Sequence
  Synthetic
gtcggcgtcatgatagcaccagttctgccctcggtgcatggacgccgtctggtccacgcaccgagagactgaggc

SEQ ID NO: 169511 - DNA, 75 bp, Artificial Sequence
  Synthetic
acgtgaccacgaagaaacgtgcaattagcaaaaatagatgtgcggcggacgcgtgacagaggatcgaattacaac

SEQ ID NO: 169512 - DNA, 75 bp, Artificial Sequence
  Synthetic
tagcaaaaatagatgtgcggcggacgcgtgacagaggatcgaattacaacagaaattcctcctccccggactcca

SEQ ID NO: 169513 - DNA, 75 bp, Artificial Sequence
  Synthetic
tatcaatgtcctggtaaggtatctcctgcttcacgcagcaacaggcgaatacccttagggttgtccacatgtcct

SEQ ID NO: 169514 - DNA, 75 bp, Artificial Sequence
  Synthetic
gtagattccaggattcagacaagcgcgaacgtaggccaaaaactgaccgacgtatagacagaaagtaataacggt

SEQ ID NO: 169515 - DNA, 75 bp, Artificial Sequence
  Synthetic
aaagctggcaaaagatacaaccacaactaaaagaacgtggagcgtctgcatgtgccatttacccacgtagttaat

SEQ ID NO: 169516 - DNA, 75 bp, Artificial Sequence
  Synthetic
ttcttaagatgtttttcatcttcgcacgcgatgtactacatcaaagggtcggctgaccgaccgcattgacgcagt

SEQ ID NO: 169517 - DNA, 75 bp, Artificial Sequence
  Synthetic
ggtgttcaaaaagacggggaaccaacctgaagtctcgttagcaaattcaccaacacactcgttattggtatgact

SEQ ID NO: 169518 - DNA, 75 bp, Artificial Sequence
  Synthetic
gttatttcgaacgcggttcaattctacaccccagacgatgacgcagtagcgatccatcgacaggttgatgagaaa

SEQ ID NO: 169519 - DNA, 75 bp, Artificial Sequence
  Synthetic
acaccccagacgatgacgcagtagcgatccatcgacaggttgatgagaaaacaaacgccggcaaaaagacagatg

SEQ ID NO: 169520 - DNA, 75 bp, Artificial Sequence
  Synthetic
cagggtcgaaatcttaccacagttgatgatagaagacggttttccatcgggtgggaaacatgggatgacggtgga

SEQ ID NO: 169521 - DNA, 75 bp, Artificial Sequence
  Synthetic
ccacacgtcacgacaccgatcgattttctttattcttagtgtgatgataggtaagggcactcgtgaggatgtgca

SEQ ID NO: 169522 - DNA, 75 bp, Artificial Sequence
  Synthetic
aacggcaggccgacaacaatcagcagatcggctacagccaggttgcagatgtaggtatcgctcggagattttttc

SEQ ID NO: 169523 - DNA, 75 bp, Artificial Sequence
  Synthetic
gcccacgatgcacatcaaccatactccgaaccgagtatactcgaacaactgataaatttcagtgctgttcaaggt

SEQ ID NO: 169524 - DNA, 75 bp, Artificial Sequence
  Synthetic
aaaaagcattacacgttagtcgtctaagcacccaggttcctcacatacagtttcaccgccccttggcttacctgg

SEQ ID NO: 169525 - DNA, 75 bp, Artificial Sequence
  Synthetic
aagcacccaggttcctcacatacagtttcaccgccccttggcttacctggtgtaagtgtcaatcacaaaaaccac

SEQ ID NO: 169526 - DNA, 75 bp, Artificial Sequence
  Synthetic
aaattacgtgagtctttgacgtcgatgtcagtcttttcgggtggtttacagaccggagctgccaaccgcagccca

SEQ ID NO: 169527 - DNA, 75 bp, Artificial Sequence
  Synthetic
tgtcagtcttttcgggtggtttacagaccggagctgccaaccgcagcccacgaacgacgtgaacaagccacgtca

SEQ ID NO: 169528 - DNA, 75 bp, Artificial Sequence
  Synthetic
cgtctggggccgttgttcggaggaccctcaagggtttacgaaagctcattctctgccaagacttgcggcaggaca

SEQ ID NO: 169529 - DNA, 75 bp, Artificial Sequence
  Synthetic
cctcaagggtttacgaaagctcattctctgccaagacttgcggcaggacatccgccacttagttcgtagctatgc

SEQ ID NO: 169530 - DNA, 75 bp, Artificial Sequence
  Synthetic
aagaaaaaggcgcccgtcatgaagacgtaggcaggggaattcccatatttttatggcttcttttaaaagtctgtg

SEQ ID NO: 169531 - DNA, 75 bp, Artificial Sequence
  Synthetic
tggcagcgcggctgtcaccgacgggcccgaaacgccctggggtcagctcatctgctgcgaagagtcgctcgagtc

SEQ ID NO: 169532 - DNA, 75 bp, Artificial Sequence
  Synthetic
cccgaaacgccctggggtcagctcatctgctgcgaagagtcgctcgagtctctgggcgtcctgcagttctctacc

SEQ ID NO: 169533 - DNA, 75 bp, Artificial Sequence
  Synthetic
tatgtagaggaaattgagccacctagccaggcccgtctggtgctcctgctaggacgttacgaaaccgtgtggtgt

SEQ ID NO: 169534 - DNA, 75 bp, Artificial Sequence
  Synthetic
gccaggcccgtctggtgctcctgctaggacgttacgaaaccgtgtggtgtctagaccgcgatcgcggggtgcttt

SEQ ID NO: 169535 - DNA, 75 bp, Artificial Sequence
  Synthetic
tgcgcacgccgctgctaaccacgcaaccggatcatattatctgcgaccttcgcctgcacgacaacagcatcagcg

SEQ ID NO: 169536 - DNA, 75 bp, Artificial Sequence
  Synthetic
accggatcatattatctgcgaccttcgcctgcacgacaacagcatcagcgaactgcagcgtgtgacctgtcgtta

SEQ ID NO: 169537 - DNA, 75 bp, Artificial Sequence
  Synthetic
cctcaaaggcgtctggcccttcatctgtatggagacggagcaattcaacgacctgttgacgttctttgtggaccg

SEQ ID NO: 169538 - DNA, 75 bp, Artificial Sequence
  Synthetic
cactattcaacacatgcggtttctctatcttttgtaaccgacactgacagtagcgggtaataaaaacaagaggat

SEQ ID NO: 169539 - DNA, 75 bp, Artificial Sequence
  Synthetic
tgtatggagacggagcaattcaacgacctgttgacgttctttgtggaccgcttatgctgtgaaaccatgataatg

SEQ ID NO: 169540 - DNA, 75 bp, Artificial Sequence
  Synthetic
tttttctattttgacgtgtctcggcgcgagatctggcggttggctgacagcgtggatatgttgttaaccgtgggt

SEQ ID NO: 169541 - DNA, 75 bp, Artificial Sequence
  Synthetic
gcgagatctggcggttggctgacagcgtggatatgttgttaaccgtgggtctgctcaaaatttaccaggccggcc

SEQ ID NO: 169542 - DNA, 75 bp, Artificial Sequence
  Synthetic
tctgggaccgctttgggaccgtggagcgtgtacgggcctctacacgccatcacgaactacgttataaatggttaa

SEQ ID NO: 169543 - DNA, 75 bp, Artificial Sequence
  Synthetic
gcgtgtacgggcctctacacgccatcacgaactacgttataaatggttaatccgcaaggacaggtttatcgtccg

SEQ ID NO: 169544 - DNA, 75 bp, Artificial Sequence
  Synthetic
ccgacccgactatccacaaacctccgatctggagtgtgccaaacaatattggcaagagctcaacgatcatgtacg

SEQ ID NO: 169545 - DNA, 75 bp, Artificial Sequence
  Synthetic
gatctggagtgtgccaaacaatattggcaagagctcaacgatcatgtacgcgaacaaacagcccgctacgggccc

SEQ ID NO: 169546 - DNA, 75 bp, Artificial Sequence
  Synthetic
ccccgtcagaacctgatgaatcccagcctgatgaaccaaggactatgcgtctactactcggacgaagaagaggat

SEQ ID NO: 169547 - DNA, 75 bp, Artificial Sequence
  Synthetic
gcctgatgaaccaaggactatgcgtctactactcggacgaagaagaggatcaagaggaagacgacacgtccgacg

SEQ ID NO: 169548 - DNA, 75 bp, Artificial Sequence
  Synthetic
gatccctggagggcgtcgaggaacgcatgctgaacgtgatgaaagaggccgtcgcggaacaagataggaaaaaga

SEQ ID NO: 169549 - DNA, 75 bp, Artificial Sequence
  Synthetic
catgctgaacgtgatgaaagaggccgtcgcggaacaagataggaaaaagacacagaagaaacacaagatagatac

SEQ ID NO: 169550 - DNA, 75 bp, Artificial Sequence
  Synthetic
catgcctcatcctgtttcttacttgcccttttggatgtaaaaacaacgtcaacagtttacgagtacaaaacagga

SEQ ID NO: 169551 - DNA, 75 bp, Artificial Sequence
  Synthetic
cccttttggatgtaaaaacaacgtcaacagtttacgagtacaaaacaggaaaggaatacaaataaaaaaagacgc

SEQ ID NO: 169552 - DNA, 75 bp, Artificial Sequence
  Synthetic
cagggagccagatggcgacggacgtcgggaccgacggacgcgactcggggtccttcggttagcggtctgttcagg

SEQ ID NO: 169553 - DNA, 75 bp, Artificial Sequence
  Synthetic
cgggaccgacggacgcgactcggggtccttcggttagcggtctgttcaggtggatgagggctcttcacggtcggg

SEQ ID NO: 169554 - DNA, 75 bp, Artificial Sequence
  Synthetic
cgtcggagagtataaactggggcgggcgcggggtggcggagcggggagcgccgatgtacctgcagctcgaacgtc

SEQ ID NO: 169555 - DNA, 75 bp, Artificial Sequence
  Synthetic
gcgcggggtggcggagcggggagcgccgatgtacctgcagctcgaacgtctctccggtaactatcggcggccggg

SEQ ID NO: 169556 - DNA, 75 bp, Artificial Sequence
  Synthetic
cccgcaacaccccgtccccggcgccggtccgcgaaacaaaaaacaccgcgggacggcacgcaccggcagtgcgca

SEQ ID NO: 169557 - DNA, 75 bp, Artificial Sequence
  Synthetic
cgaggcaaatcaacgtcgcgaacgacggtgaaaaatcggaacactttccgcggcgcttgggagcggggtgacggt

SEQ ID NO: 169558 - DNA, 75 bp, Artificial Sequence
  Synthetic
cggtgaaaaatcggaacactttccgcggcgcttgggagcggggtgacggtgtagtgttgctttctctgtatttgg

SEQ ID NO: 169559 - DNA, 75 bp, Artificial Sequence
  Synthetic
ccggcagcgcgcagaaagctacgtggacaaaactcccgcagccctgtccagccctcagtcctattccgcgaatcg

SEQ ID NO: 169560 - DNA, 75 bp, Artificial Sequence
  Synthetic
cctgacggcgctgcagttgtgccgccggagctccccgcgctgcctgtggcggccgaggatcccatggcgttatac

SEQ ID NO: 169561 - DNA, 75 bp, Artificial Sequence
  Synthetic
cggagctccccgcgctgcctgtggcggccgaggatcccatggcgttataccgacaagtgttgcgggattttaagg

SEQ ID NO: 169562 - DNA, 75 bp, Artificial Sequence
  Synthetic
gtccccccaagggctggcatgtgatgttacgtacggaggacgggatcattaccgccgccaaacaggcggcgtcaa

SEQ ID NO: 169563 - DNA, 75 bp, Artificial Sequence
  Synthetic
gttacgtacggaggacgggatcattaccgccgccaaacaggcggcgtcaaagctcatctgttgccgcgagccgct

SEQ ID NO: 169564 - DNA, 75 bp, Artificial Sequence
  Synthetic
tgtggcccggggcccgcgacacccccccctcccttgcgcccgcgagcttctgcgtgtgtctgttctttcctcttt

SEQ ID NO: 169565 - DNA, 75 bp, Artificial Sequence
  Synthetic
gtacgtggtttttatgggtcgcttttctcgcgtctacgcctacgacacccgtgaaaagtacatggtgttggtatc

SEQ ID NO: 169566 - DNA, 75 bp, Artificial Sequence
  Synthetic
tctcgcgtctacgcctacgacacccgtgaaaagtacatggtgttggtatcgcacaacctggacgaactggcacgt

SEQ ID NO: 169567 - DNA, 75 bp, Artificial Sequence
  Synthetic
ccgcgacgataccctaagggcgcgcgtaccatgcatgttttgtttctcaatgacaccacgcctgaggggtcgtac

SEQ ID NO: 169568 - DNA, 75 bp, Artificial Sequence
  Synthetic
gtaccatgcatgttttgtttctcaatgacaccacgcctgaggggtcgtacgccacggccgaacgaatcctgggtt

SEQ ID NO: 169569 - DNA, 75 bp, Artificial Sequence
  Synthetic
gcatttggcccttttgtgcgctcaccgaggtggagagccgtcgttggtggtgggctgtccgtgctaatctggcca

SEQ ID NO: 169570 - DNA, 75 bp, Artificial Sequence
  Synthetic
cgaggtggagagccgtcgttggtggtgggctgtccgtgctaatctggccacgccgtggtatgtgctaggcgtgac

SEQ ID NO: 169571 - DNA, 75 bp, Artificial Sequence
  Synthetic
acaacgcccagtgtcccaacgcgcgacttttggctcggagcagagccgaacggcggtttttccacatgatggata

SEQ ID NO: 169572 - DNA, 75 bp, Artificial Sequence
  Synthetic
catccagatggacgaccccaaccactacgtgcggcgcgttgccaacaccatcacggagtttttccgcatggggtt

SEQ ID NO: 169573 - DNA, 75 bp, Artificial Sequence
  Synthetic
tacgtgcggcgcgttgccaacaccatcacggagtttttccgcatggggttgctgaaaatggtctttcgacaccgg

SEQ ID NO: 169574 - DNA, 75 bp, Artificial Sequence
  Synthetic
gtagaccacaaacgggacattctcttcaacgaagacgccgcgttgcccgatgagcgacgcgagcgcgagcggcgt

SEQ ID NO: 169575 - DNA, 75 bp, Artificial Sequence
  Synthetic
tcaacgaagacgccgcgttgcccgatgagcgacgcgagcgcgagcggcgtattctgcagcagcagtatgactggc

SEQ ID NO: 169576 - DNA, 75 bp, Artificial Sequence
  Synthetic
gctacgacaccaactcgcagagctacgtgttggatcccgacattgtcggtgtggaagcagccgagcgcgaggccg

SEQ ID NO: 169577 - DNA, 75 bp, Artificial Sequence
  Synthetic
cgtgttggatcccgacattgtcggtgtggaagcagccgagcgcgaggccgctggtcatcaggacgatacgggccc

SEQ ID NO: 169578 - DNA, 75 bp, Artificial Sequence
  Synthetic
acgacacgcaccggtagtgcgcacaaaggcagccgcgcttacgggcctcaaagttccctcagccccgtcccgcgc

SEQ ID NO: 169579 - DNA, 75 bp, Artificial Sequence
  Synthetic
tcagtcgcggttagtgacgtactcggacccttttcccttaaagagcctgacgggtgtgcgcgagtacatccagat

SEQ ID NO: 169580 - DNA, 75 bp, Artificial Sequence
  Synthetic
gacccttttcccttaaagagcctgacgggtgtgcgcgagtacatccagatttgagcgtcgagcggaggacgcgga

SEQ ID NO: 169581 - DNA, 75 bp, Artificial Sequence
  Synthetic
cgggtgtgccgcgggtgtgtcggtcgggtgtgtcgcgggcgtgtgtcgggcgcgtggcgggtgtgtcgcgggtgt

SEQ ID NO: 169582 - DNA, 75 bp, Artificial Sequence
  Synthetic
tgtggcgtacacgttgggaagacggagctcccacgtttacgcgaaacgatgaattcctctattgccacacgcgct

SEQ ID NO: 169583 - DNA, 75 bp, Artificial Sequence
  Synthetic
aggcgacatggccctcatgacgctcgacgtgtactgttgccgccagacctccaacaacaccgccgtcgcgttctc

SEQ ID NO: 169584 - DNA, 75 bp, Artificial Sequence
  Synthetic
cgactttcagggcatctttgagtgccagtacagcgccgacgtgcttcgcgactgggtccgtaaccacgtcgacca

SEQ ID NO: 169585 - DNA, 75 bp, Artificial Sequence
  Synthetic
ccaactgctggacgacgtgatttgttgccccgaacgccttatcgtgctaggcaagtgcgtgatcatggtggagga

SEQ ID NO: 169586 - DNA, 75 bp, Artificial Sequence
  Synthetic
tgccccgaacgccttatcgtgctaggcaagtgcgtgatcatggtggaggatcactacgaagagacggagctggtg

SEQ ID NO: 169587 - DNA, 75 bp, Artificial Sequence
  Synthetic
ctggacgagctggcgcgttacggtatgatgtacaccgaagccgtataccgtcagccacagacgccgtttgctacg

SEQ ID NO: 169588 - DNA, 75 bp, Artificial Sequence
  Synthetic
tgatgtacaccgaagccgtataccgtcagccacagacgccgtttgctacgcgggtaccgcacgacgtggtagcga

SEQ ID NO: 169589 - DNA, 75 bp, Artificial Sequence
  Synthetic
ttcacacacctgggcgccatgccaaaacgttgaaactcctgaccagtttcggctgcttgacggactgctggccct

SEQ ID NO: 169590 - DNA, 75 bp, Artificial Sequence
  Synthetic
aacgttgaaactcctgaccagtttcggctgcttgacggactgctggcccttcgaggtagcgccagccgcccgctt

SEQ ID NO: 169591 - DNA, 75 bp, Artificial Sequence
  Synthetic
cgccggtggtttctttgacacgtcctttctcctcatcttcgaccgtttctgtcgtttttacgtggtgattgtcaa

SEQ ID NO: 169592 - DNA, 75 bp, Artificial Sequence
  Synthetic
atcgtctggccgacagcctagaggaactctttcgcgccggcctcatgaaggtgtacgtgcgtcgccgctacgaac

SEQ ID NO: 169593 - DNA, 75 bp, Artificial Sequence
  Synthetic
gtgtacgtgcgtcgccgctacgaacacggtctgcggcgcgcggccaggctggaacgcaacggaggctgcgtacac

SEQ ID NO: 169594 - DNA, 75 bp, Artificial Sequence
  Synthetic
acggtctgcggcgcgcggccaggctggaacgcaacggaggctgcgtacacatgggcgaagcggcgcgtctgcact

SEQ ID NO: 169595 - DNA, 75 bp, Artificial Sequence
  Synthetic
gcgccgaaatgctcaataactgggacggttgggacgcgtttaccatctggcaggcgcgcgtggtccgcggcgact

SEQ ID NO: 169596 - DNA, 75 bp, Artificial Sequence
  Synthetic
tcgcggaacgccgtcgaccgcgttccctgggagacggggaagaggaagacgaaggaaacgacggccgcgccatgc

SEQ ID NO: 169597 - DNA, 75 bp, Artificial Sequence
  Synthetic
catgccacgcgacgacgacgaagataaccacgtcgtacccgacaatcagaacctggaggtaatccacgacgcctt

SEQ ID NO: 169598 - DNA, 75 bp, Artificial Sequence
  Synthetic
ctctcaggacttgcgcgagaagcctgcgaggccctcaaaaaggccctgcggagacaccggttcctgtggcaacgg

SEQ ID NO: 169599 - DNA, 75 bp, Artificial Sequence
  Synthetic
aaccacgtcgtacccgacaatcagaacctggaggtaatccacgacgccttggcggacgatgaggagcagggagag

SEQ ID NO: 169600 - DNA, 75 bp, Artificial Sequence
  Synthetic
ggggaagacgcggttgccgcgcgtatggccgccggccacgagagcgatgacgacgagtgggaagacctgggcttt

SEQ ID NO: 169601 - DNA, 75 bp, Artificial Sequence
  Synthetic
tggccgccggccacgagagcgatgacgacgagtgggaagacctgggctttgaccttgaggaggacactgtctttg

SEQ ID NO: 169602 - DNA, 75 bp, Artificial Sequence
  Synthetic
tcgttaacgcctaccggacggaggccgaggtttcggaagccgaagtggaagcgcgacgcatcaatctgaatacgg

SEQ ID NO: 169603 - DNA, 75 bp, Artificial Sequence
  Synthetic
cgaggtttcggaagccgaagtggaagcgcgacgcatcaatctgaatacggatttgtctccggagtgggtcaagag

SEQ ID NO: 169604 - DNA, 75 bp, Artificial Sequence
  Synthetic
tgctcctatattaagctttcgcgcagcgcgctttatccgactcgctgtcgagacggctccgccggcatgtcccta

SEQ ID NO: 169605 - DNA, 75 bp, Artificial Sequence
  Synthetic
gcgcgctttatccgactcgctgtcgagacggctccgccggcatgtccctactcaccaaagccgccgccgaagcct

SEQ ID NO: 169606 - DNA, 75 bp, Artificial Sequence
  Synthetic
ttcactaccgaaggccaccaggtcatcccgttgtgcaagcttatcgcgataccgtcgacctcgagggggggcccg

SEQ ID NO: 169607 - DNA, 75 bp, Artificial Sequence
  Synthetic
gaaacaccgtctttcaaaagacgttatcgacgctgcaaggcctctatctgcgccagtacgatcctccggcgctaa

SEQ ID NO: 169608 - DNA, 75 bp, Artificial Sequence
  Synthetic
tgacaggtgacattcttctcgtcctgtatatcccaggagatcaccgagtccgcacgttcaagaaaagccaccaac

SEQ ID NO: 169609 - DNA, 75 bp, Artificial Sequence
  Synthetic
gccaactggttcctagtgatgcgcgaacaggccgccatcccgcagatttacgcacgttctctggccgccgactat

SEQ ID NO: 169610 - DNA, 75 bp, Artificial Sequence
  Synthetic
cgcacgttctctggccgccgactatctctgctgcgatgacaccctggaagccgtcggtgtactagccgtacgtcc

SEQ ID NO: 169611 - DNA, 75 bp, Artificial Sequence
  Synthetic
gtagttcgggaaaatgaaaaacttgtcggcgttttctccaaagtagctggtattgcgattggttccgttgtagaa

SEQ ID NO: 169612 - DNA, 75 bp, Artificial Sequence
  Synthetic
ctctgctgcgatgacaccctggaagccgtcggtgtactagccgtacgtccgcccgacagcgatctaacgcgaaac

SEQ ID NO: 169613 - DNA, 75 bp, Artificial Sequence
  Synthetic
caccgaggacacccgctgttcctcgtccgcgtcagccggattcataagtttacgaggaaaataacaaagaaatca

SEQ ID NO: 169614 - DNA, 75 bp, Artificial Sequence
  Synthetic
accgacgggctctacgaggtggccagtgatatcaaagccttttccaagaacggcctactctggtgcgaatatgtg

SEQ ID NO: 169615 - DNA, 75 bp, Artificial Sequence
  Synthetic
gtgatatcaaagccttttccaagaacggcctactctggtgcgaatatgtgtatcggcacccacaaacgccgttcg

SEQ ID NO: 169616 - DNA, 75 bp, Artificial Sequence
  Synthetic
cggcccgcgaaatgagcggtcttaacctggtcatccgcacgccgggtcgcaccgaggtggagccgttgctcatgc

SEQ ID NO: 169617 - DNA, 75 bp, Artificial Sequence
  Synthetic
cctggtcatccgcacgccgggtcgcaccgaggtggagccgttgctcatgctgggctccatcgagggcctgcgcgc

SEQ ID NO: 169618 - DNA, 75 bp, Artificial Sequence
  Synthetic
tgagtggtacgtcgtcggcctcgtgggctattatctggcctacgggccttttgtgccaagcggcctggtgctgct

SEQ ID NO: 169619 - DNA, 75 bp, Artificial Sequence
  Synthetic
cacgggctgcgcgggtttcaggtaaaaacaacgtgtgtgataaacgtgggtttttacctacgggaaaggggaggg

SEQ ID NO: 169620 - DNA, 75 bp, Artificial Sequence
  Synthetic
ttgtgccaagcggcctggtgctgctcgacaaatttggcgtggtctacctacacaagatcgaggactcggacctgt

SEQ ID NO: 169621 - DNA, 75 bp, Artificial Sequence
  Synthetic
tgctttggagcacgggaaacggtgtttcggtccgctgtacgtaccacggcacggacattaacatcacttccaaca

SEQ ID NO: 169622 - DNA, 75 bp, Artificial Sequence
  Synthetic
ctgcgaggtctctgccgcttcgaccgcggattgcgcggcgagtgtcggctggaggagctgcccgtctgtcaccac

SEQ ID NO: 169623 - DNA, 75 bp, Artificial Sequence
  Synthetic
gcggattgcgcggcgagtgtcggctggaggagctgcccgtctgtcaccacacgctgaaaagagacgtgctgcgct

SEQ ID NO: 169624 - DNA, 75 bp, Artificial Sequence
  Synthetic
gcactgacaaggtacccaacaacagcagcgcctggggccgcacggacctactgcccacgggcgcgctgcaagaca

SEQ ID NO: 169625 - DNA, 75 bp, Artificial Sequence
  Synthetic
cagcgcctggggccgcacggacctactgcccacgggcgcgctgcaagacaaccagaactgggccttcccctctca

SEQ ID NO: 169626 - DNA, 75 bp, Artificial Sequence
  Synthetic
tgacacaaacataaccgtgggacaattgatgctcaacttcaccggccacagttacgtgttgcgagcggtagcaca

SEQ ID NO: 169627 - DNA, 75 bp, Artificial Sequence
  Synthetic
ttgatgctcaacttcaccggccacagttacgtgttgcgagcggtagcacatacgagtccgttcgaatcacacgta

SEQ ID NO: 169628 - DNA, 75 bp, Artificial Sequence
  Synthetic
acaacgctgctttcgcatgcccaagttctttccgccgcccatgtgccgcgctccgtacaacgaatgcggcgtcga

SEQ ID NO: 169629 - DNA, 75 bp, Artificial Sequence
  Synthetic
ttctttccgccgcccatgtgccgcgctccgtacaacgaatgcggcgtcgaattaccgggcggcgatagcagcgac

SEQ ID NO: 169630 - DNA, 75 bp, Artificial Sequence
  Synthetic
ttaacactggcgaaatacgcggaaagtgattacatctttctacaagacatgtgcccgcggtttcttagaagaacc

SEQ ID NO: 169631 - DNA, 75 bp, Artificial Sequence
  Synthetic
aacgaggacgacacgacggtcgagggaacgagcggtgggcctgaagcgatggactcccagactccctacccatcg

SEQ ID NO: 169632 - DNA, 75 bp, Artificial Sequence
  Synthetic
gaacgagcggtgggcctgaagcgatggactcccagactccctacccatcggaagactcgccgaccacagagaaag

SEQ ID NO: 169633 - DNA, 75 bp, Artificial Sequence
  Synthetic
cttaagcttacaaaaaacaaaacaagaaacgcaacatttacgggaactaatgtgacgtcgcttcccatgtggaca

SEQ ID NO: 169634 - DNA, 75 bp, Artificial Sequence
  Synthetic
ccgaacccgaccagatgggagacgacggaccagacccgggtccataaaagcagattccctttccccgtttttatt

SEQ ID NO: 169635 - DNA, 75 bp, Artificial Sequence
  Synthetic
cggaccagacccgggtccataaaagcagattccctttccccgtttttattcatcataaacttatgattctgcaca

SEQ ID NO: 169636 - DNA, 75 bp, Artificial Sequence
  Synthetic
cttcgtgtatttagacgaatctcggcgataaccgccggcgttgccgccatgtcgctccgcggtcaggtccagata

SEQ ID NO: 169637 - DNA, 75 bp, Artificial Sequence
  Synthetic
cgataaccgccggcgttgccgccatgtcgctccgcggtcaggtccagatagcccggtcggtcttcctgctgcgca

SEQ ID NO: 169638 - DNA, 75 bp, Artificial Sequence
  Synthetic
ggctggagcagctcttttccagcgtgcgtctgacgctgtcttgcttaatgatctccatcgtgtgcctaggtctgt

SEQ ID NO: 169639 - DNA, 75 bp, Artificial Sequence
  Synthetic
caaaaacgtatggatcttactgacgtacacgttgcttaccagcgtggctgtcacggcgtcaggcttccactttag

SEQ ID NO: 169640 - DNA, 75 bp, Artificial Sequence
  Synthetic
tgcccgcgacgtggaattacagcgttccctattgacgggtgcatccacgctgattctcttactgttcgccgtatt

SEQ ID NO: 169641 - DNA, 75 bp, Artificial Sequence
  Synthetic
tgattctcttactgttcgccgtattttctctctttcccgaggcggtaagtgagatcctggtgatgatagccggtt

SEQ ID NO: 169642 - DNA, 75 bp, Artificial Sequence
  Synthetic
gatgaacacaaagaaaatcaagccaaagaaaatgaaaagaagattcagtaacagcagaccccaagggttaacgat

SEQ ID NO: 169643 - DNA, 75 bp, Artificial Sequence
  Synthetic
gacatcgagtatgagagttatatcccaggcgcgctctgcttgtacatggacctcatgtacctctttgtctccgtg

SEQ ID NO: 169644 - DNA, 75 bp, Artificial Sequence
  Synthetic
caggcgcgctctgcttgtacatggacctcatgtacctctttgtctccgtgctctacttcatgccctccgagcccg

SEQ ID NO: 169645 - DNA, 75 bp, Artificial Sequence
  Synthetic
cctaatcgacgtgtccgcggcgtgaccacgtcaccgtgccccactcgctcgcttgtgtataagagaagggtaggt

SEQ ID NO: 169646 - DNA, 75 bp, Artificial Sequence
  Synthetic
ccacgtcaccgtgccccactcgctcgcttgtgtataagagaagggtaggtgcaccgcagcggctttgtgccgaga

SEQ ID NO: 169647 - DNA, 75 bp, Artificial Sequence
  Synthetic
agttcaccgtatggctgcgcgtgtacgccatcttcatctttcagctggctttcagcttcggcttgggaagcgttt

SEQ ID NO: 169648 - DNA, 75 bp, Artificial Sequence
  Synthetic
cgccatcttcatctttcagctggctttcagcttcggcttgggaagcgttttttggttggggttcccacaaaaccg

SEQ ID NO: 169649 - DNA, 75 bp, Artificial Sequence
  Synthetic
gttgggcaacgaacaccctagtaacgccacggtgcttttcatctatctgttggccaacagcctgacggcggccat

SEQ ID NO: 169650 - DNA, 75 bp, Artificial Sequence
  Synthetic
gccacggtgcttttcatctatctgttggccaacagcctgacggcggccatcttccaaatgtgctctgaaagccgc

SEQ ID NO: 169651 - DNA, 75 bp, Artificial Sequence
  Synthetic
gaccgacgtcgttggaaatgcatcagctgcgtctacgtggtgatgctgctttcgttcctcacgctcgctctgcta

SEQ ID NO: 169652 - DNA, 75 bp, Artificial Sequence
  Synthetic
gctgcgtctacgtggtgatgctgctttcgttcctcacgctcgctctgctaagcgacgccgactggctgcagaaga

SEQ ID NO: 169653 - DNA, 75 bp, Artificial Sequence
  Synthetic
ttttctgcccacctaaccagtgcatccgtcatgccgtctgtctctacctggacagcatggccatctttctcacgt

SEQ ID NO: 169654 - DNA, 75 bp, Artificial Sequence
  Synthetic
ccgtcatgccgtctgtctctacctggacagcatggccatctttctcacgttgttgctcatgctctcgggtccccg

SEQ ID NO: 169655 - DNA, 75 bp, Artificial Sequence
  Synthetic
atgcctataaaaccgtgcccgttttcagagcagccgcgcttgtcgccatgcttcatgtcgtcccgctagaatgga

SEQ ID NO: 169656 - DNA, 75 bp, Artificial Sequence
  Synthetic
cagagcagccgcgcttgtcgccatgcttcatgtcgtcccgctagaatggaccgtcgaggaggtagtcccctacct

SEQ ID NO: 169657 - DNA, 75 bp, Artificial Sequence
  Synthetic
gctcagctggtggctcatgccgccaccggtggccgagctatgcgaacggggacgggacgacgacccaccgccgct

SEQ ID NO: 169658 - DNA, 75 bp, Artificial Sequence
  Synthetic
agaaaaccacgtcgacggtatttttattgatatcgacgtctcgtcctgagacagacacgtagaaaaagaggaaaa

SEQ ID NO: 169659 - DNA, 75 bp, Artificial Sequence
  Synthetic
ccggtggccgagctatgcgaacggggacgggacgacgacccaccgccgctttctcatctcagcctcgtcgtgccc

SEQ ID NO: 169660 - DNA, 75 bp, Artificial Sequence
  Synthetic
tactgcctgccgcacgcgctagcctttctgaccttgctgatgtgccagccgtcgccgcaggcctttctcagcgcg

SEQ ID NO: 169661 - DNA, 75 bp, Artificial Sequence
  Synthetic
ttctgaccttgctgatgtgccagccgtcgccgcaggcctttctcagcgcggctcttctcgccctggcggtagatc

SEQ ID NO: 169662 - DNA, 75 bp, Artificial Sequence
  Synthetic
tgtctctgctctgcgctacggcgctgggactttggctgctgcgggccgcggccccgttctttctcggtttacacg

SEQ ID NO: 169663 - DNA, 75 bp, Artificial Sequence
  Synthetic
gggactttggctgctgcgggccgcggccccgttctttctcggtttacacgcgacgacgctgttgacggtgacgct

SEQ ID NO: 169664 - DNA, 75 bp, Artificial Sequence
  Synthetic
ctatgtcgaaaatgtggctttattcatcggcatgtaccatcttctgaggctctggttgtggagcccatgacgacg

SEQ ID NO: 169665 - DNA, 75 bp, Artificial Sequence
  Synthetic
atcggcatgtaccatcttctgaggctctggttgtggagcccatgacgacgggtcggatacagggtgccgccacgg

SEQ ID NO: 169666 - DNA, 75 bp, Artificial Sequence
  Synthetic
accttagaccgacagcggtcgtaagcggcagcatgggcgacaccgcctcggtttccgaacaccatgagtcgccga

SEQ ID NO: 169667 - DNA, 75 bp, Artificial Sequence
  Synthetic
cggcagcatgggcgacaccgcctcggtttccgaacaccatgagtcgccgacggtcaccatcgtgccgctccatcg

SEQ ID NO: 169668 - DNA, 75 bp, Artificial Sequence
  Synthetic
cgggctcgtgtggcagctggcttgtaccctcacggtctgcctgctggcttggctcgccttccccgatgtgcaggg

SEQ ID NO: 169669 - DNA, 75 bp, Artificial Sequence
  Synthetic
accctcacggtctgcctgctggcttggctcgccttccccgatgtgcagggacagtgcgccaacggcatagtgcca

SEQ ID NO: 169670 - DNA, 75 bp, Artificial Sequence
  Synthetic
aattttgctcatctcacggtggcgtgcctgctgatcaacaccggcatcaccgtgtgcacgggcttttgcggagaa

SEQ ID NO: 169671 - DNA, 75 bp, Artificial Sequence
  Synthetic
gcctgctgatcaacaccggcatcaccgtgtgcacgggcttttgcggagaaaggcgcgtcatcggtctgtcgtttg

SEQ ID NO: 169672 - DNA, 75 bp, Artificial Sequence
  Synthetic
tcatcgggattggttacggctggtccgtcatcgtcttttacctattgctttacttttcgcccgtgttgtgggtca

SEQ ID NO: 169673 - DNA, 75 bp, Artificial Sequence
  Synthetic
cgtcatcgtcttttacctattgctttacttttcgcccgtgttgtgggtcagcaagatctacagcggactctacgt

SEQ ID NO: 169674 - DNA, 75 bp, Artificial Sequence
  Synthetic
taaaaacagcgtctgtgtcagcgtcgtgttgtacaccatcgtcatgagtctcctaaacatgagcgtcgccatctt

SEQ ID NO: 169675 - DNA, 75 bp, Artificial Sequence
  Synthetic
tcctaaacatgagcgtcgccatctttagcggccacgtctgggtgcagcagtacgccgagaaacacggcggacgca

SEQ ID NO: 169676 - DNA, 75 bp, Artificial Sequence
  Synthetic
ccaccttccctccagagacagacgatgaacctcccccacccagtagacagacaggacaccgcaactcggtgttgt

SEQ ID NO: 169677 - DNA, 75 bp, Artificial Sequence
  Synthetic
tgaacctcccccacccagtagacagacaggacaccgcaactcggtgttgtacttgtgttttttattcaacaataa

SEQ ID NO: 169678 - DNA, 75 bp, Artificial Sequence
  Synthetic
cactctataaacggtttctcatacgcgccttttgatcgccaccgccgtcatgtctccgaactcagaggccaccgg

SEQ ID NO: 169679 - DNA, 75 bp, Artificial Sequence
  Synthetic
cgccttttgatcgccaccgccgtcatgtctccgaactcagaggccaccgggacggcctgggcgcccccacccccg

SEQ ID NO: 169680 - DNA, 75 bp, Artificial Sequence
  Synthetic
gtgtacagcaccgtggccgtgcagggcacctgcaccttcttgctctgtctgggcctggtgctggcttttccgcat

SEQ ID NO: 169681 - DNA, 75 bp, Artificial Sequence
  Synthetic
gggcctggtgctggcttttccgcatctcaaaagcaccgtctttctctgttgcactggctttatgccgcctttgag

SEQ ID NO: 169682 - DNA, 75 bp, Artificial Sequence
  Synthetic
cccgggcctgctcagcatttacagcgtgctcacgacgctttcggtgatcgtggccagcgcctgctcctcctctac

SEQ ID NO: 169683 - DNA, 75 bp, Artificial Sequence
  Synthetic
gtgctcacgacgctttcggtgatcgtggccagcgcctgctcctcctctacgctggtgaccttctcgggcctcttg

SEQ ID NO: 169684 - DNA, 75 bp, Artificial Sequence
  Synthetic
cacaacgttatccactcttggcacatgccctgtaagatataaagaatctaggaacactgaaaacaccattggaag

SEQ ID NO: 169685 - DNA, 75 bp, Artificial Sequence
  Synthetic
atcacgctgtttgtgatcggcgttatcgcgttcttgatcgcactttacctgcagcccgtaccgttagggcacaaa

SEQ ID NO: 169686 - DNA, 75 bp, Artificial Sequence
  Synthetic
tcgcgttcttgatcgcactttacctgcagcccgtaccgttagggcacaaactttttttgggctattacgccatgg

SEQ ID NO: 169687 - DNA, 75 bp, Artificial Sequence
  Synthetic
tgctcaccttgtgtctctatgagaacctggtgtacctgtacctgctcattcttatcctcttcaccaccgaggact

SEQ ID NO: 169688 - DNA, 75 bp, Artificial Sequence
  Synthetic
cctggtgtacctgtacctgctcattcttatcctcttcaccaccgaggactcattagacaaactcatcgcttggat

SEQ ID NO: 169689 - DNA, 75 bp, Artificial Sequence
  Synthetic
acagagaaacctcacgcgaaccatggcgtaacggaaaaactcgtcgtttcccccacccgccgcgccggccgtctc

SEQ ID NO: 169690 - DNA, 75 bp, Artificial Sequence
  Synthetic
gcgtaacggaaaaactcgtcgtttcccccacccgccgcgccggccgtctccaccaatcaagcctgttagaaccgc

SEQ ID NO: 169691 - DNA, 75 bp, Artificial Sequence
  Synthetic
atgggtctgcgctttcccaccgcgacccagcgacagatcgtgtttcggcggctgttcgacagcggcaacaacgac

SEQ ID NO: 169692 - DNA, 75 bp, Artificial Sequence
  Synthetic
cccagcgacagatcgtgtttcggcggctgttcgacagcggcaacaacgacgactatgatgaagcggccgtggtgg

SEQ ID NO: 169693 - DNA, 75 bp, Artificial Sequence
  Synthetic
cggtggccgtcttgggtagcttctctctggtcttccctacagcgactcttaagtcgcgtccgggctttccttgtc

SEQ ID NO: 169694 - DNA, 75 bp, Artificial Sequence
  Synthetic
tctggtcttccctacagcgactcttaagtcgcgtccgggctttccttgtcacgttgtctgggcgcccgaggtgct

SEQ ID NO: 169695 - DNA, 75 bp, Artificial Sequence
  Synthetic
gcacccgcgctgccgtcgtccgttccgacagctggtgctattactcgccggcctcctggcgcacatcccggcgct

SEQ ID NO: 169696 - DNA, 75 bp, Artificial Sequence
  Synthetic
cgacagctggtgctattactcgccggcctcctggcgcacatcccggcgctaggtgtcacgtgtgcctgccaggag

SEQ ID NO: 169697 - DNA, 75 bp, Artificial Sequence
  Synthetic
cgcgacaactgcaccctgtccgatcaatttaccctcatcaacggcgtctgggtcgtggtctttctggctaacgtt

SEQ ID NO: 169698 - DNA, 75 bp, Artificial Sequence
  Synthetic
aatttaccctcatcaacggcgtctgggtcgtggtctttctggctaacgttctcatcgtcttcacgcggccctgga

SEQ ID NO: 169699 - DNA, 75 bp, Artificial Sequence
  Synthetic
tccttttcgtccgtcacgttcttatgccacgcgatgtggcgcatacgtcgctacagctctttattacgttcattt

SEQ ID NO: 169700 - DNA, 75 bp, Artificial Sequence
  Synthetic
gccacgcgatgtggcgcatacgtcgctacagctctttattacgttcatttcccttttttttctgatcttgcgaat

SEQ ID NO: 169701 - DNA, 75 bp, Artificial Sequence
  Synthetic
gaacgacctgtcccatgcttcgtcgtcgacgccgttgtccaccctctcgccctagattttcgttcggaactggtt

SEQ ID NO: 169702 - DNA, 75 bp, Artificial Sequence
  Synthetic
tcgacgccgttgtccaccctctcgccctagattttcgttcggaactggttttcggacagagcagccgtttccaga

SEQ ID NO: 169703 - DNA, 75 bp, Artificial Sequence
  Synthetic
ggatccaagagacccggctggcgacccgcagtctggcttgggtcgactgttgccgcgtggcgctgcacacctatg

SEQ ID NO: 169704 - DNA, 75 bp, Artificial Sequence
  Synthetic
ccgcagtctggcttgggtcgactgttgccgcgtggcgctgcacacctatggcgccgtgggttggcagctggccgg

SEQ ID NO: 169705 - DNA, 75 bp, Artificial Sequence
  Synthetic
cgccccacctagagggagggggggtagtttaatagcggaggcggatacgcggttttcactctggcaccgctgact

SEQ ID NO: 169706 - DNA, 75 bp, Artificial Sequence
  Synthetic
ggagtcctcgcccagcctcgtctttgtcatacccgtcacgtcggtgatcttcattcactgttacgaaacatcgca

SEQ ID NO: 169707 - DNA, 75 bp, Artificial Sequence
  Synthetic
gtcatacccgtcacgtcggtgatcttcattcactgttacgaaacatcgcatcccagcaatatcggcgttctgctc

SEQ ID NO: 169708 - DNA, 75 bp, Artificial Sequence
  Synthetic
gcacggtggtagtggcgttagtctgagcgggggtcatgacaagtctgaagagatgagagcgcgggtgctcatcag

SEQ ID NO: 169709 - DNA, 75 bp, Artificial Sequence
  Synthetic
gcgttgttcaccttactggcctttctcagctgcaccggcgtagcgttgttggctcccgaacgtaccgtccgccgt

SEQ ID NO: 169710 - DNA, 75 bp, Artificial Sequence
  Synthetic
tcagctgcaccggcgtagcgttgttggctcccgaacgtaccgtccgccgtcagatcgtggtcgtccatgctttga

SEQ ID NO: 169711 - DNA, 75 bp, Artificial Sequence
  Synthetic
tcaccgtcgctgtgcaacgcgtgaaacaagagcgtgatgcgcaccttcggcggtatgaagaacggttacggaaaa

SEQ ID NO: 169712 - DNA, 75 bp, Artificial Sequence
  Synthetic
ccttcagcgtgctcattacctgtctagccgtctcgcatttccacgaagcggccctggctgtacgctacgagacgc

SEQ ID NO: 169713 - DNA, 75 bp, Artificial Sequence
  Synthetic
agccgtctcgcatttccacgaagcggccctggctgtacgctacgagacgccgctggaacgcgcgcttttggcggc

SEQ ID NO: 169714 - DNA, 75 bp, Artificial Sequence
  Synthetic
aacctacttttcctctgacaagctgtagcttcgagaccttgcggatacgccgccgggcgctgcggtcccgacatg

SEQ ID NO: 169715 - DNA, 75 bp, Artificial Sequence
  Synthetic
tagcttcgagaccttgcggatacgccgccgggcgctgcggtcccgacatggagacagtttccacgcagcgggaaa

SEQ ID NO: 169716 - DNA, 75 bp, Artificial Sequence
  Synthetic
aagagggaagcacgatctcctcccggtattcggaaacagcgtccacagcttccgaagatgcggtgtgttggctac

SEQ ID NO: 169717 - DNA, 75 bp, Artificial Sequence
  Synthetic
tccgaagatgcggtgtgttggctacgtcggaccgcgatcgtcatgcgtgtctacggattgctgacgctggaaacc

SEQ ID NO: 169718 - DNA, 75 bp, Artificial Sequence
  Synthetic
cgaccaccgcgtgcgcgtccgcgtttggcacgcacaccgcgttcccgccggcggaggcgccgtacggctgcggag

SEQ ID NO: 169719 - DNA, 75 bp, Artificial Sequence
  Synthetic
gatgttcctattgggaagggtgtgaatgtacgaggtacaaagaatggtgggacgcagagaaacatcgctagatac

SEQ ID NO: 169720 - DNA, 75 bp, Artificial Sequence
  Synthetic
gggctacgagtgcagcgacgatccctcgccgctattgcttagctgcacaccggtgttggttctgggcgcgctgga

SEQ ID NO: 169721 - DNA, 75 bp, Artificial Sequence
  Synthetic
cggtgttggttctgggcgcgctggagctcaccgaccacagacaccccagcaacggcctggtgtttgcgctgtatg

SEQ ID NO: 169722 - DNA, 75 bp, Artificial Sequence
  Synthetic
ggggggggggggcaggaagcttggtggcgatgtccattaaatgcattatgtgcctgtattggtacagttgcaaac

SEQ ID NO: 169723 - DNA, 75 bp, Artificial Sequence
  Synthetic
ggcgatgtccattaaatgcattatgtgcctgtattggtacagttgcaaacgtccgggtgcagtggtataacttgg

SEQ ID NO: 169724 - DNA, 75 bp, Artificial Sequence
  Synthetic
taacgtggacgttgttcgtggcctgcaacggcgtggcttgggaacaccgtctcagctctatgtggcgtgacgcgc

SEQ ID NO: 169725 - DNA, 75 bp, Artificial Sequence
  Synthetic
cttcagctacgggctggactttcggtcgcagttggaaaagatccgcgatctgcggactcgttttgcggaactggc

SEQ ID NO: 169726 - DNA, 75 bp, Artificial Sequence
  Synthetic
aatgctaattaaaaaggtataaaaggtagagacatacatgagttgctagacacagatacatgtgtatgttggcca

SEQ ID NO: 169727 - DNA, 75 bp, Artificial Sequence
  Synthetic
ctcagctctatgtggcgtgacgcgcttttcacctccacacttttgacggtgatggtcagcgtcctggcttctact

SEQ ID NO: 169728 - DNA, 75 bp, Artificial Sequence
  Synthetic
tcgcctcctcggcgcgcagcaacgtctgtcggagcgccggctgaggcagcagcgtcgcgcgcggggtgcccacgc

SEQ ID NO: 169729 - DNA, 75 bp, Artificial Sequence
  Synthetic
ctgcatcctggctgtccttttccaagacgtgcgctacatcgccaccaaaatgcccgtgagccacatcatccgcag

SEQ ID NO: 169730 - DNA, 75 bp, Artificial Sequence
  Synthetic
gggggtagcagcgatgatacgtgttgtaatacaggtgaccgtgtactggtacgcgtgttacgatgtcgagagttt

SEQ ID NO: 169731 - DNA, 75 bp, Artificial Sequence
  Synthetic
tgatgctcacgcccgtggtgtggtcggcacgctgggaccaaatgttcagctacctggccaagctgggcacctatc

SEQ ID NO: 169732 - DNA, 75 bp, Artificial Sequence
  Synthetic
cttgagacccgctggtttataagaagactccaccgagacgctcacccgttcactcgggcgcatcacccgcctcat

SEQ ID NO: 169733 - DNA, 75 bp, Artificial Sequence
  Synthetic
gactccaccgagacgctcacccgttcactcgggcgcatcacccgcctcatggacccgccgctgccgtcgctacat

SEQ ID NO: 169734 - DNA, 75 bp, Artificial Sequence
  Synthetic
gtctacgccctagtggtctttcacatcgccatcagtacggctttctgcggaatgatttggctgggtatccccgat

SEQ ID NO: 169735 - DNA, 75 bp, Artificial Sequence
  Synthetic
tcgccatcagtacggctttctgcggaatgatttggctgggtatccccgattcccacaacatatgtcaacatgaat

SEQ ID NO: 169736 - DNA, 75 bp, Artificial Sequence
  Synthetic
acgacgtggtattgaccatgggctacgtaggcctcctctccgttaccacggttttctacacctggtgctccgacc

SEQ ID NO: 169737 - DNA, 75 bp, Artificial Sequence
  Synthetic
cgtaggcctcctctccgttaccacggttttctacacctggtgctccgacctgcccgccatcctcatcgactacac

SEQ ID NO: 169738 - DNA, 75 bp, Artificial Sequence
  Synthetic
gctcatatgctcacgggtgctcaccagcgtttttttcatcacgctctgggttatcggcgaccagaccgtgttcca

SEQ ID NO: 169739 - DNA, 75 bp, Artificial Sequence
  Synthetic
agcgtttttttcatcacgctctgggttatcggcgaccagaccgtgttccatcatcagcgtattctactctacggc

SEQ ID NO: 169740 - DNA, 75 bp, Artificial Sequence
  Synthetic
gctcagacgttacgcggctcgctgctaatctacgtaggactggtgaccatgtttaaaatcacgctgatcgtgctc

SEQ ID NO: 169741 - DNA, 75 bp, Artificial Sequence
  Synthetic
taatctacgtaggactggtgaccatgtttaaaatcacgctgatcgtgctcagtcccaacctctggcgcctgccct

SEQ ID NO: 169742 - DNA, 75 bp, Artificial Sequence
  Synthetic
acggcgtttccgtgcgcatgcgcagtcggggcgaattttcggttgtcagggcgttgccacgcggattatgggatg

SEQ ID NO: 169743 - DNA, 75 bp, Artificial Sequence
  Synthetic
ccctttctctataaaacttgccgggtacctgaagccccgacgactgttcgtctagcacccgtcatggtacagatc

SEQ ID NO: 169744 - DNA, 75 bp, Artificial Sequence
  Synthetic
tacctgaagccccgacgactgttcgtctagcacccgtcatggtacagatccagtttcaccaaggcgagccactcg

SEQ ID NO: 169745 - DNA, 75 bp, Artificial Sequence
  Synthetic
gcaacgcccgtcgtccccgcacacgcgtgccgcctcacgagcaaaagcccgaagaaaacgaggaggaagaagagg

SEQ ID NO: 169746 - DNA, 75 bp, Artificial Sequence
  Synthetic
aagatgaagacaccctgcggagcgttcaacactttctctggatggtacgtctctacggcaccgtcgtgttccaga

SEQ ID NO: 169747 - DNA, 75 bp, Artificial Sequence
  Synthetic
tcaacactttctctggatggtacgtctctacggcaccgtcgtgttccagaccagcaccaccatagccactaccat

SEQ ID NO: 169748 - DNA, 75 bp, Artificial Sequence
  Synthetic
accctgtgctctgcgttgccacgcgtactggctggaacgtcagcgccgacccgggaccctgatgctggtcatggt

SEQ ID NO: 169749 - DNA, 75 bp, Artificial Sequence
  Synthetic
ggatttttgtggctgcgctcaataagctcgagtaagagagacgctatatttagggcttccctctctttttttttt

SEQ ID NO: 169750 - DNA, 75 bp, Artificial Sequence
  Synthetic
tactggctggaacgtcagcgccgacccgggaccctgatgctggtcatggtatataccaccctcactacgatatcc

SEQ ID NO: 169751 - DNA, 75 bp, Artificial Sequence
  Synthetic
cacccgccacacgcccgcgacacacccggcacacccgccccacgcacgcacccacccagccgcgcccccggcaca

SEQ ID NO: 169752 - DNA, 75 bp, Artificial Sequence
  Synthetic
ctggtgtacgggcctagcctggctcatggcctggaacatgcaacgacggttagccatcctctgtttgctaagctt

SEQ ID NO: 169753 - DNA, 75 bp, Artificial Sequence
  Synthetic
gcccggcgggccgcggggttctatccggtggacgccgtggcccggcgttgccgtccccgcagtactcgtactagt

SEQ ID NO: 169754 - DNA, 75 bp, Artificial Sequence
  Synthetic
aacgacgcggaaaagaggaagtccccagggggacgggcggaaaagaggaatcgcctaggggaccgcgggggcagg

SEQ ID NO: 169755 - DNA, 75 bp, Artificial Sequence
  Synthetic
cgccagcaccagtttcgcctcgccgcctatcacggtgctcacgcagaacgtcctcagtgctctagaaatattgcg

SEQ ID NO: 169756 - DNA, 75 bp, Artificial Sequence
  Synthetic
cttggcgccgcgcagtctaaaaggccgtggaaaaccacccggcagcccagccacccgaaggaacacgcgcgacag

SEQ ID NO: 169757 - DNA, 75 bp, Artificial Sequence
  Synthetic
cgtcgaggacacacgcagaagcggccgcccaggggaggggggggggactcgcgggccccggggcacacttgttgt

SEQ ID NO: 169758 - DNA, 75 bp, Artificial Sequence
  Synthetic
ctttgtacacactaccggtgcgtggcgtcccacgctatttgttcgcgagaccggactaagggaggtttgcggtgc

SEQ ID NO: 169759 - DNA, 75 bp, Artificial Sequence
  Synthetic
tttggcgccgtaagcgctccgccgcttctgcggcgtgttgtccacggcgctttctgcgcgctgccggtgcgtgtg

SEQ ID NO: 169760 - DNA, 75 bp, Artificial Sequence
  Synthetic
cgtcccatctccccaaacttaccaccgccaccactaatagcgtcacccccgcacggtacatagttaccctctcga

SEQ ID NO: 169761 - DNA, 75 bp, Artificial Sequence
  Synthetic
agacgaagcaacatgtcgctgtgaagagatagagtgtgagcatagctgtatgcagcgttgcgtgtagaagcgggg

SEQ ID NO: 169762 - DNA, 75 bp, Artificial Sequence
  Synthetic
gttcgcgggacagagctcagagactgttgagaaacgtaagcgcgccgccgcttttgcggcgtgttgtccgctttc

SEQ ID NO: 169763 - DNA, 75 bp, Artificial Sequence
  Synthetic
gacgggggccttttgcgctgcagacggggcgtcgcgggtacggggggcttttgccgcggggacggaggcctttcg

SEQ ID NO: 169764 - DNA, 75 bp, Artificial Sequence
  Synthetic
gggaaacgacagacgaagtacggcacaacccgcgtcgaggacacacgcagaagcgatcgcccaggggaggggggg

SEQ ID NO: 169765 - DNA, 75 bp, Artificial Sequence
  Synthetic
ctggccgccggcggggccggggtgttgcggagacggggggtgtgcgggacggtggtggggacgggggttgcgctg

SEQ ID NO: 169766 - DNA, 75 bp, Artificial Sequence
  Synthetic
gcaaatgcatgcaaacttctcatttattgtgtctactactctgtgttgctacagggagtgaagggggtgaaggca

SEQ ID NO: 169767 - DNA, 75 bp, Artificial Sequence
  Synthetic
cgccgcaaactgtccccgtccccaacgtaacctcccctacgcggcgcgaacagccccggccccggcgcaaccccc

SEQ ID NO: 169768 - DNA, 75 bp, Artificial Sequence
  Synthetic
gcaccggcggcggtcggggtgtgtcgggggcgcggctgggtgggtgcgtgcgtggggtgggtgtcgggtgtgtcg

SEQ ID NO: 169769 - DNA, 75 bp, Artificial Sequence
  Synthetic
gggggcgcggctgggtgggtgcgtgcgtggggtgggtgtcgggtgtgtcgcgggcgtgtgtcgggtgtgtcgggg

SEQ ID NO: 169770 - DNA, 75 bp, Artificial Sequence
  Synthetic
atgtcttgtagaaaaatataatcactttccgcatataccgttaagattgacatcacagtgacggtgttgttttct

SEQ ID NO: 169771 - DNA, 75 bp, Artificial Sequence
  Synthetic
aatcacaaagaaccgcctgacggtttacaagcagaaacaccgcaccacggtggtacaagcgcggtggatctggtc

SEQ ID NO: 169772 - DNA, 75 bp, Artificial Sequence
  Synthetic
cacccaccaaaaaatgtgactggaccggttcctagtagctttgggagccatgttcaaggtggaccacagctacgg

SEQ ID NO: 169773 - DNA, 75 bp, Artificial Sequence
  Synthetic
cactaaaggtgcatgcctcccggttacattacataaccatcctttatcccaatggctccatctagtagtcatcgg

SEQ ID NO: 169774 - DNA, 75 bp, Artificial Sequence
  Synthetic
ataaatatattatatctggtgtatatactgaatgctgctggttcataaggtaacgatgctactttttttaattcc

SEQ ID NO: 169775 - DNA, 75 bp, Artificial Sequence
  Synthetic
ggggggaccggcggcgcgaaaagacagggagatggacagtgtcacggtgttttgttatgattaggacatggggac

SEQ ID NO: 169776 - DNA, 75 bp, Artificial Sequence
  Synthetic
aaccacggtcgccaccaactgtcttgtgaaaacagaaaatacccatctgacgtgtaagtgcagtccgaacgacac

SEQ ID NO: 169777 - DNA, 75 bp, Artificial Sequence
  Synthetic
actcctctttgtcgccctccgcggtggcgtcccaccattcccgtttggaacacgccgagctgaggctggagcgca

SEQ ID NO: 169778 - DNA, 75 bp, Artificial Sequence
  Synthetic
cttggtaagctatgtggccgtctgcgccgaaaccaaagtcgccaccaactgtctcgtgaaatcagaaaataccca

SEQ ID NO: 169779 - DNA, 75 bp, Artificial Sequence
  Synthetic
atcttcacaggtaaccagtttctagccacagtatagcgagcctaagagaccgcacacggtccctgctggaaacac

SEQ ID NO: 169780 - DNA, 75 bp, Artificial Sequence
  Synthetic
aaaaacccggagaagacagagaggacgagcgtccacacaccgctttggtcgtagacgtactttttattcttggta

SEQ ID NO: 169781 - DNA, 75 bp, Artificial Sequence
  Synthetic
cgccgcagtaccgccggcgccgtgactgtcgttggaaacgccgacgccgccactactgccggagccgacgctgaa

SEQ ID NO: 169782 - DNA, 75 bp, Artificial Sequence
  Synthetic
actatgacatctcacatggcacgcacactacatgggctcttatactaatttgcatagcctgcatgcttctttttt

SEQ ID NO: 169783 - DNA, 75 bp, Artificial Sequence
  Synthetic
tctatattctgcatagagttacatgcaacagtactactaccaatactgcatccatcacatcacccaacactgctt

SEQ ID NO: 169784 - DNA, 75 bp, Artificial Sequence
  Synthetic
ttctactccgaataacaacacatcaacgacgccacacacatctgtcacctcacaagcgtcgaccattggcaacat

SEQ ID NO: 169785 - DNA, 75 bp, Artificial Sequence
  Synthetic
caccaacgttacctccgacttgagtactttcacaaccgtatattctacattcaatacatcatatgccaatatatc

SEQ ID NO: 169786 - DNA, 75 bp, Artificial Sequence
  Synthetic
cgctacatcatcttataacacaacaatcaccgtaactgtcacgtcagatgaaacttcgcacaacgtatccactaa

SEQ ID NO: 169787 - DNA, 75 bp, Artificial Sequence
  Synthetic
atcaccgtaactgtcacgtcagatgaaacttcgcacaacgtatccactaataatgcacttataagcacaccatgg

SEQ ID NO: 169788 - DNA, 75 bp, Artificial Sequence
  Synthetic
atcatacgtttcaaggaaaccaatacaacaggaatagaagggagtaatgtcaccataaagggtaattctacgtgg

SEQ ID NO: 169789 - DNA, 75 bp, Artificial Sequence
  Synthetic
caacaggaatagaagggagtaatgtcaccataaagggtaattctacgtgggactgtctttcagtcgcctggatac

SEQ ID NO: 169790 - DNA, 75 bp, Artificial Sequence
  Synthetic
aagcgggctacctgttgggtggtgattttttggatactggccgcgcttatggggatgccacactacctgatgtac

SEQ ID NO: 169791 - DNA, 75 bp, Artificial Sequence
  Synthetic
tacgcatccttacctctcacactgtatgtcattctcaacatgaaagaccttcactgtaccatgacttatgccgtt

SEQ ID NO: 169792 - DNA, 75 bp, Artificial Sequence
  Synthetic
atgtcattctcaacatgaaagaccttcactgtaccatgacttatgccgttcgtgcaacaacacagaactacatct

SEQ ID NO: 169793 - DNA, 75 bp, Artificial Sequence
  Synthetic
tctgtattggtacatttgcaaatcgtcgggtgcgacggtatagtttaacgataattatattatgtatgcgcagta

SEQ ID NO: 169794 - DNA, 75 bp, Artificial Sequence
  Synthetic
cgaagatgaaaatttctacctattagtaacaccaaaaaatcatactgaagctattaatgctactttcgtttgccc

SEQ ID NO: 169795 - DNA, 75 bp, Artificial Sequence
  Synthetic
cttaactgcgtggccataatggacttcataaagctgctatcaggacgataagcaatcgtagatgtgggaatccgc

SEQ ID NO: 169796 - DNA, 75 bp, Artificial Sequence
  Synthetic
tagatacaacaccgatatcgaaaatgaagatagagagaaaggaagtcaacatactaacaatacacatcaccacaa

SEQ ID NO: 169797 - DNA, 75 bp, Artificial Sequence
  Synthetic
ctacagacgccttacgtgtccatcatgattttcaacagttacgccacggccgcatggcccatggactgcgaacac

SEQ ID NO: 169798 - DNA, 75 bp, Artificial Sequence
  Synthetic
tccctgtagtactaccgttaactattccactagtactgagacagccacatcaacatacagtacaacagttatcag

SEQ ID NO: 169799 - DNA, 75 bp, Artificial Sequence
  Synthetic
tccactagtactgagacagccacatcaacatacagtacaacagttatcagcaataaaagcacttcagaatctata

SEQ ID NO: 169800 - DNA, 75 bp, Artificial Sequence
  Synthetic
acagtccataaaagatgcgaccgcagttacgaggtgatcaacgtaacaggatacgttggtagcaacataactcta

SEQ ID NO: 169801 - DNA, 75 bp, Artificial Sequence
  Synthetic
aaaaaatgcaatcagactgagaaatggcacaatgtagactggattcattatgagtaccccacgcataaaatgtgc

SEQ ID NO: 169802 - DNA, 75 bp, Artificial Sequence
  Synthetic
ctgcaacgacacctccctaactatctacaacttaaccacaaaaaacgctggaaaatataccaggcgtcaccgtga

SEQ ID NO: 169803 - DNA, 75 bp, Artificial Sequence
  Synthetic
cgcttatagcgttgtacatgggtagccatcgcattcccaaaaatccgcattacaccaaacttcccaaatatgatc

SEQ ID NO: 169804 - DNA, 75 bp, Artificial Sequence
  Synthetic
tggtactctagtgccgatacttttacatgaacaaaaaaaggcgttttactggcgactttttctgcaaagtcaaca

SEQ ID NO: 169805 - DNA, 75 bp, Artificial Sequence
  Synthetic
cagggagacacagtctacctaaatgctagcaataatccctgtaattattccagcttttggtaccacggtaattac

SEQ ID NO: 169806 - DNA, 75 bp, Artificial Sequence
  Synthetic
ggcgcgactcgtccctaggggaccgcgggggaaacgacagacgaagtacggcacaacccgcgtcgaggacacacg

SEQ ID NO: 169807 - DNA, 75 bp, Artificial Sequence
  Synthetic
tacgcaatgttacacgttactacacaaacacatcgtgttccccgcaattcatctgcataaacgaaactaaaggtc

SEQ ID NO: 169808 - DNA, 75 bp, Artificial Sequence
  Synthetic
aatactcaattacttcgacaactgtaactacaccataaataacaccaagcatattatcaccgtggtgttttcacg

SEQ ID NO: 169809 - DNA, 75 bp, Artificial Sequence
  Synthetic
ccggcaactctgagacacaaactacgaactagaaacaacgtaaatcgcatagcgtgattacaaagtatcgacgct

SEQ ID NO: 169810 - DNA, 75 bp, Artificial Sequence
  Synthetic
gcatacaatgcgctgcatgagaacacgcgtgacacatagcgtacccctggacggtacagtctatgataacgtaat

SEQ ID NO: 169811 - DNA, 75 bp, Artificial Sequence
  Synthetic
ggggagagtttgcggcgcgggcaggggggtcttttgcggcgggggactcctgcggcggggacggaggacttttgc

SEQ ID NO: 169812 - DNA, 75 bp, Artificial Sequence
  Synthetic
atcataggtgaactgcagctgagcgtagagcacatttcgtacagattcgctttcaagcgacagggtggtcgtatt

SEQ ID NO: 169813 - DNA, 75 bp, Artificial Sequence
  Synthetic
ctttgttggcttgcaaatacatcccaccttaagcgatgagtccataaagcaccgttgtccgggtacggtgaaagt

SEQ ID NO: 169814 - DNA, 75 bp, Artificial Sequence
  Synthetic
accttaagcgatgagtccataaagcaccgttgtccgggtacggtgaaagtgactcggattgtagcacgtcccttt

SEQ ID NO: 169815 - DNA, 75 bp, Artificial Sequence
  Synthetic
tctgccgcgcggtggcggtcaggtctggagcgtagtgcccagtctggttttttttcagcaaaaggccgatcgccc

SEQ ID NO: 169816 - DNA, 75 bp, Artificial Sequence
  Synthetic
atttcgaggtcttcagaacaaaacggaagactttttgcactggttgttagggtggggtcataagtccatctgttc

SEQ ID NO: 169817 - DNA, 75 bp, Artificial Sequence
  Synthetic
gaggcgagctgcgtgtgcgtgccgtctgtgttccccgccgcgaaaggcccccgtccctcagtccgtgcgcagcac

SEQ ID NO: 169818 - DNA, 75 bp, Artificial Sequence
  Synthetic
gaaaacgggacgttatccaagaacataactaacttggcattcacctatggcagctggggcgttgcgatgctgctg

SEQ ID NO: 169819 - DNA, 75 bp, Artificial Sequence
  Synthetic
tgcggcgcgcacggcgaaacgaagacgcgtgtctgtgtctgtgtgattccccggggaaaagaggaagttcccagg

SEQ ID NO: 169820 - DNA, 75 bp, Artificial Sequence
  Synthetic
gacttacgagcggttaccaaactgcagcgcagtaactaaaacaatgggacaagacgttgaattctatagtccggc

SEQ ID NO: 169821 - DNA, 75 bp, Artificial Sequence
  Synthetic
agcgcagtaactaaaacaatgggacaagacgttgaattctatagtccggcaccttcagggtgtaacgtgacccag

SEQ ID NO: 169822 - DNA, 75 bp, Artificial Sequence
  Synthetic
aagggagttttcagcaggactctgagcctcactcagacatctttctgcgggggcttttgggcgtgctgggcgccg

SEQ ID NO: 169823 - DNA, 75 bp, Artificial Sequence
  Synthetic
ggacaccgtgtggcgttcggatgttcttggatcgcattttttttgtacaacgtttctgaaagctacagtggtgtg

SEQ ID NO: 169824 - DNA, 75 bp, Artificial Sequence
  Synthetic
cttggatcgcattttttttgtacaacgtttctgaaagctacagtggtgtgtattaccgaaaaggtaacaattgta

SEQ ID NO: 169825 - DNA, 75 bp, Artificial Sequence
  Synthetic
tgacacccgcggtggttacaaactccacagccagcgtgtcacccattgcgttgaatctgacaacaaatttcaccg

SEQ ID NO: 169826 - DNA, 75 bp, Artificial Sequence
  Synthetic
cgtcatgatggtatgcagattaccatgtgcgtgggctcaggcgacgacggaggagacggtgggaattctattaag

SEQ ID NO: 169827 - DNA, 75 bp, Artificial Sequence
  Synthetic
aattctggcaagcgttcaaagccgcgtgggcatatcagaagtcggccacagcgatagtaacagatgaggataagc

SEQ ID NO: 169828 - DNA, 75 bp, Artificial Sequence
  Synthetic
aaaccgtaacgtggcaaataaatcatgacttccgacatgggttctcatcctctgacggttacacaattccgctgt

SEQ ID NO: 169829 - DNA, 75 bp, Artificial Sequence
  Synthetic
ctgcgagtcatgtcgaatatataagcttcctgaagtccgcatgtaagcaccgccacggaattcaggatagcataa

SEQ ID NO: 169830 - DNA, 75 bp, Artificial Sequence
  Synthetic
cttcctgaagtccgcatgtaagcaccgccacggaattcaggatagcataactcatgaattcctttggtatgtcac

SEQ ID NO: 169831 - DNA, 75 bp, Artificial Sequence
  Synthetic
tttttaacaactcgattctggtggtgttatgagaagtatcattaccgacccactttttccatagttcgcacatgc

SEQ ID NO: 169832 - DNA, 75 bp, Artificial Sequence
  Synthetic
tttgcttttacaaacgtggagagggtctttctacgccctatgtgggtttaagcctaagttgtgcggctaaccaga

SEQ ID NO: 169833 - DNA, 75 bp, Artificial Sequence
  Synthetic
gttatgagaagtatcattaccgacccactttttccatagttcgcacatgcccaaaagatatcccgagactgtact

SEQ ID NO: 169834 - DNA, 75 bp, Artificial Sequence
  Synthetic
ccagagggtagtcaggtaagactcaccgcggttgatgcagttttttgtcaggttagctacgctccaattatctcc

SEQ ID NO: 169835 - DNA, 75 bp, Artificial Sequence
  Synthetic
ccagacggccacgcgagtacgtacgtggtttgtggaaagaaccacgttgtggcgtcgcacgtgggttccgggaca

SEQ ID NO: 169836 - DNA, 75 bp, Artificial Sequence
  Synthetic
acctccaacggctgtgcgggtgactccgttgggcccggtaaggagagatacaaagatggtatctgtattattatt

SEQ ID NO: 169837 - DNA, 75 bp, Artificial Sequence
  Synthetic
ccgttgggcccggtaaggagagatacaaagatggtatctgtattattatttcgggcgtcattgttcgttgtcacc

SEQ ID NO: 169838 - DNA, 75 bp, Artificial Sequence
  Synthetic
tttatcagggagaaggttttgtgccaacaatgactagcccgggactatctgcgtcagaaaagtatgtcggaaatc

SEQ ID NO: 169839 - DNA, 75 bp, Artificial Sequence
  Synthetic
tgttgggaagcacggagactgcggtcaacctcggcaacgcgactacgattattccacaacctgtggaacacccag

SEQ ID NO: 169840 - DNA, 75 bp, Artificial Sequence
  Synthetic
gacagtaaacagtacggacaagtgtttgtgacggacacggagctgtaattaactataatgtatagatacacatgg

SEQ ID NO: 169841 - DNA, 75 bp, Artificial Sequence
  Synthetic
ttgctttggttgacaacaacgttactttgtatacaacagttccatcaatggtggaacccagatacaacgttatgc

SEQ ID NO: 169842 - DNA, 75 bp, Artificial Sequence
  Synthetic
attccgaaaacgggatatggaggtcaaaacctcagcctgcctcctaagagtataccacaatctaaagactatact

SEQ ID NO: 169843 - DNA, 75 bp, Artificial Sequence
  Synthetic
tattaatttgacaactcaccatagcggaatttactactttgagtgtttctacatgtttaatacgaaagtatggaa

SEQ ID NO: 169844 - DNA, 75 bp, Artificial Sequence
  Synthetic
accaaatgtatgctacaatgtcaccgtgcaccctacgcatcaaacatacattcacacaactacattgtttcatct

SEQ ID NO: 169845 - DNA, 75 bp, Artificial Sequence
  Synthetic
gcccgcctgccgatcgcgacgtcgtggaccatcgaacagagactcacgcgtacgagaccccgaggtacgccacgc

SEQ ID NO: 169846 - DNA, 75 bp, Artificial Sequence
  Synthetic
aggagaccacgaccgtcccacccggcgtgtcgactcgtccgagacccgggaagggaacaggccccaccctttttt

SEQ ID NO: 169847 - DNA, 75 bp, Artificial Sequence
  Synthetic
agtgtcacaattccacattaagcattcttcatgtaaacgtctcagatcccaaaaactattgcaggcgaaaatgtc

SEQ ID NO: 169848 - DNA, 75 bp, Artificial Sequence
  Synthetic
ccccccggcgcagtccgcggcagggttccggccgtgctgcggtccgcacgctgcgcccgctcccgcctgcctccc

SEQ ID NO: 169849 - DNA, 75 bp, Artificial Sequence
  Synthetic
gctccgacatggcggacgagagaaaatggcgtcgagagcctaggagcgttttcgctccaggcgggtaaaaaaata

SEQ ID NO: 169850 - DNA, 75 bp, Artificial Sequence
  Synthetic
cccgtctccgtccccaccctcgtccctgccgcaaaaggcccccgtacccgcacaccccccgtccccgcacacccc

SEQ ID NO: 169851 - DNA, 75 bp, Artificial Sequence
  Synthetic
tataggctggaagacattcctagcgtgcttccgccaacgcacgagaccgatcccgcgctgataatgcgcgaccgc

SEQ ID NO: 169852 - DNA, 75 bp, Artificial Sequence
  Synthetic
tgctaaagtaggtactaacgtcacattgaacgcggtacatgtgcatgacggtgactatgtgtactggtcttttgg

SEQ ID NO: 169853 - DNA, 75 bp, Artificial Sequence
  Synthetic
ttgaacgcggtacatgtgcatgacggtgactatgtgtactggtcttttggtggaggtggagctaatagattaatg

SEQ ID NO: 169854 - DNA, 75 bp, Artificial Sequence
  Synthetic
ctccttctcatcaatgtaacggaagaatatactgattactatcgcaccatgaccacattcgtacatcagtcccat

SEQ ID NO: 169855 - DNA, 75 bp, Artificial Sequence
  Synthetic
aaagaatccaccacccctaaaacccacgtagaacttcacgtcggtttaggagccacagcagcggaaacaccgtta

SEQ ID NO: 169856 - DNA, 75 bp, Artificial Sequence
  Synthetic
aaaggcccccgtccccgccgcaaacgcccccggccccgcaacgccccgtccctgccgcaggaggcccccgtcccc

SEQ ID NO: 169857 - DNA, 75 bp, Artificial Sequence
  Synthetic
gcccccggccccgcaacgccccgtccctgccgcaggaggcccccgtccccagcgccaaagctccccgtccccact

SEQ ID NO: 169858 - DNA, 75 bp, Artificial Sequence
  Synthetic
tgttgtaggtgcactgggtggtgttttcacgcaggaagcggatgggtctcccgtaggtgttgagtagtaggtgaa

SEQ ID NO: 169859 - DNA, 75 bp, Artificial Sequence
  Synthetic
aaagcccgtgaaccgatacgggtgcagacggccgaaaaaattcgagacgacaatacgacgacagggcgtgatttt

SEQ ID NO: 169860 - DNA, 75 bp, Artificial Sequence
  Synthetic
actcccgttaccggcgccggcgcccagcacgcccgaaaacaccgccgtcgccgccccgaaaagcgaagcgccgcg

SEQ ID NO: 169861 - DNA, 75 bp, Artificial Sequence
  Synthetic
gccggacacagcacgccgcaaacgcgatgaggacgccgccgtgcttacttatgtcccgcaacgctgcctcaaccc

SEQ ID NO: 169862 - DNA, 75 bp, Artificial Sequence
  Synthetic
cgaaatcagtcgcgcaatgcgattccgagaccctcgttcccccctccggatccaccatcgcagccggcagaggat

SEQ ID NO: 169863 - DNA, 75 bp, Artificial Sequence
  Synthetic
gtgacgtccgcttagatcaaaagtcacgtatactgcgacgctgtttacacccgtttcccatcccgccgtttccga

SEQ ID NO: 169864 - DNA, 75 bp, Artificial Sequence
  Synthetic
ggtgtgtgccgggtgtggcgggtgtgtcagggtgtgccgcgggtgtgtcgcgggcgtgtgccgggtgtgtcaggg

SEQ ID NO: 169865 - DNA, 75 bp, Artificial Sequence
  Synthetic
tccttcgggtggctgggctgccgggtggtttttcacagccctttagactgcgcggcgccaaggcggcgctagcac

SEQ ID NO: 169866 - DNA, 75 bp, Artificial Sequence
  Synthetic
gcgaaagctccccgtctccgccaaaggcccccgtccccgccgcgaaaggcccccgtccccgtccccgccgcaaac

SEQ ID NO: 169867 - DNA, 75 bp, Artificial Sequence
  Synthetic
ccgtccccaccaccgtccccgacgcaaaaggcccccgtggccgtccccgcacactccccagtacggccaaaaacc

SEQ ID NO: 169868 - DNA, 75 bp, Artificial Sequence
  Synthetic
acgccgcagaaacaccgtagaaacacccgccgccaaccccagagcgcctgcaacgcgcaacatgacaagtgctgt

SEQ ID NO: 169869 - DNA, 75 bp, Artificial Sequence
  Synthetic
cccgccgccaaccccagagcgcctgcaacgcgcaacatgacaagtgctgtggagcgacacgcaccggcagcgcgc

SEQ ID NO: 169870 - DNA, 75 bp, Artificial Sequence
  Synthetic
ggtgtgtcggtcgggtgtgtcgcgggcgtgtgccgggtgtgtcaggggtgtgtcggcggggtgtgcgcgggtgga

SEQ ID NO: 169871 - DNA, 75 bp, Artificial Sequence
  Synthetic
tgtctaaagtccatcgaaaaccatggttatgttgttggtgacgccaatcgtctagcgatgtcatagtacgatagg

SEQ ID NO: 169872 - DNA, 75 bp, Artificial Sequence
  Synthetic
ttccgctgagggtgattggagcgtgatgaatttaacggagacttgcatcaaccgcggtgagtcctatctgattac

SEQ ID NO: 169873 - DNA, 75 bp, Artificial Sequence
  Synthetic
ggctactctatgtcggccgatcgcgccgcctcggacctgctcatcggcatgttcggctccgttagcctggtcaac

SEQ ID NO: 169874 - DNA, 75 bp, Artificial Sequence
  Synthetic
cggcagtgcgcacaaagcgccggacacagcacgccgcaaacgcgctgaggacgccgccgcgcttacttatgtccc

SEQ ID NO: 169875 - DNA, 75 bp, Artificial Sequence
  Synthetic
tgccggactggcggaacgacaagtgctgtggagccacacgcaccggcagcgcgcagaaagcgccgtggacaacac

SEQ ID NO: 169876 - DNA, 75 bp, Artificial Sequence
  Synthetic
attccaagctttctggggaaatttgaaacaaattaaaacgataattgttataacgataactaggggtatgatcca

SEQ ID NO: 169877 - DNA, 75 bp, Artificial Sequence
  Synthetic
taacgataactaggggtatgatccacattgtatgtggggtggcagtatcgtgttgtgcttcaacgttaccggcgg

SEQ ID NO: 169878 - DNA, 75 bp, Artificial Sequence
  Synthetic
cattgtatgtggggtggcagtatcgtgttgtgcttcaacgttaccggcggtataatggaccgcgacatgtgtgaa

SEQ ID NO: 169879 - DNA, 75 bp, Artificial Sequence
  Synthetic
ttcctcttttccgcgtcttgtctctggccgttgttttgcgtgtgtccccaaggacccgcgctgccgtcccctggg

SEQ ID NO: 169880 - DNA, 75 bp, Artificial Sequence
  Synthetic
tgtttggtaggcagaatgtacactgacattgtaacacagggtattgtattttgctattgttactccaagggtttc

SEQ ID NO: 169881 - DNA, 75 bp, Artificial Sequence
  Synthetic
acattgtaacacagggtattgtattttgctattgttactccaagggtttcaaaagaattaaaatagtaatttcta

SEQ ID NO: 169882 - DNA, 75 bp, Artificial Sequence
  Synthetic
ttgcgacgtgcgccgcgcacgtcgcttttattcgccgtcgccgtcctccgcgaccgccgtccccaccgcaccaca

SEQ ID NO: 169883 - DNA, 75 bp, Artificial Sequence
  Synthetic
tcattgggttgtacactgcactcgttattttgataaatacatagtgcgttagtaactctcggtttgtctatatac

SEQ ID NO: 169884 - DNA, 75 bp, Artificial Sequence
  Synthetic
tattttgataaatacatagtgcgttagtaactctcggtttgtctatataccattgaaaagcatcgtctttgactg

SEQ ID NO: 169885 - DNA, 75 bp, Artificial Sequence
  Synthetic
tcctgaaagcgttgcattctttatgataggtgtgacgatgtctttaccattcccacggctgctttgcgtgatgat

SEQ ID NO: 169886 - DNA, 75 bp, Artificial Sequence
  Synthetic
agttccaataattggattttcgtgtacaaagaatgattgttatccatcgaagtaataacgcgtaccggaacatca

SEQ ID NO: 169887 - DNA, 75 bp, Artificial Sequence
  Synthetic
acaaagaatgattgttatccatcgaagtaataacgcgtaccggaacatcatagttctgtgtccgtcatgaacact

SEQ ID NO: 169888 - DNA, 75 bp, Artificial Sequence
  Synthetic
atgagaatgatgacaataattagcatccaagaataatgtgttgtcgttctctgatattgtatttccccaaccggg

SEQ ID NO: 169889 - DNA, 75 bp, Artificial Sequence
  Synthetic
gcactggctcctaacgttgtccggtcactgttatttgtacgcgttgtattggcggtcttcgtgagtccataattt

SEQ ID NO: 169890 - DNA, 75 bp, Artificial Sequence
  Synthetic
tagtcccgttactctccgcgccagtcactgtcggcgtcgttgtaacgatggttgttacgttattagctgaggtag

SEQ ID NO: 169891 - DNA, 75 bp, Artificial Sequence
  Synthetic
gggggcgagcggcacggagacggaggccagctgcgggggcgcggacgcgatggcgggggccgtggggtccgctgt

SEQ ID NO: 169892 - DNA, 75 bp, Artificial Sequence
  Synthetic
cactgtcggcgtcgttgtaacgatggttgttacgttattagctgaggtagttttcagagatttcagtgtcacggt

SEQ ID NO: 169893 - DNA, 75 bp, Artificial Sequence
  Synthetic
caacgtcaggttgaagatggtgatctggctagccgcacaacttagacttaaacccacataaggcgttgaaaatcc

SEQ ID NO: 169894 - DNA, 75 bp, Artificial Sequence
  Synthetic
ttattgtacacatgatgcactgtccaacggaatcgtggaaccgtcataagatgagaacccacgccggaaaccatg

SEQ ID NO: 169895 - DNA, 75 bp, Artificial Sequence
  Synthetic
aaatctacactgaacttgagcacaaaaatactgacaatggactggatatacagacttttatatgatccctgtaca

SEQ ID NO: 169896 - DNA, 75 bp, Artificial Sequence
  Synthetic
ccgccgccgccgcgtccgccccgaccaccgtgtgcgcgtccgcgttcggcacgcacaccgcgtgcccgccggcgg

SEQ ID NO: 169897 - DNA, 75 bp, Artificial Sequence
  Synthetic
ttgataactaacgtgtttaaacgcgctggaatttaccgctagagtcgacgtaatgggtgacacattcgccgtggc

SEQ ID NO: 169898 - DNA, 75 bp, Artificial Sequence
  Synthetic
ttgtaggtacactgggtggtgttttcacgcaggaagcggatgggtctcccgtaggtgttgagcagtaggtgaaac

SEQ ID NO: 169899 - DNA, 75 bp, Artificial Sequence
  Synthetic
cagttgtcaccttttcgataataagtgccactatgattttgagaaaggttgtacataaaaaacgttgtccaagaa

SEQ ID NO: 169900 - DNA, 75 bp, Artificial Sequence
  Synthetic
cttccattctggtaacgtccccattgggttatgttacaacctgatgacgccgagccgcataactcaacgttttgt

SEQ ID NO: 169901 - DNA, 75 bp, Artificial Sequence
  Synthetic
gaagggtttttccccgtaagatgatcctcgtatcacatgaggtctggatatgtataaatgaggagtgaaataggc

SEQ ID NO: 169902 - DNA, 75 bp, Artificial Sequence
  Synthetic
atcttctcttctgaaatagtaattcctgctgttttccgttgtcagattcagtaacgtcaggcggtcataggtgca

SEQ ID NO: 169903 - DNA, 75 bp, Artificial Sequence
  Synthetic
tatctgtaatgctgctcattagaatcaccagggagttgcgggaagaacgagcaaatggacttataaccagacccg

SEQ ID NO: 169904 - DNA, 75 bp, Artificial Sequence
  Synthetic
taattagcgcaagtaatattcttgggaatctgacggttgggagacttccattccacaggagcagtcgtcgtgctg

SEQ ID NO: 169905 - DNA, 75 bp, Artificial Sequence
  Synthetic
gaatctgacggttgggagacttccattccacaggagcagtcgtcgtgctgattgaacaattcgcaaaaacataat

SEQ ID NO: 169906 - DNA, 75 bp, Artificial Sequence
  Synthetic
acgatactctttcagccttacgatcaaaatattgcactagtggtgacgataaacgatgcaaaaacaaaaaaaaag

SEQ ID NO: 169907 - DNA, 75 bp, Artificial Sequence
  Synthetic
atagactcatcacttaaggcgggatgtatttgcaagtcagcaaagacgacagttttttcgccgagagaaccagcg

SEQ ID NO: 169908 - DNA, 75 bp, Artificial Sequence
  Synthetic
aacgattccaaaccggatacgctacatacctgccacagtgggcagcttttaccatgccagaaaactcggtcgcga

SEQ ID NO: 169909 - DNA, 75 bp, Artificial Sequence
  Synthetic
gattacgctcgtcatctggaccgtagtgtggctcaaactgcttcgagacgctcttttataaaaacatacgcagaa

SEQ ID NO: 169910 - DNA, 75 bp, Artificial Sequence
  Synthetic
aactgtaccgtcctggagtacgctatgtatcacgcgtcttttcatggagcgcactgtatgccgacacacggagat

SEQ ID NO: 169911 - DNA, 75 bp, Artificial Sequence
  Synthetic
tgtatcacgcgtcttttcatggagcgcactgtatgccgacacacggagataacgaaggaaattccactcgcagat

SEQ ID NO: 169912 - DNA, 75 bp, Artificial Sequence
  Synthetic
agataatacatataagtagtttattacgatctttcatgacggagtggaaaagcggggttgtacaatttctgagag

SEQ ID NO: 169913 - DNA, 75 bp, Artificial Sequence
  Synthetic
tttttaataaagtctgggtttccagatacgcgctggttctgattttgatggtttgtgcctctgaaggctcaacga

SEQ ID NO: 169914 - DNA, 75 bp, Artificial Sequence
  Synthetic
acgatctttcatgacggagtggaaaagcggggttgtacaatttctgagagctacacaaagcacaaatttatcctg

SEQ ID NO: 169915 - DNA, 75 bp, Artificial Sequence
  Synthetic
gttgccggaacgttaaagtaagtcaaaacgcagattataattaccgtcaccacggcagctgtccaaccagcgtga

SEQ ID NO: 169916 - DNA, 75 bp, Artificial Sequence
  Synthetic
aaacgcagattataattaccgtcaccacggcagctgtccaaccagcgtgaatagatatgtgggaattggtgtgtt

SEQ ID NO: 169917 - DNA, 75 bp, Artificial Sequence
  Synthetic
ggggacggggggtgtgcggggacggggcgtcgcgggatggcgggctgttgcgtgccggggacgggggactcttgc

SEQ ID NO: 169918 - DNA, 75 bp, Artificial Sequence
  Synthetic
ttagtatgtcatattcatcatagtcacttgtattacatggcaaatcgcattcatacacgtattccgtgtatgttc

SEQ ID NO: 169919 - DNA, 75 bp, Artificial Sequence
  Synthetic
acttgtattacatggcaaatcgcattcatacacgtattccgtgtatgttcctgaatcgctagatgtaacgttatt

SEQ ID NO: 169920 - DNA, 75 bp, Artificial Sequence
  Synthetic
tatgtatccgttccatccacaaagttcgcaactgccgtagttccagaaactggaatagttgcagggattattact

SEQ ID NO: 169921 - DNA, 75 bp, Artificial Sequence
  Synthetic
ccgcaatgatattttacaggtattccgaaacctgtatggaggtcactgtcagagtaggtgatccagttaccctcg

SEQ ID NO: 169922 - DNA, 75 bp, Artificial Sequence
  Synthetic
gtgcggggacggggggtgtgcggggacgggggccttttgcggcggggacagtggtggggttgtcggcggggacgg

SEQ ID NO: 169923 - DNA, 75 bp, Artificial Sequence
  Synthetic
ggacgggggcctttcgcggcggggacgggggcctttcgcggcggggacgggggcctttcgcggcggggacggggg

SEQ ID NO: 169924 - DNA, 75 bp, Artificial Sequence
  Synthetic
attagtactgacgttaaaaatagttgacgtataggaagaatatggtgtggtggtgctgacacgacttttcttact

SEQ ID NO: 169925 - DNA, 75 bp, Artificial Sequence
  Synthetic
gagttccaacaatacgtcgactgctagcacaccgagtccctctagctctactcgcaccttaacaaccgtgaaggc

SEQ ID NO: 169926 - DNA, 75 bp, Artificial Sequence
  Synthetic
acttgtaataatcacctgtttttgacgctatttcttgcagtatacgtaattttagctgcctctcttcctcttttg

SEQ ID NO: 169927 - DNA, 75 bp, Artificial Sequence
  Synthetic
tcaagagtgccgtaaatagtgtacggtgtttcgttgcgaatcaatacgtacgtatttttcataaactctgacaca

SEQ ID NO: 169928 - DNA, 75 bp, Artificial Sequence
  Synthetic
aagtcacgttggtgacgttgaaagtcgtagacgttgtatagaaagatggcgtagtagtactttgagatttcttac

SEQ ID NO: 169929 - DNA, 75 bp, Artificial Sequence
  Synthetic
taatatacttgggaacgcggaatagatttcggctcatggcgttaaccaggtagaaactgcgtgtgcagttacgtt

SEQ ID NO: 169930 - DNA, 75 bp, Artificial Sequence
  Synthetic
atttcggctcatggcgttaaccaggtagaaactgcgtgtgcagttacgttgcgcgtaacgtagaagcagggcggc

SEQ ID NO: 169931 - DNA, 75 bp, Artificial Sequence
  Synthetic
caacgtacagtttagtgttccaacgtggtacgttaaaaaacataggattaaacgtggtcaaattaacacagcttt

SEQ ID NO: 169932 - DNA, 75 bp, Artificial Sequence
  Synthetic
tggtacgttaaaaaacataggattaaacgtggtcaaattaacacagctttcttctccggtgttgttacgaaagga

SEQ ID NO: 169933 - DNA, 75 bp, Artificial Sequence
  Synthetic
gcctgtttgattatactctgagtaaacgtacttggccggttttcgcagttgggtactatagaaatcgaaccacat

SEQ ID NO: 169934 - DNA, 75 bp, Artificial Sequence
  Synthetic
acgtacttggccggttttcgcagttgggtactatagaaatcgaaccacatataggtaatactatcattttgaata

SEQ ID NO: 169935 - DNA, 75 bp, Artificial Sequence
  Synthetic
gtaaaaaatttatagtaatcctggctcgcacctatctgctttaacagttcttgtttccactttatttcagctagc

SEQ ID NO: 169936 - DNA, 75 bp, Artificial Sequence
  Synthetic
ttgtttccactttatttcagctagcctgccattttttgataataccctgccatagggaaacggtggtctgaaaac

SEQ ID NO: 169937 - DNA, 75 bp, Artificial Sequence
  Synthetic
cagtcagcatgtcttgagcatgcggtagagcagatagatgccgatgatggccgatagcgcgtagacggacatcat

SEQ ID NO: 169938 - DNA, 75 bp, Artificial Sequence
  Synthetic
gggatgagatgttgctgattctgtttagagagtatgtagaccaggcgtacgaggctggtgatgtcggtgatctga

SEQ ID NO: 169939 - DNA, 75 bp, Artificial Sequence
  Synthetic
ttttgcctgggaacgctatggctataacgggaaagaaccggtttggcaacattccattgtggggggggggtactt

SEQ ID NO: 169940 - DNA, 75 bp, Artificial Sequence
  Synthetic
ccggcgtgaggattagttcgcacacggccttttgtccgtgcaccgtggcggcggcattgcgctcggacatgctgc

SEQ ID NO: 169941 - DNA, 75 bp, Artificial Sequence
  Synthetic
tacaaagacacttttaataaaaaacgagactactttgtgtgtgtgctccgtaaactgtttattctccccctccgt

SEQ ID NO: 169942 - DNA, 75 bp, Artificial Sequence
  Synthetic
gtctgccgcgcggtggcggtcaagtctggagcgtagtgcccagtctggttttttttcagcaaaaggccgatcgcc

SEQ ID NO: 169943 - DNA, 75 bp, Artificial Sequence
  Synthetic
ctgatgtacagccataccaacaacgagtgtgttggtgaatttgctaacgagacttcgggttggttccccgtcttt

SEQ ID NO: 169944 - DNA, 75 bp, Artificial Sequence
  Synthetic
cgtgaagttggacggcgtagtttcggggattgtgaaccgtggctgagggtgtagaagggacaggaaagagcgtgt

SEQ ID NO: 169945 - DNA, 75 bp, Artificial Sequence
  Synthetic
gtagtggacatggttatcatccaggacaaaaagtacactggtataaccagtcatgcgtcggcatcggcaacggcg

SEQ ID NO: 169946 - DNA, 75 bp, Artificial Sequence
  Synthetic
gtggtataatttgaccgtgaaacctaaacctttggaaactactccagctagtaacgtaacaaccatcgtcacgac

SEQ ID NO: 169947 - DNA, 75 bp, Artificial Sequence
  Synthetic
ccattccgggccgcgtgctgggtccccgaggggcggggggtgtttttggcgggggggtgcaaattggagttgcgt

SEQ ID NO: 169948 - DNA, 75 bp, Artificial Sequence
  Synthetic
ccattccgggccgtgtgctgggtccccgaggggcgggggggtgttttttgcgggggggtgaaatttgggaatttg

SEQ ID NO: 169949 - DNA, 75 bp, Artificial Sequence
  Synthetic
gggacggcagcgcgagtccctgaggacgcgaagatcagctctcggggggtgagggacggcggccagacgcggaaa

SEQ ID NO: 169950 - DNA, 75 bp, Artificial Sequence
  Synthetic
ataaaagcgacgtgcggcggaggacggcgacggcgaaaaggagacgcgcgtgtgtcttgtgtctctttgagtccc

SEQ ID NO: 169951 - DNA, 75 bp, Artificial Sequence
  Synthetic
tgtgtcttgtgtctctttgagtccccggggaaaaagaggaagcggtccccagtcccaggcgaataaaagccacgt

SEQ ID NO: 169952 - DNA, 75 bp, Artificial Sequence
  Synthetic
ggagaagacgaagcgcgcgccgccgcgactcgtccctagggaaaaaagaggaagctgcagacccgcgtcgggggt

SEQ ID NO: 169953 - DNA, 75 bp, Artificial Sequence
  Synthetic
cacactgcttccatccaggcgcgcacacccccaacacaccccgccgacacacccgccacacaccccgccgacaca

SEQ ID NO: 169954 - DNA, 75 bp, Artificial Sequence
  Synthetic
cctggggacgcgaagagcggacgcggaaaagaggaagtccccggggaaaaagaggaagccgcagccaggcgcgca

SEQ ID NO: 169955 - DNA, 75 bp, Artificial Sequence
  Synthetic
gcgacggtgacagtggatccatgagagaggcgccgcacgctgcatggctaaataccgtgaatcccttgacgtcgt

SEQ ID NO: 169956 - DNA, 75 bp, Artificial Sequence
  Synthetic
cacccagccaacacacccccgacacacccggcacacacccacccagccgcgccccagacacaccccggtcggcgc

SEQ ID NO: 169957 - DNA, 75 bp, Artificial Sequence
  Synthetic
acccggcacacacccacccagccgcgccccagacacaccccggtcggcgccggtgcgggacagggctcagggtgt

SEQ ID NO: 169958 - DNA, 75 bp, Artificial Sequence
  Synthetic
cgggccggcccgggctgcgggtgtttgcggcgtgctgtggccggcgctttgtgcgcgctgccggtgcgtgtggtg

SEQ ID NO: 169959 - DNA, 75 bp, Artificial Sequence
  Synthetic
tgcggcgtgctgtggccggcgctttgtgcgcgctgccggtgcgtgtggtgccacgggacagggctggaggagtgt

SEQ ID NO: 169960 - DNA, 75 bp, Artificial Sequence
  Synthetic
acacccgacacacccagccgcacccggcacacacccacccagccgcacccccgacacacccaacccggcgccggt

SEQ ID NO: 169961 - DNA, 75 bp, Artificial Sequence
  Synthetic
tgaggcagctagggaggtttgcgggcgcgccgaccgggctgagggagtttttcgctgaggccgctagggagtttg

SEQ ID NO: 169962 - DNA, 75 bp, Artificial Sequence
  Synthetic
actgccgttgcgtggcgtgccacggtatttgttcgcggaaccgggctgagggatgtttctgcgggggttttcgcc

SEQ ID NO: 169963 - DNA, 75 bp, Artificial Sequence
  Synthetic
cgcgccgaccgggctgagggagtttttcgctgaggccgctagggagtttgttcgcgggacagggctcgggtaggt

SEQ ID NO: 169964 - DNA, 75 bp, Artificial Sequence
  Synthetic
tatttgttcgcggaaccgggctgagggatgtttctgcgggggttttcgccgtttcgggacttttgcgcgccccac

SEQ ID NO: 169965 - DNA, 75 bp, Artificial Sequence
  Synthetic
gcgtaagcgcgccggccgggccgaggaagttttgcgctgacggtgcgtggggtttttgggcgtgctaaacgccgg

SEQ ID NO: 169966 - DNA, 75 bp, Artificial Sequence
  Synthetic
ctcgcgggaccgggggctttagcggcgggaccggggacggggcgttgcggggacggggggcgcgcgggaccgggg

SEQ ID NO: 169967 - DNA, 75 bp, Artificial Sequence
  Synthetic
gaagttttgcgctgacggtgcgtggggtttttgggcgtgctaaacgccggcggcgtggcgtcgcacggtctttgt

SEQ ID NO: 169968 - DNA, 75 bp, Artificial Sequence
  Synthetic
ggacggggggcgcgcgggaccggggggctttagcggcggggactcgcgggaccgggctgaggcacgatggtgggg

SEQ ID NO: 169969 - DNA, 75 bp, Artificial Sequence
  Synthetic
tttttggccgcgctgaacgccggcggcggccacgggggttgcgctggggacggggtgttgactgcggcggggacg

SEQ ID NO: 169970 - DNA, 75 bp, Artificial Sequence
  Synthetic
cgtattgggctattcaacccccaccatctacatgaccaacctctattccaccaacttcctcacgctcaccgtact

SEQ ID NO: 169971 - DNA, 75 bp, Artificial Sequence
  Synthetic
gtgctgcttgcggcggggactactgtgcgggacaggagccgcgcgggactggtggtggggacgggggagcctttt

SEQ ID NO: 169972 - DNA, 75 bp, Artificial Sequence
  Synthetic
gtagggataaatagtgcgatggcgtttgtgggagaacgcagtagcgatgggttgcgacgtgcacgatccttcgtg

SEQ ID NO: 169973 - DNA, 75 bp, Artificial Sequence
  Synthetic
acaccgcacgcagatcgagctcgacgccgctgactacgctgcttgcgcacaagcccgccagcacctctacagtca

SEQ ID NO: 169974 - DNA, 75 bp, Artificial Sequence
  Synthetic
gggatcgtcggcggatgtctcttcgggacccggcatcgcagccgtagtcggctgttctgttttcatgattttcct

SEQ ID NO: 169975 - DNA, 75 bp, Artificial Sequence
  Synthetic
gtccctggggacacacgaagagccacggccaggggggacgacggccagagacgcggaaaagacgcggaaaagagg

SEQ ID NO: 169976 - DNA, 75 bp, Artificial Sequence
  Synthetic
tacgtgttagggtccgaacaggccagctgctccagggcgtctaccagcgtcagcgggatggcgccggcgcgaaag

SEQ ID NO: 169977 - DNA, 75 bp, Artificial Sequence
  Synthetic
ctactgcagctgcagctgtaagtgcagctgcaaatgcatctcgggcccctgtagccgctgctgttcagcgtgtta

SEQ ID NO: 169978 - DNA, 75 bp, Artificial Sequence
  Synthetic
gtagccgctgctgttcagcgtgttacaaggagacgatgatttacgacatggtccaatacggtcatcgacggcgtc

SEQ ID NO: 169979 - DNA, 75 bp, Artificial Sequence
  Synthetic
acccgcgtcgaggacacacgcagaagaagcgtccggccgaggggaggggggggggctcgcgggccccggggcgca

SEQ ID NO: 169980 - DNA, 75 bp, Artificial Sequence
  Synthetic
gccatgaccaccaaaaagctagccgtcacgactagaaatgtgtaggattcggactttccgttcgagaagaaagag

SEQ ID NO: 169981 - DNA, 75 bp, Artificial Sequence
  Synthetic
cggaggtggcgggggtgtttgcggcgaggacggggtgtttcggggccaggggtggcgccggcggggacgggggtt

SEQ ID NO: 169982 - DNA, 75 bp, Artificial Sequence
  Synthetic
tgtgcggggacgggggtgtgcggggacggaggttccgttggggacggggactcaagggaccggcggtggcgggga

SEQ ID NO: 169983 - DNA, 75 bp, Artificial Sequence
  Synthetic
tgcaaaataaaaccattttattgagcattgtaatggtagtgtgtggctacattagaaaacgtgacgcgtcgcatg

SEQ ID NO: 169984 - DNA, 75 bp, Artificial Sequence
  Synthetic
atgaaaaaaaaaatttcgttttgccatcaagtggtgacgataacccgtcagattgataattggttcctacagaaa

SEQ ID NO: 169985 - DNA, 75 bp, Artificial Sequence
  Synthetic
gttttttttttaatgtaccaagaataaaaagtgcgtctacgaccaaagcggtgtgtggacgctcgtcctctgtct

SEQ ID NO: 169986 - DNA, 75 bp, Artificial Sequence
  Synthetic
tttacgtcattgggaaaccccagaatgaaagagtataatgtgcatatcaccgggggttccctgtcagtacgaatg

SEQ ID NO: 169987 - DNA, 75 bp, Artificial Sequence
  Synthetic
tgaaagagtataatgtgcatatcaccgggggttccctgtcagtacgaatgtacacaacgcgggttacattacgat

SEQ ID NO: 169988 - DNA, 75 bp, Artificial Sequence
  Synthetic
tatatagtaacgaacatgctgtggatattagttttatttgcactcgccgcatcggcgagtgaaaccactacaggt

SEQ ID NO: 169989 - DNA, 75 bp, Artificial Sequence
  Synthetic
ggcgaaaagaagacgtgtgtctgtgtggagttgattccccgacgtgtgtctgtgtctgtgtgattccccggggcg

SEQ ID NO: 169990 - DNA, 75 bp, Artificial Sequence
  Synthetic
gcgtgtcgtcccatggtctttgtcagcggcacggcgctggggacggggtttcaccgcgctgagggatctttctgc

SEQ ID NO: 169991 - DNA, 75 bp, Artificial Sequence
  Synthetic
ggcagtagctggacagtaccacagctcgcgctgcttgccgctagcggctggacattatctggactccttctctta

SEQ ID NO: 169992 - DNA, 75 bp, Artificial Sequence
  Synthetic
ggccggggcgttgcgggtacggggattacgctgggaacggggactcgcggacccgggctgagggacgggggtggc

SEQ ID NO: 169993 - DNA, 75 bp, Artificial Sequence
  Synthetic
cgcgacacacccggcacacacccacccagccgcaccccccacacaccccgaccgccgccggtgcgggacggggct

SEQ ID NO: 169994 - DNA, 75 bp, Artificial Sequence
  Synthetic
gtatacacgttcatcataaaacaccgtagaggctaaggcttcggtagggagagacctcaactgttcctgatgagc

SEQ ID NO: 169995 - DNA, 75 bp, Artificial Sequence
  Synthetic
gatgtgatgaatctcccacataggaggcgccacgtattccgtattgctgcccagcagataagtggtgtggatgta

SEQ ID NO: 169996 - DNA, 75 bp, Artificial Sequence
  Synthetic
tccacaaagtctatcttttgtacggcacggtcccggtttagcaggtaggccgtggtgggcaacgcgttgcgaacg

SEQ ID NO: 169997 - DNA, 75 bp, Artificial Sequence
  Synthetic
tgtttgtaaacggcaccctaggtgtgcggtataacattacggtaggaatcagttcgtctttattaataggacacc

SEQ ID NO: 169998 - DNA, 75 bp, Artificial Sequence
  Synthetic
accgcgggcacatgtcttgtagaaagatgtaatcactttccgcgtatttcgccagtgttaacatcacagtggtag

SEQ ID NO: 169999 - DNA, 75 bp, Artificial Sequence
  Synthetic
gttaaacataagctacgttttatcacaaaaaacgaataacacaacatcaccgtggatatatgccatacctatggg

SEQ ID NO: 170000 - DNA, 75 bp, Artificial Sequence
  Synthetic
aaacatgatccagatgagttttggactaaaacctaacatgcacatcaataaacttttttgtatttttagccaata

SEQ ID NO: 170001 - DNA, 75 bp, Artificial Sequence
  Synthetic
aggatgataccgttcggccccatgagttatttttattcttccggtaggaggcatgaagcctctgataatgctcat

SEQ ID NO: 170002 - DNA, 75 bp, Artificial Sequence
  Synthetic
gttatttttattcttccggtaggaggcatgaagcctctgataatgctcatctgctttgctgtgatattattgcag

SEQ ID NO: 170003 - DNA, 75 bp, Artificial Sequence
  Synthetic
caaagagttactaaagtatgcacggattataccagtgtaacgtgtaccccttgccccaacggcacgtatgtatcg

SEQ ID NO: 170004 - DNA, 75 bp, Artificial Sequence
  Synthetic
gattcgtaactgcacttccaccaataataccgtatgcgcacctaagaaccatacgtacttttccactccaggcgt

SEQ ID NO: 170005 - DNA, 75 bp, Artificial Sequence
  Synthetic
ttttttagcatatgtgtatcattatgaggtgaatggaacagaattacgctgcagatgtcttcatagaaaatggcc

SEQ ID NO: 170006 - DNA, 75 bp, Artificial Sequence
  Synthetic
gaggtgaatggaacagaattacgctgcagatgtcttcatagaaaatggccgcctaataaaattatattgggtaat

SEQ ID NO: 170007 - DNA, 75 bp, Artificial Sequence
  Synthetic
catcccgccttaagcgatgagtctataaagcaccgttgtccgggtacggtaaaagtgacccggattgtagcacgt

SEQ ID NO: 170008 - DNA, 75 bp, Artificial Sequence
  Synthetic
gttttccacggacatggtttcgttgtaatataaggagctcatgtcaagagtgccgtaaatagtgtacggtgtttc

SEQ ID NO: 170009 - DNA, 75 bp, Artificial Sequence
  Synthetic
ccgcctggacctggagtatgtttatcgcccgatcacctcttctcaaaatggttagacaaacacaacgataatagg

SEQ ID NO: 170010 - DNA, 75 bp, Artificial Sequence
  Synthetic
cgcccgatcacctcttctcaaaatggttagacaaacacaacgataataggtggtataatgttaacataacgaaat

SEQ ID NO: 170011 - DNA, 75 bp, Artificial Sequence
  Synthetic
caagttcgttaaaacaaaatattacagtatgtgtttaatatggtgctaacatggttgcaccatccggtttcaaac

SEQ ID NO: 170012 - DNA, 75 bp, Artificial Sequence
  Synthetic
caatcctggtgttgcgcgcgaaaatggtccaggcaggagactccatctgcgcggcgatgtgtgttgttacccact

SEQ ID NO: 170013 - DNA, 75 bp, Artificial Sequence
  Synthetic
tcgcatatcaatctgttatcggtacgacacctgtcattaatcgcatatatgttacttaccatatgtcccctagcc

SEQ ID NO: 170014 - DNA, 75 bp, Artificial Sequence
  Synthetic
acgccaagagactgaactaccaccacttcagactgcgctggtgatcatgtccctattttaccgtgcggtagctct

SEQ ID NO: 170015 - DNA, 75 bp, Artificial Sequence
  Synthetic
gcttccgacgtgagctcccatcttctaacggttacacaatcccgttggacaatacatcatatgtacaataaactg

SEQ ID NO: 170016 - DNA, 75 bp, Artificial Sequence
  Synthetic
ccacaacagttttttacaccgcaggtagacgtggtacgctttgctctatatctagaaacactctcccggatcgtg

SEQ ID NO: 170017 - DNA, 75 bp, Artificial Sequence
  Synthetic
tatgaacttacggaagccgccaatacagcacgtacaaatagcagtgactgggtaacgttaggaaccagtgcgtcg

SEQ ID NO: 170018 - DNA, 75 bp, Artificial Sequence
  Synthetic
acgtcgccacatctcgagaatgccggccttgcggggtccccttcgcgcaacattcctggccctggtcgcgttcgg

SEQ ID NO: 170019 - DNA, 75 bp, Artificial Sequence
  Synthetic
cagaaataacgtcgacaacgccacgagtagcggacccacaaccgggatcaacatgaccaccacccacgagtcttc

SEQ ID NO: 170020 - DNA, 75 bp, Artificial Sequence
  Synthetic
atactgaaaaacttgaagaaatagatagcaagccagatattatacgacgatgttttttgaatcatacattgtttc

SEQ ID NO: 170021 - DNA, 75 bp, Artificial Sequence
  Synthetic
gaggatgttagtgttaggtaattcgtgttgttcacgtttacttgatatgtataggtaggtgtactgtttgtgagg

SEQ ID NO: 170022 - DNA, 75 bp, Artificial Sequence
  Synthetic
tggcaaaataggtaccaacgttacgttgaacgcggtagatgttctccacaatgatcacgttcgctggtcatacgg

SEQ ID NO: 170023 - DNA, 75 bp, Artificial Sequence
  Synthetic
cgtgatctgagtgtcgttacattgagtacaattagtacagttgtaaagccctgtgagataagtgccgttggggca

SEQ ID NO: 170024 - DNA, 75 bp, Artificial Sequence
  Synthetic
gagggctccgtctgcgtcaagacgggcctggtatacgaggctctctatccggtggcgcgtagccacctgttggaa

SEQ ID NO: 170025 - DNA, 75 bp, Artificial Sequence
  Synthetic
atctccgagctcattttcagacacataccctaccgccacggccttgtgcggcacactggtggtggtgggcatcgt

SEQ ID NO: 170026 - DNA, 75 bp, Artificial Sequence
  Synthetic
cacccccagcaagaacgtaactctcagtcagggggggtccaccaccgacggaaacgaagattactccggggaaga

SEQ ID NO: 170027 - DNA, 75 bp, Artificial Sequence
  Synthetic
gcggggttcatatccccgggcaacggcgccgtcggagcccagggcgagttaccgttgaccggggtttgggtaccc

SEQ ID NO: 170028 - DNA, 75 bp, Artificial Sequence
  Synthetic
tatcctactagtgaaaatggactagcaggaagggttcctatcgtaacgttgtaccggacacctagggtgccgttt

SEQ ID NO: 170029 - DNA, 75 bp, Artificial Sequence
  Synthetic
ccccggccgtgtacatcacatccttcaccacgaccggcggcagcggcggcgacgaggacaactcgctctcgacgg

SEQ ID NO: 170030 - DNA, 75 bp, Artificial Sequence
  Synthetic
ccctgtcccgcaccggcgccgttcggggtgtgtcgggggcgcggctgggtgggtgggtgtgtgccgggtgtgtcg

SEQ ID NO: 170031 - DNA, 75 bp, Artificial Sequence
  Synthetic
gggtgtgtcgggggcgcggctgggtgggtgggtgtgtgccgggtgtgtcgcgggcgtgtgtcgggtgtgtcgggg

SEQ ID NO: 170032 - DNA, 75 bp, Artificial Sequence
  Synthetic
tcgccgtccacacacgcaactccaattttcacccccccgctaaaaacacccccccgcccctcggggacccaccac

SEQ ID NO: 170033 - DNA, 75 bp, Artificial Sequence
  Synthetic
caacaccccgggccagcgcaacccccgtccccgcaacacgccgtccccgccggcggccagcacgcccgaaaaccc

SEQ ID NO: 170034 - DNA, 75 bp, Artificial Sequence
  Synthetic
cggcggccagcacgcccgaaaacccgcggaaggcgaagcgccgcgctgacggaacgcaaacctcccgcagcccgg

SEQ ID NO: 170035 - DNA, 75 bp, Artificial Sequence
  Synthetic
gtgtcgcgggtgtgtcggtcgggtgtgtcgcgggcgtgtggcgggtgtgtcgcgggtgtgtcaggggtgtgtcgg

SEQ ID NO: 170036 - DNA, 75 bp, Artificial Sequence
  Synthetic
tgtcgcgggcgtgtggcgggtgtgtcgcgggtgtgtcaggggtgtgtcggcggtgtgccgggtgtgtcaggggtg

SEQ ID NO: 170037 - DNA, 75 bp, Artificial Sequence
  Synthetic
aagtgtgccccggggtccgcgagccccccccctcccctcggccggacgcctcttctctcgacgcggcttgtgccg

SEQ ID NO: 170038 - DNA, 75 bp, Artificial Sequence
  Synthetic
tcttctctcgacgcggcttgtgccgtacttcgtggccgttgcttccccctcttttccgcgcgcggccgtccccct

SEQ ID NO: 170039 - DNA, 75 bp, Artificial Sequence
  Synthetic
tatccagggcccgatatgtaaccagacccacaacagtacctcgtaaataaagacgcacagacctcacgcatatag

SEQ ID NO: 170040 - DNA, 75 bp, Artificial Sequence
  Synthetic
ccgccgcaatcaacccccgtccccgcaatcaacccccgtccccgcaatcaacccccgtcctcgccgcaatcaacc

SEQ ID NO: 170041 - DNA, 75 bp, Artificial Sequence
  Synthetic
ggctcggagcagagccgaacggcggtttttccacatgatggataacgtagtccaatatttccacccctggcattg

SEQ ID NO: 170042 - DNA, 75 bp, Artificial Sequence
  Synthetic
tgtttcttctgttgtttttcgcaagcttaacgctcctcttaagaaaccgcggacacatgtcttgtagaaaaatgt

SEQ ID NO: 170043 - DNA, 75 bp, Artificial Sequence
  Synthetic
cttaacgctcctcttaagaaaccgcggacacatgtcttgtagaaaaatgtaatcactttccgcatataccgttaa

SEQ ID NO: 170044 - DNA, 75 bp, Artificial Sequence
  Synthetic
ggccgcaacacgccgcagacgccgcgccgcgctgacgggcccgcaaagccgtccctcagcccggtgccgcgaaca

SEQ ID NO: 170045 - DNA, 75 bp, Artificial Sequence
  Synthetic
ggatgactcaaacggactcgtgcgcgccagtgcccgtaatacgtaactgcggccggtaaggttaagcgtcagctg

SEQ ID NO: 170046 - DNA, 75 bp, Artificial Sequence
  Synthetic
ggccggtaaggttaagcgtcagctgtcccatggtaatgttagtgtcatttgtaaaacacgcaacctccccgtaga

SEQ ID NO: 170047 - DNA, 75 bp, Artificial Sequence
  Synthetic
gtgtgtcgcgggcgtgtgccgggtgtgtcgggggtgtgttggcggggtgtgtcagggtgtgccgcgggtgtgtcg

SEQ ID NO: 170048 - DNA, 75 bp, Artificial Sequence
  Synthetic
cagccttccaggtggtactgaaaaccaaacgtgagcatgacgctgtgccactgccgacgtgattgccgaaacgtt

SEQ ID NO: 170049 - DNA, 75 bp, Artificial Sequence
  Synthetic
acgttcaagggcagtttggattcggctccggcgcaggggccgttgtagatttgcgtatgattgcacgtgcagttt

SEQ ID NO: 170050 - DNA, 75 bp, Artificial Sequence
  Synthetic
gccccggggcccgcgagcccccccccctcccctcggccggacgcttcttctgcgcgtgtcctcgacgcgggttgc

SEQ ID NO: 170051 - DNA, 75 bp, Artificial Sequence
  Synthetic
aacgttgctggaacgcagttctttctgcgagtaaagttccagtaccctgaagtcggtgttttccagcgggtcgat

SEQ ID NO: 170052 - DNA, 75 bp, Artificial Sequence
  Synthetic
ggcgcgacacgtcgtaaacatggcccatatgaaaaagagcatgccgaacgaccagctgatgccggtgcggtattc

SEQ ID NO: 170053 - DNA, 75 bp, Artificial Sequence
  Synthetic
agtagatgatggagatgatagcgtagaccacgaagacggctaacaccatgtggcctgtacgcacgaaaaagttgt

SEQ ID NO: 170054 - DNA, 75 bp, Artificial Sequence
  Synthetic
cacacacgataggggtacttggtggtgttaacccccaccacatctccgtacttgagggtggtgttgtagatagtc

SEQ ID NO: 170055 - DNA, 75 bp, Artificial Sequence
  Synthetic
tattgcaggtcctgctgccactgcttttccgtgcggaaagtcgccatgtcttccacacgtgtagcgacgatagac

SEQ ID NO: 170056 - DNA, 75 bp, Artificial Sequence
  Synthetic
gggtaaaacggtgatgaagcataaaaacaccgtggggggggggggcttggtggcggtggccattagatgcatttt

SEQ ID NO: 170057 - DNA, 75 bp, Artificial Sequence
  Synthetic
agcaattatgcgtattgtggtgcggattatcgtgtacttgtgtgcgtatgacgacacgcgtaccctatcgctgta

SEQ ID NO: 170058 - DNA, 75 bp, Artificial Sequence
  Synthetic
cgacgtggaggggggtagcagcaatgatacgtgttgtaatacaggttaccgtgtactggtgcgcgtgttacgatg

SEQ ID NO: 170059 - DNA, 75 bp, Artificial Sequence
  Synthetic
tccagttagggggagtgccgcctcgccgtcaccgggaaacttacgtgtaagaacacggcgtgacaataaacaaca

SEQ ID NO: 170060 - DNA, 75 bp, Artificial Sequence
  Synthetic
tttcggggcggcgccggcggtggggacggcgcgttgcggaaccggggacagtggtggggacggagacacggggtg

SEQ ID NO: 170061 - DNA, 75 bp, Artificial Sequence
  Synthetic
ggtgggtccccgaggggcgggggggtgtttttagcgggggggtgaaaattggagttgcgtgtgtggacggcgacg

SEQ ID NO: 170062 - DNA, 75 bp, Artificial Sequence
  Synthetic
acggcagcgcctgtcgtaatcttctagttctaaaacatggacggctaggggacatatggtaagtaacatatatgc

SEQ ID NO: 170063 - DNA, 75 bp, Artificial Sequence
  Synthetic
catattaaacacatactgtaatattttgttttaacgaacttgtctgtttgaaaacatacattaaatattatcctc

SEQ ID NO: 170064 - DNA, 75 bp, Artificial Sequence
  Synthetic
ccgaggggcgggggggtgtttttagcgggggggtgaaaattggagtcttggagtcgcgtgtgctgtggaggtgcg

SEQ ID NO: 170065 - DNA, 75 bp, Artificial Sequence
  Synthetic
taacacctatcaaggttatatttattcgtctcggttctggtgatttcgttatgttaacattataccacctattat

SEQ ID NO: 170066 - DNA, 75 bp, Artificial Sequence
  Synthetic
cgtctggatacaataaatgttcatttttatcgcatccgggccctctgggatcgcgatgaagccaataattaccca

SEQ ID NO: 170067 - DNA, 75 bp, Artificial Sequence
  Synthetic
tcgcgatgaagccaataattacccaatataattttattaggcggccattttctatgaagacatctgcagcgtaat

SEQ ID NO: 170068 - DNA, 75 bp, Artificial Sequence
  Synthetic
acaccccgccaacacacccccgacacacccgacacacgcccgcgacacacccggcacacgcccgcgacacacccg

SEQ ID NO: 170069 - DNA, 75 bp, Artificial Sequence
  Synthetic
gtgcgtgtcgtcccgcggtctttgttcgcggcacggcgctggggaatttgtgcgcgctgagggatctctctacgg

SEQ ID NO: 170070 - DNA, 75 bp, Artificial Sequence
  Synthetic
tcccctccttaatcagttgttcatgtaggcgtgtggcggggtgaggggcggcatgccgttggcggcgccgggaat

SEQ ID NO: 170071 - DNA, 75 bp, Artificial Sequence
  Synthetic
tggggacggggactcgcggggacggggattacgttggggacggcgatggcgggggtgtttgcggcaaggacgggg

SEQ ID NO: 170072 - DNA, 75 bp, Artificial Sequence
  Synthetic
ggattacgttggggacggcgatggcgggggtgtttgcggcaaggacggggtgtgcggggacgggggtggcgccgg

SEQ ID NO: 170073 - DNA, 75 bp, Artificial Sequence
  Synthetic
tccctgctgggaacacgtaccaccacatcgattcgtcgtgccgtagaaccgtagagttttccgaacttttataca

SEQ ID NO: 170074 - DNA, 75 bp, Artificial Sequence
  Synthetic
accgaaacaccgtgtcccgtgctccaaagcagcgtcaacaacagccacacagacacctacgtggggacgacacgg

SEQ ID NO: 170075 - DNA, 75 bp, Artificial Sequence
  Synthetic
gtttccacaggaaatcctaccaggcaaagccccgcttgttttgttcctgaccatcttgtttagcaactcgtaaac

SEQ ID NO: 170076 - DNA, 75 bp, Artificial Sequence
  Synthetic
aaacaccacccacaccacgccgcttcacccagaggaccaacacacgtgccccttacaccacagcaacacacaacc

SEQ ID NO: 170077 - DNA, 75 bp, Artificial Sequence
  Synthetic
tggatgtggcggtggtattactaggggaagtaacggcgcttgtggtgctactttccactcccgggtgcgtgtcgc

SEQ ID NO: 170078 - DNA, 75 bp, Artificial Sequence
  Synthetic
tgtatccgcgtgtaatgcacgcggtgtgctttttagcactcggcttgataagctacgtggccgtttgcgccgaaa

SEQ ID NO: 170079 - DNA, 75 bp, Artificial Sequence
  Synthetic
ctttgtttggtatcgcggctacgaattccctgcgccgacgccgcaggcgacgacggcgggtggtggtggtggtgg

SEQ ID NO: 170080 - DNA, 75 bp, Artificial Sequence
  Synthetic
gttcaccatcttcttcgtcattcaaccgatgacccactccgtacaacgaatcagtctgctgcgtcatattgcaaa

SEQ ID NO: 170081 - DNA, 75 bp, Artificial Sequence
  Synthetic
aagcaaaatcacaaagaaaatacacatgcagcacctagatatccagtttaaccccgtatatcacaagtctctgtc

SEQ ID NO: 170082 - DNA, 75 bp, Artificial Sequence
  Synthetic
gtcgaagcgacagccgctgccgtagtacatagcttcgttcaacggccggcgggccgggtcgccgagttccgggtc

SEQ ID NO: 170083 - DNA, 75 bp, Artificial Sequence
  Synthetic
actttaacgttccggcaacccggagacacagactacgaactagaaataacgttaaccacatactgtaattacaaa

SEQ ID NO: 170084 - DNA, 75 bp, Artificial Sequence
  Synthetic
tgccatgatcaattgagcccaccaccttttttttaagagaggaggaatttcgtcttgatctccagccggagataa

SEQ ID NO: 170085 - DNA, 75 bp, Artificial Sequence
  Synthetic
gtgttttaatatgtatccgcgtgtaatgcacgcggtgtgctttttagcactcggcttgataagctacgtggccgt

SEQ ID NO: 170086 - DNA, 75 bp, Artificial Sequence
  Synthetic
agattcagactggagcggttggccaaacgttcgagttccaccagagatttttgcttgataccttgccagaacact

SEQ ID NO: 170087 - DNA, 75 bp, Artificial Sequence
  Synthetic
agctgcgtgtgcgtgccatcccgcgactccccgtccccgccgccaaaagcccgcaagtccccgccgccaaccccc

SEQ ID NO: 170088 - DNA, 75 bp, Artificial Sequence
  Synthetic
cgtccccggccccgcaacgcgccgtccccaccaccgtccccgccgcaaaaggcccccgtgcccggccccgcacac

SEQ ID NO: 170089 - DNA, 75 bp, Artificial Sequence
  Synthetic
atgtgcggtatgattttgctgtcgttgcttgtgatgttggacgcctggagtggaaaagtacgtatggttcttagg

SEQ ID NO: 170090 - DNA, 75 bp, Artificial Sequence
  Synthetic
ctatctgcgtcggaaaattatgacggaaattatgaactaacggaaaccgccaatacaacgcgtacaaatagcagt

SEQ ID NO: 170091 - DNA, 75 bp, Artificial Sequence
  Synthetic
ctggcggggtgtgtcaggggtgcggtgtgcgcggctggatggaagcagtgtgccccggggtctgcgacccccccc

SEQ ID NO: 170092 - DNA, 75 bp, Artificial Sequence
  Synthetic
tccctggggacacacgcagaacggacgactcccaggggccagcgacgcggaaacgacgcggaaaagaggaagtcc

SEQ ID NO: 170093 - DNA, 75 bp, Artificial Sequence
  Synthetic
acgttaattcttattaacctaaccgcaacatatagtaggaactattactttcaatctcttaaaactcttgggcaa

SEQ ID NO: 170094 - DNA, 75 bp, Artificial Sequence
  Synthetic
acacccaccccacgcacgcacccacccagccgcgcccccggcacacccaacccgacgccggtgcgggacggggct

SEQ ID NO: 170095 - DNA, 75 bp, Artificial Sequence
  Synthetic
gggcgaccgctgaagcgagctgcgtgtgcgtgccgtctgtgttccccgccgcgaaaggcccccgtccccggcgcc

SEQ ID NO: 170096 - DNA, 75 bp, Artificial Sequence
  Synthetic
gcggcagcagcggcggcgccgacggtgatggtgggtccgacggcgatggcgggtccggcggcgtcggggaccgtg

SEQ ID NO: 170097 - DNA, 75 bp, Artificial Sequence
  Synthetic
aaggcccccgtccccggccccgcacacccccgtccccgacgtcaccccgtgtctccgtccccaccaccgtccccg

SEQ ID NO: 170098 - DNA, 75 bp, Artificial Sequence
  Synthetic
cgaccacgagaacgacaactaccaccacaacaaagaaaacaaccaccacaaggacgacaacaaccaccactaccg

SEQ ID NO: 170099 - DNA, 75 bp, Artificial Sequence
  Synthetic
cattgcgcccggtaacattcaccaacggacgcagccaactttcatacttgtcaccctgaaacacctcacccaaca

SEQ ID NO: 170100 - DNA, 75 bp, Artificial Sequence
  Synthetic
tcccctcccttgcggccgcgcggctggatggaagcagtgtgccccggggtccgcgacccccccccccccgggcga

SEQ ID NO: 170101 - DNA, 75 bp, Artificial Sequence
  Synthetic
gacaagtctgaagagatgagagcgcgggtgctcatcaggaacagttgaggtgtctccctaccgaagccttagcct

SEQ ID NO: 170102 - DNA, 75 bp, Artificial Sequence
  Synthetic
ccacacacgcaactccacttttcacccccccgcaaaaaacacccccccgcccctcggggacccagcacacggccc

SEQ ID NO: 170103 - DNA, 75 bp, Artificial Sequence
  Synthetic
ccccccgcaaaaaacacccccccgcccctcggggacccagcacacggcccggaatggatgccgggcgtccaccta

SEQ ID NO: 170104 - DNA, 75 bp, Artificial Sequence
  Synthetic
agctgtattgtgctagccccacttagcgtcatgggtaaaacggtgataaagcgtcaaaacagcatgggggggggg

SEQ ID NO: 170105 - DNA, 75 bp, Artificial Sequence
  Synthetic
ccctcacgcttgtcatagtcacgtcgctgtttttgttcacaactcagggaagtttatcgaacgccgtcgaaccaa

SEQ ID NO: 170106 - DNA, 75 bp, Artificial Sequence
  Synthetic
atagcggaccgtgagaggctgacagcttacgaagcaaaatcacaaagaaatacacatgcagcacctagatatcca

SEQ ID NO: 170107 - DNA, 75 bp, Artificial Sequence
  Synthetic
gtttttagcgggggggtgaaatttggagtcggagtcttggagtcgcgtgtgctgtggaggacggtgacggtggta

SEQ ID NO: 170108 - DNA, 75 bp, Artificial Sequence
  Synthetic
actccgtcatgaaagatcgtaataaactacttatatgtattatctttattttcaccatgtgcctcatctgtcttt

SEQ ID NO: 170109 - DNA, 75 bp, Artificial Sequence
  Synthetic
caccgccgacacacccctgacacacccgcgacacacccgccacacgcccgcgacacacccgaccgacacacccgc

SEQ ID NO: 170110 - DNA, 75 bp, Artificial Sequence
  Synthetic
ccggttgatgtagccgcgcaacgtgtcgtaggtgaactgcagctgggcgtagaccagattgtgtaccgagtccat

SEQ ID NO: 170111 - DNA, 75 bp, Artificial Sequence
  Synthetic
tgtgtggacggcgacggcgaatagttgcgtgtggtgcggtgtggtggtgcggtggggaataaaagcgacgtgcgc

SEQ ID NO: 170112 - DNA, 75 bp, Artificial Sequence
  Synthetic
ttcgaagacggacacgtttccgtacttttcatatgtctgattgtatgaagcattaaaaatctgctgtaacttatt

SEQ ID NO: 170113 - DNA, 75 bp, Artificial Sequence
  Synthetic
ggggacgggcgacgccccggctcgacggcagtcggccccggagggttgggggctgggggcccggtcaggagctcc

SEQ ID NO: 170114 - DNA, 75 bp, Artificial Sequence
  Synthetic
gatttgactaagaaagtcttggcaccaaaagtcccgttagagccccagcaggtgacgctgctatttacataagtt

SEQ ID NO: 170115 - DNA, 75 bp, Artificial Sequence
  Synthetic
ggtgacgctgctatttacataagttccaggtgcccccgctagcatgtatttcagttggtgggtataattttttct

SEQ ID NO: 170116 - DNA, 75 bp, Artificial Sequence
  Synthetic
aacaccgtacggtgtttgtggcctccaaaatcacatcagctaacaaaccgtgaaaagtcacgtttcacgaacacg

SEQ ID NO: 170117 - DNA, 75 bp, Artificial Sequence
  Synthetic
aatagcgtcacccccgcacggtacatagttaccctctcgacgtcgccggctgtcaatgacgtgcctgcgtcagtg

SEQ ID NO: 170118 - DNA, 75 bp, Artificial Sequence
  Synthetic
tgggccatgtgtggtggcagatggcggtgtccacttgtgcttgtcgcggcagcgcacagacgaagcaacatgtcg

SEQ ID NO: 170119 - DNA, 75 bp, Artificial Sequence
  Synthetic
gtagatagtctcgttggctctatgactgacggcttcagaagacgttacgcgttgagaggagattgaccgggtttg

SEQ ID NO: 170120 - DNA, 75 bp, Artificial Sequence
  Synthetic
gtccccgtccccgacgtcactccgtgtctccgttctcgtccccgtccccgccgcgaaaggcccccgtccccgccg

SEQ ID NO: 170121 - DNA, 75 bp, Artificial Sequence
  Synthetic
cccgtccccgcacaccccccgtccccggcgcaacccccgtccccgtccccagcgtaactcccgttaccagcgccg

SEQ ID NO: 170122 - DNA, 75 bp, Artificial Sequence
  Synthetic
ctgcatggttttgcaagctttgatggcctcatctaacacctggtgcatactgggaatcgtgaagggcaggttctt

SEQ ID NO: 170123 - DNA, 75 bp, Artificial Sequence
  Synthetic
tcttcacctcatgattgcgggtgtagatgatctggatgcccttgttgttcacctgcatggttttgcaagctttga

SEQ ID NO: 170124 - DNA, 75 bp, Artificial Sequence
  Synthetic
caatggcagcaagtgccacgcgatgtgcaaatgccgggtcacagaacccattaccatgctaggcgcatactcggc

SEQ ID NO: 170125 - DNA, 75 bp, Artificial Sequence
  Synthetic
atcatacaagcgtcactggtgaccttgtactcattacacatggtttccacacatgtagtgaggatatccataaat

SEQ ID NO: 170126 - DNA, 75 bp, Artificial Sequence
  Synthetic
gctcattttcagacacataccctaccgccacggccttgtgcggcacactggtggtggtgggcatcgtgctgtgcc

SEQ ID NO: 170127 - DNA, 75 bp, Artificial Sequence
  Synthetic
cataaacactccagtcccaaaaaatccaccacccctaacagtcacgtagaacatcacgttggttttgaagccaca

SEQ ID NO: 170128 - DNA, 75 bp, Artificial Sequence
  Synthetic
atgcggtcagtgacaggtatcgtaccgataagagtttgatgtacgaattcggaatcgaatggtgtaaccatgtta

SEQ ID NO: 170129 - DNA, 75 bp, Artificial Sequence
  Synthetic
aataaaaaaaccatcgcaggccagaggctaagccgaaaccgtccggggaagcgggcgcgagttttccgacttagt

SEQ ID NO: 170130 - DNA, 75 bp, Artificial Sequence
  Synthetic
acaattcatccacgtcaacctctgcaactacatcaaagtcttctgctagcgtatcaactaccaaactaacaacag

SEQ ID NO: 170131 - DNA, 75 bp, Artificial Sequence
  Synthetic
gtcacgtttgtggcgttcgtagagcacgcgacttccccacggacctctgtgacgtttatctcacggctttcattc

SEQ ID NO: 170132 - DNA, 75 bp, Artificial Sequence
  Synthetic
gacgtttatctcacggctttcattcagaattcgcaggggaaaccagccttccagatgatactgaaaaccaaattt

SEQ ID NO: 170133 - DNA, 75 bp, Artificial Sequence
  Synthetic
atgaagcttagcaaacagaggatggctaaccgtcgttgcatgttccaggccatgagccaggctaggcccgtacac

SEQ ID NO: 170134 - DNA, 75 bp, Artificial Sequence
  Synthetic
aatgtgtcacccattacgtcgactctagcggtaaattccagcgcgtttaaacacgttagttatcaacggcaacag

SEQ ID NO: 170135 - DNA, 75 bp, Artificial Sequence
  Synthetic
attcaacagaatttggttgttacaacgacagcgtttgtcgtaatcttccaattctaaaagatggacggctagggg

SEQ ID NO: 170136 - DNA, 75 bp, Artificial Sequence
  Synthetic
acatatggcaaataacatgtatgcagtcaattgcatatatcgtaccgataaaatgttagtgtgcggattcagaat

SEQ ID NO: 170137 - DNA, 75 bp, Artificial Sequence
  Synthetic
atatcgaaaaagtatacatattaccgattcattataattagggaattatttccaacgcggacgtttgttagtgac

SEQ ID NO: 170138 - DNA, 75 bp, Artificial Sequence
  Synthetic
ctctgtgccatgagttgtcttttttaccatccagccatttcgacaaatgatgatcaggagctaaacatacaggtt

SEQ ID NO: 170139 - DNA, 75 bp, Artificial Sequence
  Synthetic
gcccagcgccacctccaccaagttgacgatgagcgtgcggaactgcaccgtgcccttgagcttggggtgcaggcg

SEQ ID NO: 170140 - DNA, 75 bp, Artificial Sequence
  Synthetic
ttgggagggtcacgaccaacccaaaataagccacctataggatgatgtaaagctttgtgggtacacggacaacgc

SEQ ID NO: 170141 - DNA, 75 bp, Artificial Sequence
  Synthetic
acggttacatgtgcggtatgattttgtcgttgcttgtgatgttggacgcctggaacggaaaacgacgtataattc

SEQ ID NO: 170142 - DNA, 75 bp, Artificial Sequence
  Synthetic
tggaagtgcagttacgaattgtaacctcagtgtcattacactcagtgcaattggtacaattgtaaagccctgata

SEQ ID NO: 170143 - DNA, 75 bp, Artificial Sequence
  Synthetic
ggctataagatagagaattaaaagtatgatacccacgagaaagatgaagagggacaaccaggctagagtatgacg

SEQ ID NO: 170144 - DNA, 75 bp, Artificial Sequence
  Synthetic
catacgtgccgttagggcaaagtgtacatgttgtactcgtatattgcgtacattgtcctgtaacacgatatcctt

SEQ ID NO: 170145 - DNA, 75 bp, Artificial Sequence
  Synthetic
cattgtcctgtaacacgatatccttgtttacatgggggacaacactgatttcctaattgcacttcttcgggtttg

SEQ ID NO: 170146 - DNA, 75 bp, Artificial Sequence
  Synthetic
aaaaaaaaaggcacccctcggtagcgacctctcaccatcgtttgcccgtccgcccgtccttcgtagccatcatca

SEQ ID NO: 170147 - DNA, 75 bp, Artificial Sequence
  Synthetic
gcgcctattgtggctgtagcgcccataggtatggcgtatacccacggtgatgttgtgttattcgttttttgtgat

SEQ ID NO: 170148 - DNA, 75 bp, Artificial Sequence
  Synthetic
cagggagctctagcagcaactcgtccacgtcaacgtcttcaactacaccaagtccttctagtgtgtcgacgagta

SEQ ID NO: 170149 - DNA, 75 bp, Artificial Sequence
  Synthetic
ggccgacacgcatcaggcttttataggcagcgacgtgtacggcgcttgctggcgccgccttggcgccgcgcaggt

SEQ ID NO: 170150 - DNA, 75 bp, Artificial Sequence
  Synthetic
ttttggatccagggtgtgaaccatgactccaatgtttgtatagtaaggtgtcctactaataaagacgaactgatt

SEQ ID NO: 170151 - DNA, 75 bp, Artificial Sequence
  Synthetic
gtggtgcggtggggacggcggtcgcggaggacggcgacggcgaataaaagcgacgtgcgcggcgcacgtcgcaaa

SEQ ID NO: 170152 - DNA, 75 bp, Artificial Sequence
  Synthetic
acataggattgaacgtggtgaagttaccgcagccttcttcgccggtatcattacgcttggaaacatttaacatct

SEQ ID NO: 170153 - DNA, 75 bp, Artificial Sequence
  Synthetic
caaggttcgtcgggccggctgagcgtctccagttgcgtgagaattacgaagcgttgcatgatgaggccgtggctg

SEQ ID NO: 170154 - DNA, 75 bp, Artificial Sequence
  Synthetic
gcaaaggcagcaagtaaatatgagaaggagtccagataatgtccagccgctagcggcaagtagcgcgagctgtgg

SEQ ID NO: 170155 - DNA, 75 bp, Artificial Sequence
  Synthetic
gtgtagaagcggggggattaagacgttaataaagagtagcggcggttctgataggccgaccgctgaagcaaactg

SEQ ID NO: 170156 - DNA, 75 bp, Artificial Sequence
  Synthetic
agtagattgactggaattagagctggtacctgtagtggtttcactcgccgatgcggcaagtgcaaataaaactaa

SEQ ID NO: 170157 - DNA, 75 bp, Artificial Sequence
  Synthetic
tgcataaagggcgagcgtccccggagagggtatattcgttcggcgagagcgggcggcggtggtgggtatgtcccc

SEQ ID NO: 170158 - DNA, 75 bp, Artificial Sequence
  Synthetic
ggctgaaagaaaagaggccaggtgcgttttgtgtagttttagggcaaagtcggcgatctgtcgtagtgcccactg

SEQ ID NO: 170159 - DNA, 75 bp, Artificial Sequence
  Synthetic
cccaaaaggtgagctgacaggtgacattcttctcgtcctgtatatcccaagagatcaccgagtcggcacgttcga

SEQ ID NO: 170160 - DNA, 75 bp, Artificial Sequence
  Synthetic
aggggtgtgtcggggtgtgttggcgggccgtatctgcgtgtgtcctcgacgcggattgtgcagtgcgccccgggg

SEQ ID NO: 170161 - DNA, 75 bp, Artificial Sequence
  Synthetic
gaatttccgcagcaaccgcatagtttacgcagtaactggaagcagcaaaagcagcagacgaacatcaatagtagt

SEQ ID NO: 170162 - DNA, 75 bp, Artificial Sequence
  Synthetic
tacgcagtaactggaagcagcaaaagcagcagacgaacatcaatagtagtataaagcacgaccatccaccagcag

SEQ ID NO: 170163 - DNA, 75 bp, Artificial Sequence
  Synthetic
agacacgcgtcttgtttgcgacgtgcgccgcgcacgtcgcttttattcgccgtcgccgtccacgcccgcgactcc

SEQ ID NO: 170164 - DNA, 75 bp, Artificial Sequence
  Synthetic
tattactgcttacgatggcaactgccgcgacggctatcgtcaacataacaacaaccgtcatgttgcatgcggtac

SEQ ID NO: 170165 - DNA, 75 bp, Artificial Sequence
  Synthetic
gccaccggagaagccgacgagggatcgggcgggtgcagccagaacctcacgccccgatcccgcctccggtaggcg

SEQ ID NO: 170166 - DNA, 75 bp, Artificial Sequence
  Synthetic
tgcactgggaagacacttcctcccaacggaccaagatctcgtcgggccgttcggagaaacggtatcgtctgtccg

SEQ ID NO: 170167 - DNA, 75 bp, Artificial Sequence
  Synthetic
gggacgccgtcgatgaccgtattggaccatgtcgtaaatcatcgtctccttgtaacacgctgaacagcagcggct

SEQ ID NO: 170168 - DNA, 75 bp, Artificial Sequence
  Synthetic
cgtctctggacgctctttttgtcggtctgaatcgacccgggatacgtaagagagcggccctacatcggggggcgc

SEQ ID NO: 170169 - DNA, 75 bp, Artificial Sequence
  Synthetic
cgggggtggcgccggggacgggggcctttcgcggcggggaacacagacggcacgcacacgcagctcgcctattta

SEQ ID NO: 170170 - DNA, 75 bp, Artificial Sequence
  Synthetic
tggtcctgggagaacatgaccatcgccgccaacgctcagcgggggggacgggttgggaacacagaggctgagggg

SEQ ID NO: 170171 - DNA, 75 bp, Artificial Sequence
  Synthetic
tcggccacgccgggtggcatctgcggcatggcggggggaggcgcgtcgggcggaccgccgggcatcgccgtcggc

SEQ ID NO: 170172 - DNA, 75 bp, Artificial Sequence
  Synthetic
catcggcaggtgagaaggtcgattacggagtctttgaagaattcccggtaacggatgagatacgcgcagaggaaa

SEQ ID NO: 170173 - DNA, 75 bp, Artificial Sequence
  Synthetic
cagtaccagttgagagtcgattcggtcggtcaacatcgtaagcatcgtggcggtggtgtgatggagtggaacaca

SEQ ID NO: 170174 - DNA, 75 bp, Artificial Sequence
  Synthetic
cgtcgccgtgtggcgcggcctggccggctgtctgcgcccagatctgttggccttttggttcctctggctgctgct

SEQ ID NO: 170175 - DNA, 75 bp, Artificial Sequence
  Synthetic
cataatattctatattctgcatagagttacatgcaacagtactactaccaatactgcatccatcacatcacccaa

SEQ ID NO: 170176 - DNA, 75 bp, Artificial Sequence
  Synthetic
gcggcgcgtgatcggcacgcgtgttattgtaggttcgttgccagatggcaagtgctgtcaacagcagacgttgtg

SEQ ID NO: 170177 - DNA, 75 bp, Artificial Sequence
  Synthetic
cggacctgctcgtcagcagcgagctacgcagacggaatatctggaggagagttacgtgtgtcacaggagagcgcg

SEQ ID NO: 170178 - DNA, 75 bp, Artificial Sequence
  Synthetic
tagcggcggttttgatagggcgaccgctgaggcgaggcgcgtgtgcgtgtggtgtctgctccccgtcccttagcc

SEQ ID NO: 170179 - DNA, 75 bp, Artificial Sequence
  Synthetic
ccctgccaccgccggtcccgcgagtccccgtccccaacgtaacccccgtccccgcagacccccggcactggcggt

SEQ ID NO: 170180 - DNA, 75 bp, Artificial Sequence
  Synthetic
gcgccttgtcgttcactttgccgcagcgtattcgcccgtcagcttcgaggtataacctacaacacggaggggaag

SEQ ID NO: 170181 - DNA, 75 bp, Artificial Sequence
  Synthetic
cccgcagacccccggcactggcggtcccgcacatccccgtccccaacgtaacccccgtccgcgccgccaactctc

SEQ ID NO: 170182 - DNA, 75 bp, Artificial Sequence
  Synthetic
cacgaccccaatgtgatgagaccacatgctcacaatgatttttacaaggcgcattgtacatcgcatatgtatgaa

SEQ ID NO: 170183 - DNA, 75 bp, Artificial Sequence
  Synthetic
acataggcaggcgaccaaacgcggaacccgaaataaaaacgttatacacagagacaaccgcggattattgagtgt

SEQ ID NO: 170184 - DNA, 75 bp, Artificial Sequence
  Synthetic
ctccctgtccgtcagcgcggtcccgcaatcaacccccgtccccgccggcgccacccctggccccgaaacaccccg

SEQ ID NO: 170185 - DNA, 75 bp, Artificial Sequence
  Synthetic
gctgaagtgagctgcgtgtgcgtgtggtttgtggagtccccgccgcccccggtcccgtgtccgccggcaaagccc

SEQ ID NO: 170186 - DNA, 75 bp, Artificial Sequence
  Synthetic
ggcggtgttccggcggggtaaggtttccatatgtggacgactgtaggctaaagttacggatttcacttaaaaaca

SEQ ID NO: 170187 - DNA, 75 bp, Artificial Sequence
  Synthetic
gccggtcccgcgagtccccgtccccgccgcaaaaggcccccgtcctcgccgcaaacacccccgccacccccgtcc

SEQ ID NO: 170188 - DNA, 75 bp, Artificial Sequence
  Synthetic
tacacccacgtcgctagatcctttaactgcgtggtcagaatggatttcataaagttttcgtcaggacgataacca

SEQ ID NO: 170189 - DNA, 75 bp, Artificial Sequence
  Synthetic
gtccccgcacaccccccggccccgcacaccccccgtccccgcacaccccccgtccccgccgcaacccccgtcccc

SEQ ID NO: 170190 - DNA, 75 bp, Artificial Sequence
  Synthetic
acaaagcgctggtcgaaacacgccgcaaacgccgccccgcgctgacgcaccgcaaacctcccttagtccggtctc

SEQ ID NO: 170191 - DNA, 75 bp, Artificial Sequence
  Synthetic
gtataggaagaatatggtgtggtggtgctgacacgacttttcttactgatcgatttgacaggcgcttgtttacgt

SEQ ID NO: 170192 - DNA, 75 bp, Artificial Sequence
  Synthetic
ccgcaacacccccgggtccgcgaaaaaaaacaccgcgggacgccacgcaccggcagtgcgcacaaagcgccggac

SEQ ID NO: 170193 - DNA, 75 bp, Artificial Sequence
  Synthetic
gcgttaaccaggtagaagctgcgtgtacagttacgttgcgcgtaacgtagaagcagggcggctaaacctaaaaaa

SEQ ID NO: 170194 - DNA, 75 bp, Artificial Sequence
  Synthetic
cgggtcgtgccgtactttgcggccgttgcttcccccgcggtccccagggtcgcgcggcgccgcgcgcttcctctt

SEQ ID NO: 170195 - DNA, 75 bp, Artificial Sequence
  Synthetic
tcagggtgtgtcaggggtgtgtcggcggtgtgcgcggccggagggaacaacaagtgtgccccggggcccgcgagt

SEQ ID NO: 170196 - DNA, 75 bp, Artificial Sequence
  Synthetic
gaaacctccctcagccctgtcccgcaccggcggcggtcggggtgtgtcgggggcgcggctgggtgggtgtgtgcc

SEQ ID NO: 170197 - DNA, 75 bp, Artificial Sequence
  Synthetic
aacataggattaaatgtggtaaaattgccacagttttcctccccggtgttgttacgccgggatacatttagcatt

SEQ ID NO: 170198 - DNA, 75 bp, Artificial Sequence
  Synthetic
tgccacagttttcctccccggtgttgttacgccgggatacatttagcatttcagaaaggcaagtcatggaaggta

SEQ ID NO: 170199 - DNA, 75 bp, Artificial Sequence
  Synthetic
cccccccccctcccctgggcggccgcttctgcgtgtgtcctcgacgcgggttgcggcgtacttcgtctgttcctg

SEQ ID NO: 170200 - DNA, 75 bp, Artificial Sequence
  Synthetic
tcttttccgcccgtccccctggggacttcctcttttccgcgtcgtttccgcgtccctggccgtcgtcgtcccccc

SEQ ID NO: 170201 - DNA, 75 bp, Artificial Sequence
  Synthetic
cgtgtctgcgtgtgtcctcgacgcgggttgtgcagtgtgccccggggcccgcgacacccccccccctcccttgcg

SEQ ID NO: 170202 - DNA, 75 bp, Artificial Sequence
  Synthetic
gtttacggagttgggtcgtgtgaaaatcgaaccagaggtgggtaatgctatgattacggataggtcctgctaaaa

SEQ ID NO: 170203 - DNA, 75 bp, Artificial Sequence
  Synthetic
tgtactgtgagtaaacgtattttgcgggttttctaagctgggtactataaaaatcaaaccacagataggttatac

SEQ ID NO: 170204 - DNA, 75 bp, Artificial Sequence
  Synthetic
acagacgcgcgtctgcttttcgccgtgcgcgccgcacgccgcttttattcgccgccgccgtcccaaccgcaccgc

SEQ ID NO: 170205 - DNA, 75 bp, Artificial Sequence
  Synthetic
cccctctcccctgggcgatcgcttctgcgttttccccggggacttcctcttttctgcgtcttgtctcttcgtgtg

SEQ ID NO: 170206 - DNA, 75 bp, Artificial Sequence
  Synthetic
gagaatagcaggaaagttagcgacataaggaagaataaattaaaaacacctctcatctctccttttctccccatg

SEQ ID NO: 170207 - DNA, 75 bp, Artificial Sequence
  Synthetic
tccgacggccatggcccagcgcaacggcatgtcgccgcgccccccgcccctcggtcgcggccgcggagccggagg

SEQ ID NO: 170208 - DNA, 75 bp, Artificial Sequence
  Synthetic
caaagtcttaggcgaggggaattgtccatagagtttcaccgcacctttcagtacatggttctgaataacacagcc

SEQ ID NO: 170209 - DNA, 75 bp, Artificial Sequence
  Synthetic
gcgcgatagcgggagccgtggggtccgctgtacctgtgcctccgcagccgtacggcgccgccggcgggggcgcga

SEQ ID NO: 170210 - DNA, 75 bp, Artificial Sequence
  Synthetic
cgtccaccgtcaacaacaaaggttccgtatctaggtccgtccgcagatgttcagcgtcctgttccccgattcgtt

SEQ ID NO: 170211 - DNA, 75 bp, Artificial Sequence
  Synthetic
aacgtatgcaatggccattagccaatattgatttatgctatataaccaatgactaatatggctaatggccaatat

SEQ ID NO: 170212 - DNA, 75 bp, Artificial Sequence
  Synthetic
ggctgacgggaataagacgggtgagggatttccacctttttcttaagtgtgactctccttacggtaaatcgcacc

SEQ ID NO: 170213 - DNA, 75 bp, Artificial Sequence
  Synthetic
agtccacagtcacatacacgataaacaataccaacagggtaatgtttatggagtaaaacactattgtccaggcca

SEQ ID NO: 170214 - DNA, 75 bp, Artificial Sequence
  Synthetic
ggtgatgtgtggcacttggaagtcagctaaatgttgtatcgcttagtgaattggtgttcttacagttttcatgta

SEQ ID NO: 170215 - DNA, 75 bp, Artificial Sequence
  Synthetic
cgttctccaagggagacatcgaaggtaacttcagtgggcccgtcgtcgtggagttggactacgaagacgtcgata

SEQ ID NO: 170216 - DNA, 75 bp, Artificial Sequence
  Synthetic
atcccagagtagtgacgtgagcccagccacctcccagattcctgacgttttggttgtctttcctgccaattcctc

SEQ ID NO: 170217 - DNA, 75 bp, Artificial Sequence
  Synthetic
aattgcctgaaggtggatagcattctaaccaatgatgttttgtaggccattttcctctaggatgccaactctgtc

SEQ ID NO: 170218 - DNA, 75 bp, Artificial Sequence
  Synthetic
gagctgacgagcggcggaggagaaacaccgacggcacttctatccggaggtgccaaggtagctgagcgcgctcag

SEQ ID NO: 170219 - DNA, 75 bp, Artificial Sequence
  Synthetic
gcaactacgtgccaaaagaggcgttacggtactttccgtactgggatttccaaaccgggactttccacacggcgg

SEQ ID NO: 170220 - DNA, 75 bp, Artificial Sequence
  Synthetic
cccatcggcaggtgaagacgtcgattacggagtctttaaagaattcccggtaacggatgaggtacgcgcagagga

SEQ ID NO: 170221 - DNA, 75 bp, Artificial Sequence
  Synthetic
cgtgggggcggtttgagactcgccgttcgcttcccccaattgcagcggcgtagagagcagaatctggaagggatc

SEQ ID NO: 170222 - DNA, 75 bp, Artificial Sequence
  Synthetic
gtgcgcaaagtcctcacccagctgtttccagctatcatctgcatctgtgcagtcccctgtatcgttgtaacaaac

SEQ ID NO: 170223 - DNA, 75 bp, Artificial Sequence
  Synthetic
aggttgagagcgcccaacaggtccacgggggtggcagcgtggatgatcatgttgcggtaatcggaagaacggggg

SEQ ID NO: 170224 - DNA, 75 bp, Artificial Sequence
  Synthetic
gcgatcgccagtacgggacacatgttgccgtgtgacgagacggcgtgtggacgagctatatgtggcaggaggccg

SEQ ID NO: 170225 - DNA, 75 bp, Artificial Sequence
  Synthetic
acgttaataaagaacagcggcggttctgatagggcgaccgctgaggcgagctgcgtgtgcgtgtgtttagtgttc

SEQ ID NO: 170226 - DNA, 75 bp, Artificial Sequence
  Synthetic
gtccccgccgctaaagccccccggtcccgcgcgccccccgtccccgcaacgccccgtccccggtcccgccgctaa

SEQ ID NO: 170227 - DNA, 75 bp, Artificial Sequence
  Synthetic
cccgcgcgccccccgtccccgcaacgccccgtccccggtcccgccgctaaagcccccggtcccgcgaggcgcaaa

SEQ ID NO: 170228 - DNA, 75 bp, Artificial Sequence
  Synthetic
gcgcaaaagtcccgaaacggcgaaaacccccgcagaaacatccctcagcccggttccgcgaacaaataccgtggc

SEQ ID NO: 170229 - DNA, 75 bp, Artificial Sequence
  Synthetic
acccccgcagaaacatccctcagcccggttccgcgaacaaataccgtggcacgccacgcaacggcagtgcgcgcg

SEQ ID NO: 170230 - DNA, 75 bp, Artificial Sequence
  Synthetic
tccagccctgtcccgtggcaccacacgcaccggcagcgcgcacaaagcgccggccacagcacgccgcaaacaccc

SEQ ID NO: 170231 - DNA, 75 bp, Artificial Sequence
  Synthetic
cgcaccggcagcgcgcacaaagcgccggccacagcacgccgcaaacacccgcagcccgggccggcccgcaaaact

SEQ ID NO: 170232 - DNA, 75 bp, Artificial Sequence
  Synthetic
gtggcgggcgtgtggcgggtgtgtcggcggggtgtgccgggggtgtgtcggcggggtgtgtggcgggtgtgtcgg

SEQ ID NO: 170233 - DNA, 75 bp, Artificial Sequence
  Synthetic
atacgtcggtcagtttttagcctacgttcgcgcttgtctgaatccggggatctacatcctagtaggcactcaaat

SEQ ID NO: 170234 - DNA, 75 bp, Artificial Sequence
  Synthetic
acgcgggtctgcagcttcctcttttttccctagggacgagtcgcggcggcgcgcgcttcgtcttctccgcgtgtc

SEQ ID NO: 170235 - DNA, 75 bp, Artificial Sequence
  Synthetic
ttcctcttttccgcgtgttttccgcgtctggccgccgtccctcaccccccgagagctgatcttcgcgtcctcagg

SEQ ID NO: 170236 - DNA, 75 bp, Artificial Sequence
  Synthetic
agttcctctaggctgtcggccagacggtagatttcaccggctagacgctgcaggggcggcgagcggtccaggtgc

SEQ ID NO: 170237 - DNA, 75 bp, Artificial Sequence
  Synthetic
acaccccccgcccctcggggacccagcacgcggcccggaatgggatgccgggcgtccacctaggtgtgtgcgcgc

SEQ ID NO: 170238 - DNA, 75 bp, Artificial Sequence
  Synthetic
tttttttttcttttctctttggaacaacaaaagaggataaagatggtcggtgaatgtattattattatcatcatc

SEQ ID NO: 170239 - DNA, 75 bp, Artificial Sequence
  Synthetic
cccgagaattgcaagggggaccgtgggggcgaggaatagataaaaggacagtaaacgtcgccgcgtcatgcggtt

SEQ ID NO: 170240 - DNA, 75 bp, Artificial Sequence
  Synthetic
tttcgctgttttcctggcagtgcgtaaagtcgaagaaggggtgcagctcggtgtagagcgtgatgttgcccacct

SEQ ID NO: 170241 - DNA, 75 bp, Artificial Sequence
  Synthetic
gcgtacgctatgcttgtatttgtgactataatatgtgcagtcgtgtgtcgatgttcctattgggaagggtgtgaa

SEQ ID NO: 170242 - DNA, 75 bp, Artificial Sequence
  Synthetic
ccacggtcgccaccagcacgatccacgcgtcccgcggcgacagttgacgcaggtccgtcgcgcccacgccgttca

SEQ ID NO: 170243 - DNA, 75 bp, Artificial Sequence
  Synthetic
gggtgtgtgccgggtgtgtcgcgggcgtgtgtcgggtgtgtcgggggtgtgttggcggggtgtgtcagggtgtgt

SEQ ID NO: 170244 - DNA, 75 bp, Artificial Sequence
  Synthetic
cggtcgggtgtgtcgcgggcgtgtgtcgggcgtgtggcgggtgtgtcgcgggtgtgtcaggggtgtgtcggcggt

SEQ ID NO: 170245 - DNA, 75 bp, Artificial Sequence
  Synthetic
gtgcgcggcttcggggtgcgtgtcggcggccggagggaacaacaagtgtgccccggggcccgcgagtcccccccc

SEQ ID NO: 170246 - DNA, 75 bp, Artificial Sequence
  Synthetic
aaccagaaagttccacgaggcaattgtcctaaaagtcgatgataccctatgcatgtacaacgaccattaccttca

SEQ ID NO: 170247 - DNA, 75 bp, Artificial Sequence
  Synthetic
ccattccgggccgtgtggtgggtccccgaggggcgggggggtgtttttagcgggggggggtgaaatttggagttg

SEQ ID NO: 170248 - DNA, 75 bp, Artificial Sequence
  Synthetic
cgtgtgtggacggcgacggcgactagttgcgtgtggtgcggtggggacggcggtcgcggaggacggcgacggcga

SEQ ID NO: 170249 - DNA, 75 bp, Artificial Sequence
  Synthetic
agcgcaacggcatgtcgccgcgccccccgcccctcggtcgcggccgcggtgccggagggccttcgggggttggtt

SEQ ID NO: 170250 - DNA, 75 bp, Artificial Sequence
  Synthetic
agtcgcgggccccgggcacactgcacaaccacacacgcagacacgcgggtccctggggacacacgaagagacaag

SEQ ID NO: 170251 - DNA, 75 bp, Artificial Sequence
  Synthetic
acgcggaaaagagggacggcagacacgcgaagagcaacgcccggagctcgcgcgcggaaaaggggaagcgctcgg

SEQ ID NO: 170252 - DNA, 75 bp, Artificial Sequence
  Synthetic
ctgagcgacttcttggcgccgtaagcgcgccgccgcttctgcggcgtgttccccacggcgcttcctgcgcgctgc

SEQ ID NO: 170253 - DNA, 75 bp, Artificial Sequence
  Synthetic
atatatatagtcaatgacaggtatcgtaccaataataatttgttatgccatcttgtagcccagcaatgtgatgtc

SEQ ID NO: 170254 - DNA, 75 bp, Artificial Sequence
  Synthetic
gtaccaataataatttgttatgccatcttgtagcccagcaatgtgatgtcaacatcgtgcaaaaaatgcaataca

SEQ ID NO: 170255 - DNA, 75 bp, Artificial Sequence
  Synthetic
ctgcatggccgctaccacatcgggcgggagcggctccggcggaagctcgatgagcagttgctgcgaatctcggcg

SEQ ID NO: 170256 - DNA, 75 bp, Artificial Sequence
  Synthetic
ctttcgcggcgggtgtttgcacggagtttctactaagcttttgcgcggcgcttcgcttttcggggcggggacggc

SEQ ID NO: 170257 - DNA, 75 bp, Artificial Sequence
  Synthetic
acaaattgtacacgcatagtgtgttaagtatgttactactaatgtatatgatgacaaacataaagatccataaac

SEQ ID NO: 170258 - DNA, 75 bp, Artificial Sequence
  Synthetic
cacaccttgaatagcaccgaaatttatcagttgttcgagtacactcggttcggggtatggttgatgtgcatcgtg

SEQ ID NO: 170259 - DNA, 75 bp, Artificial Sequence
  Synthetic
aagtatgttactactaatgtatatgatgacaaacataaagatccataaacttacatacatataaaagtacaattc

SEQ ID NO: 170260 - DNA, 75 bp, Artificial Sequence
  Synthetic
gggggcgagcggcacggagacggaggccgccggcggggacgcgccgtgcgcgatggcgggagccgtggggtccgc

SEQ ID NO: 170261 - DNA, 75 bp, Artificial Sequence
  Synthetic
ttatctgaagccatgtttccgaaccagatttatgatttccatacatccacttagataaaggatgataatcggata

SEQ ID NO: 170262 - DNA, 75 bp, Artificial Sequence
  Synthetic
ctcagttccaccacccacgaccctaatgtgatgagacgacatgctaacgatgatttttacaaggcgcattgcaca

SEQ ID NO: 170263 - DNA, 75 bp, Artificial Sequence
  Synthetic
gaagccaggacgctgaccatcaccgtcaaaagtgtggaggtaaaaagcgcgtcacgccacacggagctgagacgg

SEQ ID NO: 170264 - DNA, 75 bp, Artificial Sequence
  Synthetic
ttgtcctaaaagtcgatgataccctatgcatgcacaacgaccattaccttcagtgccaaaaccgccgttacatgt

SEQ ID NO: 170265 - DNA, 75 bp, Artificial Sequence
  Synthetic
caaaccgttattactttctgtctatacgtcggtcagtttttggcctacgttcgcgcttgtctgaatcctgggatc

SEQ ID NO: 170266 - DNA, 75 bp, Artificial Sequence
  Synthetic
ggcaccgggctgcgggacggtgtttccgcgcgctgccggtgcgttccacggtccttgtctgtgtcgtttcggcgc

SEQ ID NO: 170267 - DNA, 75 bp, Artificial Sequence
  Synthetic
aaaaaaataccgttcgtagagaatgccgtgttgaaggaacgcgcttttattgagacgattaaacagcatcaggag

SEQ ID NO: 170268 - DNA, 75 bp, Artificial Sequence
  Synthetic
ctctttttcgccgcctgcaagcattggtgcgcaaagtcctcacccagctgtttccagctatcatctgcatctgtg

SEQ ID NO: 170269 - DNA, 75 bp, Artificial Sequence
  Synthetic
aacgtgtgacgtgagtctgatccaacactgaacgctttcgtcgtgtttttcatgcagcttttacagaccatgaca

SEQ ID NO: 170270 - DNA, 75 bp, Artificial Sequence
  Synthetic
atgaattagattccaagtggtaacgataggataatgaccgttcgctcccaacggatgacacaaagtatccgaata

SEQ ID NO: 170271 - DNA, 75 bp, Artificial Sequence
  Synthetic
tagaggtacttattgacgtagtagacgtgacggtggtattactaggggaagtgacggcgcttgtggtgctacttt

SEQ ID NO: 170272 - DNA, 75 bp, Artificial Sequence
  Synthetic
cgttgtgctagccccacctgagcagcgtcatgggtaaagcggtgattaagcgtgaaaacaccgtaaggggggggg

SEQ ID NO: 170273 - DNA, 75 bp, Artificial Sequence
  Synthetic
ttgcgctggggacgtgttgcgggaccggactgagggacggggggtgtgcgctggggacgggggttgcggggacgg

SEQ ID NO: 170274 - DNA, 75 bp, Artificial Sequence
  Synthetic
atcaacgtaacaggatacgttggtggcaacataactctaaaaaaatgcaatcagactgagaaatggcacaatgta

SEQ ID NO: 170275 - DNA, 75 bp, Artificial Sequence
  Synthetic
gggggggggggataatattgctaatcatgcgtcttgcagtacagatagccgctgtatcttacgcgtattgtcgca

SEQ ID NO: 170276 - DNA, 75 bp, Artificial Sequence
  Synthetic
acaccaaattcccaaggccgcgcatgttatccaggccacaataatcgtgggaacgccccattggcattgccacga

SEQ ID NO: 170277 - DNA, 75 bp, Artificial Sequence
  Synthetic
tgcgggggtgagggacggcgggcagacaaaagaggaagctgcaagcagtcaagacgcgaaaaagaggaagtcccc

SEQ ID NO: 170278 - DNA, 75 bp, Artificial Sequence
  Synthetic
gccgacacgcagccggcttttataggcagcgacgagcgcggcgcttgctggcgccgccttggcgccgcgcagtcg

SEQ ID NO: 170279 - DNA, 75 bp, Artificial Sequence
  Synthetic
cgggggaagtaacggccgcccaggggagggggggggctcgcgggccccgggccacacacacgcaccccgaagccg

SEQ ID NO: 170280 - DNA, 75 bp, Artificial Sequence
  Synthetic
aggacggcgacggcgaataaaagcgacgtgcgcggcgcacgtcgcaaagaagacgcgtgtctgtgtctgtctgat

SEQ ID NO: 170281 - DNA, 75 bp, Artificial Sequence
  Synthetic
cgtgcgaggcgggtagggtgccgaacgacggatatgcgtcgttgtcatcttcgactataaggatcgcgaccgagt

SEQ ID NO: 170282 - DNA, 75 bp, Artificial Sequence
  Synthetic
gggccccggggcacactgcttccatccacccgcgcacaccccgccacacacccctgacacacccggcacacgccc

SEQ ID NO: 170283 - DNA, 75 bp, Artificial Sequence
  Synthetic
cgacacacccgaccgacacacccgcgacacacccgaccgacacaccccgccaacacacccccgacacacccggca

SEQ ID NO: 170284 - DNA, 75 bp, Artificial Sequence
  Synthetic
tacacgcgtgcatgctgcatgggtggatggtacggccgggagacgcggaagagaaactcacataaaaaggtgaca

SEQ ID NO: 170285 - DNA, 75 bp, Artificial Sequence
  Synthetic
cgtgttgtccacggcgctgtgtgcgcgctgcccatgcgtgtcgtcccacggtgtttgttggctgcgggagttttg

SEQ ID NO: 170286 - DNA, 75 bp, Artificial Sequence
  Synthetic
cagtccggcacgcgttgtcccacggtctttgcccgcgggacggcgctcgggacgggatttcccgacgggtgtttt

SEQ ID NO: 170287 - DNA, 75 bp, Artificial Sequence
  Synthetic
ggaaagacagtaaacagtacggacaagtgtttgtgacggacacggagctgtaattaactataatgtatagataca

SEQ ID NO: 170288 - DNA, 75 bp, Artificial Sequence
  Synthetic
cgacgtggttacggacccagtcgcgaagcacgtcggcgctgtactggcactcaaagatgccctgaaagtcgccca

SEQ ID NO: 170289 - DNA, 75 bp, Artificial Sequence
  Synthetic
aagagtataccacaatctaaagactatactttttcatggtataaagattcacttaactccgttaacatgctatgt

SEQ ID NO: 170290 - DNA, 75 bp, Artificial Sequence
  Synthetic
atcgcccgtcctctgaaataccgctatcaacgtctcgtcgctaccgtgtagctagttagccagctgtgtatagtt

SEQ ID NO: 170291 - DNA, 75 bp, Artificial Sequence
  Synthetic
tggaacacgacgaagatatcatcgcgccgcagagtttgtggtgcacggcgttcaaggaagccctctgggatgtgg

SEQ ID NO: 170292 - DNA, 75 bp, Artificial Sequence
  Synthetic
tctaataccggcaatggcagcaagtgccacgcgatgtgcaaatgccgggtcacagaacccattaccatgctaggc

SEQ ID NO: 170293 - DNA, 75 bp, Artificial Sequence
  Synthetic
ttgacgctcgcgctcgaaacgccggtgtcgaaagaccattttcagcaaccccatgcggaaaaactccgtgatggt

SEQ ID NO: 170294 - DNA, 75 bp, Artificial Sequence
  Synthetic
gacaaattccagcgcgtttagacacgctagttatcaacggcaacagcgtgtcggaaacgggacgttatccaagaa

SEQ ID NO: 170295 - DNA, 75 bp, Artificial Sequence
  Synthetic
acgctgaacagctgcggacggatctggatacggaacctttattgttgacggtagacgaggatttagaataaaaaa

SEQ ID NO: 170296 - DNA, 75 bp, Artificial Sequence
  Synthetic
cgcacaccccccgtctccgcaacaccccggccccgccggcggccagaacgctccaaaacccccgagaagcgcagc

SEQ ID NO: 170297 - DNA, 75 bp, Artificial Sequence
  Synthetic
aggcagcgtcggacacaacacgccgcaaacgcggcgccgcgcttacggccctcaaacctccctcagccccgtccc

SEQ ID NO: 170298 - DNA, 75 bp, Artificial Sequence
  Synthetic
caacggaaactaacgttggttctacggaaataaacgttacttccatgaatacttcggcaacaagcaacgtcacat

SEQ ID NO: 170299 - DNA, 75 bp, Artificial Sequence
  Synthetic
ggacgttttaatggtaacagtacagctcccgttaaacattagattaatagacgttagtggataacagcatgttat

SEQ ID NO: 170300 - DNA, 75 bp, Artificial Sequence
  Synthetic
catctgtaagttgtgaaatgttcaatacgacaattaataatacacaagaccgtgatgaatgtaaaccaataaaag

SEQ ID NO: 170301 - DNA, 75 bp, Artificial Sequence
  Synthetic
agcaccacaactacgtgccgtcgctggattcttaaatcagacgcctcgggaaaacaacacgcacctggccttggt

SEQ ID NO: 170302 - DNA, 75 bp, Artificial Sequence
  Synthetic
gtgtgtcctcgacgcgggttgtgccgtacttcgtctgtcgtttcccccgcggtcccctagggacgagtcgcgccg

SEQ ID NO: 170303 - DNA, 75 bp, Artificial Sequence
  Synthetic
tatgcatctcgtgcgacaacggaacactacatctctacggtgtaaacacaactcattcaggtagatatactgcac

SEQ ID NO: 170304 - DNA, 75 bp, Artificial Sequence
  Synthetic
aaattataacggaaattatgaacttacggaagccgccaatacagcacgtacaaatagcagtgactgggtaacgtt

SEQ ID NO: 170305 - DNA, 75 bp, Artificial Sequence
  Synthetic
cagacacagacgcgcgtctgcttttcgccgtgcgcgccgcacgtcgcttttattcgccgtccccgtccccaccgc

SEQ ID NO: 170306 - DNA, 75 bp, Artificial Sequence
  Synthetic
cgccgtgcgcgccgcacgtcgcttttattcgccgtccccgtccccaccgcaccgcagcgcacgcaactattcgtc

SEQ ID NO: 170307 - DNA, 75 bp, Artificial Sequence
  Synthetic
atctgtctgcgagcacctcaaaaagtctacgatcgctggaaagacaataaacagtacggacaagtatttatgacg

SEQ ID NO: 170308 - DNA, 75 bp, Artificial Sequence
  Synthetic
tccacgggcttcccgactgcgcgccgccaaggcggcgccagcaagcgccgtgcacgtcgctgcctataaaagcca

SEQ ID NO: 170309 - DNA, 75 bp, Artificial Sequence
  Synthetic
agggacggtgaaactgtatgtgaggaacctgggtgcttagacaactaacgtgtaatgctttttacaggaccgttc

SEQ ID NO: 170310 - DNA, 75 bp, Artificial Sequence
  Synthetic
caacagttctatcaatggtggaaaccagatacaacgtcatgcattcagaaaacgggatatgaaggtcaaaacctc

SEQ ID NO: 170311 - DNA, 75 bp, Artificial Sequence
  Synthetic
cagatacaacgtcatgcattcagaaaacgggatatgaaggtcaaaacctcagtctgcctcctagtaatgcattat

SEQ ID NO: 170312 - DNA, 75 bp, Artificial Sequence
  Synthetic
agatattatacgacgatgttttttgaatcatacattgtttcttattaatttaacaagtcactatagcgggattta

SEQ ID NO: 170313 - DNA, 75 bp, Artificial Sequence
  Synthetic
caaacacacatccacacaactatattgctctatccgcctacgtccacatataattcattaactatatcatcattt

SEQ ID NO: 170314 - DNA, 75 bp, Artificial Sequence
  Synthetic
atatagagtaaaatccagtgaatctacgaacactgaaggtaccgtcggaagtaaccttatagaaaccattcggaa

SEQ ID NO: 170315 - DNA, 75 bp, Artificial Sequence
  Synthetic
gttattatgtatacgttacccaaaacggaacacttcccactaccaccaccaaaaaacccactacgaccacgagaa

SEQ ID NO: 170316 - DNA, 75 bp, Artificial Sequence
  Synthetic
accaaaccttaacacaggtgagcaacatgacaaatcacaccttgaacaacaccgaaatctatcagctgttcgagt

SEQ ID NO: 170317 - DNA, 75 bp, Artificial Sequence
  Synthetic
gaacgcaattcaaagagggtacaaattcctaacaacatgttatcacagaggatcacgcaacatacgtgttttcta

SEQ ID NO: 170318 - DNA, 75 bp, Artificial Sequence
  Synthetic
tcggcctgccgttttttctagaatatgccaagcatcaccctaaactcagccgagaggtggtttgttcgggactca

SEQ ID NO: 170319 - DNA, 75 bp, Artificial Sequence
  Synthetic
tgccggcgtttgttttctcatcaacctgtcgatggatcgctactgcgtcattgtttggggtgtagaattgaaccg

SEQ ID NO: 170320 - DNA, 75 bp, Artificial Sequence
  Synthetic
cgtgcgaaataacaagcgggccacctgttgggtggtgattttttggatactagccgtgcttatggggatgccaca

SEQ ID NO: 170321 - DNA, 75 bp, Artificial Sequence
  Synthetic
cgttgcggggccggagacggtggtggggacggggacggaggtggcgccggggacgggggcctttcgcggcgggga

SEQ ID NO: 170322 - DNA, 75 bp, Artificial Sequence
  Synthetic
cgctgcgattggcttaagcaattcggttccgaccggcagggtattcaacagaatttggttattacagcgacaccg

SEQ ID NO: 170323 - DNA, 75 bp, Artificial Sequence
  Synthetic
caggtatcgtaccgataaaagtttaatgcgcgaattcagaatcggatgatgtaaccatgttagcaacatattgaa

SEQ ID NO: 170324 - DNA, 75 bp, Artificial Sequence
  Synthetic
atgcgcgaattcagaatcggatgatgtaaccatgttagcaacatattgaaaacatgatattttctgctctaacaa

SEQ ID NO: 170325 - DNA, 75 bp, Artificial Sequence
  Synthetic
acgacggccagggacgcggaaaagacgcggaaaagaggaagtccccagggggacgggcggaaaagaggaagcgcc

SEQ ID NO: 170326 - DNA, 75 bp, Artificial Sequence
  Synthetic
cgttccggttgtcttgttacattaacattataccacctgttatcgttgcgtttgtctagccattttgaaaaaggg

SEQ ID NO: 170327 - DNA, 75 bp, Artificial Sequence
  Synthetic
ccgcgcacaccgccgacacacccctgacacacccgcgacacacccgccacacgcccgacacacgcccgcgacaca

SEQ ID NO: 170328 - DNA, 75 bp, Artificial Sequence
  Synthetic
gaagctaggcgcgcctgtttaaacatggatccggccgcccttaattaacgtgggagtctgatccaacactgaacg

SEQ ID NO: 170329 - DNA, 75 bp, Artificial Sequence
  Synthetic
ctgccgtaccacctgacgctgtttgtggacacgttaaaactcctcaaatggatctccagcagctgcgagttcgaa

SEQ ID NO: 170330 - DNA, 75 bp, Artificial Sequence
  Synthetic
tgaccgagtcgctcgccttttgtcactgttgtctcaatccgctgctgtacgtcttcgtgggcaccaagtttcggc

SEQ ID NO: 170331 - DNA, 75 bp, Artificial Sequence
  Synthetic
ctccgccttgccgtccgtcacttcgtcctcttcgggcacggcgacggtgtctcctccgtcttgttcttcttcgtc

SEQ ID NO: 170332 - DNA, 75 bp, Artificial Sequence
  Synthetic
gcgcacggcgcgtccccgccggcggcctctgcctccgtgccgctcgcccccgccagcaacgtcgtccccgtcgcc

SEQ ID NO: 170333 - DNA, 75 bp, Artificial Sequence
  Synthetic
agctcattacgagtattatccgcatccacatatatcaacgtcatagctaggcacgctataagtacccccccccca

SEQ ID NO: 170334 - DNA, 75 bp, Artificial Sequence
  Synthetic
accaaattcccaaggccgcgcatgttatccagatcacaatgatcgcggggacgccccattggcattggcacgaag

SEQ ID NO: 170335 - DNA, 75 bp, Artificial Sequence
  Synthetic
ggccgcagagtccgaagaaggcgcccaggtggtagccgaattgcaccttgacgtattgaaaaaagacggcctcga

SEQ ID NO: 170336 - DNA, 75 bp, Artificial Sequence
  Synthetic
aaatggcacatgcagacgctccacgttcttttagttgtggttgtatcttttgccagcttttggtttcccttcaac

SEQ ID NO: 170337 - DNA, 75 bp, Artificial Sequence
  Synthetic
aaagagacgggaggctgatcgcggccttcagcgtctcatttgtctttactctcgagtgcggtcggtgtctcgtcg

SEQ ID NO: 170338 - DNA, 75 bp, Artificial Sequence
  Synthetic
tacatcaccttttatcgcaaaaaggtactttacctaacggccgcatgcatctttggtggctacatcagcttccac

SEQ ID NO: 170339 - DNA, 75 bp, Artificial Sequence
  Synthetic
gatcaggttcgttggtcatatggttcaggtgggcaaggccacatgctatgcatttacacttttacatcaacaaca

SEQ ID NO: 170340 - DNA, 75 bp, Artificial Sequence
  Synthetic
caggtgggcaaggccacatgctatgcatttacacttttacatcaacaacaacatttaacaacacacgctttaatt

SEQ ID NO: 170341 - DNA, 75 bp, Artificial Sequence
  Synthetic
catcgttaaacgattggcgtcacaaaacacattatcataaacctcccggatggaacttagacacatgctacaatc

SEQ ID NO: 170342 - DNA, 75 bp, Artificial Sequence
  Synthetic
caaccgcggtgagtcctatctaactaccatctggcttctgaactgcgctgacaacaatacttattggtactctgg

SEQ ID NO: 170343 - DNA, 75 bp, Artificial Sequence
  Synthetic
acaacaatacttattggtactctggaaatgcctataaccatacaattgacacttgtaaaaatacagtttcgggat

SEQ ID NO: 170344 - DNA, 75 bp, Artificial Sequence
  Synthetic
cgggggtctgcattcaaactacaccaacttaaccgaggcattcagattcactccagcaaacacaacaactaactc

SEQ ID NO: 170345 - DNA, 75 bp, Artificial Sequence
  Synthetic
acattacgtgtctgtattggtacatttgcaaaccgccgggtgtgtcggtatagcttagcgatgattatattatgt

SEQ ID NO: 170346 - DNA, 75 bp, Artificial Sequence
  Synthetic
gtctctgtgctagtctaacaacacctgtgtaatgcgtacaaccagaaaaaagacgcgaaagcaacgtgtatgggg

SEQ ID NO: 170347 - DNA, 75 bp, Artificial Sequence
  Synthetic
ggatgtgtgttactcattcgtggcgttgttatagtattgtgaaaaagaattctcgtaagcatgttgacaactgca

SEQ ID NO: 170348 - DNA, 75 bp, Artificial Sequence
  Synthetic
aaataaaagcattttattgagcattgtaatggtagtgtgtggctacattagaaaacgtgacgcgtcgcatgtcgc

SEQ ID NO: 170349 - DNA, 75 bp, Artificial Sequence
  Synthetic
aaccccgcggctgaccgtcgtccggtaaaggaacaacccgtcgtcgcaagccgggttcgaccaagagaaaaaacc

SEQ ID NO: 170350 - DNA, 75 bp, Artificial Sequence
  Synthetic
cagcggaccccacggctcccgccatcgcgcacggcgcgtccccgccggcggcctccgtctccgtgccgctcgccc

SEQ ID NO: 170351 - DNA, 75 bp, Artificial Sequence
  Synthetic
gctgtgattggaggcttcgtgagttatgtgacagctgtgattacacctatcgccaaggctgacagcggttaccca

SEQ ID NO: 170352 - DNA, 75 bp, Artificial Sequence
  Synthetic
ccattccgggccgtgtgctgggtctccgaggggcgggggggtttttttgcgggggggtgaaatttggagttgcgt

SEQ ID NO: 170353 - DNA, 75 bp, Artificial Sequence
  Synthetic
tcccatagggcgaccgctgaggcgagctgcgtgtgcgtgtgatttgtgttccccagcgcaaaagccccccgtccc

SEQ ID NO: 170354 - DNA, 75 bp, Artificial Sequence
  Synthetic
gctgcgtgtgcgtgtgatttgtgttccccagcgcaaaagccccccgtccccgccgcccccgtcccgcacaccccc

SEQ ID NO: 170355 - DNA, 75 bp, Artificial Sequence
  Synthetic
cccgcgcagcgcccgtgtccccgcaacacgcccccgcagcccggtcccgcaagtccccgccggcaaagtcccccc

SEQ ID NO: 170356 - DNA, 75 bp, Artificial Sequence
  Synthetic
acacgcccccgcagcccggtcccgcaagtccccgccggcaaagtccccccgtccccaccaccgtccctcagcccg

SEQ ID NO: 170357 - DNA, 75 bp, Artificial Sequence
  Synthetic
gcagcaccccgtccccgccgcaagcaacaccgctcccccgtccccgccgcaatcaacaccccgtccccagcgcaa

SEQ ID NO: 170358 - DNA, 75 bp, Artificial Sequence
  Synthetic
aacaccgctcccccgtccccgccgcaatcaacaccccgtccccagcgcaacccccgtggccgccgccggcgttca

SEQ ID NO: 170359 - DNA, 75 bp, Artificial Sequence
  Synthetic
cgatcccaccaattctccaacggcctcgcccgccaagtcagacaagctggaagccgacgcagacacagcactcca

SEQ ID NO: 170360 - DNA, 75 bp, Artificial Sequence
  Synthetic
tcgcccgccaagtcagacaagctggaagccgacgcagacacagcactccatcgacgcccggcctcgctgttgcgc

SEQ ID NO: 170361 - DNA, 75 bp, Artificial Sequence
  Synthetic
aacccccgagtaaacaaagaccgtgcgacgccacgccgccggcgtttagcacgcccaaaaaccccacgcaccgtc

SEQ ID NO: 170362 - DNA, 75 bp, Artificial Sequence
  Synthetic
cgacgccacgccgccggcgtttagcacgcccaaaaaccccacgcaccgtcagcgcaaaacttcctcggcccggcc

SEQ ID NO: 170363 - DNA, 75 bp, Artificial Sequence
  Synthetic
gtgcaccacaaactctgcggcgcgatgatctcttcgtcgtgttccaccacttgcacaccgctgattatggacttg

SEQ ID NO: 170364 - DNA, 75 bp, Artificial Sequence
  Synthetic
tgatctcttcgtcgtgttccaccacttgcacaccgctgattatggacttgccgtcgctgtccgtggaactatctg

SEQ ID NO: 170365 - DNA, 75 bp, Artificial Sequence
  Synthetic
tgacgccccgcaaacctacccgagccctgtcccgcgaacaaactccctagcggcctcagcgaaaaactccctcag

SEQ ID NO: 170366 - DNA, 75 bp, Artificial Sequence
  Synthetic
cctgtcccgcgaacaaactccctagcggcctcagcgaaaaactccctcagcccggtcggcgcgcccgcaaacctc

SEQ ID NO: 170367 - DNA, 75 bp, Artificial Sequence
  Synthetic
aaaagaggaagtccccaggaggacggccgcgcgcggcgccactcgtccctggggaccgcgggagaaataacggcc

SEQ ID NO: 170368 - DNA, 75 bp, Artificial Sequence
  Synthetic
cgatccgcaacacgttgtccgccccaacctcacctgctgcggctaccacgcatcgactgtcgttccctggagaat

SEQ ID NO: 170369 - DNA, 75 bp, Artificial Sequence
  Synthetic
aacctcacctgctgcggctaccacgcatcgactgtcgttccctggagaatcgaccttctgcctcaccgctgtttc

SEQ ID NO: 170370 - DNA, 75 bp, Artificial Sequence
  Synthetic
ttgggtgtgtcgggggtgcggctgggtgggtgtgtgccgggtgcggctgggtgtgtcgggtgtgtcgcgggtgtg

SEQ ID NO: 170371 - DNA, 75 bp, Artificial Sequence
  Synthetic
ttcgtccacggtctccgagaccggcacttttccgcagagcacaacaggccgcacacgtgtcaacgacaccgccgt

SEQ ID NO: 170372 - DNA, 75 bp, Artificial Sequence
  Synthetic
acttttccgcagagcacaacaggccgcacacgtgtcaacgacaccgccgtcgttaccgccggagacccgcgctct

SEQ ID NO: 170373 - DNA, 75 bp, Artificial Sequence
  Synthetic
ccctgacacaccctgccaacacacccccgacacacccgacacacgcccgcgacacacccgacacccaccccacgc

SEQ ID NO: 170374 - DNA, 75 bp, Artificial Sequence
  Synthetic
gtggtggcggggtgtgtcaggggtagcagtgtgccccggggcccgcgactcccccccccctcctccccgcggccc

SEQ ID NO: 170375 - DNA, 75 bp, Artificial Sequence
  Synthetic
ctccgcggaggtgagcacgaggccatccccaaagtcgcgtcgctgttctggacgctgctcaaagcaacacagata

SEQ ID NO: 170376 - DNA, 75 bp, Artificial Sequence
  Synthetic
tccccaaagtcgcgtcgctgttctggacgctgctcaaagcaacacagatagttgacatgactcacaaaacaccga

SEQ ID NO: 170377 - DNA, 75 bp, Artificial Sequence
  Synthetic
tcgcgtccccagggagtcgcgccgccgtcccctcgggaccgcttcctctttttccccggggactcaaagagacgc

SEQ ID NO: 170378 - DNA, 75 bp, Artificial Sequence
  Synthetic
ggcaacgaacctacaatgacacgcgtgccgcccacgcgccgcaagtgcgcctgctcggcgacatcctcacttacc

SEQ ID NO: 170379 - DNA, 75 bp, Artificial Sequence
  Synthetic
tgccgcccacgcgccgcaagtgcgcctgctcggcgacatcctcacttaccgcagaccgcaaactgccaccgcgtc

SEQ ID NO: 170380 - DNA, 75 bp, Artificial Sequence
  Synthetic
ctctttttccccggggactcaaagagacacaagacacacgcgcgtctccttttcgccgtcgccgtcctccgccgc

SEQ ID NO: 170381 - DNA, 75 bp, Artificial Sequence
  Synthetic
gacacaagacacacgcgcgtctccttttcgccgtcgccgtcctccgccgcacgtcgcttttattcgccgtcgccg

SEQ ID NO: 170382 - DNA, 75 bp, Artificial Sequence
  Synthetic
cggcgcttcgcttttcggagcggcgacggcggtgtttccgggcgtgctgggcgccggcgccggtaacgggagtta

SEQ ID NO: 170383 - DNA, 75 bp, Artificial Sequence
  Synthetic
cgcgccacacggcgacgagccgcatagcgacggcgagctacgccgcgagtcgcattctgcaccgccgacgtctcg

SEQ ID NO: 170384 - DNA, 75 bp, Artificial Sequence
  Synthetic
agcgacggcgagctacgccgcgagtcgcattctgcaccgccgacgtctcgtacactacccgatacgattttggca

SEQ ID NO: 170385 - DNA, 75 bp, Artificial Sequence
  Synthetic
ccccgcccctcggggacccagcacacggcccggaatggatgccgggcgtccacctaggtgtgtgcgcgctcggca

SEQ ID NO: 170386 - DNA, 75 bp, Artificial Sequence
  Synthetic
tttcgccgacggttgttgctccccttatccggctatttccgcgccaacgagctccggaatcaacaatttatgggc

SEQ ID NO: 170387 - DNA, 75 bp, Artificial Sequence
  Synthetic
tatccggctatttccgcgccaacgagctccggaatcaacaatttatgggctatggaacaaagaacggccttaaga

SEQ ID NO: 170388 - DNA, 75 bp, Artificial Sequence
  Synthetic
tggcggactctgcgacgcaacgcattttccacacgttgtacgccgcactgcagaccgtacgggtgtggtataccg

SEQ ID NO: 170389 - DNA, 75 bp, Artificial Sequence
  Synthetic
ggggtctcgtacgcgtgagtctctgttcgatggtccacgacgtcgcgatcggcaggcgggccggctgcggcgctc

SEQ ID NO: 170390 - DNA, 75 bp, Artificial Sequence
  Synthetic
tcagggccaccagacagactccgatgaagatgacgatagcaacgctgatccaccatctcctgatggcgttgtcgg

SEQ ID NO: 170391 - DNA, 75 bp, Artificial Sequence
  Synthetic
aggagtttccctggagcagcgccgtaggcaagtgccgcggcgcgtgtccgggtggctttataacggccgtcgatg

SEQ ID NO: 170392 - DNA, 75 bp, Artificial Sequence
  Synthetic
ggttcatgtgaagtaccaggcgacgatgctgaccatgacgccgagcagcagagtgaagacgatgacgttgaacag

SEQ ID NO: 170393 - DNA, 75 bp, Artificial Sequence
  Synthetic
accggcgttttcgggacggtcggttaacgtgggtttcaggggaaggctgtaagcacggggaaggagcgctgatag

SEQ ID NO: 170394 - DNA, 75 bp, Artificial Sequence
  Synthetic
taccagcccagggatcgcgtctttcgccgccacgctgcttcaccgatatccaataaacccatcccctcgccacga

SEQ ID NO: 170395 - DNA, 75 bp, Artificial Sequence
  Synthetic
ggggtgtgttggcgggccgtgtctgcgtgtgtcctcgacgcgggttgtgcagtgtgccccggggcccgcgactcc

SEQ ID NO: 170396 - DNA, 75 bp, Artificial Sequence
  Synthetic
acgggatggcgctggatacgctagcggggctggctatctgcgtgggtctagtcatgggggtcaccgtgatcgcgt

SEQ ID NO: 170397 - DNA, 75 bp, Artificial Sequence
  Synthetic
ggggctggctatctgcgtgggtctagtcatgggggtcaccgtgatcgcgtcgtgcgcgctgctggtgttttatta

SEQ ID NO: 170398 - DNA, 75 bp, Artificial Sequence
  Synthetic
caccgaatccttaaccgctatcctgccggacggttcgtccacggagcaggagatctaccacacgcgactttaagt

SEQ ID NO: 170399 - DNA, 75 bp, Artificial Sequence
  Synthetic
cacggaggaagttacgtgggtaggagggcaccgtgccccgaggcggcgacgggctagcgtataacaagccgcgcg

SEQ ID NO: 170400 - DNA, 75 bp, Artificial Sequence
  Synthetic
ctggattcccgtgtgcgtcgtggtagtcatgacctccgtagtcctgttcgcaggtctgcacgtgtacctgtggta

SEQ ID NO: 170401 - DNA, 75 bp, Artificial Sequence
  Synthetic
gctggtggaagatgccgaaccgccggccgagctggagatggtggaagtgtcggacgagtgttactaggagatcgc

SEQ ID NO: 170402 - DNA, 75 bp, Artificial Sequence
  Synthetic
tggcccagcgcaacggcatgtcgccgcgccccccgcccctcggtcgcggccgcggggccggagggccttcggggg

SEQ ID NO: 170403 - DNA, 75 bp, Artificial Sequence
  Synthetic
atggggcgtccccgcgatcatcgtgatctggataacatgcgcggccttgggaatttggtgtttggcgggatcgtc

SEQ ID NO: 170404 - DNA, 75 bp, Artificial Sequence
  Synthetic
cgagatagtcgaaagtcccccggtttcggcgccgacggtgtccgtccccccgccgtcggaggagtcccaccagcc

SEQ ID NO: 170405 - DNA, 75 bp, Artificial Sequence
  Synthetic
tcggcgccgacggtgtccgtccccccgccgtcggaggagtcccaccagcccgtcatcccaccgcagccgccagca

SEQ ID NO: 170406 - DNA, 75 bp, Artificial Sequence
  Synthetic
tgcgaaccgacggtgagttcacaaccaccgtcgcagccgacggcgatgcccggcggtccgcccgacgctcctccc

SEQ ID NO: 170407 - DNA, 75 bp, Artificial Sequence
  Synthetic
cggcggtccgcccgacgctcctccccccgccatgccgcagatgccacccggcgtggccgaggcggtacaagctgc

SEQ ID NO: 170408 - DNA, 75 bp, Artificial Sequence
  Synthetic
agcaatgatacgtgttgtaatacaggttaccgtgtactggtgcgcgtgttacgatggcagtactttgtcggtgta

SEQ ID NO: 170409 - DNA, 75 bp, Artificial Sequence
  Synthetic
tgtgataaggaattttccgacttggcccacatctccttcctcagtgtttggacaataaacacattccttgccaaa

SEQ ID NO: 170410 - DNA, 75 bp, Artificial Sequence
  Synthetic
cccacatctccttcctcagtgtttggacaataaacacattccttgccaaaaaatgacgtttccagaaatccaagg

SEQ ID NO: 170411 - DNA, 75 bp, Artificial Sequence
  Synthetic
tatggctcggcgtcgggctcctcggcggtaccggactggcttccctggtcctggccatttccttatttacccagc

SEQ ID NO: 170412 - DNA, 75 bp, Artificial Sequence
  Synthetic
cggtaccggactggcttccctggtcctggccatttccttatttacccagcgccgaggccgcaagcgatccgacga

SEQ ID NO: 170413 - DNA, 75 bp, Artificial Sequence
  Synthetic
gaaagacgacgtcgtcgagccgctggatctggaactggggctcatgcgggtggccacccacccgccgacgccgca

SEQ ID NO: 170414 - DNA, 75 bp, Artificial Sequence
  Synthetic
gatctggaactggggctcatgcgggtggccacccacccgccgacgccgcaggtgccgcggtgtacgtcgctctac

SEQ ID NO: 170415 - DNA, 75 bp, Artificial Sequence
  Synthetic
ccgggaacgccgaccagcatcggccgatctccgtcgcattgctcctcgtcgggctctttgtcgtcctcgaccagc

SEQ ID NO: 170416 - DNA, 75 bp, Artificial Sequence
  Synthetic
gggctctttgtcgtcctcgaccagcgtcgacacggtgctgcatcagccgccgccatcctggaagccacctccgcc

SEQ ID NO: 170417 - DNA, 75 bp, Artificial Sequence
  Synthetic
cgcggctgtcgtcgcacagacccccgacgccgatacccgcgccgcgtaagaacctgagcacgccgcccaccaaga

SEQ ID NO: 170418 - DNA, 75 bp, Artificial Sequence
  Synthetic
gacgccgatacccgcgccgcgtaagaacctgagcacgccgcccaccaagaaaacgccgccgcccacgaaacccaa

SEQ ID NO: 170419 - DNA, 75 bp, Artificial Sequence
  Synthetic
tccgagactgccgcgcaccgtcgggctggagaatctctcgaaggtgggactctcgtgtccctgtccccgaccccg

SEQ ID NO: 170420 - DNA, 75 bp, Artificial Sequence
  Synthetic
ccctcagccctgtcccgcaccggcggcggtcggggtgtgtcgggggcgcggctgggtgggtgcgtgcgtggggtg

SEQ ID NO: 170421 - DNA, 75 bp, Artificial Sequence
  Synthetic
tctcgtgtccctgtccccgaccccgcacgccgacggagccgaccacgctgcctatcgtgtcggtttccgagttag

SEQ ID NO: 170422 - DNA, 75 bp, Artificial Sequence
  Synthetic
cgatgcagatgacctgagaccgaaagagcgagcgcgtccgttgtacagttgtatagcagcacacgccttccctct

SEQ ID NO: 170423 - DNA, 75 bp, Artificial Sequence
  Synthetic
gagcgagcgcgtccgttgtacagttgtatagcagcacacgccttccctctttttcaccgcagctaagagagagaa

SEQ ID NO: 170424 - DNA, 75 bp, Artificial Sequence
  Synthetic
tcgaaaggccctgagtcgcattcaccggttctgggaatgtcggctacgggtgtggtggctgagtgacgccggcgt

SEQ ID NO: 170425 - DNA, 75 bp, Artificial Sequence
  Synthetic
cggttctgggaatgtcggctacgggtgtggtggctgagtgacgccggcgtaagagaaaccgacccaccgcgtccc

SEQ ID NO: 170426 - DNA, 75 bp, Artificial Sequence
  Synthetic
atcggcgcgctcatcgcgtacttaagatattaccaccaggacagttggcgagacatgctccacgatctattttgc

SEQ ID NO: 170427 - DNA, 75 bp, Artificial Sequence
  Synthetic
gatattaccaccaggacagttggcgagacatgctccacgatctattttgcggctgtcattatcccgagaagtgcc

SEQ ID NO: 170428 - DNA, 75 bp, Artificial Sequence
  Synthetic
gccggccgttgaacggagccatgtactacggcagcggctgtcgcttcgacacggtggaaatggtggacgagacga

SEQ ID NO: 170429 - DNA, 75 bp, Artificial Sequence
  Synthetic
acggtggaaatggtggacgagacgagacccgcgccgccggcgctgtcatcgcccgaaaccggcgacgatagcaac

SEQ ID NO: 170430 - DNA, 75 bp, Artificial Sequence
  Synthetic
ctgccggaatggatggatgcggtgcatgtggcggtccaagccgccgttcaagcgaccgtgcaagtgagtggcccg

SEQ ID NO: 170431 - DNA, 75 bp, Artificial Sequence
  Synthetic
atgtggcggtccaagccgccgttcaagcgaccgtgcaagtgagtggcccgcgggagaacgccgtatctcccgcta

SEQ ID NO: 170432 - DNA, 75 bp, Artificial Sequence
  Synthetic
cggtcaccatggacgatctgccgctgaacgtcgggttacccatcatcggcgtgatgctcgtgctgatcgtggcca

SEQ ID NO: 170433 - DNA, 75 bp, Artificial Sequence
  Synthetic
gaacgtcgggttacccatcatcggcgtgatgctcgtgctgatcgtggccatcctctgctatctggcttaccactg

SEQ ID NO: 170434 - DNA, 75 bp, Artificial Sequence
  Synthetic
gtacgagcgccggttcgcggacctgtcgtctctgggcctcggcgccgtacggcgggagtcggacagacgataccg

SEQ ID NO: 170435 - DNA, 75 bp, Artificial Sequence
  Synthetic
tcgtctctgggcctcggcgccgtacggcgggagtcggacagacgataccgtttctccgaacggcccgacgagatc

SEQ ID NO: 170436 - DNA, 75 bp, Artificial Sequence
  Synthetic
tcgtcctcgtcgtcggtccacgtcgctaaccagagaaacagcgtgcctccgccggacatggcggtgacggcgccg

SEQ ID NO: 170437 - DNA, 75 bp, Artificial Sequence
  Synthetic
gccggacatggcggtgacggcgccgctgaccgacgtcgatctgttgaaacccgtaacgggatccgcgacgcagtt

SEQ ID NO: 170438 - DNA, 75 bp, Artificial Sequence
  Synthetic
cgcgataatgtcgttttgacattctctgctcgatctactcagcgtctgcacgaaacggcgcccgcacggaggcga

SEQ ID NO: 170439 - DNA, 75 bp, Artificial Sequence
  Synthetic
ctgctcgatctactcagcgtctgcacgaaacggcgcccgcacggaggcgagcccaagcgtatctgcagcaagcgg

SEQ ID NO: 170440 - DNA, 75 bp, Artificial Sequence
  Synthetic
gatcaggcggctcccgggcgtggagttcaacgggtggtaatggtggcggtgatcggtgttaaaaaacggtggccc

SEQ ID NO: 170441 - DNA, 75 bp, Artificial Sequence
  Synthetic
ttcaacgggtggtaatggtggcggtgatcggtgttaaaaaacggtggccctggcaaacatatatctactgtaaac

SEQ ID NO: 170442 - DNA, 75 bp, Artificial Sequence
  Synthetic
attaacaaacgggacgatccacgatgtatattgtgtaaacaagaatcttcctgccattacactatcacacgacgt

SEQ ID NO: 170443 - DNA, 75 bp, Artificial Sequence
  Synthetic
gtatattgtgtaaacaagaatcttcctgccattacactatcacacgacgtaggcaacattgcgataagtcacacg

SEQ ID NO: 170444 - DNA, 75 bp, Artificial Sequence
  Synthetic
gacggttgttgttatgttgacgatagccgtcgcggcagttgccatcgtaagcagtaataacaatacaaccaacag

SEQ ID NO: 170445 - DNA, 75 bp, Artificial Sequence
  Synthetic
ggtacctggtggacagttcagcatgtcggaatgctggctgctggtggatggtcgtgctttatactactattgatg

SEQ ID NO: 170446 - DNA, 75 bp, Artificial Sequence
  Synthetic
gggtgtgcggggacggccacgggggccttttgcggcggggacggtggtggggacggcgcgttgcggggccgggga

SEQ ID NO: 170447 - DNA, 75 bp, Artificial Sequence
  Synthetic
aaaacaacccacgcgtacaccaatgccgcattcacttcttccgacgcgacgctacccatgggcactacagggtcg

SEQ ID NO: 170448 - DNA, 75 bp, Artificial Sequence
  Synthetic
gcgccatctcctcctggaggccggcggcgttaactgctacagctgcggcggcgacgacagctgcgatttgtcggc

SEQ ID NO: 170449 - DNA, 75 bp, Artificial Sequence
  Synthetic
acctcaactgttcctgatgagcacccgcgctctcatctcttcagacttgtcatgacccccgctcagactaacgcc

SEQ ID NO: 170450 - DNA, 75 bp, Artificial Sequence
  Synthetic
cgcgctctcatctcttcagacttgtcatgacccccgctcagactaacgccactaccaccgtgcacccgcacgacg

SEQ ID NO: 170451 - DNA, 75 bp, Artificial Sequence
  Synthetic
actgacgtgaggggcgattcacgtcactgacggctgacgggaataagacgggtgaggaatttccacctttttctt

SEQ ID NO: 170452 - DNA, 75 bp, Artificial Sequence
  Synthetic
tctttatgctctacttttggaacaacgacgtgttccgtaagctgctccgctgcgcttggatccaacgctgctgcg

SEQ ID NO: 170453 - DNA, 75 bp, Artificial Sequence
  Synthetic
cgacgtgttccgtaagctgctccgctgcgcttggatccaacgctgctgcgaccgcttcgacgcgtggcaagacga

SEQ ID NO: 170454 - DNA, 75 bp, Artificial Sequence
  Synthetic
tcttttatcacccgcgtccgatggcggttttgacaacccggcactgacagaagccgtcgacagcgtggacgactg

SEQ ID NO: 170455 - DNA, 75 bp, Artificial Sequence
  Synthetic
gaacgcgctgcgccacagccacgactcttggcagcttcatcagaccctgtgacgcagatgaacgttccttcttaa

SEQ ID NO: 170456 - DNA, 75 bp, Artificial Sequence
  Synthetic
gacgcagatgaacgttccttcttaaacatccgaggtagcaatgagacaggtcgcgtaccgccggcgacgcgagag

SEQ ID NO: 170457 - DNA, 75 bp, Artificial Sequence
  Synthetic
tgttcgccatccgcaccaccgaagccgtgctcaatacactcatcatcttcgtgggcggtccgctcaacgctatag

SEQ ID NO: 170458 - DNA, 75 bp, Artificial Sequence
  Synthetic
cagcaaaaaagacctgcaaaaaaaccggacgctcagttgcgggcatcccgggcgagaagctgcgtcgcacggtgg

SEQ ID NO: 170459 - DNA, 75 bp, Artificial Sequence
  Synthetic
cggacgctcagttgcgggcatcccgggcgagaagctgcgtcgcacggtggtcaccaccacgccggcccgacgttt

SEQ ID NO: 170460 - DNA, 75 bp, Artificial Sequence
  Synthetic
cgccgggagtcgctccgaactctgccgtggctgttctgggtgctgttgagctgcccgcgactcctcgaatattct

SEQ ID NO: 170461 - DNA, 75 bp, Artificial Sequence
  Synthetic
cgtggctgttctgggtgctgttgagctgcccgcgactcctcgaatattcttcctcttcgttctccttcgccaccg

SEQ ID NO: 170462 - DNA, 75 bp, Artificial Sequence
  Synthetic
agcaagttactatcccctgcacggtcatgacacactcctggcccatggtctccattcgcgcacgtttctgtcgtt

SEQ ID NO: 170463 - DNA, 75 bp, Artificial Sequence
  Synthetic
cccacgacggtagcgacgagctcatcctggacgccgtcaaaggccatcggctgatgaacggactccagtaccgcc

SEQ ID NO: 170464 - DNA, 75 bp, Artificial Sequence
  Synthetic
tacgaacggattccataccggccctccagacagaacgacaactccccgttgatcgaaccgacgggcacagacgac

SEQ ID NO: 170465 - DNA, 75 bp, Artificial Sequence
  Synthetic
atacagccggcatgtacgaatgcgtgctgcgcaactacagccacggcctcatcatgcaacgcttcgtaattctca

SEQ ID NO: 170466 - DNA, 75 bp, Artificial Sequence
  Synthetic
gctgcgcaactacagccacggcctcatcatgcaacgcttcgtaattctcacgcagctggagacgctcagccggcc

SEQ ID NO: 170467 - DNA, 75 bp, Artificial Sequence
  Synthetic
tctacggaatcacgactgcgggatgtaccgcggttttcaacgcaactacttctatatcggccgcgccgacgccga

SEQ ID NO: 170468 - DNA, 75 bp, Artificial Sequence
  Synthetic
taccgcggttttcaacgcaactacttctatatcggccgcgccgacgccgaggattgctggaaacccgcatgtccg

SEQ ID NO: 170469 - DNA, 75 bp, Artificial Sequence
  Synthetic
cacccgccgaaattcttaccggtgacgccagcaccgccggccgacatagacaccgggatgtctccctgggccact

SEQ ID NO: 170470 - DNA, 75 bp, Artificial Sequence
  Synthetic
cgccagcaccgccggccgacatagacaccgggatgtctccctgggccactcggggaatcgcggcgtttttggggt

SEQ ID NO: 170471 - DNA, 75 bp, Artificial Sequence
  Synthetic
cgggaaggggacgacgaggcggtgagggctatcgacgcctaccgacttacgatagttaccccggtgttagaaaga

SEQ ID NO: 170472 - DNA, 75 bp, Artificial Sequence
  Synthetic
gggctatcgacgcctaccgacttacgatagttaccccggtgttagaaagatgaagaggtgagaacacgtataaaa

SEQ ID NO: 170473 - DNA, 75 bp, Artificial Sequence
  Synthetic
ggtggttattcggatactttatgtcatccgttgggagcgaacggtcattatcctatcattaccacctggaatcta

SEQ ID NO: 170474 - DNA, 75 bp, Artificial Sequence
  Synthetic
ggcaccctatgtgtccggtataacgttacgataggaacccttcctgctagtccattttcactagtaggatacctt

SEQ ID NO: 170475 - DNA, 75 bp, Artificial Sequence
  Synthetic
tattttttggattctgcagaaaagcaagtgtaacaacaccactatcgctaatacttccacgtcgattacacccac

SEQ ID NO: 170476 - DNA, 75 bp, Artificial Sequence
  Synthetic
aagtgtaacaacaccactatcgctaatacttccacgtcgattacacccacaagcttaatatctactacacaactg

SEQ ID NO: 170477 - DNA, 75 bp, Artificial Sequence
  Synthetic
accgaaactctttataatatagatagcgaaaacattcatcgcgtatctcaatattttcacacaagatggataaaa

SEQ ID NO: 170478 - DNA, 75 bp, Artificial Sequence
  Synthetic
gcgaaaacattcatcgcgtatctcaatattttcacacaagatggataaaatctctgcaagagaatcacacttgcg

SEQ ID NO: 170479 - DNA, 75 bp, Artificial Sequence
  Synthetic
ggattcactgcaagctctgtaaaaggcacagacgtgacctcaactatttccgccatatctacccaaacatctaca

SEQ ID NO: 170480 - DNA, 75 bp, Artificial Sequence
  Synthetic
ataacaacacatataagtatccgtcctcctgactcatttatcgctatctctatgccccgctcacatgcaagagtt

SEQ ID NO: 170481 - DNA, 75 bp, Artificial Sequence
  Synthetic
cgccgcgacgatgctgaacgacaggatcagacagacggcgtacaggagtcctaggtcggcgtcgacgcggcaggt

SEQ ID NO: 170482 - DNA, 75 bp, Artificial Sequence
  Synthetic
aacggcgacacgaattcatcgacacagcatgtaaccgatagtactgtgactttgcaaactatatcattatcaacc

SEQ ID NO: 170483 - DNA, 75 bp, Artificial Sequence
  Synthetic
cgggatggcaagaccgtctaaattacaccgtcataaatagtacacactttaacctcacagaatcgaacataacca

SEQ ID NO: 170484 - DNA, 75 bp, Artificial Sequence
  Synthetic
aacactactactatggtaaatgcaaatgaaaacgtcactacaccgcttccaacttgctcatcgcctaacagcaca

SEQ ID NO: 170485 - DNA, 75 bp, Artificial Sequence
  Synthetic
gcattcaaaaatatctcaacactacctgcatagaaagactccgtaactacaccttggagtccgtatacaccacaa

SEQ ID NO: 170486 - DNA, 75 bp, Artificial Sequence
  Synthetic
aataatactatatcaaaagaacctgaaacattattggaggcggcacaaggagacaatattactataacacacaac

SEQ ID NO: 170487 - DNA, 75 bp, Artificial Sequence
  Synthetic
aagatacaactcaaagacatactgtacagacgccgtcttttaacgacacacataacgtgacggaacacacgttaa

SEQ ID NO: 170488 - DNA, 75 bp, Artificial Sequence
  Synthetic
ggtattacttacctttatcaccgggcgcaaaagcgctaagataccccacctgagtgaagggacccttgcagtctg

SEQ ID NO: 170489 - DNA, 75 bp, Artificial Sequence
  Synthetic
atttatgttttacatgcgatcgtaatttatctttatctctgtacggtcttaattttactcattctggtaaatata

SEQ ID NO: 170490 - DNA, 75 bp, Artificial Sequence
  Synthetic
gtcagtaaatatgattccgattcaacacatatactccccacgatcctcgaacaccttacagcatatgagcaaaaa

SEQ ID NO: 170491 - DNA, 75 bp, Artificial Sequence
  Synthetic
tttgggcaaataacatgctgtcatccactagcgtctattaatctaatgtttaacgggagctgtactgtcgccgtt

SEQ ID NO: 170492 - DNA, 75 bp, Artificial Sequence
  Synthetic
tcagccttggcgacaggtgtaatcacagctgtcacataactctcgaagcctccaatcacagcagcacacatagtc

SEQ ID NO: 170493 - DNA, 75 bp, Artificial Sequence
  Synthetic
ttcggaaaacttgacggttgtacggcacgacaaatcgatgtagtggtatgtgtttccagcagggaccgtgtgcgg

SEQ ID NO: 170494 - DNA, 75 bp, Artificial Sequence
  Synthetic
aaaactttcagcgttgtaggtggactttgcagtatgcgggttagtgaagttatgtcatttatttacgtttacgat

SEQ ID NO: 170495 - DNA, 75 bp, Artificial Sequence
  Synthetic
tttttattcttccggtaggaggcatgaagcctctggtgatgctcatctgcttcggtgtgtttttactacagcttg

SEQ ID NO: 170496 - DNA, 75 bp, Artificial Sequence
  Synthetic
acaaaagggttcattccgataccgcagagtagtatacacccatgttgcgagatctcttaactgcgtggccataat

SEQ ID NO: 170497 - DNA, 75 bp, Artificial Sequence
  Synthetic
aagttacaaaagtgtgtacagagaatagtggcataacgtgtacattgtgcccaaacggtacttatctcacagggc

SEQ ID NO: 170498 - DNA, 75 bp, Artificial Sequence
  Synthetic
cgtaactgcacttccaccaataacaccatatgcgcatctaagaatcatacgtcgttttccagtccaggtgtccaa

SEQ ID NO: 170499 - DNA, 75 bp, Artificial Sequence
  Synthetic
gcctggttgtccctcttcatctttctcgtgggtatcatacttttaattctctatcttatagccgcctatcggagt

SEQ ID NO: 170500 - DNA, 75 bp, Artificial Sequence
  Synthetic
tcgtgggtatcatacttttaattctctatcttatagccgcctatcggagtgagagatgccaacagtgttgctcaa

SEQ ID NO: 170501 - DNA, 75 bp, Artificial Sequence
  Synthetic
tcgtcccgtcgcaaagcacgtcccaaactggcttggggagtcaacggtggttctgtgggtcgggtgtagcgcgag

SEQ ID NO: 170502 - DNA, 75 bp, Artificial Sequence
  Synthetic
ataattacagatgagctgttcatattttttattattttttccaattcctgcactaaaaaaagaagcactttacgg

SEQ ID NO: 170503 - DNA, 75 bp, Artificial Sequence
  Synthetic
tttttattattttttccaattcctgcactaaaaaaagaagcactttacggaaccgtgtctgaatatctgtgggga

SEQ ID NO: 170504 - DNA, 75 bp, Artificial Sequence
  Synthetic
gccgcccggcgcgtcgtctgtgtgcgggagccgaaacaccgtgcctctttatatcgtcccgacgtgacgcgagta

SEQ ID NO: 170505 - DNA, 75 bp, Artificial Sequence
  Synthetic
ctctttcttgttgccttcgatgtacggcgtcctggctcattactactcctttatcagtagccccagcgttatggt

SEQ ID NO: 170506 - DNA, 75 bp, Artificial Sequence
  Synthetic
ggcgtcctggctcattactactcctttatcagtagccccagcgttatggttaattttaaacatcataacgccgtg

SEQ ID NO: 170507 - DNA, 75 bp, Artificial Sequence
  Synthetic
aactatggagcatatgccgtgttgatggctacatcgcaaagaaagtccctagtgttacatcgatacagtgccgtg

SEQ ID NO: 170508 - DNA, 75 bp, Artificial Sequence
  Synthetic
agtgttacatcgatacagtgccgtgacagccgtggccctgcagctcatgcctgttgagatgctccgtaagctaga

SEQ ID NO: 170509 - DNA, 75 bp, Artificial Sequence
  Synthetic
cgacgatgactcctcgatgggtggaagtgaagattgatgatgagaacctgacaagaaagacgagagagaaattca

SEQ ID NO: 170510 - DNA, 75 bp, Artificial Sequence
  Synthetic
agtgaagattgatgatgagaacctgacaagaaagacgagagagaaattcagagctgtcattgtagaattagtcta

SEQ ID NO: 170511 - DNA, 75 bp, Artificial Sequence
  Synthetic
gattgattggtatgtggggggatccgatttcaaaggggggtacttatcgggaattgatgtgtcatggacgcagtt

SEQ ID NO: 170512 - DNA, 75 bp, Artificial Sequence
  Synthetic
gatttcaaaggggggtacttatcgggaattgatgtgtcatggacgcagttttgagtgattttccgggaataccgg

SEQ ID NO: 170513 - DNA, 75 bp, Artificial Sequence
  Synthetic
gttatcgtgtatacgtattattatgaagtacagagcgtagaattacgttgcccgtgtactgatggtttccgcaat

SEQ ID NO: 170514 - DNA, 75 bp, Artificial Sequence
  Synthetic
aagtacagagcgtagaattacgttgcccgtgtactgatggtttccgcaatcctttattcggtctatttcttattg

SEQ ID NO: 170515 - DNA, 75 bp, Artificial Sequence
  Synthetic
gcttgggtccagaacatcacttatcatcatggctcaaaggtcaaaatagtagtttatggcacaaagtactggtga

SEQ ID NO: 170516 - DNA, 75 bp, Artificial Sequence
  Synthetic
atcatggctcaaaggtcaaaatagtagtttatggcacaaagtactggtgacaaaaaaaggcgatgaaccacaagt

SEQ ID NO: 170517 - DNA, 75 bp, Artificial Sequence
  Synthetic
ataaagtttttacgaaaaaatgcaatgcaatgttttcaacatgttaacatggttacaccattcgattccgaattc

SEQ ID NO: 170518 - DNA, 75 bp, Artificial Sequence
  Synthetic
tcttttagaactggaagattacgacaggcgctgtcgttgtaacaaccaaattctgttgaataccctgccagtcgg

SEQ ID NO: 170519 - DNA, 75 bp, Artificial Sequence
  Synthetic
aaccgaattgcttaagccaatcgcagcgagcgaaagctgcaatcgtcaggaagtgctggctattttaaaggacaa

SEQ ID NO: 170520 - DNA, 75 bp, Artificial Sequence
  Synthetic
gactataaggatcgcgaccgagttttctggcatggtaaaagctgcccactgtggcaggtatgtagcgtatccggt

SEQ ID NO: 170521 - DNA, 75 bp, Artificial Sequence
  Synthetic
agacgaagaacaacgcatttacgacgtagtgtctaccaatattgagtttggtgcctggccagtccctacggccta

SEQ ID NO: 170522 - DNA, 75 bp, Artificial Sequence
  Synthetic
gacggcgaataaaagcgacgtgcggcgcgcacggcgaaaagcagacgcgcgtctgtgtctgtttgattccccggg

SEQ ID NO: 170523 - DNA, 75 bp, Artificial Sequence
  Synthetic
tggaccacgaagagtgcgaggaaccggacgagatcgttcgcgaagagcaagactatcgggctctgctggcctttt

SEQ ID NO: 170524 - DNA, 75 bp, Artificial Sequence
  Synthetic
cgtcacttgtgtgatctgagacgtcatgctggtagcgtttatgagtcgggcggtggccgacacgccgcatttcct

SEQ ID NO: 170525 - DNA, 75 bp, Artificial Sequence
  Synthetic
cgcgactatgtgcatgttcggctactgagctaccgaggcgaccccctggtcttcaagcacactttctcgggtgtg

SEQ ID NO: 170526 - DNA, 75 bp, Artificial Sequence
  Synthetic
tgagctaccgaggcgaccccctggtcttcaagcacactttctcgggtgtgcgtcgacccttcaccgagctaggct

SEQ ID NO: 170527 - DNA, 75 bp, Artificial Sequence
  Synthetic
cggtgcggcgttacagcacggtgagccccggcaaggaagtgacgcttcagcttcacgggaaccaaaccgtacagc

SEQ ID NO: 170528 - DNA, 75 bp, Artificial Sequence
  Synthetic
aaaacagcaggaattactatttcagaagagaagatgcgaattccaccttctattactcttgttacaatctgaccg

SEQ ID NO: 170529 - DNA, 75 bp, Artificial Sequence
  Synthetic
ccccggcaaggaagtgacgcttcagcttcacgggaaccaaaccgtacagccgtcgtttctaagctttacgtgccg

SEQ ID NO: 170530 - DNA, 75 bp, Artificial Sequence
  Synthetic
ttgtgtttacgttgcttttgaaatgttaagcgtccctacggcgctaacatgtttctaggctactctgactgtgta

SEQ ID NO: 170531 - DNA, 75 bp, Artificial Sequence
  Synthetic
ttgcgtctccatgattgtgccacgttcgagtcctgctgttacgacatcaccgaggcggagagtaacaaggctata

SEQ ID NO: 170532 - DNA, 75 bp, Artificial Sequence
  Synthetic
cttcgtggccggacacggcgagaccgacttttacatgaactggacgctgcgtcgcagtcagacccactacctgga

SEQ ID NO: 170533 - DNA, 75 bp, Artificial Sequence
  Synthetic
gacttttacatgaactggacgctgcgtcgcagtcagacccactacctggaggagatggccttacaggtggagatt

SEQ ID NO: 170534 - DNA, 75 bp, Artificial Sequence
  Synthetic
cgcaatgccactgcgtgacgtcccacggtctttgttcgcgagaccgacctgagggaggtttgcgggccgtgagcg

SEQ ID NO: 170535 - DNA, 75 bp, Artificial Sequence
  Synthetic
gatttctgcgtgtaccgctacaacgcgcgcctgacccgcggctacgtacgatacaccctgtcaccgaaagcgcgc

SEQ ID NO: 170536 - DNA, 75 bp, Artificial Sequence
  Synthetic
cgcgcctgacccgcggctacgtacgatacaccctgtcaccgaaagcgcgcttgcccgcaaaagcagagggttggc

SEQ ID NO: 170537 - DNA, 75 bp, Artificial Sequence
  Synthetic
ccacggcgcttagtgcgcgctgccgatgcgtgtcgtcccacggtatttgtcagcggcacggcgctggggacgggg

SEQ ID NO: 170538 - DNA, 75 bp, Artificial Sequence
  Synthetic
gcgttttgataacctacctggtgtcgcggcgtcggtagaggcttgcggaaaccacgtcctcgtcacacgtcgttc

SEQ ID NO: 170539 - DNA, 75 bp, Artificial Sequence
  Synthetic
gcggcgcttcgccttccgcgggtttttgggcgtgctggccgccggcggggacggcgtgttgcggggacgggggtt

SEQ ID NO: 170540 - DNA, 75 bp, Artificial Sequence
  Synthetic
gcggcgtcggtagaggcttgcggaaaccacgtcctcgtcacacgtcgttcgcggacataacaagaaatccacgtc

SEQ ID NO: 170541 - DNA, 75 bp, Artificial Sequence
  Synthetic
acgggtgtttccacggcgcttctgcgcggcgcttcgccttccgcgggtttttgggcgtgctggccgccggcgggg

SEQ ID NO: 170542 - DNA, 75 bp, Artificial Sequence
  Synthetic
ttgggcgtgctggccgccggcggggacggcgtgttgcggggacgggggttgcgctgggtccgggggtgttgcggg

SEQ ID NO: 170543 - DNA, 75 bp, Artificial Sequence
  Synthetic
tgcttcacatggacttcagcgacgctacaaatatgaccagcagcacaaacgtccctactagcaccagcagcagaa

SEQ ID NO: 170544 - DNA, 75 bp, Artificial Sequence
  Synthetic
tacaaatatgaccagcagcacaaacgtccctactagcaccagcagcagaaataccgtcgagagcaccacgagtag

SEQ ID NO: 170545 - DNA, 75 bp, Artificial Sequence
  Synthetic
gaaagtgctggctatcctcttctacatcgtgacaggcacctccattttcagcttcatagcggtactcatcgcggt

SEQ ID NO: 170546 - DNA, 75 bp, Artificial Sequence
  Synthetic
atcgtgacaggcacctccattttcagcttcatagcggtactcatcgcggtagtttactcctcgtgttgcaagcac

SEQ ID NO: 170547 - DNA, 75 bp, Artificial Sequence
  Synthetic
atgcggctcggcgtcatcaggttgtaacataacccaatggggacgttaccagaatggaagtacgctggggccatg

SEQ ID NO: 170548 - DNA, 75 bp, Artificial Sequence
  Synthetic
ccgtttggcagcggttcccgacgaggttctcagatccccgccggattttgttcctcgagcccttatcagcggttg

SEQ ID NO: 170549 - DNA, 75 bp, Artificial Sequence
  Synthetic
gttctcagatccccgccggattttgttcctcgagcccttatcagcggttggaaactcgggactgggacgaggagg

SEQ ID NO: 170550 - DNA, 75 bp, Artificial Sequence
  Synthetic
tggacacgtcgttcgtgaatcccaattatgggagaggctcgcctttgaccatcgaatctcacctctcggacaatg

SEQ ID NO: 170551 - DNA, 75 bp, Artificial Sequence
  Synthetic
ctcggtgtacgatgaactgaccgcctcggaaatggaagaaccttcgaacagcaccagctggcagattcccaaact

SEQ ID NO: 170552 - DNA, 75 bp, Artificial Sequence
  Synthetic
ccgcgttcgaaataacaagcgggctacctgttgggtggtgattttttggatactagccgtgcttatggggatgcc

SEQ ID NO: 170553 - DNA, 75 bp, Artificial Sequence
  Synthetic
ggcagggtattcaacagaatttggttattacagcgacagcgccggtcgtaatcttccagctctagaagacggaca

SEQ ID NO: 170554 - DNA, 75 bp, Artificial Sequence
  Synthetic
ttccaactctttccccgccccatcacctcgcctatactatgtgtatgatgtctcataataaagctttctttctca

SEQ ID NO: 170555 - DNA, 75 bp, Artificial Sequence
  Synthetic
cctcgcctatactatgtgtatgatgtctcataataaagctttctttctcagtctgcaacatgcggctgtgtcggg

SEQ ID NO: 170556 - DNA, 75 bp, Artificial Sequence
  Synthetic
gttgtttgcccccgtgattttggaatccgtcatctacgtgtatgcgccagagggagggaacgttaccctggtatc

SEQ ID NO: 170557 - DNA, 75 bp, Artificial Sequence
  Synthetic
agtaccgcattactgggacgcgtgctctcgcgcgctgcccgaccaaacccgttacaagtatgtggaacagctcgt

SEQ ID NO: 170558 - DNA, 75 bp, Artificial Sequence
  Synthetic
gttacaagtatgtggaacagctcgtggacctcacgttgaactaccactacgatgcgagccacggcttggacaact

SEQ ID NO: 170559 - DNA, 75 bp, Artificial Sequence
  Synthetic
taggtaaccgcatggggtgtgaaatgacgttcggaacctgtgcttgcagaatcaacgtgaccgaggtgtcgttgc

SEQ ID NO: 170560 - DNA, 75 bp, Artificial Sequence
  Synthetic
gacgttcggaacctgtgcttgcagaatcaacgtgaccgaggtgtcgttgctcatcagcgactttagacgtcagaa

SEQ ID NO: 170561 - DNA, 75 bp, Artificial Sequence
  Synthetic
gttcagcgtgcgactctttgccaactagcctgcgtcacgggaaataatatgctgcggcttctgcttcgtcaccac

SEQ ID NO: 170562 - DNA, 75 bp, Artificial Sequence
  Synthetic
tagcctgcgtcacgggaaataatatgctgcggcttctgcttcgtcaccactttcactgcctgcttctgtgcgcgg

SEQ ID NO: 170563 - DNA, 75 bp, Artificial Sequence
  Synthetic
aactgacgtattccaaaccgcatgacgcggcgacgttttactgtccttttatctatccctcgctcccacggtccc

SEQ ID NO: 170564 - DNA, 75 bp, Artificial Sequence
  Synthetic
ccttgcaattctcggggttccagcgggtattaacgggtcccgagtgtcgcaacgagaccctgtatctgctgtaca

SEQ ID NO: 170565 - DNA, 75 bp, Artificial Sequence
  Synthetic
gagaagctccacctgggtgaaaaaggtgatctggtacctgagcggtcgcaaccagaccatcctccaacggatgcc

SEQ ID NO: 170566 - DNA, 75 bp, Artificial Sequence
  Synthetic
gtgatctggtacctgagcggtcgcaaccagaccatcctccaacggatgccccgaacggcttcgaaaccgagcgac

SEQ ID NO: 170567 - DNA, 75 bp, Artificial Sequence
  Synthetic
cgcttcgtcgtcaacgatggcacacgttatcagatgtgtgtgatgaagctggagagctgggctcacgtcttccgg

SEQ ID NO: 170568 - DNA, 75 bp, Artificial Sequence
  Synthetic
gttatcagatgtgtgtgatgaagctggagagctgggctcacgtcttccgggactacagcgtgtcttttcaggtgc

SEQ ID NO: 170569 - DNA, 75 bp, Artificial Sequence
  Synthetic
gcgcgcgcagggaattttgaaaaccgcgcgtcatgagtcccaaaaacctgacgccgttcttgacggcgttgtggc

SEQ ID NO: 170570 - DNA, 75 bp, Artificial Sequence
  Synthetic
tgctattggatcacagccgcgtgccgcgggtacgcgcagaagaatgttgcgaattcataaacgtcaaccacccgc

SEQ ID NO: 170571 - DNA, 75 bp, Artificial Sequence
  Synthetic
gtgcaatcgcttcaccgtcgcgtacgtattttcatgattgtctgcgttctgtggtgcgtctggatctgtctctcg

SEQ ID NO: 170572 - DNA, 75 bp, Artificial Sequence
  Synthetic
gtattttcatgattgtctgcgttctgtggtgcgtctggatctgtctctcgacgtttctgatagccatgttccatc

SEQ ID NO: 170573 - DNA, 75 bp, Artificial Sequence
  Synthetic
agtcccgagaaaacggctgagattcgcgggatcgtcaccaccatgacccattcattgacacgccaggtcgtacac

SEQ ID NO: 170574 - DNA, 75 bp, Artificial Sequence
  Synthetic
gttatcgttataacaattatcgttttaatttgtttcaaatttccccagaaagcttggaataaattcacacaatac

SEQ ID NO: 170575 - DNA, 75 bp, Artificial Sequence
  Synthetic
cccttcccctccgtgttgtaggttatacctcgaagctgacgggcgaatacgctgtggcaaagtaaacgacaaggc

SEQ ID NO: 170576 - DNA, 75 bp, Artificial Sequence
  Synthetic
agcgttccctatcgatggatcaatctggaatacgacaagataacccggatcgtgggcctggatcagtacctggag

SEQ ID NO: 170577 - DNA, 75 bp, Artificial Sequence
  Synthetic
tggaatacgacaagataacccggatcgtgggcctggatcagtacctggagagcgttaagaaacacaaacggctgg

SEQ ID NO: 170578 - DNA, 75 bp, Artificial Sequence
  Synthetic
agatttctgtcgccgattaaattcatgtcgcgcgatagtggtgtttatcgccgatagatatggcgatattggaaa

SEQ ID NO: 170579 - DNA, 75 bp, Artificial Sequence
  Synthetic
tgtcgcgcgatagtggtgtttatcgccgatagatatggcgatattggaaaaatcgatatttgaaaatatggcata

SEQ ID NO: 170580 - DNA, 75 bp, Artificial Sequence
  Synthetic
gatatctggcgatagcgcttatatcgtttacgggggatggcgatagacgactttggcgacttgggcgattctgtg

SEQ ID NO: 170581 - DNA, 75 bp, Artificial Sequence
  Synthetic
tggcacatggccaatgcatatcgatatatacattgaatcaatattggccattagccatattagtcattggttata

SEQ ID NO: 170582 - DNA, 75 bp, Artificial Sequence
  Synthetic
cataatgtgtacatttatattggctcatgtccaatatgaccgccatgttgacattgattattgactagttattaa

SEQ ID NO: 170583 - DNA, 75 bp, Artificial Sequence
  Synthetic
catgtccaatatgaccgccatgttgacattgattattgactagttattaatagtaatcaattacggggtcattag

SEQ ID NO: 170584 - DNA, 75 bp, Artificial Sequence
  Synthetic
cccgcctattgacgtcaataatgacgtgagttcccatagtaacgccaatagggactttccattgacgtcaatggg

SEQ ID NO: 170585 - DNA, 75 bp, Artificial Sequence
  Synthetic
gtgagttcccatagtaacgccaatagggactttccattgacgtcaatgggtggagtatttacggtaaactgccca

SEQ ID NO: 170586 - DNA, 75 bp, Artificial Sequence
  Synthetic
aaaaattaatcgcattataattttattatctacgtcactaccagtaattcgtaatatccggtattcccggaaaat

SEQ ID NO: 170587 - DNA, 75 bp, Artificial Sequence
  Synthetic
gcattatgcccagtacatgaccttacgggactttcctacttggcagtacatctacgtattagtcatcgctattac

SEQ ID NO: 170588 - DNA, 75 bp, Artificial Sequence
  Synthetic
cgggactttcctacttggcagtacatctacgtattagtcatcgctattaccatggtgatgcggttttggcagtac

SEQ ID NO: 170589 - DNA, 75 bp, Artificial Sequence
  Synthetic
ttttggcaccaaattcaacgggactttccaaaatgtcgtaataactccgccccattgacgcaaatgggcggtagg

SEQ ID NO: 170590 - DNA, 75 bp, Artificial Sequence
  Synthetic
cccccccccacaatggaatgttgccaaaccggttctttcccgttatagccatagcgttcccaggcaaaagcaaac

SEQ ID NO: 170591 - DNA, 75 bp, Artificial Sequence
  Synthetic
ttccaaaatgtcgtaataactccgccccattgacgcaaatgggcggtaggcgtgtactatgggaggtctatataa

SEQ ID NO: 170592 - DNA, 75 bp, Artificial Sequence
  Synthetic
gggaccgatccagcctccgcggccgggaacggtgcattggaacgcggattccccgtgccaagagtgacgtaagta

SEQ ID NO: 170593 - DNA, 75 bp, Artificial Sequence
  Synthetic
cagtgaacgaaaacggtacattccccactaccaccaccaaaaagcccactacgactacgagaacgacaactacca

SEQ ID NO: 170594 - DNA, 75 bp, Artificial Sequence
  Synthetic
ggaacggtgcattggaacgcggattccccgtgccaagagtgacgtaagtaccgcctatagactctataggcacac

SEQ ID NO: 170595 - DNA, 75 bp, Artificial Sequence
  Synthetic
atggtatagcttagcctataggtgtgggttattgaccattattgaccactcccctattggtgacgatactttcca

SEQ ID NO: 170596 - DNA, 75 bp, Artificial Sequence
  Synthetic
tgcccgcagtttttattaaacataacgtgggatctccacgcgaatctcgggtacgtgttccggacatgggctctt

SEQ ID NO: 170597 - DNA, 75 bp, Artificial Sequence
  Synthetic
cgtgggatctccacgcgaatctcgggtacgtgttccggacatgggctcttctccggtagcggcggagcttccaca

SEQ ID NO: 170598 - DNA, 75 bp, Artificial Sequence
  Synthetic
cttaggcacagcacgatgcccaccaccaccagtgtgccgcacaaggccgtggcggtagggtatgtgtctgaaaat

SEQ ID NO: 170599 - DNA, 75 bp, Artificial Sequence
  Synthetic
ccaccagtgtgccgcacaaggccgtggcggtagggtatgtgtctgaaaatgagctcggggaatgggcttgcaccg

SEQ ID NO: 170600 - DNA, 75 bp, Artificial Sequence
  Synthetic
gttgtgttctgttgagagtcagaggtaactcctgttgcggtgctgttaacggtggagggcagtgtagtctgagca

SEQ ID NO: 170601 - DNA, 75 bp, Artificial Sequence
  Synthetic
taactcctgttgcggtgctgttaacggtggagggcagtgtagtctgagcagtactcgttgctgccgcgcgcgcca

SEQ ID NO: 170602 - DNA, 75 bp, Artificial Sequence
  Synthetic
tggaccctgataatcctgacgagggcccttcctccaaggtgccacggtacgtgtcgggacttgtgttcccctttt

SEQ ID NO: 170603 - DNA, 75 bp, Artificial Sequence
  Synthetic
gcgagacgggatacgttggcagtaccaagagctgcagtatctggtggaagaacaacggcggcgaaatcagtcgcg

SEQ ID NO: 170604 - DNA, 75 bp, Artificial Sequence
  Synthetic
atgtgtttaggcccgagacacccgtgaccaaggccacgacgttcctgcagactatgttaaggaaggaggttaaca

SEQ ID NO: 170605 - DNA, 75 bp, Artificial Sequence
  Synthetic
gaccaaggccacgacgttcctgcagactatgttaaggaaggaggttaacagtcagctgagcctgggagacccgct

SEQ ID NO: 170606 - DNA, 75 bp, Artificial Sequence
  Synthetic
aagtttttccaggacagaacaggatagtcagccatcttcacagtctacctcttaggccgtatccaggagcatagg

SEQ ID NO: 170607 - DNA, 75 bp, Artificial Sequence
  Synthetic
agatgtcctggcagaactcggtaagtctgttgacatgtatgtgatatatactaacctgcatgggacgtggattta

SEQ ID NO: 170608 - DNA, 75 bp, Artificial Sequence
  Synthetic
tctgttgacatgtatgtgatatatactaacctgcatgggacgtggatttacttgtgtatgtcagatagagtgaag

SEQ ID NO: 170609 - DNA, 75 bp, Artificial Sequence
  Synthetic
tatcctcctctacagtcaaacagattaaggttcgagtggacatggtgcggcatagaatcaaggagcacatgctga

SEQ ID NO: 170610 - DNA, 75 bp, Artificial Sequence
  Synthetic
taaggttcgagtggacatggtgcggcatagaatcaaggagcacatgctgaaaaaatatacccagacggaagagaa

SEQ ID NO: 170611 - DNA, 75 bp, Artificial Sequence
  Synthetic
tttcgaggagatgaagtgtattgggctaactatgcagagcatgtatgagaactacattgtacccgaggataagcg

SEQ ID NO: 170612 - DNA, 75 bp, Artificial Sequence
  Synthetic
actacattgtacccgaggataagcgggagatgtggatggcttgtattaaggagctgcatgatgtgaccaagggcg

SEQ ID NO: 170613 - DNA, 75 bp, Artificial Sequence
  Synthetic
atatgtgctacaggaatatagagttctttaccaagaactcagccttccctaagaccaccaatggctgcagtcagg

SEQ ID NO: 170614 - DNA, 75 bp, Artificial Sequence
  Synthetic
gctcacgcacattgatcacatatttatggatatcctcactacatgtgtggaaaccatgtgtaatgagtacaaggt

SEQ ID NO: 170615 - DNA, 75 bp, Artificial Sequence
  Synthetic
ctatatcttagaggagactagtgtgatgctggccaagcggcctctgataaccaagcctgaggttatcaatgtcat

SEQ ID NO: 170616 - DNA, 75 bp, Artificial Sequence
  Synthetic
gaagcgccgcattgaggagatctgcatgaaggtctttgcccagtacattctgggggccgatcctctgagagtctg

SEQ ID NO: 170617 - DNA, 75 bp, Artificial Sequence
  Synthetic
cacggccgacacgcacctggcttttataggcagcggcgtgcacggcgcttgctggcgccgccttggcgccgcgca

SEQ ID NO: 170618 - DNA, 75 bp, Artificial Sequence
  Synthetic
ggccaccgctggtgctagctcctctgattctctggtgtcacccccagagtcccctgtacccgcgactatccctct

SEQ ID NO: 170619 - DNA, 75 bp, Artificial Sequence
  Synthetic
gattctctggtgtcacccccagagtcccctgtacccgcgactatccctctgtcctcagtgattgtggctgagaac

SEQ ID NO: 170620 - DNA, 75 bp, Artificial Sequence
  Synthetic
ggacgcctgccgagcgcgcacacacctaggtggacgcccggcatccattccgggccgtgtgctgggtccccgagg

SEQ ID NO: 170621 - DNA, 75 bp, Artificial Sequence
  Synthetic
tctgtcaagtctgagccagtgtctgagatagaggaagttgcctcagaggaagaggaggatggtgctgaggaaccc

SEQ ID NO: 170622 - DNA, 75 bp, Artificial Sequence
  Synthetic
gggagggggggggggctcgcgggccccggggcacacttgttcccgccgccgacacgcaccccgcacaccgccgac

SEQ ID NO: 170623 - DNA, 75 bp, Artificial Sequence
  Synthetic
agatagaggaagttgcctcagaggaagaggaggatggtgctgaggaacccaccacctctggaggcaagagcaccc

SEQ ID NO: 170624 - DNA, 75 bp, Artificial Sequence
  Synthetic
aaagcagcaaaagcagcaggtaaataagagaaggagtccagataatgtccagccgctagcggcaagcagcgcgag

SEQ ID NO: 170625 - DNA, 75 bp, Artificial Sequence
  Synthetic
gtcactattgtatactctatattatactctatgttatactctgtaatcctactcaataaacgtgtcacgcctgtg

SEQ ID NO: 170626 - DNA, 75 bp, Artificial Sequence
  Synthetic
acacaccctgacacaccccgccaacacacccccgacacacccgacacacacccacccagccgcgcccccgaccca

SEQ ID NO: 170627 - DNA, 75 bp, Artificial Sequence
  Synthetic
atggcgtggttggtgctacagtactgttactactattggtggaagtactggaattagaactggtgcctgtagtag

SEQ ID NO: 170628 - DNA, 75 bp, Artificial Sequence
  Synthetic
actctatgttatactctgtaatcctactcaataaacgtgtcacgcctgtgaaaccgtactaagtctcccgtgtct

SEQ ID NO: 170629 - DNA, 75 bp, Artificial Sequence
  Synthetic
cgctgacaacccactcttgcagcgttagcagcgcccctcttaacaagccgacccccaccagcgtcgcggttacta

SEQ ID NO: 170630 - DNA, 75 bp, Artificial Sequence
  Synthetic
tagcagcgcccctcttaacaagccgacccccaccagcgtcgcggttactaacactcctctccccggggcatccgc

SEQ ID NO: 170631 - DNA, 75 bp, Artificial Sequence
  Synthetic
gggggggagtcgcgggccccggggcacactgctacccctgacacaccccgccaccacacccccgacacacccggc

SEQ ID NO: 170632 - DNA, 75 bp, Artificial Sequence
  Synthetic
gcctcccgcgcctatcatgctgcccctcatcaaacaggaagacatcaagcccgagcccgactttaccatccagta

SEQ ID NO: 170633 - DNA, 75 bp, Artificial Sequence
  Synthetic
ctcatcaaacaggaagacatcaagcccgagcccgactttaccatccagtaccgcaacaagattatcgataccgcc

SEQ ID NO: 170634 - DNA, 75 bp, Artificial Sequence
  Synthetic
ccgaggggcgggggggtgttttttgcgggggggtgaaaattggagttgcgtgtgcggtgcggaggacggcgacgg

SEQ ID NO: 170635 - DNA, 75 bp, Artificial Sequence
  Synthetic
ccttccaccggcagcggcacgccgcgagtgacctctcccacgcacccgctctcccagatgaaccaccctcctctt

SEQ ID NO: 170636 - DNA, 75 bp, Artificial Sequence
  Synthetic
ctcccagatgaaccaccctcctcttcccgatcctttgggccggcccgatgaagatagttcctcttcgtcttcctc

SEQ ID NO: 170637 - DNA, 75 bp, Artificial Sequence
  Synthetic
aatccccggggaacagaggaagaagaagtccctggggacgcgagcatcaactcccgggggaaggggacggcagcg

SEQ ID NO: 170638 - DNA, 75 bp, Artificial Sequence
  Synthetic
aagtccctggggacgcgagcatcaactcccgggggaaggggacggcagcgcgagttcccgggggtgagggacgac

SEQ ID NO: 170639 - DNA, 75 bp, Artificial Sequence
  Synthetic
ggggacgggggcctttcgcggcggggacagtggtggggacgggggactcttgcggcggggacggggacgggggtg

SEQ ID NO: 170640 - DNA, 75 bp, Artificial Sequence
  Synthetic
gcagcagtggcggaggagcatccgtgacctcgagccaccatgggcgcggcggttttggtggcgcggcctcctcct

SEQ ID NO: 170641 - DNA, 75 bp, Artificial Sequence
  Synthetic
gacctcgagccaccatgggcgcggcggttttggtggcgcggcctcctcctctctgctgagctgcggccatcagag

SEQ ID NO: 170642 - DNA, 75 bp, Artificial Sequence
  Synthetic
ctgcagacccgcgtcgggtcggggggggggagtcgcgggccccggggcacactgcttccatccagccgcgcgcac

SEQ ID NO: 170643 - DNA, 75 bp, Artificial Sequence
  Synthetic
gggggagtcgcgggccccggggcacactgcttccatccagccgcgcgcacacacccctgacacaccccgccacac

SEQ ID NO: 170644 - DNA, 75 bp, Artificial Sequence
  Synthetic
caatatcatgaaagataagaacacccccttctgcacacccaacgtgcagactcggcggggtcgcgtcaagattga

SEQ ID NO: 170645 - DNA, 75 bp, Artificial Sequence
  Synthetic
cccttctgcacacccaacgtgcagactcggcggggtcgcgtcaagattgacgaggtgagccgcatgttccgcaac

SEQ ID NO: 170646 - DNA, 75 bp, Artificial Sequence
  Synthetic
aaagcttgcaaaaccatgcaggtgaacaacaagggcatccagatcatctacacccgcaatcatgaggtgaagagt

SEQ ID NO: 170647 - DNA, 75 bp, Artificial Sequence
  Synthetic
acaacaagggcatccagatcatctacacccgcaatcatgaggtgaagagtgaggtggatgcggtgcggtgtcgcc

SEQ ID NO: 170648 - DNA, 75 bp, Artificial Sequence
  Synthetic
caacacacccggcaccgcgacacacccggcacacccagccgcacccggcacacacccacccagccgcacccccga

SEQ ID NO: 170649 - DNA, 75 bp, Artificial Sequence
  Synthetic
aagtggcgcagcgcacggccgatgcttgtaacgaaggcgtcaaggccgcgtggagcctcaaagaattgcacaccc

SEQ ID NO: 170650 - DNA, 75 bp, Artificial Sequence
  Synthetic
ttgtaacgaaggcgtcaaggccgcgtggagcctcaaagaattgcacacccaccaattatgcccccgttcctccga

SEQ ID NO: 170651 - DNA, 75 bp, Artificial Sequence
  Synthetic
cactgccgctgcgtggcgtcgcacggtctttgtttgctcagggatctttctgcgggtgtttttgtgcgctgggta

SEQ ID NO: 170652 - DNA, 75 bp, Artificial Sequence
  Synthetic
gtctttgtttgctcagggatctttctgcgggtgtttttgtgcgctgggtacggggtgctgcggggacgggggttt

SEQ ID NO: 170653 - DNA, 75 bp, Artificial Sequence
  Synthetic
gcaaaagttccccaaacaggtcatggtgcgcatcttctccaccaaccagggtgggttcatgctgcctatctacga

SEQ ID NO: 170654 - DNA, 75 bp, Artificial Sequence
  Synthetic
gtgcgcatcttctccaccaaccagggtgggttcatgctgcctatctacgagacggccgcgaaggcctacgccgtg

SEQ ID NO: 170655 - DNA, 75 bp, Artificial Sequence
  Synthetic
gcttgcggcggggaggcttttgcgctgcggggactcgcgaggacggcagttggcggcggggacgggggcttttgc

SEQ ID NO: 170656 - DNA, 75 bp, Artificial Sequence
  Synthetic
tgcggggactcgcgaggacggcagttggcggcggggacgggggcttttgcgctagggacttgcgggacagggtgt

SEQ ID NO: 170657 - DNA, 75 bp, Artificial Sequence
  Synthetic
caggacctgaggaacaagtctcagtaagtgaaaaactggaaagagagacatggactcttgtacatagtgattccc

SEQ ID NO: 170658 - DNA, 75 bp, Artificial Sequence
  Synthetic
ggggattaagacgttaataaagagtagcggcggttctgatagggcgaccgctgaagcgagctgcgtgtgcgtgcc

SEQ ID NO: 170659 - DNA, 75 bp, Artificial Sequence
  Synthetic
attgcggcggggacgggggggctctgccggcggggaacacaaatcacacgcacacgcagctcgcctatttaacct

SEQ ID NO: 170660 - DNA, 75 bp, Artificial Sequence
  Synthetic
tttttatacatctccgtctctggtctcgtgatgtgggggtgcgggtggtcccggatacttgtccttctccccctc

SEQ ID NO: 170661 - DNA, 75 bp, Artificial Sequence
  Synthetic
acccaacccagggagacttagaatctcttgcgccctctcggtgttggaccaaagactgtggtgggagatccagta

SEQ ID NO: 170662 - DNA, 75 bp, Artificial Sequence
  Synthetic
tcttgcgccctctcggtgttggaccaaagactgtggtgggagatccagtattcatcgggtcgtctcacccgagtc

SEQ ID NO: 170663 - DNA, 75 bp, Artificial Sequence
  Synthetic
catccctatgtgatttctttggttaccccgctgaccatcaatgccacgctacggctgctgatacgagatgggatg

SEQ ID NO: 170664 - DNA, 75 bp, Artificial Sequence
  Synthetic
ccccgctgaccatcaatgccacgctacggctgctgatacgagatgggatgtacgggcggggggagaaagagttgt

SEQ ID NO: 170665 - DNA, 75 bp, Artificial Sequence
  Synthetic
tctgtctgatcctgtcgttcagcatcgtcgcggcggccctgtggaaggtagattacgacagatccgttgcggttg

SEQ ID NO: 170666 - DNA, 75 bp, Artificial Sequence
  Synthetic
ccggcgacgtcgagagggtaactatgtaccgtgcgggggtgacgctattagtggtggcggtggtaagtttgggga

SEQ ID NO: 170667 - DNA, 75 bp, Artificial Sequence
  Synthetic
ataatgacactaacctgactattttttgtaacactacagctcgcaattcgccctttttggcctcgggaatgatga

SEQ ID NO: 170668 - DNA, 75 bp, Artificial Sequence
  Synthetic
ttgtaacactacagctcgcaattcgccctttttggcctcgggaatgatgatcagtattccacataacacacgatt

SEQ ID NO: 170669 - DNA, 75 bp, Artificial Sequence
  Synthetic
gctaacgggtgatccgggaacctacgtgaacggcagcgttacttgctggggctctaacggaattttcggcgccgg

SEQ ID NO: 170670 - DNA, 75 bp, Artificial Sequence
  Synthetic
cgtggcgcgtggatgccggccgagacatttacgtgtcccaaggataaacgtccctggtagctgccgctgcgtggc

SEQ ID NO: 170671 - DNA, 75 bp, Artificial Sequence
  Synthetic
tgaactggtggagaatcccgcgtactttaggcgcagcaatcaccgagcctttatgattgtcatactgacgcaagt

SEQ ID NO: 170672 - DNA, 75 bp, Artificial Sequence
  Synthetic
tttaggcgcagcaatcaccgagcctttatgattgtcatactgacgcaagtggtttttgtggtcttcattattaac

SEQ ID NO: 170673 - DNA, 75 bp, Artificial Sequence
  Synthetic
gcggcggccacgggggttttcgggcgccgttggggacggggggccaacgctttgtgcgctggggacggggacggg

SEQ ID NO: 170674 - DNA, 75 bp, Artificial Sequence
  Synthetic
gccgttggggacggggggccaacgctttgtgcgctggggacggggacggggtgttgcggcggggacttgcgggac

SEQ ID NO: 170675 - DNA, 75 bp, Artificial Sequence
  Synthetic
ttatgattgtcatactgacgcaagtggtttttgtggtcttcattattaacgcttcttttatctggagctggacgt

SEQ ID NO: 170676 - DNA, 75 bp, Artificial Sequence
  Synthetic
ccccctgccacatatagctcgtccacacgccgtctcgtcacacagcaacatgtgtcccgtactggcgatcgtact

SEQ ID NO: 170677 - DNA, 75 bp, Artificial Sequence
  Synthetic
gtggtgggaacgaggggcttttgcgctagggacttgcgggggagggggggtgtgcaggacggcggtgggaacggg

SEQ ID NO: 170678 - DNA, 75 bp, Artificial Sequence
  Synthetic
ctagggacttgcgggggagggggggtgtgcaggacggcggtgggaacgggctaagggacggggggttgtgcagcg

SEQ ID NO: 170679 - DNA, 75 bp, Artificial Sequence
  Synthetic
ggcacctgtatactgtgaattgcgaagccagctacagctacgaccaagtgtctctaaacgccacctgcaaagtta

SEQ ID NO: 170680 - DNA, 75 bp, Artificial Sequence
  Synthetic
caggaaaactacatctctcctacaacgctactgctcaagagctgcttatctcgggactcaggccgcaggagacca

SEQ ID NO: 170681 - DNA, 75 bp, Artificial Sequence
  Synthetic
tcgggactcaggccgcaggagaccactgagtacacgtgctctttcttcagctggggccgccatcacaacgccact

SEQ ID NO: 170682 - DNA, 75 bp, Artificial Sequence
  Synthetic
ctgagtacacgtgctctttcttcagctggggccgccatcacaacgccacttgggaccttttcacctatcccatct

SEQ ID NO: 170683 - DNA, 75 bp, Artificial Sequence
  Synthetic
tgctcaacggtagcagcctctatcaccccaacagcaccgtgcatctgcatcagggcgaccagctcattccgccgt

SEQ ID NO: 170684 - DNA, 75 bp, Artificial Sequence
  Synthetic
ccccaacagcaccgtgcatctgcatcagggcgaccagctcattccgccgtggaatattagtaacgtgacgtataa

SEQ ID NO: 170685 - DNA, 75 bp, Artificial Sequence
  Synthetic
gggccgaagttttaccaccacctacgtgtttatcaagagcgacccgctgttcgaggaccggctgctggcctacgg

SEQ ID NO: 170686 - DNA, 75 bp, Artificial Sequence
  Synthetic
gtgtttatcaagagcgacccgctgttcgaggaccggctgctggcctacggcgtgctggctttcctggtgttcatg

SEQ ID NO: 170687 - DNA, 75 bp, Artificial Sequence
  Synthetic
gttgaggaaaagaaacacccggtgccctacttcaagcagtggtagggcccgaaacgagaggagcggctgctgtgt

SEQ ID NO: 170688 - DNA, 75 bp, Artificial Sequence
  Synthetic
gacacgctgtccgacgaggtgtgtcgcgtctcacaaattataccgtaataaaaaagcgctataacttcgtatagc

SEQ ID NO: 170689 - DNA, 75 bp, Artificial Sequence
  Synthetic
gggtttcccctcagcctctgtgttcccaacccgtccccccgctgagcgttggcggcgatggtcatgttctcccag

SEQ ID NO: 170690 - DNA, 75 bp, Artificial Sequence
  Synthetic
gaccacgtccagatcgtctacggctccacacgcatctgcaagtccctggccccggccaacaagagaaagacccat

SEQ ID NO: 170691 - DNA, 75 bp, Artificial Sequence
  Synthetic
cccggccaacaagagaaagacccatcgcaccatcgtggtagcgccgcggcggggttttttgcgtattcccccgga

SEQ ID NO: 170692 - DNA, 75 bp, Artificial Sequence
  Synthetic
acggcggccgatcccgccgttgcggccgccgctcacagtctatccctatggcacgtcgctgatccgcaggtcagc

SEQ ID NO: 170693 - DNA, 75 bp, Artificial Sequence
  Synthetic
ccgccgctcacagtctatccctatggcacgtcgctgatccgcaggtcagctagggacgcaaaactccgctccaag

SEQ ID NO: 170694 - DNA, 75 bp, Artificial Sequence
  Synthetic
atggatcatagtgagttcctcaccagctttcgtcgcgaggtcgatcggcaaaccgtactgaccgccgagagcgcg

SEQ ID NO: 170695 - DNA, 75 bp, Artificial Sequence
  Synthetic
gctttcgtcgcgaggtcgatcggcaaaccgtactgaccgccgagagcgcgcccgccactgtggaagtctgtctgg

SEQ ID NO: 170696 - DNA, 75 bp, Artificial Sequence
  Synthetic
atatgcccacgcggctttgaacgcttgccagaattcactgaggaagaggaggaaaaagaaaacttgttaacgcac

SEQ ID NO: 170697 - DNA, 75 bp, Artificial Sequence
  Synthetic
ccgccgctgccgccgctgtggccggagtgcccgtcgccgcaaaccccgtcatgcccgccaccgccacggtcacca

SEQ ID NO: 170698 - DNA, 75 bp, Artificial Sequence
  Synthetic
agtgcccgtcgccgcaaaccccgtcatgcccgccaccgccacggtcaccacgccgcccatgatcgaccttaccag

SEQ ID NO: 170699 - DNA, 75 bp, Artificial Sequence
  Synthetic
cgccacctacattttgccggccgactgtcggtacgcgccactctttgccagcaagtataagtacgtcttcgaaga

SEQ ID NO: 170700 - DNA, 75 bp, Artificial Sequence
  Synthetic
cggaacaacctggaggagtcgcggcatgacggcacccaagtgtgttacgaccactacctatctggtgaagaccaa

SEQ ID NO: 170701 - DNA, 75 bp, Artificial Sequence
  Synthetic
gcaagtataagtacgtcttcgaagaggtgtcacgtctcatgcggctgcacgactccacggccgtgcagctgcaga

SEQ ID NO: 170702 - DNA, 75 bp, Artificial Sequence
  Synthetic
aaggagatgtgggccaagtcggaaaattccttatcacaccgggggcgggttacgttccggtctgatgctgctgct

SEQ ID NO: 170703 - DNA, 75 bp, Artificial Sequence
  Synthetic
aagttgcacaacgtcaccgtgttagcgggccagcagctcatcacgcagacgatgccgcacacgccacaggccgta

SEQ ID NO: 170704 - DNA, 75 bp, Artificial Sequence
  Synthetic
cgggccagcagctcatcacgcagacgatgccgcacacgccacaggccgtagccacgttcaaattctttcaccagg

SEQ ID NO: 170705 - DNA, 75 bp, Artificial Sequence
  Synthetic
acggtggttcctcgagcggttcaaagcacaaccaccgtaatgacacccacggtggttacaaactccacattcagt

SEQ ID NO: 170706 - DNA, 75 bp, Artificial Sequence
  Synthetic
agatgtgggtctcgggcgccaccaagaaagacctgtttgacgccgtgaccctgtgcgcttccatcgtagaaaagc

SEQ ID NO: 170707 - DNA, 75 bp, Artificial Sequence
  Synthetic
gaaagacctgtttgacgccgtgaccctgtgcgcttccatcgtagaaaagcagccagacgtatttaatatcaacgt

SEQ ID NO: 170708 - DNA, 75 bp, Artificial Sequence
  Synthetic
cacctcatgaagcggcggcggcgatggcggggctggttgcttttcctggccctgtgcttttgcttactgcgtgaa

SEQ ID NO: 170709 - DNA, 75 bp, Artificial Sequence
  Synthetic
cctgtgcttttgcttactgcgtgaagcggtggaaaccaacacgaccaccgttaccagtaccaccgctgccgccgc

SEQ ID NO: 170710 - DNA, 75 bp, Artificial Sequence
  Synthetic
acgtcacttcaaccacgagtaacaccgtcaccactcccaccacggtttcctcggtcagcaatctgacgtccagca

SEQ ID NO: 170711 - DNA, 75 bp, Artificial Sequence
  Synthetic
gtacgaacgctacttccccctccccttctgtatccatacttaccaccgtgacaccggccgcgacttctaccacct

SEQ ID NO: 170712 - DNA, 75 bp, Artificial Sequence
  Synthetic
aacattaccaccacccgcgctcccacgcgtcctcccgcccaggacctgtgtagccataacctgtcaatcatcctg

SEQ ID NO: 170713 - DNA, 75 bp, Artificial Sequence
  Synthetic
tagccataacctgtcaatcatcctgtacgaagaggaatctcagagcagcgtggacattacggtgggtgaagaaga

SEQ ID NO: 170714 - DNA, 75 bp, Artificial Sequence
  Synthetic
gaagagtacgacgaactgtggttccccctctacttcgaggctgagtgcaacctaaattacacgctacaatacgtc

SEQ ID NO: 170715 - DNA, 75 bp, Artificial Sequence
  Synthetic
aatcacagttgtgattacagcgtgcgccagtcgtctgtctcattccccccgtggcgcgacatcgactcagttacc

SEQ ID NO: 170716 - DNA, 75 bp, Artificial Sequence
  Synthetic
gccagtcgtctgtctcattccccccgtggcgcgacatcgactcagttaccttcgtacccaggaacctctccaact

SEQ ID NO: 170717 - DNA, 75 bp, Artificial Sequence
  Synthetic
atacagttcagattacaggtctcacgatagagccaggtgctgccgcggctgtgccactgatccttgaccgtcacg

SEQ ID NO: 170718 - DNA, 75 bp, Artificial Sequence
  Synthetic
tgctggatgcaatatataacgttttagggatcgaagacctgagtgccaactttcggcgccaactggctccttacc

SEQ ID NO: 170719 - DNA, 75 bp, Artificial Sequence
  Synthetic
tttcggcgccaactggctccttaccgtcacactctcatcgtgccgcagacttgatgtgccgccgcccggattgcg

SEQ ID NO: 170720 - DNA, 75 bp, Artificial Sequence
  Synthetic
tcagcgtcgctcctaccgccgccgagaaagtccccgcggagtgccccgaactaacgcgccgatgcctgttgggtg

SEQ ID NO: 170721 - DNA, 75 bp, Artificial Sequence
  Synthetic
gaaagtccccgcggagtgccccgaactaacgcgccgatgcctgttgggtgaggtgtttcagggtgacaagtatga

SEQ ID NO: 170722 - DNA, 75 bp, Artificial Sequence
  Synthetic
tacgccggaagccgccaactccgtgctgttggacgaggctttcctggacactctggccctgctgtacaacaatcc

SEQ ID NO: 170723 - DNA, 75 bp, Artificial Sequence
  Synthetic
ctgttggacgaggctttcctggacactctggccctgctgtacaacaatccggatcaattgcgggccctgctgacg

SEQ ID NO: 170724 - DNA, 75 bp, Artificial Sequence
  Synthetic
cgttggcctgatggtggaagtcggcgccgccgccgcttggaccttcgtgcgttgtctcgcctatcagcgctcctt

SEQ ID NO: 170725 - DNA, 75 bp, Artificial Sequence
  Synthetic
gccgtgtacacgtgcgtggacgacctgtgccgcggctacgacctcacgcgactgtcatacgagcgcagcatcttc

SEQ ID NO: 170726 - DNA, 75 bp, Artificial Sequence
  Synthetic
tgtgccgcggctacgacctcacgcgactgtcatacgagcgcagcatcttcacggaacacgtgttaggcttcgagc

SEQ ID NO: 170727 - DNA, 75 bp, Artificial Sequence
  Synthetic
tgcccgtgagcaccgctgccgcgcccgagggcatcacgctcttttacggcctgtacaacgcagtgaaggaattct

SEQ ID NO: 170728 - DNA, 75 bp, Artificial Sequence
  Synthetic
cgagggcatcacgctcttttacggcctgtacaacgcagtgaaggaattctgcctgcgtcaccagctggacccgcc

SEQ ID NO: 170729 - DNA, 75 bp, Artificial Sequence
  Synthetic
tgtcgctgtgaagagatagagtgtgagcatagctgtatgcagcggggcgtgtggaagcggggggacgaagaggtt

SEQ ID NO: 170730 - DNA, 75 bp, Artificial Sequence
  Synthetic
tcactcgcgctatggccctcaagcagtggatgctcgctaacattgctgataataaaggctctctgttaacccccg

SEQ ID NO: 170731 - DNA, 75 bp, Artificial Sequence
  Synthetic
gtggatgctcgctaacattgctgataataaaggctctctgttaacccccgacgagcaggctcgcgtgttttgtct

SEQ ID NO: 170732 - DNA, 75 bp, Artificial Sequence
  Synthetic
caaagccccccgtccccgtaacaccccttgtccagcgtaaccccggcggaaacatcccgccctcagcccggtccc

SEQ ID NO: 170733 - DNA, 75 bp, Artificial Sequence
  Synthetic
gcaacatcccgtccccgtccccgccgcaaaagccttccgtccccgtccccagtcccgcacaaagcgccggcgccc

SEQ ID NO: 170734 - DNA, 75 bp, Artificial Sequence
  Synthetic
cctgcattcgcgtgtactatgtgagtggcaaacaaattatctaaaacatcactatgatttatgttttacatgcga

SEQ ID NO: 170735 - DNA, 75 bp, Artificial Sequence
  Synthetic
ggagggcgcgcggcaactcgagatggtgtacccggcacccgagcacgtacaccgctggagctatctgtgtccgcc

SEQ ID NO: 170736 - DNA, 75 bp, Artificial Sequence
  Synthetic
agtcccgcacaaagcgccggcgcccagcacgcccaaaagcccccgcagaaagatgtctgagtgaggctcagagtc

SEQ ID NO: 170737 - DNA, 75 bp, Artificial Sequence
  Synthetic
acgcgataggggtacttggtggtgttgacccccaccacatctccgtacttgagggtagtgttgtagatggtctcg

SEQ ID NO: 170738 - DNA, 75 bp, Artificial Sequence
  Synthetic
gcctgggcgcgacgcggcgtgctgctgctcaacaccgtgttcaccgtggtgcacggacagcctggatctcaccgt

SEQ ID NO: 170739 - DNA, 75 bp, Artificial Sequence
  Synthetic
tgctcaacaccgtgttcaccgtggtgcacggacagcctggatctcaccgtcacttaggctggcagacgctgagta

SEQ ID NO: 170740 - DNA, 75 bp, Artificial Sequence
  Synthetic
gcgagtacctgatcgaccgacggcggcacttggtactcaagtcctgccacccgtcgccgcgcaacaccacccgcg

SEQ ID NO: 170741 - DNA, 75 bp, Artificial Sequence
  Synthetic
gcacttggtactcaagtcctgccacccgtcgccgcgcaacaccacccgcgccttcgtgggcaacgaccactttat

SEQ ID NO: 170742 - DNA, 75 bp, Artificial Sequence
  Synthetic
aacgccccgtccctgccgcaaaaggcccccgtccgcgacgtcaccccgtgtctccgtccccaccactgtccccgc

SEQ ID NO: 170743 - DNA, 75 bp, Artificial Sequence
  Synthetic
cccccgtccgcgacgtcaccccgtgtctccgtccccaccactgtccccgccgcaaaagcccgcaagtcaccgccg

SEQ ID NO: 170744 - DNA, 75 bp, Artificial Sequence
  Synthetic
atatatatagacacacaccgaaaggggtggaaacccaaatgtccaagcgcgtcctgtttcataatttttccggtc

SEQ ID NO: 170745 - DNA, 75 bp, Artificial Sequence
  Synthetic
aaacgccgcgatcgaggcggcggcgatcgcagcctcctcgctgggatcgataatttcgagtccgtcctcgaggaa

SEQ ID NO: 170746 - DNA, 75 bp, Artificial Sequence
  Synthetic
gcggttgtttctccgtcgcgatctccgagaggaggaggacgacgacgatgcggcctgccgccggctgtttctacc

SEQ ID NO: 170747 - DNA, 75 bp, Artificial Sequence
  Synthetic
cgagaggaggaggacgacgacgatgcggcctgccgccggctgtttctaccaccgccaccaccgccgcctcctcgg

SEQ ID NO: 170748 - DNA, 75 bp, Artificial Sequence
  Synthetic
gaagagttactggcagccgcggcggtggcgacaacggggtttaccacgtagggcttgatttcacacacgggccgg

SEQ ID NO: 170749 - DNA, 75 bp, Artificial Sequence
  Synthetic
tggcgacaacggggtttaccacgtagggcttgatttcacacacgggccggggaggagcagctggtgtttcgactg

SEQ ID NO: 170750 - DNA, 75 bp, Artificial Sequence
  Synthetic
ggcgggtgtgtcaggggtgtgtcgtgcgcggctggatggaagcagtgtgccccggggtcctggacccccccccct

SEQ ID NO: 170751 - DNA, 75 bp, Artificial Sequence
  Synthetic
ctgctggggggccaacgccggctgtggagacagctgcggcggtcctcgcgacgctgctgtggttgacgacgacag

SEQ ID NO: 170752 - DNA, 75 bp, Artificial Sequence
  Synthetic
ggagacagctgcggcggtcctcgcgacgctgctgtggttgacgacgacagtcccgcccgacgtctctggcaagag

SEQ ID NO: 170753 - DNA, 75 bp, Artificial Sequence
  Synthetic
aatgtcatcaaaacgcggactgcgaggaggctgaggcgccgcggattcctgcgaattcggaggaacacggcagtt

SEQ ID NO: 170754 - DNA, 75 bp, Artificial Sequence
  Synthetic
ggaggctgaggcgccgcggattcctgcgaattcggaggaacacggcagttagagactggagtggtggaatcattc

SEQ ID NO: 170755 - DNA, 75 bp, Artificial Sequence
  Synthetic
aatcagacagacacagacacgcgtcttctttgcgacgtgcgcggcgcacgtcgcttttattccccaccgcaccac

SEQ ID NO: 170756 - DNA, 75 bp, Artificial Sequence
  Synthetic
ccaaatttcacccccccgctaaaaacacccccccgcccctcggggacccagcacacggcccggaatggatgtcgg

SEQ ID NO: 170757 - DNA, 75 bp, Artificial Sequence
  Synthetic
gccgccgccgtcgccgccgcctcggactcctgcaccgtctcgcccgcgctgtgggcgctgctgggtcgagggagc

SEQ ID NO: 170758 - DNA, 75 bp, Artificial Sequence
  Synthetic
cacccccccgcccctcggggacccagcacacggcccggaatggatgtcgggcgtccacctaggtgtgtgcgcgct

SEQ ID NO: 170759 - DNA, 75 bp, Artificial Sequence
  Synthetic
actcctgcaccgtctcgcccgcgctgtgggcgctgctgggtcgagggagcgaaagaagtgacgacggcgacgtcg

SEQ ID NO: 170760 - DNA, 75 bp, Artificial Sequence
  Synthetic
tcacggcgttatggtggtgatgatggtggtggtggttgttggaggaagaagagaccgcggaggatgaagacgagt

SEQ ID NO: 170761 - DNA, 75 bp, Artificial Sequence
  Synthetic
gtggtggtggttgttggaggaagaagagaccgcggaggatgaagacgagtaattgagaaaggccaccgcttcaga

SEQ ID NO: 170762 - DNA, 75 bp, Artificial Sequence
  Synthetic
ctcgttcttgccgccgccgccatggccttcgtgctgtgcggtggtcttttgtctcttcgcctcccggaggggagg

SEQ ID NO: 170763 - DNA, 75 bp, Artificial Sequence
  Synthetic
gtctcttcgcctcccggaggggaggagagcctacagacgggacgacacatagcgcacgaaaaagcacatggttat

SEQ ID NO: 170764 - DNA, 75 bp, Artificial Sequence
  Synthetic
tcggaaagcaccgtgacgcgaggagggccgggactcaccgtcgttctcggaggagggaggcggccgccgctcctt

SEQ ID NO: 170765 - DNA, 75 bp, Artificial Sequence
  Synthetic
ggccgggactcaccgtcgttctcggaggagggaggcggccgccgctccttctgccggttcatcaaccggggatcc

SEQ ID NO: 170766 - DNA, 75 bp, Artificial Sequence
  Synthetic
caaaagctccctgtccccagcgcgacagctccccgtccccagcgccaaagctccccgtccccaacgtgaccccct

SEQ ID NO: 170767 - DNA, 75 bp, Artificial Sequence
  Synthetic
ccgcctccaccaccaccggcagacgaggacgattttttgcgccgttcttcgtgacgctgttcctgccttcgccgt

SEQ ID NO: 170768 - DNA, 75 bp, Artificial Sequence
  Synthetic
aggacgattttttgcgccgttcttcgtgacgctgttcctgccttcgccgttgctgttcctccgcagaagggccgt

SEQ ID NO: 170769 - DNA, 75 bp, Artificial Sequence
  Synthetic
ctccgccggaggattcgccgtggtttttcaggtaatgccgcacgtaagtcacttgcaaattaccgttttcggaaa

SEQ ID NO: 170770 - DNA, 75 bp, Artificial Sequence
  Synthetic
attacagtacaggctaccgcgtggtgttgtgtatgttacgatgcggtgtgcctgtcggtgtaattggatgtatgt

SEQ ID NO: 170771 - DNA, 75 bp, Artificial Sequence
  Synthetic
tttcaggtaatgccgcacgtaagtcacttgcaaattaccgttttcggaaatcatagtgagcagcgcgctctcatt

SEQ ID NO: 170772 - DNA, 75 bp, Artificial Sequence
  Synthetic
acggcccaaaaacccccgtcctcgccggcgccgccccgaaaagcgaagcgccgcgcaaaagctgcgtggaaacgc

SEQ ID NO: 170773 - DNA, 75 bp, Artificial Sequence
  Synthetic
cgaccaaagcggtgtgtggacgctcgtcctctctgtcttctccgggttttttttttcacgtgtgtttttttcctt

SEQ ID NO: 170774 - DNA, 75 bp, Artificial Sequence
  Synthetic
aagttccccgtcgcccgtaatgtcaatggacatgaagccctgctgcgtcttggcgccggccgaagcctcgccgtg

SEQ ID NO: 170775 - DNA, 75 bp, Artificial Sequence
  Synthetic
ctgcataatggtagcgcagagccagcccttgttgaggtgcagcaccttgccatcgccgtccacgcagttgaccag

SEQ ID NO: 170776 - DNA, 75 bp, Artificial Sequence
  Synthetic
acacgcaccggcagcgcgcagaaagcgccgtggacaacacgccgcagaagcggcggagcgcttacggcgccaaaa

SEQ ID NO: 170777 - DNA, 75 bp, Artificial Sequence
  Synthetic
cgtaaaagtccagtattttcgcacgacggtagtaggcagatccatgacgcggcggcgcaaagcgcgagcgcaacg

SEQ ID NO: 170778 - DNA, 75 bp, Artificial Sequence
  Synthetic
acggtagtaggcagatccatgacgcggcggcgcaaagcgcgagcgcaacgctcgtcggaggccgtggagcgagtg

SEQ ID NO: 170779 - DNA, 75 bp, Artificial Sequence
  Synthetic
acccacaaacaacgtcacgacgcaacgtggttaaacagtacgtttattaaagtaactgggtgaacaacaccggag

SEQ ID NO: 170780 - DNA, 75 bp, Artificial Sequence
  Synthetic
gacgcgggttgtgccgtacttcgtctgtcgtttcccccgcggtcccctagggacttcctcttttccgcgtcttgc

SEQ ID NO: 170781 - DNA, 75 bp, Artificial Sequence
  Synthetic
cgtggttaaacagtacgtttattaaagtaactgggtgaacaacaccggagcggactgcaaatcgcaacgctactt

SEQ ID NO: 170782 - DNA, 75 bp, Artificial Sequence
  Synthetic
cgatttcctttccgcctcctgagacagccgactaatcacggacttatctccgcaacctaacagaggctgggagcc

SEQ ID NO: 170783 - DNA, 75 bp, Artificial Sequence
  Synthetic
agccgactaatcacggacttatctccgcaacctaacagaggctgggagcccgacaaaagtaaaacagcgtgctat

SEQ ID NO: 170784 - DNA, 75 bp, Artificial Sequence
  Synthetic
ccggggaatcaaacagacacagacgcgcgtctgcttttcgccgtgcgcggcgcacgtcgcttttattcgccgtcg

SEQ ID NO: 170785 - DNA, 75 bp, Artificial Sequence
  Synthetic
taaaattccccacctttctctgttcaaatggccccgaaactgtaaaacaccgtttgaccgcaccccaaccggcgc

SEQ ID NO: 170786 - DNA, 75 bp, Artificial Sequence
  Synthetic
cgcacgtcgcttttattcgccgtcgccgtccaccgcgaccgccgtccccaccgcaccacaccgcaccacacgcaa

SEQ ID NO: 170787 - DNA, 75 bp, Artificial Sequence
  Synthetic
attctagcgtcgagcgcatactatgcaattccgtcttaagtccgggatagacgtggtcgcctgcggggaacacga

SEQ ID NO: 170788 - DNA, 75 bp, Artificial Sequence
  Synthetic
caattccgtcttaagtccgggatagacgtggtcgcctgcggggaacacgatctccagataccgcctcaacaacca

SEQ ID NO: 170789 - DNA, 75 bp, Artificial Sequence
  Synthetic
ttacaagaggaaaactacgtcacccgacacgcggaaaataaagaccgtcgcaataaaccgtacctacgtgaccta

SEQ ID NO: 170790 - DNA, 75 bp, Artificial Sequence
  Synthetic
gacacgcggaaaataaagaccgtcgcaataaaccgtacctacgtgacctaccaacgtaggttttactcgatgaaa

SEQ ID NO: 170791 - DNA, 75 bp, Artificial Sequence
  Synthetic
cgtcgtcgttgccggcttcgcctcctcggaagcgcctagaaaaaagacgatcaggaccagagaggaagagaccat

SEQ ID NO: 170792 - DNA, 75 bp, Artificial Sequence
  Synthetic
tcggaagcgcctagaaaaaagacgatcaggaccagagaggaagagaccatcaccgacagcatcgccgcagcatgc

SEQ ID NO: 170793 - DNA, 75 bp, Artificial Sequence
  Synthetic
tttcaatttctttcttccgcggttagaatagtttctgtaggaaccaattatcaatctgacgggttatcgtcacca

SEQ ID NO: 170794 - DNA, 75 bp, Artificial Sequence
  Synthetic
cgacgccggcccacgccgtccaccgggtagaaccccgcgggccgccgggcgcccctccgggtagcggcaacaaca

SEQ ID NO: 170795 - DNA, 75 bp, Artificial Sequence
  Synthetic
tcaatctgacgggttatcgtcaccacttgatggcaaaacgaaatttttttttcattgccttgaagtctctcccgc

SEQ ID NO: 170796 - DNA, 75 bp, Artificial Sequence
  Synthetic
tgggctcaattgatcatggcaagaagaaaaactatactgaataaactgtgtgcaaaactactagtaacaacaaaa

SEQ ID NO: 170797 - DNA, 75 bp, Artificial Sequence
  Synthetic
gaaaaactatactgaataaactgtgtgcaaaactactagtaacaacaaaaatagcgactagatacaccacggaca

SEQ ID NO: 170798 - DNA, 75 bp, Artificial Sequence
  Synthetic
tttttttttcgtccatgtatgtgattacgagtagtagtggtatgtagaacaagaagaaaaatcgtagtccccaaa

SEQ ID NO: 170799 - DNA, 75 bp, Artificial Sequence
  Synthetic
tacgagtagtagtggtatgtagaacaagaagaaaaatcgtagtccccaaaaggataataaaaataacactcatag

SEQ ID NO: 170800 - DNA, 75 bp, Artificial Sequence
  Synthetic
gttacgttgagtctgacgacaaattccagcgcgtctggacacattagttatcaacggcaacggcgtatcgaaaac

SEQ ID NO: 170801 - DNA, 75 bp, Artificial Sequence
  Synthetic
aatagcaccttcatagattcatttcagctttctactccttgtaatttaaagttgcactaaacaaagctcttaaag

SEQ ID NO: 170802 - DNA, 75 bp, Artificial Sequence
  Synthetic
agctttctactccttgtaatttaaagttgcactaaacaaagctcttaaagaaggttcgagccgctctcgatcact

SEQ ID NO: 170803 - DNA, 75 bp, Artificial Sequence
  Synthetic
ccgtgccaaaagttgctgttgttgccgctactcggaggggcgcccggcggcccgcggggttctacccggtggacg

SEQ ID NO: 170804 - DNA, 75 bp, Artificial Sequence
  Synthetic
aaccctcgatttcctagctgttgttttttgattattttgttcgctctaagagagatactcgaaatcctacttaca

SEQ ID NO: 170805 - DNA, 75 bp, Artificial Sequence
  Synthetic
ttttgattattttgttcgctctaagagagatactcgaaatcctacttacaccaaggaccctacatcatcgcagga

SEQ ID NO: 170806 - DNA, 75 bp, Artificial Sequence
  Synthetic
ctgtgccgtatttttttttgacaatctgtctgaatctgcggaaatagttacggagaagcaattctgttaaaaaat

SEQ ID NO: 170807 - DNA, 75 bp, Artificial Sequence
  Synthetic
ctgtctgaatctgcggaaatagttacggagaagcaattctgttaaaaaattcagtacgttagcagcaaaagataa

SEQ ID NO: 170808 - DNA, 75 bp, Artificial Sequence
  Synthetic
ccgacgacgcactcgactggaaaaggcaggaacccggaggaacacgcgcaacagggccgcggactgggtccccga

SEQ ID NO: 170809 - DNA, 75 bp, Artificial Sequence
  Synthetic
gggtgaaccaggggccccggtgcgcatgcgcgggccctggcccgcgggagggtcgccctgcgcatgcgccggtaa

SEQ ID NO: 170810 - DNA, 75 bp, Artificial Sequence
  Synthetic
caacagataatatggttaccatttagagtagtgtcactttactttcacggaagatgcaacccccgagaaaaagaa

SEQ ID NO: 170811 - DNA, 75 bp, Artificial Sequence
  Synthetic
gaatcgatcatagataaaagaaatcaagccagacttgttaagaaaaaaaaaagatcaaaaaattactacctaaaa

SEQ ID NO: 170812 - DNA, 75 bp, Artificial Sequence
  Synthetic
aatacacaggctgaccttcgaaaaccaagcctattgataataatctaccccatagaacaggatataatcaagcat

SEQ ID NO: 170813 - DNA, 75 bp, Artificial Sequence
  Synthetic
caagcctattgataataatctaccccatagaacaggatataatcaagcatccaaacaacaaacagcgccgccgtg

SEQ ID NO: 170814 - DNA, 75 bp, Artificial Sequence
  Synthetic
ccccatcatcttctccttcgtcccagacggacggctatcggttcgcgcgctcgtcttttcttcgatgtgcgcagg

SEQ ID NO: 170815 - DNA, 75 bp, Artificial Sequence
  Synthetic
gacggacggctatcggttcgcgcgctcgtcttttcttcgatgtgcgcaggtttcgtcatcggagaagaagaccgc

SEQ ID NO: 170816 - DNA, 75 bp, Artificial Sequence
  Synthetic
agaaaaaaaaaacaagcagccactctaaccatcacactcacgagttaatatggggttaggggggaggaagagaaa

SEQ ID NO: 170817 - DNA, 75 bp, Artificial Sequence
  Synthetic
taaccatcacactcacgagttaatatggggttaggggggaggaagagaaataccgccatgaaggcaagagcagca

SEQ ID NO: 170818 - DNA, 75 bp, Artificial Sequence
  Synthetic
gtccagaagacagttgcacgggtttcagtgagatgagtactttagcgatgtccgcggggacgctacgtttcaccg

SEQ ID NO: 170819 - DNA, 75 bp, Artificial Sequence
  Synthetic
atcgtgatgatggaaacaagaatgatgataataatgatgacgataaagccaccacacgatatatacagagaacaa

SEQ ID NO: 170820 - DNA, 75 bp, Artificial Sequence
  Synthetic
ttgtccccttcgcgggggacatcatcgccgccgacccgcgtgtgccctgcctcacggctggtccgtgatgaactc

SEQ ID NO: 170821 - DNA, 75 bp, Artificial Sequence
  Synthetic
cgccgccgacccgcgtgtgccctgcctcacggctggtccgtgatgaactcttgctcgtaaccgccaagcgataaa

SEQ ID NO: 170822 - DNA, 75 bp, Artificial Sequence
  Synthetic
gaataagtgaactttagacacgatagatgaagccatagtctgaatagtcatgatgttaggaacactatacgacta

SEQ ID NO: 170823 - DNA, 75 bp, Artificial Sequence
  Synthetic
gatgaagccatagtctgaatagtcatgatgttaggaacactatacgactaatacatacatacatacaccccctta

SEQ ID NO: 170824 - DNA, 75 bp, Artificial Sequence
  Synthetic
ccccgaccgccgccggtgcgggacagggctgagcgccgttttggcgccgtaagcgcggcgcttcgcgggatcggc

SEQ ID NO: 170825 - DNA, 75 bp, Artificial Sequence
  Synthetic
ccaaaatcgatcaccaccatagacgtactatcatcattacaacgaaaaactagacggatggatagctgtaagtct

SEQ ID NO: 170826 - DNA, 75 bp, Artificial Sequence
  Synthetic
tactatcatcattacaacgaaaaactagacggatggatagctgtaagtctcacctagctaactaacgatcacatt

SEQ ID NO: 170827 - DNA, 75 bp, Artificial Sequence
  Synthetic
agtcatagcccgttctttttttccaagtatcctttagtccataagcattattataaccgtattacccagaaatct

SEQ ID NO: 170828 - DNA, 75 bp, Artificial Sequence
  Synthetic
ttataaccgtattacccagaaatctttgttatgagtctcttcgctgtcaactgattagtagcaagttgctgtgat

SEQ ID NO: 170829 - DNA, 75 bp, Artificial Sequence
  Synthetic
tattctgaaacttgtatggaggtcactgtcaaagtaggtgatccagctatcctcggcagtggacacggttatcat

SEQ ID NO: 170830 - DNA, 75 bp, Artificial Sequence
  Synthetic
ctgtcaaagtaggtgatccagctatcctcggcagtggacacggttatcatccaggacaaaaagtacattggtata

SEQ ID NO: 170831 - DNA, 75 bp, Artificial Sequence
  Synthetic
tttttttacttcggtagattaaaacaaatgaaacacgtagctgttgttttttggtgaatatagtttggtaagtcc

SEQ ID NO: 170832 - DNA, 75 bp, Artificial Sequence
  Synthetic
aaatgaaacacgtagctgttgttttttggtgaatatagtttggtaagtccttagcgggtaagttctaagaaacat

SEQ ID NO: 170833 - DNA, 75 bp, Artificial Sequence
  Synthetic
aacataagatgataaaaaccactccgccgccattaccgccgttgtacgaatgtcataattctacattaagtatcc

SEQ ID NO: 170834 - DNA, 75 bp, Artificial Sequence
  Synthetic
gccgccattaccgccgttgtacgaatgtcataattctacattaagtatccttcatgtaaacgtttcagatcccaa

SEQ ID NO: 170835 - DNA, 75 bp, Artificial Sequence
  Synthetic
ttaggtaagcaaacaacatagatagtgattttagtatagataactcgtgtaagtgttttagtgacttgtaactcg

SEQ ID NO: 170836 - DNA, 75 bp, Artificial Sequence
  Synthetic
tgattttagtatagataactcgtgtaagtgttttagtgacttgtaactcgactcggtagacttctcagagtttcg

SEQ ID NO: 170837 - DNA, 75 bp, Artificial Sequence
  Synthetic
agatgaccgatattatacttcattaactcacgaagatgactgtaagtaaggatattgttgttcatgatagtagcc

SEQ ID NO: 170838 - DNA, 75 bp, Artificial Sequence
  Synthetic
actcacgaagatgactgtaagtaaggatattgttgttcatgatagtagccaggttataaggatcatatatatctc

SEQ ID NO: 170839 - DNA, 75 bp, Artificial Sequence
  Synthetic
catgatataagttaagaagattgatatctgtcctttttctgaaacgaagataggcctttttattttttcgaattc

SEQ ID NO: 170840 - DNA, 75 bp, Artificial Sequence
  Synthetic
atctgtcctttttctgaaacgaagataggcctttttattttttcgaattcatgttcgaaaacacaagcttccata

SEQ ID NO: 170841 - DNA, 75 bp, Artificial Sequence
  Synthetic
aacacatcaaagaaagacgaccagctgattatgttcttaggaattccacacacccgcgagccgatccgcaaacgt

SEQ ID NO: 170842 - DNA, 75 bp, Artificial Sequence
  Synthetic
ccattccgggccgtgtgttgggtccccgcggggcgggggggtgtttttcgcggggggggttaatttttgcgtctt

SEQ ID NO: 170843 - DNA, 75 bp, Artificial Sequence
  Synthetic
tgattatgttcttaggaattccacacacccgcgagccgatccgcaaacgtcgtgcgaggcgcgctttctctggct

SEQ ID NO: 170844 - DNA, 75 bp, Artificial Sequence
  Synthetic
aacatgggcaaagtccaattagccaaaaagacgacgattctaagaattgatgaatcctcgatatacgcctatcga

SEQ ID NO: 170845 - DNA, 75 bp, Artificial Sequence
  Synthetic
taggtttcaattgtgtcatatacatcaaatgaaaaacaggacgcacgataaaagcttccttacagcataactgta

SEQ ID NO: 170846 - DNA, 75 bp, Artificial Sequence
  Synthetic
cgaagagcaactcccaggggaaaagaggaagtccccaggggaacggcgaccccaagggaggggggggagactcgc

SEQ ID NO: 170847 - DNA, 75 bp, Artificial Sequence
  Synthetic
ctgtcaaggaaaaaatcaatgtaccaccacatcactttctgctcggtcccggcgacggatgggcgcgcacgcgga

SEQ ID NO: 170848 - DNA, 75 bp, Artificial Sequence
  Synthetic
accacatcactttctgctcggtcccggcgacggatgggcgcgcacgcggacaaagacccaccggccacttccact

SEQ ID NO: 170849 - DNA, 75 bp, Artificial Sequence
  Synthetic
actccttgacgcaccggcagcgcgcaggaagcgccgtggggaacacgccgcagaagcggcggcgcgcttacggcg

SEQ ID NO: 170850 - DNA, 75 bp, Artificial Sequence
  Synthetic
tcacaccgcgcacgcgagaaggggccggggtccgcgggcaccgccgccggaggcgcggttccctctctctaattc

SEQ ID NO: 170851 - DNA, 75 bp, Artificial Sequence
  Synthetic
aaaagacgacaaaaggtctctattctgctacatgagagaaattatagctgttggcaatttttcaaaatacatgtt

SEQ ID NO: 170852 - DNA, 75 bp, Artificial Sequence
  Synthetic
aacccatatatgtgaagcagaatgatgaccgaccgcacggagcgacgccgtcgactgacccacgcggcatgtacg

SEQ ID NO: 170853 - DNA, 75 bp, Artificial Sequence
  Synthetic
tcgtagactgtcagcctcgcgaagagacaccgcggaccggggaaacggataagtttacgaacagaaatctcaaga

SEQ ID NO: 170854 - DNA, 75 bp, Artificial Sequence
  Synthetic
gtcacggagacacggtggtttttattgaatttccagtgtatcgagccaccgtgatgcaggtacggtggttttatg

SEQ ID NO: 170855 - DNA, 75 bp, Artificial Sequence
  Synthetic
tgaatttccagtgtatcgagccaccgtgatgcaggtacggtggttttatgtgaagtgccgctatctataggcgat

SEQ ID NO: 170856 - DNA, 75 bp, Artificial Sequence
  Synthetic
aaagtcacgttttccttacacggtgttgtgtcaaaaaataagcgtggtgcgtttgtctttgagcgcgcgacagat

SEQ ID NO: 170857 - DNA, 75 bp, Artificial Sequence
  Synthetic
ttgtgtcaaaaaataagcgtggtgcgtttgtctttgagcgcgcgacagatatagggggtgatagcggtgttcttc

SEQ ID NO: 170858 - DNA, 75 bp, Artificial Sequence
  Synthetic
atgtggctcatcttgaggttcttgggatggtccccaaagtccacggccaccttctcgagcgacaggccctgactc

SEQ ID NO: 170859 - DNA, 75 bp, Artificial Sequence
  Synthetic
cttctcgagcgacaggccctgactcttagcgatggtcatggccgtgcgcgaagtgaggccgtagtccacggtggt

SEQ ID NO: 170860 - DNA, 75 bp, Artificial Sequence
  Synthetic
gagcgcatcgcgtagcaccagccgcgaaagaccgcgctgcaccacctcggggtggatgcggtggcggtcactggg

SEQ ID NO: 170861 - DNA, 75 bp, Artificial Sequence
  Synthetic
gaaagaccgcgctgcaccacctcggggtggatgcggtggcggtcactgggcagactgagcacgttgtcgctggtg

SEQ ID NO: 170862 - DNA, 75 bp, Artificial Sequence
  Synthetic
atctgacagttggccttgaacaccacgttacggcgattgtaggtaacgagcggcaacgtggcgaagcgaccgccc

SEQ ID NO: 170863 - DNA, 75 bp, Artificial Sequence
  Synthetic
cgttacggcgattgtaggtaacgagcggcaacgtggcgaagcgaccgcccgtgagacgctgcatgagctggtagc

SEQ ID NO: 170864 - DNA, 75 bp, Artificial Sequence
  Synthetic
gcttgacgtatttgagaaaaaagggatccgcgtacagactggtgtgatccatgagttcggcgtccgtgatggcgt

SEQ ID NO: 170865 - DNA, 75 bp, Artificial Sequence
  Synthetic
atccgcgtacagactggtgtgatccatgagttcggcgtccgtgatggcgtccgagtcgtcatggtggttggacag

SEQ ID NO: 170866 - DNA, 75 bp, Artificial Sequence
  Synthetic
agaatccgcgtcgacgtgattatttatcagattctctcccccgctccaagcgggagcggcggccgtggcggcggc

SEQ ID NO: 170867 - DNA, 75 bp, Artificial Sequence
  Synthetic
atcagattctctcccccgctccaagcgggagcggcggccgtggcggcggcagcggcgcagagcgaactcacgtcg

SEQ ID NO: 170868 - DNA, 75 bp, Artificial Sequence
  Synthetic
gagaagagcaggcccgaaactaacgagtaggcgtaggccgcctgctcgcagggcgtgcgttcgataaacgtgtcc

SEQ ID NO: 170869 - DNA, 75 bp, Artificial Sequence
  Synthetic
agtaggcgtaggccgcctgctcgcagggcgtgcgttcgataaacgtgtccttttgcaagatgtccacgaaacgtt

SEQ ID NO: 170870 - DNA, 75 bp, Artificial Sequence
  Synthetic
taatgcgcaaggtgagcagcgtctcacggctatcgggcgcggtggtggtatcatcgtcctggaaaaacgccgtct

SEQ ID NO: 170871 - DNA, 75 bp, Artificial Sequence
  Synthetic
acggctatcgggcgcggtggtggtatcatcgtcctggaaaaacgccgtctcgtcgttgccgccggtgctcccgat

SEQ ID NO: 170872 - DNA, 75 bp, Artificial Sequence
  Synthetic
ctccttggtgatctcgctggagaggttgtggtcgacaaactgcgagtagttaatgatgcgcgccaagttctggcg

SEQ ID NO: 170873 - DNA, 75 bp, Artificial Sequence
  Synthetic
ttgtggtcgacaaactgcgagtagttaatgatgcgcgccaagttctggcggaaccagagctcgacgggctgcggc

SEQ ID NO: 170874 - DNA, 75 bp, Artificial Sequence
  Synthetic
tcaaagagacggtggcgctcgctcaggcggatctgctcgtgcagccgcttgaagtaagcctgcacctcgacgtgc

SEQ ID NO: 170875 - DNA, 75 bp, Artificial Sequence
  Synthetic
ggcggatctgctcgtgcagccgcttgaagtaagcctgcacctcgacgtgcgagagaaaaagccgcgtcatctcgg

SEQ ID NO: 170876 - DNA, 75 bp, Artificial Sequence
  Synthetic
gcgggataccgaactccatgtacttgagcaggtcgccaaagtccaggtcggtgcaacgcttgttgtgaataaaca

SEQ ID NO: 170877 - DNA, 75 bp, Artificial Sequence
  Synthetic
gagcaggtcgccaaagtccaggtcggtgcaacgcttgttgtgaataaacatgacccagttgtcggcgatgtcgca

SEQ ID NO: 170878 - DNA, 75 bp, Artificial Sequence
  Synthetic
gtagtggtcgtagcggctctccagcgcctcggtctgcgtgggcgaaccgacgcagatgatgcagggcacgcggcg

SEQ ID NO: 170879 - DNA, 75 bp, Artificial Sequence
  Synthetic
gcctcggtctgcgtgggcgaaccgacgcagatgatgcagggcacgcggcgttcgcggtaaagtcgcgtgtcgccc

SEQ ID NO: 170880 - DNA, 75 bp, Artificial Sequence
  Synthetic
acgatgatattgctctcgcacagctccgagaggtcctcgcaggcggcggccgcggccgcggcggaggccgaagcg

SEQ ID NO: 170881 - DNA, 75 bp, Artificial Sequence
  Synthetic
tacctttcttcggtttgggttccgatgtcggtgctggcggctgcggtgggatgacgggctggtgggactcctccg

SEQ ID NO: 170882 - DNA, 75 bp, Artificial Sequence
  Synthetic
ccgagaggtcctcgcaggcggcggccgcggccgcggcggaggccgaagcggccttgcgctcccacatatttaagc

SEQ ID NO: 170883 - DNA, 75 bp, Artificial Sequence
  Synthetic
cctcgtgcggctcgcacacgcggtagcgttccagcgtctcgtggctaacggcgctgtcagccagcggcacgtgct

SEQ ID NO: 170884 - DNA, 75 bp, Artificial Sequence
  Synthetic
gcgttccagcgtctcgtggctaacggcgctgtcagccagcggcacgtgcttgctgacgaagccgaagacgcggta

SEQ ID NO: 170885 - DNA, 75 bp, Artificial Sequence
  Synthetic
ggtgatcacgcaatctagattggccgccagcacctggatgctggaagtcttgccggcgcccgccgtgccggtgac

SEQ ID NO: 170886 - DNA, 75 bp, Artificial Sequence
  Synthetic
gccagcacctggatgctggaagtcttgccggcgcccgccgtgccggtgacgagcagcgcgcggaagggaaagaag

SEQ ID NO: 170887 - DNA, 75 bp, Artificial Sequence
  Synthetic
gaggagtgaacggtcgccgttgccgcggcggtagttgcggcagaggggttgttatctgtcgttcgttcaacgcga

SEQ ID NO: 170888 - DNA, 75 bp, Artificial Sequence
  Synthetic
cggcggtagttgcggcagaggggttgttatctgtcgttcgttcaacgcgactgatggagcgaaaccactggaacg

SEQ ID NO: 170889 - DNA, 75 bp, Artificial Sequence
  Synthetic
acgagaggttgaggatcaaggcgtcgtcgtacttgggcgtgggccgcggcgtggatgacgaggccgtcatcgaca

SEQ ID NO: 170890 - DNA, 75 bp, Artificial Sequence
  Synthetic
gtcgtacttgggcgtgggccgcggcgtggatgacgaggccgtcatcgacattttccccacgggccagacgatgag

SEQ ID NO: 170891 - DNA, 75 bp, Artificial Sequence
  Synthetic
cgtgctgcgcaagcagctgctctacggagtgtgcaagacgctctttgacaccatcacggtgcggcgcgtggccga

SEQ ID NO: 170892 - DNA, 75 bp, Artificial Sequence
  Synthetic
ccatcacggtgcggcgcgtggccgaggagtggaagttacacgcggcgttgtttccctaccgcgcgctggacgaag

SEQ ID NO: 170893 - DNA, 75 bp, Artificial Sequence
  Synthetic
gtgcaaacgggcgtgctgggcgcgctccgcgacattttatatcagtacgccgataacgacgactatggtctctac

SEQ ID NO: 170894 - DNA, 75 bp, Artificial Sequence
  Synthetic
tccgcgacattttatatcagtacgccgataacgacgactatggtctctacgtggattggtgcgtaacggtgggac

SEQ ID NO: 170895 - DNA, 75 bp, Artificial Sequence
  Synthetic
agcgggccaccgagacacacccgctggcgcaggacctgctgcagactaacctggcgctgctgctgcaggtggccg

SEQ ID NO: 170896 - DNA, 75 bp, Artificial Sequence
  Synthetic
ggcgcaggacctgctgcagactaacctggcgctgctgctgcaggtggccgagcgcctgggcgccgtgcgcgtagc

SEQ ID NO: 170897 - DNA, 75 bp, Artificial Sequence
  Synthetic
aaccgaggcattcaacttcacttcagcaaacacaacaactaactcctccactgagggtagttggagcgtgactaa

SEQ ID NO: 170898 - DNA, 75 bp, Artificial Sequence
  Synthetic
ccgcttgtacgtggcggccgaaccgctggcttatgagcgcgacaagctgctgttcaccacgccggtggcacacct

SEQ ID NO: 170899 - DNA, 75 bp, Artificial Sequence
  Synthetic
ctggcttatgagcgcgacaagctgctgttcaccacgccggtggcacacctgcacgaggagattctgcgctacgac

SEQ ID NO: 170900 - DNA, 75 bp, Artificial Sequence
  Synthetic
gagctcaactgcaagaagctggtggagatgatggagcagcacgaccggggcagcgacgccaaaaagtccattatg

SEQ ID NO: 170901 - DNA, 75 bp, Artificial Sequence
  Synthetic
agatgatggagcagcacgaccggggcagcgacgccaaaaagtccattatgaagtttttgcttaacgtctcggaca

SEQ ID NO: 170902 - DNA, 75 bp, Artificial Sequence
  Synthetic
accgtctactacccgcgcgtggtccgggtggacccggcgtggtgggacccggcggcgccgtggtgggaggacccg

SEQ ID NO: 170903 - DNA, 75 bp, Artificial Sequence
  Synthetic
gggtggacccggcgtggtgggacccggcggcgccgtggtgggaggacccgcgggccacgtcgggctgctgccgcc

SEQ ID NO: 170904 - DNA, 75 bp, Artificial Sequence
  Synthetic
gcagatccagtcgcaggtggacgagatccaggacctgcgcacgctcaaccagacctgggagaatcgcgtgcgcga

SEQ ID NO: 170905 - DNA, 75 bp, Artificial Sequence
  Synthetic
agacctgggagaatcgcgtgcgcgagctgcgcgacctgctcacgcgctacgcctcgcgccgcgaggactccatga

SEQ ID NO: 170906 - DNA, 75 bp, Artificial Sequence
  Synthetic
tataccggcgatgtcgaggctttctacctcatcatccacccacgcagcttctgccgagctttggaaacgcgtcga

SEQ ID NO: 170907 - DNA, 75 bp, Artificial Sequence
  Synthetic
gtgcgcaaggcgcgcgacgcggcgcccttccgtccgctggcggtggaggacaaccgcctggtggccaacagcttc

SEQ ID NO: 170908 - DNA, 75 bp, Artificial Sequence
  Synthetic
ccttccgtccgctggcggtggaggacaaccgcctggtggccaacagcttcttctcgcagttcgtgcccggcaccg

SEQ ID NO: 170909 - DNA, 75 bp, Artificial Sequence
  Synthetic
cgcatcagggggccgaagaggccatcgtatactccaattacacggtagagcgcgtgaccctgccctatctgtgtc

SEQ ID NO: 170910 - DNA, 75 bp, Artificial Sequence
  Synthetic
cgtatactccaattacacggtagagcgcgtgaccctgccctatctgtgtcacatcctggcgctgggcacgctgga

SEQ ID NO: 170911 - DNA, 75 bp, Artificial Sequence
  Synthetic
ccttctacattgtacataggggcatatgtaacagcaccgataccaacaattctacatctacttcaaatagcaccg

SEQ ID NO: 170912 - DNA, 75 bp, Artificial Sequence
  Synthetic
ccgatacgtggagctgatttgcagccgcgagaaggcgcgccggcgccaaatgagccgcgaagcggcgggcggagt

SEQ ID NO: 170913 - DNA, 75 bp, Artificial Sequence
  Synthetic
cgcgagaaggcgcgccggcgccaaatgagccgcgaagcggcgggcggagtgccagaaaggggaactgcctcgagc

SEQ ID NO: 170914 - DNA, 75 bp, Artificial Sequence
  Synthetic
cgtgtcggccgatttcgaaatggaggccctgatgatccgcggcgtgctggaggtccatacggatttcactagaca

SEQ ID NO: 170915 - DNA, 75 bp, Artificial Sequence
  Synthetic
gccctgatgatccgcggcgtgctggaggtccatacggatttcactagacagaatgtgatgatcatggagccgcaa

SEQ ID NO: 170916 - DNA, 75 bp, Artificial Sequence
  Synthetic
gaggaggccatgtcgcggcggcgacagcgcatgctgtggcggatgttctctcgtggaggagacggcgaatgcagc

SEQ ID NO: 170917 - DNA, 75 bp, Artificial Sequence
  Synthetic
taccgcagcgagttgctgtgcacctcggcctttctgggctactccgccgtgtttttgctcgagaccgaagacgcc

SEQ ID NO: 170918 - DNA, 75 bp, Artificial Sequence
  Synthetic
gtcgtgagcacgctataaatggtgagcaggcccgggctcggcggcgacgtgaacgatccttcatcgcgtttgccg

SEQ ID NO: 170919 - DNA, 75 bp, Artificial Sequence
  Synthetic
cggcctttctgggctactccgccgtgtttttgctcgagaccgaagacgccgtcacgcaggtgaggctctcggatc

SEQ ID NO: 170920 - DNA, 75 bp, Artificial Sequence
  Synthetic
gcgtggaaaattgcaacttaacgcgcaagtgcctgcacgacctgctccagtacctggacgcggtgaacgtgcgcg

SEQ ID NO: 170921 - DNA, 75 bp, Artificial Sequence
  Synthetic
caagtgcctgcacgacctgctccagtacctggacgcggtgaacgtgcgcgaaagcttcggccggctgctgcacca

SEQ ID NO: 170922 - DNA, 75 bp, Artificial Sequence
  Synthetic
gcccgctaccttcgtgctcttccagcagacgcggcatacctgcctgcagctggtagcacgcttctttttccgcct

SEQ ID NO: 170923 - DNA, 75 bp, Artificial Sequence
  Synthetic
tggtagcacgcttctttttccgccttaccggtcaagacgaggcacactcgtttagcctcaagctgaccgagcgta

SEQ ID NO: 170924 - DNA, 75 bp, Artificial Sequence
  Synthetic
cccccaagctgccaccgcgctgggaacggggagaggaagagtgagaagcgaactagacacgcatatcatagaaaa

SEQ ID NO: 170925 - DNA, 75 bp, Artificial Sequence
  Synthetic
aaaaacacgcaacacgtagtgagctttgacgtcccttttactagtatccacgtcacacgctgagaactttgacgc

SEQ ID NO: 170926 - DNA, 75 bp, Artificial Sequence
  Synthetic
acttacccacgtagttctcctacgtgactcgttaagcgttgagccggaaaaaccgcaggccctcggaagccaccc

SEQ ID NO: 170927 - DNA, 75 bp, Artificial Sequence
  Synthetic
cgccagcgagcgcacccactcgtcgcgctcctcgagccaagttgccgacgaagaagaacaagacggaggagacac

SEQ ID NO: 170928 - DNA, 75 bp, Artificial Sequence
  Synthetic
ggtggaagcggtggaggacgacaataactctcgcgcccagacctccacgcaagccgtgagcatggcaaaggcctt

SEQ ID NO: 170929 - DNA, 75 bp, Artificial Sequence
  Synthetic
aactctcgcgcccagacctccacgcaagccgtgagcatggcaaaggccttgtccacatagacgccgtagccgata

SEQ ID NO: 170930 - DNA, 75 bp, Artificial Sequence
  Synthetic
caatcaatcaccccagcgtgcggccttacttcgttttcaccgggctggaagcgcagtaaccaaaagtccacgtcg

SEQ ID NO: 170931 - DNA, 75 bp, Artificial Sequence
  Synthetic
ttacttcgttttcaccgggctggaagcgcagtaaccaaaagtccacgtcgttgcggcgagccacgaagcgaaaga

SEQ ID NO: 170932 - DNA, 75 bp, Artificial Sequence
  Synthetic
gttttacgtgtattgttacacgggtcgcgtatccctataatcggatgtgtgttactcattcgcggcgttgttata

SEQ ID NO: 170933 - DNA, 75 bp, Artificial Sequence
  Synthetic
catgacccacggccgagagccagtcgccaccggccgcgcagcaacagccacctaacgccgcgggcggcgtggagg

SEQ ID NO: 170934 - DNA, 75 bp, Artificial Sequence
  Synthetic
gccaccggccgcgcagcaacagccacctaacgccgcgggcggcgtggagggagaaacccgatcactaccgccgtt

SEQ ID NO: 170935 - DNA, 75 bp, Artificial Sequence
  Synthetic
gccgccgccgctagaatggcggtgagtgacgacgcagcccgcgcaacaagcgccaccgcaatgtcccgccgcgaa

SEQ ID NO: 170936 - DNA, 75 bp, Artificial Sequence
  Synthetic
cgccaccgcaatgtcccgccgcgaaatcacccaccaccccgtggagcggactaccaccggcgccgccgttgccgt

SEQ ID NO: 170937 - DNA, 75 bp, Artificial Sequence
  Synthetic
acgccgggcgcgctctcttgaacacgacaggtgggacccggatcgtcgccgccaaaaagtttgcgccaataacag

SEQ ID NO: 170938 - DNA, 75 bp, Artificial Sequence
  Synthetic
gacaggtgggacccggatcgtcgccgccaaaaagtttgcgccaataacagtcgaccacagtccgcacgcacactt

SEQ ID NO: 170939 - DNA, 75 bp, Artificial Sequence
  Synthetic
tccagcagcaccaccagcatgacgcgcggcacggtccccgacgccgccggacccaccatcgccgtcggacccacc

SEQ ID NO: 170940 - DNA, 75 bp, Artificial Sequence
  Synthetic
aaaggccggccgaagcgcaggctgacgtaacgtgctcggagatgtagcccagcagactctggatctgccagaagg

SEQ ID NO: 170941 - DNA, 75 bp, Artificial Sequence
  Synthetic
cgtaacgtgctcggagatgtagcccagcagactctggatctgccagaaggcgcgtcgcgagcgaaaacgcagatt

SEQ ID NO: 170942 - DNA, 75 bp, Artificial Sequence
  Synthetic
gcgtacacacttggccagcacgcgctcgaccaaatccacgatgagcactcgatgtagcgtggcgtcgcgaacgtg

SEQ ID NO: 170943 - DNA, 75 bp, Artificial Sequence
  Synthetic
tcgaccaaatccacgatgagcactcgatgtagcgtggcgtcgcgaacgtgcacggtgaaagtagcgtcgtcgctc

SEQ ID NO: 170944 - DNA, 75 bp, Artificial Sequence
  Synthetic
ggcggcaacagccagcgacgatcgccgccggccggtcgctcgcgaaaagccgtggcattgagacgcacggcgccg

SEQ ID NO: 170945 - DNA, 75 bp, Artificial Sequence
  Synthetic
cgccggccggtcgctcgcgaaaagccgtggcattgagacgcacggcgccgccgccggcctcggtgccgaagacct

SEQ ID NO: 170946 - DNA, 75 bp, Artificial Sequence
  Synthetic
caggcaggccgcaccacgagagcacctcagccgccgcgtccaacgccgtctcgcgcattaacgtgtgcagaccgt

SEQ ID NO: 170947 - DNA, 75 bp, Artificial Sequence
  Synthetic
ctcagccgccgcgtccaacgccgtctcgcgcattaacgtgtgcagaccgtggaccgcgtagacgggcacgggcgg

SEQ ID NO: 170948 - DNA, 75 bp, Artificial Sequence
  Synthetic
ctgcccagcgaaaccacggaaaagcacgtcgtaaaggtgagtccaggccgactgcagcaataaacaacactgctc

SEQ ID NO: 170949 - DNA, 75 bp, Artificial Sequence
  Synthetic
acgtcgtaaaggtgagtccaggccgactgcagcaataaacaacactgctcgtcggtcactgccacggccacgaaa

SEQ ID NO: 170950 - DNA, 75 bp, Artificial Sequence
  Synthetic
aaacgtcgttgtattcctactccgtccccagacaaagcggatctgcgagtggaatttccctcgttacccccgtgt

SEQ ID NO: 170951 - DNA, 75 bp, Artificial Sequence
  Synthetic
gcctcgtcgtcgcgctccagcacgtacttgtgagtgccgacgcgaaacgacatggccaaatcgtaggcgtagtaa

SEQ ID NO: 170952 - DNA, 75 bp, Artificial Sequence
  Synthetic
acttgtgagtgccgacgcgaaacgacatggccaaatcgtaggcgtagtaaccgcgacgcaattttttgtgcgcgt

SEQ ID NO: 170953 - DNA, 75 bp, Artificial Sequence
  Synthetic
cgatgaccactagcttggctacgtggaaaagactaagcgcgttcgacagcgctgcggtttccacgcccagtgccg

SEQ ID NO: 170954 - DNA, 75 bp, Artificial Sequence
  Synthetic
gtgcggcctccaaaatctccacaccgctagcgtccgtctgaatctgcaccggcgtgaaggtgcgcgccaacacgc

SEQ ID NO: 170955 - DNA, 75 bp, Artificial Sequence
  Synthetic
aactttggcgtgcccagccccgtatacgcactcgaggccttggtggacttccaggtgcgcaacgcttttatgaag

SEQ ID NO: 170956 - DNA, 75 bp, Artificial Sequence
  Synthetic
gacatcttccgacacgctgtccgacgaggtgtgtcgcgtctcacaaattataccgtaataaaaaagcgctacctc

SEQ ID NO: 170957 - DNA, 75 bp, Artificial Sequence
  Synthetic
cacgcgcgccaacacggcgctacgctgctctaggccgcgccggcgctcgtcggcgtccgtagtcacggccgaggc

SEQ ID NO: 170958 - DNA, 75 bp, Artificial Sequence
  Synthetic
tgctctaggccgcgccggcgctcgtcggcgtccgtagtcacggccgaggccagcgcggcgtagctggcgcgatgc

SEQ ID NO: 170959 - DNA, 75 bp, Artificial Sequence
  Synthetic
ccacccagatccaaaaacagacattgtacgataggcaccgaggcctccagaaggccgtaccagctgagatgacag

SEQ ID NO: 170960 - DNA, 75 bp, Artificial Sequence
  Synthetic
gtacgataggcaccgaggcctccagaaggccgtaccagctgagatgacagctggtcccgaacagggtgtacgggt

SEQ ID NO: 170961 - DNA, 75 bp, Artificial Sequence
  Synthetic
ttcgtcgaccgcccggacgtgctcaaaccgcgtcgtgagccgcggcggctcccatcgtagtatttaacgacccgc

SEQ ID NO: 170962 - DNA, 75 bp, Artificial Sequence
  Synthetic
aaccgcgtcgtgagccgcggcggctcccatcgtagtatttaacgacccgcgagcctgtcgtcatcggcgcgcccc

SEQ ID NO: 170963 - DNA, 75 bp, Artificial Sequence
  Synthetic
tggagcgcttctatcgttttcatggtgctgacttttgtcaacgtcagcgtgcatctggtgctgagcaattttccg

SEQ ID NO: 170964 - DNA, 75 bp, Artificial Sequence
  Synthetic
tgctgacttttgtcaacgtcagcgtgcatctggtgctgagcaattttccgcacctgggctacccctgcgtctact

SEQ ID NO: 170965 - DNA, 75 bp, Artificial Sequence
  Synthetic
cgcggaaaagacgcggaaaagaggaagtccccagggggacggccgcgcgcggaaaagaggaagcgcgcggcgcga

SEQ ID NO: 170966 - DNA, 75 bp, Artificial Sequence
  Synthetic
agtccccagggggacggccgcgcgcggaaaagaggaagcgcgcggcgcgactcgtccctaggggaccgcggggga

SEQ ID NO: 170967 - DNA, 75 bp, Artificial Sequence
  Synthetic
tagactcggtgcagctggtgtgctacgccgtgttcatgcagctcgtctttttagccgtgaccatctactacctgg

SEQ ID NO: 170968 - DNA, 75 bp, Artificial Sequence
  Synthetic
cgccgtgttcatgcagctcgtctttttagccgtgaccatctactacctggtatgctggatcaagatcagcatgcg

SEQ ID NO: 170969 - DNA, 75 bp, Artificial Sequence
  Synthetic
cttcatcctcagcatggacacgttccaactattcacactgaccatgtcatttcggctgcccagcatgatcgcctt

SEQ ID NO: 170970 - DNA, 75 bp, Artificial Sequence
  Synthetic
accaccgtggtagccatggccctgtgctacggcttcggaaacaactttttcgtgcgtacaggccacatggtgttg

SEQ ID NO: 170971 - DNA, 75 bp, Artificial Sequence
  Synthetic
gactgctcccgtggaatggaagtctcccgaccgtcagattcctaagaatattacttgcgctaattactcagggac

SEQ ID NO: 170972 - DNA, 75 bp, Artificial Sequence
  Synthetic
ggtttgcgggacttaagcgcggcggcgtcgtcagcgcactgccactgcgtgcctttgtgcgcactgccggtgcgt

SEQ ID NO: 170973 - DNA, 75 bp, Artificial Sequence
  Synthetic
cgaagccgtcttttttcaatacgtcaaagtgcaattcggctaccacctgggcgccttcttcggactctgcggcct

SEQ ID NO: 170974 - DNA, 75 bp, Artificial Sequence
  Synthetic
gtaccggcatcagctggtcgttcggcatgctctttttcatatgggccatgtttacgacgtgtcgcgccgtccgct

SEQ ID NO: 170975 - DNA, 75 bp, Artificial Sequence
  Synthetic
tttacgacgtgtcgcgccgtccgctactttcgcggacgcggtagcggcagtgtcaagtaccaggcgctggccaca

SEQ ID NO: 170976 - DNA, 75 bp, Artificial Sequence
  Synthetic
ttcggcagtacgccacgcggtgtcccacggtctttgtcagcggcacggcgctggggacggggtttcaccgcgctg

SEQ ID NO: 170977 - DNA, 75 bp, Artificial Sequence
  Synthetic
gacgacgatgatgaagacttcgaggacgcttgaccccgccgccacccgcaccagacttggagacatggacataaa

SEQ ID NO: 170978 - DNA, 75 bp, Artificial Sequence
  Synthetic
ccagacttggagacatggacataaaaaagagacacgcagaccgtgggtcgggagcacatactttttttttattaa

SEQ ID NO: 170979 - DNA, 75 bp, Artificial Sequence
  Synthetic
acaaaaaaaataatatacacacggagaaacacccacgggtgtcccattcccgactcgcgaatcgtacgcgagacc

SEQ ID NO: 170980 - DNA, 75 bp, Artificial Sequence
  Synthetic
gaaacacccacgggtgtcccattcccgactcgcgaatcgtacgcgagacctgaaagtttatgagttaaaagggca

SEQ ID NO: 170981 - DNA, 75 bp, Artificial Sequence
  Synthetic
ccatgtcgctgcgcagataagaggtaggtcgtagtgcggcgtgctgcacgctcaccgttaatggtaccaggtcgt

SEQ ID NO: 170982 - DNA, 75 bp, Artificial Sequence
  Synthetic
tgtcgggccgcggcagtcgcttagccaccacctggacgggggggaccgggggcggggacaggtaaattgaggtgt

SEQ ID NO: 170983 - DNA, 75 bp, Artificial Sequence
  Synthetic
gcaacacacaaccgcatgtccaaacctcggacaaacacgccgacgaagaacaccgcacgcagatggagctcgacg

SEQ ID NO: 170984 - DNA, 75 bp, Artificial Sequence
  Synthetic
caccacctggacgggggggaccgggggcggggacaggtaaattgaggtgtcctcttcgtctaagtcgtccgtctc

SEQ ID NO: 170985 - DNA, 75 bp, Artificial Sequence
  Synthetic
cggagccttgtcctcgcgaaacgtcgagcgcaccgcgtttttcttggggccgtcgtgggtggcctcgcggtggct

SEQ ID NO: 170986 - DNA, 75 bp, Artificial Sequence
  Synthetic
gagcgcaccgcgtttttcttggggccgtcgtgggtggcctcgcggtggctgccgctactactgtcgtttcccccg

SEQ ID NO: 170987 - DNA, 75 bp, Artificial Sequence
  Synthetic
ccttcgtccgaggaggaagtcggagggatgttgtcgtaggagcgtagagacacctggcgacccagagcatctttc

SEQ ID NO: 170988 - DNA, 75 bp, Artificial Sequence
  Synthetic
ggatgttgtcgtaggagcgtagagacacctggcgacccagagcatctttcaggggctcaccggacgtggtaccga

SEQ ID NO: 170989 - DNA, 75 bp, Artificial Sequence
  Synthetic
gctattgcccgcaacacgtagctgtggccggtgaagttgagcgtcagttgtcccacggtcacgttcgtgtcattc

SEQ ID NO: 170990 - DNA, 75 bp, Artificial Sequence
  Synthetic
acggtctaacacggtagagacggcatggcgcgtaaactgagggtcaaagaccacgggcgtgacgatgagcaggag

SEQ ID NO: 170991 - DNA, 75 bp, Artificial Sequence
  Synthetic
tggcgcgtaaactgagggtcaaagaccacgggcgtgacgatgagcaggagcgggatgtggtcgcagtggaaaacg

SEQ ID NO: 170992 - DNA, 75 bp, Artificial Sequence
  Synthetic
gtaggcaggtcgcggaaatcgatccgctccgggtccggatgcttctttatatagtattggctgagcacgtactgc

SEQ ID NO: 170993 - DNA, 75 bp, Artificial Sequence
  Synthetic
gctccgggtccggatgcttctttatatagtattggctgagcacgtactgctgaatgagcatctgaaagtaatact

SEQ ID NO: 170994 - DNA, 75 bp, Artificial Sequence
  Synthetic
gcgtgttttcgtcctcgaaaggtatcggcggcggcgaatcgcccgggctgccccgcaggtggtgatcagcgccgc

SEQ ID NO: 170995 - DNA, 75 bp, Artificial Sequence
  Synthetic
cggcggcggcgaatcgcccgggctgccccgcaggtggtgatcagcgccgccgccagcggcgtcgcccgcggctag

SEQ ID NO: 170996 - DNA, 75 bp, Artificial Sequence
  Synthetic
caggcagccgagatctaccgccagggcgagaagagccgcgccgagaaaggcctgcggcgacggctggcacatcag

SEQ ID NO: 170997 - DNA, 75 bp, Artificial Sequence
  Synthetic
agaaaatgaaacaagtatgtttattaagcagcatgtggggctaataggggggataactgaggtatagcaactatg

SEQ ID NO: 170998 - DNA, 75 bp, Artificial Sequence
  Synthetic
gatcacttccgaacactcggccttattgagatacagcagatcggccaggtactcgcgcagcggttcgggcggctt

SEQ ID NO: 170999 - DNA, 75 bp, Artificial Sequence
  Synthetic
ttgagatacagcagatcggccaggtactcgcgcagcggttcgggcggcttgagcgggcgcgcgcgcttgagcgtg

SEQ ID NO: 171000 - DNA, 75 bp, Artificial Sequence
  Synthetic
acgcccggcaccgggtgtgactgcaacagcgaggccacggccgccgcgtcgtgcctccgcagcacgttctgcaca

SEQ ID NO: 171001 - DNA, 75 bp, Artificial Sequence
  Synthetic
acagcgaggccacggccgccgcgtcgtgcctccgcagcacgttctgcacaaaggggtcctcctttttgcgcaaat

SEQ ID NO: 171002 - DNA, 75 bp, Artificial Sequence
  Synthetic
gcacgccgaagcacaggtccatggaagcgcccagcagccccgacgtggggtcgatgagcagaccgaggccgtcgc

SEQ ID NO: 171003 - DNA, 75 bp, Artificial Sequence
  Synthetic
agcgcccagcagccccgacgtggggtcgatgagcagaccgaggccgtcgcgcaccggctcgcgtccgtgcatcac

SEQ ID NO: 171004 - DNA, 75 bp, Artificial Sequence
  Synthetic
gcctcgcagtgcaacagcccgtgtcgcgcaaaatcgtccagactgtgcgccaggtagtaaagcaccccgcgatcg

SEQ ID NO: 171005 - DNA, 75 bp, Artificial Sequence
  Synthetic
cgagcccgtgtagtgcgagccgccgccacccgaaccgtccgccgccgcggcgccgggcagacagccgctgacgaa

SEQ ID NO: 171006 - DNA, 75 bp, Artificial Sequence
  Synthetic
ccacccgaaccgtccgccgccgcggcgccgggcagacagccgctgacgaaggcctcgtagaacttggtggccgag

SEQ ID NO: 171007 - DNA, 75 bp, Artificial Sequence
  Synthetic
agctcgacctgccgatagttgggcgccaaatccagcaaccggctgagccacacgtagtcgtccgagccgccgtgc

SEQ ID NO: 171008 - DNA, 75 bp, Artificial Sequence
  Synthetic
ccaaatccagcaaccggctgagccacacgtagtcgtccgagccgccgtgccggtcgtcgcaccgctcggccacgc

SEQ ID NO: 171009 - DNA, 75 bp, Artificial Sequence
  Synthetic
cgtcgcgagccagcgcggccacgcgcgtcataaagtcctcggctactggcgtaccgtgggcccgcagcatcttgg

SEQ ID NO: 171010 - DNA, 75 bp, Artificial Sequence
  Synthetic
cgtcataaagtcctcggctactggcgtaccgtgggcccgcagcatcttggcgaagatgcggtaggcgtaagacag

SEQ ID NO: 171011 - DNA, 75 bp, Artificial Sequence
  Synthetic
atcatgctacaggtgagcaacgtaacgaatcacaccttgaacagcactgaaatttatcagttgttcgagtacact

SEQ ID NO: 171012 - DNA, 75 bp, Artificial Sequence
  Synthetic
aggctcatcgtcccaaaccgccagcagccgggtgagctcctcatcgtcgtcgtagtccaaactcgagacgcccca

SEQ ID NO: 171013 - DNA, 75 bp, Artificial Sequence
  Synthetic
agccgggtgagctcctcatcgtcgtcgtagtccaaactcgagacgccccacatgatgatggcggcgcctcagtat

SEQ ID NO: 171014 - DNA, 75 bp, Artificial Sequence
  Synthetic
tcggggaacagttgacggcagtcaccgtcaaggtcctcctcgcagattatgctggtggtgcgccgaaaggcgtta

SEQ ID NO: 171015 - DNA, 75 bp, Artificial Sequence
  Synthetic
cgtcaaggtcctcctcgcagattatgctggtggtgcgccgaaaggcgttatataaatacagcccgtcgctcgtgg

SEQ ID NO: 171016 - DNA, 75 bp, Artificial Sequence
  Synthetic
aggcgcgtacgcgacacgaggacatcttggcctccacaaagcgtagcgtgtgcgacaccagcgcggcgccatgct

SEQ ID NO: 171017 - DNA, 75 bp, Artificial Sequence
  Synthetic
cttggcctccacaaagcgtagcgtgtgcgacaccagcgcggcgccatgctcgcccaggagacaggcgccgtagct

SEQ ID NO: 171018 - DNA, 75 bp, Artificial Sequence
  Synthetic
cgcgccggcgtgcttaaagagcaacgcctccgtacccatgcgcacctcgtccagaccgcgccggtccaacagccg

SEQ ID NO: 171019 - DNA, 75 bp, Artificial Sequence
  Synthetic
gcctccgtacccatgcgcacctcgtccagaccgcgccggtccaacagccgcatgaggcaaaagcccagcacgtta

SEQ ID NO: 171020 - DNA, 75 bp, Artificial Sequence
  Synthetic
agcagcttctgcagcggcatgggtcggaaagcagggtggtaacattcgcgcagacggtgcgagcagttggggatg

SEQ ID NO: 171021 - DNA, 75 bp, Artificial Sequence
  Synthetic
ggaaagcagggtggtaacattcgcgcagacggtgcgagcagttggggatgcggcgcgccgtgcccgtctcctgaa

SEQ ID NO: 171022 - DNA, 75 bp, Artificial Sequence
  Synthetic
tctcgctggggttgtgcgggttcacgtcgatgagcacgttcatgggtgtaatatcaaagtggcatacacgacact

SEQ ID NO: 171023 - DNA, 75 bp, Artificial Sequence
  Synthetic
gtcgatgagcacgttcatgggtgtaatatcaaagtggcatacacgacactggtgattgagaaatttgatagcgtc

SEQ ID NO: 171024 - DNA, 75 bp, Artificial Sequence
  Synthetic
cttagggaaggctgagttcttggtaaagaactctatattcctgtagcacatatacatcatctttctcttaagttc

SEQ ID NO: 171025 - DNA, 75 bp, Artificial Sequence
  Synthetic
gtggaaacgtcgatgtactgtgacgttgtgcagcagacagcagcccgtggccgtgagcagaccgcggtgcacgcc

SEQ ID NO: 171026 - DNA, 75 bp, Artificial Sequence
  Synthetic
ttgtgcagcagacagcagcccgtggccgtgagcagaccgcggtgcacgcccgtgcccaccagcgacggcggctgc

SEQ ID NO: 171027 - DNA, 75 bp, Artificial Sequence
  Synthetic
gccaccttgaccacgcgatagcgatcgagcggccagacctcgccgaaggagccctggcccaggcggtagctctcg

SEQ ID NO: 171028 - DNA, 75 bp, Artificial Sequence
  Synthetic
cgagcggccagacctcgccgaaggagccctggcccaggcggtagctctcgtcgctcatgtccacggcataacaga

SEQ ID NO: 171029 - DNA, 75 bp, Artificial Sequence
  Synthetic
gcgtaaggcgcaagaacatacgcgggtcgcacgtaaggccgcggatggacgtggtgatgatctggtcgttggaac

SEQ ID NO: 171030 - DNA, 75 bp, Artificial Sequence
  Synthetic
gtcgcacgtaaggccgcggatggacgtggtgatgatctggtcgttggaacaggtgcaatgcacgtcgtcgtgtga

SEQ ID NO: 171031 - DNA, 75 bp, Artificial Sequence
  Synthetic
gcccgatgccacggcgctgtcctgactttccgcgcgcagctccacgtcgttttcttcgagcaccgcgtccacgcc

SEQ ID NO: 171032 - DNA, 75 bp, Artificial Sequence
  Synthetic
ctttccgcgcgcagctccacgtcgttttcttcgagcaccgcgtccacgccgcccacacgacgtcggcacagcggg

SEQ ID NO: 171033 - DNA, 75 bp, Artificial Sequence
  Synthetic
gggtcgctgccgccggtgaagagagcgcggcgtacgctggtcacgtcgccgtcgcgatcgtactcgaacgaccac

SEQ ID NO: 171034 - DNA, 75 bp, Artificial Sequence
  Synthetic
cgcggcgtacgctggtcacgtcgccgtcgcgatcgtactcgaacgaccacatggccgaggtttcgcggcagcgca

SEQ ID NO: 171035 - DNA, 75 bp, Artificial Sequence
  Synthetic
gcgcacacacctaggtggacgcccgacatccattccgggccgtgtgctgggtccccgaggggcgggggggtgttt

SEQ ID NO: 171036 - DNA, 75 bp, Artificial Sequence
  Synthetic
ccttgtccgaagccgcgtcctctttttctccgtcacgcatcacgtcacttcgaacgcatgcggaaaaagtcgcgt

SEQ ID NO: 171037 - DNA, 75 bp, Artificial Sequence
  Synthetic
cgaacgcatgcggaaaaagtcgcgtgtccaagcacggtggttgtgctgacggaactcagggtggtcaaagtggtg

SEQ ID NO: 171038 - DNA, 75 bp, Artificial Sequence
  Synthetic
gcggcggcctgcgcggcctgtaccgcggcttgagcggcggcctgcgcagcttcgcgcatccactggcgccggcgc

SEQ ID NO: 171039 - DNA, 75 bp, Artificial Sequence
  Synthetic
gaccgaagtgcggaggacatagtggcgacagtcttccctgttcctagggctgcactagctaccacaccgacactg

SEQ ID NO: 171040 - DNA, 75 bp, Artificial Sequence
  Synthetic
gtcgtcaacctccaggtccaaatcgcacgtcgccgaaaccgagtccaccaaggtggctctcacgtcgtctaccgt

SEQ ID NO: 171041 - DNA, 75 bp, Artificial Sequence
  Synthetic
cacgtcgccgaaaccgagtccaccaaggtggctctcacgtcgtctaccgtgtccttcagctcggttaaagagtcc

SEQ ID NO: 171042 - DNA, 75 bp, Artificial Sequence
  Synthetic
gtggacggccgggctccattccgggccgcgtgctgggtccccgaggggcgggggggtgtttttagcgggggggtg

SEQ ID NO: 171043 - DNA, 75 bp, Artificial Sequence
  Synthetic
aacaggtgtgcggccacgcactgcgtcgttcgctgactgtatcgggtctgttcccgagcggccacacgcatcacc

SEQ ID NO: 171044 - DNA, 75 bp, Artificial Sequence
  Synthetic
aattttttccatgcccgcggctgtctacactacggtagtaatgcatcatgaagccaatgataccactaatgccac

SEQ ID NO: 171045 - DNA, 75 bp, Artificial Sequence
  Synthetic
tcgttcgctgactgtatcgggtctgttcccgagcggccacacgcatcaccgtcaaagcctgctgcgtggtgagcc

SEQ ID NO: 171046 - DNA, 75 bp, Artificial Sequence
  Synthetic
agagctgtttgttgaccgacgtcatagattcaacgtgatgagacccgcgtcgttcagcgagagagcgtccagcaa

SEQ ID NO: 171047 - DNA, 75 bp, Artificial Sequence
  Synthetic
agattcaacgtgatgagacccgcgtcgttcagcgagagagcgtccagcaacttgccgacgtggtagacggggaaa

SEQ ID NO: 171048 - DNA, 75 bp, Artificial Sequence
  Synthetic
acgatggggctataactcacggtccgcgcctcgtcacgcgcgagatctaaacagagacggttctgactgtagagc

SEQ ID NO: 171049 - DNA, 75 bp, Artificial Sequence
  Synthetic
gcgcctcgtcacgcgcgagatctaaacagagacggttctgactgtagagcgcgcacaacaaacaggtgcgcgacg

SEQ ID NO: 171050 - DNA, 75 bp, Artificial Sequence
  Synthetic
acgtacgtggtttgtggaaagaaccacgttttggcgtcgcacgtgggttccgggacagaacccggcggccgaagc

SEQ ID NO: 171051 - DNA, 75 bp, Artificial Sequence
  Synthetic
gcgagacgggctttaaaggcaaatgcacctcgtcgccggcgtcatcgacccggcctgctgacgcgctcgtctcga

SEQ ID NO: 171052 - DNA, 75 bp, Artificial Sequence
  Synthetic
cccggggcacaacacacggcccgccaacacaccccgacacacccctgacacaccccgcccgccacacgcccgcga

SEQ ID NO: 171053 - DNA, 75 bp, Artificial Sequence
  Synthetic
cggcctgctgacgcgctcgtctcgaccgcacaagcgccggccccgccgccgccaccactaccaccaccaccacca

SEQ ID NO: 171054 - DNA, 75 bp, Artificial Sequence
  Synthetic
ataccaaacaaagacgtacagctcagccagattcatgtaggtcatatagtcccgcacgggttcgtaaaagagttt

SEQ ID NO: 171055 - DNA, 75 bp, Artificial Sequence
  Synthetic
gccagattcatgtaggtcatatagtcccgcacgggttcgtaaaagagtttgggcaacaacgcggggaaaggacaa

SEQ ID NO: 171056 - DNA, 75 bp, Artificial Sequence
  Synthetic
gcctccacgtcgcacacgttgtgatgatctaacaagcccggcgtgtacacctgtcgcagcacggcttccacgtat

SEQ ID NO: 171057 - DNA, 75 bp, Artificial Sequence
  Synthetic
gatctaacaagcccggcgtgtacacctgtcgcagcacggcttccacgtattgcaccttgttgctggagagtgaca

SEQ ID NO: 171058 - DNA, 75 bp, Artificial Sequence
  Synthetic
tgcgtaacgcataatcatgcacacaaagcgacggcaaaggctcagccgcggccgcgaaacgctccagcacgtcgt

SEQ ID NO: 171059 - DNA, 75 bp, Artificial Sequence
  Synthetic
aagcgacggcaaaggctcagccgcggccgcgaaacgctccagcacgtcgtgtcgacgtagaaaagacggcgtggc

SEQ ID NO: 171060 - DNA, 75 bp, Artificial Sequence
  Synthetic
tttattcccgacgtttttctttttgtcctccggcccgctatcgccaccgctgctactgctatccaacaccggcac

SEQ ID NO: 171061 - DNA, 75 bp, Artificial Sequence
  Synthetic
tcctccggcccgctatcgccaccgctgctactgctatccaacaccggcacctcggccgactcgcgcggaattacg

SEQ ID NO: 171062 - DNA, 75 bp, Artificial Sequence
  Synthetic
agctccctgtccccagcgcgacagctccccgtccgcagcgccaaagctccccgtccccaacgtcaccccctgtcc

SEQ ID NO: 171063 - DNA, 75 bp, Artificial Sequence
  Synthetic
tgagtcacgtggcacgttgccagctgaaaccgccgtcgtctccgccggcgttttctccatcacgggaccgcgccg

SEQ ID NO: 171064 - DNA, 75 bp, Artificial Sequence
  Synthetic
cggacaacacgccgcaaaagcggcggcgcgcttacgtttctcaacactctctgagctctgtcccgcgaacaaaca

SEQ ID NO: 171065 - DNA, 75 bp, Artificial Sequence
  Synthetic
gccaccagcgccatatttacggcctcctcgaagcgccaagcctcggagaccgagaaatcggcggccggagactgc

SEQ ID NO: 171066 - DNA, 75 bp, Artificial Sequence
  Synthetic
aagacaatgaaagcgacgtcaacggtggaattcgctgggctctatatatacaaaccggcgacgccaagtacggta

SEQ ID NO: 171067 - DNA, 75 bp, Artificial Sequence
  Synthetic
cgagaaatcggcggccggagactgcgccgacagctcgaccatccgttccaccgagcacagggacgtcgaaacccc

SEQ ID NO: 171068 - DNA, 75 bp, Artificial Sequence
  Synthetic
cgacatgttatcacagaacacacagattttctgcgtgttttataaaagagcgtctcgaagcagcttgagccacac

SEQ ID NO: 171069 - DNA, 75 bp, Artificial Sequence
  Synthetic
gtctgagcctgacgccgaggaagacgacaccactagggacgacgaagacgaacgagtgacggcgcccgtcccaca

SEQ ID NO: 171070 - DNA, 75 bp, Artificial Sequence
  Synthetic
gacaccactagggacgacgaagacgaacgagtgacggcgcccgtcccacaagccacgtccgcgacaacgtggttt

SEQ ID NO: 171071 - DNA, 75 bp, Artificial Sequence
  Synthetic
cgcactaccgccgccgccatcatgttgcgcggagattcggccgccaagatccaggagcgctacgcggagctgcag

SEQ ID NO: 171072 - DNA, 75 bp, Artificial Sequence
  Synthetic
ctgacttccaagtgccacacatcaccactgtattcatccatgttttcaccgaaccaacgagacagatcgaagaag

SEQ ID NO: 171073 - DNA, 75 bp, Artificial Sequence
  Synthetic
tgcgcggagattcggccgccaagatccaggagcgctacgcggagctgcagaagcgcaagagccaccccacctcct

SEQ ID NO: 171074 - DNA, 75 bp, Artificial Sequence
  Synthetic
tggcccactcgtgcaacgaggccttcctgccgctcatggccttctgcggccgccaccgcgactacaactcgcccg

SEQ ID NO: 171075 - DNA, 75 bp, Artificial Sequence
  Synthetic
cctgccgctcatggccttctgcggccgccaccgcgactacaactcgcccgaggaaagccagcgcgagctgctgtt

SEQ ID NO: 171076 - DNA, 75 bp, Artificial Sequence
  Synthetic
gaagctggacgcgttaaccgagctctaccgcgatccgcagtttcagcagatcaacaacttcatgaccgactttaa

SEQ ID NO: 171077 - DNA, 75 bp, Artificial Sequence
  Synthetic
taccgcgatccgcagtttcagcagatcaacaacttcatgaccgactttaaaaagtggctcgacggcggcttcagt

SEQ ID NO: 171078 - DNA, 75 bp, Artificial Sequence
  Synthetic
cacgcccgaaaacaccgccgtcgccgccccgaaaagcgaagcgccgcgcaaaagctgcgtagaaacgccgcacaa

SEQ ID NO: 171079 - DNA, 75 bp, Artificial Sequence
  Synthetic
tttatagccgtgaccaagatccccgtgctggccaatcgcgtgctgcagtacctcatccacgccttccagatcgac

SEQ ID NO: 171080 - DNA, 75 bp, Artificial Sequence
  Synthetic
tgctggccaatcgcgtgctgcagtacctcatccacgccttccagatcgacttcctctcgcagacctccatcgaca

SEQ ID NO: 171081 - DNA, 75 bp, Artificial Sequence
  Synthetic
gcagtgcgcaaaaagcgccggccacggcacgccgtaaacaaaactccggccccgcacacccgtggaaacagccct

SEQ ID NO: 171082 - DNA, 75 bp, Artificial Sequence
  Synthetic
cgtttctgcttaagcacatgatcggcatcagcatcggctacgtggcgcaccaaaagcacgtgtcgcagtttgtgc

SEQ ID NO: 171083 - DNA, 75 bp, Artificial Sequence
  Synthetic
catcagcatcggctacgtggcgcaccaaaagcacgtgtcgcagtttgtgctcaaagaggtcgagttccgctgccg

SEQ ID NO: 171084 - DNA, 75 bp, Artificial Sequence
  Synthetic
cacggcgctttttgccagttgctacaacaccaacgtgagtagctccatgatgataatatacgccttgccacaaac

SEQ ID NO: 171085 - DNA, 75 bp, Artificial Sequence
  Synthetic
ttttgttcctgaccatcttgtttagcaactcgtaaactgtcagcctagcgacgtccgtttagatcaaaagtcacg

SEQ ID NO: 171086 - DNA, 75 bp, Artificial Sequence
  Synthetic
tttttgttgtttcttgtttcttctccccgtgaactgtcagaccccgttagtgcactaggttcttaagcaccggac

SEQ ID NO: 171087 - DNA, 75 bp, Artificial Sequence
  Synthetic
aggaacacactatcatacgtgacacaggttcctctaccttgaccaggtcccacacatcggtcttgacgggcaacc

SEQ ID NO: 171088 - DNA, 75 bp, Artificial Sequence
  Synthetic
aggttcctctaccttgaccaggtcccacacatcggtcttgacgggcaaccatcggccctcagaatccttgacacc

SEQ ID NO: 171089 - DNA, 75 bp, Artificial Sequence
  Synthetic
gtcatcgctctcacagaaaaaagtcgcgggttcctcgttgtggatgagcgactgcgtcatgggcccacagggcac

SEQ ID NO: 171090 - DNA, 75 bp, Artificial Sequence
  Synthetic
gcgggttcctcgttgtggatgagcgactgcgtcatgggcccacagggcacgtaacaaagacagcggcccatatcg

SEQ ID NO: 171091 - DNA, 75 bp, Artificial Sequence
  Synthetic
ctctacgtccgattgggctcgctatatccgagaccgcccggatccgggctcgccaaacacccctccgtaagcgcc

SEQ ID NO: 171092 - DNA, 75 bp, Artificial Sequence
  Synthetic
ccgcaggccgtggccgccgccatgagccgcgtcatggaagggatatcgcaccgattgccgcatgaggtaaacagg

SEQ ID NO: 171093 - DNA, 75 bp, Artificial Sequence
  Synthetic
gccgcgtcatggaagggatatcgcaccgattgccgcatgaggtaaacaggtcgtagcacagaatgtaaaagaaaa

SEQ ID NO: 171094 - DNA, 75 bp, Artificial Sequence
  Synthetic
ccatggcaccgtgacccttgaccaggatgcgcttggcttcatcctggggcaccaacatgcagacctcgtaaatca

SEQ ID NO: 171095 - DNA, 75 bp, Artificial Sequence
  Synthetic
cttggcaagaaatcaatgctggctggacccaaaggacctccgaagctcagttggtacaaggtaggtaaatgacag

SEQ ID NO: 171096 - DNA, 75 bp, Artificial Sequence
  Synthetic
atccattcgccgtcgcggtagagcaacagcaattggcacaagatacacgagccgtcgtcctccggactaaagatc

SEQ ID NO: 171097 - DNA, 75 bp, Artificial Sequence
  Synthetic
actcgcggtgtttccggctcttgccgaccagcttccacatgcattcctcttgcaagaactgcttcaaagttctgg

SEQ ID NO: 171098 - DNA, 75 bp, Artificial Sequence
  Synthetic
tcacgttagtggtgacgttgaaagcggtagacgttgtataggaaagatatggcgtagtagtactttgagatttct

SEQ ID NO: 171099 - DNA, 75 bp, Artificial Sequence
  Synthetic
acccagtaaaagtccaagtctggcgtgacgtagaacacgcacacctcgggctgcgagagccaacgtcgcaggcgt

SEQ ID NO: 171100 - DNA, 75 bp, Artificial Sequence
  Synthetic
tgacgtagaacacgcacacctcgggctgcgagagccaacgtcgcaggcgtccgcggcgatcacggacgatccaaa

SEQ ID NO: 171101 - DNA, 75 bp, Artificial Sequence
  Synthetic
cagcgtaccaagtccgttcggcgggcggaccgctctcgttccgcggtccgaaaagcagctcctgcggtttgggcg

SEQ ID NO: 171102 - DNA, 75 bp, Artificial Sequence
  Synthetic
cggaccgctctcgttccgcggtccgaaaagcagctcctgcggtttgggcgccgagcgctcgcgctgacgacgagc

SEQ ID NO: 171103 - DNA, 75 bp, Artificial Sequence
  Synthetic
ccgatccatccagagcgccaaggcatgacggcaaagttcccaaacaacgcgccaggacatgttccgtggcacgtg

SEQ ID NO: 171104 - DNA, 75 bp, Artificial Sequence
  Synthetic
tgacggcaaagttcccaaacaacgcgccaggacatgttccgtggcacgtggcaggcgaaacgctgtggcaacgcg

SEQ ID NO: 171105 - DNA, 75 bp, Artificial Sequence
  Synthetic
gcccgataagcgtccaacgcccggtatagttcgacttcgtggtcatcgtagctcagctcgcgactgcgccaaaag

SEQ ID NO: 171106 - DNA, 75 bp, Artificial Sequence
  Synthetic
atagttcgacttcgtggtcatcgtagctcagctcgcgactgcgccaaaaggaattgacgtaccacagcacacgga

SEQ ID NO: 171107 - DNA, 75 bp, Artificial Sequence
  Synthetic
cgacctcgtcgcggtcgtgcggatcggtggcgtacatgaggtctggatttacatccaggcgcagctgcaccaact

SEQ ID NO: 171108 - DNA, 75 bp, Artificial Sequence
  Synthetic
acatccaggcgcagctgcaccaactcatgaccgcgtatcttggaaggcggctccaatggacccgcgtgatagatg

SEQ ID NO: 171109 - DNA, 75 bp, Artificial Sequence
  Synthetic
gtcgcataaaaggcggtgggatgtggggatgaaacatatccagatacgcagttttgttatcctaacaaaacccgt

SEQ ID NO: 171110 - DNA, 75 bp, Artificial Sequence
  Synthetic
gagattcctgctccgttcggaatttcaaaaaatggagtactgacggccgtctccagagaagccacagccgcttcg

SEQ ID NO: 171111 - DNA, 75 bp, Artificial Sequence
  Synthetic
aactggtgctgccggtcgcgcttattcgcttccatttcttctcgtaacaggtcacgcgctaaaaactcccagtca

SEQ ID NO: 171112 - DNA, 75 bp, Artificial Sequence
  Synthetic
tcgcttccatttcttctcgtaacaggtcacgcgctaaaaactcccagtcacgatagctgccgtcgggccagacca

SEQ ID NO: 171113 - DNA, 75 bp, Artificial Sequence
  Synthetic
atgtagaaagtataaagaatggtgggacgcagagaggcatcgctagacacaggttgatcgttgtgctagccccac

SEQ ID NO: 171114 - DNA, 75 bp, Artificial Sequence
  Synthetic
agaacatgcgcacgcgctgctctttctctaacgtcacagtgagaccgctttgacgtaggtaatcgagcaactcca

SEQ ID NO: 171115 - DNA, 75 bp, Artificial Sequence
  Synthetic
ctctaacgtcacagtgagaccgctttgacgtaggtaatcgagcaactccagtgggcgcggtagtacacgaaaaca

SEQ ID NO: 171116 - DNA, 75 bp, Artificial Sequence
  Synthetic
attgtatatgtgccgtgcaaagtgtcctagaatattatgatacgaagcgttgcaataacaggaaaagtgctaaat

SEQ ID NO: 171117 - DNA, 75 bp, Artificial Sequence
  Synthetic
cggtgcgtcgtcctcatctccgcccggagcgcggcccgcggatcggccagcgctgtctacattacgatagtagac

SEQ ID NO: 171118 - DNA, 75 bp, Artificial Sequence
  Synthetic
ggagcgcggcccgcggatcggccagcgctgtctacattacgatagtagacgtagcgcagcgtctcggcctcctcg

SEQ ID NO: 171119 - DNA, 75 bp, Artificial Sequence
  Synthetic
agatccgaatacaggtgcgtttccatattcggaacgcatctgtttcagaagcgcgtcctcacgcttcttacgact

SEQ ID NO: 171120 - DNA, 75 bp, Artificial Sequence
  Synthetic
tattcggaacgcatctgtttcagaagcgcgtcctcacgcttcttacgactaaccttgatgacacacgcgtcgtac

SEQ ID NO: 171121 - DNA, 75 bp, Artificial Sequence
  Synthetic
acgttatgcatagaacggaaaaccttattaaaggtgaagtaaatactgtcctccacctgctttttgaggcggtcg

SEQ ID NO: 171122 - DNA, 75 bp, Artificial Sequence
  Synthetic
ctccacctgctttttgaggcggtcgcgctcgaccacctcttggatcacgtcggcgtaacggccggcgtgcgtcat

SEQ ID NO: 171123 - DNA, 75 bp, Artificial Sequence
  Synthetic
caacaggtggctacgcgccaccggatagagagtctcgtataccaggcccgtcttgacgcagacggagccctcgag

SEQ ID NO: 171124 - DNA, 75 bp, Artificial Sequence
  Synthetic
tagagagtctcgtataccaggcccgtcttgacgcagacggagccctcgagcgtggagacgagcgcgcagccgctg

SEQ ID NO: 171125 - DNA, 75 bp, Artificial Sequence
  Synthetic
gcgttctggacgtgcctcatgtcacaggcgcccgaggcgtcgcacatgacgtctgagcgtcgctgacagttttgg

SEQ ID NO: 171126 - DNA, 75 bp, Artificial Sequence
  Synthetic
aggcgcccgaggcgtcgcacatgacgtctgagcgtcgctgacagttttgggggcggagggaacaggagaagggca

SEQ ID NO: 171127 - DNA, 75 bp, Artificial Sequence
  Synthetic
ctccaccgtcaggtgctcgaacacggacgcgaccagttccaagcggcgcgggcctgactcctcggcctggaaaag

SEQ ID NO: 171128 - DNA, 75 bp, Artificial Sequence
  Synthetic
gacgcgaccagttccaagcggcgcgggcctgactcctcggcctggaaaaggaaggaaaagtgttgaaagaggcgg

SEQ ID NO: 171129 - DNA, 75 bp, Artificial Sequence
  Synthetic
atggcggctgtggcgggtcgcgacgacgacactttcgtttttatgggcgcgcgtcacgcggcgccggtgtcggcg

SEQ ID NO: 171130 - DNA, 75 bp, Artificial Sequence
  Synthetic
acgacactttcgtttttatgggcgcgcgtcacgcggcgccggtgtcggcggattggttccggttttcaggtcgca

SEQ ID NO: 171131 - DNA, 75 bp, Artificial Sequence
  Synthetic
gtaggcttccagccgagcgtgcgtaatcataagagtcccttttctgtctcctctctacacagagcatccgaggac

SEQ ID NO: 171132 - DNA, 75 bp, Artificial Sequence
  Synthetic
atcataagagtcccttttctgtctcctctctacacagagcatccgaggacaaaacttccatttgctgctggtgga

SEQ ID NO: 171133 - DNA, 75 bp, Artificial Sequence
  Synthetic
cttcatatcgtccaccaacactaccagtgacgccacgtgtttcttgacgcgcctcaacaatgcgccctttgacat

SEQ ID NO: 171134 - DNA, 75 bp, Artificial Sequence
  Synthetic
agtgacgccacgtgtttcttgacgcgcctcaacaatgcgccctttgacatgctcaacgtggtctcttacgtgtgc

SEQ ID NO: 171135 - DNA, 75 bp, Artificial Sequence
  Synthetic
ttcatcagcctcaactcgcaggtgcgcaagacggccaacatgtttatgccgggcgctttcatggacgagatcatc

SEQ ID NO: 171136 - DNA, 75 bp, Artificial Sequence
  Synthetic
catcgcatatgacgttgaccgtcgtggggatttttgacgggcaacacttttttacctatcacgttaattccagcg

SEQ ID NO: 171137 - DNA, 75 bp, Artificial Sequence
  Synthetic
gcaagacggccaacatgtttatgccgggcgctttcatggacgagatcatcggcggtaccaataaaatctcgcaga

SEQ ID NO: 171138 - DNA, 75 bp, Artificial Sequence
  Synthetic
acgattatttcggcaagacgctttacgtgtatctggacccggccttcaccaccaaccgcaaggcctcgggcacgg

SEQ ID NO: 171139 - DNA, 75 bp, Artificial Sequence
  Synthetic
cgtgtatctggacccggccttcaccaccaaccgcaaggcctcgggcacgggcgtggcggccgtaggcgcctaccg

SEQ ID NO: 171140 - DNA, 75 bp, Artificial Sequence
  Synthetic
cgagtgcgcggcgcacatgatcatctcggtgctgagcctgcacccttacctggacgaactgcgtatcgccgtgga

SEQ ID NO: 171141 - DNA, 75 bp, Artificial Sequence
  Synthetic
cgtcaccactagtgcaatattgtgattgtaagaccgagagagtattgttacgatgcttagaacgtggagattatt

SEQ ID NO: 171142 - DNA, 75 bp, Artificial Sequence
  Synthetic
tcggtgctgagcctgcacccttacctggacgaactgcgtatcgccgtggagggcaacaccaaccaggcggcggcc

SEQ ID NO: 171143 - DNA, 75 bp, Artificial Sequence
  Synthetic
gaccagaaccacatcgaacagcccttctacctcatgggccgcgacaaggcgctggccgtggaacagttcatctcg

SEQ ID NO: 171144 - DNA, 75 bp, Artificial Sequence
  Synthetic
tctacctcatgggccgcgacaaggcgctggccgtggaacagttcatctcgcgtttcaactcgggctacatcaaag

SEQ ID NO: 171145 - DNA, 75 bp, Artificial Sequence
  Synthetic
tactcgggtctggttataagtccatttgctcatttttcccgcaactcccgggtaattccaatgagcagcattaca

SEQ ID NO: 171146 - DNA, 75 bp, Artificial Sequence
  Synthetic
acctgcaccgcgtcacgctggccgaaggcacgacggcacgctactcggccaagcgccagaatcgtatctcggacg

SEQ ID NO: 171147 - DNA, 75 bp, Artificial Sequence
  Synthetic
aggcacgacggcacgctactcggccaagcgccagaatcgtatctcggacgatcttatcatcgccgtcatcatggc

SEQ ID NO: 171148 - DNA, 75 bp, Artificial Sequence
  Synthetic
gcgactgacgccggcatcggcagaaacgagacgatcgtaacccaggcgcgtaaaactccccaaaggcgaaaacgt

SEQ ID NO: 171149 - DNA, 75 bp, Artificial Sequence
  Synthetic
acgagacgatcgtaacccaggcgcgtaaaactccccaaaggcgaaaacgtttcagcgtagtcggctaacaaagcc

SEQ ID NO: 171150 - DNA, 75 bp, Artificial Sequence
  Synthetic
tcgttctcctcgacgcgcggcggcggaggatccaaggcctccagcgcctcctggtgcaaatgcagcgaattgagc

SEQ ID NO: 171151 - DNA, 75 bp, Artificial Sequence
  Synthetic
gaggatccaaggcctccagcgcctcctggtgcaaatgcagcgaattgagcaacaaacacagacaggcggccagct

SEQ ID NO: 171152 - DNA, 75 bp, Artificial Sequence
  Synthetic
tgcccagcatctcctcgcccatctcgtcctcgtccagctcgtaaagacagacttgacaaagaaaatagttctcca

SEQ ID NO: 171153 - DNA, 75 bp, Artificial Sequence
  Synthetic
acttgacaaagaaaatagttctccagacgcggcacgtcgagcaagagcagcttcttagcacccgccagccccacg

SEQ ID NO: 171154 - DNA, 75 bp, Artificial Sequence
  Synthetic
ccatcaaacatgtccgaatcaccgcgcgtggcactctgtaacaacggcgctagacgctcctccatctcgggcgga

SEQ ID NO: 171155 - DNA, 75 bp, Artificial Sequence
  Synthetic
gcgtggcactctgtaacaacggcgctagacgctcctccatctcgggcggacaaagaaccagctcctcgtgcgagc

SEQ ID NO: 171156 - DNA, 75 bp, Artificial Sequence
  Synthetic
tagtgatcacaacgtccggcgcccaaagcacgctggtacccggccaaataacgtgtctggggccggtgctgccgc

SEQ ID NO: 171157 - DNA, 75 bp, Artificial Sequence
  Synthetic
aagcacgctggtacccggccaaataacgtgtctggggccggtgctgccgccgtcgttgacgcgaatcatataaat

SEQ ID NO: 171158 - DNA, 75 bp, Artificial Sequence
  Synthetic
ccaccgtagcctactactccccaactgaccgcattccaccaccaacttggcgcaatgggtaatgcccgtaagcgc

SEQ ID NO: 171159 - DNA, 75 bp, Artificial Sequence
  Synthetic
tgaccgcattccaccaccaacttggcgcaatgggtaatgcccgtaagcgcgtacaccagatcgctatgcttctgc

SEQ ID NO: 171160 - DNA, 75 bp, Artificial Sequence
  Synthetic
acgtcgtcttcggcgtcgggcggcggcggtaacacacggcgaatcagttgcgacagcggtccgttgcgaaacgcg

SEQ ID NO: 171161 - DNA, 75 bp, Artificial Sequence
  Synthetic
gcggtaacacacggcgaatcagttgcgacagcggtccgttgcgaaacgcgtgctcgcgcaccgtaccgtcgtcca

SEQ ID NO: 171162 - DNA, 75 bp, Artificial Sequence
  Synthetic
ccgaggggcgggggggtgtttttttcgggggggtgaaaattggagttgcgtgtgtggacggcgaatagttgcgtg

SEQ ID NO: 171163 - DNA, 75 bp, Artificial Sequence
  Synthetic
cttccatcatcgtgatgcaaaccgcgctcgcggcgacgtgggttcagaactgccgtcaacgctgacggaggtttg

SEQ ID NO: 171164 - DNA, 75 bp, Artificial Sequence
  Synthetic
gctcgcggcgacgtgggttcagaactgccgtcaacgctgacggaggtttggacagaagggacggaggaagatgag

SEQ ID NO: 171165 - DNA, 75 bp, Artificial Sequence
  Synthetic
tggtggatcacttcgcgcgtgtgcggcgtaccgctgatactctgcaacacgcccagcacctcgactaacactttg

SEQ ID NO: 171166 - DNA, 75 bp, Artificial Sequence
  Synthetic
aagccacgtggacgatgaagaacgtggtttgttaacgtaggaaataaaaagcactgtttgagcgtgactgtttcc

SEQ ID NO: 171167 - DNA, 75 bp, Artificial Sequence
  Synthetic
gcgtaccgctgatactctgcaacacgcccagcacctcgactaacactttgaggcgcgtgcgagggatcttgtggg

SEQ ID NO: 171168 - DNA, 75 bp, Artificial Sequence
  Synthetic
gttgtggaaggtgaccaacgcggatagcgtcttcgctccgcgcacgggcaaatttacgttggccgacctgctggg

SEQ ID NO: 171169 - DNA, 75 bp, Artificial Sequence
  Synthetic
ccaggatcttgggcacgttgttggctagacgactgccgatgagcgcacaagtgtgcttgatcttggtgtgcgccg

SEQ ID NO: 171170 - DNA, 75 bp, Artificial Sequence
  Synthetic
tagacgactgccgatgagcgcacaagtgtgcttgatcttggtgtgcgccgtgaggttcttgctgtagtcaaagag

SEQ ID NO: 171171 - DNA, 75 bp, Artificial Sequence
  Synthetic
cacccaccccacgcacgcacccagccgcgccccagacacaccccgacagccgccagcccggcacaccccgaccgc

SEQ ID NO: 171172 - DNA, 75 bp, Artificial Sequence
  Synthetic
agcacgcagaaacagcactaactgcttggccaggaaggggatctggtacgaattgcgcagctctagttgcgtgaa

SEQ ID NO: 171173 - DNA, 75 bp, Artificial Sequence
  Synthetic
ttggccaggaaggggatctggtacgaattgcgcagctctagttgcgtgaaaacgcggtgcagaccgtaatcgatg

SEQ ID NO: 171174 - DNA, 75 bp, Artificial Sequence
  Synthetic
gtaagcttttgcgcggcgcttcgcttttcggggcggggacggcggtgttttcgggcgtactggggttgacggcgc

SEQ ID NO: 171175 - DNA, 75 bp, Artificial Sequence
  Synthetic
ggcacaatggccgtagccgctttgaaccagcccacgttgacgttgttagtatgcgagatcatgcacggaaagttg

SEQ ID NO: 171176 - DNA, 75 bp, Artificial Sequence
  Synthetic
accagcccacgttgacgttgttagtatgcgagatcatgcacggaaagttggtggtccagtacaccttgctgcgct

SEQ ID NO: 171177 - DNA, 75 bp, Artificial Sequence
  Synthetic
ctgatagggcgaccgctgaagcgagctgcgtgtgcgtgccgtctgtgttccccgccgcgaaaggcccccgtcccc

SEQ ID NO: 171178 - DNA, 75 bp, Artificial Sequence
  Synthetic
gaaaaaagtgatcgatattaacgtgcagccggtacacgcccagcgagtacagaaactcggggtaggaaccgcgaa

SEQ ID NO: 171179 - DNA, 75 bp, Artificial Sequence
  Synthetic
ggagacacggggtgacgtcggagacaggggccttttgcggcagggacggggcgtttgcggcggggacgggggcct

SEQ ID NO: 171180 - DNA, 75 bp, Artificial Sequence
  Synthetic
cagccggtacacgcccagcgagtacagaaactcggggtaggaaccgcgaatattgacgttgagcgagttaatgta

SEQ ID NO: 171181 - DNA, 75 bp, Artificial Sequence
  Synthetic
gtgggtcatgttcttgggaagccgcggcgcgcgcacgccgagacccgacgcggcgatggacgagagcgcggcctt

SEQ ID NO: 171182 - DNA, 75 bp, Artificial Sequence
  Synthetic
ggcgcgcgcacgccgagacccgacgcggcgatggacgagagcgcggccttcatattgataacgcggttggtgttg

SEQ ID NO: 171183 - DNA, 75 bp, Artificial Sequence
  Synthetic
acagcacccacaccacgccgcttcacccagaggaccaacacaccttacccttacaccacagcaacacacaaccgc

SEQ ID NO: 171184 - DNA, 75 bp, Artificial Sequence
  Synthetic
tcgccggcggccagaacgctcgaaaacccccgagaagcgcagcgccgaaacgacacagacaagtaccgtggaacg

SEQ ID NO: 171185 - DNA, 75 bp, Artificial Sequence
  Synthetic
cggcacggcgcgtaacgctgcacggctagatgtttacgacgtcggtgttcctgataggcccggcgcagctgctgc

SEQ ID NO: 171186 - DNA, 75 bp, Artificial Sequence
  Synthetic
taacgtcgaacgcgatcggcggccgggtcgcgcggcagtgacagcttgtgacccgcgctcgtcgtcgggagcgcg

SEQ ID NO: 171187 - DNA, 75 bp, Artificial Sequence
  Synthetic
acccgcgctcgtcgtcgggagcgcggtggaagacagcgcgtgtccgttcgccgaaaccaccgtcgattctgacgg

SEQ ID NO: 171188 - DNA, 75 bp, Artificial Sequence
  Synthetic
catccgcgggagaagcccaagctcgaggcctattgccacgcatccggatcacccccatctccacatctccacgcc

SEQ ID NO: 171189 - DNA, 75 bp, Artificial Sequence
  Synthetic
ccccagatcccgagctagttcataataaacgtagaaaaggtttctccacaccgtgtccgtgtcggcaaacgtgac

SEQ ID NO: 171190 - DNA, 75 bp, Artificial Sequence
  Synthetic
taaacgtagaaaaggtttctccacaccgtgtccgtgtcggcaaacgtgacgctaaggcgtcgataacacagtagg

SEQ ID NO: 171191 - DNA, 75 bp, Artificial Sequence
  Synthetic
ctcacctgtaacttgaagtacagtacctgtcgcttgaagcgactgagaacgaaggtgctcaggtggcacaccgtc

SEQ ID NO: 171192 - DNA, 75 bp, Artificial Sequence
  Synthetic
cctgtcgcttgaagcgactgagaacgaaggtgctcaggtggcacaccgtctgctcgggcaagcgaagcgccatca

SEQ ID NO: 171193 - DNA, 75 bp, Artificial Sequence
  Synthetic
accaccaaaggcacgtactcgacgctggatcgcgcactgctggagaagatgcaagtcgtcttcgatccctacgga

SEQ ID NO: 171194 - DNA, 75 bp, Artificial Sequence
  Synthetic
caacgcccagccaaagcttttgcagctccagtagaaaaaagtcgcgtgtagcgtccaacgcgcacggcgcttgcg

SEQ ID NO: 171195 - DNA, 75 bp, Artificial Sequence
  Synthetic
ctccagtagaaaaaagtcgcgtgtagcgtccaacgcgcacggcgcttgcggacgcacgttgagtccaaagagcag

SEQ ID NO: 171196 - DNA, 75 bp, Artificial Sequence
  Synthetic
ctcgctgacactgagtacgcgtccgatttccaccatcaggtaaggatagtcgtccaggtgcaggctgaggtcgcg

SEQ ID NO: 171197 - DNA, 75 bp, Artificial Sequence
  Synthetic
cgtccaggtgcaggctgaggtcgcgcggcaggcaggccatagcgtagcgttcctcggttcccgaggcgccaccgc

SEQ ID NO: 171198 - DNA, 75 bp, Artificial Sequence
  Synthetic
gcgtggccacgtggttttcgagaacgtggtaggacagcgcgcgcccggcggtcacggatccgcaacaacaacgtc

SEQ ID NO: 171199 - DNA, 75 bp, Artificial Sequence
  Synthetic
acaaaactgcgtcgtaggtaccagatgttcaccgtggccctccacttcaccgtcgcaaaaacagggtacggccac

SEQ ID NO: 171200 - DNA, 75 bp, Artificial Sequence
  Synthetic
gtagagagccgcaaaaacagcgcgcacccgttcgacgttaacgggtcgcggacgacagaagcgggcgtcctcgcc

SEQ ID NO: 171201 - DNA, 75 bp, Artificial Sequence
  Synthetic
acccgttcgacgttaacgggtcgcggacgacagaagcgggcgtcctcgcccgtcgatagctcttgggtgaggttg

SEQ ID NO: 171202 - DNA, 75 bp, Artificial Sequence
  Synthetic
cagccgaggcggcgcggcgcagcgccggccattctccgggtcgcgctgctttccccgagctccgacgcctcgcgc

SEQ ID NO: 171203 - DNA, 75 bp, Artificial Sequence
  Synthetic
cggccattctccgggtcgcgctgctttccccgagctccgacgcctcgcgctcacgccgccgccgcgatggagaac

SEQ ID NO: 171204 - DNA, 75 bp, Artificial Sequence
  Synthetic
gaggagatgtttgaggccttacgcatctactacggcgatgaccccgagcgttacaatattcacttcgaagccatc

SEQ ID NO: 171205 - DNA, 75 bp, Artificial Sequence
  Synthetic
tctactacggcgatgaccccgagcgttacaatattcacttcgaagccatcttcggcaccttctgcaatcgcctgg

SEQ ID NO: 171206 - DNA, 75 bp, Artificial Sequence
  Synthetic
ctacgggaaaaatgctgttccacgtgcaggtgccgcgtgtggccagcggcgccggtttgcctaccagtcgtcaga

SEQ ID NO: 171207 - DNA, 75 bp, Artificial Sequence
  Synthetic
ccaccattatggtcaccaaatacagtgaaaaatcccccatcaccatcccctttgagctcagcgcagcctgcctca

SEQ ID NO: 171208 - DNA, 75 bp, Artificial Sequence
  Synthetic
tatgtgtcgcataaaaggcggtgggatgtggggatgaaacatccagatacgcagttctgttatccgagcaaagcc

SEQ ID NO: 171209 - DNA, 75 bp, Artificial Sequence
  Synthetic
gcgcgctcaaaaacacggccgacgccatggaacgcggcttgattcacagctttttacagacactgctacgcaagg

SEQ ID NO: 171210 - DNA, 75 bp, Artificial Sequence
  Synthetic
catggaacgcggcttgattcacagctttttacagacactgctacgcaaggcgccgccgtactttgtggtgcagac

SEQ ID NO: 171211 - DNA, 75 bp, Artificial Sequence
  Synthetic
ggccaaaatgctggccacgctctttttgctgaatcgcacgcgcgatcgcgactatgtgctcaagttcctcacgcg

SEQ ID NO: 171212 - DNA, 75 bp, Artificial Sequence
  Synthetic
ttgctgaatcgcacgcgcgatcgcgactatgtgctcaagttcctcacgcgtctggccgaagcggccaccgatagc

SEQ ID NO: 171213 - DNA, 75 bp, Artificial Sequence
  Synthetic
tcacatataggtaccgtcatggatgaagcaggcattaagcacaaaaaacaccgtgtgtgtgtggggggggggcag

SEQ ID NO: 171214 - DNA, 75 bp, Artificial Sequence
  Synthetic
gttatgcagatcatcatgtcgctgctctcaagccacatcaccaaagaaacggtctcggcgccggccacctacggc

SEQ ID NO: 171215 - DNA, 75 bp, Artificial Sequence
  Synthetic
ttttgtgaatcgtccactgtgtcggtataatgtggcgatgattattttatgtgtgtgctatgcagcgaacacaac

SEQ ID NO: 171216 - DNA, 75 bp, Artificial Sequence
  Synthetic
tataatgtggcgatgattattttatgtgtgtgctatgcagcgaacacaacgtcagtgtaacatgaagcgccgcaa

SEQ ID NO: 171217 - DNA, 75 bp, Artificial Sequence
  Synthetic
aattttgtactcagtcccgaaaatgccgtcactgccatatcctatcactcgatcctggccgatttcaactcgtac

SEQ ID NO: 171218 - DNA, 75 bp, Artificial Sequence
  Synthetic
ttgttacaaacgcgtgtctatgctaggacaagagtgcctatacaatgcgtccaacgaaaagcgtaaagataacgt

SEQ ID NO: 171219 - DNA, 75 bp, Artificial Sequence
  Synthetic
ccgctgagcatggacgtgatccgactgggcgaaaaaacggtgattatggaaaacttgcggcgcgtctacaaaaac

SEQ ID NO: 171220 - DNA, 75 bp, Artificial Sequence
  Synthetic
tgggcgaaaaaacggtgattatggaaaacttgcggcgcgtctacaaaaacaccgataccaaagatccgctagaac

SEQ ID NO: 171221 - DNA, 75 bp, Artificial Sequence
  Synthetic
agcttattgtgtattggtgcgagtattacgacatgagtggcatatcgttgtaattggatgtgcgttactgagtgc

SEQ ID NO: 171222 - DNA, 75 bp, Artificial Sequence
  Synthetic
ttacgacatgagtggcatatcgttgtaattggatgtgcgttactgagtgcgtgtaacgtcagcttagtgttgtaa

SEQ ID NO: 171223 - DNA, 75 bp, Artificial Sequence
  Synthetic
gcaaagttaagcttaacgacaccgttcgcaacgcgttgcccaccacggcctacctgctaaaccgggaccgtgccg

SEQ ID NO: 171224 - DNA, 75 bp, Artificial Sequence
  Synthetic
caagtataaaagccaaaagtatacatacaagggttgctagacacagggttgtgtttgtgctagcccaacgacagc

SEQ ID NO: 171225 - DNA, 75 bp, Artificial Sequence
  Synthetic
tacaagggttgctagacacagggttgtgtttgtgctagcccaacgacagctgtacaatgcatgcaacaagaaaac

SEQ ID NO: 171226 - DNA, 75 bp, Artificial Sequence
  Synthetic
ctgcacgagcccgcgccctgtctacagaccttcacggaacgcggaccgccctcggaacccgccatgcaacgactg

SEQ ID NO: 171227 - DNA, 75 bp, Artificial Sequence
  Synthetic
accgtacctttgagcttggggtgcagacgcgagaagaaaaagagtgagcgtttgaagctgcggtactgcgtgacc

SEQ ID NO: 171228 - DNA, 75 bp, Artificial Sequence
  Synthetic
ctcggaacccgccatgcaacgactgctcgagtgtcgttttcagcaggaacccatgggcggtgcggcgcgccgcat

SEQ ID NO: 171229 - DNA, 75 bp, Artificial Sequence
  Synthetic
ctcgagtgtcgttttcagcaggaacccatgggcggtgcggcgcgccgcataccgcatttttaccgcgtacgacgc

SEQ ID NO: 171230 - DNA, 75 bp, Artificial Sequence
  Synthetic
ctctacaccgagctgcaccccttcttcgactttacgcactgccaggaaaacagcgaaacggtggcgctgtgtaca

SEQ ID NO: 171231 - DNA, 75 bp, Artificial Sequence
  Synthetic
tcgactttacgcactgccaggaaaacagcgaaacggtggcgctgtgtacaccgcgtatcgtcatcggtaatttgc

SEQ ID NO: 171232 - DNA, 75 bp, Artificial Sequence
  Synthetic
cacccgactacgaagagacgttgcgacttttcaaaaccaccgtgacaagccccaattaccccgagctttgctacc

SEQ ID NO: 171233 - DNA, 75 bp, Artificial Sequence
  Synthetic
acttttcaaaaccaccgtgacaagccccaattaccccgagctttgctacctggtcgacgtgctggtacacggcaa

SEQ ID NO: 171234 - DNA, 75 bp, Artificial Sequence
  Synthetic
ggtttttgcgcacagctacgcgctggtgacgttgatcgccgaacacctggctgatggcgccctaccaccgcagtt

SEQ ID NO: 171235 - DNA, 75 bp, Artificial Sequence
  Synthetic
gtgacgttgatcgccgaacacctggctgatggcgccctaccaccgcagttgctctttcactaccgcaatctggtc

SEQ ID NO: 171236 - DNA, 75 bp, Artificial Sequence
  Synthetic
tcggcttacgtgaacgcgctgcacgaccaccggctgtggccccccttcgttacgcacctgccgcgtaacatggaa

SEQ ID NO: 171237 - DNA, 75 bp, Artificial Sequence
  Synthetic
accaccggctgtggccccccttcgttacgcacctgccgcgtaacatggaaggcgtacaggtagtggccgaccggc

SEQ ID NO: 171238 - DNA, 75 bp, Artificial Sequence
  Synthetic
aaagctgcggagagacgccgcacaaacacccgcgaaacgtccgccgccaacccccgagcgcccgcaacaccccgt

SEQ ID NO: 171239 - DNA, 75 bp, Artificial Sequence
  Synthetic
ccgacgagccgctgtttgtggacgattaccgtgccaccgacgacgaatggacgttacaaaaggtcttttatctct

SEQ ID NO: 171240 - DNA, 75 bp, Artificial Sequence
  Synthetic
ttaccgtgccaccgacgacgaatggacgttacaaaaggtcttttatctctgcctcatgcccgccatgaccaacaa

SEQ ID NO: 171241 - DNA, 75 bp, Artificial Sequence
  Synthetic
gccggccgccaccgcggtctccacgtcaggtacgacgtcgaaagagagcacaagcggtgtcacccccgaagactc

SEQ ID NO: 171242 - DNA, 75 bp, Artificial Sequence
  Synthetic
caacactccctcagccctgtcccgtgccggactggcgcgcagaaagcgccgtggacaacacgccgcagaagcggc

SEQ ID NO: 171243 - DNA, 75 bp, Artificial Sequence
  Synthetic
tcaggtacgacgtcgaaagagagcacaagcggtgtcacccccgaagactcgatagcggcgcaacgtcaagccgta

SEQ ID NO: 171244 - DNA, 75 bp, Artificial Sequence
  Synthetic
ctgtttttggccgtgcaattcgtgggcgagcacgtcaaggtgctcgaagtgcgcgcgcctctggaccacgcgcag

SEQ ID NO: 171245 - DNA, 75 bp, Artificial Sequence
  Synthetic
gcgagcacgtcaaggtgctcgaagtgcgcgcgcctctggaccacgcgcagcgtcagggcctgccggactttatct

SEQ ID NO: 171246 - DNA, 75 bp, Artificial Sequence
  Synthetic
acgaggggatgacgagcgtgagagccccgttgttaccgcttcggcgtctttgtccggtcaggatcagtgcccggg

SEQ ID NO: 171247 - DNA, 75 bp, Artificial Sequence
  Synthetic
tacctttccaccgtttctactcaaaccccaccatctgcgcggcgttgagcgacgacattaaacgctacgtgaccg

SEQ ID NO: 171248 - DNA, 75 bp, Artificial Sequence
  Synthetic
ccccaccatctgcgcggcgttgagcgacgacattaaacgctacgtgaccgagttcccgcactatcaccgtcacga

SEQ ID NO: 171249 - DNA, 75 bp, Artificial Sequence
  Synthetic
ggccacctgtcccaacgtgttgcactcagtcatgacgctggccgccatgttatacaaaatctcaccagtttcact

SEQ ID NO: 171250 - DNA, 75 bp, Artificial Sequence
  Synthetic
tcagtcatgacgctggccgccatgttatacaaaatctcaccagtttcactggtgctgcagaccaaggcgcacatc

SEQ ID NO: 171251 - DNA, 75 bp, Artificial Sequence
  Synthetic
tgcacgtcagttatcatcaacaaccctatcgtgaccaaggaggaacgcgacatcagcaccacgtaccacgtcacg

SEQ ID NO: 171252 - DNA, 75 bp, Artificial Sequence
  Synthetic
ctatcgtgaccaaggaggaacgcgacatcagcaccacgtaccacgtcacgcagaacattaacaccgtagacatgg

SEQ ID NO: 171253 - DNA, 75 bp, Artificial Sequence
  Synthetic
acctctttcgcgtcttccctatgaacgtgtaccggcacgacgaggtggaccgctggatccggcacgcggccggcg

SEQ ID NO: 171254 - DNA, 75 bp, Artificial Sequence
  Synthetic
ccgccacggtgcacggacaaaaggccgcgtgcgaactaatccttacgccggtgacgattgacgttaattacttta

SEQ ID NO: 171255 - DNA, 75 bp, Artificial Sequence
  Synthetic
aggccatctacgaccatcgcgaagcggacgcacagactttcgcggccacacacaacccctgggcctcgcaagccg

SEQ ID NO: 171256 - DNA, 75 bp, Artificial Sequence
  Synthetic
gttattataagcataattacagttacaaaatgaaaccagtttattgagcattgtaatgataatgtgtggctacat

SEQ ID NO: 171257 - DNA, 75 bp, Artificial Sequence
  Synthetic
caaaatgaaaccagtttattgagcattgtaatgataatgtgtggctacattagaaaacgtgacgcgtcgcatgtc

SEQ ID NO: 171258 - DNA, 75 bp, Artificial Sequence
  Synthetic
ggacgcacagactttcgcggccacacacaacccctgggcctcgcaagccggctgtctgagcgacgtactctacaa

SEQ ID NO: 171259 - DNA, 75 bp, Artificial Sequence
  Synthetic
gattatcgcggccaacaaaacgctcttcaaaaccatcgacgagtacctgctacgcgccaaggactgcatccgcgg

SEQ ID NO: 171260 - DNA, 75 bp, Artificial Sequence
  Synthetic
ttcaaaaccatcgacgagtacctgctacgcgccaaggactgcatccgcggcgacacggacacgcagtacgtctgc

SEQ ID NO: 171261 - DNA, 75 bp, Artificial Sequence
  Synthetic
acgctggcgctgatggagaccaaactcaagggtggcgccggggcttttgctacgtccgaaacgcactttggtaac

SEQ ID NO: 171262 - DNA, 75 bp, Artificial Sequence
  Synthetic
tcaagggtggcgccggggcttttgctacgtccgaaacgcactttggtaactacgtcgtaggcgaaatcatcccgc

SEQ ID NO: 171263 - DNA, 75 bp, Artificial Sequence
  Synthetic
ggaggacggcgtgacggtgtacgtggaggtacagggtcagtacggactgcgcgtacccaccacgcgtttcgtaga

SEQ ID NO: 171264 - DNA, 75 bp, Artificial Sequence
  Synthetic
tcacctagacgcaaacgcgggcccggacgcgccacgctcgctctgacgccgcgcccggtgcagacgttgttcgtc

SEQ ID NO: 171265 - DNA, 75 bp, Artificial Sequence
  Synthetic
gacgcgccacgctcgctctgacgccgcgcccggtgcagacgttgttcgtctctgcttctcctccgtcgcggccag

SEQ ID NO: 171266 - DNA, 75 bp, Artificial Sequence
  Synthetic
cggacccaccatcgccgtcggacccaccatcaccgtcgccgccgccgcgtccgccccgaccaccgcgtgcgcgtc

SEQ ID NO: 171267 - DNA, 75 bp, Artificial Sequence
  Synthetic
gtaggcaaactgaccaagctagtagcggccgttgtgcccattccgcagcgtctacatctcatcaagcactaccag

SEQ ID NO: 171268 - DNA, 75 bp, Artificial Sequence
  Synthetic
cggccgttgtgcccattccgcagcgtctacatctcatcaagcactaccagctgggcctacaccagttcgtagatc

SEQ ID NO: 171269 - DNA, 75 bp, Artificial Sequence
  Synthetic
accagatcctcctacacgtaccgacgcacggactgctctacaccgtcctcaacacgggacccgtgacttgggaga

SEQ ID NO: 171270 - DNA, 75 bp, Artificial Sequence
  Synthetic
gcacggactgctctacaccgtcctcaacacgggacccgtgacttgggagaagggcgacgcgctatgcgtgctgcc

SEQ ID NO: 171271 - DNA, 75 bp, Artificial Sequence
  Synthetic
cgtacccatgccactggcgctggaaatcaaccagcgactactcatcatgggcctcttctcgctcgaccgttcgta

SEQ ID NO: 171272 - DNA, 75 bp, Artificial Sequence
  Synthetic
atcaaccagcgactactcatcatgggcctcttctcgctcgaccgttcgtacgaggaggtaaaggctgccgtgcag

SEQ ID NO: 171273 - DNA, 75 bp, Artificial Sequence
  Synthetic
gacatgaagaccgcctgcctctccatgtccatggtggccaacctagcctcggagctgaccatgacctatgtgcgc

SEQ ID NO: 171274 - DNA, 75 bp, Artificial Sequence
  Synthetic
tgtccatggtggccaacctagcctcggagctgaccatgacctatgtgcgcaagttggcgctagaggacagctcca

SEQ ID NO: 171275 - DNA, 75 bp, Artificial Sequence
  Synthetic
ctcgatgccagcacagcgcgtgtcgtacgcgcaccgtcagcgtaggcgtcagatccgcgtccgttgattccgcgg

SEQ ID NO: 171276 - DNA, 75 bp, Artificial Sequence
  Synthetic
cgcggccgcagcacgtgtcacccgacgacgagatcgcgcggctgtcggcgcttttcgtcatgctgcgacagctgg

SEQ ID NO: 171277 - DNA, 75 bp, Artificial Sequence
  Synthetic
cgacgagatcgcgcggctgtcggcgcttttcgtcatgctgcgacagctggatgacctcatccgcgaacaggtcgt

SEQ ID NO: 171278 - DNA, 75 bp, Artificial Sequence
  Synthetic
gcgcgacaggcccgcagccccggagcgcaaagcaaagccgcctcccgagcgcgcacccacctaggtggacgcccg

SEQ ID NO: 171279 - DNA, 75 bp, Artificial Sequence
  Synthetic
gcccgcagacaccaagcatgccacgcgtcgaccccaaccttcggaatcgggcccgccggccacgagccagacgag

SEQ ID NO: 171280 - DNA, 75 bp, Artificial Sequence
  Synthetic
cgtcgaccccaaccttcggaatcgggcccgccggccacgagccagacgaggcggcggcggtggcgttggcagcaa

SEQ ID NO: 171281 - DNA, 75 bp, Artificial Sequence
  Synthetic
tactaccaccacgaccatgatgggcgtcgccagtaccgacgacgacagtctcctcctgaaaacgccggacgagct

SEQ ID NO: 171282 - DNA, 75 bp, Artificial Sequence
  Synthetic
gtcgccagtaccgacgacgacagtctcctcctgaaaacgccggacgagctggacaagcacagcggctcaccgcag

SEQ ID NO: 171283 - DNA, 75 bp, Artificial Sequence
  Synthetic
ttgcacctcgacctccgacccgaagaattgcgggatcccttccagattctgctctctacgccgctgcaattgggg

SEQ ID NO: 171284 - DNA, 75 bp, Artificial Sequence
  Synthetic
cgggacagggctgagggggttttgagggccgtgagcgcgccgccgcttctgcggcgtgttgtcgacggcgctttc

SEQ ID NO: 171285 - DNA, 75 bp, Artificial Sequence
  Synthetic
aattgcgggatcccttccagattctgctctctacgccgctgcaattgggggaagcgaacggcgagtctcaaaccg

SEQ ID NO: 171286 - DNA, 75 bp, Artificial Sequence
  Synthetic
aagaagaagaggacgaggatgaccgcaacgacgatcgtgaacgcggcattctatgcgtggtctctaacgaggatt

SEQ ID NO: 171287 - DNA, 75 bp, Artificial Sequence
  Synthetic
caacgacgatcgtgaacgcggcattctatgcgtggtctctaacgaggattctgacgtgcgcccggccttctctct

SEQ ID NO: 171288 - DNA, 75 bp, Artificial Sequence
  Synthetic
cttatcactcaatctgttcgcgctccgtatcatcacgccgctgctgaaacggctaccgctacgacgtaaagccgc

SEQ ID NO: 171289 - DNA, 75 bp, Artificial Sequence
  Synthetic
ggctaccgctacgacgtaaagccgcgcatcacacggcgttacacgactgtctggcgctgcatctgccagaactca

SEQ ID NO: 171290 - DNA, 75 bp, Artificial Sequence
  Synthetic
tctcgggggttttcgagcgttctggccgccggcggggccggggtgttgcggagacggggggtgtgcgggacggtg

SEQ ID NO: 171291 - DNA, 75 bp, Artificial Sequence
  Synthetic
acgcggatctaacgcccacgctgacggtgcgcgtacgacacgcgctgtgctggcatcgagtggaaggcggcatct

SEQ ID NO: 171292 - DNA, 75 bp, Artificial Sequence
  Synthetic
ggtgcgcgtacgacacgcgctgtgctggcatcgagtggaaggcggcatctcggggccgcgtggactcaccagccg

SEQ ID NO: 171293 - DNA, 75 bp, Artificial Sequence
  Synthetic
gaacgaatcaccgccggacctgacgctgtcgtcactcacgctataccaagacggcatgttacgtttcaacgtgac

SEQ ID NO: 171294 - DNA, 75 bp, Artificial Sequence
  Synthetic
ctgtcgtcactcacgctataccaagacggcatgttacgtttcaacgtgacctgcgaccgcaccgaggcgccagcc

SEQ ID NO: 171295 - DNA, 75 bp, Artificial Sequence
  Synthetic
tactttgtaccgccacgctccggcgcggcggacgagggactggaggtgcgcgtcccttacgaattgacgctgaag

SEQ ID NO: 171296 - DNA, 75 bp, Artificial Sequence
  Synthetic
cggcggacgagggactggaggtgcgcgtcccttacgaattgacgctgaagaactcgcacacgttacgtatctacc

SEQ ID NO: 171297 - DNA, 75 bp, Artificial Sequence
  Synthetic
ggctaccgcgctcctggttggaattaaccgtactggtgagcgacgagaacggcgccacgttcccacgggacgcgc

SEQ ID NO: 171298 - DNA, 75 bp, Artificial Sequence
  Synthetic
aaccgtactggtgagcgacgagaacggcgccacgttcccacgggacgcgctcctggggcgcctctattttatctc

SEQ ID NO: 171299 - DNA, 75 bp, Artificial Sequence
  Synthetic
tacgtcccattcgccgtcgcaacagcagctctcggtgctgggcgcttccatcgcgctggaggacctgctgcccat

SEQ ID NO: 171300 - DNA, 75 bp, Artificial Sequence
  Synthetic
cactttagccatggtctgcggcgatctctaaacagaggaccctggtgatgggaaacggacactaggcgtccgcgc

SEQ ID NO: 171301 - DNA, 75 bp, Artificial Sequence
  Synthetic
ttttttaataaaaaaagacactcaataatccgcggttgtctctgtgtagaacgtttttatttcgggttccgcgtc

SEQ ID NO: 171302 - DNA, 75 bp, Artificial Sequence
  Synthetic
taatccgcggttgtctctgtgtagaacgtttttatttcgggttccgcgtctggtcgcctgcctatgtaaggcggc

SEQ ID NO: 171303 - DNA, 75 bp, Artificial Sequence
  Synthetic
cccgaaatgatatccgtactgggtcccatttcggggcacgtgctgaaagccgtgtttagtcgcggcgacacgccg

SEQ ID NO: 171304 - DNA, 75 bp, Artificial Sequence
  Synthetic
ccatttcggggcacgtgctgaaagccgtgtttagtcgcggcgacacgccggtgctgccgcacgagacgcgactcc

SEQ ID NO: 171305 - DNA, 75 bp, Artificial Sequence
  Synthetic
catgccaccgcggcgacaatcagctgcaggtgcagcacacgtactttacgggcagcgaggtggagaacgtgtcgg

SEQ ID NO: 171306 - DNA, 75 bp, Artificial Sequence
  Synthetic
gcaggtgcagcacacgtactttacgggcagcgaggtggagaacgtgtcggtcaacgtgcacaaccccacgggccg

SEQ ID NO: 171307 - DNA, 75 bp, Artificial Sequence
  Synthetic
catcaacgtgcaccactacccgtcggcggccgagcgcaaacaccgacacctgcccgtagccgacgctgttattca

SEQ ID NO: 171308 - DNA, 75 bp, Artificial Sequence
  Synthetic
gcggccgagcgcaaacaccgacacctgcccgtagccgacgctgttattcacgcgtcgggcaagcagatgtggcag

SEQ ID NO: 171309 - DNA, 75 bp, Artificial Sequence
  Synthetic
tcggcgttcgtgtttcccaccaaggacgtggcactgcggcacgtggtgtgcgcgcacgagctggtttgctccatg

SEQ ID NO: 171310 - DNA, 75 bp, Artificial Sequence
  Synthetic
acgtggcactgcggcacgtggtgtgcgcgcacgagctggtttgctccatggagaacacgcgcgcaaccaagatgc

SEQ ID NO: 171311 - DNA, 75 bp, Artificial Sequence
  Synthetic
tgcacgtcacgttgggctctgacgtggaagaggacctgacgatgacccgcaacccgcaacccttcatgcgccccc

SEQ ID NO: 171312 - DNA, 75 bp, Artificial Sequence
  Synthetic
ggaagaggacctgacgatgacccgcaacccgcaacccttcatgcgcccccacgagcgcaacggctttacggtgtt

SEQ ID NO: 171313 - DNA, 75 bp, Artificial Sequence
  Synthetic
ttaaaagatggtctccgatgatgatattgttattgatcgaatcatggtgcagaacggcgacggagaggagcgtgt

SEQ ID NO: 171314 - DNA, 75 bp, Artificial Sequence
  Synthetic
gcattttgggctgctgtgtcccaagagcatcccgggcctgagcatctcaggtaacctattgatgaacgggcagca

SEQ ID NO: 171315 - DNA, 75 bp, Artificial Sequence
  Synthetic
agcatcccgggcctgagcatctcaggtaacctattgatgaacgggcagcagatcttcctggaggtgcaagcgata

SEQ ID NO: 171316 - DNA, 75 bp, Artificial Sequence
  Synthetic
attacgaactagctcgggatctggggtcccatgggacggaggaccgacccgtaagccgcggttacggtgtttctt

SEQ ID NO: 171317 - DNA, 75 bp, Artificial Sequence
  Synthetic
cgcgggcctcagtacagcgagcaccccaccttcaccagccagtatcgcatccagggcaagcttgagtaccgacac

SEQ ID NO: 171318 - DNA, 75 bp, Artificial Sequence
  Synthetic
ccaccttcaccagccagtatcgcatccagggcaagcttgagtaccgacacacctgggaccggcacgacgagggtg

SEQ ID NO: 171319 - DNA, 75 bp, Artificial Sequence
  Synthetic
ccgcgctcccgacgacgagcgcgggtcacaagctgtcactgccgcgcgacccggccgcagatcgcgttcgacgtt

SEQ ID NO: 171320 - DNA, 75 bp, Artificial Sequence
  Synthetic
cgccccgcgttaccggcggcggcgccatggcgggcgcctccacttccgcgggccgcaaacgcaaatcagcatcct

SEQ ID NO: 171321 - DNA, 75 bp, Artificial Sequence
  Synthetic
catggcgggcgcctccacttccgcgggccgcaaacgcaaatcagcatcctcggcgacggcgtgcacggcgggcgt

SEQ ID NO: 171322 - DNA, 75 bp, Artificial Sequence
  Synthetic
acgttccggcaaccctgaaacgcaaactacgaactagaaacaacgctacccacataccgtgattacaaagtaccc

SEQ ID NO: 171323 - DNA, 75 bp, Artificial Sequence
  Synthetic
aatccacaatccggccgtgttcacctggccgccctggcaggccggcatcctggcccgcaacctggtgcccatggt

SEQ ID NO: 171324 - DNA, 75 bp, Artificial Sequence
  Synthetic
tggccgccctggcaggccggcatcctggcccgcaacctggtgcccatggtggctacggttcagggtcagaatctg

SEQ ID NO: 171325 - DNA, 75 bp, Artificial Sequence
  Synthetic
gctgcgcaacccaaacgtcgccgccaccggcaagacgccttgcccgggccatgcatcgcctcgacgcccaaaaag

SEQ ID NO: 171326 - DNA, 75 bp, Artificial Sequence
  Synthetic
aacccacgtccactcagacacgcaacttttggccgccacacctgtcgccgctgctatatttgcgacagttgccgg

SEQ ID NO: 171327 - DNA, 75 bp, Artificial Sequence
  Synthetic
acccccccccatcccgccttcgcaatgtctcaggcatcgtcctcgcccggtgagggaccctcgtcggaagcggcc

SEQ ID NO: 171328 - DNA, 75 bp, Artificial Sequence
  Synthetic
ttttataaaagagcgtctcgaagcagtttgagccacactacggtccagatgacgagcgtaatcaaaaatatgccg

SEQ ID NO: 171329 - DNA, 75 bp, Artificial Sequence
  Synthetic
tgtctcaggcatcgtcctcgcccggtgagggaccctcgtcggaagcggccgcgatcagcgaggccgaagccgcca

SEQ ID NO: 171330 - DNA, 75 bp, Artificial Sequence
  Synthetic
gcgactagacgcgttatccacggcctcggaaagagaagacgcaaggatgatgatggaagaagaggaggatgaaga

SEQ ID NO: 171331 - DNA, 75 bp, Artificial Sequence
  Synthetic
gtcgtctgcgactcctggacctgcgtaccaacatagaggtgagccggccctcggttctctgctgttttcaggaga

SEQ ID NO: 171332 - DNA, 75 bp, Artificial Sequence
  Synthetic
taccaacatagaggtgagccggccctcggttctctgctgttttcaggagaacaaatctccgcacgacaccgtaga

SEQ ID NO: 171333 - DNA, 75 bp, Artificial Sequence
  Synthetic
tggcccacgacgcctgacgccaggctcagaaaacaacacggtctcggtactggcctttgcactgccgctggaccg

SEQ ID NO: 171334 - DNA, 75 bp, Artificial Sequence
  Synthetic
cgtgcccgttagcggactgcacctctttcagagccagcggcgcggcggcgaagaaaatcggccgcgagtggaggc

SEQ ID NO: 171335 - DNA, 75 bp, Artificial Sequence
  Synthetic
taacgccgaactggcgccgcagaaccgacagcagcttggaggccggccagatctttgtcagccagttcgcctttc

SEQ ID NO: 171336 - DNA, 75 bp, Artificial Sequence
  Synthetic
atctttgtcagccagttcgcctttcgcgccggcgctatcccgctgacgctggtagacgccctggagcagctggcc

SEQ ID NO: 171337 - DNA, 75 bp, Artificial Sequence
  Synthetic
ccaatggatcatgctgtttctgcatcacgactcaccgcacccgccgaccagcgtgtttctgcacttttcggttta

SEQ ID NO: 171338 - DNA, 75 bp, Artificial Sequence
  Synthetic
cacgcatcgcgccgaggtggtggcgcgacacaatccgtacccgcacctacgacgcttgccggacaacggcttcca

SEQ ID NO: 171339 - DNA, 75 bp, Artificial Sequence
  Synthetic
ccccccccacaatggaatgctgccaaactggttctttcccattatagccatggcgtccctaggcaagagctaacg

SEQ ID NO: 171340 - DNA, 75 bp, Artificial Sequence
  Synthetic
gaccaatcagactcacgacaccatctttttcccggaaaacatcccgggcgtctccatagaagccggcccgctacc

SEQ ID NO: 171341 - DNA, 75 bp, Artificial Sequence
  Synthetic
tttttcccggaaaacatcccgggcgtctccatagaagccggcccgctacccgatcgtgtgcgaatcaccctccgc

SEQ ID NO: 171342 - DNA, 75 bp, Artificial Sequence
  Synthetic
gggttttggactctcacacccggtaaaccggacaagatcaagcgtccccaggtgcagctgcgcgccggtctcttt

SEQ ID NO: 171343 - DNA, 75 bp, Artificial Sequence
  Synthetic
aaccggacaagatcaagcgtccccaggtgcagctgcgcgccggtctctttccacggagcaacgtcatgcgcggcg

SEQ ID NO: 171344 - DNA, 75 bp, Artificial Sequence
  Synthetic
acgaagatgacctctcctccacaccgacgccaacccccctgtccgaagccatgtttgccggcttcgaggaggcca

SEQ ID NO: 171345 - DNA, 75 bp, Artificial Sequence
  Synthetic
ctgaccggacaaagacgccgaagcggtaacaacggggctctcacactcgtcatcccctcgtggcacgtctttgcg

SEQ ID NO: 171346 - DNA, 75 bp, Artificial Sequence
  Synthetic
acgacctacctcttatctgcgcagcgacatggacggcgacgtgcgtaccgcggcagacatcagcagcacgttgcg

SEQ ID NO: 171347 - DNA, 75 bp, Artificial Sequence
  Synthetic
gcaccccacgcagtcgaccccgcatctagagagagacttctttgttgttcccccgcgtgtttttcccattccctg

SEQ ID NO: 171348 - DNA, 75 bp, Artificial Sequence
  Synthetic
aaaaaaaagagagggaagccctaaatatagcgtctctcttactcgagcttattgagcgcagccacaaaaatccgc

SEQ ID NO: 171349 - DNA, 75 bp, Artificial Sequence
  Synthetic
attgagcgcagccacaaaaatccgccgattcagatccaccatgtctttgggcgggctctgggaagctgcggcggc

SEQ ID NO: 171350 - DNA, 75 bp, Artificial Sequence
  Synthetic
cgcctcagaacccgacgcggtagcgaggcggcaactggcgttcaccacgccggcctgagcgcgctcagctacctt

SEQ ID NO: 171351 - DNA, 75 bp, Artificial Sequence
  Synthetic
ggcacctcctgatagaagtgccgtcggtgtttctcctccgccgctcgtcagctcgccggtgggagtacacacggt

SEQ ID NO: 171352 - DNA, 75 bp, Artificial Sequence
  Synthetic
acgtagaactctgccgcgcggcaaacagatcgcgtttcagctcgtgaatggcatcccgcagttcatcgtaacgtt

SEQ ID NO: 171353 - DNA, 75 bp, Artificial Sequence
  Synthetic
gttgctgctgctgattggaacccgcgtgcccgccacttccaccgtcgctgttgacgtgactttttagacgctttc

SEQ ID NO: 171354 - DNA, 75 bp, Artificial Sequence
  Synthetic
ccttacggcgtttgttgtgtccgccgctgcccccgtgacggtgctgcttctgcgactgaccacggtgaccaccgt

SEQ ID NO: 171355 - DNA, 75 bp, Artificial Sequence
  Synthetic
gctgcccccgtgacggtgctgcttctgcgactgaccacggtgaccaccgtcgtaacgctcccatccggacggtgg

SEQ ID NO: 171356 - DNA, 75 bp, Artificial Sequence
  Synthetic
atgcaaaggcggcgcgggctcgtaacgccgaccccacccgggataatggggatccacgtagtccgcaaagtgacg

SEQ ID NO: 171357 - DNA, 75 bp, Artificial Sequence
  Synthetic
cgccgaccccacccgggataatggggatccacgtagtccgcaaagtgacgtgccgccaactggtcgtaacccacg

SEQ ID NO: 171358 - DNA, 75 bp, Artificial Sequence
  Synthetic
gtggtaaataaatcatggtttccggcgtgggttctcatcttatgacggttccacgattccgttggacagtgcatc

SEQ ID NO: 171359 - DNA, 75 bp, Artificial Sequence
  Synthetic
gcgccgggatacatgacgggcgctgccgagcgactggccccaagtagcgagaaaaaagcgtctttgggtaaataa

SEQ ID NO: 171360 - DNA, 75 bp, Artificial Sequence
  Synthetic
actccgtcgtgaggccacgctaaagacggcacagccggcgacgcacctgccacggtagcacctggaggagccgta

SEQ ID NO: 171361 - DNA, 75 bp, Artificial Sequence
  Synthetic
ggtgattccgtggggagaacggacggcgacgctggaagcgcaggcggctggacaggagatggcggttcgactgga

SEQ ID NO: 171362 - DNA, 75 bp, Artificial Sequence
  Synthetic
gcgacgctggaagcgcaggcggctggacaggagatggcggttcgactggaggcgacggggatgaagagggaacgc

SEQ ID NO: 171363 - DNA, 75 bp, Artificial Sequence
  Synthetic
acgccgcctcaggcgaaacgctcgccttgacgtacgactcgcgctccgtcacgccgactagttgcttgtcgtagc

SEQ ID NO: 171364 - DNA, 75 bp, Artificial Sequence
  Synthetic
cttgacgtacgactcgcgctccgtcacgccgactagttgcttgtcgtagcgcagcttgggcagtcgctcacggat

SEQ ID NO: 171365 - DNA, 75 bp, Artificial Sequence
  Synthetic
aggaagcttggtggcagtggccgttagatacattacgtgtctgtattggtacatttgcaaaccgccgggtgtgtc

SEQ ID NO: 171366 - DNA, 75 bp, Artificial Sequence
  Synthetic
agtgctgccgcagcgctgccactgtgcacgtagcccgtcgcggtcggccgccgtgaggtctggaaaccgctgggt

SEQ ID NO: 171367 - DNA, 75 bp, Artificial Sequence
  Synthetic
gcacgtagcccgtcgcggtcggccgccgtgaggtctggaaaccgctgggtaacccactcgggatcgcgcccgtac

SEQ ID NO: 171368 - DNA, 75 bp, Artificial Sequence
  Synthetic
agcgacgtcgcggcctccacgtcgtcgcagcgccggctggagagcgagaggccggcgtagctgccgctgagaaac

SEQ ID NO: 171369 - DNA, 75 bp, Artificial Sequence
  Synthetic
cgcagcgccggctggagagcgagaggccggcgtagctgccgctgagaaactccaccaccttgtccggctgcagcg

SEQ ID NO: 171370 - DNA, 75 bp, Artificial Sequence
  Synthetic
tgacgcagcctaggcaaaaaagaccgtcgcgaacgctctgcatcgccgcaacgtgtcctacaacggccgtgtcgt

SEQ ID NO: 171371 - DNA, 75 bp, Artificial Sequence
  Synthetic
gtcgcgaacgctctgcatcgccgcaacgtgtcctacaacggccgtgtcgtcgtgattgatgttgagcgggagcgc

SEQ ID NO: 171372 - DNA, 75 bp, Artificial Sequence
  Synthetic
aaagccagaagtatacatacaagggttgctagacacaggtttgtttctgtgctagcccaacggcacttgtacaat

SEQ ID NO: 171373 - DNA, 75 bp, Artificial Sequence
  Synthetic
ggcctcgtccggagactggtcgtaacgggcgagaaagccgcccacgtagaccggcgctacagcctgcggctgctg

SEQ ID NO: 171374 - DNA, 75 bp, Artificial Sequence
  Synthetic
cgggcgagaaagccgcccacgtagaccggcgctacagcctgcggctgctgttcgtccatcgtcattgtcgtcacc

SEQ ID NO: 171375 - DNA, 75 bp, Artificial Sequence
  Synthetic
gcaaattctcctttacttgcgccaatcatctaatattacagattagcgagaagatgtcgcgcggacagccgctga

SEQ ID NO: 171376 - DNA, 75 bp, Artificial Sequence
  Synthetic
tcatctaatattacagattagcgagaagatgtcgcgcggacagccgctgaactcgctgcgtttggaagaactcaa

SEQ ID NO: 171377 - DNA, 75 bp, Artificial Sequence
  Synthetic
cctgggtgtctcggaccacgccgtgcttagccgcaagacgccgcaaccctactggcctcatctgtaccgcgaact

SEQ ID NO: 171378 - DNA, 75 bp, Artificial Sequence
  Synthetic
cttagccgcaagacgccgcaaccctactggcctcatctgtaccgcgaactgcgccaggccttcccgggactggac

SEQ ID NO: 171379 - DNA, 75 bp, Artificial Sequence
  Synthetic
ggactgctgacgcgctttgtgcagcgccacaccggcctgccggtcgttttccccgaagacctggcgcgcaacggc

SEQ ID NO: 171380 - DNA, 75 bp, Artificial Sequence
  Synthetic
gccacaccggcctgccggtcgttttccccgaagacctggcgcgcaacggcaacatcctcttctccctaggcacgc

SEQ ID NO: 171381 - DNA, 75 bp, Artificial Sequence
  Synthetic
ttcgcatcatctgtcaaaaaatgtggtacttttatctcatcggcaccggcaagatgcgcattacccccgacgcct

SEQ ID NO: 171382 - DNA, 75 bp, Artificial Sequence
  Synthetic
gtacttttatctcatcggcaccggcaagatgcgcattacccccgacgccttcgagatccagcggagtcgacacga

SEQ ID NO: 171383 - DNA, 75 bp, Artificial Sequence
  Synthetic
acacccacaacagcagcagcaccaccaccccggtcccccccatcctcctctttctcaccctgcctcgtcctgtct

SEQ ID NO: 171384 - DNA, 75 bp, Artificial Sequence
  Synthetic
caccccggtcccccccatcctcctctttctcaccctgcctcgtcctgtctcagcccagaggccgtactggccgcc

SEQ ID NO: 171385 - DNA, 75 bp, Artificial Sequence
  Synthetic
gccgtacagcgccgccgctcataatgccgtcaccgtcgcgtccgacgcgacggtgttttcgccgtcggtgcagag

SEQ ID NO: 171386 - DNA, 75 bp, Artificial Sequence
  Synthetic
cggtgttttcgccgtcggtgcagaggacggaggaactttcggccgaaacatcgatcgtagtcccaggacacattt

SEQ ID NO: 171387 - DNA, 75 bp, Artificial Sequence
  Synthetic
atgtcgcgtcggcgtaacaacggctggaggactttttcaccgcttcggcgacgtctcggacggacgtagaaaagt

SEQ ID NO: 171388 - DNA, 75 bp, Artificial Sequence
  Synthetic
ggaggactttttcaccgcttcggcgacgtctcggacggacgtagaaaagtaacacacggccagctccacgctata

SEQ ID NO: 171389 - DNA, 75 bp, Artificial Sequence
  Synthetic
ataatcaaaggagtcatccagatccttggtgggctcgcgggaaaagaacgcaatgataaagagcggcagaatgcc

SEQ ID NO: 171390 - DNA, 75 bp, Artificial Sequence
  Synthetic
ttggtgggctcgcgggaaaagaacgcaatgataaagagcggcagaatgccaagacgcatggtgagaagggtacgc

SEQ ID NO: 171391 - DNA, 75 bp, Artificial Sequence
  Synthetic
actctgaagcagtagtagggcacaaaaagcatgagacacgtcacgtagaaggtgcagacacgacccacgtaggac

SEQ ID NO: 171392 - DNA, 75 bp, Artificial Sequence
  Synthetic
aaagcatgagacacgtcacgtagaaggtgcagacacgacccacgtaggaccagacgtggtcgcgccgatcgctgt

SEQ ID NO: 171393 - DNA, 75 bp, Artificial Sequence
  Synthetic
gtcgcttcctcggcgcgcagcaacgtctgtcggagtgccgcctgaggcagcagcgttgcgcgcggcgtgcccacg

SEQ ID NO: 171394 - DNA, 75 bp, Artificial Sequence
  Synthetic
ccaccgcggcatactgtatagggatctgacagcctagccaacggtagtccagtgaacccgtagcggcggtgggca

SEQ ID NO: 171395 - DNA, 75 bp, Artificial Sequence
  Synthetic
ctgacagcctagccaacggtagtccagtgaacccgtagcggcggtgggcacagcggctacgatggaaagaaccca

SEQ ID NO: 171396 - DNA, 75 bp, Artificial Sequence
  Synthetic
gatggccgacagacgatccagtatcagaaagaggaaaaacaacgccgtcgaatataggcccacgtcgtcgacaaa

SEQ ID NO: 171397 - DNA, 75 bp, Artificial Sequence
  Synthetic
agaaagaggaaaaacaacgccgtcgaatataggcccacgtcgtcgacaaagagcactaagcgacagaggctgaga

SEQ ID NO: 171398 - DNA, 75 bp, Artificial Sequence
  Synthetic
ttccaagtaaaaatcatcacggacacgggcggccgcgtaacacgcaacacccagaggcaaccgatgatggtcagc

SEQ ID NO: 171399 - DNA, 75 bp, Artificial Sequence
  Synthetic
ggcgcgatcggccgacatagagtagccttcgaacgggcccatgtatttgaaattcacgatagcgagcatgatgga

SEQ ID NO: 171400 - DNA, 75 bp, Artificial Sequence
  Synthetic
accctctccggggacgctcgccctttatgcagcaagcgacacgtggtggaaattacaacaccgccacgctcggaa

SEQ ID NO: 171401 - DNA, 75 bp, Artificial Sequence
  Synthetic
gctttcgtttacgccgcgcacgtgcaccgtctgggccgggcaatcctggtgttgcgcgcgaaagtggtcctgaca

SEQ ID NO: 171402 - DNA, 75 bp, Artificial Sequence
  Synthetic
gaaaacccaacactaaaaagtacaacagttcgtaaatatcgttgacgttaaagagggacgagcccagagtggaca

SEQ ID NO: 171403 - DNA, 75 bp, Artificial Sequence
  Synthetic
cttccaagcgacgtaaatcgccgtactgtttggagctctgcgcgaacatgtagtcggccacgggattgctcttgc

SEQ ID NO: 171404 - DNA, 75 bp, Artificial Sequence
  Synthetic
ctgtttggagctctgcgcgaacatgtagtcggccacgggattgctcttgctgagctgcatgagcacggcgccgcc

SEQ ID NO: 171405 - DNA, 75 bp, Artificial Sequence
  Synthetic
cagagccaggccgggaaagagctgcgacagcgtgaccgcggggtcgcgcgcgtaccacggcccgatgtagtactg

SEQ ID NO: 171406 - DNA, 75 bp, Artificial Sequence
  Synthetic
gacagcgtgaccgcggggtcgcgcgcgtaccacggcccgatgtagtactgcaccagaaactcaaagttacgtacc

SEQ ID NO: 171407 - DNA, 75 bp, Artificial Sequence
  Synthetic
tcgtaggccgagttcccggcgatgaagatcttgaggctgggaagctgacattcctcagtgcggtggttgcccaac

SEQ ID NO: 171408 - DNA, 75 bp, Artificial Sequence
  Synthetic
tccgaacccagcaggtcggccaacgtgaatttgcccgtacgcggagcgaagacgctatccgcgttggtcaccttc

SEQ ID NO: 171409 - DNA, 75 bp, Artificial Sequence
  Synthetic
ccattccgggccgcgtggtgggtccccgaggggcgggggggtgtttttagcggggggggtgaaaattggagtctt

SEQ ID NO: 171410 - DNA, 75 bp, Artificial Sequence
  Synthetic
cggggggggtgaaaattggagtcttggagtcgcgtgtgctgtggaacggcggcggcgaataaaagcggcgtgcgc

SEQ ID NO: 171411 - DNA, 75 bp, Artificial Sequence
  Synthetic
tcgtcccgtagcccggcaaatgctggaggacgccgcgtttgtggaaaagccgcaccagcacgtgacgatcaaaag

SEQ ID NO: 171412 - DNA, 75 bp, Artificial Sequence
  Synthetic
cgcaccagcacgtgacgatcaaaagtgcccgggtgatagtggcgaccaccacttaggggcatgtagtaacgtaga

SEQ ID NO: 171413 - DNA, 75 bp, Artificial Sequence
  Synthetic
cggtgcgtggcgtcccacgctatttgttcgcgggaccggactgcgggaggtttgcgggccgtcagcgcggcgcgg

SEQ ID NO: 171414 - DNA, 75 bp, Artificial Sequence
  Synthetic
caaatcggatagtacgcagtcgtacgtcggatacaccgtcacgttttccaaagcgttgaccacgccgagcagcag

SEQ ID NO: 171415 - DNA, 75 bp, Artificial Sequence
  Synthetic
gtcggatacaccgtcacgttttccaaagcgttgaccacgccgagcagcagctcctgcgaaatggaaaagttgtcc

SEQ ID NO: 171416 - DNA, 75 bp, Artificial Sequence
  Synthetic
ccaaaggagaaagtccaagtggaggcgttctcgaacatggtgttgaccacctcgccgcgaaaatcggtgtgaaag

SEQ ID NO: 171417 - DNA, 75 bp, Artificial Sequence
  Synthetic
cctgggcgttgcgggtacgggggttacgttggcgacggggaatcgcgggaccgggctgagggacgggggtggcgc

SEQ ID NO: 171418 - DNA, 75 bp, Artificial Sequence
  Synthetic
ttccaaagtagctaggtacgttcccgggcaacggccgctcggcgcactgcgccagccaggtagaagaagcaccag

SEQ ID NO: 171419 - DNA, 75 bp, Artificial Sequence
  Synthetic
agacgaggcggcggcgggtcccgtgatggcatcgtgccgactataaagaccgtgtgggacggcgaaagctcctgc

SEQ ID NO: 171420 - DNA, 75 bp, Artificial Sequence
  Synthetic
atggcatcgtgccgactataaagaccgtgtgggacggcgaaagctcctgccacgccggtccctggggacgacgaa

SEQ ID NO: 171421 - DNA, 75 bp, Artificial Sequence
  Synthetic
gcctccgcctcggacacgcgcccttcgagatcctcgcagtaagtctgcaccctgtgacccagatccctcatctcc

SEQ ID NO: 171422 - DNA, 75 bp, Artificial Sequence
  Synthetic
cgagatcctcgcagtaagtctgcaccctgtgacccagatccctcatctcctgacgcagataccgtttgcgcaccc

SEQ ID NO: 171423 - DNA, 75 bp, Artificial Sequence
  Synthetic
cgcgctcggggcagcgcagcacgttttcctcgtgcggctcgaagaagacggcgacgggtagccgccaaaaggtgt

SEQ ID NO: 171424 - DNA, 75 bp, Artificial Sequence
  Synthetic
ttcctcgtgcggctcgaagaagacggcgacgggtagccgccaaaaggtgtgcaacagactcatcctgacgcctcc

SEQ ID NO: 171425 - DNA, 75 bp, Artificial Sequence
  Synthetic
cggcacaacccgcgtcgaggacagacgcagaagaagcgtccggccgaggggaggggggggggctcgcgggccccc

SEQ ID NO: 171426 - DNA, 75 bp, Artificial Sequence
  Synthetic
ccgccaccgcgtggcagacgcagaaaatcaaagtccaccagtgcgcccttgagctggcgcaggccctcggcgtac

SEQ ID NO: 171427 - DNA, 75 bp, Artificial Sequence
  Synthetic
aatcaaagtccaccagtgcgcccttgagctggcgcaggccctcggcgtactgcaggctgtgggtggcgtgccacc

SEQ ID NO: 171428 - DNA, 75 bp, Artificial Sequence
  Synthetic
cagagtccggcggtaaaaacaccaacacgcaatcgggaatccgccgacttaatcgtacttcgatgaaaagacggc

SEQ ID NO: 171429 - DNA, 75 bp, Artificial Sequence
  Synthetic
cacgcaatcgggaatccgccgacttaatcgtacttcgatgaaaagacggcgacggtacttttgcaactcgggtgg

SEQ ID NO: 171430 - DNA, 75 bp, Artificial Sequence
  Synthetic
atcacacgctctttcctgtcccttctacaccctcagccacggttcacaatccccgaaactacgccgtccaacttc

SEQ ID NO: 171431 - DNA, 75 bp, Artificial Sequence
  Synthetic
gtgcttgcgcttaccgatccgcttacgcacgtgaggcaatctccgcagagcgttccccgtcaaatcagcgtcgtc

SEQ ID NO: 171432 - DNA, 75 bp, Artificial Sequence
  Synthetic
cccacgcccggacggcatggcttattcgcgtgtcccctcttctcccttcgcagcggccaatgacatcgtattaaa

SEQ ID NO: 171433 - DNA, 75 bp, Artificial Sequence
  Synthetic
tctcgggtgtaacgccaaccaccacctggatcacgccgctgaacccagcggcgcggccgcgctatgcggccaggc

SEQ ID NO: 171434 - DNA, 75 bp, Artificial Sequence
  Synthetic
gcgcggccgcgctatgcggccaggcctcccctcctacctcatcgtcctcgccgtctgtctcctcagccacctact

SEQ ID NO: 171435 - DNA, 75 bp, Artificial Sequence
  Synthetic
gagacccatccgcttcctgcgtgaaaacaccacccagtgtacctacaacagcagcctccgtaacagcacggtcgt

SEQ ID NO: 171436 - DNA, 75 bp, Artificial Sequence
  Synthetic
ttttgcgggtcctctggcggagcagtttctgaaccaagtagatctgaccgaaaccctggaaagataccaacagag

SEQ ID NO: 171437 - DNA, 75 bp, Artificial Sequence
  Synthetic
tttctgaaccaagtagatctgaccgaaaccctggaaagataccaacagagacttaacacttacgcgctggtatcc

SEQ ID NO: 171438 - DNA, 75 bp, Artificial Sequence
  Synthetic
gagtcgcgtgtgctgtggaggtgcggttggaacggcggcggcgaataaaagcggcgcgcgtgtgtctgtgtggag

SEQ ID NO: 171439 - DNA, 75 bp, Artificial Sequence
  Synthetic
gtgccaccgcccattgacctgtcaatacctcacgtttggatgccaccgcaaaccactccacacggctggacagaa

SEQ ID NO: 171440 - DNA, 75 bp, Artificial Sequence
  Synthetic
gaccacactttaaccagacctgtatcctctttgatggacacgatctactattcagcaccgtcacaccttgtttgc

SEQ ID NO: 171441 - DNA, 75 bp, Artificial Sequence
  Synthetic
tgtccatagacgacgacacacccatgctgcttatcttcggccatcttccacgcgtactcttcaaagcgccctatc

SEQ ID NO: 171442 - DNA, 75 bp, Artificial Sequence
  Synthetic
gctgcttatcttcggccatcttccacgcgtactcttcaaagcgccctatcaacgcgacaactttatactacgaca

SEQ ID NO: 171443 - DNA, 75 bp, Artificial Sequence
  Synthetic
ctttcttgacgccgcacttgacttcaactacctagatctcagcgcactactacgtaacagctttcaccgttacgc

SEQ ID NO: 171444 - DNA, 75 bp, Artificial Sequence
  Synthetic
tacgtaacagctttcaccgttacgccgtggatgtactcaagagcggtcgatgtcagatgctggaccgccgcacag

SEQ ID NO: 171445 - DNA, 75 bp, Artificial Sequence
  Synthetic
cctgcgcactgccggtgcctgtcgtcccacggtctttgttcgcgggaccgggctgagggaggtttgcgggccgac

SEQ ID NO: 171446 - DNA, 75 bp, Artificial Sequence
  Synthetic
cccacggtctttgttcgcgggaccgggctgagggaggtttgcgggccgacgctttctgcatttcggcgtctgcgg

SEQ ID NO: 171447 - DNA, 75 bp, Artificial Sequence
  Synthetic
tcccacgggccctagaccgccaggccgcactcttacaaatacaagaatttatgatcacctgcctctcacaaacac

SEQ ID NO: 171448 - DNA, 75 bp, Artificial Sequence
  Synthetic
cgcactcttacaaatacaagaatttatgatcacctgcctctcacaaacaccaccacgcaccacgttgctgctgta

SEQ ID NO: 171449 - DNA, 75 bp, Artificial Sequence
  Synthetic
gaaccgggctgcgggacggggggtgtgcggggcggcggtggggccggagcgttgcgggtacgggggttgcgctgc

SEQ ID NO: 171450 - DNA, 75 bp, Artificial Sequence
  Synthetic
cctggtctacatactctctaaacagaatcagcaacatctcatcccccagtgggcactacgacagatcgccgactt

SEQ ID NO: 171451 - DNA, 75 bp, Artificial Sequence
  Synthetic
aatcagcaacatctcatcccccagtgggcactacgacagatcgccgactttgccctaaaactacacaaaacgcac

SEQ ID NO: 171452 - DNA, 75 bp, Artificial Sequence
  Synthetic
tgcgacgttgtttccacccgtttccccgtcccgccgtttccgaacaacccacccgggttcagacaaccgaccacc

SEQ ID NO: 171453 - DNA, 75 bp, Artificial Sequence
  Synthetic
aacggggtgttgcggggccggggacgttcgcgccgcggacgggggacactttgcgacgcggacgggggtgtgcgg

SEQ ID NO: 171454 - DNA, 75 bp, Artificial Sequence
  Synthetic
catacgacggagagacgcgaaatcttcatcgtagaaacgggcctctgttcattggccgagctatcgcactttacg

SEQ ID NO: 171455 - DNA, 75 bp, Artificial Sequence
  Synthetic
tcatcgtagaaacgggcctctgttcattggccgagctatcgcactttacgcagttgctagctcatccgcaccacg

SEQ ID NO: 171456 - DNA, 75 bp, Artificial Sequence
  Synthetic
tcttccccgatgccaccgtccccgctaccgttcccgccgccctctccatcctatctaccatgcaaccaagcacgc

SEQ ID NO: 171457 - DNA, 75 bp, Artificial Sequence
  Synthetic
taccgttcccgccgccctctccatcctatctaccatgcaaccaagcacgctggaaaccttccccgacctgttttg

SEQ ID NO: 171458 - DNA, 75 bp, Artificial Sequence
  Synthetic
gatcaaaggtatctcttaccctgtctccaccaccgtcgtaggccagagcctcatcatcacccagacggacagtca

SEQ ID NO: 171459 - DNA, 75 bp, Artificial Sequence
  Synthetic
tccaccaccgtcgtaggccagagcctcatcatcacccagacggacagtcaaactaaatgcgaactgacgcgcaac

SEQ ID NO: 171460 - DNA, 75 bp, Artificial Sequence
  Synthetic
ctagaatacgacgacacgcaaggcgtcatcaatatcatgtacatgcacgactcggacgacgtccttttcgccctg

SEQ ID NO: 171461 - DNA, 75 bp, Artificial Sequence
  Synthetic
tcatcaatatcatgtacatgcacgactcggacgacgtccttttcgccctggatccctacaacgaagtggtggtct

SEQ ID NO: 171462 - DNA, 75 bp, Artificial Sequence
  Synthetic
ccaccgacagtcgtctcctcatgatgtccgtctacgcgctatcggccatcatcggcatctatctgctctaccgca

SEQ ID NO: 171463 - DNA, 75 bp, Artificial Sequence
  Synthetic
gttgtgggtctggttacatatcgggccctggatacaagctcggtacacagccaaggtgcgggagactaggtcgtc

SEQ ID NO: 171464 - DNA, 75 bp, Artificial Sequence
  Synthetic
atttcatccaaggcaacatatcagctaatgcgtccagtggagataattggagcgtagctaacctgacaaaaaact

SEQ ID NO: 171465 - DNA, 75 bp, Artificial Sequence
  Synthetic
gcatcaaccgcggtgagtcttacctgactaccctctggcttttgaactgtactcaaaacgatacttattggtact

SEQ ID NO: 171466 - DNA, 75 bp, Artificial Sequence
  Synthetic
taacacctgtggaagtacagtctcgggatatcttttgggcatgtgcgaactatggaaaaagtgggtcggtaatga

SEQ ID NO: 171467 - DNA, 75 bp, Artificial Sequence
  Synthetic
ctatataaccaatgactaatatggctaatggccaatattgattcaatgtatagatcgatatgcattggccatgtg

SEQ ID NO: 171468 - DNA, 75 bp, Artificial Sequence
  Synthetic
taagggtgcgcgatcacaacgagcaccatttcgtcctaggatatggcaccccacggtattaaaaaaactaaagca

SEQ ID NO: 171469 - DNA, 75 bp, Artificial Sequence
  Synthetic
ccatttcgtcctaggatatggcaccccacggtattaaaaaaactaaagcaattaaaattagaaattttaagacaa

SEQ ID NO: 171470 - DNA, 75 bp, Artificial Sequence
  Synthetic
gagtttccttattattatattttagcaggtcctattcgcaacgaaagtgtaactcatttgtggtatgatttctat

SEQ ID NO: 171471 - DNA, 75 bp, Artificial Sequence
  Synthetic
cacggcccgaaaaataacgttcaaacccccgtcgtgtggcgcagtgccttccatgacttgtctttctgaaatgct

SEQ ID NO: 171472 - DNA, 75 bp, Artificial Sequence
  Synthetic
tgtaccgcgttggaacaccaaattgtacgtgggtccgactaaagttaacgtagatagtcaaacgatttatttttt

SEQ ID NO: 171473 - DNA, 75 bp, Artificial Sequence
  Synthetic
tacgtgggtccgactaaagttaacgtagatagtcaaacgatttattttttaggtttaaccgccctgcttctacgt

SEQ ID NO: 171474 - DNA, 75 bp, Artificial Sequence
  Synthetic
gaaaaaaagaccaagaaatctcagagtactactacgccatatttgtcctatacaacgtctaccgctctcaacgtc

SEQ ID NO: 171475 - DNA, 75 bp, Artificial Sequence
  Synthetic
atctacgattgcttatcgtcccgatagcagctttatgaagtccattatggccacgcagttaagggatctagcgac

SEQ ID NO: 171476 - DNA, 75 bp, Artificial Sequence
  Synthetic
agcagctttatgaagtccattatggccacgcagttaagggatctagcgacatgggtgtatactactctgcgctat

SEQ ID NO: 171477 - DNA, 75 bp, Artificial Sequence
  Synthetic
atccgtaacgaaacaccgtacactatttatggtactcttgacatgagttccttatattgtaacgaaaccatgtcc

SEQ ID NO: 171478 - DNA, 75 bp, Artificial Sequence
  Synthetic
accggggtttcagagaacgtttatagatcccctgtgggactatctagactcgctgctgttcctagataaaatccg

SEQ ID NO: 171479 - DNA, 75 bp, Artificial Sequence
  Synthetic
accgccgagctgtaaatctgtccacccttaatagcctttggtggtggttgcagtaaagttctggaagcagcaatg

SEQ ID NO: 171480 - DNA, 75 bp, Artificial Sequence
  Synthetic
ccttaatagcctttggtggtggttgcagtaaagttctggaagcagcaatgtcgtagtacgatacaaaaagctccc

SEQ ID NO: 171481 - DNA, 75 bp, Artificial Sequence
  Synthetic
ggcctgcccactacggactaattatcgtgagcggacggatatgtccggtttcaaactcactgtttgaatataggg

SEQ ID NO: 171482 - DNA, 75 bp, Artificial Sequence
  Synthetic
gatcatgtcgtttcatcacattagggttgtgagtggtagaacccggtttagtactcgttaatgtggttgtggtcg

SEQ ID NO: 171483 - DNA, 75 bp, Artificial Sequence
  Synthetic
gctggtagtcgattttaccgttgatacactagaactaggaggactcggtgtacttgcagaggttgacgtagatga

SEQ ID NO: 171484 - DNA, 75 bp, Artificial Sequence
  Synthetic
accgccacgatgcttacgatgttgaccgatcgaatcgactctcaactggtactgtcgcggctgccgcgctcccgt

SEQ ID NO: 171485 - DNA, 75 bp, Artificial Sequence
  Synthetic
ccgatcgaatcgactctcaactggtactgtcgcggctgccgcgctcccgttttcagcgattctgggagaccccta

SEQ ID NO: 171486 - DNA, 75 bp, Artificial Sequence
  Synthetic
actgcgtacgtttcgctagcgatagcgattttcaaaccacatttacgctgccccaatcgaccgaggagaaatacg

SEQ ID NO: 171487 - DNA, 75 bp, Artificial Sequence
  Synthetic
cgattttcaaaccacatttacgctgccccaatcgaccgaggagaaatacgacaaagagcagcatccgggagaaga

SEQ ID NO: 171488 - DNA, 75 bp, Artificial Sequence
  Synthetic
atgccacacgcagctggccttttacaataaacacatcatttggctatcacgcgagcgcaaagtgcccacctcgct

SEQ ID NO: 171489 - DNA, 75 bp, Artificial Sequence
  Synthetic
aataaacacatcatttggctatcacgcgagcgcaaagtgcccacctcgctgggcgtcagcctctatatccccgaa

SEQ ID NO: 171490 - DNA, 75 bp, Artificial Sequence
  Synthetic
tgcggcgatgcagagcgttcgcgacggtcttttttgcctaggctgcgtcacttcgcccaggtttctggagattgt

SEQ ID NO: 171491 - DNA, 75 bp, Artificial Sequence
  Synthetic
ctgcaagtcccgcagttggatgttgtcaacctcaacgacacttttcagtccatctttccaggcaccatcgaaggc

SEQ ID NO: 171492 - DNA, 75 bp, Artificial Sequence
  Synthetic
tcaacctcaacgacacttttcagtccatctttccaggcaccatcgaaggcgatatcggcgttttcccctgttttg

SEQ ID NO: 171493 - DNA, 75 bp, Artificial Sequence
  Synthetic
cgctggtgatcggtccgggtcacacgcaaaccgtctattttgacgcggcctacgtgcacgcgcccggtatctgcg

SEQ ID NO: 171494 - DNA, 75 bp, Artificial Sequence
  Synthetic
gcaaaccgtctattttgacgcggcctacgtgcacgcgcccggtatctgcgcccttatagtgggcgtgcgccagtt

SEQ ID NO: 171495 - DNA, 75 bp, Artificial Sequence
  Synthetic
ttcgcacaccaccgtctgcatctccccacacaccaccgtagccaaagcggtttttaccacccaccgctttaccta

SEQ ID NO: 171496 - DNA, 75 bp, Artificial Sequence
  Synthetic
ccacacaccaccgtagccaaagcggtttttaccacccaccgctttacctatctaccggtgggcagtcacccccta

SEQ ID NO: 171497 - DNA, 75 bp, Artificial Sequence
  Synthetic
ccctcgccggtagacgatgacgtcgacgagacagaagaagatgaaaagagctccgacgcagaaagccctgtcaac

SEQ ID NO: 171498 - DNA, 75 bp, Artificial Sequence
  Synthetic
acgagacagaagaagatgaaaagagctccgacgcagaaagccctgtcaacacgagtgacgttatttttgacgtcg

SEQ ID NO: 171499 - DNA, 75 bp, Artificial Sequence
  Synthetic
cacgtacgttttccaaaacgtgccaggctgttcacgcggaggacagcaaggccgccgccgtgggtttctttttct

SEQ ID NO: 171500 - DNA, 75 bp, Artificial Sequence
  Synthetic
ggctgttcacgcggaggacagcaaggccgccgccgtgggtttctttttcttcacgcccctgagttcacgcgcgga

SEQ ID NO: 171501 - DNA, 75 bp, Artificial Sequence
  Synthetic
gctgtgtcgcatgagatccaaaatctcgcgttcgtgattcgtaggcagcgtctcctgcggcgccgactccttgta

SEQ ID NO: 171502 - DNA, 75 bp, Artificial Sequence
  Synthetic
tcgcgttcgtgattcgtaggcagcgtctcctgcggcgccgactccttgtagcgccgacggtgagacccgcgtccc

SEQ ID NO: 171503 - DNA, 75 bp, Artificial Sequence
  Synthetic
tcatcctcctcgtcgccctcttccagcagccgctggtcgaacctcataacggtgggacaggagacggtgttaatg

SEQ ID NO: 171504 - DNA, 75 bp, Artificial Sequence
  Synthetic
gcagccgctggtcgaacctcataacggtgggacaggagacggtgttaatgtgagccaaactcatcataggacgcg

SEQ ID NO: 171505 - DNA, 75 bp, Artificial Sequence
  Synthetic
aaaaataaattaaaaacacctctcatctctccttttctccccatgacagaggaggagaccccgcaccgtccgtct

SEQ ID NO: 171506 - DNA, 75 bp, Artificial Sequence
  Synthetic
ccccgtcctcgcggacgccgctttccccctgaacgaccgccggtggcgtcggtggtgcaaccgtcgcagccacgc

SEQ ID NO: 171507 - DNA, 75 bp, Artificial Sequence
  Synthetic
ggtggtgcaaccgtcgcagccacgccggcctcgagcatgtacgcgcttttctcgcagtccatgtccaccaggccc

SEQ ID NO: 171508 - DNA, 75 bp, Artificial Sequence
  Synthetic
cagcaacatctccaggctgtcggcctcggacatggcaaactcgcccaccaccagtttgaggatgagaatgtccag

SEQ ID NO: 171509 - DNA, 75 bp, Artificial Sequence
  Synthetic
tcggacatggcaaactcgcccaccaccagtttgaggatgagaatgtccagggcctctaggatacgctgcgatttc

SEQ ID NO: 171510 - DNA, 75 bp, Artificial Sequence
  Synthetic
ttgctctggcattgcctatagagcggcagcagcttcagcaggtggttcaccacgtccgtgtcgcgagaaaaggtt

SEQ ID NO: 171511 - DNA, 75 bp, Artificial Sequence
  Synthetic
gcagcagcttcagcaggtggttcaccacgtccgtgtcgcgagaaaaggttcgtaggtcggccggggtgatctcca

SEQ ID NO: 171512 - DNA, 75 bp, Artificial Sequence
  Synthetic
aatcggccacaggcgcagctttgcgacggcacatcagcagctcgcacaggcgctgggccagctgcatcgtgccgg

SEQ ID NO: 171513 - DNA, 75 bp, Artificial Sequence
  Synthetic
acggcacatcagcagctcgcacaggcgctgggccagctgcatcgtgccggcgcgacgatgacgctcgttctgttc

SEQ ID NO: 171514 - DNA, 75 bp, Artificial Sequence
  Synthetic
atactagtgctgtaccacaccagagcgctcagcgtgcccagggctaccgcacggtaaaatagggacatgatcacc

SEQ ID NO: 171515 - DNA, 75 bp, Artificial Sequence
  Synthetic
ctgctggtcaaacaccaggtctcgcgacgtgtttatttctgcctacagacgcaaaagtgctcggactcgcgacgg

SEQ ID NO: 171516 - DNA, 75 bp, Artificial Sequence
  Synthetic
gacgtgtttatttctgcctacagacgcaaaagtgctcggactcgcgacgggtggcgcccgtcttcgccgtgaaca

SEQ ID NO: 171517 - DNA, 75 bp, Artificial Sequence
  Synthetic
acgaggccgagacgcaaccgctctaccggcatctcttccgcacgcccgtgctctcgcccgaacacggcggcgagg

SEQ ID NO: 171518 - DNA, 75 bp, Artificial Sequence
  Synthetic
ccggcatctcttccgcacgcccgtgctctcgcccgaacacggcggcgaggtgcgcgaattcaagcacctggtgta

SEQ ID NO: 171519 - DNA, 75 bp, Artificial Sequence
  Synthetic
cgtcttcgggcacaccgagggccaggtgctgctgaccatggcctactacctattcgagggccagtacagcaccat

SEQ ID NO: 171520 - DNA, 75 bp, Artificial Sequence
  Synthetic
cccgtccccaccaccgtccccggccccgcaacgcgccgtccccaccaccgtccccgccgcaaaaggcccccgtgg

SEQ ID NO: 171521 - DNA, 75 bp, Artificial Sequence
  Synthetic
gtgctgctgaccatggcctactacctattcgagggccagtacagcaccatctccaccgtggaggagtacgtgcgc

SEQ ID NO: 171522 - DNA, 75 bp, Artificial Sequence
  Synthetic
ggctcgcccttccgtcagcgcgtgtccgctttcgtggcgtacgccgtggcgcgcaaccgccgcgactacaccgag

SEQ ID NO: 171523 - DNA, 75 bp, Artificial Sequence
  Synthetic
ccgctttcgtggcgtacgccgtggcgcgcaaccgccgcgactacaccgagctagagcaggtggacacgcagatca

SEQ ID NO: 171524 - DNA, 75 bp, Artificial Sequence
  Synthetic
tggcacgcgcgcggttgctcgagtaccggcgcgtggtggcttacgacgctgacgcggcgcccgaagcgcagtgca

SEQ ID NO: 171525 - DNA, 75 bp, Artificial Sequence
  Synthetic
ccggctttccaccgagctgctggacgtcatgcaaaaatacttctcgctcgacaactttctacacgactacgtgga

SEQ ID NO: 171526 - DNA, 75 bp, Artificial Sequence
  Synthetic
cattactaactgcacctacaccataaacagtactaaatatattatcaccgtgctctccccacatcattctaaaca

SEQ ID NO: 171527 - DNA, 75 bp, Artificial Sequence
  Synthetic
cggccgcatcgacggcacgcacctggcgggcttcttcggcacctccacgcagctggcgcgccagctcgaacgcat

SEQ ID NO: 171528 - DNA, 75 bp, Artificial Sequence
  Synthetic
gcgggcttcttcggcacctccacgcagctggcgcgccagctcgaacgcatcaacacgctttccgagtctgtcttc

SEQ ID NO: 171529 - DNA, 75 bp, Artificial Sequence
  Synthetic
agacacaaactacaaactagaaacaacgtaaaccgcataacgtgattacaaagtatcgacgctaatttacccaag

SEQ ID NO: 171530 - DNA, 75 bp, Artificial Sequence
  Synthetic
cgtgccgagctgcctttttaataaagtctgggtttccagatacgcgctggttctgattttgatggtttgtgcctc

SEQ ID NO: 171531 - DNA, 75 bp, Artificial Sequence
  Synthetic
ggcacgctaacgcgttactcgcaacgtcgctacctgctacccgagcccgcgctggcaccgctgctggagcgaccg

SEQ ID NO: 171532 - DNA, 75 bp, Artificial Sequence
  Synthetic
gtcgctacctgctacccgagcccgcgctggcaccgctgctggagcgaccgctgcccgtctaccgcgtacacctgc

SEQ ID NO: 171533 - DNA, 75 bp, Artificial Sequence
  Synthetic
gtcacgtacccgacagccgtttctcggacgaggccctgaccgagaccgtgtggctacacgacgacgacgtggcca

SEQ ID NO: 171534 - DNA, 75 bp, Artificial Sequence
  Synthetic
ggacgaggccctgaccgagaccgtgtggctacacgacgacgacgtggccagcaccagccccgagacacagttcta

SEQ ID NO: 171535 - DNA, 75 bp, Artificial Sequence
  Synthetic
cgacggcgtctccggtctggcgcgacacaccgtctttgagttatgtcgcggactacgacgcgtttggatgaccgt

SEQ ID NO: 171536 - DNA, 75 bp, Artificial Sequence
  Synthetic
cacaccgtctttgagttatgtcgcggactacgacgcgtttggatgaccgtatgggcgagcctctttggctacacg

SEQ ID NO: 171537 - DNA, 75 bp, Artificial Sequence
  Synthetic
aaaatatgccgcgcagtagtcgaaagccgtactgagcgtgcgaggcgggtagggtgccgaacgacggatatgcgt

SEQ ID NO: 171538 - DNA, 75 bp, Artificial Sequence
  Synthetic
gcgcctttcgatgacgacgactatctcgattaccgggacgagcgcgacacagaggaagacgaagacgggaaagag

SEQ ID NO: 171539 - DNA, 75 bp, Artificial Sequence
  Synthetic
tcgattaccgggacgagcgcgacacagaggaagacgaagacgggaaagagaataaaaataacgttccggataacg

SEQ ID NO: 171540 - DNA, 75 bp, Artificial Sequence
  Synthetic
gcatcatcacgccgttccccgcctgcaccgtcgccgtacatcccagcgttttacgcgccgtggcgcaggtgctca

SEQ ID NO: 171541 - DNA, 75 bp, Artificial Sequence
  Synthetic
caccgtcgccgtacatcccagcgttttacgcgccgtggcgcaggtgctcaatcacgccgtctgtctcgacgccga

SEQ ID NO: 171542 - DNA, 75 bp, Artificial Sequence
  Synthetic
tgtacgtctgccctacatgtataaaatggaccaagacgacggctatttcatgcatcgccgtctgttgccactgtt

SEQ ID NO: 171543 - DNA, 75 bp, Artificial Sequence
  Synthetic
atggaccaagacgacggctatttcatgcatcgccgtctgttgccactgttcatcgtgcccgacgcctaccgcgaa

SEQ ID NO: 171544 - DNA, 75 bp, Artificial Sequence
  Synthetic
gcgttgcccctgtcgccaccgccacgcgtcattctcagcgtacgcgacaaaatctgcccctcgaccgaagccaac

SEQ ID NO: 171545 - DNA, 75 bp, Artificial Sequence
  Synthetic
gcgtcattctcagcgtacgcgacaaaatctgcccctcgaccgaagccaactttatcgagacgcgctcgcttaacg

SEQ ID NO: 171546 - DNA, 75 bp, Artificial Sequence
  Synthetic
ctgcgatttccgacacggacttgcagcggctcgtcgtcacccgcgtgtggccgccgttgctcgagcacctcacgc

SEQ ID NO: 171547 - DNA, 75 bp, Artificial Sequence
  Synthetic
gcggctcgtcgtcacccgcgtgtggccgccgttgctcgagcacctcacgcaacactacgaaccgcacgtcagcga

SEQ ID NO: 171548 - DNA, 75 bp, Artificial Sequence
  Synthetic
aaagaagataggaggggtcaaaacgcggactgaaagtatataacgccgatcatgtccgaggaactgttaataaaa

SEQ ID NO: 171549 - DNA, 75 bp, Artificial Sequence
  Synthetic
ggcgcgcacgcgggattttcgctgtctcaactacacgcaccgcaacccgcaagagaccgtgcaagtgttcatcga

SEQ ID NO: 171550 - DNA, 75 bp, Artificial Sequence
  Synthetic
ctcaactacacgcaccgcaacccgcaagagaccgtgcaagtgttcatcgacctgcgcaccgagcacagctacgcg

SEQ ID NO: 171551 - DNA, 75 bp, Artificial Sequence
  Synthetic
aaaatcagaccgcccgacgcgcccgtgccgccggcgaccgccgtctgagcctcactttccacggcgccggtgacc

SEQ ID NO: 171552 - DNA, 75 bp, Artificial Sequence
  Synthetic
tgccgccggcgaccgccgtctgagcctcactttccacggcgccggtgacccgccccccggcagcggtctcatcta

SEQ ID NO: 171553 - DNA, 75 bp, Artificial Sequence
  Synthetic
acgctccgtcgttatcttccctgagcgagcgcgaacgccgcgcccgtcgcgcacggcgcttctgtctggattacg

SEQ ID NO: 171554 - DNA, 75 bp, Artificial Sequence
  Synthetic
cgagcgcgaacgccgcgcccgtcgcgcacggcgcttctgtctggattacgaacccgtgccacggaagttccgacg

SEQ ID NO: 171555 - DNA, 75 bp, Artificial Sequence
  Synthetic
cggcgccgcctcgcatcatcaccgaccctgcgtccccgcacgacgaccccgctacagcaaagacgatgataccga

SEQ ID NO: 171556 - DNA, 75 bp, Artificial Sequence
  Synthetic
gcggatcgctggcaggtgaaacgcgcccaggtgtctgttgcgctccagcctcagctcggcgtgttccaaacggga

SEQ ID NO: 171557 - DNA, 75 bp, Artificial Sequence
  Synthetic
ccctgcgtccccgcacgacgaccccgctacagcaaagacgatgataccgaaggcgatccggaccactatcctcct

SEQ ID NO: 171558 - DNA, 75 bp, Artificial Sequence
  Synthetic
ggcggacatagggcgtcctcctctttcaaacgacgcgtggccgcgtccgcctcggtgccccttaaccctcactac

SEQ ID NO: 171559 - DNA, 75 bp, Artificial Sequence
  Synthetic
tcaaacgacgcgtggccgcgtccgcctcggtgccccttaaccctcactacggtaagtcttacgacaacgatgacg

SEQ ID NO: 171560 - DNA, 75 bp, Artificial Sequence
  Synthetic
cttctcacccctcctcagccaataatcatcacggatcgtccgccggaccgcaacaacaacagatgctggcgctta

SEQ ID NO: 171561 - DNA, 75 bp, Artificial Sequence
  Synthetic
tcatcacggatcgtccgccggaccgcaacaacaacagatgctggcgcttattgacgacgaactggacgccatgga

SEQ ID NO: 171562 - DNA, 75 bp, Artificial Sequence
  Synthetic
gtcgggtacctcaccgagttctacctcgcccgtctacgaccttcagcgctacacggccgagagtctacgtctggc

SEQ ID NO: 171563 - DNA, 75 bp, Artificial Sequence
  Synthetic
tcgcccgtctacgaccttcagcgctacacggccgagagtctacgtctggcaccctaccccgccgatctcaaggtc

SEQ ID NO: 171564 - DNA, 75 bp, Artificial Sequence
  Synthetic
tacctgttgcacatccgtcaacagttcgattggctggaggaaccgttgctgcgcaagctggtggtggaaaagatc

SEQ ID NO: 171565 - DNA, 75 bp, Artificial Sequence
  Synthetic
tcgattggctggaggaaccgttgctgcgcaagctggtggtggaaaagatcttcgccgtatacaacgctcccaact

SEQ ID NO: 171566 - DNA, 75 bp, Artificial Sequence
  Synthetic
acccgcacgatccctatctggagacggtgggcggcatgcgtcagctgcttttcaacaaactcaacaacctggacc

SEQ ID NO: 171567 - DNA, 75 bp, Artificial Sequence
  Synthetic
ggtgggcggcatgcgtcagctgcttttcaacaaactcaacaacctggacctgggctgcatcctggaccaccagga

SEQ ID NO: 171568 - DNA, 75 bp, Artificial Sequence
  Synthetic
cgacgtctgcgatctgcagaagcgtccgcccgagaccttctcgcaacccatgcaccgcgccatggcctacgtgtg

SEQ ID NO: 171569 - DNA, 75 bp, Artificial Sequence
  Synthetic
ccgcccgagaccttctcgcaacccatgcaccgcgccatggcctacgtgtgctccttctcgcgcgtggccgtctcg

SEQ ID NO: 171570 - DNA, 75 bp, Artificial Sequence
  Synthetic
acctaccgctgcggcgctgtctcggacctgatcctaggcgccctgcagtgccacgagtgtcagaacgagatgtgc

SEQ ID NO: 171571 - DNA, 75 bp, Artificial Sequence
  Synthetic
acctgatcctaggcgccctgcagtgccacgagtgtcagaacgagatgtgcgaactgcgcatccaacgcgcgttgg

SEQ ID NO: 171572 - DNA, 75 bp, Artificial Sequence
  Synthetic
ttaccggtcccaacggagttacccgcacggccatcgggggtttgtattcaaactacactaacttaactggaacat

SEQ ID NO: 171573 - DNA, 75 bp, Artificial Sequence
  Synthetic
cgacaacgacaaccgccagcaaccacgccactgccggcggacaacagcggggaggagaccaaattcatcccaccg

SEQ ID NO: 171574 - DNA, 75 bp, Artificial Sequence
  Synthetic
ggaggagaccaaattcatcccaccgatgagcaatgcgcaagtatggaaagcaggacggacccagcaacgctgaca

SEQ ID NO: 171575 - DNA, 75 bp, Artificial Sequence
  Synthetic
cagccaccgtcgcaaccacagcagcactactctgagggcgagctggaagaggacgaagacagtgacgacgctagc

SEQ ID NO: 171576 - DNA, 75 bp, Artificial Sequence
  Synthetic
actactctgagggcgagctggaagaggacgaagacagtgacgacgctagcagtcaagatctggtacgagccacgg

SEQ ID NO: 171577 - DNA, 75 bp, Artificial Sequence
  Synthetic
ggagtcaccgtggtgagcttaacttgatgacgccgtcgccttctcacggcggcagtccaccccaggttccccaca

SEQ ID NO: 171578 - DNA, 75 bp, Artificial Sequence
  Synthetic
ggcagtccaccccaggttccccacaagcagcccatcatcccggtgcagtccgccaacggtaatcacagtacgacg

SEQ ID NO: 171579 - DNA, 75 bp, Artificial Sequence
  Synthetic
cgactcggtggtaatgcgctgccagacgcccgattacgaggacatgctgtgttacagcgatgatatggatgacta

SEQ ID NO: 171580 - DNA, 75 bp, Artificial Sequence
  Synthetic
gtgtttttttctctctgtgagcttttttccccataagctgtgtactgttcgtgtccggaccccatacacggtttc

SEQ ID NO: 171581 - DNA, 75 bp, Artificial Sequence
  Synthetic
cacaatacacatgtggttttttggttcgaatcgagcttggcgtttatttcttctcgagccccacgtcctctccct

SEQ ID NO: 171582 - DNA, 75 bp, Artificial Sequence
  Synthetic
cgtttccaggtcgtggtgacgatgatgatgtggtttttatcggggtggtagtacaagggtttgctactgtagtcg

SEQ ID NO: 171583 - DNA, 75 bp, Artificial Sequence
  Synthetic
tgatgtggtttttatcggggtggtagtacaagggtttgctactgtagtcgaaaaggtgggccgagaacatagagg

SEQ ID NO: 171584 - DNA, 75 bp, Artificial Sequence
  Synthetic
aggatatataaagtataaatagcgtatataaaaacatatatctatgtacaagacgcatgggataaataacacgta

SEQ ID NO: 171585 - DNA, 75 bp, Artificial Sequence
  Synthetic
atataaaaacatatatctatgtacaagacgcatgggataaataacacgtatttacacatttttctgcacatgtac

SEQ ID NO: 171586 - DNA, 75 bp, Artificial Sequence
  Synthetic
gcggttgtgatagggcgaccgctgaggcgagctgcgtgtgcgtgtgatttgtgttccccgctgcaaaaggctccc

SEQ ID NO: 171587 - DNA, 75 bp, Artificial Sequence
  Synthetic
atgaagacgttaataaagaaaagcggcggttgtgatagggcgaccgctgaggcgagctgcgtgtgcgtgtgattt

SEQ ID NO: 171588 - DNA, 75 bp, Artificial Sequence
  Synthetic
aattggtggctatggtgaggagtttggaggaaataatatacatcatatattctgatgacagtgtagtaaacattt

SEQ ID NO: 171589 - DNA, 75 bp, Artificial Sequence
  Synthetic
tccgcacaaccccccgtctccgttcccaccaccagttcagcgcaaaagccccccgtccccgcaagtccctagctc

SEQ ID NO: 171590 - DNA, 75 bp, Artificial Sequence
  Synthetic
ggaggaaataatatacatcatatattctgatgacagtgtagtaaacatttcactggcttcggcccggtgcgacgg

SEQ ID NO: 171591 - DNA, 75 bp, Artificial Sequence
  Synthetic
ccccgtccccgcaagtccctagctccgcaaaactccctcgctgcctcagcgcaaacctccctcggcccggtcggc

SEQ ID NO: 171592 - DNA, 75 bp, Artificial Sequence
  Synthetic
atcttcttcattctttcacagtaaagcacatttctttatgtggggacgggaatcgatgtcatttgtgtatttgca

SEQ ID NO: 171593 - DNA, 75 bp, Artificial Sequence
  Synthetic
gcacatttctttatgtggggacgggaatcgatgtcatttgtgtatttgcattcggtagagagctacagtctccag

SEQ ID NO: 171594 - DNA, 75 bp, Artificial Sequence
  Synthetic
ggcagggtgtgtcagggtgtgtcgcgggcgtgtgccgggtgtgtcgtgccgggtgtgtcgcgggcgtgtggcggg

SEQ ID NO: 171595 - DNA, 75 bp, Artificial Sequence
  Synthetic
taaggttatagcatcatctagtttgttcatttcatacctgttgagaacgtttatgttctagcaattgatttcgcg

SEQ ID NO: 171596 - DNA, 75 bp, Artificial Sequence
  Synthetic
ttcatttcatacctgttgagaacgtttatgttctagcaattgatttcgcgtcatagggctgtgacggtgattctt

SEQ ID NO: 171597 - DNA, 75 bp, Artificial Sequence
  Synthetic
ccccccccctcccctcggccggacgcttcttctgcgtctgtcctcgacgcgggttgtgccgtacctcgcggccgt

SEQ ID NO: 171598 - DNA, 75 bp, Artificial Sequence
  Synthetic
tgaagattactccgggggagactatgacgttttgattacggatacagatggaggtaaccatcagcaaccacaaga

SEQ ID NO: 171599 - DNA, 75 bp, Artificial Sequence
  Synthetic
ggacggtttcggcttagcctctggcctgcgatggtttttttattccaagttcgttccatgaatagagcgttatac

SEQ ID NO: 171600 - DNA, 75 bp, Artificial Sequence
  Synthetic
ctgcgatggtttttttattccaagttcgttccatgaatagagcgttatacgattgtgttttcgtgtcattcagac

SEQ ID NO: 171601 - DNA, 75 bp, Artificial Sequence
  Synthetic
cttggagagacgaaaagcgagcgtgtttcacgagatggctgatgccgagtgtcgtcgacataagtcattttctaa

SEQ ID NO: 171602 - DNA, 75 bp, Artificial Sequence
  Synthetic
tttcacgagatggctgatgccgagtgtcgtcgacataagtcattttctaaagaagcaacataaaaaaaagatgat

SEQ ID NO: 171603 - DNA, 75 bp, Artificial Sequence
  Synthetic
caccgtcttctccgggacgtcttgccgtcgtccgtcacccgggcgtcgagatgttcgtagagaacgatggaggac

SEQ ID NO: 171604 - DNA, 75 bp, Artificial Sequence
  Synthetic
ttttttgcctcggcacgaccgtatttgcccgtcttaccgcacctccggaaagatggtgtttttacgcaggtgggt

SEQ ID NO: 171605 - DNA, 75 bp, Artificial Sequence
  Synthetic
gatgatgatggctacgaaggacgggcggacgggcaaacgatggtgagaggtcgccaccgaggggtgccttttttt

SEQ ID NO: 171606 - DNA, 75 bp, Artificial Sequence
  Synthetic
ttctggtcagatggaacgtcgtcggtctcgagcgccccccgatgtagggccgctctcttacgtatcccgggtcga

SEQ ID NO: 171607 - DNA, 75 bp, Artificial Sequence
  Synthetic
cggaaagtccgaatcctacacatttctagtcgtgacggctagttttttggtggtcatggcggtggtggtcaacat

SEQ ID NO: 171608 - DNA, 75 bp, Artificial Sequence
  Synthetic
ctagtcgtgacggctagttttttggtggtcatggcggtggtggtcaacatatatctccagatataggagatgagg

SEQ ID NO: 171609 - DNA, 75 bp, Artificial Sequence
  Synthetic
tcaaaagatgatttgtacaacagggaaggatacggttttaaaggttagtgcagagaaactatataaagagcgtat

SEQ ID NO: 171610 - DNA, 75 bp, Artificial Sequence
  Synthetic
aacatggagttcattctgtcattaaaaaggttctaagtagagcatattaaaaatagacgagagctagagttttat

SEQ ID NO: 171611 - DNA, 75 bp, Artificial Sequence
  Synthetic
gccggacgccggctacgtcccagtccggggcttcgcgcacccaaacgcaggtttcccccgttttcaaacacctca

SEQ ID NO: 171612 - DNA, 75 bp, Artificial Sequence
  Synthetic
tgttatacacagtgaaaacgtggggggacagagttccaaacacgtgtctatcaagcaaaaattcagacgatataa

SEQ ID NO: 171613 - DNA, 75 bp, Artificial Sequence
  Synthetic
tacagacttatgagctttttaccaaacagatgcaaatcgcctaccggaggcgggatcgggcgtgaggttctggct

SEQ ID NO: 171614 - DNA, 75 bp, Artificial Sequence
  Synthetic
acagatgcaaatcgcctaccggaggcgggatcgggcgtgaggttctggctgcacccgcccgatccctcgtcggct

SEQ ID NO: 171615 - DNA, 75 bp, Artificial Sequence
  Synthetic
atggtttgcgcgtcttatctgaatatatctagcacgatatagacgatacacgtcaagatcattgtatcacttctt

SEQ ID NO: 171616 - DNA, 75 bp, Artificial Sequence
  Synthetic
tatctagcacgatatagacgatacacgtcaagatcattgtatcacttcttttcgtctacgtggtaagagtcttgg

SEQ ID NO: 171617 - DNA, 75 bp, Artificial Sequence
  Synthetic
cgttgttgagcggttgtgttggatgaacttgtcatcattctgtattttttcacataaggtgttcttttcttcgag

SEQ ID NO: 171618 - DNA, 75 bp, Artificial Sequence
  Synthetic
aacttgtcatcattctgtattttttcacataaggtgttcttttcttcgagcagtttataaaaggggtcaggcgcg

SEQ ID NO: 171619 - DNA, 75 bp, Artificial Sequence
  Synthetic
tggtttgacgtcagcgaccgttagccctcagggcgaaaacaggaagagtcgcctcgacggcgccctctaggtagc

SEQ ID NO: 171620 - DNA, 75 bp, Artificial Sequence
  Synthetic
cgagatgcatttgcagctgcacttacagctgcagctgcagtagcgaacccatcggcaggtgaggaggtcgattac

SEQ ID NO: 171621 - DNA, 75 bp, Artificial Sequence
  Synthetic
aggcggtgcccgcgactcgcccctcctccaagatggcgccgctcggccagactcgtcgagattttcagggctatc

SEQ ID NO: 171622 - DNA, 75 bp, Artificial Sequence
  Synthetic
aaatgttaactcccgcggtctttccggccgtgctctacctcctggcgcttgtcgtctgggttgagatgttctgcc

SEQ ID NO: 171623 - DNA, 75 bp, Artificial Sequence
  Synthetic
gcacagaaaagttatcgtgctatttttttacccgcctggagcgaaaacgctcctcggctctcgacaccattttct

SEQ ID NO: 171624 - DNA, 75 bp, Artificial Sequence
  Synthetic
ttttacccgcctggagcgaaaacgctcctcggctctcgacaccattttctctcgtccgccatgtcggagctcaga

SEQ ID NO: 171625 - DNA, 75 bp, Artificial Sequence
  Synthetic
agaaaggtggggaattttgagggacacggttttgtcgggtgggggagaaaatcacgccctgccgtcgtattgccg

SEQ ID NO: 171626 - DNA, 75 bp, Artificial Sequence
  Synthetic
gtggggcctgttcccttcccgggtctcggacgagtcgacacgccgggtgggacggtcgtggtctcctcggcccgt

SEQ ID NO: 171627 - DNA, 75 bp, Artificial Sequence
  Synthetic
gccgggaccctccccgtggattcacggtgttccggacccctccaggaaagggtggaaaacgcgtggagcccacgg

SEQ ID NO: 171628 - DNA, 75 bp, Artificial Sequence
  Synthetic
ggggacggtgattgtggaggggcgtactgacggcaattgaggtgtcatggcggcccaccgtcgaccccgagcgct

SEQ ID NO: 171629 - DNA, 75 bp, Artificial Sequence
  Synthetic
gcatcggccagcacacacgccacagcctggtggggtccgaggcgccgaccccggctgggcggccgatggggggag

SEQ ID NO: 171630 - DNA, 75 bp, Artificial Sequence
  Synthetic
aagactggcatcgacgtcaaagactcacgtaatttggaacatgtgcgaccgcaaagtgcgtcagaatagcacgtg

SEQ ID NO: 171631 - DNA, 75 bp, Artificial Sequence
  Synthetic
gggagcgtcacgggaccggccaacgcccagggtaaggcggaccgagagccggcggctaggccgagggacccccga

SEQ ID NO: 171632 - DNA, 75 bp, Artificial Sequence
  Synthetic
gaggggggaggggagcccaaccggagccgccgagagggagccgccgcgagacccggaagccgtcgcggtcgaccc

SEQ ID NO: 171633 - DNA, 75 bp, Artificial Sequence
  Synthetic
cgctcccggagctcctgaccgggcccccagcccccaaccctccggggccgactgccgtcgagccggggcgtcgcc

SEQ ID NO: 171634 - DNA, 75 bp, Artificial Sequence
  Synthetic
cccagcccccaaccctccggggccgactgccgtcgagccggggcgtcgcccgtccccaccaccgtccgcccggcc

SEQ ID NO: 171635 - DNA, 75 bp, Artificial Sequence
  Synthetic
cgagccgggaaggggagctgggtgggggatccccggtcgcccaccgcggaacgagcctaggaaccggggtccgcg

SEQ ID NO: 171636 - DNA, 75 bp, Artificial Sequence
  Synthetic
gggatccccggtcgcccaccgcggaacgagcctaggaaccggggtccgcgacccagccccccgtggggggagggg

SEQ ID NO: 171637 - DNA, 75 bp, Artificial Sequence
  Synthetic
gagggatcccgggccggagcccggggaggagcggggtgggggtgggaagcccccgctcgggtccccccgggccgc

SEQ ID NO: 171638 - DNA, 75 bp, Artificial Sequence
  Synthetic
ccccgctcgggtccccccgggccgcggacgggaaccgggaccccggtgcgggggtcccagcccggccgggccgtc

SEQ ID NO: 171639 - DNA, 75 bp, Artificial Sequence
  Synthetic
ctattcgccattcgaaccaccgaagccgtactcaacacattcatcatcttcgtgggcggtccacttaacgccata

SEQ ID NO: 171640 - DNA, 75 bp, Artificial Sequence
  Synthetic
cacggccccggatggtgctccagggcggtgggacgggcccgcggacggaccggcgccgggcctcggccggggagg

SEQ ID NO: 171641 - DNA, 75 bp, Artificial Sequence
  Synthetic
cggtgggacgggcccgcggacggaccggcgccgggcctcggccggggagggtggggggtagggcgggaggcaggc

SEQ ID NO: 171642 - DNA, 75 bp, Artificial Sequence
  Synthetic
ccgggttttataggttttcagaggccccgcctaggtgggcggagcggtaattttccaccgccgcggcccatgccc

SEQ ID NO: 171643 - DNA, 75 bp, Artificial Sequence
  Synthetic
agtccgccacgtccctgtcttgtcgctccccaatcgtctcccgcacaccccccgcggcacccagagggcgggtga

SEQ ID NO: 171644 - DNA, 75 bp, Artificial Sequence
  Synthetic
tgaccgcctccagtggaaaaatactggcgcatgcgcacgacacacacccagtggaattttaccggcgcatgcgca

SEQ ID NO: 171645 - DNA, 75 bp, Artificial Sequence
  Synthetic
ggacgaccctcccgcgggccaggacccgcgcatgcgcaccggggcccctggttcaccccactttatatataagct

SEQ ID NO: 171646 - DNA, 75 bp, Artificial Sequence
  Synthetic
ccgggtgtgtcgcgggcgtgtggcgggcggggtgtgtcaggggtgtgtcggggtgtgttggcgggccgtgtgttg

SEQ ID NO: 171647 - DNA, 75 bp, Artificial Sequence
  Synthetic
aaaattcgccccgactgcgcatgcgcacggaaacgccgtcccattggaaatcatggttgcccaaatttggtaaaa

SEQ ID NO: 171648 - DNA, 75 bp, Artificial Sequence
  Synthetic
cacggaaacgccgtcccattggaaatcatggttgcccaaatttggtaaaaatttgccccccccggttccggagga

SEQ ID NO: 171649 - DNA, 75 bp, Artificial Sequence
  Synthetic
aagaattatgctatatagggtatgcatcctaggggtggaagctaggctccgcccctacggggcgtcgcctagcat

SEQ ID NO: 171650 - DNA, 75 bp, Artificial Sequence
  Synthetic
acgtagctcgcttcgctcgctacgtcatcagagatgatttccgccggaggtgacgcacgcatacgtgacgtagct

SEQ ID NO: 171651 - DNA, 75 bp, Artificial Sequence
  Synthetic
tgtgtcctgcagatagttccacggacagcgacggcaagtccataatcaccggtgtgcaagtggtggaacacgacg

SEQ ID NO: 171652 - DNA, 75 bp, Artificial Sequence
  Synthetic
agtgtgacgtaggcttgtcaggggtcacgtgagaagcggcggcgttaagtttactaggccaaaacagaggaaggg

SEQ ID NO: 171653 - DNA, 75 bp, Artificial Sequence
  Synthetic
cacgtgagaagcggcggcgttaagtttactaggccaaaacagaggaagggggcggataccctaggtaagggggcg

SEQ ID NO: 171654 - DNA, 75 bp, Artificial Sequence
  Synthetic
agcaggtgtatatttccggtagacggagaagcctgtacgtacaccgaggacggtggaaccctaacgggttccacc

SEQ ID NO: 171655 - DNA, 75 bp, Artificial Sequence
  Synthetic
gagaagcctgtacgtacaccgaggacggtggaaccctaacgggttccacctatctgaaatttccgtacaaggggt

SEQ ID NO: 171656 - DNA, 75 bp, Artificial Sequence
  Synthetic
tatacgtaagcggatatggctacacgtaatgggtgtggcttcactagggatcgctgtattctaccgcgcgcgtgc

SEQ ID NO: 171657 - DNA, 75 bp, Artificial Sequence
  Synthetic
gcggcggttctgagagggcgaccgctgaagcgagttgcctgtgcgtgcggtttgtggttccaagcgccgtacacc

SEQ ID NO: 171658 - DNA, 75 bp, Artificial Sequence
  Synthetic
gtaacaaatcaccttgtgattatgacgttggtatctggcaccgcctcttgggcggttctacgggcctcgcttcct

SEQ ID NO: 171659 - DNA, 75 bp, Artificial Sequence
  Synthetic
cccaacctccctggtcccgccgcaaaaggcccccgttcccgcacccccccgtccccgtggccagcagcttccccg

SEQ ID NO: 171660 - DNA, 75 bp, Artificial Sequence
  Synthetic
aaggcccccgttcccgcacccccccgtccccgtggccagcagcttccccgttcctggcgcaacccccgtcctcgc

SEQ ID NO: 171661 - DNA, 75 bp, Artificial Sequence
  Synthetic
acaccagatggcgctcgttgaccaggaaagctgtctacgcgggttttacagtgtgtttttgcgtcattgtgacgt

SEQ ID NO: 171662 - DNA, 75 bp, Artificial Sequence
  Synthetic
gtgtgtttttgcgtcattgtgacgtagagccggcgatcgccacattcgatggtgtacgctcgccgccagatgtcg

SEQ ID NO: 171663 - DNA, 75 bp, Artificial Sequence
  Synthetic
agaccgtgggacaacgcgtgccggactgccgaaacgcacatagcgccgggcgcaacacgccgcaagcgccgcgtc

SEQ ID NO: 171664 - DNA, 75 bp, Artificial Sequence
  Synthetic
ctgccgaaacgcacatagcgccgggcgcaacacgccgcaagcgccgcgtcgcgcaaaactcccgcagccaacaaa

SEQ ID NO: 171665 - DNA, 75 bp, Artificial Sequence
  Synthetic
ttgggcacggcggtttcaggttacattacatcaagacgcgacaacgccccgaataaaaacaccgggcaccgttat

SEQ ID NO: 171666 - DNA, 75 bp, Artificial Sequence
  Synthetic
gtatacacgacgtcgatactgatcgccgtagtgacgtcagtcgacacacaacaccgttccccatcacggtgtttc

SEQ ID NO: 171667 - DNA, 75 bp, Artificial Sequence
  Synthetic
acgccccgccaacctccctcacccccgtcccgcaccggcgtcgggttgggtgtgtcggggcgcggctgggtgggt

SEQ ID NO: 171668 - DNA, 75 bp, Artificial Sequence
  Synthetic
aaaatacacaattttaaagttcggatcttttcctgttttattgactcgtaaactgtaaggtcttcgagtacgtgt

SEQ ID NO: 171669 - DNA, 75 bp, Artificial Sequence
  Synthetic
tcgcgggtgtgtcggtcgggtgtgtcgcgggcgtgtgccgggtgtgtcaggggtgtgtggcggggtgtgcgcggg

SEQ ID NO: 171670 - DNA, 75 bp, Artificial Sequence
  Synthetic
tcttttcctgttttattgactcgtaaactgtaaggtcttcgagtacgtgtcgggggtctgtgccgcgtacgtgtt

SEQ ID NO: 171671 - DNA, 75 bp, Artificial Sequence
  Synthetic
cggccggacgcctcttctgcgtgtgtgctcgacgcgggttgtgccgtactttgtctgttgtttcccccgcggtgt

SEQ ID NO: 171672 - DNA, 75 bp, Artificial Sequence
  Synthetic
cgggtttttggggtgtgtagcttgtacggcgttttgtcggcggagcgcagcgaaaatcggtggtgatagcggcga

SEQ ID NO: 171673 - DNA, 75 bp, Artificial Sequence
  Synthetic
gcgcttgtaccaccgtggtgcggtgtttctgcttgtaaaccgtcaggcggttctttgtgatttaaaaacaccgtg

SEQ ID NO: 171674 - DNA, 75 bp, Artificial Sequence
  Synthetic
catctcccaacctttttccaataaacgaaaccgacatgacacacgtaatgggtgctcgtggctacatttattgaa

SEQ ID NO: 171675 - DNA, 75 bp, Artificial Sequence
  Synthetic
ttcgtgaaacgtgacttttcacggtttgttagctgatgtgattttggaggtcacaaacaccgtacggtgttttcg

SEQ ID NO: 171676 - DNA, 75 bp, Artificial Sequence
  Synthetic
aacaccgttttctagggacggtgttttcacgtgccctgtgtggggtttttatgtgctgcttgtgcgactgagtgg

SEQ ID NO: 171677 - DNA, 75 bp, Artificial Sequence
  Synthetic
ctaccgacgttagttggcggtgacgcaaagccgtcccgaacatcacgctattttcgcgggcgggtgcgtcggcta

SEQ ID NO: 171678 - DNA, 75 bp, Artificial Sequence
  Synthetic
caaagccgtcccgaacatcacgctattttcgcgggcgggtgcgtcggctagcggtctggctgcgagaggctaccc

SEQ ID NO: 171679 - DNA, 75 bp, Artificial Sequence
  Synthetic
ccagaccgcagtggtggccacggtggtgtctcagacgtcgtgcgtcaaacatgacgtgctgaacttttccttggt

SEQ ID NO: 171680 - DNA, 75 bp, Artificial Sequence
  Synthetic
gtgtctcagacgtcgtgcgtcaaacatgacgtgctgaacttttccttggtataaaattcactcagtggcggcgta

SEQ ID NO: 171681 - DNA, 75 bp, Artificial Sequence
  Synthetic
cggagccgctatccgccatccgtaccacagaagccgtgatcaacacgttcatcattttcgtaggcggcccgctca

SEQ ID NO: 171682 - DNA, 75 bp, Artificial Sequence
  Synthetic
ctctacttcagcaggttgaacgcagaaacgcaggagattctggccactctctcgttatgcgaccgttcctcgagc

SEQ ID NO: 171683 - DNA, 75 bp, Artificial Sequence
  Synthetic
aaacgcaggagattctggccactctctcgttatgcgaccgttcctcgagcgtggtgatcgctcctctgttggcgg

SEQ ID NO: 171684 - DNA, 75 bp, Artificial Sequence
  Synthetic
aagtcacgtccttctgtccttttgcgctctactttcatcatacgcaaggcatcgtggcttttaccgaggatcacg

SEQ ID NO: 171685 - DNA, 75 bp, Artificial Sequence
  Synthetic
gctctactttcatcatacgcaaggcatcgtggcttttaccgaggatcacggagacgtgcatcggctgtgcgagga

SEQ ID NO: 171686 - DNA, 75 bp, Artificial Sequence
  Synthetic
tgttcgtgtacgacctggcgaacaacacgctgatcctagcggcgcgcgacgcggacgagtggtttcggcacggcg

SEQ ID NO: 171687 - DNA, 75 bp, Artificial Sequence
  Synthetic
cgcggcggtgggctgtcaggcgtccgagacgactgtgcacgtggtggtgggcaacggcttgaaggagtttctctt

SEQ ID NO: 171688 - DNA, 75 bp, Artificial Sequence
  Synthetic
gagacgactgtgcacgtggtggtgggcaacggcttgaaggagtttctctttgccggtcagctgattccatgcgtg

SEQ ID NO: 171689 - DNA, 75 bp, Artificial Sequence
  Synthetic
tcgctgcagcttgacgccgaagccgacgaggtctcgctggatgcgcgcagcgcttttgtggaggcgcgagggctc

SEQ ID NO: 171690 - DNA, 75 bp, Artificial Sequence
  Synthetic
acgaggtctcgctggatgcgcgcagcgcttttgtggaggcgcgagggctctacgtgccggccgtaagcgagacgc

SEQ ID NO: 171691 - DNA, 75 bp, Artificial Sequence
  Synthetic
tgcggcagtttgtgcacgacagtcagcagtcggtgaagctggcgccacataagcgctacttggggtacatgagcc

SEQ ID NO: 171692 - DNA, 75 bp, Artificial Sequence
  Synthetic
gcagtcggtgaagctggcgccacataagcgctacttggggtacatgagccagcgactcagcagtctggaaaagga

SEQ ID NO: 171693 - DNA, 75 bp, Artificial Sequence
  Synthetic
ccaacctgccgagtctatgctcttttccgagtggcctttagtgaccaacgcaaccgatcaccgcgatctgatccg

SEQ ID NO: 171694 - DNA, 75 bp, Artificial Sequence
  Synthetic
tccgagtggcctttagtgaccaacgcaaccgatcaccgcgatctgatccgcgcgctgaccgagctcaagttgcat

SEQ ID NO: 171695 - DNA, 75 bp, Artificial Sequence
  Synthetic
tcgtcggcgcggcatcccagcgccggcggtacggccagtcaggagacgttgctcaaggctattcagttcaccaac

SEQ ID NO: 171696 - DNA, 75 bp, Artificial Sequence
  Synthetic
gcggtacggccagtcaggagacgttgctcaaggctattcagttcaccaacgggttgtcggcggcctgcgaagacg

SEQ ID NO: 171697 - DNA, 75 bp, Artificial Sequence
  Synthetic
tggcgttggtgtgtggcacgtgtccgcagctagtttcgggcttcgtctggtatctaaatcgtgtctcggtgtata

SEQ ID NO: 171698 - DNA, 75 bp, Artificial Sequence
  Synthetic
gcagctagtttcgggcttcgtctggtatctaaatcgtgtctcggtgtataacacgggcttgtcgggttcgtcgac

SEQ ID NO: 171699 - DNA, 75 bp, Artificial Sequence
  Synthetic
tcagacggccttcgtgcgggtgcgcacccgcttgcccgtggtgcccaagcagcccaagaaggagccctgcgtgat

SEQ ID NO: 171700 - DNA, 75 bp, Artificial Sequence
  Synthetic
acccgcttgcccgtggtgcccaagcagcccaagaaggagccctgcgtgatcaccgtgcagtcgcgttttctcaac

SEQ ID NO: 171701 - DNA, 75 bp, Artificial Sequence
  Synthetic
atgacggcagggcgcgatcttctcccccatccgacaaaaccgtgtcccttaaaattccccacctttctctgttca

SEQ ID NO: 171702 - DNA, 75 bp, Artificial Sequence
  Synthetic
gacgacggggttccgggcggcggtgctggcgggggtggtggacgagacgtgagcgggggcccgagcgacggtctg

SEQ ID NO: 171703 - DNA, 75 bp, Artificial Sequence
  Synthetic
ctggcgggggtggtggacgagacgtgagcgggggcccgagcgacggtctgggcggcggtcgtggtggtgggggtg

SEQ ID NO: 171704 - DNA, 75 bp, Artificial Sequence
  Synthetic
atcgcatcttggattactgccgcaagatgcggctcatcgaccccgtgacgggcgaggatacctttagcgcgcacg

SEQ ID NO: 171705 - DNA, 75 bp, Artificial Sequence
  Synthetic
gatgcggctcatcgaccccgtgacgggcgaggatacctttagcgcgcacggcaaaagcgactttgtggccgtctt

SEQ ID NO: 171706 - DNA, 75 bp, Artificial Sequence
  Synthetic
cgaggtggcgggcgccacgcaggccttcaacctggatctgaatccctacgccgtggccttccagccgctgctggc

SEQ ID NO: 171707 - DNA, 75 bp, Artificial Sequence
  Synthetic
ttcaacctggatctgaatccctacgccgtggccttccagccgctgctggcctacgcctatttcagatccgtcttt

SEQ ID NO: 171708 - DNA, 75 bp, Artificial Sequence
  Synthetic
tccaaatggatgacgcagcattttcaatccattcacggcgcgttctccaccacgtcgtcgcgcaagggctttctc

SEQ ID NO: 171709 - DNA, 75 bp, Artificial Sequence
  Synthetic
aatccattcacggcgcgttctccaccacgtcgtcgcgcaagggctttctcttcaccaagcagatcaagtcgtcca

SEQ ID NO: 171710 - DNA, 75 bp, Artificial Sequence
  Synthetic
tcaagctctcgcggctgtcggtacccacgttgatcatggtgcgggtgaaaaaccgacccatctaccgcgcgggca

SEQ ID NO: 171711 - DNA, 75 bp, Artificial Sequence
  Synthetic
cacgttgatcatggtgcgggtgaaaaaccgacccatctaccgcgcgggcaagggcaacgcgggtagcgtgttttt

SEQ ID NO: 171712 - DNA, 75 bp, Artificial Sequence
  Synthetic
actctttcctgaatgtggtctcccctgcttacagttttggcagaaggtctgttccaacgcgttgcccaagaatgt

SEQ ID NO: 171713 - DNA, 75 bp, Artificial Sequence
  Synthetic
tgcttacagttttggcagaaggtctgttccaacgcgttgcccaagaatgtgcccataggtgacatgggcgagttc

SEQ ID NO: 171714 - DNA, 75 bp, Artificial Sequence
  Synthetic
tgtgtgctgagttacgtggaaagccgtttccataacaaattcctctgctactacggcttcaaagactacatcggc

SEQ ID NO: 171715 - DNA, 75 bp, Artificial Sequence
  Synthetic
gtttccataacaaattcctctgctactacggcttcaaagactacatcggctcgctgcacgggttaacgacgcgct

SEQ ID NO: 171716 - DNA, 75 bp, Artificial Sequence
  Synthetic
cgttacatgtcaagggcttgaagaccgcaggcgtgccggcgcccatggccgccactgtggcgcgtgaatcgttgg

SEQ ID NO: 171717 - DNA, 75 bp, Artificial Sequence
  Synthetic
cgcaggcgtgccggcgcccatggccgccactgtggcgcgtgaatcgttggtacggagcgtttttgagcatcgttc

SEQ ID NO: 171718 - DNA, 75 bp, Artificial Sequence
  Synthetic
gatcggctacttttcgggcaacggtgtggagcgcagccttaacgtgagctctatgagcggccaagattatcgttt

SEQ ID NO: 171719 - DNA, 75 bp, Artificial Sequence
  Synthetic
gtggagcgcagccttaacgtgagctctatgagcggccaagattatcgtttcatgcgccagcgctacctcttggct

SEQ ID NO: 171720 - DNA, 75 bp, Artificial Sequence
  Synthetic
cgcgtcatgctggcgctggacgccgagaacttggattgcgaccccgaagtaatggccgtgtacgagattctgagc

SEQ ID NO: 171721 - DNA, 75 bp, Artificial Sequence
  Synthetic
agaacttggattgcgaccccgaagtaatggccgtgtacgagattctgagcgtgcgcgaggagatccccgcgtccg

SEQ ID NO: 171722 - DNA, 75 bp, Artificial Sequence
  Synthetic
gcgcaccctcctaggtggacgcccgacatccattccgggccgcgtggtgggtccccgaggggcgggggggtgttt

SEQ ID NO: 171723 - DNA, 75 bp, Artificial Sequence
  Synthetic
agcagggcgtggaggacttttcgctggagaacttgcgacgcgtgctggacgccgacgcccagcgattgacggacg

SEQ ID NO: 171724 - DNA, 75 bp, Artificial Sequence
  Synthetic
agtacctcgtaaataaagacgcacagacctcacgcatatagtaccatcacaccgtgtggcgtgtactttattaca

SEQ ID NO: 171725 - DNA, 75 bp, Artificial Sequence
  Synthetic
ggagaacttgcgacgcgtgctggacgccgacgcccagcgattgacggacgccgctgggggggaggtgcacgacct

SEQ ID NO: 171726 - DNA, 75 bp, Artificial Sequence
  Synthetic
tgtcccttttctcataaactgtcaggtcctacagtcagcatgtcttgagcatgcggtagagcagatagatgccga

SEQ ID NO: 171727 - DNA, 75 bp, Artificial Sequence
  Synthetic
cgtcacgggcaactccatttgcttcggcgtgcccggcgagacgggaggtggctgctttctcgtgaacgccggcga

SEQ ID NO: 171728 - DNA, 75 bp, Artificial Sequence
  Synthetic
ggcgtgcccggcgagacgggaggtggctgctttctcgtgaacgccggcgaagacgaggctggcggcgtcggcggg

SEQ ID NO: 171729 - DNA, 75 bp, Artificial Sequence
  Synthetic
acaacggccgccgcagccacgagcatcgcaacaacagcagcaacagtcgcagcccccgtggccgcttttcagacc

SEQ ID NO: 171730 - DNA, 75 bp, Artificial Sequence
  Synthetic
ccaccgacacagcagcaccaggcgacaccgtatcagctaccgccgcaacagcggcgacagacggcgtcgcatcat

SEQ ID NO: 171731 - DNA, 75 bp, Artificial Sequence
  Synthetic
cagcagcagcaacagccccgaaggttggcgccgcggcaccagagacagagaccgccgccgcgctggcaagctccg

SEQ ID NO: 171732 - DNA, 75 bp, Artificial Sequence
  Synthetic
tggcgccgcggcaccagagacagagaccgccgccgcgctggcaagctccgacattcgcgtcggcgcccgggccgc

SEQ ID NO: 171733 - DNA, 75 bp, Artificial Sequence
  Synthetic
cggcggtggtggaggaggttgcgccgcaggcggcggcaacagcgtcgggagcagaacccgcgtcgtcgacgacgt

SEQ ID NO: 171734 - DNA, 75 bp, Artificial Sequence
  Synthetic
gcaggcggcggcaacagcgtcgggagcagaacccgcgtcgtcgacgacgtcgttatatattaacgtcaacgtcag

SEQ ID NO: 171735 - DNA, 75 bp, Artificial Sequence
  Synthetic
cgtctcgtacgtgagcgagtcgagtcatggagatgaatttgttacagaaactatgcgtagtgtgttcgaaatgca

SEQ ID NO: 171736 - DNA, 75 bp, Artificial Sequence
  Synthetic
catggagatgaatttgttacagaaactatgcgtagtgtgttcgaaatgcaacgaatacgccatggagctggagtg

SEQ ID NO: 171737 - DNA, 75 bp, Artificial Sequence
  Synthetic
tctgtaccggaagatctacccggaggtggtggcgcagaatcgtacgcagagttcgctgctgacgctctatctgga

SEQ ID NO: 171738 - DNA, 75 bp, Artificial Sequence
  Synthetic
gtggtggcgcagaatcgtacgcagagttcgctgctgacgctctatctggagatgctgctgaaggcgctgcacgag

SEQ ID NO: 171739 - DNA, 75 bp, Artificial Sequence
  Synthetic
ccccaccaccgtcccgcacaccccccgtctccgcaacaccccggccccgccggcggccagaacgctcgaaaaccc

SEQ ID NO: 171740 - DNA, 75 bp, Artificial Sequence
  Synthetic
ctccgtttggatcgctgcgatcgccatcacaccgtggaactccagtttacggacaacgtccgtttcagcgtcagt

SEQ ID NO: 171741 - DNA, 75 bp, Artificial Sequence
  Synthetic
atcacaccgtggaactccagtttacggacaacgtccgtttcagcgtcagtctggccacactcaacgacatcgagc

SEQ ID NO: 171742 - DNA, 75 bp, Artificial Sequence
  Synthetic
gccgtgagcgcggcggcgctggtaacgggagttacgctggggacggggacgggggttgcgccggggacggggggt

SEQ ID NO: 171743 - DNA, 75 bp, Artificial Sequence
  Synthetic
tagcgtcatattgaaggtatgctacattttatttataaaaacttcatgagctatcacatgttaatattattgtgg

SEQ ID NO: 171744 - DNA, 75 bp, Artificial Sequence
  Synthetic
tggagctcctccgtcgcctatgcggcatctcgccggtggcgcgtcaggaagtgtacgtcgaagggacgacatgcg

SEQ ID NO: 171745 - DNA, 75 bp, Artificial Sequence
  Synthetic
gttagcggcggggacttgcggccttttgcggcggggacggcgcgttgcagggccggggacggtggtggggacggc

SEQ ID NO: 171746 - DNA, 75 bp, Artificial Sequence
  Synthetic
atttggaacatgtgcgaccgcaaagtgcgtcagaatagcacgtggctttaggacataaaaagtaccgtgaggtct

SEQ ID NO: 171747 - DNA, 75 bp, Artificial Sequence
  Synthetic
catctcgccggtggcgcgtcaggaagtgtacgtcgaagggacgacatgcgcccaatgctacgaggagctgaccat

SEQ ID NO: 171748 - DNA, 75 bp, Artificial Sequence
  Synthetic
ttatcatctccgttttttattataactttataccatgaattactattttgaccatccagccatttagatatatga

SEQ ID NO: 171749 - DNA, 75 bp, Artificial Sequence
  Synthetic
cgtgggacgacacgcaccggcagcgcgcaggcagcgtcggacacaacacgccgcagaagcggcggagcgcttacg

SEQ ID NO: 171750 - DNA, 75 bp, Artificial Sequence
  Synthetic
gtcaagccagtccgatgtgaatatccagacggtggagcaggacctgctggacctgacaacgcgcatcccccactt

SEQ ID NO: 171751 - DNA, 75 bp, Artificial Sequence
  Synthetic
cagacggtggagcaggacctgctggacctgacaacgcgcatcccccacttggctggagtcctttcggccctcaaa

SEQ ID NO: 171752 - DNA, 75 bp, Artificial Sequence
  Synthetic
tttggagggtcacgaccaatgagaaatacaccacttacgggcttatttacactattactcccacatggacaacgc

SEQ ID NO: 171753 - DNA, 75 bp, Artificial Sequence
  Synthetic
gtgtcgggtgtgtcgggggtgtgttggcggggtgtgtcagggtgtgtcgcgggtgtgtcggtcgggtgtgtcgcg

SEQ ID NO: 171754 - DNA, 75 bp, Artificial Sequence
  Synthetic
tttacggatataccggaacgaatatattccttgtcggattttacctactggtcccgtacctcggaggttatcgtc

SEQ ID NO: 171755 - DNA, 75 bp, Artificial Sequence
  Synthetic
cccccgctaaaaacacccccccgcccctcggggacccagcacacggcccggaatggatgtcgggcgtccacctag

SEQ ID NO: 171756 - DNA, 75 bp, Artificial Sequence
  Synthetic
gtgtcgcgggtgtgtcgggggtgtgttggcggggtgtgtccgggtgtgtcggcggtgtgcggggtgcgtgtcggc

SEQ ID NO: 171757 - DNA, 75 bp, Artificial Sequence
  Synthetic
attccttgtcggattttacctactggtcccgtacctcggaggttatcgtcaagcgggtgggcatcaccatccagc

SEQ ID NO: 171758 - DNA, 75 bp, Artificial Sequence
  Synthetic
aggacatcttcgtgctcggggaaaaggcgttggacggggaggagcgcatgttcgtggggtcggtctttgccgccc

SEQ ID NO: 171759 - DNA, 75 bp, Artificial Sequence
  Synthetic
ggcgttggacggggaggagcgcatgttcgtggggtcggtctttgccgcccccaacaggatcatcgacctcatcac

SEQ ID NO: 171760 - DNA, 75 bp, Artificial Sequence
  Synthetic
aatcaagcatattctcgaggagattcgacgtccgctgcccgatggcacggggggcgacggccccgagggcgaggc

SEQ ID NO: 171761 - DNA, 75 bp, Artificial Sequence
  Synthetic
ggggcgacggccccgagggcgaggctattcacctgcgtggacgggaggcgatgtcggggacgggtacgactttga

SEQ ID NO: 171762 - DNA, 75 bp, Artificial Sequence
  Synthetic
gaggcaagaaagcggtagggggaggggcgaatgggcaggacggcgacggcagcgagaacggcttacgggtgcgca

SEQ ID NO: 171763 - DNA, 75 bp, Artificial Sequence
  Synthetic
ctgggctgccgggtggttttccacggccttttagactgcgcggcgccaaggcggcgctagcacgcgccgtgcacg

SEQ ID NO: 171764 - DNA, 75 bp, Artificial Sequence
  Synthetic
ggcgaatgggcaggacggcgacggcagcgagaacggcttacgggtgcgcaactgcgacgaacacgaggctctcga

SEQ ID NO: 171765 - DNA, 75 bp, Artificial Sequence
  Synthetic
ggtctcggaggtgggctatggcaaggtgatccgttgcatcaaaacgcaggagcgtctgactagcaagctcatcga

SEQ ID NO: 171766 - DNA, 75 bp, Artificial Sequence
  Synthetic
gtgatccgttgcatcaaaacgcaggagcgtctgactagcaagctcatcgatgtcaacctagtggggcccttgtgt

SEQ ID NO: 171767 - DNA, 75 bp, Artificial Sequence
  Synthetic
gtgggggatcagttcacctacgatgagcacctgtatgtggtcaataacctgatccacaagagtctgcctgtggaa

SEQ ID NO: 171768 - DNA, 75 bp, Artificial Sequence
  Synthetic
agcacctgtatgtggtcaataacctgatccacaagagtctgcctgtggaatccctcccgctactgggtcagcaga

SEQ ID NO: 171769 - DNA, 75 bp, Artificial Sequence
  Synthetic
ggggcgagcggcacggagacggaggccgccggcggggacgcgccgtgcgcgatggcgggagccgtggggtctgct

SEQ ID NO: 171770 - DNA, 75 bp, Artificial Sequence
  Synthetic
cctatgcctgcgacaacgcgggcgtactaccccacgtcaaggacgatttggtcaaatgcgcggaaggtaccgtgt

SEQ ID NO: 171771 - DNA, 75 bp, Artificial Sequence
  Synthetic
actaccccacgtcaaggacgatttggtcaaatgcgcggaaggtaccgtgtatcccagtgagtggatggtggtgaa

SEQ ID NO: 171772 - DNA, 75 bp, Artificial Sequence
  Synthetic
ggagctcgtgctctccgtcgcactatataatgaaactttcgggaaacaactctcgatcgcgtgcctgcgcgacga

SEQ ID NO: 171773 - DNA, 75 bp, Artificial Sequence
  Synthetic
tataatgaaactttcgggaaacaactctcgatcgcgtgcctgcgcgacgaactgcacccggacagagatgtgatt

SEQ ID NO: 171774 - DNA, 75 bp, Artificial Sequence
  Synthetic
ctcctctacaggcatctgtccagaccggatgagagtggcgacgtgccaacagctcccgtggccaagccctccacc

SEQ ID NO: 171775 - DNA, 75 bp, Artificial Sequence
  Synthetic
cggatgagagtggcgacgtgccaacagctcccgtggccaagccctccaccctgacggccgccgcggccgtctcgg

SEQ ID NO: 171776 - DNA, 75 bp, Artificial Sequence
  Synthetic
gggtccgcgcgacacgcaagagaccacgacgcgcctcatcgctgctggatttggcccgcgacgaacatggaatcc

SEQ ID NO: 171777 - DNA, 75 bp, Artificial Sequence
  Synthetic
acgacgcgcctcatcgctgctggatttggcccgcgacgaacatggaatccaggatctggtgcctggtagtctgcg

SEQ ID NO: 171778 - DNA, 75 bp, Artificial Sequence
  Synthetic
atggaagccatacttctcgtacgacgtctgctcaaacccggtcagtctattctcaacacgtaacgtcttctgaag

SEQ ID NO: 171779 - DNA, 75 bp, Artificial Sequence
  Synthetic
cctttaaggtacgggtctaccaaaaggttttgacgtttcgtcgtagctacgcttacatctacaccacttatctgc

SEQ ID NO: 171780 - DNA, 75 bp, Artificial Sequence
  Synthetic
gcttacatctacaccacttatctgctgggcagcaatacggaatacgtggcgcctcctatgtgggagattcatcac

SEQ ID NO: 171781 - DNA, 75 bp, Artificial Sequence
  Synthetic
tgggcagcaatacggaatacgtggcgcctcctatgtgggagattcatcacatcaacaagtttgctcaatgctaca

SEQ ID NO: 171782 - DNA, 75 bp, Artificial Sequence
  Synthetic
cacccacagtacccgttacgtgacggtcaaggatcagtggcacagccgcggcagcacctggctctatcgtgagac

SEQ ID NO: 171783 - DNA, 75 bp, Artificial Sequence
  Synthetic
gtcaaggatcagtggcacagccgcggcagcacctggctctatcgtgagacctgtaatctgaactgtatgctgacc

SEQ ID NO: 171784 - DNA, 75 bp, Artificial Sequence
  Synthetic
ttctacaacggaaccaatcgcaatgccagctactttggagaaaacgccgacaagtttttcattttcccgaactac

SEQ ID NO: 171785 - DNA, 75 bp, Artificial Sequence
  Synthetic
gactcggtgatctcttgggatatacaggacgagaagaatgtcacctgccagctcaccttctgggaagcctcggaa

SEQ ID NO: 171786 - DNA, 75 bp, Artificial Sequence
  Synthetic
aggacgagaagaatgtcacctgccagctcaccttctgggaagcctcggaacgtactatccgttccgaagccgaag

SEQ ID NO: 171787 - DNA, 75 bp, Artificial Sequence
  Synthetic
gctcaccttctgggaagcctcggaacgtactatccgttccgaagccgaagactcgtaccacttttcttctgccaa

SEQ ID NO: 171788 - DNA, 75 bp, Artificial Sequence
  Synthetic
ggctataaataagttacagcagattttcaatacttcatacaatcaaacatatgaaaaatacggaaacgtgtccgt

SEQ ID NO: 171789 - DNA, 75 bp, Artificial Sequence
  Synthetic
ttcaatacttcatacaatcaaacatatgaaaaatacggaaacgtgtccgtcttcgaaaccagcggcggtctggtg

SEQ ID NO: 171790 - DNA, 75 bp, Artificial Sequence
  Synthetic
actcataggaccagaagaagtacgagtgacaataatacaactcatttgtccagcatggaatcggtgcacaatctg

SEQ ID NO: 171791 - DNA, 75 bp, Artificial Sequence
  Synthetic
gcctggtgtgtggatcaacggcgcaccctagaggtcttcaaggaactcagcaagatcaacccgtcagccattctc

SEQ ID NO: 171792 - DNA, 75 bp, Artificial Sequence
  Synthetic
ccctagaggtcttcaaggaactcagcaagatcaacccgtcagccattctctcggccatttacaacaaaccgattg

SEQ ID NO: 171793 - DNA, 75 bp, Artificial Sequence
  Synthetic
gtgatatgaacgtgaaggaatcgccaggacgctgctactcacgacccgtggtcatctttaatttcgccaacagct

SEQ ID NO: 171794 - DNA, 75 bp, Artificial Sequence
  Synthetic
ccattggtggtcttagggaaggctgagttcttggtaaagaactctatattcctgtagcacatataaatcatcttt

SEQ ID NO: 171795 - DNA, 75 bp, Artificial Sequence
  Synthetic
ctttttgtatcgtactacgacattgctgcttccagaactttactgcaaccaccaccaaaggctattaagggtgga

SEQ ID NO: 171796 - DNA, 75 bp, Artificial Sequence
  Synthetic
ttcccagcctcaagatcttcatcgccgggaactcggcctacgagtacgtggactacctcttcaaacgcatgattg

SEQ ID NO: 171797 - DNA, 75 bp, Artificial Sequence
  Synthetic
ccgctggaaaataccgacttcagggtactggaactttactcgcagaaagagctgcgttccagcaacgtttttgac

SEQ ID NO: 171798 - DNA, 75 bp, Artificial Sequence
  Synthetic
ctcgaagagatcatgcgcgaattcaactcgtacaagcagcgggtaaagtacgtggaggacaaggtagtcgacccg

SEQ ID NO: 171799 - DNA, 75 bp, Artificial Sequence
  Synthetic
gctactcgtggcgctctcgacggtatttctgctgctggtgctagtagggacgtttgtgctgctggtcatattcgt

SEQ ID NO: 171800 - DNA, 75 bp, Artificial Sequence
  Synthetic
acgacctcatgagcggcctgggcgccgcgggaaaggccgttggcgtagccattggggccgtgggtggcgcggtgg

SEQ ID NO: 171801 - DNA, 75 bp, Artificial Sequence
  Synthetic
cgcgggaaaggccgttggcgtagccattggggccgtgggtggcgcggtggcctccgtggtcgaaggcgttgccac

SEQ ID NO: 171802 - DNA, 75 bp, Artificial Sequence
  Synthetic
ctatactcgacagcggcgtctgtgcacgcagccgctgcagaacctctttccctatctggtgtccgccgacgggac

SEQ ID NO: 171803 - DNA, 75 bp, Artificial Sequence
  Synthetic
acgcagccgctgcagaacctctttccctatctggtgtccgccgacgggaccaccgtgacgtcgggcagcaccaaa

SEQ ID NO: 171804 - DNA, 75 bp, Artificial Sequence
  Synthetic
gtggccttggtcacgggtgtctcgggcctaaacacatgataaacaaagtcataagcacatgggtcacatacagga

SEQ ID NO: 171805 - DNA, 75 bp, Artificial Sequence
  Synthetic
tcgtctgatgcatccacggcggctccgccttacaccaacgagcaggcttaccagatgcttctggccctggcccgt

SEQ ID NO: 171806 - DNA, 75 bp, Artificial Sequence
  Synthetic
cgccttacaccaacgagcaggcttaccagatgcttctggccctggcccgtctggacgcagagcagcgagcgcagc

SEQ ID NO: 171807 - DNA, 75 bp, Artificial Sequence
  Synthetic
ggacgcgaaataaattccggctcatggcgttaaccaggtagaaactgtgtgtgcagttgcgttgcgcgtaacgta

SEQ ID NO: 171808 - DNA, 75 bp, Artificial Sequence
  Synthetic
tgcgacatcgcaaaaacggctacagacacttgaaagactccgacgaagaagagaacgtctgaaccaggagaaaaa

SEQ ID NO: 171809 - DNA, 75 bp, Artificial Sequence
  Synthetic
cagagacttgtgatatacggggttaaactggatatctaggtgctgcatgtgtattttctttgtgattttgcttcg

SEQ ID NO: 171810 - DNA, 75 bp, Artificial Sequence
  Synthetic
taagctgtcagcctctcacggtccgctatgtttttcaacccgtatctgagcggcggcgtgaccggcggtgcggtc

SEQ ID NO: 171811 - DNA, 75 bp, Artificial Sequence
  Synthetic
ctatgtttttcaacccgtatctgagcggcggcgtgaccggcggtgcggtcgcgggtggccggcgtcagcgttcgc

SEQ ID NO: 171812 - DNA, 75 bp, Artificial Sequence
  Synthetic
tgttcgacggtcagacggggttgatcaagcataagacgggacggctgcctctcatgttctatcgagagattaaac

SEQ ID NO: 171813 - DNA, 75 bp, Artificial Sequence
  Synthetic
caagcataagacgggacggctgcctctcatgttctatcgagagattaaacatttgttgagtcatgacatggtttg

SEQ ID NO: 171814 - DNA, 75 bp, Artificial Sequence
  Synthetic
cgccgtgctcttcttcgactcgcccgaaaacgtgtcgccgcgctatcgtcagcatctggtgccttcggggaacgt

SEQ ID NO: 171815 - DNA, 75 bp, Artificial Sequence
  Synthetic
gaaaacgtgtcgccgcgctatcgtcagcatctggtgccttcggggaacgtgttgcgtttcttcggggccacagaa

SEQ ID NO: 171816 - DNA, 75 bp, Artificial Sequence
  Synthetic
ggcctggtattccagctccgtcagcgcctggcgctccaccggaatctgagacagcaacaggcgctccgggccgtg

SEQ ID NO: 171817 - DNA, 75 bp, Artificial Sequence
  Synthetic
ctgcgtgaggtcattgccagcgtgggcgaactagtgcccgaaccgcggacgccatacgccgtgtctgtcacgccg

SEQ ID NO: 171818 - DNA, 75 bp, Artificial Sequence
  Synthetic
gcgaactagtgcccgaaccgcggacgccatacgccgtgtctgtcacgccggccaccaagacctccatctatgggt

SEQ ID NO: 171819 - DNA, 75 bp, Artificial Sequence
  Synthetic
atctgctggagcagggttttcccgtgtacgaagtccgtgtggatccgctgacgcgtttggtcatcgatcggcgga

SEQ ID NO: 171820 - DNA, 75 bp, Artificial Sequence
  Synthetic
gtacgaagtccgtgtggatccgctgacgcgtttggtcatcgatcggcggatcaccacgttcggctggtgctccgt

SEQ ID NO: 171821 - DNA, 75 bp, Artificial Sequence
  Synthetic
gtataaaggatggtggggtacaaagggacatcgctagacacggatcgattgctgtgctagtttcatataattaac

SEQ ID NO: 171822 - DNA, 75 bp, Artificial Sequence
  Synthetic
ggtggccgtgcccgacgacagctcgtggccgcgctatcgatgcctgtccttcgatatcgagtgcatgagcggcga

SEQ ID NO: 171823 - DNA, 75 bp, Artificial Sequence
  Synthetic
tggccgcgctatcgatgcctgtccttcgatatcgagtgcatgagcggcgagggtggttttccctgcgccgagaag

SEQ ID NO: 171824 - DNA, 75 bp, Artificial Sequence
  Synthetic
caacgtggcacattgaaaaacatggggttgaacgtggtgaaattgccgcagccttgttcgccagtatcattacgt

SEQ ID NO: 171825 - DNA, 75 bp, Artificial Sequence
  Synthetic
taattacattcttcctgtattacgcagcgagcagttatttgagcctgtaatataacgcattaccaatatgaaaag

SEQ ID NO: 171826 - DNA, 75 bp, Artificial Sequence
  Synthetic
atgcatctctgtgcttacctaatgacacttggaaaatgcttacagcgagaacaagacatacaaataacgtggagg

SEQ ID NO: 171827 - DNA, 75 bp, Artificial Sequence
  Synthetic
ccaaacgggaacgatggtcggggctgcacttcggagggtgtgatctttgggcactcgggtcttcatctctttacg

SEQ ID NO: 171828 - DNA, 75 bp, Artificial Sequence
  Synthetic
gcacttcggagggtgtgatctttgggcactcgggtcttcatctctttacgatcggcacctgcgggcaggtgggcc

SEQ ID NO: 171829 - DNA, 75 bp, Artificial Sequence
  Synthetic
acaagacatacaaataacgtggagggggatggggtcagttacaggaatagtatgtgttgcggtactgaccatcgt

SEQ ID NO: 171830 - DNA, 75 bp, Artificial Sequence
  Synthetic
taattggatgtctattatgtatcaccggcgttgttataacattgtaaaaaagaattatcggaaataatggcaggt

SEQ ID NO: 171831 - DNA, 75 bp, Artificial Sequence
  Synthetic
cgccggcctttgtgaccggttacaacatcaactcttttgacttgaagtacatcctcacgcgtctcgagtacctgt

SEQ ID NO: 171832 - DNA, 75 bp, Artificial Sequence
  Synthetic
catcaactcttttgacttgaagtacatcctcacgcgtctcgagtacctgtataaggtggactcgcagcgcttctg

SEQ ID NO: 171833 - DNA, 75 bp, Artificial Sequence
  Synthetic
cgcttttccctcggcttctcacaacaatccggccagcacggccgccaccaaggtgtatattgcgggttcggtggt

SEQ ID NO: 171834 - DNA, 75 bp, Artificial Sequence
  Synthetic
aatccggccagcacggccgccaccaaggtgtatattgcgggttcggtggttatcgacatgtaccctgtatgcatg

SEQ ID NO: 171835 - DNA, 75 bp, Artificial Sequence
  Synthetic
tcttacaaggacatcccgcgttgtttcgtggctaatgccgagggccgcgcccaggtaggccgttactgtctgcag

SEQ ID NO: 171836 - DNA, 75 bp, Artificial Sequence
  Synthetic
tcgtggctaatgccgagggccgcgcccaggtaggccgttactgtctgcaggacgccgtattggtgcgcgatctgt

SEQ ID NO: 171837 - DNA, 75 bp, Artificial Sequence
  Synthetic
ttgacggacagcagatccgtatctacacctcgctgctggacgagtgcgcctgccgcgattttatcctgcccaacc

SEQ ID NO: 171838 - DNA, 75 bp, Artificial Sequence
  Synthetic
cacctcgctgctggacgagtgcgcctgccgcgattttatcctgcccaaccactacagcaaaggtacgacggtgcc

SEQ ID NO: 171839 - DNA, 75 bp, Artificial Sequence
  Synthetic
tgtggcggctatgtttcagatgtcgccgcccttgcaatctgcgccgtccagtcaggacggcgtttcacccggctc

SEQ ID NO: 171840 - DNA, 75 bp, Artificial Sequence
  Synthetic
cggtagtaacagtagtagcagcgtcggcgttttcagcgtcggctccggcagtagtggcggcgtcggcgtttccaa

SEQ ID NO: 171841 - DNA, 75 bp, Artificial Sequence
  Synthetic
cggtgtttgagcccgaggtgggttactacaacgaccccgtggccgtgttcgactttgccagcctctacccttcca

SEQ ID NO: 171842 - DNA, 75 bp, Artificial Sequence
  Synthetic
ctacaacgaccccgtggccgtgttcgactttgccagcctctacccttccatcatcatggctcacaacctctgcta

SEQ ID NO: 171843 - DNA, 75 bp, Artificial Sequence
  Synthetic
cgtgacacaccgctttgtgcgtgcttcggtgcgcgtctcggtgctttcggaactgctcaacaagtgggtttcgca

SEQ ID NO: 171844 - DNA, 75 bp, Artificial Sequence
  Synthetic
tcggtgcgcgtctcggtgctttcggaactgctcaacaagtgggtttcgcagcggcgtgccgtgcgcgaatgcatg

SEQ ID NO: 171845 - DNA, 75 bp, Artificial Sequence
  Synthetic
ttctacggttttaccggcgtggtcaacggcatgatgccgtgtctgcccatcgccgccagcattacgcgcatcggt

SEQ ID NO: 171846 - DNA, 75 bp, Artificial Sequence
  Synthetic
accgtgtcctaaagaacgcacgtgaagttccacagagccgcgtggctgtagctattgtgtttacgttgcttttga

SEQ ID NO: 171847 - DNA, 75 bp, Artificial Sequence
  Synthetic
cgccccgaaaagcgaagcgccgcgcaaaagcttagtagaaactccgtgcaaacacccgccgcgaaagccctccga

SEQ ID NO: 171848 - DNA, 75 bp, Artificial Sequence
  Synthetic
cgcgacatgctagagcgcacggcgcggttcatcaaagacaacttttcagagccgtgttttttgcacaattttttt

SEQ ID NO: 171849 - DNA, 75 bp, Artificial Sequence
  Synthetic
acatcatcagggggcttggacgaacggcgggtggaggcgcgggtcatctacggggacacggacagcgtgtttgtc

SEQ ID NO: 171850 - DNA, 75 bp, Artificial Sequence
  Synthetic
ggcgggtggaggcgcgggtcatctacggggacacggacagcgtgtttgtccgctttcgtggcctgacgccgcagg

SEQ ID NO: 171851 - DNA, 75 bp, Artificial Sequence
  Synthetic
ttgaaaaggtcttcgtctctcttatgatgatctgcaagaaacgttacatcggcaaagtggagggcgcctcgggtc

SEQ ID NO: 171852 - DNA, 75 bp, Artificial Sequence
  Synthetic
gatgatctgcaagaaacgttacatcggcaaagtggagggcgcctcgggtctgagcatgaagggcgtggatctggt

SEQ ID NO: 171853 - DNA, 75 bp, Artificial Sequence
  Synthetic
ctcggaagcagccgtgcgcctgtcgcgcctctcactcgatgaagtcaagaaatacggcgtgccacgcggtttctg

SEQ ID NO: 171854 - DNA, 75 bp, Artificial Sequence
  Synthetic
cgcctctcactcgatgaagtcaagaaatacggcgtgccacgcggtttctggcgtatcttgcgccgcctggtgcag

SEQ ID NO: 171855 - DNA, 75 bp, Artificial Sequence
  Synthetic
ttcgtgtgtccccagggacccgcgtgtctgcgtgtgtggttgtgcagtgtgcccggggcccgcgactcccccccc

SEQ ID NO: 171856 - DNA, 75 bp, Artificial Sequence
  Synthetic
agaagaaggagaggaaccaacccccgacggccctccggccccgcggccgcgaccgaggggcggggggcgcggcga

SEQ ID NO: 171857 - DNA, 75 bp, Artificial Sequence
  Synthetic
tgtcagattgctgaccgaggaaaccgtggtgggagtggtgacggtgttactcgtggttgaagtgacgttagggga

SEQ ID NO: 171858 - DNA, 75 bp, Artificial Sequence
  Synthetic
tcgttgtaccgtcaatctaacctgccgcacattgccgtcattaagcgactggcggcccgttctgaggagctaccc

SEQ ID NO: 171859 - DNA, 75 bp, Artificial Sequence
  Synthetic
cgcacattgccgtcattaagcgactggcggcccgttctgaggagctaccctcggtcggggatcgggtcttttacg

SEQ ID NO: 171860 - DNA, 75 bp, Artificial Sequence
  Synthetic
gcgcacgtcgcttttattcgccgtcgccgtcctccgcgaccgccgtccccaccgcaccacacgcaactagtcgcc

SEQ ID NO: 171861 - DNA, 75 bp, Artificial Sequence
  Synthetic
tttcccggtcggacgcgattgatggcacggacgacgacgctgacggcggcggggtagaggagagcaacaggagag

SEQ ID NO: 171862 - DNA, 75 bp, Artificial Sequence
  Synthetic
gtcgccgtccacacacgcaactccaaatttcacccccccccgctaaaaacacccccccgcccctcggggacccac

SEQ ID NO: 171863 - DNA, 75 bp, Artificial Sequence
  Synthetic
cacggacgacgacgctgacggcggcggggtagaggagagcaacaggagaggaggagagccggcaaagaagagggc

SEQ ID NO: 171864 - DNA, 75 bp, Artificial Sequence
  Synthetic
ccgtcctcgccgcaaacacccccgccacctccgtccccaacgtaatccccgtccccgcaacaccccgtccccgca

SEQ ID NO: 171865 - DNA, 75 bp, Artificial Sequence
  Synthetic
cattcacgccgataagtactttgagcaggttctcaaggctgtaaccaacgtgctgtcgcccgtctttcccggcgg

SEQ ID NO: 171866 - DNA, 75 bp, Artificial Sequence
  Synthetic
caggttctcaaggctgtaaccaacgtgctgtcgcccgtctttcccggcggcgaaaccgcgcgcaaggacaagttt

SEQ ID NO: 171867 - DNA, 75 bp, Artificial Sequence
  Synthetic
gacacccgtagagacatccctcagcgcggtgaaaccccgtccccagcgccgtgccgctgacaaagaccgtgggac

SEQ ID NO: 171868 - DNA, 75 bp, Artificial Sequence
  Synthetic
gcggtgaaaccccgtccccagcgccgtgccgctgacaaagaccgtgggacaccgcgtggcgtactgccgaaatgc

SEQ ID NO: 171869 - DNA, 75 bp, Artificial Sequence
  Synthetic
aacgcccgggggcgagggacgacggccagagacaagacgcggaaaagaggaagtccccaggaggacggccgcgcg

SEQ ID NO: 171870 - DNA, 75 bp, Artificial Sequence
  Synthetic
gtgccgctgacaaagaccgtgggacaccgcgtggcgtactgccgaaatgcagaacgcgccggccgcaacacgccg

SEQ ID NO: 171871 - DNA, 75 bp, Artificial Sequence
  Synthetic
tgttgagaaacagcggcggcggtggtgactggggacggtgatgatgctgctgagactgagactggtggtgagagt

SEQ ID NO: 171872 - DNA, 75 bp, Artificial Sequence
  Synthetic
tgactggggacggtgatgatgctgctgagactgagactggtggtgagagtagtggtggggctgcgtcgcctgcga

SEQ ID NO: 171873 - DNA, 75 bp, Artificial Sequence
  Synthetic
cggcgacgcggttaagggagaccgtatcgcgtaggacgacgtggcctcctcgtataggttgctgccgctggactg

SEQ ID NO: 171874 - DNA, 75 bp, Artificial Sequence
  Synthetic
caaatctcccgcagtctggtcccgcgaacaaataccgtgggaggaaacgcaccggcagtgcgcacaaaggcacgc

SEQ ID NO: 171875 - DNA, 75 bp, Artificial Sequence
  Synthetic
atcgcgtaggacgacgtggcctcctcgtataggttgctgccgctggactgacacagctcctgaatgagctctttg

SEQ ID NO: 171876 - DNA, 75 bp, Artificial Sequence
  Synthetic
ccattccgggccgtgtgctgggtccccgaggggcgggggggtgttttttgcggggggggggtgaaaattggagtt

SEQ ID NO: 171877 - DNA, 75 bp, Artificial Sequence
  Synthetic
atcttgacgctgctggccgagacggcgtgacacagcacgctgataacgacgtggtcgcgcacgatgttgagcgtg

SEQ ID NO: 171878 - DNA, 75 bp, Artificial Sequence
  Synthetic
cgtgacacagcacgctgataacgacgtggtcgcgcacgatgttgagcgtgacgctgtagtcttcgcgcgccgccg

SEQ ID NO: 171879 - DNA, 75 bp, Artificial Sequence
  Synthetic
cgtcctcggcgtgcataaagggcacgatgtcgtggttggcggcgtgcagcaggtaataaatttggaagatgggcg

SEQ ID NO: 171880 - DNA, 75 bp, Artificial Sequence
  Synthetic
gatgtcgtggttggcggcgtgcagcaggtaataaatttggaagatgggcggctggttggtggagagcttgagtag

SEQ ID NO: 171881 - DNA, 75 bp, Artificial Sequence
  Synthetic
catggcgtcggaggcggtgggcaggatgcggttgtcctcgcacgaggtgcaggcgatgcgcgagacctgctcgtt

SEQ ID NO: 171882 - DNA, 75 bp, Artificial Sequence
  Synthetic
gccgcgcgcttcctcttttccgcgcgcggccgtccccctggggacttcctcttttccgcgtcttttccgcgtctc

SEQ ID NO: 171883 - DNA, 75 bp, Artificial Sequence
  Synthetic
ccgcggtcccctagggacgagtcgcgccgcgcgcttcctcttttccgcgcgcggccgtccccctggggacttcct

SEQ ID NO: 171884 - DNA, 75 bp, Artificial Sequence
  Synthetic
atgcggttgtcctcgcacgaggtgcaggcgatgcgcgagacctgctcgttgccgtacggcgagatgtcgaggcag

SEQ ID NO: 171885 - DNA, 75 bp, Artificial Sequence
  Synthetic
ccggtgcgggacagggctgagggagttttgcgcgacgtaagctcgccgcgctggtcacgggctgtccgcgcgctc

SEQ ID NO: 171886 - DNA, 75 bp, Artificial Sequence
  Synthetic
ttgaggtacttgagctccagttcggggtgctcgcggaagatgtcgtgcaggtcgtgcagcgtgaggcgcgggcgc

SEQ ID NO: 171887 - DNA, 75 bp, Artificial Sequence
  Synthetic
ggtgctcgcggaagatgtcgtgcaggtcgtgcagcgtgaggcgcgggcgcgcgtcggccggcgacggcggttcgc

SEQ ID NO: 171888 - DNA, 75 bp, Artificial Sequence
  Synthetic
ggagcagggagcgcaaggccgagcgtcgttcgcgcggcgtgcgcacgccgctcacgctagacatacttgtctatc

SEQ ID NO: 171889 - DNA, 75 bp, Artificial Sequence
  Synthetic
tcgttcgcgcggcgtgcgcacgccgctcacgctagacatacttgtctatcacgtacgtggggtccaccagcttga

SEQ ID NO: 171890 - DNA, 75 bp, Artificial Sequence
  Synthetic
cgtactggggacggggggtgtgcggggacgggggccttttgcggcggggacagggggggtgcggggacggtggtg

SEQ ID NO: 171891 - DNA, 75 bp, Artificial Sequence
  Synthetic
ttgtaatctgaaaggccttgaagagtgtgatgcagagccacacacgtcgcggaagtcgacttatatagtaattgt

SEQ ID NO: 171892 - DNA, 75 bp, Artificial Sequence
  Synthetic
ctgcgcggcgccaaggcggcgccagcaagcgccgtgcacgtcgctgcctataaaagccaggtgcgtgtcggccgt

SEQ ID NO: 171893 - DNA, 75 bp, Artificial Sequence
  Synthetic
cgttgtcagtgacgtttgtttcttcccaacgtacgtatgattcgaacggactcgtgtgcgctattgcccgcaaca

SEQ ID NO: 171894 - DNA, 75 bp, Artificial Sequence
  Synthetic
ttttgcggcggggacactggtggggacggagacacagggtgacgtcggggacgggggccttttgcggcagggacg

SEQ ID NO: 171895 - DNA, 75 bp, Artificial Sequence
  Synthetic
tgtgatgcagagccacacacgtcgcggaagtcgacttatatagtaattgtcgtgacagatggccagtttcacctc

SEQ ID NO: 171896 - DNA, 75 bp, Artificial Sequence
  Synthetic
gtcgcagaaaaagtgcttgtagatgcccgtgacgcctgcctgacgcaggacgtggcaaaataccgggtcgggtcg

SEQ ID NO: 171897 - DNA, 75 bp, Artificial Sequence
  Synthetic
cccgtgacgcctgcctgacgcaggacgtggcaaaataccgggtcgggtcgcgccagtgcgccgtcgacgccgctc

SEQ ID NO: 171898 - DNA, 75 bp, Artificial Sequence
  Synthetic
gcgccgagcggcgacgtgcattcgcgcaacagatcggccaataccagctgaatgcggtccaccatcttcacattg

SEQ ID NO: 171899 - DNA, 75 bp, Artificial Sequence
  Synthetic
gcaacagatcggccaataccagctgaatgcggtccaccatcttcacattgttctgacaatacgagacgacgcggc

SEQ ID NO: 171900 - DNA, 75 bp, Artificial Sequence
  Synthetic
tttggttcttggtaaaaaaagcgggtacgggacataggtaaatgggacccacgtttttttttagcgtgctctcgc

SEQ ID NO: 171901 - DNA, 75 bp, Artificial Sequence
  Synthetic
tacgggacataggtaaatgggacccacgtttttttttagcgtgctctcgctgaaccccccgctggtgacaccgcc

SEQ ID NO: 171902 - DNA, 75 bp, Artificial Sequence
  Synthetic
gtcttctctttccgaggccgtggataacgcgtctagtcgcgcgaacttagtgtgcgtgagttccgtgagtggcgt

SEQ ID NO: 171903 - DNA, 75 bp, Artificial Sequence
  Synthetic
aacgcgtctagtcgcgcgaacttagtgtgcgtgagttccgtgagtggcgtggtgctcatgacgccggtgccggcc

SEQ ID NO: 171904 - DNA, 75 bp, Artificial Sequence
  Synthetic
tgcggcacttcgacgtgataagggttgtttttttgcttctgttgcgggtggcgccgaggcttgttgtaaggcacc

SEQ ID NO: 171905 - DNA, 75 bp, Artificial Sequence
  Synthetic
tgtttttttgcttctgttgcgggtggcgccgaggcttgttgtaaggcaccgtgtcttcgcccatgaccatggccc

SEQ ID NO: 171906 - DNA, 75 bp, Artificial Sequence
  Synthetic
tgatgaaaaagtgcaggtggaaatcgaagaccgtgagaacgtggtgtcggaacaggtcgtcgatgcgcagatcgg

SEQ ID NO: 171907 - DNA, 75 bp, Artificial Sequence
  Synthetic
gaagaccgtgagaacgtggtgtcggaacaggtcgtcgatgcgcagatcggaaaagtgctgctgcagcagatgcgt

SEQ ID NO: 171908 - DNA, 75 bp, Artificial Sequence
  Synthetic
ctcgaggagccagctctggtcgcagtcctgtttgaggcagatgctgatgatggcgcataggttacagcgcgtgtc

SEQ ID NO: 171909 - DNA, 75 bp, Artificial Sequence
  Synthetic
tcctgtttgaggcagatgctgatgatggcgcataggttacagcgcgtgtcgatggccagcggcgcgcacagtcgc

SEQ ID NO: 171910 - DNA, 75 bp, Artificial Sequence
  Synthetic
ctaaaaaacccggacagaaacctacatcgccgcgactaagaaccacgccaaagaaacatacgcaaaacaaaagat

SEQ ID NO: 171911 - DNA, 75 bp, Artificial Sequence
  Synthetic
ccggcgggtcctgcgttgctactgccggcgacggctccgccgcagctagtggtgttggtcgcattggtgagtacg

SEQ ID NO: 171912 - DNA, 75 bp, Artificial Sequence
  Synthetic
cggcgacggctccgccgcagctagtggtgttggtcgcattggtgagtacggtggattgcgttccgccgcacgtgg

SEQ ID NO: 171913 - DNA, 75 bp, Artificial Sequence
  Synthetic
ggtaacggttagcggggtgttgaggattcacctggtatgaggcggccgccgcggcggccagcgcttcgtccatag

SEQ ID NO: 171914 - DNA, 75 bp, Artificial Sequence
  Synthetic
attcacctggtatgaggcggccgccgcggcggccagcgcttcgtccataggtacttgacgcgggtgcgcgtgcca

SEQ ID NO: 171915 - DNA, 75 bp, Artificial Sequence
  Synthetic
tcgttgcggactgcacaaggtagcggcggtgacggagctggtggacggggccgggctggtcgggggaagaaacgt

SEQ ID NO: 171916 - DNA, 75 bp, Artificial Sequence
  Synthetic
gcggtgacggagctggtggacggggccgggctggtcgggggaagaaacgtggtgtggggcccgtgagggggagtc

SEQ ID NO: 171917 - DNA, 75 bp, Artificial Sequence
  Synthetic
atgtcctgggctaagcagcgggtgccgtttctggacgatgacgacggagaggaggaaaacgacgtgaaggatgac

SEQ ID NO: 171918 - DNA, 75 bp, Artificial Sequence
  Synthetic
cgtttctggacgatgacgacggagaggaggaaaacgacgtgaaggatgacgtggattctccggtgccgacgcgac

SEQ ID NO: 171919 - DNA, 75 bp, Artificial Sequence
  Synthetic
aggacggtgaagacgggcacgcgctacccgatcttgacgacgatctgctattacagttcgagccgatgctgccgc

SEQ ID NO: 171920 - DNA, 75 bp, Artificial Sequence
  Synthetic
acccgatcttgacgacgatctgctattacagttcgagccgatgctgccgcgcgtctacgatctgttgctgccctc

SEQ ID NO: 171921 - DNA, 75 bp, Artificial Sequence
  Synthetic
cgcgacctgcagtcacggagagatcctccgtgagaagacgcaactattaacggcgatcgtcagcaagctcatgga

SEQ ID NO: 171922 - DNA, 75 bp, Artificial Sequence
  Synthetic
ctccgtgagaagacgcaactattaacggcgatcgtcagcaagctcatggacattaacggaatcctggagggaaaa

SEQ ID NO: 171923 - DNA, 75 bp, Artificial Sequence
  Synthetic
tcttatttttttattttatgcgtgttctcacctcttcatctttctaacaccggggtaactatcgtaagtcggtag

SEQ ID NO: 171924 - DNA, 75 bp, Artificial Sequence
  Synthetic
cgccaaagtcgtctatcgccatcccccgtaaacgatataagcgctatcgccagatatcgcgtatgcccaaaaatc

SEQ ID NO: 171925 - DNA, 75 bp, Artificial Sequence
  Synthetic
ctggtgcaggccacgcggcgtatcctcaagttgggtcccagcgagctgcgcgtcaccgacgccggccttatctgt

SEQ ID NO: 171926 - DNA, 75 bp, Artificial Sequence
  Synthetic
tcaagttgggtcccagcgagctgcgcgtcaccgacgccggccttatctgtaaaaatcccaattactcggtgtgcg

SEQ ID NO: 171927 - DNA, 75 bp, Artificial Sequence
  Synthetic
tgccttgttttatctttaaaaacactggctgcgccgtctccctctgctgttttgtgcgagcgcccatcaagctcg

SEQ ID NO: 171928 - DNA, 75 bp, Artificial Sequence
  Synthetic
tggctgcgccgtctccctctgctgttttgtgcgagcgcccatcaagctcgtctcgccggcgcgccacgtaggtga

SEQ ID NO: 171929 - DNA, 75 bp, Artificial Sequence
  Synthetic
cggagtgctgacgaagtgcgtggtgcgcaaatccaattcggcgtcggtcttcaacatcgagctcatcgccttcgg

SEQ ID NO: 171930 - DNA, 75 bp, Artificial Sequence
  Synthetic
cgcaaatccaattcggcgtcggtcttcaacatcgagctcatcgccttcggacccgaaaacgagggcgagtacgag

SEQ ID NO: 171931 - DNA, 75 bp, Artificial Sequence
  Synthetic
agtcacagcggcagcggtccgtccctgtggcgcgcccgtatgtcggccgcgctcacgcgaacggcgggaaagcgg

SEQ ID NO: 171932 - DNA, 75 bp, Artificial Sequence
  Synthetic
tgtggcgcgcccgtatgtcggccgcgctcacgcgaacggcgggaaagcggtcctctcggaccgcatctccccctc

SEQ ID NO: 171933 - DNA, 75 bp, Artificial Sequence
  Synthetic
cgccgccacccatggcggcggggtcgtggcggctgtgtcgttgcgaggcctgtatgggacgatgcggatgcgcaa

SEQ ID NO: 171934 - DNA, 75 bp, Artificial Sequence
  Synthetic
gtggcggctgtgtcgttgcgaggcctgtatgggacgatgcggatgcgcaagcgagggagacgctgatgaagagga

SEQ ID NO: 171935 - DNA, 75 bp, Artificial Sequence
  Synthetic
gcgtcggcctctggaggagcacgtgagtcgtcggcgaggggtgtcgacccatcaccgtcatccgccgtctccgcc

SEQ ID NO: 171936 - DNA, 75 bp, Artificial Sequence
  Synthetic
agtcgtcggcgaggggtgtcgacccatcaccgtcatccgccgtctccgccgtgcgcgccgtccttggagcggact

SEQ ID NO: 171937 - DNA, 75 bp, Artificial Sequence
  Synthetic
cccgcgcgctttgcgactctgggcccgctggtgctggctcttctgctggtgctggctctgctgtggcgcggtcat

SEQ ID NO: 171938 - DNA, 75 bp, Artificial Sequence
  Synthetic
cgctggtgctggctcttctgctggtgctggctctgctgtggcgcggtcatggccagtcgtcgtctccgacacgct

SEQ ID NO: 171939 - DNA, 75 bp, Artificial Sequence
  Synthetic
ttccatgtgcagctggtgatcggccgcggtgcgctgcagccggaggaagcggcggtagaaacgtcgcagccaccg

SEQ ID NO: 171940 - DNA, 75 bp, Artificial Sequence
  Synthetic
gcggtgcgctgcagccggaggaagcggcggtagaaacgtcgcagccaccggcgcagtttgcggcgcagacgtcgg

SEQ ID NO: 171941 - DNA, 75 bp, Artificial Sequence
  Synthetic
gtgcagcgttgcgcatggaagcgaggggataaagacgttaataaagaataggggctgttctgatagggccaccgc

SEQ ID NO: 171942 - DNA, 75 bp, Artificial Sequence
  Synthetic
ttctgaatcgcgagctgggcgaccgtctctaccaacgcttcctgcgcgaatggctggtgtgtcggcaagccgagc

SEQ ID NO: 171943 - DNA, 75 bp, Artificial Sequence
  Synthetic
tgaagcgagccgcgtgtgcgtgtggtttgtggagtccccgtcctcaacgtaacccccgtccccgcacacccccgc

SEQ ID NO: 171944 - DNA, 75 bp, Artificial Sequence
  Synthetic
tctctaccaacgcttcctgcgcgaatggctggtgtgtcggcaagccgagcgggaggcggtgacggcgctctttca

SEQ ID NO: 171945 - DNA, 75 bp, Artificial Sequence
  Synthetic
tttgtggagtccccgtcctcaacgtaacccccgtccccgcacacccccgcgaccgccggtcccgcgagtccccgt

SEQ ID NO: 171946 - DNA, 75 bp, Artificial Sequence
  Synthetic
cgtccgcacgatggcctttctgcgtttcgaacgctacgacgccgactacctgctgcgccgtctgcggctctaccc

SEQ ID NO: 171947 - DNA, 75 bp, Artificial Sequence
  Synthetic
gcccgagcggctgcacgcgttgttggacggtgtcaccgcctcgctgctaggtgaccttcaccgtttccttttcgg

SEQ ID NO: 171948 - DNA, 75 bp, Artificial Sequence
  Synthetic
cccgcaccggcgtggggttgggtgtgtctggggcgcggctgggtgggtgcgtgcgtggggcgggtgtgccgggtg

SEQ ID NO: 171949 - DNA, 75 bp, Artificial Sequence
  Synthetic
cgcccgcgctgatttggccgtataccaccgtaaccagtggcgtcaccaacggcagccgcggtcgccgcagctgcg

SEQ ID NO: 171950 - DNA, 75 bp, Artificial Sequence
  Synthetic
gggcctcatcgcagccttgcgccggcacgccgggcaggtaccctgcggaaacccgctctacgtactggcccgaca

SEQ ID NO: 171951 - DNA, 75 bp, Artificial Sequence
  Synthetic
ctctccttaccgggcccaacggagttactcgcacagccatcgggggtctgcattcaaactacaccaacttaaccg

SEQ ID NO: 171952 - DNA, 75 bp, Artificial Sequence
  Synthetic
gggtgtgtcgcgggcgcgtgtcgggcgtgtggcgggtgtgtcgcgggtgtgtcaggggtgtgtcggcggtgtgcg

SEQ ID NO: 171953 - DNA, 75 bp, Artificial Sequence
  Synthetic
tgtccgcgatacctggtgccgttgcgggcactgggtctgcacgacgagacgcgcggaggaggctcgacggcggca

SEQ ID NO: 171954 - DNA, 75 bp, Artificial Sequence
  Synthetic
gggcactgggtctgcacgacgagacgcgcggaggaggctcgacggcggcagctgcggcggtaggacacgcgggcg

SEQ ID NO: 171955 - DNA, 75 bp, Artificial Sequence
  Synthetic
tcttttccgcgtcgtttccgcgtcgctggcagcagtgtgccccggggcccgcgagtctcccccccctcccttggg

SEQ ID NO: 171956 - DNA, 75 bp, Artificial Sequence
  Synthetic
tcatcggcagcgtcatcgacctgccgctctggtgtctgtgtcgactcaagtgcgagcgccatctggacgcgcgct

SEQ ID NO: 171957 - DNA, 75 bp, Artificial Sequence
  Synthetic
gctctggtgtctgtgtcgactcaagtgcgagcgccatctggacgcgcgctcgctggtggccgtggtctgtcggca

SEQ ID NO: 171958 - DNA, 75 bp, Artificial Sequence
  Synthetic
gtcgtcccctggggacttcctcttttccccggggaatcacagacagacacagacacgcgtcttcttttcgccgtg

SEQ ID NO: 171959 - DNA, 75 bp, Artificial Sequence
  Synthetic
ttatcgggaccgtcaagaaaagagcgtcatcttcaacacgcacgccgagctcgtgcactgctcgctctgcggcag

SEQ ID NO: 171960 - DNA, 75 bp, Artificial Sequence
  Synthetic
gtcatcttcaacacgcacgccgagctcgtgcactgctcgctctgcggcagtcagcgggtggtgcggcagcgcgtc

SEQ ID NO: 171961 - DNA, 75 bp, Artificial Sequence
  Synthetic
tcgcacggcctgtggtgcgactgcggcgactggcgagagcacctctattgtgtgtacgacagccattttcagcga

SEQ ID NO: 171962 - DNA, 75 bp, Artificial Sequence
  Synthetic
gcggcttgtgccgtgtacgatcaccggctggctttcgacgtcattctgccctgcgcggcacgcacctgcgactcc

SEQ ID NO: 171963 - DNA, 75 bp, Artificial Sequence
  Synthetic
ggctggctttcgacgtcattctgccctgcgcggcacgcacctgcgactccactgtggtggtacgcgacgtgacgg

SEQ ID NO: 171964 - DNA, 75 bp, Artificial Sequence
  Synthetic
acgtcgctgcctataaaagccaggtgcgtgtcggccgtggcacacggacaacgcagacgtccccgtgtgtaaacg

SEQ ID NO: 171965 - DNA, 75 bp, Artificial Sequence
  Synthetic
cgaaaaacggtactgcaggatgaaagtcccgttgggggggggggggcagatagtagtcgctgttgccgctgggcg

SEQ ID NO: 171966 - DNA, 75 bp, Artificial Sequence
  Synthetic
acagctgtttggaaagcgaggacggcgccccgctgtgtcggggctgcgcgctggttaaacagaccgcctgccacg

SEQ ID NO: 171967 - DNA, 75 bp, Artificial Sequence
  Synthetic
cgccccgctgtgtcggggctgcgcgctggttaaacagaccgcctgccacgtcggcggccacattgtgcagcaggc

SEQ ID NO: 171968 - DNA, 75 bp, Artificial Sequence
  Synthetic
ccacggtggccaacaagcgggacgaaaaacaccgtcacgtcgtcaacgtcgttttggagctgccgaccgagatat

SEQ ID NO: 171969 - DNA, 75 bp, Artificial Sequence
  Synthetic
gcgcctttaagctggacctgttgcgcatggtagccgtgtcgcgcacccggcgctgacagcccaaggggaaaagga

SEQ ID NO: 171970 - DNA, 75 bp, Artificial Sequence
  Synthetic
ctaggtggacgcccgacatccattccgggccgtgtgctgggtccccgaggggcgggggggtgtttttagcggggg

SEQ ID NO: 171971 - DNA, 75 bp, Artificial Sequence
  Synthetic
tattacccgctactgtcagtgtcggttacaaaagatagagaaaccgcatgtgttgaatagtgtcctgtacggatt

SEQ ID NO: 171972 - DNA, 75 bp, Artificial Sequence
  Synthetic
gcgccagttgtcgcaggtccaatcgcactagccgcagtatttctagagcactgaggacgttctgcgtgagcaccg

SEQ ID NO: 171973 - DNA, 75 bp, Artificial Sequence
  Synthetic
tttctcccaatcggttttcttgaaagacggacccgccaaaggcggtagagactaatgcagagtcggctgtccttg

SEQ ID NO: 171974 - DNA, 75 bp, Artificial Sequence
  Synthetic
gacggacccgccaaaggcggtagagactaatgcagagtcggctgtccttgatgtatcgtcttgtacgtgatctat

SEQ ID NO: 171975 - DNA, 75 bp, Artificial Sequence
  Synthetic
tggcgggttttcacgcaggaactgaatattgactggcacgcggttgaaaggtaccggcggtgttggagcggcgcc

SEQ ID NO: 171976 - DNA, 75 bp, Artificial Sequence
  Synthetic
atattgactggcacgcggttgaaaggtaccggcggtgttggagcggcgccagacgcagcgacgttgtccgcggat

SEQ ID NO: 171977 - DNA, 75 bp, Artificial Sequence
  Synthetic
aacgtggagggcggtcgcagcacgcgtacgacggtgtggtcctgtgcgttgtaaatgactaggggaataaactct

SEQ ID NO: 171978 - DNA, 75 bp, Artificial Sequence
  Synthetic
gtacgacggtgtggtcctgtgcgttgtaaatgactaggggaataaactctaagcgggtggggaaacgcaggtaat

SEQ ID NO: 171979 - DNA, 75 bp, Artificial Sequence
  Synthetic
gactgagattgagatcccgggagcgttggatgcggaggaagtcgcggtctcgcgacgtgtattcgaggtggcgcg

SEQ ID NO: 171980 - DNA, 75 bp, Artificial Sequence
  Synthetic
ctactagtatacgttggcctttcagcaggtcggctacatgcacgccgagacacacgggtatgccgaaaagccagg

SEQ ID NO: 171981 - DNA, 75 bp, Artificial Sequence
  Synthetic
gcaggaaggttggtggcagtggccgttggataccttacgtgtatgtattggtacatttgcaaacagtggagtgtg

SEQ ID NO: 171982 - DNA, 75 bp, Artificial Sequence
  Synthetic
tgtctgtggtggttgtgtcctgacgtcgcacgcggatcatctgaagcaccggctctccggtggggagctgcggtt

SEQ ID NO: 171983 - DNA, 75 bp, Artificial Sequence
  Synthetic
tcgcacgcggatcatctgaagcaccggctctccggtggggagctgcggttgcgtgtacccctcggtcaccatttc

SEQ ID NO: 171984 - DNA, 75 bp, Artificial Sequence
  Synthetic
tttcagttctagccacagacactgcagcatgtcttgtggaaagaccagcgtggccatggcgtagagccatagctt

SEQ ID NO: 171985 - DNA, 75 bp, Artificial Sequence
  Synthetic
agcatgtcttgtggaaagaccagcgtggccatggcgtagagccatagcttgcctaggggcggtgtgcttttttgc

SEQ ID NO: 171986 - DNA, 75 bp, Artificial Sequence
  Synthetic
aaaaaaagtatgtgctcccgacccacggtctgcgtgtctcttttttatgtctatgtctccaagtctggtgcgggt

SEQ ID NO: 171987 - DNA, 75 bp, Artificial Sequence
  Synthetic
gtgggggtgatacagaaagccttgacctgttcggggaggtggtcggggggcattttgtgtgtgttattgactacc

SEQ ID NO: 171988 - DNA, 75 bp, Artificial Sequence
  Synthetic
cattttgtgtgtgttattgactaccgcgtgtattacatcctgatgtaggtgagctgtgagggagggtagcgacat

SEQ ID NO: 171989 - DNA, 75 bp, Artificial Sequence
  Synthetic
actcaggcgcagtacggtgccgcggcccggtctctgttcccctacgtcaccaccctcgccgcttcctacgcgatc

SEQ ID NO: 171990 - DNA, 75 bp, Artificial Sequence
  Synthetic
cccggtctctgttcccctacgtcaccaccctcgccgcttcctacgcgatcggcggccgtcagctcctgctgcgtg

SEQ ID NO: 171991 - DNA, 75 bp, Artificial Sequence
  Synthetic
gggtgcgtgtggctctgatgctgcgtgaggtagggtcgtaggtcgtactgcgagatctgcggccagaaagtgcgc

SEQ ID NO: 171992 - DNA, 75 bp, Artificial Sequence
  Synthetic
accgcccgatcggagcacgcagcgcgcctcggaatactctactcggtactccgaaacatcgggcagaggcggtaa

SEQ ID NO: 171993 - DNA, 75 bp, Artificial Sequence
  Synthetic
tgaggtagggtcgtaggtcgtactgcgagatctgcggccagaaagtgcgcaatgtctgacagacggccacggcta

SEQ ID NO: 171994 - DNA, 75 bp, Artificial Sequence
  Synthetic
gccggccatcgtctcgcagcgccaagtacttaaaggctacgttgccgtaatcggtgaccaggtgaatgggttcgc

SEQ ID NO: 171995 - DNA, 75 bp, Artificial Sequence
  Synthetic
tcggtgaccaggtgaatgggttcgccggcctgcgtgacgatttgccgcatgccgaagacgtctaccacttcaagg

SEQ ID NO: 171996 - DNA, 75 bp, Artificial Sequence
  Synthetic
gttggcggaagcacgctaggaatgtcttccagcctatagactagcgatgagccgttgagcttgttgagcagatac

SEQ ID NO: 171997 - DNA, 75 bp, Artificial Sequence
  Synthetic
gccgttgagcttgttgagcagatactggtgacccagctggacgtgtcgttccagcgcgttcaacccgcgtgtaaa

SEQ ID NO: 171998 - DNA, 75 bp, Artificial Sequence
  Synthetic
tcgcttggctagttccgcaaaacgagtccgcagatcgcggatcttttccaactgcgaccgaaagtccagcccgta

SEQ ID NO: 171999 - DNA, 75 bp, Artificial Sequence
  Synthetic
gtccgcagatcgcggatcttttccaactgcgaccgaaagtccagcccgtagctgaaggtctggattccgtgtaac

SEQ ID NO: 172000 - DNA, 75 bp, Artificial Sequence
  Synthetic
tcctgcactttttgatgacgcgcggcgccgccggctacgcgtccgggttccagtcgctgccagaccgcttccacc

SEQ ID NO: 172001 - DNA, 75 bp, Artificial Sequence
  Synthetic
cgccgccggctacgcgtccgggttccagtcgctgccagaccgcttccaccgcctggaccatgtcgacccgcggcg

SEQ ID NO: 172002 - DNA, 75 bp, Artificial Sequence
  Synthetic
gcgctagtgtcacggcgctctcgacggcttgctgttgcaggttccggtagtgggtcctgcttccgtgatgcgggt

SEQ ID NO: 172003 - DNA, 75 bp, Artificial Sequence
  Synthetic
ggcttgctgttgcaggttccggtagtgggtcctgcttccgtgatgcgggtgcgtagggtccgcggtgatttgcgc

SEQ ID NO: 172004 - DNA, 75 bp, Artificial Sequence
  Synthetic
tcctcgcgtttcaaaaattactttaaactccccgggggggttaaaaaaaggggggtattaaccctaaccctaacc

SEQ ID NO: 172005 - DNA, 75 bp, Artificial Sequence
  Synthetic
taggtctaaccctaaccctaaccctaaccctaaccctaaccctaaccctaaccctaaccctaaccctaaccctag

SEQ ID NO: 172006 - DNA, 75 bp, Artificial Sequence
  Synthetic
aaccctaaccctaaccctaaccctaaccctaaccctaaccctaaccctaaccctaactctagccttagccctagc

SEQ ID NO: 172007 - DNA, 75 bp, Artificial Sequence
  Synthetic
cctagccctagccctaacactcatcctcgcatctggccctaccgctacccctctttcaacccctcaccatcaccc

SEQ ID NO: 172008 - DNA, 75 bp, Artificial Sequence
  Synthetic
aacccgctgccccacccacatcccccccaccgccaccgctaccgtcacctctgaacttcacctttttcctccatc

SEQ ID NO: 172009 - DNA, 75 bp, Artificial Sequence
  Synthetic
tcgccccacttctctctacatttctccgcccctctattcttactcctgttttctaggatgccgctgacggcgcgt

SEQ ID NO: 172010 - DNA, 75 bp, Artificial Sequence
  Synthetic
ttctaggatgccgctgacggcgcgtgccggccacaccctgcatcgtcttccgctctcccactattggtggcttct

SEQ ID NO: 172011 - DNA, 75 bp, Artificial Sequence
  Synthetic
gttgggtcgacactcccttcgtcatgtccattcctaccttcgcctgcgcaaaggtctacgccttcctttaccttg

SEQ ID NO: 172012 - DNA, 75 bp, Artificial Sequence
  Synthetic
gtccattcctaccttcgcctgcgcaaaggtctacgccttcctttaccttggcccgaacaagaatgtctgcattta

SEQ ID NO: 172013 - DNA, 75 bp, Artificial Sequence
  Synthetic
catcctaagccttacaagtttctcctgcgttacccttgtctaacaagacaaccgcatcttcttcagggctggccc

SEQ ID NO: 172014 - DNA, 75 bp, Artificial Sequence
  Synthetic
gcggattcttctctatgtgagtgacatttacacttccacttgttcacatgatttattgtgttttgtctggtacac

SEQ ID NO: 172015 - DNA, 75 bp, Artificial Sequence
  Synthetic
caagcacatttcggtttctcttttatacatttatctctattctctcggtctcagggttcgaccctaaaccctacc

SEQ ID NO: 172016 - DNA, 75 bp, Artificial Sequence
  Synthetic
atccttcggccgacagcaagttgctacctctgggcctcatcacgctgtccgccttttccatgcgcgtttcggagc

SEQ ID NO: 172017 - DNA, 75 bp, Artificial Sequence
  Synthetic
cgacacactgcagcggcttccacgcggcagatccgtctctcagttggttaacgggatcgtccccttggctcgtgc

SEQ ID NO: 172018 - DNA, 75 bp, Artificial Sequence
  Synthetic
tcctacaagcgccaggagggtctctgttctgccacgacgtgttccaaggccggctctatctcctgtcgcactccg

SEQ ID NO: 172019 - DNA, 75 bp, Artificial Sequence
  Synthetic
tgtcgctctttctaaagacgggccttcgccagtgtgaggccatctatcgcgcaccgctgtggcgcgtacggcccc

SEQ ID NO: 172020 - DNA, 75 bp, Artificial Sequence
  Synthetic
gcaccgctgtggcgcgtacggcccctgccgagcctatggacgtgtcgagatcccgacacggctttcttgccgaaa

SEQ ID NO: 172021 - DNA, 75 bp, Artificial Sequence
  Synthetic
ttgctggcgagaaccgcccgacgcggcctggccgctttctatgccctgtggagactgcatctgggatcccgctcg

SEQ ID NO: 172022 - DNA, 75 bp, Artificial Sequence
  Synthetic
gagctctctcaccccgtgttggagtgggagagaacagagctggtcctgacggatcggagacgcgggtggccgtgt

SEQ ID NO: 172023 - DNA, 75 bp, Artificial Sequence
  Synthetic
acgcacctcctgtccggctcggagtcccagcgcgtttcctcgagtgacgccggagacacatggaacgcagcgaca

SEQ ID NO: 172024 - DNA, 75 bp, Artificial Sequence
  Synthetic
ataaacgtgatgaagcatacgatctactcccctgagacaaaccttctcgtaagcattctactaaaggcgtatacc

SEQ ID NO: 172025 - DNA, 75 bp, Artificial Sequence
  Synthetic
gagaaggcggcggggggaaaagaggaggcggagagaggcgggcgacagcaagccactgacagactcgcaagtccg

SEQ ID NO: 172026 - DNA, 75 bp, Artificial Sequence
  Synthetic
aggcggagagaggcgggcgacagcaagccactgacagactcgcaagtccgcacctgacgcggggccgccgcgact

SEQ ID NO: 172027 - DNA, 75 bp, Artificial Sequence
  Synthetic
gactaccttaaaaaatacgtaaacccctggatcaaacagaccataacggcaaacttctccctgttacagacgtac

SEQ ID NO: 172028 - DNA, 75 bp, Artificial Sequence
  Synthetic
gcggtcggtcccttcagggtgaggagcccagcgccgcggaagactttgcgaggtgcagaccgctgctggacgaac

SEQ ID NO: 172029 - DNA, 75 bp, Artificial Sequence
  Synthetic
tgtgcggggagggcggctggcttccctttgcgtttctcacggcatctccgcacgtctgtctgatcctaacggagg

SEQ ID NO: 172030 - DNA, 75 bp, Artificial Sequence
  Synthetic
aaacttagacaatctatttatctccatgactatcggaacagaaaaaattgataccacttcgttttactccttcat

SEQ ID NO: 172031 - DNA, 75 bp, Artificial Sequence
  Synthetic
gaggccccgtcctggcgcttgacctgaacgacacctccctgtggcgcatcgcggacgacttggagctgctgctgc

SEQ ID NO: 172032 - DNA, 75 bp, Artificial Sequence
  Synthetic
gcctggggagcctgctcctgctctcagggctccggcttcctctccgtcccccgagcgggagcggcgaggcggcga

SEQ ID NO: 172033 - DNA, 75 bp, Artificial Sequence
  Synthetic
gaaagccggggtacgagaaggaagagggaagagggagagcgacgacggcgagcgcgacggccgcgacgtcgccgc

SEQ ID NO: 172034 - DNA, 75 bp, Artificial Sequence
  Synthetic
gcagaccgacccgtccgaggggggtgacggagaagggacgtgtgacaaccggggacgtccctttctccgcacatc

SEQ ID NO: 172035 - DNA, 75 bp, Artificial Sequence
  Synthetic
ccgaatctgaggaacagacagacggccaccacgggcgccaagaaagcggccacggcgaccagcgcggcggggacg

SEQ ID NO: 172036 - DNA, 75 bp, Artificial Sequence
  Synthetic
gacgaggacaccgcgatgacggcgcgcgccgccacgcgaatgacgaaacagagccccagcagcgcggagagcacg

SEQ ID NO: 172037 - DNA, 75 bp, Artificial Sequence
  Synthetic
aggacggggaacagaccgactccgggcgcgaggaggacgcacaggagagcgaggtcgcaagaagagacgagaagg

SEQ ID NO: 172038 - DNA, 75 bp, Artificial Sequence
  Synthetic
gaacggagcagggcggtagcggaaggagctgcgggagggcaacgcagacgtacggcgggagaggcgaacatggtg

SEQ ID NO: 172039 - DNA, 75 bp, Artificial Sequence
  Synthetic
cctggtcgtcgatccccctgtctgtccccaggcccgatccccgcgtgtgggtccctcctcctcatctgttattcc

SEQ ID NO: 172040 - DNA, 75 bp, Artificial Sequence
  Synthetic
cttccccgctgccgtcgataacgcccgtcgaagacgagccgtccgcccgccctcggtgcccgccaggtcccgcgg

SEQ ID NO: 172041 - DNA, 75 bp, Artificial Sequence
  Synthetic
aggaaccctctaagtgttctccgtgcccgccctgcccgtcgcccgacgccccgcagtccgctgtcccgcgcctct

SEQ ID NO: 172042 - DNA, 75 bp, Artificial Sequence
  Synthetic
ccgctctgtccgtcccctcgccgtccaccgcgcgtgtccgtttctccctctcctccctctcctcctcctcctcct

SEQ ID NO: 172043 - DNA, 75 bp, Artificial Sequence
  Synthetic
cctcttcctcctcctccccgtcctactctccctccccgttgtctccgccctctcccgtctctccctcgtctccca

SEQ ID NO: 172044 - DNA, 75 bp, Artificial Sequence
  Synthetic
gatctccgttcatctcccccattagatctccgggactccgagcaaagccgtgggtgtcctccgggcatcccgtgg

SEQ ID NO: 172045 - DNA, 75 bp, Artificial Sequence
  Synthetic
ttggcctcatagatttcatactgtatggcaaaaccaagaattgtccagcttttgcagtcatcacgatcggcgtcg

SEQ ID NO: 172046 - DNA, 75 bp, Artificial Sequence
  Synthetic
cgttcccgccggcgccctcgtccgcgccgcccttttccaaaagagtcccgtccgttccctcatcggcatctccgt

SEQ ID NO: 172047 - DNA, 75 bp, Artificial Sequence
  Synthetic
tatcgcgagcaattttttttcttaacaatactctctacttattcgactctcacccgactgaacgagaagccacag

SEQ ID NO: 172048 - DNA, 75 bp, Artificial Sequence
  Synthetic
ccgcgccgtgcatcggcaggtcgcggccgccctccgcacagacggcgtgagacgccgcgtgaggtgacggaggcg

SEQ ID NO: 172049 - DNA, 75 bp, Artificial Sequence
  Synthetic
gcgaagggacacgagaagaacatgcagaagaacatgaagacgaagaagacgaagaaacgaggacgaaaggagggg

SEQ ID NO: 172050 - DNA, 75 bp, Artificial Sequence
  Synthetic
gaagaaacgaggacgaaaggaggggaatacaccggagaccgagcggcggatggagcccgctcggtctcgcacgtc

SEQ ID NO: 172051 - DNA, 75 bp, Artificial Sequence
  Synthetic
cgcgataccgagcgggctccgtcgccgctccggaccctccacgcccctccgtccaggacccgaggtccgacacgc

SEQ ID NO: 172052 - DNA, 75 bp, Artificial Sequence
  Synthetic
ccccacctggcgcaccgcctccgccaccaccgctgacagtcaccgcatatcacccccatacacacccagcagcag

SEQ ID NO: 172053 - DNA, 75 bp, Artificial Sequence
  Synthetic
accaccgctgacagtcaccgcatatcacccccatacacacccagcagcagaggccggcacatacacacgcgcgga

SEQ ID NO: 172054 - DNA, 75 bp, Artificial Sequence
  Synthetic
gcacgcacgagaacacgcgagacatcggccgccgagattaacggagtctatgcgcgcgccgtgacacggaaaacc

SEQ ID NO: 172055 - DNA, 75 bp, Artificial Sequence
  Synthetic
tcctgctatccgtcctccctgggcacggtccacacgccagtctgcggagtcacctgagggccagatccgctctgc

SEQ ID NO: 172056 - DNA, 75 bp, Artificial Sequence
  Synthetic
gccccccgcccgatccgccccgataaaaaaaaatcatctgactcgtgccagttcacacagatgcaaccgatgaca

SEQ ID NO: 172057 - DNA, 75 bp, Artificial Sequence
  Synthetic
gttcacacagatgcaaccgatgacaaaaaaaaaacacaccaccgcaagcaaacgctcgccggcccgtccaccgtc

SEQ ID NO: 172058 - DNA, 75 bp, Artificial Sequence
  Synthetic
cctctcacccccactcgaatcgcgcaggcgcgtcggcgggaagtcccccgaacgcctccacggcaacgctcctcc

SEQ ID NO: 172059 - DNA, 75 bp, Artificial Sequence
  Synthetic
aggcgcgtcggcgggaagtcccccgaacgcctccacggcaacgctcctcccacgccccctcggtcccccctccct

SEQ ID NO: 172060 - DNA, 75 bp, Artificial Sequence
  Synthetic
ccatccccctccccggagcatacgcgccgactctctccgcagaggcggcgaccacagcggcagcggaaactgtaa

SEQ ID NO: 172061 - DNA, 75 bp, Artificial Sequence
  Synthetic
cggccacgttctttgaacagtgacagtaacggcggcggcggctgtcgccgtcacggtagtcgtggcggagcaccc

SEQ ID NO: 172062 - DNA, 75 bp, Artificial Sequence
  Synthetic
ggggaggcgacgacggggactaccgatgctctcagatcatcgccatagtgaaagagtaccgaataaaacaagtta

SEQ ID NO: 172063 - DNA, 75 bp, Artificial Sequence
  Synthetic
aaagagtaccgaataaaacaagttaaatttcgttgtaaataaaaaaaaatactatgtggaaattaaaaataaaaa

SEQ ID NO: 172064 - DNA, 75 bp, Artificial Sequence
  Synthetic
aaatgaaaataaaggctaaacactgactaaacgtacatccttctccgtacgtcccctttcaataaatggcggacc

SEQ ID NO: 172065 - DNA, 75 bp, Artificial Sequence
  Synthetic
gtcccctttcaataaatggcggacccgacctctccataaacggagacacgccgggagactccggccctcccgttc

SEQ ID NO: 172066 - DNA, 75 bp, Artificial Sequence
  Synthetic
cagaggtagcccgagacctaatcacaaaactgtacctgaaaccgaaagtatagagggcggcctcgaatgccccac

SEQ ID NO: 172067 - DNA, 75 bp, Artificial Sequence
  Synthetic
ctatgaggcgggacttcgcgacgcgccacccttcctatacgcccggccttccgcgtgcgcgcctataggacgcat

SEQ ID NO: 172068 - DNA, 75 bp, Artificial Sequence
  Synthetic
cccctcgccccgaaaccgcaacgcggcagagtcggcgccacacccccgtcccccgagttcgcgatgggctggcgc

SEQ ID NO: 172069 - DNA, 75 bp, Artificial Sequence
  Synthetic
cgaccctgccgcggcaacgaaggcgaaacgagaccccgacgcatgcgggcataaagagcgagaagtaaacgcggg

SEQ ID NO: 172070 - DNA, 75 bp, Artificial Sequence
  Synthetic
gtcccgaattatcgcgagactatttgcccgggcccgccctcgtcctcatgcccttccccccgccctcatcccctg

SEQ ID NO: 172071 - DNA, 75 bp, Artificial Sequence
  Synthetic
acacacccggtggaaaaaacgaaagacacataaataaaacgaattttgttgttaaaaatgtttccacgtgacgtc

SEQ ID NO: 172072 - DNA, 75 bp, Artificial Sequence
  Synthetic
cccggtgattcccggagatgcggcacgcggcggattcgcccgtttacatcggggtccgcagacgcggttctgcca

SEQ ID NO: 172073 - DNA, 75 bp, Artificial Sequence
  Synthetic
cgcggcggattcgcccgtttacatcggggtccgcagacgcggttctgccagggcgttgcgctgtcggttccgcac

SEQ ID NO: 172074 - DNA, 75 bp, Artificial Sequence
  Synthetic
gggcgttgcgctgtcggttccgcacaaaacaccgcggtccgtcgtcacccttcagccacgcggtagttccgcgat

SEQ ID NO: 172075 - DNA, 75 bp, Artificial Sequence
  Synthetic
tctatggttcatctccgctcacatcgttcttttttttttattctttcactgagccgctccaccaccaagagtgtt

SEQ ID NO: 172076 - DNA, 75 bp, Artificial Sequence
  Synthetic
actatctacaccgtatacatgttttttttttatctctccgcccctccccatcacagaccatcaaacaccttttgc

SEQ ID NO: 172077 - DNA, 75 bp, Artificial Sequence
  Synthetic
cgtatcgacactgactatactcgaccgcggatgacaacggtcgttggtcacaacagagctacagcggacagcaaa

SEQ ID NO: 172078 - DNA, 75 bp, Artificial Sequence
  Synthetic
aataacataaatacagtaagagagaggccccggtccacataggaagccaagggcggacgaaaataaaaacccgtc

SEQ ID NO: 172079 - DNA, 75 bp, Artificial Sequence
  Synthetic
ggccccggtccacataggaagccaagggcggacgaaaataaaaacccgtccgtaattcacacacgaatcgggggt

SEQ ID NO: 172080 - DNA, 75 bp, Artificial Sequence
  Synthetic
tatgacaacgcgacacacgcagacgagggacggacgcatcgcgatccggcgcgacggggcgcgattggcccacgc

SEQ ID NO: 172081 - DNA, 75 bp, Artificial Sequence
  Synthetic
gcgagcccgtgcccgcttcgagtggctgctcctggctcgcggcaggccgtccaaactgtacggctatacgagtcg

SEQ ID NO: 172082 - DNA, 75 bp, Artificial Sequence
  Synthetic
gcaccggggagaacggatccacctaccgtggccgcggtactggtgcctagaactccatccggatccgtacaggga

SEQ ID NO: 172083 - DNA, 75 bp, Artificial Sequence
  Synthetic
cgccaggagcgccaccgtgtggggtcaccgctggggttggccgccaacgcacgtgagacccagatccgttcaaga

SEQ ID NO: 172084 - DNA, 75 bp, Artificial Sequence
  Synthetic
ctgcggtgagtgagcgccgccgcgaccggcgacgctatgcgcacacgggcgagcggcggggagggacgtcggccg

SEQ ID NO: 172085 - DNA, 75 bp, Artificial Sequence
  Synthetic
cagggcgagccggtggagggcgagccggtggagggcgagcgggtggagggtgagcgggtggagggtgagcgggtg

SEQ ID NO: 172086 - DNA, 75 bp, Artificial Sequence
  Synthetic
gagggttcgtcgaaaaccaccgaagacattggctggcggagagtggggacaaaacaacgtcacgtcaggggcgga

SEQ ID NO: 172087 - DNA, 75 bp, Artificial Sequence
  Synthetic
aaaacaacgtcacgtcaggggcggagaaatatagggtgcgcagaccgtcaaagcgcgagtaacggaaaacgagtg

SEQ ID NO: 172088 - DNA, 75 bp, Artificial Sequence
  Synthetic
cggatacggggggggggggaaggaaacatggtgaagtctgtgacacgcgtgaccgtcagccggaaacgcctgcca

SEQ ID NO: 172089 - DNA, 75 bp, Artificial Sequence
  Synthetic
gaccgtcagccggaaacgcctgccacggcctctggcctcacagacgactcacggagtttccttcagacattgttt

SEQ ID NO: 172090 - DNA, 75 bp, Artificial Sequence
  Synthetic
ttttttttgtattcatcggtaatgcggtatacgtaaattccccgcaaaggtactttccgttaaggacggtacagg

SEQ ID NO: 172091 - DNA, 75 bp, Artificial Sequence
  Synthetic
cggtatgacttccggaacacgatgattacggatatcctgcatagtgtacaggagaccgctttttttttaggttcc

SEQ ID NO: 172092 - DNA, 75 bp, Artificial Sequence
  Synthetic
gtataagacgtacgtcggcgacgtacacacaacagttaaaaaaataaaaaaaagaggaaacagtaaagctcctcc

SEQ ID NO: 172093 - DNA, 75 bp, Artificial Sequence
  Synthetic
cacacaacagttaaaaaaataaaaaaaagaggaaacagtaaagctcctcctttcctctatgttatcgcgttcagt

SEQ ID NO: 172094 - DNA, 75 bp, Artificial Sequence
  Synthetic
atctagtcctaaatacgcacacgctgaaagaaataaaaaacacccaattcagagaaacggcatctgctaaagctc

SEQ ID NO: 172095 - DNA, 75 bp, Artificial Sequence
  Synthetic
tagtaggcgccattgctgttgcgtatgcttttcgcgttaacggtacgcgacaggatacgaatgcgttacacgccg

SEQ ID NO: 172096 - DNA, 75 bp, Artificial Sequence
  Synthetic
tgcttttcgcgttaacggtacgcgacaggatacgaatgcgttacacgccgcaaaggctccctacaatgactctat

SEQ ID NO: 172097 - DNA, 75 bp, Artificial Sequence
  Synthetic
gcggcatctcccgttcgcgcagaaacgcgagttcccgggacgccagtcttgacgtccggccgatgggatgccttt

SEQ ID NO: 172098 - DNA, 75 bp, Artificial Sequence
  Synthetic
gcgtgtgcggatgttttctgctgttttataggaacagagacaagagacgaaaatagcggaacgcccactataacg

SEQ ID NO: 172099 - DNA, 75 bp, Artificial Sequence
  Synthetic
tgcatttttctctgtgttttgtgttttcatgttttatgattcttctacggtatcggccggaacggtcatcctcga

SEQ ID NO: 172100 - DNA, 75 bp, Artificial Sequence
  Synthetic
tccttctcgtacgcgtgtcccgccccagccctggactcgagtctgtacgtatgttgcggatacggagaaaaactt

SEQ ID NO: 172101 - DNA, 75 bp, Artificial Sequence
  Synthetic
caacccgtgggcttcgtaagctcgtatctgacccactccccgctcgacacgcttcgcgtgctcctggtcggtaga

SEQ ID NO: 172102 - DNA, 75 bp, Artificial Sequence
  Synthetic
gacggagccgtgtacgtccaccacatgagggcggccagactctgccgtctggcgtcgaacgtaacggagtttgca

SEQ ID NO: 172103 - DNA, 75 bp, Artificial Sequence
  Synthetic
aggcgagggctgcagcgggaccccgtggcgtatgaggaagacctagagctgccggaccggcgtatgtgcggaacg

SEQ ID NO: 172104 - DNA, 75 bp, Artificial Sequence
  Synthetic
aacgtcagacatctgttcgacgtgatcgccgcggccgccgacgaacacgacctgctgaccgtcggcggcctgtgt

SEQ ID NO: 172105 - DNA, 75 bp, Artificial Sequence
  Synthetic
cagacgcacgccggagtgagctgtgaattactagagaccgtgcgagatccgtggacggcggttccgggcgtacgc

SEQ ID NO: 172106 - DNA, 75 bp, Artificial Sequence
  Synthetic
atgactctgaccgtggcgcgggctcagtatcgcttgtggcccgatgcccggagacagctccgcctgcacctgtac

SEQ ID NO: 172107 - DNA, 75 bp, Artificial Sequence
  Synthetic
tattttctgactcactcatcacagaaaattatattaacggtctgcgcgcactcctcaacttcataacgcgtgcgc

SEQ ID NO: 172108 - DNA, 75 bp, Artificial Sequence
  Synthetic
gcgggacaccccctgggaccgtggatagtgtgcgccgttctgtctcgagagagggagacgcagacgccgtcgcct

SEQ ID NO: 172109 - DNA, 75 bp, Artificial Sequence
  Synthetic
aaaactacatccagaacacacttctgaaacaatgggcggtatttcagcaacaaaatttcatcccgatcgatgact

SEQ ID NO: 172110 - DNA, 75 bp, Artificial Sequence
  Synthetic
tgggaaacgtgcccacgccggggccacgcgaggtggagacggcttgggtgatcgtcaccgtggcgggaccgttgt

SEQ ID NO: 172111 - DNA, 75 bp, Artificial Sequence
  Synthetic
tatcgttctggcccgataacggcaagatctgccgtctggcgaactcgttcgccgccctgtggaggatggggccgc

SEQ ID NO: 172112 - DNA, 75 bp, Artificial Sequence
  Synthetic
gggccatgagaggacattggacgtattcggccccgggtagacatctccccggggacgcttggccactctgtgaac

SEQ ID NO: 172113 - DNA, 75 bp, Artificial Sequence
  Synthetic
acgtgagaccgccagtcggaaaacttccccggcaaagagcgtacctggattagacgccacggcggcgacgtaagg

SEQ ID NO: 172114 - DNA, 75 bp, Artificial Sequence
  Synthetic
gtgtaaatctttcataattatactacagcagttctgggagaatataatcactctggacctaggctccgacctcag

SEQ ID NO: 172115 - DNA, 75 bp, Artificial Sequence
  Synthetic
atgcgacctacggccagagacatgaccgtaggaagatcatgacaaggatctcgaaatataaaaccaaaaaaaaag

SEQ ID NO: 172116 - DNA, 75 bp, Artificial Sequence
  Synthetic
agacggtacacaaaattttaaaagagaacttataccgaacgtgaacttgaaattatttatatacatcataacaca

SEQ ID NO: 172117 - DNA, 75 bp, Artificial Sequence
  Synthetic
tcgaaatataaaaccaaaaaaaaagtgaggagtgcgtaatcgcaagaaaagaaaaaacagagccgcggtggaaat

SEQ ID NO: 172118 - DNA, 75 bp, Artificial Sequence
  Synthetic
gtctatccgcctgcgtgtatgtgtggggtgtgtatatgtgcgcgtgaccgtatccctccctgcctttaacccgat

SEQ ID NO: 172119 - DNA, 75 bp, Artificial Sequence
  Synthetic
gagaaataaaatcggcgaatgtacacagtcacacacaatgtgcttacgtgccgtgttactgacaccacataacaa

SEQ ID NO: 172120 - DNA, 75 bp, Artificial Sequence
  Synthetic
aaaaaaaaaacatacttcctgtccgtgagacaccgccgccctctagcggggttgctatagcagcgcccgatgcca

SEQ ID NO: 172121 - DNA, 75 bp, Artificial Sequence
  Synthetic
acgcgacacggtgagtcgcatagatcgggactgcttgaaagcgcgccacattcgtcttttatatagacaccccgg

SEQ ID NO: 172122 - DNA, 75 bp, Artificial Sequence
  Synthetic
ggagtgggaggagccaacatacacacgaggtcggtctgaggttggagacgaacgcggaaaatcaacggcgtaaaa

SEQ ID NO: 172123 - DNA, 75 bp, Artificial Sequence
  Synthetic
aaaataagaaaggcggagacacatagccttggcgggaagacgataacaggttcaaagatagacagtgaaaaaaaa

SEQ ID NO: 172124 - DNA, 75 bp, Artificial Sequence
  Synthetic
aagaggagaccatgccattgaatacacgtgtggcagcaatccaatcaacgtgacgtgccggcgcgcaaaaaaaaa

SEQ ID NO: 172125 - DNA, 75 bp, Artificial Sequence
  Synthetic
agtatacggaagtgcatgcgacagacagtcacgcggaccgacgacaaaggccgacccctagcatggcagctagga

SEQ ID NO: 172126 - DNA, 75 bp, Artificial Sequence
  Synthetic
aaaaaaataaacaacgctgaaatatactaacaaaggaaacatcccttcatccctccctaccccatctaccacaac

SEQ ID NO: 172127 - DNA, 75 bp, Artificial Sequence
  Synthetic
ccctccctaccccatctaccacaacacccccctccgtaatcccttttctccgcgtttctcccacagacgcgtgca

SEQ ID NO: 172128 - DNA, 75 bp, Artificial Sequence
  Synthetic
cacgcagacacgcagacacgcacacaccacctctatggcagtcgcgggtgggcaggcggggagcatacggggggc

SEQ ID NO: 172129 - DNA, 75 bp, Artificial Sequence
  Synthetic
agatgtgaagacaatgaggaacggcatcgggcgcgacgtgccgccgtctcggacccatgctatcctggcacgacg

SEQ ID NO: 172130 - DNA, 75 bp, Artificial Sequence
  Synthetic
atcgggcgcgacgtgccgccgtctcggacccatgctatcctggcacgacgccaagggaaaccgctggcgcaatct

SEQ ID NO: 172131 - DNA, 75 bp, Artificial Sequence
  Synthetic
cacccaatattcccctgatactatttaattatgacaacgaagttgtcaacgtttatctaccgccgatgtccacca

SEQ ID NO: 172132 - DNA, 75 bp, Artificial Sequence
  Synthetic
atccaaaaaaagtcgctttctacataaaaaatcctttccactttcccgtgcaagaatacgaagcgacagatttaa

SEQ ID NO: 172133 - DNA, 75 bp, Artificial Sequence
  Synthetic
ctaaccctaaccctaaccctaaccctaaccctaaccctaaccctaaccctaaccctaaccctaaccctaacccta

SEQ ID NO: 172134 - DNA, 75 bp, Artificial Sequence
  Synthetic
cactgcaagaggggggtgaaaaaacctcccctccccgaccggcccgagtggtccgcgcgtgtcgccggtgcgccc

SEQ ID NO: 172135 - DNA, 75 bp, Artificial Sequence
  Synthetic
gtccgcgcgtgtcgccggtgcgccccgcgcccgggccccccccccccgggaacgggcgagggtatatgggtggat

SEQ ID NO: 172136 - DNA, 75 bp, Artificial Sequence
  Synthetic
ggcgtgtagtttaaaggcgaaggtgcagccgggcgccggagcccggtgagagcgaaaaaacgatggcgcgcgcga

SEQ ID NO: 172137 - DNA, 75 bp, Artificial Sequence
  Synthetic
gagagaaagagaggcagaaggcagagccgcagagggacagacgaggagacgccggaggaaagagagaacggccgc

SEQ ID NO: 172138 - DNA, 75 bp, Artificial Sequence
  Synthetic
gagggccatgagctccacctagcgtcagactacgccaccgcggccgcggtgcgctcgttcccgaggagggcccgc

SEQ ID NO: 172139 - DNA, 75 bp, Artificial Sequence
  Synthetic
cagactacgccaccgcggccgcggtgcgctcgttcccgaggagggcccgcatgtggcgcgagagagggaaaagag

SEQ ID NO: 172140 - DNA, 75 bp, Artificial Sequence
  Synthetic
atgtggcgcgagagagggaaaagagcgggcgcgtgtagaaacggccaacgggcggatgcgcagagcgccccgccg

SEQ ID NO: 172141 - DNA, 75 bp, Artificial Sequence
  Synthetic
cgggcgcgtgtagaaacggccaacgggcggatgcgcagagcgccccgccgggcgaatcacctttttatagacccc

SEQ ID NO: 172142 - DNA, 75 bp, Artificial Sequence
  Synthetic
cgacccatttcggtgatgcagatacgcacgcgaacacgcacagacatgcctacgcggcctcaccgagcagactgc

SEQ ID NO: 172143 - DNA, 75 bp, Artificial Sequence
  Synthetic
gcacgcgaacacgcacagacatgcctacgcggcctcaccgagcagactgcaacgtgagcgaaagcatacacacac

SEQ ID NO: 172144 - DNA, 75 bp, Artificial Sequence
  Synthetic
tacgcggcctcaccgagcagactgcaacgtgagcgaaagcatacacacacacgaaaaaaacacacacaaaaaaac

SEQ ID NO: 172145 - DNA, 75 bp, Artificial Sequence
  Synthetic
acacacaaaaaaacacacacacaaaaaaatacacacaaaaaaatacacacaaaaaaatacacacacaaaaaaata

SEQ ID NO: 172146 - DNA, 75 bp, Artificial Sequence
  Synthetic
cacacaaaaaaatacacacaaaaaaatacacacacaaaaaaatacacacacaaaaaaatacacacataaaataca

SEQ ID NO: 172147 - DNA, 75 bp, Artificial Sequence
  Synthetic
cacaaaaaaaccattttatttatgcgctgttctcacaatgttaacataggacaaagacaaccacgaaaacgacca

SEQ ID NO: 172148 - DNA, 75 bp, Artificial Sequence
  Synthetic
acaaagacaaccacgaaaacgaccactacaacaacagcaacagcatcaactacagcaacagacgagggcgggatc

SEQ ID NO: 172149 - DNA, 75 bp, Artificial Sequence
  Synthetic
acgaagtgtcaactcccgcatctccgtcgcgcaacgtgtcctcgcagtccctacggactacggtagaagccccgc

SEQ ID NO: 172150 - DNA, 75 bp, Artificial Sequence
  Synthetic
aagagactgcggacatttcccgctctaccatgtgcggagaaagttgatagacggcaggtagatttatcacaggcg

SEQ ID NO: 172151 - DNA, 75 bp, Artificial Sequence
  Synthetic
cgtgcacgcacgtcacgggcagctgcatggtccacagatgtcccggagggaatcgatggttcttgaacagttttc

SEQ ID NO: 172152 - DNA, 75 bp, Artificial Sequence
  Synthetic
tgacacccatggcgagaaacgccctgaagctatcggacaggcgcaccacggctcccccgtcgagactggccgcat

SEQ ID NO: 172153 - DNA, 75 bp, Artificial Sequence
  Synthetic
acaccctgccgacctgatccatgagcacccgctgtcgtctgagcagaggtaaagtaacgccgcgtccgaagaatc

SEQ ID NO: 172154 - DNA, 75 bp, Artificial Sequence
  Synthetic
tgccgatcaccaccgcgacgcctccgccgggtatgagccgccacctcttctccgccctcctgggtacggcaaact

SEQ ID NO: 172155 - DNA, 75 bp, Artificial Sequence
  Synthetic
caaagaaagctccgcgcggccaaggcaacggcacgagagccttatcgaaagacacggcgaaagccagggcgtcgt

SEQ ID NO: 172156 - DNA, 75 bp, Artificial Sequence
  Synthetic
caactccactcatgccgccgaagaaagaggcgccggtttccatgagacacttggaaccgtagacgggctcgaagc

SEQ ID NO: 172157 - DNA, 75 bp, Artificial Sequence
  Synthetic
gacgcaagccgtgcttccagagaccgaacgcgtcctccgcgagacggtacagcgcgtcgtcgaacacgccgttaa

SEQ ID NO: 172158 - DNA, 75 bp, Artificial Sequence
  Synthetic
acgcgtatatctccccgcactctccgaccagcaccagcgcggaaacttctgcgaagatagtgaccccgatgaccg

SEQ ID NO: 172159 - DNA, 75 bp, Artificial Sequence
  Synthetic
tgagatccataccgggacagcacccgtatccgcgagacagcttggccaactcggcctgcgtgatcccgagcatgt

SEQ ID NO: 172160 - DNA, 75 bp, Artificial Sequence
  Synthetic
cggaggtggcgaatctcagttctgcccccacgggccacgagagcgccaacctgcaatgggcaaaagtagagacga

SEQ ID NO: 172161 - DNA, 75 bp, Artificial Sequence
  Synthetic
agtccctcacgtcgtccgccgatagcggccgggcgacgagagtccgaacgaacgccgtccatttaacctccggca

SEQ ID NO: 172162 - DNA, 75 bp, Artificial Sequence
  Synthetic
ctgccgcatcgcaccgcagatcacgtcccgcagggaaagagcacgaagaagggcagagagccgcagaggccagac

SEQ ID NO: 172163 - DNA, 75 bp, Artificial Sequence
  Synthetic
tccaagaagatataccgagaaacggagagcgacaaaacatttttttttctgtgcggaatccgagataaaattaaa

SEQ ID NO: 172164 - DNA, 75 bp, Artificial Sequence
  Synthetic
aggaaaaaaaaaataaaaaaaacgataacggcagcgttaccggcagtctcacataaacgtctacgatcgcgctaa

SEQ ID NO: 172165 - DNA, 75 bp, Artificial Sequence
  Synthetic
ggatgctacaactgttagaaacaaacaacgttgaatcgacatattcccgacgtcttccacgaaaatggaagtgaa

SEQ ID NO: 172166 - DNA, 75 bp, Artificial Sequence
  Synthetic
cctaccgcccacaaaactgtgaacacatcccatccccgggtaaaatatacaatgatcccagacgtcaaaagcgcc

SEQ ID NO: 172167 - DNA, 75 bp, Artificial Sequence
  Synthetic
catcccatccccgggtaaaatatacaatgatcccagacgtcaaaagcgcccgtaagaactcgatctaccacgctt

SEQ ID NO: 172168 - DNA, 75 bp, Artificial Sequence
  Synthetic
cgtaagaactcgatctaccacgcttccattctttttttttttatacctaacctcccacgttagggcgaactatcg

SEQ ID NO: 172169 - DNA, 75 bp, Artificial Sequence
  Synthetic
aactacgtcgtgcacggcactcctagtgccggcgtccggaaattcctgacgctcatcgtttctagcctttacaaa

SEQ ID NO: 172170 - DNA, 75 bp, Artificial Sequence
  Synthetic
cagcagatcttcgtcggcctgcctccaagttttctgataaaacattcgcgagagatgacaagtcggaagaagcgc

SEQ ID NO: 172171 - DNA, 75 bp, Artificial Sequence
  Synthetic
acacgcagaatgttgcattctctcacagcatgatggccttctgctttaaccggggcatgcaaataacaagacatc

SEQ ID NO: 172172 - DNA, 75 bp, Artificial Sequence
  Synthetic
cagcatgatggccttctgctttaaccggggcatgcaaataacaagacatcgacacacgtccgcctgtgtttttga

SEQ ID NO: 172173 - DNA, 75 bp, Artificial Sequence
  Synthetic
ccattcgggctgctccctacggaaaacgtagctcttataatactgaatgactcctatccgtctaaactgctgaaa

SEQ ID NO: 172174 - DNA, 75 bp, Artificial Sequence
  Synthetic
attttccgccacaaagcgcggccgtccgtcttcgtcgttgtcgttgaatccgaaaatccgtccgtcgtcggccac

SEQ ID NO: 172175 - DNA, 75 bp, Artificial Sequence
  Synthetic
gtagagagaaatccgaccggcgtccgcaaagtacttgtagccgaagctgccgaagaaacacatttccgcgagcct

SEQ ID NO: 172176 - DNA, 75 bp, Artificial Sequence
  Synthetic
gcgccgtgcctcgtcgcacctgacgaatacaaaagaatcccgccgccgatgaaagagcagagtctcgttcttggg

SEQ ID NO: 172177 - DNA, 75 bp, Artificial Sequence
  Synthetic
ccacctcagggcgaaagaacgacctatgtgccggtctcgaaagcacagcacgtcccgacaactgcagacgccgtc

SEQ ID NO: 172178 - DNA, 75 bp, Artificial Sequence
  Synthetic
tatttaaatattcttgatgttctaatattccatttacatttaacagctttgacaatatcgaagtgagaagtatga

SEQ ID NO: 172179 - DNA, 75 bp, Artificial Sequence
  Synthetic
cacctcggtgtcctccaccacaaactgcagcgatgataccagctgatgtgcgtaatagaacctcttcagaccttt

SEQ ID NO: 172180 - DNA, 75 bp, Artificial Sequence
  Synthetic
ttttctgagccatgacctctcgatgcacgcaatcgacatccccgtgaacgtatctagaaaaagcaacgtgtctat

SEQ ID NO: 172181 - DNA, 75 bp, Artificial Sequence
  Synthetic
acgaagaaaatcgtcaatggtgtcaccgacgcggcacagttgctgcggcaataaccaagtatgcgcataaacgcg

SEQ ID NO: 172182 - DNA, 75 bp, Artificial Sequence
  Synthetic
accggcaccgccgagcagaacgactatgtcacctttcagaaaccagtaagccggctccgatccgatctcccccct

SEQ ID NO: 172183 - DNA, 75 bp, Artificial Sequence
  Synthetic
ccggctccgatccgatctccccccttttcttcacgtaccccagtacgacgaggcgctcccggcaacacactagat

SEQ ID NO: 172184 - DNA, 75 bp, Artificial Sequence
  Synthetic
cggccagttcgcccaacttttcatcggcatattcattctcgtctctacagttgttaataaccagctcgtatcctt

SEQ ID NO: 172185 - DNA, 75 bp, Artificial Sequence
  Synthetic
caggccaagccaagggaattcgcctgccgaaattgacgaacgtaaacattcggacgctattcaggcacgtataga

SEQ ID NO: 172186 - DNA, 75 bp, Artificial Sequence
  Synthetic
cgcgcaagagatcgacgagatctctcttggacttgttatagagacgttgacgtttcttcatcctctcctgagact

SEQ ID NO: 172187 - DNA, 75 bp, Artificial Sequence
  Synthetic
gcagctcgtcatccccacacatcatagaatcttgagccggctcatgaaggccttcgataaatcgcaccgtagccg

SEQ ID NO: 172188 - DNA, 75 bp, Artificial Sequence
  Synthetic
tagccaaaatctgccgttgcgccgaagaaacacgccggctgtttgtcgtttccattacgggctcacagcgacaga

SEQ ID NO: 172189 - DNA, 75 bp, Artificial Sequence
  Synthetic
tccattacgggctcacagcgacagagaaatagcactcaaaacttagtaagcaaaagttgcaactcgcaaaaaaaa

SEQ ID NO: 172190 - DNA, 75 bp, Artificial Sequence
  Synthetic
aatgaaagataatatagtcacaaaagaaacttgtcacaatgtacacccaaaaagaacgatatggatgatcacacg

SEQ ID NO: 172191 - DNA, 75 bp, Artificial Sequence
  Synthetic
gaaacttgtcacaatgtacacccaaaaagaacgatatggatgatcacacgacaacggcaacaataatatcgtttt

SEQ ID NO: 172192 - DNA, 75 bp, Artificial Sequence
  Synthetic
caaagcgaaaacataaccctgatcacatgcatatcgatcgaccctactaaaagagacagtataccgcacatcaaa

SEQ ID NO: 172193 - DNA, 75 bp, Artificial Sequence
  Synthetic
tttttttaaagctaaacaaagtgaaagaagcgtaccggttttccggattcgtctgtatcagataaaggtcacaca

SEQ ID NO: 172194 - DNA, 75 bp, Artificial Sequence
  Synthetic
agccagcttaggaacgcggcgcgcttcgcgaatgtctaaccctcgctgttgcacgcgtcttataagcctacgtct

SEQ ID NO: 172195 - DNA, 75 bp, Artificial Sequence
  Synthetic
gaggactattcgcttttgacgtctccggtgctcctgcaacctgatgtcaaacgagccgccgccgcgcacagcgta

SEQ ID NO: 172196 - DNA, 75 bp, Artificial Sequence
  Synthetic
aggaacgacgttcggatacaccccactccacatatgggtcccgtaaagattgcagtcgtgaaaacgaaaaaacct

SEQ ID NO: 172197 - DNA, 75 bp, Artificial Sequence
  Synthetic
caccggattcgacatgtaagataactccagagtattgaggaagccctccagaacatcgtgccttatctcgcgagc

SEQ ID NO: 172198 - DNA, 75 bp, Artificial Sequence
  Synthetic
gagtcgcatggatgcacacaggtcgcctagacagatcttttttaggcacagatgctccaagagcgcacgaacgcg

SEQ ID NO: 172199 - DNA, 75 bp, Artificial Sequence
  Synthetic
atgccgttccttgtcataacccgatacgagaatcgtcacgatctcaagaaagaaaaaacacaaccgagggacgcg

SEQ ID NO: 172200 - DNA, 75 bp, Artificial Sequence
  Synthetic
catgggatctttaatctcgaactgagaactgacaactaacagtttgatcctgacaccgtggaggccagaaacggt

SEQ ID NO: 172201 - DNA, 75 bp, Artificial Sequence
  Synthetic
atcgatgcaacgctccatttctgagatcgcttttacgaagaaacgagcaatggccgtgagatcacttacgatgcg

SEQ ID NO: 172202 - DNA, 75 bp, Artificial Sequence
  Synthetic
ctgtttgacgcgtctcagcagaaacagacacagaacaatgttgcagtacaccttcaagatgttacgttcgaaatg

SEQ ID NO: 172203 - DNA, 75 bp, Artificial Sequence
  Synthetic
ccctctccccaactgcttatcgtgaagaatgggcaaatgccgcctttccatagagttaagaataagagaagaacc

SEQ ID NO: 172204 - DNA, 75 bp, Artificial Sequence
  Synthetic
aagatctcggtcaatctccgcccggagagcgaccgcttcacgcgcgtcgaggtgcagctggcctaaaatgagatc

SEQ ID NO: 172205 - DNA, 75 bp, Artificial Sequence
  Synthetic
agctggatcgaattcggaaatatcagatatgttcacggcccgggaatctttcttacccagatagatccgaaagag

SEQ ID NO: 172206 - DNA, 75 bp, Artificial Sequence
  Synthetic
agacgcccggcactgatcgcaactacagagcacagaagacacaaagcgataagaagaagcgtacgcgacaaagat

SEQ ID NO: 172207 - DNA, 75 bp, Artificial Sequence
  Synthetic
gtaatcggacaaaaagtgtttcaagagcacactcgtcggagacgccgcgtcgccatagatctccttgggattggg

SEQ ID NO: 172208 - DNA, 75 bp, Artificial Sequence
  Synthetic
caaaatatcgaacaaggtcaacagagtattggactcactcctgttcctcagcataaggaactgcaggaagaggga

SEQ ID NO: 172209 - DNA, 75 bp, Artificial Sequence
  Synthetic
gtccaacaactccaaaagacggttgaaatgcgccgagatagtatccctcttctccccatcgacgatgtactccag

SEQ ID NO: 172210 - DNA, 75 bp, Artificial Sequence
  Synthetic
aatcgagaagtgcgccagagcggtgcacttggtcaggagtcgataaaaagctgacgtttcgtcctcaaaagttaa

SEQ ID NO: 172211 - DNA, 75 bp, Artificial Sequence
  Synthetic
ccgttctaagagagacatgaaagccgagagatccatggtcgtctttccacgcctttggaattccacagaaacttt

SEQ ID NO: 172212 - DNA, 75 bp, Artificial Sequence
  Synthetic
ctccgccagagccgcccagagaacactatcgtcacaaaatcgtaagccgcgggtcatgaacagatcctctgcggt

SEQ ID NO: 172213 - DNA, 75 bp, Artificial Sequence
  Synthetic
caacgtgccgctatctataatcatctcctccgttatgtctttcagatcaacatcaagttccctggaatggtgaac

SEQ ID NO: 172214 - DNA, 75 bp, Artificial Sequence
  Synthetic
ggtcagcgagagatagggatggttgggaatggtatacgtgacccgttctcgaacgggtcccttataaatgtcgtg

SEQ ID NO: 172215 - DNA, 75 bp, Artificial Sequence
  Synthetic
gtccaataactccatcactcaagtaagtatatatctgagacagcgtttatttttttgtcgcagaaaaaaacaaac

SEQ ID NO: 172216 - DNA, 75 bp, Artificial Sequence
  Synthetic
gagcagaattcaaattgcaggagacggccacgtacatcacaatcgagaaaacacacaatcactcatccccatcat

SEQ ID NO: 172217 - DNA, 75 bp, Artificial Sequence
  Synthetic
gtccattcagttcgccggcacagtccggtgcatattcataatacttgtaatcatccctgaggacgtccaacgacc

SEQ ID NO: 172218 - DNA, 75 bp, Artificial Sequence
  Synthetic
ccaatttatacccgatagctctgacgtctttctcgggacttatttgaacaccccgatgattaccactcccaaaat

SEQ ID NO: 172219 - DNA, 75 bp, Artificial Sequence
  Synthetic
atttcaagccactgaaaaaaaaagccatagtcccgtttatgcacctggtgttagttaaataatcttcggcgacgg

SEQ ID NO: 172220 - DNA, 75 bp, Artificial Sequence
  Synthetic
gcaacactacccgttgtagccgctgtaagaaattctcttcatgggtattaacgataaaaaaacccggaatgagat

SEQ ID NO: 172221 - DNA, 75 bp, Artificial Sequence
  Synthetic
tatcagaagacaccaggtcacgatcattgtgctcgtggaagcgttttatatgaagatgatgcagaaaaaacattt

SEQ ID NO: 172222 - DNA, 75 bp, Artificial Sequence
  Synthetic
tctgcccgattttgaaaaagctcctcccgcgctttgcacagacgacgcaaaattttatgaatacccacaggcact

SEQ ID NO: 172223 - DNA, 75 bp, Artificial Sequence
  Synthetic
cccgcgctttgcacagacgacgcaaaattttatgaatacccacaggcactccttcgtcacgcaactgtgtttgcg

SEQ ID NO: 172224 - DNA, 75 bp, Artificial Sequence
  Synthetic
ccatgaaccgagtctcgtcgtagtctttgtaagcaggaacggaaaaaccgattctcagagcttcccaacacttta

SEQ ID NO: 172225 - DNA, 75 bp, Artificial Sequence
  Synthetic
agataaactgactcttttccccgggacacctaacaatttctttcatttgtttcatcgaagaaaagtagcacaggt

SEQ ID NO: 172226 - DNA, 75 bp, Artificial Sequence
  Synthetic
ctccgaggcacccgttccgccccagcttcatttcttcctccatggtcacacacaattttcccacttcttccgtga

SEQ ID NO: 172227 - DNA, 75 bp, Artificial Sequence
  Synthetic
agaggtcgtaatatatgtccaactcagcatttatgacacggtagagggtgttcacgacgaacacaatgaaaacaa

SEQ ID NO: 172228 - DNA, 75 bp, Artificial Sequence
  Synthetic
tgttagttaagaaggttagcaatgccttcttatccggggtgacagagatctgtagcgaaataggcagcctactgt

SEQ ID NO: 172229 - DNA, 75 bp, Artificial Sequence
  Synthetic
gctctatctgaccttcaatcatgctcaaccctaaatccttcgctatgagactcgacagactcacactgtagggtt

SEQ ID NO: 172230 - DNA, 75 bp, Artificial Sequence
  Synthetic
cacccaaatgcagaaaagccggaagacgaattgaacctatcataggaaaacactgaattcggacacagtggccaa

SEQ ID NO: 172231 - DNA, 75 bp, Artificial Sequence
  Synthetic
aatcacacttcctgcctctcttgttatacatgataaacatgcgcctacactcgacacaaccacacaggagcataa

SEQ ID NO: 172232 - DNA, 75 bp, Artificial Sequence
  Synthetic
agtgctcgatgagacaggattcgatacgctcaaagaaatcgtatctgaagaagacatcggatttgttctccaagc

SEQ ID NO: 172233 - DNA, 75 bp, Artificial Sequence
  Synthetic
agtccttcaattcttgaccccagtgacaaagattataacctcccagctgccgagtagattcctttgtcaactctt

SEQ ID NO: 172234 - DNA, 75 bp, Artificial Sequence
  Synthetic
ttaacttgctttcaaactgaaataataacatggaggcgtactcacatagatagcgacaccagtagcccagcgtag

SEQ ID NO: 172235 - DNA, 75 bp, Artificial Sequence
  Synthetic
gtttggacgcgaagttaaacagagacgctccagcatagagaccgataaaagccagtttagtgatgcactgccact

SEQ ID NO: 172236 - DNA, 75 bp, Artificial Sequence
  Synthetic
tctcatcaaaattgtccataaatttcaagtttttcaccatgtcagcaatctgatcggctctgacgtaggtggaag

SEQ ID NO: 172237 - DNA, 75 bp, Artificial Sequence
  Synthetic
gatacttgtaagtttcatactcataatctatcagtctgttccacactacgcagtccgaagagggatgtagtcctt

SEQ ID NO: 172238 - DNA, 75 bp, Artificial Sequence
  Synthetic
taatgccaaatctagctgctgcggttccctgcagaccgttcgtcaacctagcgcaggagacgggaacgacaaacc

SEQ ID NO: 172239 - DNA, 75 bp, Artificial Sequence
  Synthetic
tgctggtagcgggcagtcgaccgacgaataccggcgtgagaaattttgtgataaatttaaccgtcagcgaatcct

SEQ ID NO: 172240 - DNA, 75 bp, Artificial Sequence
  Synthetic
cttcgtccagacgcaccgcaaacagaattttgctgcggtctttcacgagcctgttgtaagaaaaaacaagttaac

SEQ ID NO: 172241 - DNA, 75 bp, Artificial Sequence
  Synthetic
ggagagtcttcatcctcgaagaattgtcttttcgggaaaaacgacacacaacacatctacccacctgtcctttcg

SEQ ID NO: 172242 - DNA, 75 bp, Artificial Sequence
  Synthetic
cacgcacatatgccgaggcttactgcggagaacgggcaactccccattcaacatcctattaagattctccgtctc

SEQ ID NO: 172243 - DNA, 75 bp, Artificial Sequence
  Synthetic
agtgtcacttatataaaataaggtatcgtcattccagtccaatgaatacttctctttatagagcaattcatcaaa

SEQ ID NO: 172244 - DNA, 75 bp, Artificial Sequence
  Synthetic
tcctctacgtataaaagtcctcaaacttttagagactttgctgattctgttttctacgtagatatagatgtgaca

SEQ ID NO: 172245 - DNA, 75 bp, Artificial Sequence
  Synthetic
gttcgagcccataacgatagcagctctgcaatttggttcagcttgagagcgggcacacgtccctatgatagcata

SEQ ID NO: 172246 - DNA, 75 bp, Artificial Sequence
  Synthetic
atccttttctgtgattttctctagaatgccaggtccagtcagataataaatatccgacaaggaacaaaaggaaaa

SEQ ID NO: 172247 - DNA, 75 bp, Artificial Sequence
  Synthetic
gtcaaagtcctggaaagcatccaccctgattctcttgccacaatgttttgctacgtaatccttcatagccgggag

SEQ ID NO: 172248 - DNA, 75 bp, Artificial Sequence
  Synthetic
attcctctgtaaaaggataaattcctctcggccgcatttagtctctccgaaccacatcttttcctgctctggatc

SEQ ID NO: 172249 - DNA, 75 bp, Artificial Sequence
  Synthetic
taactccgcttcggcaaagggtggaaattgtctaagtccgatattgaagaactggaccagtgattctgctatgat

SEQ ID NO: 172250 - DNA, 75 bp, Artificial Sequence
  Synthetic
gtacactttctccgtcaccgtgtccacggcaatggtctttccagttgaactatgcatcacgtatggatcgtagtc

SEQ ID NO: 172251 - DNA, 75 bp, Artificial Sequence
  Synthetic
aggattcggatcacgatatatcgggtgagcgtacccaatggcggacaaaaattcatcagtatccagaagactgct

SEQ ID NO: 172252 - DNA, 75 bp, Artificial Sequence
  Synthetic
ccagtcataggcacttacccatctatgcgtgtgaaagtgataaaactcacccagagttaatgcatacatgggagg

SEQ ID NO: 172253 - DNA, 75 bp, Artificial Sequence
  Synthetic
ccaggcgatacaacatcgcaagcccggagaactgatctccaacccgtctccgtaagctgcagacagcacgtctac

SEQ ID NO: 172254 - DNA, 75 bp, Artificial Sequence
  Synthetic
atcaaaatccaaagtaggcacacatgatgacaaggtgaactcatcgttgcagaccggtacgatttctgtttgaaa

SEQ ID NO: 172255 - DNA, 75 bp, Artificial Sequence
  Synthetic
cataaacgcaaaatgaagtacaatactttcacacaagactcgctttccgccctccgtttcaagtatcagacgaaa

SEQ ID NO: 172256 - DNA, 75 bp, Artificial Sequence
  Synthetic
attcgacatgaactacttactgaggctcatgcacgattgataagtctccgacatgcccaacgtcgacatccgtcc

SEQ ID NO: 172257 - DNA, 75 bp, Artificial Sequence
  Synthetic
gaagcgcatggatatttttccaatcttctcataaccgcagtccgcaaaaagtctggcaaatcccacacgcaaaaa

SEQ ID NO: 172258 - DNA, 75 bp, Artificial Sequence
  Synthetic
agtcagtagacaatcgcccagcttcaccagcacgttgtctatccaatcgtaataatatatttttccagatttccc

SEQ ID NO: 172259 - DNA, 75 bp, Artificial Sequence
  Synthetic
tatacatagaataggtcttgtacatttagactcataatcatggtcattcaggtaacctaacactactactttttc

SEQ ID NO: 172260 - DNA, 75 bp, Artificial Sequence
  Synthetic
tactaagtcttcctgttcttctagatttgccaagcgacatgtccctatccagacactgtcacgagtccctagagt

SEQ ID NO: 172261 - DNA, 75 bp, Artificial Sequence
  Synthetic
caaactcttaaaaaccggcatatccaatctcagatcccggccgacgttgagagacacgaaacgttccacatcgtc

SEQ ID NO: 172262 - DNA, 75 bp, Artificial Sequence
  Synthetic
caaactggcacaacgggccagctcatcaaactctcgcaacatggcaatgtaatgtttcctcatagccttgatgcc

SEQ ID NO: 172263 - DNA, 75 bp, Artificial Sequence
  Synthetic
caaaacgcctttcctattcaacttcagatggatattcaaagtacagggactccttaacacatcattattccttaa

SEQ ID NO: 172264 - DNA, 75 bp, Artificial Sequence
  Synthetic
attttccagcgattcgaatctggggccgtcatacaagccatgacggtacacaggctccgcgcatgtgatgatgtt

SEQ ID NO: 172265 - DNA, 75 bp, Artificial Sequence
  Synthetic
agtacccaggacgccgtatcttacaaattgctcaaaattatcacacacgaagtggagagtatccgtctctagatc

SEQ ID NO: 172266 - DNA, 75 bp, Artificial Sequence
  Synthetic
gtgcaagaaaattcttttagatcggccgatcaaaattggaacatctctgtaaggaatctgaatagtccccagtag

SEQ ID NO: 172267 - DNA, 75 bp, Artificial Sequence
  Synthetic
acacagtttttccacaaaaccctgatagtgatcattcatatcttcaaacatcttttctgtatatccagctacatc

SEQ ID NO: 172268 - DNA, 75 bp, Artificial Sequence
  Synthetic
tttacgtagagtgaatctcagccagcagttccgaggccagataatagacagacaccagttcttatacgtgccgac

SEQ ID NO: 172269 - DNA, 75 bp, Artificial Sequence
  Synthetic
aaaattctcgattcgagaaagatcagcagattcacagaaacgacacaattcggcaagagcgttctcgttcggaat

SEQ ID NO: 172270 - DNA, 75 bp, Artificial Sequence
  Synthetic
ctcacctgagacctccttcgcctcgaggtccatcttgaaaactccgaataacactagaagtgaaacaatgaaata

SEQ ID NO: 172271 - DNA, 75 bp, Artificial Sequence
  Synthetic
tctgaaatataagacctcgatgcgagacgccgtcacatgacaggaaattggaaaaaagagagtggtgtgacaaac

SEQ ID NO: 172272 - DNA, 75 bp, Artificial Sequence
  Synthetic
tataacacaccgtttcactccttaatcccttcgcatcgacgacccgcatactcttatgaagctgaacggatgact

SEQ ID NO: 172273 - DNA, 75 bp, Artificial Sequence
  Synthetic
tttattaaatttcaacccccgttttgactcacacgctttcctccgcatgtacagaaaaatccgttccaccaacga

SEQ ID NO: 172274 - DNA, 75 bp, Artificial Sequence
  Synthetic
tttcctgcgaatgttggacaacaaacaccttcatttcctcggaattatgaaaatcttccttacatacatcagaag

SEQ ID NO: 172275 - DNA, 75 bp, Artificial Sequence
  Synthetic
caaaagtatataaacactcgcattccgaaagttttatgcattgcgatttgacatagctgcaatccgcattcaaac

SEQ ID NO: 172276 - DNA, 75 bp, Artificial Sequence
  Synthetic
cttgcaccccgtactttaagcaggagacctccatcgttccggcttctgtattgcactcctcggatttcgatttag

SEQ ID NO: 172277 - DNA, 75 bp, Artificial Sequence
  Synthetic
aaaacagctgtacgactgtcttccataactttctaacagccatcggcagatccacttcagaaaaaacgaactcga

SEQ ID NO: 172278 - DNA, 75 bp, Artificial Sequence
  Synthetic
agcgccactaaaaacagatggaaatagtcacatacaagacggcttcagcgagatctccgaccgtcacctggtcat

SEQ ID NO: 172279 - DNA, 75 bp, Artificial Sequence
  Synthetic
gtagtcttaaaaatttgataactaccgttcatgctgtatgtatcattataatctgacatatagacttctttaatt

SEQ ID NO: 172280 - DNA, 75 bp, Artificial Sequence
  Synthetic
cgggattcggacgagctatagcctcaattcaaaaaaggcatcaagaaaatatcaggaaacccctacgcttctaca

SEQ ID NO: 172281 - DNA, 75 bp, Artificial Sequence
  Synthetic
atattctcaaattcattcttaatacacgtttgtttggggtcggtaagatttaaagaatccttgggggtgacgaaa

SEQ ID NO: 172282 - DNA, 75 bp, Artificial Sequence
  Synthetic
acgtttgtttggggtcggtaagatttaaagaatccttgggggtgacgaaagcggctgtcaactccttagaaataa

SEQ ID NO: 172283 - DNA, 75 bp, Artificial Sequence
  Synthetic
gcggtctcctacactgccttataaaacagtatgagcattgcctcgtcccgccaaataaatcaatacgtttcgaca

SEQ ID NO: 172284 - DNA, 75 bp, Artificial Sequence
  Synthetic
tcgaagcccgtgagtcaccgtagtccaatgctttagcatacacaccgattcattctcttccttgatttcccaaga

SEQ ID NO: 172285 - DNA, 75 bp, Artificial Sequence
  Synthetic
aagggaagattgaagtcgcggccctaattctagatctcggacaccaggtacttggtcgtcagatacacgtccgac

SEQ ID NO: 172286 - DNA, 75 bp, Artificial Sequence
  Synthetic
caatgctttagcatacacaccgattcattctcttccttgatttcccaagaaaacagagtatcccctttctcgaga

SEQ ID NO: 172287 - DNA, 75 bp, Artificial Sequence
  Synthetic
aacgtatctacagctggactagcatcacactccctaaactctttactcccagagaactttactttttagttgcct

SEQ ID NO: 172288 - DNA, 75 bp, Artificial Sequence
  Synthetic
ctccagaagacgaagacatcgtatttaatccaactataacaaagggagggtggatctcgggaagtttttcgtatc

SEQ ID NO: 172289 - DNA, 75 bp, Artificial Sequence
  Synthetic
ccgttgaatacagatcaaacttttcgctaaccggaatgtcggctaacgtattaatggtgccgttcgttccgtata

SEQ ID NO: 172290 - DNA, 75 bp, Artificial Sequence
  Synthetic
gatacccactaaactatgctcgcttcatatcgtcaatagatctgatgatactaaacgaacaatttccggaacacg

SEQ ID NO: 172291 - DNA, 75 bp, Artificial Sequence
  Synthetic
aatgcggagacatacagattttaaagcagcgaaactacctctacctgggagtcatcaaaaatcttacatggaaaa

SEQ ID NO: 172292 - DNA, 75 bp, Artificial Sequence
  Synthetic
aaagcgtcaccggcacaggtcagacagctccacatagaatcctaaaagcttcgttcataggaagttggccggaca

SEQ ID NO: 172293 - DNA, 75 bp, Artificial Sequence
  Synthetic
cctccctgcctgacagagtagcactgcgtttctttaataacactaggtttacgatacactgccacgagttcgcaa

SEQ ID NO: 172294 - DNA, 75 bp, Artificial Sequence
  Synthetic
tacatcggcatagccaaacccatcaccgtccgatccagaaaataaaccacacccacatcacggtaactggtttgg

SEQ ID NO: 172295 - DNA, 75 bp, Artificial Sequence
  Synthetic
ccgtccgatccagaaaataaaccacacccacatcacggtaactggtttggaacgtcagctcgtttttatacgttc

SEQ ID NO: 172296 - DNA, 75 bp, Artificial Sequence
  Synthetic
ttaatattgaaaatctcggtctcgtcaaaaataaagagaaagtctttgggacactagccaccgtatgctgcgagc

SEQ ID NO: 172297 - DNA, 75 bp, Artificial Sequence
  Synthetic
aaatcccttctctactaacgactgaaaatctaccgagatatttaatagttcagtttgaagtagtaacgcaaatcg

SEQ ID NO: 172298 - DNA, 75 bp, Artificial Sequence
  Synthetic
tatatggcgagcacgaaatatctctgtcgaaccgcatcaaatccgtacctttggcaatcgaacaaatccgaaaag

SEQ ID NO: 172299 - DNA, 75 bp, Artificial Sequence
  Synthetic
aagatcccgaacccctgttattttccagtaacccgaaactatattttacaggagacgtactaaacgcaacgatgc

SEQ ID NO: 172300 - DNA, 75 bp, Artificial Sequence
  Synthetic
aactacagcacaacccaaattattacgatctactcgtacacgcgccatacgacatccatttctatccaagccgat

SEQ ID NO: 172301 - DNA, 75 bp, Artificial Sequence
  Synthetic
gtcacatagtaattctacctatccgatatttcacgaggggtgacaagcaaatcctcatatccggctatcagaacg

SEQ ID NO: 172302 - DNA, 75 bp, Artificial Sequence
  Synthetic
aaggtttcttcgaaacccaggtgatgctgtgggctcctggaacaccgttgcatattacgctgcgttcattctctc

SEQ ID NO: 172303 - DNA, 75 bp, Artificial Sequence
  Synthetic
caaatctgatcctgccccaaagcacacctatcgcaaccctgttttatgtagaaagaatgacaagccagaacactg

SEQ ID NO: 172304 - DNA, 75 bp, Artificial Sequence
  Synthetic
aacaaaaagacgtaatcgcaaagctgtctgagaatggacattttattggcaacctgaagctccccagagaaaatt

SEQ ID NO: 172305 - DNA, 75 bp, Artificial Sequence
  Synthetic
ttttacatcacgacgcgatcactgacttgtctttggcagctatacccaaggactcagcgactcccggcccaggga

SEQ ID NO: 172306 - DNA, 75 bp, Artificial Sequence
  Synthetic
cggtttcttcatcagtttccccgtcttgacgtatcctcagaaccatcttttcaattacatcgtctttttcttcag

SEQ ID NO: 172307 - DNA, 75 bp, Artificial Sequence
  Synthetic
gtgtctcaaccttcattaattgcgtgggaataagagtttcatcctgaccgactttgaaatctgaggtttctctct

SEQ ID NO: 172308 - DNA, 75 bp, Artificial Sequence
  Synthetic
cacctgccttcactttttgaagagcgagatctatttcccgttctccgttacccgggagcttcacgtccagcgcat

SEQ ID NO: 172309 - DNA, 75 bp, Artificial Sequence
  Synthetic
ccttaaatgacacagaatctaaatcgcgagacagatcagcatttggcagcctaaacggagactgcacagaatcga

SEQ ID NO: 172310 - DNA, 75 bp, Artificial Sequence
  Synthetic
gatcgttttgcaacttaaaatttttaaacagattttgaggatcactaacttcaagaattctttctacgttagctt

SEQ ID NO: 172311 - DNA, 75 bp, Artificial Sequence
  Synthetic
cctccgattcgcgtcccaacttgttttctgtaggcaacttaagctcggtcccagactgattgtgcaaaatgtctt

SEQ ID NO: 172312 - DNA, 75 bp, Artificial Sequence
  Synthetic
gaatgcccttctcgcctaaactaatcagatttgtaaattcggctagaatcttgttaactcgctgcccaagacccg

SEQ ID NO: 172313 - DNA, 75 bp, Artificial Sequence
  Synthetic
cttgaacatactgttcctctccggcatttctagcagcttccattaaattaggtaatggctcttgctcgttttgcg

SEQ ID NO: 172314 - DNA, 75 bp, Artificial Sequence
  Synthetic
tcatttctttatcgacattaaactttcctgaggtttcctttttttctgcattgccgccagaatacaagtccctgc

SEQ ID NO: 172315 - DNA, 75 bp, Artificial Sequence
  Synthetic
tatttcctttcccccctcttgatacgtcacgagcatatttcttatttaacccggcaaaaatatcattcgcgtgct

SEQ ID NO: 172316 - DNA, 75 bp, Artificial Sequence
  Synthetic
tagtttttctcaacactggggaatcccgagcagtcacagtttcagtcgcatcgccagagtctccggtcacttcgc

SEQ ID NO: 172317 - DNA, 75 bp, Artificial Sequence
  Synthetic
gtgagtgtactatagccttatcatttttttccttagtccagcttccaagcagatctaacttcttctgtttcctaa

SEQ ID NO: 172318 - DNA, 75 bp, Artificial Sequence
  Synthetic
aaccgtctttgtccctcaaatctttaatgagagaaacgttatggggcgacactccggtctcagtactgtgcgtcg

SEQ ID NO: 172319 - DNA, 75 bp, Artificial Sequence
  Synthetic
taagtttcgcctctgatccagccacatcggaattattcaacacgaagggtgtccctgtctgctcagaaaccaaac

SEQ ID NO: 172320 - DNA, 75 bp, Artificial Sequence
  Synthetic
gatgcaccggatcgaaaacatctgcattcgccgctgtgtttttactccacggccgtgaaacatccgatttattct

SEQ ID NO: 172321 - DNA, 75 bp, Artificial Sequence
  Synthetic
gacgcagattgagattagcgagaccatttaccacatcagtaataccgctactgggacttctgatcgaagttttat

SEQ ID NO: 172322 - DNA, 75 bp, Artificial Sequence
  Synthetic
cctgtagtaaatccacgtctcccgtattagattgcgcctcagctggaagtttaacaccaaaatctaaaatccccg

SEQ ID NO: 172323 - DNA, 75 bp, Artificial Sequence
  Synthetic
aagggccaattcgataattaccgtgcgacttatctcgcagatccagattggtagaagtcaaagacgacaacggct

SEQ ID NO: 172324 - DNA, 75 bp, Artificial Sequence
  Synthetic
caactccggacattaaagagacagacgaaacaggcgttgtcgctctaacgtctctacccccgagtgtttctttct

SEQ ID NO: 172325 - DNA, 75 bp, Artificial Sequence
  Synthetic
ttatcaaaatttttcccccggcattatcgacgctatccgactctggaaatttatgtcgcctctgcgtttttaagg

SEQ ID NO: 172326 - DNA, 75 bp, Artificial Sequence
  Synthetic
gcgcgtccaaacttttgggttgacttattttcagacgagccaaatccgcagatggtctctttgtatctatagata

SEQ ID NO: 172327 - DNA, 75 bp, Artificial Sequence
  Synthetic
tactaggtaaactcaaatctgaaggcatgcggccgtctaaagaggcgaaatccattaaagagtgaggcccattct

SEQ ID NO: 172328 - DNA, 75 bp, Artificial Sequence
  Synthetic
caggcaccgaaaatgctttcgacgcgctgtatgattccagactacttttgataatctcataatcactggtgatta

SEQ ID NO: 172329 - DNA, 75 bp, Artificial Sequence
  Synthetic
ttttcaaaaaactctctactctctgaccagttagaggggtctgcaaaaccctctgagaatacacagcattaaaat

SEQ ID NO: 172330 - DNA, 75 bp, Artificial Sequence
  Synthetic
tctcgttcttcctcaaatgacccgagagatgattttgcgtggttacaatttgagacatagcaaccttttctagct

SEQ ID NO: 172331 - DNA, 75 bp, Artificial Sequence
  Synthetic
ttgaccaggactggtttaacgttacaaataacttaccaagataaactaatttattaatactcgtcactaagtaac

SEQ ID NO: 172332 - DNA, 75 bp, Artificial Sequence
  Synthetic
cgttttcgtcccaggggtcatttatgttatagacggtgtaccagagcatgtttttttcagcgtcttgcaaattat

SEQ ID NO: 172333 - DNA, 75 bp, Artificial Sequence
  Synthetic
tttctatctcgctgctgtcttctgcagtaagatttacataaggagtatcgatcggaacattgctaccccacctaa

SEQ ID NO: 172334 - DNA, 75 bp, Artificial Sequence
  Synthetic
tagaatttcctaaacgcagtaaagcgcgatgaatatcactgaattgcgattcaaacttttctttgttcgtgaaca

SEQ ID NO: 172335 - DNA, 75 bp, Artificial Sequence
  Synthetic
tattttcaaaatttcctttattcagacctttggattttaagtactcgtttacgacattctggagtttcgtgatgt

SEQ ID NO: 172336 - DNA, 75 bp, Artificial Sequence
  Synthetic
cttgccatatagcattataatccggcttccgtttagataacacgtagtgatacataagccataaaataaatgtgt

SEQ ID NO: 172337 - DNA, 75 bp, Artificial Sequence
  Synthetic
tatacagtgtttttaactcgtctacatcttctccctctctcacgacacaagaattagtcacatagggatgttctc

SEQ ID NO: 172338 - DNA, 75 bp, Artificial Sequence
  Synthetic
gtaaatctacattctccagattttccaaattgctaagaaaatttgtaagacgctgaactttgtctcgatctagcc

SEQ ID NO: 172339 - DNA, 75 bp, Artificial Sequence
  Synthetic
acgcaaacgggatcgactgcgctttcaaatccatcttttagaaaacaaactcaaaaacaaaactgctcgtcttcg

SEQ ID NO: 172340 - DNA, 75 bp, Artificial Sequence
  Synthetic
ccaagactcaatgtttaatagtcctttttttacccacacagaaagctgacaagcgacgagatggacactgtcatt

SEQ ID NO: 172341 - DNA, 75 bp, Artificial Sequence
  Synthetic
gagctgtccaaactcctggtaagtctccagagatcattgttaccgaatattttattgtagcgtaccatgacaata

SEQ ID NO: 172342 - DNA, 75 bp, Artificial Sequence
  Synthetic
acattcaatatctttaatagcacgatgaagagttcaaagacaacgcttcctgtacctcgacccccacgctaaaga

SEQ ID NO: 172343 - DNA, 75 bp, Artificial Sequence
  Synthetic
cagcacgaatcattgagagcgcagttaccggaatcacgctcactgcatccgtacccatgatcattatagtgatta

SEQ ID NO: 172344 - DNA, 75 bp, Artificial Sequence
  Synthetic
ccaccatgattctctatcacagagtcgcaaaacataacgctacttcattttacgtcatcacactctttgctagcg

SEQ ID NO: 172345 - DNA, 75 bp, Artificial Sequence
  Synthetic
attttgtgctcatgtggtgtgtcttttttatgacagtgaacagagagcagctgttctcatttaaccgtttcttct

SEQ ID NO: 172346 - DNA, 75 bp, Artificial Sequence
  Synthetic
gccagttagtttacttcatctatcatgcagtctgttcatatagcataagcatgctagctataatcgcaacaatta

SEQ ID NO: 172347 - DNA, 75 bp, Artificial Sequence
  Synthetic
ggtacaaaactttgcaccggcgtaagcagaccgaaagtaaaacatatagcacggggcgaaacataggaattctcc

SEQ ID NO: 172348 - DNA, 75 bp, Artificial Sequence
  Synthetic
tactagcttcctcaatgtgcgcgattcccaccgctctctttgtgcagattaacggagcaaaaaaaacgacgggaa

SEQ ID NO: 172349 - DNA, 75 bp, Artificial Sequence
  Synthetic
aatgcgtcgtttatctatcctctccgaaagcttacgaactgtttctagcggtgaaaattgttttcagcttcattt

SEQ ID NO: 172350 - DNA, 75 bp, Artificial Sequence
  Synthetic
ggtgagtcctcccaaccatggtgttcagcttcttctactttatcttttgcaaagctttgcacggcgtcaccaaga

SEQ ID NO: 172351 - DNA, 75 bp, Artificial Sequence
  Synthetic
aaaaacacaaaaagactctattttttattagtatccttctcctgtcatttttactcatacagatcccctatatag

SEQ ID NO: 172352 - DNA, 75 bp, Artificial Sequence
  Synthetic
ctatccttatatctgaaatcgcatttctctacatgccacagaacacctgcttttggttagcccgtgcagagatat

SEQ ID NO: 172353 - DNA, 75 bp, Artificial Sequence
  Synthetic
tgcagttaatcattcgattaatgccacaggtacattgtttctctaatccgttagtctacgcattcactggaggcg

SEQ ID NO: 172354 - DNA, 75 bp, Artificial Sequence
  Synthetic
aactaagaaaccgatttaccacctgtttccaatgtccattttttcccaaaagactatgtagtacacagaatcgca

SEQ ID NO: 172355 - DNA, 75 bp, Artificial Sequence
  Synthetic
aacagtcagacgtctccgaacatgatcagaactcgccatcagaatcgtcagtggatgaaaacgaacccccttaaa

SEQ ID NO: 172356 - DNA, 75 bp, Artificial Sequence
  Synthetic
cacgttttccaacttaataaatgctacccacataaaatcacgtgctagctctgttttctttgttttgtcttccat

SEQ ID NO: 172357 - DNA, 75 bp, Artificial Sequence
  Synthetic
agagcatggcgcacgctaaaaagcaggcacgacgaaaacttttaacttcgacggacgatcccatattgtccagca

SEQ ID NO: 172358 - DNA, 75 bp, Artificial Sequence
  Synthetic
cttttaccatgcgcccgacaagtaagattgcagacgctgaaatcatttcaagagaacatgattatatcgcaagca

SEQ ID NO: 172359 - DNA, 75 bp, Artificial Sequence
  Synthetic
aaacacaggcggattcaaaaaaaaaattatcgtccctgtctgtgatttttgacaaaactgtcctgtttgaatttt

SEQ ID NO: 172360 - DNA, 75 bp, Artificial Sequence
  Synthetic
acggtataggagacaacaacgaaaaagctatcgtctaccctatcgatccagatttcttattatgtgattcggaaa

SEQ ID NO: 172361 - DNA, 75 bp, Artificial Sequence
  Synthetic
ataattgcaccctatcacctttcttataaaatttttttctcctgatctcacgtcacagtttttttttcatatgtc

SEQ ID NO: 172362 - DNA, 75 bp, Artificial Sequence
  Synthetic
tcgcgttgatacatcccgtatgaaatatttaaggtggttgaaatcacaccaatgatcacacacgcgatggaaggg

SEQ ID NO: 172363 - DNA, 75 bp, Artificial Sequence
  Synthetic
tcgaagacattcaacattcccactttcgtcttagacgaaaattgtaacttcatacccgatgttctctcacgcgcc

SEQ ID NO: 172364 - DNA, 75 bp, Artificial Sequence
  Synthetic
aacgctaaatttatcaaagaggtactcatccgagactcctacaatgcggtttgtcttgcaaacagctttattccc

SEQ ID NO: 172365 - DNA, 75 bp, Artificial Sequence
  Synthetic
atggcgactcaaaccgtagagcaaattctgattattatcacaaagtttaagttctcacgttcacgagatctgctc

SEQ ID NO: 172366 - DNA, 75 bp, Artificial Sequence
  Synthetic
atgtcagtatttcgcctcggcgtacatataaacagattttatgccggaaaaaatcaagtcaaacatatgatcaca

SEQ ID NO: 172367 - DNA, 75 bp, Artificial Sequence
  Synthetic
atgatgaaaagtcttttcgataccgaagaagccatgcgacaactcgacagagctcttatggggctgtttgtcgat

SEQ ID NO: 172368 - DNA, 75 bp, Artificial Sequence
  Synthetic
gctcgtgataattcatatatgcctctcatagcattgtccctgcacgaaaacggcttaccggattctaaattcata

SEQ ID NO: 172369 - DNA, 75 bp, Artificial Sequence
  Synthetic
aaagccgtcagattaatacaaacaaccgtaaactcctttcataatcgaccggacgcagatatcgaacagtatgca

SEQ ID NO: 172370 - DNA, 75 bp, Artificial Sequence
  Synthetic
gaaaaattacgagcatacaattacctctataaaatacccaagtattctctgaaagaagctgtcgacatttattcc

SEQ ID NO: 172371 - DNA, 75 bp, Artificial Sequence
  Synthetic
gataatcttaaagatctcactattggagtcaataaaaagcccaccttactgtttacgtcttcagatgacgcatat

SEQ ID NO: 172372 - DNA, 75 bp, Artificial Sequence
  Synthetic
ttatctcacatttacaacgacttactatttttaacttctacttggaatatgatttataattgcaaaaaagagata

SEQ ID NO: 172373 - DNA, 75 bp, Artificial Sequence
  Synthetic
aggcgtttgaatacttggatcaaatacgaaattaactccataatggaaactgctgtattggtaggattccaactt

SEQ ID NO: 172374 - DNA, 75 bp, Artificial Sequence
  Synthetic
ccagatctgaaggaaacaattctagacctagcggcactcatatcaaatatgaatctcgtcagccccgataaagaa

SEQ ID NO: 172375 - DNA, 75 bp, Artificial Sequence
  Synthetic
cttttccctcactacaaactcatattagcaaaattgtttgaaatctgtatttttgcaactaaggcaaacatttgc

SEQ ID NO: 172376 - DNA, 75 bp, Artificial Sequence
  Synthetic
attttaccatccttcataaagggtcacctaatagagttcgaggatgtcttaaaaagaagcaatgatgacgaagac

SEQ ID NO: 172377 - DNA, 75 bp, Artificial Sequence
  Synthetic
ctcaactatctgcttctgaaatctcgagattctgatgacgaatacgatgaagacaaacccccaatacaagtcgat

SEQ ID NO: 172378 - DNA, 75 bp, Artificial Sequence
  Synthetic
ccaggcagagtagacaacgtgcttacagattctgacttttttaacgtaaccccggaaaatgctttctcttctata

SEQ ID NO: 172379 - DNA, 75 bp, Artificial Sequence
  Synthetic
gcgatcatgccaatttcttatgataagacgatagatgtggaagacaatgaaattcaagtcctagaggttgagatg

SEQ ID NO: 172380 - DNA, 75 bp, Artificial Sequence
  Synthetic
cagagcctctcagcagttgtctacggagccgttgcaagcaaatacggcttaagcctggagcaagttatcagaaag

SEQ ID NO: 172381 - DNA, 75 bp, Artificial Sequence
  Synthetic
ttaaatcgaaatgaaggacggacctcttctcgtgcatcccccagccacagtacttctaccgtcccatactccccc

SEQ ID NO: 172382 - DNA, 75 bp, Artificial Sequence
  Synthetic
cttctcgtgcatcccccagccacagtacttctaccgtcccatactcccccccgcaaagcgatcgctccactccaa

SEQ ID NO: 172383 - DNA, 75 bp, Artificial Sequence
  Synthetic
cttctattctaagacaaagagtaccaatgcgttccaacagcagatcatcatcggtttctttctcacaggaagaca

SEQ ID NO: 172384 - DNA, 75 bp, Artificial Sequence
  Synthetic
gcaatcgtagtcattactctgacgaaacaaatattagtgattattcatatcccatggcagatctagaattagaag

SEQ ID NO: 172385 - DNA, 75 bp, Artificial Sequence
  Synthetic
acgaagaacccatggaggaccatccgcactcccctcaatcaacatcatctaacaactccatgtctcgtcaaagcc

SEQ ID NO: 172386 - DNA, 75 bp, Artificial Sequence
  Synthetic
gagctctacaaaacggacaaagaagacgtgctcccacaatggtcccatcatctcagacacgaagacaaaataatg

SEQ ID NO: 172387 - DNA, 75 bp, Artificial Sequence
  Synthetic
cccgccccagacgcgtagccaggcgcctaacggaaatgatgaacgacgcaaggttataatcacaaataattttat

SEQ ID NO: 172388 - DNA, 75 bp, Artificial Sequence
  Synthetic
tgactgtgaaaagtgctttatccggccaattcattgtacgataataaaagttccattgtttgattgatttccgta

SEQ ID NO: 172389 - DNA, 75 bp, Artificial Sequence
  Synthetic
ttcttgagcttgtagataatttccaatagaacatcccgcgttagatgtaactcatcaacgtaagaaaaaaaacga

SEQ ID NO: 172390 - DNA, 75 bp, Artificial Sequence
  Synthetic
atagcattctgttcttcatcatcaccaagtctaaggtgactcttctctaaaaactaaaaaaaaaaacacaccatc

SEQ ID NO: 172391 - DNA, 75 bp, Artificial Sequence
  Synthetic
aattttattcaaccaatctaagatagttttgcattaaacaataaattactgccagaaaaactatagcctagcaag

SEQ ID NO: 172392 - DNA, 75 bp, Artificial Sequence
  Synthetic
ctagtgaatcaaatacctaattccaatttaatatatcttgaaatctaccataacgcgtacaaaatcaaactcacc

SEQ ID NO: 172393 - DNA, 75 bp, Artificial Sequence
  Synthetic
gcatatatcatattaaggaaaagctgtttctcttgtctactggttaacatgtacaacaacacaattatcttcctg

SEQ ID NO: 172394 - DNA, 75 bp, Artificial Sequence
  Synthetic
gtttctcttgtctactggttaacatgtacaacaacacaattatcttcctgtaaaagaaaaacacatcaatcagca

SEQ ID NO: 172395 - DNA, 75 bp, Artificial Sequence
  Synthetic
gtacaacaacacaattatcttcctgtaaaagaaaaacacatcaatcagcatacattagcttgtcattctctcttc

SEQ ID NO: 172396 - DNA, 75 bp, Artificial Sequence
  Synthetic
ctgtaacaaaataaacaatttatgcaatccaattaaagtcccttgtctttgtatcgaaagaaaactattaaagcc

SEQ ID NO: 172397 - DNA, 75 bp, Artificial Sequence
  Synthetic
cgcttccacgtatacttaaatcaatacccacctttttacaggaatattggtgaactgagctacgacgaaacagtc

SEQ ID NO: 172398 - DNA, 75 bp, Artificial Sequence
  Synthetic
gtttactttccggatgttcaatctaaaaaattgattaatctcttcccatctttttaaaataaataacatttcaat

SEQ ID NO: 172399 - DNA, 75 bp, Artificial Sequence
  Synthetic
aactacggatttagtaaccgtcatactcaacgtcagagccggcaaaataaatctatacatagtagaaaagtccat

SEQ ID NO: 172400 - DNA, 75 bp, Artificial Sequence
  Synthetic
tttaaatagatatttaacgtatataatttcggtatttgacaagatattcgacagtgacattaatgcaggcaaagg

SEQ ID NO: 172401 - DNA, 75 bp, Artificial Sequence
  Synthetic
acacagttcacggcattcttgaagccgttgacgcttccacacatccatcctcgtcacagccaaagctctgttccg

SEQ ID NO: 172402 - DNA, 75 bp, Artificial Sequence
  Synthetic
ctcagctcggcagctctccgtattataaaaacagatactgaatcacacgctttaagaattaagaatcattggctg

SEQ ID NO: 172403 - DNA, 75 bp, Artificial Sequence
  Synthetic
cttgcccatccgttaggacatctcattcttaacacatatccaatacaatggtaaaaaaacaggattaaaaaaaca

SEQ ID NO: 172404 - DNA, 75 bp, Artificial Sequence
  Synthetic
aacaacgacaaatcttatcatcggctgaaatttttattctgtatactaacatccaacatctccatacatcaagtt

SEQ ID NO: 172405 - DNA, 75 bp, Artificial Sequence
  Synthetic
aaatacaactcaaagtatgacgtatctatctactcttcatcctcagatgataaatcataaatgtaatcattcgag

SEQ ID NO: 172406 - DNA, 75 bp, Artificial Sequence
  Synthetic
aatgtgggccctagaaaagtatgaggacacaacggcagaatttcttggacggtgctaatgttctgatggaaaaac

SEQ ID NO: 172407 - DNA, 75 bp, Artificial Sequence
  Synthetic
ttatagcgacgatatcccctaacaatcccctgtcttaaaaaagattcaaattcgtctgctattttaacacatgat

SEQ ID NO: 172408 - DNA, 75 bp, Artificial Sequence
  Synthetic
ccaattcctgttccgatcgtatcaataccataaattgcccccgataaatccatcatcacaaacatcgtcttcgga

SEQ ID NO: 172409 - DNA, 75 bp, Artificial Sequence
  Synthetic
tacagtaatgtttttccaatgctcccaataacatgcccgtgatacggcatgctctcgtagacatccgaaaagaaa

SEQ ID NO: 172410 - DNA, 75 bp, Artificial Sequence
  Synthetic
ttccattccatcctactaggaaaatcttctttcctagtaagaaataaaacaaaaactccgtcgttattttccaaa

SEQ ID NO: 172411 - DNA, 75 bp, Artificial Sequence
  Synthetic
caagacttcataatgtaatgcctcccactatttttataaacgatcgtagcaaatttccataaattatcctgcaca

SEQ ID NO: 172412 - DNA, 75 bp, Artificial Sequence
  Synthetic
tcaatcaacgattgaagaacatcatcaatttttgttaaaaagcgaatgtccttttctcgatataccggatcataa

SEQ ID NO: 172413 - DNA, 75 bp, Artificial Sequence
  Synthetic
cgacgcaatccgagaactgcaaatcgttccgtcgtttccgccaacaaatacagtgtctcattcacgaagtcgaga

SEQ ID NO: 172414 - DNA, 75 bp, Artificial Sequence
  Synthetic
ccatagaatcgttcgtcttctcccacaaacaccaacgttttagttaggcacacatcacgagtctcctttccccag

SEQ ID NO: 172415 - DNA, 75 bp, Artificial Sequence
  Synthetic
gcagaaacatatccaagtagttgcaatctctctgggcagcaaagcaataacgaaccttgtttaaaaggaaaaata

SEQ ID NO: 172416 - DNA, 75 bp, Artificial Sequence
  Synthetic
actttattttcacagcaaaaaacgagaaagacacattacaaaactgacacgaaacactgatacttacacatttct

SEQ ID NO: 172417 - DNA, 75 bp, Artificial Sequence
  Synthetic
tgcaactctgcggcagactttgtgggaaatggaattttacacagtgtcgaaatcaccaagcaccgacttttcggc

SEQ ID NO: 172418 - DNA, 75 bp, Artificial Sequence
  Synthetic
caattaaactgtatagttaagccggtcttctgttcaacgtatgtcgataaagaatcacgaaaaactgcaattttt

SEQ ID NO: 172419 - DNA, 75 bp, Artificial Sequence
  Synthetic
atatcgtttaaattcattagtgcaatgtcataacgagttttaacatagtcgccgattcgttcgtctgccatctct

SEQ ID NO: 172420 - DNA, 75 bp, Artificial Sequence
  Synthetic
acgttatgaaaccgtcaactacccctttggacccaaaactacaaataaaccagctcgcatttcttatccatcttt

SEQ ID NO: 172421 - DNA, 75 bp, Artificial Sequence
  Synthetic
tatagcacacagagataaaaaactcaacttaatcaactaccatccaaaaacaaggaacgtcatagtgttggacta

SEQ ID NO: 172422 - DNA, 75 bp, Artificial Sequence
  Synthetic
aaattaccatttcgttcgcccatagaaaatcaacagagactaccggacaattccctacgttaataatatccatcc

SEQ ID NO: 172423 - DNA, 75 bp, Artificial Sequence
  Synthetic
ttgtgtatgtaaaataatacaatgtaaacaataatgattcaacaatgaccttggtttcttctcatacaactgatt

SEQ ID NO: 172424 - DNA, 75 bp, Artificial Sequence
  Synthetic
tcccgtaaaggaaacgaatgataaaaaatcacagtcgcggaaaattcaaatactcgtcatatgagaaattcccta

SEQ ID NO: 172425 - DNA, 75 bp, Artificial Sequence
  Synthetic
aaatcttatatataagaaagccacaaaccctcacaacctcatagacaccaaactttctgaagagcaaaaagagta

SEQ ID NO: 172426 - DNA, 75 bp, Artificial Sequence
  Synthetic
gcaaatcacggccaccattacaactatgttcgccttcaacatcaacattttcttcatctattctaccggaagaaa

SEQ ID NO: 172427 - DNA, 75 bp, Artificial Sequence
  Synthetic
caatccagagattatctctcaagataaacagatccataagcggcagccatcgaatgatactgacattgaagtggt

SEQ ID NO: 172428 - DNA, 75 bp, Artificial Sequence
  Synthetic
aagaaatatcaaaaaacgcggatacaaatttttaccgatagaaacgcgatatttatttaagcactgttcaatcct

SEQ ID NO: 172429 - DNA, 75 bp, Artificial Sequence
  Synthetic
ttccacaggcagacttcttacccgaaaactacagtagtcggatccgtaattcccaccgacaaaacaaaacggtaa

SEQ ID NO: 172430 - DNA, 75 bp, Artificial Sequence
  Synthetic
acacttttatcgttttgttatacactaatacccaggagagctcagattttgactgatctgcacattacgaatacc

SEQ ID NO: 172431 - DNA, 75 bp, Artificial Sequence
  Synthetic
ccagaatatttacacctgtttgcgatttttttataggtctcactgctccacattctaacgacactgggaatgaac

SEQ ID NO: 172432 - DNA, 75 bp, Artificial Sequence
  Synthetic
gttatccgtgcttctctatcaaatacgcattgacgcagatgagtaagttttttcactaatccattttaaatccga

SEQ ID NO: 172433 - DNA, 75 bp, Artificial Sequence
  Synthetic
cagaaaaacacaccattgactatatgtaattaatatttttttatttccgcagatatgatttaatccgacgaccac

SEQ ID NO: 172434 - DNA, 75 bp, Artificial Sequence
  Synthetic
tacatgttttactgtccacgatcaccttttccttaatgcaaatagcactcacggcactttatagaaaatgtctca

SEQ ID NO: 172435 - DNA, 75 bp, Artificial Sequence
  Synthetic
cgataatgcacaccaattttctgaatgttttcatgtaatttaataaacatttatttgtatcctaaatctttcaca

SEQ ID NO: 172436 - DNA, 75 bp, Artificial Sequence
  Synthetic
acatgtttccgcgtaatcattgataaacagcatagcaataacagcatcgtaaatgcacccccagccaaaaagaac

SEQ ID NO: 172437 - DNA, 75 bp, Artificial Sequence
  Synthetic
aacccagcagccgacattgaatgcgtaatttcagacacattctcgtaatcccttgaaaaatccaacaacgcttca

SEQ ID NO: 172438 - DNA, 75 bp, Artificial Sequence
  Synthetic
atctccttgtatttataccaattagtccatgcagacttccatgtatttcttaagaattttttcggcatcgtatca

SEQ ID NO: 172439 - DNA, 75 bp, Artificial Sequence
  Synthetic
tttttaattaatgaaaaatatttcgaatgcacaacctttttcttgtaaatttcatccgacaattgaggacagatc

SEQ ID NO: 172440 - DNA, 75 bp, Artificial Sequence
  Synthetic
atgctcaggaaatagctatccagagacactctctcatttaaaatgttcaaagtgccattggcatctggcccgtca

SEQ ID NO: 172441 - DNA, 75 bp, Artificial Sequence
  Synthetic
cttgtccattgactcgcattcatttcagtgctggacttgagaacaatccgttccgttccataaaatagagtcatc

SEQ ID NO: 172442 - DNA, 75 bp, Artificial Sequence
  Synthetic
acacctcctgcgctatgaccttctagccagcaatttacagtactcgatagctgagcggcatttggaagcctttta

SEQ ID NO: 172443 - DNA, 75 bp, Artificial Sequence
  Synthetic
gcgatcaaagctctgagcatcactcctctaaaataataattaataatcacacgtagaaaagccgttttttcagag

SEQ ID NO: 172444 - DNA, 75 bp, Artificial Sequence
  Synthetic
atagatgtgatatttccaactttcatggctttaaagccatctgttagcatcgcaaggttgatcagatatgaagtt

SEQ ID NO: 172445 - DNA, 75 bp, Artificial Sequence
  Synthetic
ctgacagaaacacagctggaattcccagctaacactccattcacataacaagtagagatgcatatagctccaagt

SEQ ID NO: 172446 - DNA, 75 bp, Artificial Sequence
  Synthetic
ttctgttcctgaattaaaactattttttgctcgcatgtgagattcgatgtaaagcagactcccattacaaaggta

SEQ ID NO: 172447 - DNA, 75 bp, Artificial Sequence
  Synthetic
taaactaacaaggactccatagttaacttcttcatgatatttagaattcacagatcgtttgcaatttcttccaaa

SEQ ID NO: 172448 - DNA, 75 bp, Artificial Sequence
  Synthetic
aaatctgccgcatctctgtggaatacaatagaaacaaatttgaaactttataaaagaacaaacccatttaagacg

SEQ ID NO: 172449 - DNA, 75 bp, Artificial Sequence
  Synthetic
taaaagaacaaacccatttaagacgcggcaacacaattcagtcatctataatccacatccactttcgtgcactct

SEQ ID NO: 172450 - DNA, 75 bp, Artificial Sequence
  Synthetic
tgtaccagcacttgccacatgcatcaagtaaaaacatccaccatccctaaaactaccctttgcgcgcacgctctc

SEQ ID NO: 172451 - DNA, 75 bp, Artificial Sequence
  Synthetic
cccatccgtgaaacaattaaaaaacctacctcagcacagctgccgattcatgaacagcattttctgggctcttaa

SEQ ID NO: 172452 - DNA, 75 bp, Artificial Sequence
  Synthetic
gccaatgaatgttcggtttgcattccgatggagtagcaatgatacaataaccttttaaaggtttttcttgcgcca

SEQ ID NO: 172453 - DNA, 75 bp, Artificial Sequence
  Synthetic
aagacgcaccaccctgaacatgtttacaacctacatcatcggttgccatagcaccgaccactgttgtatcgtaca

SEQ ID NO: 172454 - DNA, 75 bp, Artificial Sequence
  Synthetic
ccgagtcgattcgaggatcagagacatcaaaggtattttttgcggtcgcttggacttccgtttccaaaattgact

SEQ ID NO: 172455 - DNA, 75 bp, Artificial Sequence
  Synthetic
gatgaaccaaatttccaccgagaaacagagtttctgaagaattatccaccacgtcttcagtttgagtggcagcgt

SEQ ID NO: 172456 - DNA, 75 bp, Artificial Sequence
  Synthetic
cacacatcgcctcagaccgatctgtctgtgtatgcctcgataacataatttttataccaggagttttggtaagtc

SEQ ID NO: 172457 - DNA, 75 bp, Artificial Sequence
  Synthetic
catagattgtgcaatggcgagcggagttgtcttcttgacacgataaagccatacacaccgtccccccaacatctt

SEQ ID NO: 172458 - DNA, 75 bp, Artificial Sequence
  Synthetic
ttttcgcagatggctgcaacaattcttccgtcggccaacaaaatggacccttagcaccgaaagagtcagactgaa

SEQ ID NO: 172459 - DNA, 75 bp, Artificial Sequence
  Synthetic
ttggtctcatggaagcacgagcatcttcttccacgcaagcaccactctctaccttctgaaaccgtctaggtaata

SEQ ID NO: 172460 - DNA, 75 bp, Artificial Sequence
  Synthetic
cacctgtcaaagaaattggggtatgtctcattctcgtaaaatatttttgaaattgatcactgtattcatcgcggg

SEQ ID NO: 172461 - DNA, 75 bp, Artificial Sequence
  Synthetic
acttctgtgcaataaaattactcaagatcgcgttctgacacgagaactccatggcagttgtccagaaatctgaaa

SEQ ID NO: 172462 - DNA, 75 bp, Artificial Sequence
  Synthetic
acgtaggtgacaaataaaatatcacaccatcttcatatccaagcacttgaccagttgacgataacaaaaaaacaa

SEQ ID NO: 172463 - DNA, 75 bp, Artificial Sequence
  Synthetic
cttgtctctccggagccgcagatgcaccttcccattcctccgttacaccaaacatactcatcctaccctcaaaag

SEQ ID NO: 172464 - DNA, 75 bp, Artificial Sequence
  Synthetic
gatacaacccgtttattaataaacatctcaactgacggtcagatagaatatcggaattgtcacagatccgaactt

SEQ ID NO: 172465 - DNA, 75 bp, Artificial Sequence
  Synthetic
tgatacaagtgatatgttgaagaacaattccggaagccatagcttcctgtacaactttctcaaatctcagagcgg

SEQ ID NO: 172466 - DNA, 75 bp, Artificial Sequence
  Synthetic
accccgccgaagaaatcatcttatccttaaactgcaacatgcgcgccagttcatcaccggtgaatgccattacga

SEQ ID NO: 172467 - DNA, 75 bp, Artificial Sequence
  Synthetic
tgttttttctcgttaatgattaagataatcggccatccaaatatgtaagaactgcacaatcttagttaaatttat

SEQ ID NO: 172468 - DNA, 75 bp, Artificial Sequence
  Synthetic
acgaaaaaatactgcaactccggaaatgggtgtggcataatctctaaaagcaccttaagaaaaaaaacagacact

SEQ ID NO: 172469 - DNA, 75 bp, Artificial Sequence
  Synthetic
atgggtgtggcataatctctaaaagcaccttaagaaaaaaaacagacactgttaacaaaaaaaaaaacaatttat

SEQ ID NO: 172470 - DNA, 75 bp, Artificial Sequence
  Synthetic
ttaaaaaatctctgttcaaatcacctcacagtcatggaaacattttacaaaggcaacatttctaacttgacattg

SEQ ID NO: 172471 - DNA, 75 bp, Artificial Sequence
  Synthetic
ctaaaactttcgtgagattttattgactgtcgttctatatcaaacgaattatttccgcagacaactgctattgaa

SEQ ID NO: 172472 - DNA, 75 bp, Artificial Sequence
  Synthetic
tcatcacggacgttttgaacgctatgaagttccatgtcgtgattttcagcttcgtagttgcagtattctacttcc

SEQ ID NO: 172473 - DNA, 75 bp, Artificial Sequence
  Synthetic
ataatcaccataggcacttcatcattccctctacgcctttttagcaccctatttggattcgatgaagatccccca

SEQ ID NO: 172474 - DNA, 75 bp, Artificial Sequence
  Synthetic
gaaacaaaaaactgaatataccgcgttaaaatatatagaaacatacacccagcagcaattggaattacaatgaaa

SEQ ID NO: 172475 - DNA, 75 bp, Artificial Sequence
  Synthetic
atccacaacagctgcaatttattaaatttttttctgtgcggcgctggaaaattatgacgaggaaacgtgtcctcg

SEQ ID NO: 172476 - DNA, 75 bp, Artificial Sequence
  Synthetic
gattccttcacgggattcacaaaacctttgaaactaaaagcatcctctcttgttaagagagctggggtaactaat

SEQ ID NO: 172477 - DNA, 75 bp, Artificial Sequence
  Synthetic
aatttatgcgtaatttcacatgaaaactcacgatgtgtcatgctcaaagctctactcaatgctctttcataagag

SEQ ID NO: 172478 - DNA, 75 bp, Artificial Sequence
  Synthetic
tatagaagttgaccggaaatttcggttctaatgaaatcgtcagtcgtatgatcatctgaaactgtttggttgtga

SEQ ID NO: 172479 - DNA, 75 bp, Artificial Sequence
  Synthetic
agactccattgaatgttcgttccaatgggccgatatcgtcgagctgtacagacgagcaaacctgtatctctcttg

SEQ ID NO: 172480 - DNA, 75 bp, Artificial Sequence
  Synthetic
ctgaaaacttgcggaggacgatatttagagtctccgaaaacaaccttaccatagaaatttaagatgtcttctaca

SEQ ID NO: 172481 - DNA, 75 bp, Artificial Sequence
  Synthetic
caaaaacgtcttgcataaaacgacaatacgtgcaaagaacgattttgtaaaaaactgctcacatttataagatcg

SEQ ID NO: 172482 - DNA, 75 bp, Artificial Sequence
  Synthetic
tgaacaaaactacgattctcattaaacagatctatctgtacataggttgtatttctcgctaaaaaaacgtagctg

SEQ ID NO: 172483 - DNA, 75 bp, Artificial Sequence
  Synthetic
ccagacaactgcgtattattgttgacgaagcaaaccaattcgcttacagaaaaattttgaactgagacatactga

SEQ ID NO: 172484 - DNA, 75 bp, Artificial Sequence
  Synthetic
agcccagcgtgcaatctatgaaattcacgtattaccacatgtcctaaaaaacggtctacggtagaattttttcct

SEQ ID NO: 172485 - DNA, 75 bp, Artificial Sequence
  Synthetic
tcttccaggcttcccgcgaggtcaaacaacgtctctccaacagccgtatggttccgcaaagtcaaatctccataa

SEQ ID NO: 172486 - DNA, 75 bp, Artificial Sequence
  Synthetic
agcctctcgtaagcaaaaacgatatcgttatcaatgccgataacggtctgaagtttaccgattccttcagccaga

SEQ ID NO: 172487 - DNA, 75 bp, Artificial Sequence
  Synthetic
gtagtcttgatgtaaagtttagccggcaacgaagaaacgcattgaaataaacatgcgacaaaaacagttatcatt

SEQ ID NO: 172488 - DNA, 75 bp, Artificial Sequence
  Synthetic
tttaaatctttaattcacgtcgaagaaaggtacggcccttgaagaaacagttaaccgccgtagtcaataacttat

SEQ ID NO: 172489 - DNA, 75 bp, Artificial Sequence
  Synthetic
tacaaaaaggccacatggaattaacactaacaaatataaagtatattatctccttcagtcctacaaaacaggaaa

SEQ ID NO: 172490 - DNA, 75 bp, Artificial Sequence
  Synthetic
tacccagaatacccacacaaaccgccaccgcacccatgaacataaggttcaccatgatagatgttatctctgcga

SEQ ID NO: 172491 - DNA, 75 bp, Artificial Sequence
  Synthetic
atgctaacatagtcgaaccttcgttataaatctgaatagacttttcgacattcttctccggaagcgtaacgataa

SEQ ID NO: 172492 - DNA, 75 bp, Artificial Sequence
  Synthetic
cattatcgccactctccttattcgtgcacatgcagaaatatttatcccctacccacttatccaatgaaataagtc

SEQ ID NO: 172493 - DNA, 75 bp, Artificial Sequence
  Synthetic
cccacgtcacatcatcgcgaaacaaagacgtatatgcaccggacgatctcatctttaccgttttccataccatat

SEQ ID NO: 172494 - DNA, 75 bp, Artificial Sequence
  Synthetic
caaacgtcagcggctcctccgcaaagatctcgatctttcccagcttgctaacaccccaacctgaatattcacaaa

SEQ ID NO: 172495 - DNA, 75 bp, Artificial Sequence
  Synthetic
ctgcaaattctccttctgcgcccagccacctagagaacgaacatttcaaatcatcagctctgaacaatctttctg

SEQ ID NO: 172496 - DNA, 75 bp, Artificial Sequence
  Synthetic
aagaagatctaataaccggcataaaatttagttttaactcctcgtcgtaagacagagccattcgtctaaattcgc

SEQ ID NO: 172497 - DNA, 75 bp, Artificial Sequence
  Synthetic
cgtacaactcagataggactttaacgtcgttattgcacgaagatatcaagtactgtcgatatgtcgagagttcag

SEQ ID NO: 172498 - DNA, 75 bp, Artificial Sequence
  Synthetic
tccaaagacgtaacatcgttctgtcttcaccctggaaattcttatctgcaatccaagagttattgctaccatcga

SEQ ID NO: 172499 - DNA, 75 bp, Artificial Sequence
  Synthetic
ggaaaaaagcaacacgtagtacttgtttcttgagatttgtttcattcattctactgagtcgtatcgattttttat

SEQ ID NO: 172500 - DNA, 75 bp, Artificial Sequence
  Synthetic
taacagagcattggacttgaatgctaataaatgtcatttttccatgaccacatttttgaacacgctttcttgcaa

SEQ ID NO: 172501 - DNA, 75 bp, Artificial Sequence
  Synthetic
gatgcatggttgcactactcacggtattaaacaatagtttatgtacgttatgaaaaacctggaaacatcgaaaaa

SEQ ID NO: 172502 - DNA, 75 bp, Artificial Sequence
  Synthetic
ccaaaaactttccaaagtcgtattcaatttgactgtcttccattcctccgtaaaacacttggttgtttaccgccg

SEQ ID NO: 172503 - DNA, 75 bp, Artificial Sequence
  Synthetic
cactaccccataactccattttaccgcttctccaatttctgtatgcagatatctctaagagcatctccccagatc

SEQ ID NO: 172504 - DNA, 75 bp, Artificial Sequence
  Synthetic
taaccgcttcaccgttccctgcgccaagggccggacaagtggaaggatagatttcaccccggacgaacgttaaga

SEQ ID NO: 172505 - DNA, 75 bp, Artificial Sequence
  Synthetic
cgcataagaaaacaaagcagatcatcatgctgcgttttccttctcttttgcgatcactagcgcccactaactcca

SEQ ID NO: 172506 - DNA, 75 bp, Artificial Sequence
  Synthetic
gcgatgcaatctttaatataagatcgccgtcataccacagcgtcgaggggttacgcccacatattaaacaaagga

SEQ ID NO: 172507 - DNA, 75 bp, Artificial Sequence
  Synthetic
gccgtcataccacagcgtcgaggggttacgcccacatattaaacaaaggatccaaagcaaaccagcaagaacaaa

SEQ ID NO: 172508 - DNA, 75 bp, Artificial Sequence
  Synthetic
tccaaagcaaaccagcaagaacaaaaaacggcaacagcaaaaaggtaaaccgagatgcagtagtaaacgaagcgc

SEQ ID NO: 172509 - DNA, 75 bp, Artificial Sequence
  Synthetic
tcatagcggggtaaaaagcgtcttctttcttttcggcagaatgctacagaaatgaagcaatcacctctctctgta

SEQ ID NO: 172510 - DNA, 75 bp, Artificial Sequence
  Synthetic
gttttcctagcgtaatccactacatacgttttagttctaattgactccatcaccgattgatttagtaattgtaac

SEQ ID NO: 172511 - DNA, 75 bp, Artificial Sequence
  Synthetic
tgcacaccgctcggaaaggaaacattacacgtagtatcattgtccacaaacacaacaccaatatttttattgtat

SEQ ID NO: 172512 - DNA, 75 bp, Artificial Sequence
  Synthetic
cgacataatatcttagaccccagggcagtctcgataacgcatcgagggttaaataaaaaggctatatctctttcg

SEQ ID NO: 172513 - DNA, 75 bp, Artificial Sequence
  Synthetic
aaataagcattaataggcacactagccatccgccaccaagcagttccacttctctgagccatttttacaaaaatc

SEQ ID NO: 172514 - DNA, 75 bp, Artificial Sequence
  Synthetic
aaccaatgtcttaactccgtttcactatgtgttccgataaaaactgaattttcattgttaataatatgcaaagac

SEQ ID NO: 172515 - DNA, 75 bp, Artificial Sequence
  Synthetic
ggtatcaccgacacgtataatacactcacccatgctaaactccaaccctgaggcaccataatcactagtaacaat

SEQ ID NO: 172516 - DNA, 75 bp, Artificial Sequence
  Synthetic
ctatgggagcctcatctgcaagtctttgcatccctcctgatttgcacatccggtttattctcttcatcccaaagc

SEQ ID NO: 172517 - DNA, 75 bp, Artificial Sequence
  Synthetic
aaagacctctgcttgtctttcttataccaattatacaaaataactatcacaattatgaatgccccgacaaaacta

SEQ ID NO: 172518 - DNA, 75 bp, Artificial Sequence
  Synthetic
atcccgcaaatccaaattactaacgagcttagaaaatctttaaaatactcttcatctccctcatttgtatctgtt

SEQ ID NO: 172519 - DNA, 75 bp, Artificial Sequence
  Synthetic
aactcagggacttgaacagtatcagtttcccaaagagcctgaaccgtcttttttggtgtggatttcgtcggcaaa

SEQ ID NO: 172520 - DNA, 75 bp, Artificial Sequence
  Synthetic
ccctgaggcgtcttttcagacacatcggaaagagtcgacgctaagattactgtgaaaaacgtctcaatatcctgc

SEQ ID NO: 172521 - DNA, 75 bp, Artificial Sequence
  Synthetic
gcctcatcacccttgaccgttggaaacgaacttgttgtaacatttacattattgccactggatcgatttgtggtt

SEQ ID NO: 172522 - DNA, 75 bp, Artificial Sequence
  Synthetic
cccacggctagcgtagaggtcaccatagaagactggtttaaatatgccacagaagctattgatatttcggtaaca

SEQ ID NO: 172523 - DNA, 75 bp, Artificial Sequence
  Synthetic
tttttaccccacgtttcgggattcgccgaaaacgtagtttcagatttcccagttaaatagtcgctggatgtcgat

SEQ ID NO: 172524 - DNA, 75 bp, Artificial Sequence
  Synthetic
acattcgtttccatatttttagacgcaattgaggcaaattcagttgccgaaacttctgtagtcgttaggttgagc

SEQ ID NO: 172525 - DNA, 75 bp, Artificial Sequence
  Synthetic
atttgcacctcttcacagagacacacgagtaaaaaagacaagaacaacatgtttttgcgattacccaagtgcaac

SEQ ID NO: 172526 - DNA, 75 bp, Artificial Sequence
  Synthetic
ggttttttaatcacacccacaccaagatagcagaatgaaaacaatcttttagaacaatgttccgcattagttttt

SEQ ID NO: 172527 - DNA, 75 bp, Artificial Sequence
  Synthetic
ataatacaactcgacgaattcaaattaaaaacacaaatgccgatcataagaaaacacgattttgcattaaattca

SEQ ID NO: 172528 - DNA, 75 bp, Artificial Sequence
  Synthetic
gacttcctcatacattcagatttgtcatgttagtttaatagtcgatgcctgctattccttttaaacaatagagat

SEQ ID NO: 172529 - DNA, 75 bp, Artificial Sequence
  Synthetic
ttttcaacgttcatgtttccgttccacatcgggtcagcaaatgcttctaagacaggtaattcatttttttcgacg

SEQ ID NO: 172530 - DNA, 75 bp, Artificial Sequence
  Synthetic
gacaggtaattcatttttttcgacgattcacattgaaaacgtaaataacaaaagcaataaacaaaatcattgcga

SEQ ID NO: 172531 - DNA, 75 bp, Artificial Sequence
  Synthetic
attcacattgaaaacgtaaataacaaaagcaataaacaaaatcattgcgatagccaagcccgtcaaaactaaaaa

SEQ ID NO: 172532 - DNA, 75 bp, Artificial Sequence
  Synthetic
agcaaacgtctttcgtctcttgttccacaaattccacgctgagcgagatgactgcggaggcggtaagcattcaac

SEQ ID NO: 172533 - DNA, 75 bp, Artificial Sequence
  Synthetic
aaacgatgtatcattgctagcgtgcggagaaacctgtccgtacatgacgtccatcatcagcacctctgaatagga

SEQ ID NO: 172534 - DNA, 75 bp, Artificial Sequence
  Synthetic
cggcggcggcgtccgagggcgatccatcctcttcccgacgaagattcacgttgaaatacacggcgaggacaaaat

SEQ ID NO: 172535 - DNA, 75 bp, Artificial Sequence
  Synthetic
ttctccaaacggacttaaattactaagataatcggagtagacgagaaatgcgagcacaaatgcgactacgagagt

SEQ ID NO: 172536 - DNA, 75 bp, Artificial Sequence
  Synthetic
gtatgttccttcccagagttcctcggcacttctaggaatggggaatagagttttgcttataagcaacatggtaaa

SEQ ID NO: 172537 - DNA, 75 bp, Artificial Sequence
  Synthetic
acaatacaacctaccctctttcaatacaattaattcccctgactagagacgtacatatctttaataatcctcgat

SEQ ID NO: 172538 - DNA, 75 bp, Artificial Sequence
  Synthetic
cccggcgcgacctctgacagtgctcacggagaggacagaggacgtctctagaaaacatctcatccacctgcttaa

SEQ ID NO: 172539 - DNA, 75 bp, Artificial Sequence
  Synthetic
tatagtccgtatcttgcgtaaaccattgcgtatgcaaccgacgattctcattataacgcagacatccaattttta

SEQ ID NO: 172540 - DNA, 75 bp, Artificial Sequence
  Synthetic
aaaaatctgacatattgcgagctataaagagaaggctctcctcgcggtcgacgcaaaaaagcataccgtggccgt

SEQ ID NO: 172541 - DNA, 75 bp, Artificial Sequence
  Synthetic
caaacactactacgagctccctccagtcaccgaaaaaattatgctgtacaataaacactacatctagtagactcg

SEQ ID NO: 172542 - DNA, 75 bp, Artificial Sequence
  Synthetic
tctgcagtttcctccgccactgaatcaaatgtttactagaaaacccagtcatgctcagattgcaaaagcgaacaa

SEQ ID NO: 172543 - DNA, 75 bp, Artificial Sequence
  Synthetic
aggtcttgtacggatacgttttcaaggtaaaaaaagcattctttctttcatttcggtaatgtaagagctcagaaa

SEQ ID NO: 172544 - DNA, 75 bp, Artificial Sequence
  Synthetic
acgatttactgtgagcaatcatatccagtgccacagtactgtccagtgcataatcacacgtctcataaatcggat

SEQ ID NO: 172545 - DNA, 75 bp, Artificial Sequence
  Synthetic
aaaaaaaccgcaaaccattagaaaacaaatcgtgaaaagaagaagccacgtgataaagacttctgtcaaaaaaac

SEQ ID NO: 172546 - DNA, 75 bp, Artificial Sequence
  Synthetic
cattatacacatagatgtgtccccgcgccccctgaaggacaatcggtcccctgcaggttctggtttttgccttat

SEQ ID NO: 172547 - DNA, 75 bp, Artificial Sequence
  Synthetic
gtataaccccgaccacaaccaattcgccttcgcaacacatataggtcttcgcccagttttgaacatcttcacgtg

SEQ ID NO: 172548 - DNA, 75 bp, Artificial Sequence
  Synthetic
aaatatccggaatgttttctacactatgtagagtcaaccgataatcctcgggccagggcaaagctaaagtggcgc

SEQ ID NO: 172549 - DNA, 75 bp, Artificial Sequence
  Synthetic
cctggcgattttcgataaaatttaccaacaaatcgatgtctttgcttgaagacaaacccataacgatgaactgcc

SEQ ID NO: 172550 - DNA, 75 bp, Artificial Sequence
  Synthetic
cggctcagagcaaataaacacaaatttgaaaaacattaatactgcaaaaaattttattggtgtccaccaaaacaa

SEQ ID NO: 172551 - DNA, 75 bp, Artificial Sequence
  Synthetic
gcacgataaattgtctaatcacacaccaaaatacatgcaacacacgactaaacaaaaaaagccgttcaataaatc

SEQ ID NO: 172552 - DNA, 75 bp, Artificial Sequence
  Synthetic
acccgcataaaaagatctgtctttcagatcgctgctcaaagtcaacataatcgaactaaacccgagacctaaaaa

SEQ ID NO: 172553 - DNA, 75 bp, Artificial Sequence
  Synthetic
ggcttcaaagataattcgatataggcagacgttcatcatcagtcccgacaagatcgccaccattgcgcacgcagc

SEQ ID NO: 172554 - DNA, 75 bp, Artificial Sequence
  Synthetic
agctttgaaaacatttagtttaaaaaacacgttgttgaccaccgtcagaaaaaaaagatgattagattttggcat

SEQ ID NO: 172555 - DNA, 75 bp, Artificial Sequence
  Synthetic
actcaagaagatttttccgatccagagtatcgtaaataataacaaaaattcgaccgtaaactttacaaggtattt

SEQ ID NO: 172556 - DNA, 75 bp, Artificial Sequence
  Synthetic
caaatcaacttcacgaaacgacgttgacttcaaaatcggacgatatttttgcaaactaataagaaatccagatga

SEQ ID NO: 172557 - DNA, 75 bp, Artificial Sequence
  Synthetic
tcgtatcatccatccatatctcagagtaaacggcaggagaaacgcagtcgtcgtcaagacagaataatcatcgaa

SEQ ID NO: 172558 - DNA, 75 bp, Artificial Sequence
  Synthetic
catttgactcttaaaaaataaagacaccatcatccccgtaaacacagcgggggaataagacggcataatcaggac

SEQ ID NO: 172559 - DNA, 75 bp, Artificial Sequence
  Synthetic
acaacgacttaaaatcattctcaacctcatctcggaaaaaatcaagcagatcatgaccactgcagacaagaatga

SEQ ID NO: 172560 - DNA, 75 bp, Artificial Sequence
  Synthetic
tggcagtttcgccgccattaaagacagaaacacaatcttgaaatcacctatgggtttataaaagcgtggatcaaa

SEQ ID NO: 172561 - DNA, 75 bp, Artificial Sequence
  Synthetic
ttttttaaaagtcaacaaaaaggaaatcgcaacggttatcacaacgcctatctgttcgagggaggacctcccctc

SEQ ID NO: 172562 - DNA, 75 bp, Artificial Sequence
  Synthetic
tgtcattctaaacggatacagccccggaataacggcacccttagcaagaccgagaataaaactatctgtcagacg

SEQ ID NO: 172563 - DNA, 75 bp, Artificial Sequence
  Synthetic
acgcatctctgtctcttaggattggagctgtattcaaaatgcatggaatcgtcgctctcgctatcttctttctca

SEQ ID NO: 172564 - DNA, 75 bp, Artificial Sequence
  Synthetic
ttaaataagctagagcccgcagtcccgtttttagtgggaaccatgtagttggttattttatattgcgtttcctgt

SEQ ID NO: 172565 - DNA, 75 bp, Artificial Sequence
  Synthetic
tttgatgccaacgcacttccgtcttcgttcttatgattcctatccccttttccgtcatcttgtttacccattcgt

SEQ ID NO: 172566 - DNA, 75 bp, Artificial Sequence
  Synthetic
tcaaagcgagattcctctttaagctgctcctgagttaaaaatgcttccaccgtcaacaacgtgcttttggaagtt

SEQ ID NO: 172567 - DNA, 75 bp, Artificial Sequence
  Synthetic
aagatcaatttacagtctttagcggctaccgtacgtaaactacacgacgtcttgattacagcacacatacttaaa

SEQ ID NO: 172568 - DNA, 75 bp, Artificial Sequence
  Synthetic
gcctgctgtaaatttttggcagataaattaaatcgcatgttattaacatcgtaaaatataaccttattgctgttt

SEQ ID NO: 172569 - DNA, 75 bp, Artificial Sequence
  Synthetic
gaaaactccagttcattcatctctgtcacgaattttatagtcggggggttaacctgtactataatgtgcgccatg

SEQ ID NO: 172570 - DNA, 75 bp, Artificial Sequence
  Synthetic
aaagcgtcagatttaccagagcgtttagttttagttacgggcgaaagccattttaacacctcggaaacggtcgaa

SEQ ID NO: 172571 - DNA, 75 bp, Artificial Sequence
  Synthetic
tgatcaaggtcaatcctcaacggcgatttcccgctgtctcgcaccacttcttgtccatgcacacagggaaccgac

SEQ ID NO: 172572 - DNA, 75 bp, Artificial Sequence
  Synthetic
gcctgtgtacatgtatcggaagccgtcaccaaaaccctcgtatacaaatcactatcatgctgaatgtacagcttc

SEQ ID NO: 172573 - DNA, 75 bp, Artificial Sequence
  Synthetic
gtaacctcaggattcgagatgatgttcataaaactttcaaagagtggaatatgattattaatggttttcgttaaa

SEQ ID NO: 172574 - DNA, 75 bp, Artificial Sequence
  Synthetic
aagtgctccgtatctgataaaaacaaacattccgcctgaatggtcagcttttgcacgagatgatttttagcagac

SEQ ID NO: 172575 - DNA, 75 bp, Artificial Sequence
  Synthetic
tgaattattatcgaaggctgcggagtgaaagtcactgtagtattctcttttaacagttttgtaaacgctttaagc

SEQ ID NO: 172576 - DNA, 75 bp, Artificial Sequence
  Synthetic
ggtttattaatagttttccagcttttcatatgaaaagctagggtcggcggttctctcagttctctatgttcccga

SEQ ID NO: 172577 - DNA, 75 bp, Artificial Sequence
  Synthetic
tgatcacggtgatcacgatgatgatctcgactaccgcgctccatctctgtcaagaacgaagtcctagcaccaact

SEQ ID NO: 172578 - DNA, 75 bp, Artificial Sequence
  Synthetic
ctcgactaccgcgctccatctctgtcaagaacgaagtcctagcaccaactcgcgccttctgtgctttaaaaacaa

SEQ ID NO: 172579 - DNA, 75 bp, Artificial Sequence
  Synthetic
atgaaatgaccaacacattatatactgtatttttttggcgccaacattttattacatcattataaaatgttcttt

SEQ ID NO: 172580 - DNA, 75 bp, Artificial Sequence
  Synthetic
acgtgcataaccacaccatccgagcatttcccgatcaacggtaacggatttgataaatcaaggtgtttatacatc

SEQ ID NO: 172581 - DNA, 75 bp, Artificial Sequence
  Synthetic
tcagaactacacaaaaccttatacatagcgactttgaatccagttttatacagcaacggtagcaagtgtttcaaa

SEQ ID NO: 172582 - DNA, 75 bp, Artificial Sequence
  Synthetic
ctcacagtatcgttgaaataaaatacatttgcctgcccctgatccaaaaaaggcaacccactcttatacatctca

SEQ ID NO: 172583 - DNA, 75 bp, Artificial Sequence
  Synthetic
atcaaatcattcaaaggataactaaaaccatctttgaaaacagctaaatcatccaactccttgtccgtaaataga

SEQ ID NO: 172584 - DNA, 75 bp, Artificial Sequence
  Synthetic
ttcgtgtccacgtttaaaaccctatatcccacagtcttcaaatattgctgatgcttattaaatctgttgagcaac

SEQ ID NO: 172585 - DNA, 75 bp, Artificial Sequence
  Synthetic
agattgttatacacgggaatatataacgattttaattctgacgaataaaccgaagtgacatcatttaaaccgtct

SEQ ID NO: 172586 - DNA, 75 bp, Artificial Sequence
  Synthetic
tttccaattacgactttgatgtttgaccgcctgagaattttattgtcttccatcggccagaacgattcagaagag

SEQ ID NO: 172587 - DNA, 75 bp, Artificial Sequence
  Synthetic
ttgatgatatcgaattctttctgcatggcagtaccggcagtgaaatgaatattgcgaactccgtgcatcagcaca

SEQ ID NO: 172588 - DNA, 75 bp, Artificial Sequence
  Synthetic
tctttccttagcgttgtccacaattcctccggaagcgtgcattcgacattatcgaattgatcaaagtataacatc

SEQ ID NO: 172589 - DNA, 75 bp, Artificial Sequence
  Synthetic
cccagtgcgtattttgacctgtcaaataaattgcatggctctgctcctttcatgcaacaatccacactcgttcga

SEQ ID NO: 172590 - DNA, 75 bp, Artificial Sequence
  Synthetic
acacaagtataataaatgtgttcacacatcattcgatataatcgacaagcatctggatgtgcataggataacccg

SEQ ID NO: 172591 - DNA, 75 bp, Artificial Sequence
  Synthetic
acggtcatgaaaacggaatgaagacccgtaatacagatacctagacttcgtccatctacaattccctcacgcaga

SEQ ID NO: 172592 - DNA, 75 bp, Artificial Sequence
  Synthetic
aaatctttattatctacagcataatcaattacagcattagcgaccaacaccatttttcgaaccacccgccttaat

SEQ ID NO: 172593 - DNA, 75 bp, Artificial Sequence
  Synthetic
tcattaaacataaaaaatttacactgcaaacgcacaaaatcaatctcctcggttagctcatcgcttacttcgtca

SEQ ID NO: 172594 - DNA, 75 bp, Artificial Sequence
  Synthetic
gagaataaatcttcggcgctgattcctgtaaggtcaaatatggcagaactgtcgagaaactgtgggttttcagac

SEQ ID NO: 172595 - DNA, 75 bp, Artificial Sequence
  Synthetic
cccaagaaatgcaccacattaagcaacattctcaaacaagtgttaataccgtctctgacaggtaaaacatccaaa

SEQ ID NO: 172596 - DNA, 75 bp, Artificial Sequence
  Synthetic
aaatcacccccgcaatacaaaggcacatgaggaatcatagaatactgatatacgttttttcggaaaataagtccc

SEQ ID NO: 172597 - DNA, 75 bp, Artificial Sequence
  Synthetic
tacgccagcgtggatatctcaaattttccaaacattataaggtaggcgaaccataggtgttttgcagataagccg

SEQ ID NO: 172598 - DNA, 75 bp, Artificial Sequence
  Synthetic
attctgcccctttttaaacaacggcaaattttttccacaaaactagccatagtaatttttgcatgatctgttgtc

SEQ ID NO: 172599 - DNA, 75 bp, Artificial Sequence
  Synthetic
cgctcaaactccaaatattttgtcgagaaagtaacttcgtcacactttcccagttcaaaagctatatttttatga

SEQ ID NO: 172600 - DNA, 75 bp, Artificial Sequence
  Synthetic
aaaagagaccactgcgctctttttagctcgtacctatccatgaaaatcccaggaatgatcaagcaaaatgtgacc

SEQ ID NO: 172601 - DNA, 75 bp, Artificial Sequence
  Synthetic
cgagaagtctcaggtagaacttgatacaagtccagccacgttagtgcggacacatgccagacttccacatagact

SEQ ID NO: 172602 - DNA, 75 bp, Artificial Sequence
  Synthetic
gtcaactgaaccgtcttatcggtatcacgttccaccacctgaatttgagacagtaatatctcaaaaatattcttg

SEQ ID NO: 172603 - DNA, 75 bp, Artificial Sequence
  Synthetic
gcttcctgttgataacgagtcacattcatgcttatatttgaaccgtttaacaaagccggaaaaagatgctcgccg

SEQ ID NO: 172604 - DNA, 75 bp, Artificial Sequence
  Synthetic
tttactgttataaaatccgcaagcgaatataaacatgtattgtaaatcgccacgtcgaaaaccgtactattagcc

SEQ ID NO: 172605 - DNA, 75 bp, Artificial Sequence
  Synthetic
ttttccacgaggcccaaatttgtcatacaagaaaacggtaaaacccatttttgagtaaaaagggaaaacgccaat

SEQ ID NO: 172606 - DNA, 75 bp, Artificial Sequence
  Synthetic
tcttcgaatatcacgtaaggattctcctgatatatctcccgcagataaccatttcttaacacgatctctgtcaaa

SEQ ID NO: 172607 - DNA, 75 bp, Artificial Sequence
  Synthetic
gtagcacacatacgaagatagatgcatggaatactctcttcgacaccgtttaaagaattggaaatctcctctaaa

SEQ ID NO: 172608 - DNA, 75 bp, Artificial Sequence
  Synthetic
aagcgagatgcacccaaaactcccggcatatattggtttttccaactcacacttactttatagaggacgctacga

SEQ ID NO: 172609 - DNA, 75 bp, Artificial Sequence
  Synthetic
ataaaatctcgatacttctttacaaagttcaatacatttggcataatcacattagggcatgataaaattaaatcg

SEQ ID NO: 172610 - DNA, 75 bp, Artificial Sequence
  Synthetic
tccggacaaaagtcgtaaaaaatactcgtctttagataccatcttcctagcattcgatccactcgtggaacgcaa

SEQ ID NO: 172611 - DNA, 75 bp, Artificial Sequence
  Synthetic
tgtgtagctctcaaaacagagattatggcatcccgcaaacaccaagcatctaaacctgagtcgagccgatccatt

SEQ ID NO: 172612 - DNA, 75 bp, Artificial Sequence
  Synthetic
atcttagcgatgtcacgaacccgttcatacaaaacagaagcgcatgaatattgagaataacaaaaacgtttttgc

SEQ ID NO: 172613 - DNA, 75 bp, Artificial Sequence
  Synthetic
gacgcttcgtaatgacaaacgcattttctgttgtagccaaaatctttattaatacgacgctcctttctcttcatc

SEQ ID NO: 172614 - DNA, 75 bp, Artificial Sequence
  Synthetic
ttcagacagaaggctcagaagctatacgaacacttttttctcagaaaggtcaacgaatatgttctctagctttat

SEQ ID NO: 172615 - DNA, 75 bp, Artificial Sequence
  Synthetic
caccggcagggtaattccacgatactgcagaaaacccgatttaatgtcctccgttgcgcaacgaccaatgcgctg

SEQ ID NO: 172616 - DNA, 75 bp, Artificial Sequence
  Synthetic
aacgcttccaaagtaactcagcgtggtattgctattaatgagatagttcaaaaacagaaaccgctccttttcgaa

SEQ ID NO: 172617 - DNA, 75 bp, Artificial Sequence
  Synthetic
atactgtcgcaagatatcaactaccaggtcctcgttctgaaaactggtcagaactacgtagatcccatactggag

SEQ ID NO: 172618 - DNA, 75 bp, Artificial Sequence
  Synthetic
ctttgataaaacctctttgtaaacatgaaccacgtaaacgtactgggtggaatgctgccgcggttcccagtctgg

SEQ ID NO: 172619 - DNA, 75 bp, Artificial Sequence
  Synthetic
ctctaggaaaatctcttttaataccgtaagcccgtgaatgttttctttgttagcgtcatagacatttccttgcat

SEQ ID NO: 172620 - DNA, 75 bp, Artificial Sequence
  Synthetic
gacgcatgacaacagacaactgctgccgcaagaaactaagctcgtcacaccaaacaaagacactttgtcttccag

SEQ ID NO: 172621 - DNA, 75 bp, Artificial Sequence
  Synthetic
gtacttacacgtgttgatcatcgataacacgttatcaaccattgagtttgtatacatggtagttaaagcggttct

SEQ ID NO: 172622 - DNA, 75 bp, Artificial Sequence
  Synthetic
cacgcaagcagacacattgaaagcgttcgaacaaaggaaaaacagacccacaaacagaattttagggttgtccac

SEQ ID NO: 172623 - DNA, 75 bp, Artificial Sequence
  Synthetic
atcagtctcaaaacgatacatcaacattcccaaattttcgagctccggagccaataattcgcaaggcgtgaaaac

SEQ ID NO: 172624 - DNA, 75 bp, Artificial Sequence
  Synthetic
ccttgccgctatacgtaaattctccctgccggacaaaaactgtttcagaaatttcctttctttttctacaacatt

SEQ ID NO: 172625 - DNA, 75 bp, Artificial Sequence
  Synthetic
atttaaggttcccgcctcgatagatatatattttctcttcttcacagcttccacagtatccacaatggcagctcg

SEQ ID NO: 172626 - DNA, 75 bp, Artificial Sequence
  Synthetic
tgcactcgatttagagttcattcttagttcactcaaaaacagcacgtccccagaatcattactagccgctacggc

SEQ ID NO: 172627 - DNA, 75 bp, Artificial Sequence
  Synthetic
aaaaatcgagattttatccctggcagccgatagcgtaacacacaacagagtaatagcttttattaatcgactgcc

SEQ ID NO: 172628 - DNA, 75 bp, Artificial Sequence
  Synthetic
cccgaaaaaatatcactttgaccttatcagggaatatacagttttctactttttaaactctacgaccttaacatc

SEQ ID NO: 172629 - DNA, 75 bp, Artificial Sequence
  Synthetic
agaaaataaattgctctccgcagaacttttacacgaagaactcagtcaaattcgctcttcgagttcgccgggcac

SEQ ID NO: 172630 - DNA, 75 bp, Artificial Sequence
  Synthetic
agaacttgaaaacttaaataatgcagaggtcctttacgtgttcgatcgaatactcaattccattaaaatgctaaa

SEQ ID NO: 172631 - DNA, 75 bp, Artificial Sequence
  Synthetic
aaatgagttatcgtctccaatcggcaaacttcgagtacaacccgccgccaacgacccaggtaccgataaaacgat

SEQ ID NO: 172632 - DNA, 75 bp, Artificial Sequence
  Synthetic
aaaatactccaagattcaatccatcatacaaaaggtacacagctttacacgagaaaattcacttcttgccaactg

SEQ ID NO: 172633 - DNA, 75 bp, Artificial Sequence
  Synthetic
ccgcgccgtcgtagaactgatagacgatctatatcggaaactttactcatggtttctacatattctcactttcga

SEQ ID NO: 172634 - DNA, 75 bp, Artificial Sequence
  Synthetic
ggacattcagtttccaggcgacacatttctagacaggctgttgaaaatggactactgttttacatattacccttc

SEQ ID NO: 172635 - DNA, 75 bp, Artificial Sequence
  Synthetic
ttcaaatcgccatctaatagatcttttcgaaaagacgttggacaatcaaacatccacagacatcgataaattttt

SEQ ID NO: 172636 - DNA, 75 bp, Artificial Sequence
  Synthetic
tgacacttcaggaaacagtccagaactactttatcaaaaaacgtttagcttgaaaatattttcaaaaaatctcac

SEQ ID NO: 172637 - DNA, 75 bp, Artificial Sequence
  Synthetic
agcccaggacaatggattatatatctatccactacttaaaaccgacctgtccatcctcgacttcctcggaaccga

SEQ ID NO: 172638 - DNA, 75 bp, Artificial Sequence
  Synthetic
aaatattctcttccatcgaggtctcatctatcacatacttcatcaaaaaacaatccctcaagaacgggagaatga

SEQ ID NO: 172639 - DNA, 75 bp, Artificial Sequence
  Synthetic
tctcaataaaatcaatcaatttttcgctactgtcatccagcaggttatcgaaacgagaagctcatgcttacccgc

SEQ ID NO: 172640 - DNA, 75 bp, Artificial Sequence
  Synthetic
gtcgttatcccgactcttagatacgatttttcacttcaacagaatcggtttaaacatagaaacgtgcagaatcta

SEQ ID NO: 172641 - DNA, 75 bp, Artificial Sequence
  Synthetic
cgtcgagatcctctcaaaccacatggcgacaccagacacccaacccataatcaatacattcaccatcaacttaat

SEQ ID NO: 172642 - DNA, 75 bp, Artificial Sequence
  Synthetic
ccatattgttttcaccgcgcacgtgtttttcatctgcatggaaaatttcagcccgacattcttattctataatag

SEQ ID NO: 172643 - DNA, 75 bp, Artificial Sequence
  Synthetic
gaaaaaactcatattagaacaacagagagccattttgatcatcgaacgaaatgaatattccacactctggaaaca

SEQ ID NO: 172644 - DNA, 75 bp, Artificial Sequence
  Synthetic
aatatctgatcacatcgactgtctcttcaacatctctctctccgaatccttttttaaagaatataccaaaggagg

SEQ ID NO: 172645 - DNA, 75 bp, Artificial Sequence
  Synthetic
aaacgaagaacataaacagtttctatacaaaaacctattcgaaaaatggggtgacgtctttttccctttcacgta

SEQ ID NO: 172646 - DNA, 75 bp, Artificial Sequence
  Synthetic
ctcggtaaccacctcaaaaaactccacggcacaccatattacaacccttgagctaagggccatctgcaaagaggt

SEQ ID NO: 172647 - DNA, 75 bp, Artificial Sequence
  Synthetic
ctatcagagcgattccccggaggcatacgaatcgttacttccctacagcactcatccagcttttaaaacattatt

SEQ ID NO: 172648 - DNA, 75 bp, Artificial Sequence
  Synthetic
cattaaaatctacgttatacctatggtcacatacattaccaatcttacctttgataaattacaatctgattacag

SEQ ID NO: 172649 - DNA, 75 bp, Artificial Sequence
  Synthetic
actcataactctgatccacgcctgtaaactcctactcccctcgcaacatctactactacactacatggtgtggct

SEQ ID NO: 172650 - DNA, 75 bp, Artificial Sequence
  Synthetic
atacgctttttccataaacgtagaccacatagatctaggcactttcaccgtaataaagtccgtaatctttaaaat

SEQ ID NO: 172651 - DNA, 75 bp, Artificial Sequence
  Synthetic
cgctgaccacataaacgtgatgacgcatacgatctactcccctgagacaaaccttctcgtaagcattctactaaa

SEQ ID NO: 172652 - DNA, 75 bp, Artificial Sequence
  Synthetic
catacgatctactcccctgagacaaaccttctcgtaagcattctactaaacgcgtataccgactaccttcaaaaa

SEQ ID NO: 172653 - DNA, 75 bp, Artificial Sequence
  Synthetic
tacgtaaacccctggatcaaacagaccataacggcaaacttctccctgttacagacgtacataaccttcacgaaa

SEQ ID NO: 172654 - DNA, 75 bp, Artificial Sequence
  Synthetic
caatgcgccagcatcttagcgaccaaatgcaacataaacttagacaatctatttatctccatgactatcggaaca

SEQ ID NO: 172655 - DNA, 75 bp, Artificial Sequence
  Synthetic
aatgcaacataaacttagacaatctatttatctccatgactatcggaacagacaaaattgtaaccacttcgtttt

SEQ ID NO: 172656 - DNA, 75 bp, Artificial Sequence
  Synthetic
gctccttcatcgctacatgcagaaatttagtacgtcaacacgaagaattcaaaaaatcactaaaaacgatcgaaa

SEQ ID NO: 172657 - DNA, 75 bp, Artificial Sequence
  Synthetic
tttagtacgtcaacacgaagaattcaaaaaatcactaaaaacgatcgaaacttccaaaaccacactcacgaatat

SEQ ID NO: 172658 - DNA, 75 bp, Artificial Sequence
  Synthetic
gctactaaacataatcacaagcgtctcctcctccaaggagctgctgaccaacgaagcactacaaaaattcatcga

SEQ ID NO: 172659 - DNA, 75 bp, Artificial Sequence
  Synthetic
cactgtccaacgcatctcccaacacgtaaacgaaacataccaattaatttccgtgaacctcgaaaaatgtaaaat

SEQ ID NO: 172660 - DNA, 75 bp, Artificial Sequence
  Synthetic
ctcaaacgacatcctaatcgaatccctaaagaagaccatctccatagttgatgtactcagctccgatgcaatcct

SEQ ID NO: 172661 - DNA, 75 bp, Artificial Sequence
  Synthetic
aaacacgtcgttaacttctagatgtctggaggccgccacgctcgcggtttcaaacaattctttcacaatactcga

SEQ ID NO: 172662 - DNA, 75 bp, Artificial Sequence
  Synthetic
aattaaaaaggacgcagttgccgttttcaagccttttataacacaactatttgaaagcatgaaacccaccacgag

SEQ ID NO: 172663 - DNA, 75 bp, Artificial Sequence
  Synthetic
tctatataagaaattgatggctacccaaaaactgaccaccgaccgcattccatttctcgatatcttcgacgatag

SEQ ID NO: 172664 - DNA, 75 bp, Artificial Sequence
  Synthetic
gtacaacctagtcagacacgtcgaacgacaattaaactggtacgccgcatatgccgaagcagcgcagcaagatct

SEQ ID NO: 172665 - DNA, 75 bp, Artificial Sequence
  Synthetic
tattgctcctcttacgttttaacggtcgcgttctaacccatgaaaatcattaccagtagcacgaaccaaaatgac

SEQ ID NO: 172666 - DNA, 75 bp, Artificial Sequence
  Synthetic
tctaaatacggaccgagagccggaaaacaatgcatgtcgaacagcttttcatttctccacactgtttacttaaac

SEQ ID NO: 172667 - DNA, 75 bp, Artificial Sequence
  Synthetic
ggaattaacaattctctcaatgcgggtactatagacgccataatggaagaaggctatcacttagacacggccagc

SEQ ID NO: 172668 - DNA, 75 bp, Artificial Sequence
  Synthetic
accttagctctaatgctagataactcagattcgcaagactacagactcctcaccgaaatccccagaaggatccat

SEQ ID NO: 172669 - DNA, 75 bp, Artificial Sequence
  Synthetic
tctaggtacggcgtcacacagcatgaactctcacggccatttaacggaaccctagacacacagaaaattgacaat

SEQ ID NO: 172670 - DNA, 75 bp, Artificial Sequence
  Synthetic
gaggtctattttggcctcatagatttcatactgtatggcaaaaccaagaattgtccagcttttgcagtcatcacg

SEQ ID NO: 172671 - DNA, 75 bp, Artificial Sequence
  Synthetic
tcatactgtatggcaaaaccaagaattgtccagcttttgcagtcatcacgatcggcgtgctatcgcgagcaattt

SEQ ID NO: 172672 - DNA, 75 bp, Artificial Sequence
  Synthetic
tttttcttaacaatactctctacttattcgactctcacccgactgaacgagaagccacagcagccatctacatct

SEQ ID NO: 172673 - DNA, 75 bp, Artificial Sequence
  Synthetic
gtcaagacattgaagaagcttatgaactgctcaccgcccacggcactgaaggcttctactacgacgccagcttca

SEQ ID NO: 172674 - DNA, 75 bp, Artificial Sequence
  Synthetic
tttttttcatagaaacctccaatttgtcgctctctagtcacgacgccgagcttcttatcctaaaaacttataaag

SEQ ID NO: 172675 - DNA, 75 bp, Artificial Sequence
  Synthetic
accccgacatagcgattacgctagataaattttcttccacggaaatccatgatataaaaaaaacagatgatatcg

SEQ ID NO: 172676 - DNA, 75 bp, Artificial Sequence
  Synthetic
taaattttcttccacggaaatccatgatataaaaaaaacagatgatatcggatcgcaacaagacctcgttgcggc

SEQ ID NO: 172677 - DNA, 75 bp, Artificial Sequence
  Synthetic
taaaacgacatatctagaacgcgcgccccagaaaagaaagaaaaactctcatagtctagaactagaactaaatga

SEQ ID NO: 172678 - DNA, 75 bp, Artificial Sequence
  Synthetic
caagaagaaaaaagataccgcatccttgacatattacgcaacggaagtcgacctgattccgagcttttatgaact

SEQ ID NO: 172679 - DNA, 75 bp, Artificial Sequence
  Synthetic
acgatcacaatttcaatctttatttcacgatctcaaatcttttcctataatgaaatctcaattcaactggaccat

SEQ ID NO: 172680 - DNA, 75 bp, Artificial Sequence
  Synthetic
atacttacaagattctcccatgaatcctaatcagcccttcgcaacaccctttctctggaacagagtttttcactt

SEQ ID NO: 172681 - DNA, 75 bp, Artificial Sequence
  Synthetic
attgtgtcaaatcgtcgacgtgtttgtaggcgtcggatccacaaatgacgattctagcaaacaaaagcagcaaac

SEQ ID NO: 172682 - DNA, 75 bp, Artificial Sequence
  Synthetic
gattttcataaattatttattgcctttcaaggacttttccgaagtattcaacgaggcgttgacagcttgtcaaga

SEQ ID NO: 172683 - DNA, 75 bp, Artificial Sequence
  Synthetic
aaacaatctggacatcctcttgatttacaataattacctgtgcaaaaccacgacctttcgaacactcgagagaat

SEQ ID NO: 172684 - DNA, 75 bp, Artificial Sequence
  Synthetic
cttactaagcaaatttctggcaatagctgataatgagcacgaaaaacattatgaatgggtcaaatcgtggaccac

SEQ ID NO: 172685 - DNA, 75 bp, Artificial Sequence
  Synthetic
acaaatgctccaagagatgccaaagaaactagatgacatagagaattatctaaaagcctatgtgagccagaaccc

SEQ ID NO: 172686 - DNA, 75 bp, Artificial Sequence
  Synthetic
tgtgaaacacttccatgaattcgtttgtctgaataaggcagaaaaacacaacatagctgttctgctcaacgaaaa

SEQ ID NO: 172687 - DNA, 75 bp, Artificial Sequence
  Synthetic
acgaaaagagattcaagaagatattgaacgagacaagaatattttcgcacaactctctaattttattgacaaact

SEQ ID NO: 172688 - DNA, 75 bp, Artificial Sequence
  Synthetic
cggcgaaactcccgcacttcctatcgaatcagaaaacgtgcacaaagttcacacgagcgacatcactgaagccat

SEQ ID NO: 172689 - DNA, 75 bp, Artificial Sequence
  Synthetic
cgttccgcgtttcatgactgaatcgattgaattaccaaacatctccacactgaacaacacccaacaattatccct

SEQ ID NO: 172690 - DNA, 75 bp, Artificial Sequence
  Synthetic
agaaaaacaaatcagtgaaaaactcaccaacaccatccacacactcagaaacaaattcacaaaaatcgtacaaga

SEQ ID NO: 172691 - DNA, 75 bp, Artificial Sequence
  Synthetic
taactataacaatctcgctgccggtttcatgccagttaccgaactgaattgcctatttgcctacctggtaaacct

SEQ ID NO: 172692 - DNA, 75 bp, Artificial Sequence
  Synthetic
ttattttaacattgaagttttaaaacacagcggcctaaacattaacactgagttgcttcaagaagtggaaaaact

SEQ ID NO: 172693 - DNA, 75 bp, Artificial Sequence
  Synthetic
gtatgacaacacgcaatttctacgcttcggaacttctcacttcaatataaacaacctttcgaactttaccctatc

SEQ ID NO: 172694 - DNA, 75 bp, Artificial Sequence
  Synthetic
tatcagaaaaatgttcgtcgatttctataacagtcaaaaaccctcggacagagcttccgaaatcctagccgcaat

SEQ ID NO: 172695 - DNA, 75 bp, Artificial Sequence
  Synthetic
cgaatccatcttagcggaccccagcaaaaacaagacaatcgtaaatatagaaatgatcaaatcacaactggaaga

SEQ ID NO: 172696 - DNA, 75 bp, Artificial Sequence
  Synthetic
actggggaaaatggaaatctccaccaccgaaaacaagcaaacagctgaaatcacaaaacaaatccttggggacca

SEQ ID NO: 172697 - DNA, 75 bp, Artificial Sequence
  Synthetic
agagttaacccctatttacgatttcctgcaccatctctctgcttataacctacctaatactacgaccgtaaaaaa

SEQ ID NO: 172698 - DNA, 75 bp, Artificial Sequence
  Synthetic
tttacacctccatttcatcttagaaaaacgaccagatatcgctgcgattctccacgataaaatacaatccatact

SEQ ID NO: 172699 - DNA, 75 bp, Artificial Sequence
  Synthetic
tgacatatgtatagacgacatgctcaatgacataacagtccctgagcagacgttttcaaccgttctatttcttgt

SEQ ID NO: 172700 - DNA, 75 bp, Artificial Sequence
  Synthetic
agatctcttcccaaacagcaccgaaaaaacagcactgttcgaatccgttctcacactacggcaattagcaaagaa

SEQ ID NO: 172701 - DNA, 75 bp, Artificial Sequence
  Synthetic
atgcgctaacttaaaaactctagaagaattcgacgatctggcccagttcatcacgacgaacagcgaacaactcca

SEQ ID NO: 172702 - DNA, 75 bp, Artificial Sequence
  Synthetic
aaacatgatgaaacagcattttggaaaaaaaataccaacgctgatggatcatatcaaatttctctactctcaaaa

SEQ ID NO: 172703 - DNA, 75 bp, Artificial Sequence
  Synthetic
aataatcaccgctgaagagaaaaattggatacagagagcaaaaacagccgtcattacatctcccgaagaactgac

SEQ ID NO: 172704 - DNA, 75 bp, Artificial Sequence
  Synthetic
agccttcttagccactgcacccactaaacacgccttacaaacttgcaagcctgagctcgataaagcactacaacg

SEQ ID NO: 172705 - DNA, 75 bp, Artificial Sequence
  Synthetic
acatatggaagagcaaatgaaacaaactgctgaaaacgacaaaaaacacatcctcacaatcagaaacaccctcga

SEQ ID NO: 172706 - DNA, 75 bp, Artificial Sequence
  Synthetic
aaaaagactgaacgacatcttactcattctaaaagacggtcaattctcgtctttggaaacagtgcatttgaatct

SEQ ID NO: 172707 - DNA, 75 bp, Artificial Sequence
  Synthetic
tttagaaacctttctaaaacaattgcaggataacgatctcatcattcacttcactcatgcactactgccagtgtt

SEQ ID NO: 172708 - DNA, 75 bp, Artificial Sequence
  Synthetic
aaaggacatagaaacgaccatcagcaagaccatctccgacattctcgaaaagatattaatcaaaactcctctaaa

SEQ ID NO: 172709 - DNA, 75 bp, Artificial Sequence
  Synthetic
ccccgaacagatgtccaaggaagaacaaaaatatacccctttactcagtttcttatccaagttcaaaaaaacaac

SEQ ID NO: 172710 - DNA, 75 bp, Artificial Sequence
  Synthetic
attctgcacagaagatgtaaaaacagagatcgaccaaatgcaaaaaagtatcacgttcctcacgaaaattgctac

SEQ ID NO: 172711 - DNA, 75 bp, Artificial Sequence
  Synthetic
ctccactaataaatatactagaatcagccactccgtctacggacaagaattaaacctctacgaagaacgcatcac

SEQ ID NO: 172712 - DNA, 75 bp, Artificial Sequence
  Synthetic
agagctgaaaaaagagacgaacaaaataaaagaacagctctccaaagaatacgcagtagctgagaaaaaaattct

SEQ ID NO: 172713 - DNA, 75 bp, Artificial Sequence
  Synthetic
tctctcgtcacaagatgcaaaaaccaataaaatttatctagtcctaaatacgcacacgctgaaagaaataaaaaa

SEQ ID NO: 172714 - DNA, 75 bp, Artificial Sequence
  Synthetic
aataaaatttatctagtcctaaatacgcacacgctgaaagaaataaaaaacacccaattcagagaaacggcattc

SEQ ID NO: 172715 - DNA, 75 bp, Artificial Sequence
  Synthetic
gataacgtaagccaattctgggtacgagccactcgtcaagctttcggtgacaattttgagggtgaagtcgtagtt

SEQ ID NO: 172716 - DNA, 75 bp, Artificial Sequence
  Synthetic
gctaaagctctcacggtcgaagtcaacaacaaagaaaatcaactccaggagctgttaaaccactttaacgcacac

SEQ ID NO: 172717 - DNA, 75 bp, Artificial Sequence
  Synthetic
ctaaaggcgaaaatggatcagaaccatataacaaaactttcattcgatacaaaatggacagcctttgtttcggat

SEQ ID NO: 172718 - DNA, 75 bp, Artificial Sequence
  Synthetic
tccaggctctacttcccagacttcgttgacatcaaactgcaggactttatttctgatccctttaaagttataagt

SEQ ID NO: 172719 - DNA, 75 bp, Artificial Sequence
  Synthetic
cagctgatgaacaaagcagccaacgagatgccttacattcaagcagagataactctcaaatggttaacacaatta

SEQ ID NO: 172720 - DNA, 75 bp, Artificial Sequence
  Synthetic
gtacacgacatcaacaaattctgcctgtcagctataagcgaattcgggaaagaagcaatcccgttcaattacgcg

SEQ ID NO: 172721 - DNA, 75 bp, Artificial Sequence
  Synthetic
gccctacgagatttggaataccagattaacaccaagtacgtagaaattgaaaacaaagtcatctgcaacgaaacc

SEQ ID NO: 172722 - DNA, 75 bp, Artificial Sequence
  Synthetic
gtcgagaacacgaaaaacattccgaaactgactaagctcttgaaggagttagatcctaaacgcgttgccggtggc

SEQ ID NO: 172723 - DNA, 75 bp, Artificial Sequence
  Synthetic
cagaaacagtatcaaactctcatgaacaagattctcacttccgaaacttctatgcaacagacctacgaaaaagaa

SEQ ID NO: 172724 - DNA, 75 bp, Artificial Sequence
  Synthetic
caactcaaaaaagaatacttcgagaccgtcaataatgtcgccagcttcaagttagcattcaactttcctaagcaa

SEQ ID NO: 172725 - DNA, 75 bp, Artificial Sequence
  Synthetic
cgacaaaatgtggaacgactaatggagaagttcaagtcgctgcccaaaggccagccatttgaaaaatttccagag

SEQ ID NO: 172726 - DNA, 75 bp, Artificial Sequence
  Synthetic
gaaaatgacctattttctgactcactcatcacagaaaattatattaacggtctgcgcgcactcctcaacttcata

SEQ ID NO: 172727 - DNA, 75 bp, Artificial Sequence
  Synthetic
tcatcacagaaaattatattaacggtctgcgcgcactcctcaacttcataacggctgcgcaaaactacatccaga

SEQ ID NO: 172728 - DNA, 75 bp, Artificial Sequence
  Synthetic
acacacttctgaaacaatgggcggtatttcagcaacaaaatttcatcccgatcgattactcagtagcgaatgtca

SEQ ID NO: 172729 - DNA, 75 bp, Artificial Sequence
  Synthetic
agcctatttcggatttatatgcccgcctcaggattgaacgggaccgtcaagtgttctaccaagtaaactctgtct

SEQ ID NO: 172730 - DNA, 75 bp, Artificial Sequence
  Synthetic
ttggaactcaactaattgttgacgaaacaggagttccgctgcaattccacaacatcttttacaacgccgtagtga

SEQ ID NO: 172731 - DNA, 75 bp, Artificial Sequence
  Synthetic
agtttttctccctgaactacaagcagattcatgtaccagaagacaccccccgcctggtatctagccaatataaac

SEQ ID NO: 172732 - DNA, 75 bp, Artificial Sequence
  Synthetic
tcctgtccgtgtgtaaatctttcataattatactacagcagttctgggagaatataatcactctggacctaggcc

SEQ ID NO: 172733 - DNA, 75 bp, Artificial Sequence
  Synthetic
aattatactacagcagttctgggagaatataatcactctggacctaggcccgtacctcagagacggtacacaaaa

SEQ ID NO: 172734 - DNA, 75 bp, Artificial Sequence
  Synthetic
ttttaaaagagaacttataccgatcgtgaacttgaaattatttatatacatcataacacaagcctggacagcatc

SEQ ID NO: 172735 - DNA, 75 bp, Artificial Sequence
  Synthetic
tgaagacagtactgtttccacagcgttcgaattgcccatcaagcaattcacacttttgatactatgctcacatcc

SEQ ID NO: 172736 - DNA, 75 bp, Artificial Sequence
  Synthetic
tgaatatctctacggctgtctcagtcatccaacagatctggttataaattcattagccaaaagcatagacaaaga

SEQ ID NO: 172737 - DNA, 75 bp, Artificial Sequence
  Synthetic
cagtctctatgacacattcgtcgttagccacaaccctcccgagaagcccatgcatttgatgagaagtatatgtat

SEQ ID NO: 172738 - DNA, 75 bp, Artificial Sequence
  Synthetic
cgacacccagctatggcaatccgccaaacttatgaaagataccttccaacaaacattttttacacaactgtgccc

SEQ ID NO: 172739 - DNA, 75 bp, Artificial Sequence
  Synthetic
ccaaaacgaaaagttttttatctatctcactgccttcttaattctcccctacaaatttctgaactatatttggat

SEQ ID NO: 172740 - DNA, 75 bp, Artificial Sequence
  Synthetic
tcaatacaaaccgatcacttttacccaaagatcttatcaaaacttaattaaggacctatgctccgaatacgtaca

SEQ ID NO: 172741 - DNA, 75 bp, Artificial Sequence
  Synthetic
ccaaaataagatcaccatgtcctcggtaactccccacgaaccggacacaataaaatccggagaaaagattacctc

SEQ ID NO: 172742 - DNA, 75 bp, Artificial Sequence
  Synthetic
aaaaatcaccgtacacaaagcacaaaacacaccgacactcactcgcctgcaggctcaggaatatgtcttcgacta

SEQ ID NO: 172743 - DNA, 75 bp, Artificial Sequence
  Synthetic
cattctttactctttcttgacggggtacgaaatgacattcgctatgtacatcgacaccatcgaaaaaacatacct

SEQ ID NO: 172744 - DNA, 75 bp, Artificial Sequence
  Synthetic
gctttgcatgagacacctggaaaacgtactccacgataaagacttccaatccgtcctcagagcacgcacattcga

SEQ ID NO: 172745 - DNA, 75 bp, Artificial Sequence
  Synthetic
catcaactacatcctgaaacagtcatggactaagaacatagtcgaacattcaatcttttcagtacagctcaataa

SEQ ID NO: 172746 - DNA, 75 bp, Artificial Sequence
  Synthetic
tgttgttaggaccggttgcggtgccatgtttctgtgaagagtgggacaccaacgactatttatcgaaatctggat

SEQ ID NO: 172747 - DNA, 75 bp, Artificial Sequence
  Synthetic
atgtttctgtgaagagtgggacaccaacgactatttatcgaaatctggatgtaaatgtctaggtccgatcttata

SEQ ID NO: 172748 - DNA, 75 bp, Artificial Sequence
  Synthetic
aatcgtctcctacctcaaccacacaaacagagcgacacccaatattcccctgatactatttaattatgacaacga

SEQ ID NO: 172749 - DNA, 75 bp, Artificial Sequence
  Synthetic
aacagagcgacacccaatattcccctgatactatttaattatgacaacgaagttgtcaacgtttatctaccgccg

SEQ ID NO: 172750 - DNA, 75 bp, Artificial Sequence
  Synthetic
tgatactatttaattatgacaacgaagttgtcaacgtttatctaccgccgatgtccactgatccaaaaaaagtcg

SEQ ID NO: 172751 - DNA, 75 bp, Artificial Sequence
  Synthetic
ctttctacataaaaaatcctttccactttcccgtgcaagaatacgaagcgacagatttaatttcctttcatctct

SEQ ID NO: 172752 - DNA, 75 bp, Artificial Sequence
  Synthetic
acccaaaaacaacagatattttaaaccaacttccgcccaataaaactgtgtctactcgcccatacaaccttagct

SEQ ID NO: 172753 - DNA, 75 bp, Artificial Sequence
  Synthetic
ctgaaactttaaccaccaaaaacctctccgaaccaaagtttaaacagcctaccgttactggacttatgcccaaga

SEQ ID NO: 172754 - DNA, 75 bp, Artificial Sequence
  Synthetic
gccaatcaatcatcctatccactgataccaacgtactggaaaccagtccagacataaaagctaacacggccagcg

SEQ ID NO: 172755 - DNA, 75 bp, Artificial Sequence
  Synthetic
cagcgataaaagatgtcactctagctcgagaacaaatcagcgagttctccgaatcgataaatacaactctttcaa

SEQ ID NO: 172756 - DNA, 75 bp, Artificial Sequence
  Synthetic
aattaaaatctttgtatctgtaacattcgacacacaaagtcatgcttcttttataaatttttattagttaaacat

SEQ ID NO: 172757 - DNA, 75 bp, Artificial Sequence
  Synthetic
acgaaataaatgaagctttcatcaatcactccctgtttttgtgttcagtctatgcagcgccagcattcttatcaa

SEQ ID NO: 172758 - DNA, 75 bp, Artificial Sequence
  Synthetic
atcgagtcggaacgccgttttatccacgttaccgccgttctgcttagcgtattttggcaaaaagaccccaaggac

SEQ ID NO: 172759 - DNA, 75 bp, Artificial Sequence
  Synthetic
gggatgattggccatggtaggctgcagccctaaaacaccggtaagcatctgctgcttcttcttttcctcctcttt

SEQ ID NO: 172760 - DNA, 75 bp, Artificial Sequence
  Synthetic
tttcgaaatttgcttctgttgtattacgattacagtttgccgggcgaatgcaaaacaaacgaagaaaacgttttg

SEQ ID NO: 172761 - DNA, 75 bp, Artificial Sequence
  Synthetic
ttttgaagaacttcctgaaatctgagtgatctgattcgacaaatcatcaccacgtatggtcgtcatttcaaatac

SEQ ID NO: 172762 - DNA, 75 bp, Artificial Sequence
  Synthetic
aagtgcggtcccgccaggcgtgagaccagattttaccttcgtggcacaactgcctaaacgtaaagagttgcctaa

SEQ ID NO: 172763 - DNA, 75 bp, Artificial Sequence
  Synthetic
acctcacgttttgggaaatctgacaaccttgacagatattaacacagtcttccagatctaagcaagtctctctaa

SEQ ID NO: 172764 - DNA, 75 bp, Artificial Sequence
  Synthetic
ccagattttaccttcgtggcacaactgcctaaacgtaaagagttgcctaatgtccccggtggtattgattttgct

SEQ ID NO: 172765 - DNA, 75 bp, Artificial Sequence
  Synthetic
acgaatgctgacaatgctgacactgaaaatcagaaccgtgtgaaacaagccgtaacaacttcttgacggtcacgt

SEQ ID NO: 172766 - DNA, 75 bp, Artificial Sequence
  Synthetic
tgtagagatgcacagtagaataacaggatctacacgaacaaggaacaataacatcgaacttcacattgtcattta

SEQ ID NO: 172767 - DNA, 75 bp, Artificial Sequence
  Synthetic
aaatagtgcaagcagaatttgttccgatcaccgccttccatgaaacagtttccaccttcatccccaatacacaat

SEQ ID NO: 172768 - DNA, 75 bp, Artificial Sequence
  Synthetic
catacatttaaagaacctgcgtttactgtaagcacgtttgtttcaaatgatgatttagatatgagttcattgaat

SEQ ID NO: 172769 - DNA, 75 bp, Artificial Sequence
  Synthetic
gctcagacatttcatatatccgctcgaacaccaactgctgactcccacacagcgaacaatacattacatccgtat

SEQ ID NO: 172770 - DNA, 75 bp, Artificial Sequence
  Synthetic
gcatgctgtatatcaaatttttctcctgcttgtctctaaaatagaacatggagctcaacgaaaagccctgcggcg

SEQ ID NO: 172771 - DNA, 75 bp, Artificial Sequence
  Synthetic
aacacaacttttcttttccggagtttaaacagtgaccacattttgcacaaataacgcaaatgtaactctcttcaa

SEQ ID NO: 172772 - DNA, 75 bp, Artificial Sequence
  Synthetic
gtataaaccgagaacatttagtcttacaatagcacatgacgggtaacgaaataacactggtagctaagccatcct

SEQ ID NO: 172773 - DNA, 75 bp, Artificial Sequence
  Synthetic
ttaaggacgttgccagggcaaaggttagaatctttggaaaatcaccccgttcaggtttgctcggcaccataggta

SEQ ID NO: 172774 - DNA, 75 bp, Artificial Sequence
  Synthetic
ctagattattatgctccactggaataagatatctgtctgcgctaaaacagaagttttccaccaaagccttcgcca

SEQ ID NO: 172775 - DNA, 75 bp, Artificial Sequence
  Synthetic
cggaatctacatcagattccgtttctcgttaaacagtttcttatttttttacgtcttggcctgttaatgggttac

SEQ ID NO: 172776 - DNA, 75 bp, Artificial Sequence
  Synthetic
acgtcttggcctgttaatgggttacgggcactctcggcgtaacaaggtgcatgatatcatgttacacttaatttc

SEQ ID NO: 172777 - DNA, 75 bp, Artificial Sequence
  Synthetic
tagtaaacatgaaattccccgccggagatttcaaagcatacttttgcaacatggagggaaatgacaaaacgtgct

SEQ ID NO: 172778 - DNA, 75 bp, Artificial Sequence
  Synthetic
ctctctgcctatatcgcaacatcaccgtctcggtctgctcatagtcacgtaaacagaatagcctcatacacggta

SEQ ID NO: 172779 - DNA, 75 bp, Artificial Sequence
  Synthetic
agttgacgtgcgtcggaatcggaagcaacaactgttgctcgaacagaaacatgtgcaactcattgatttcggaaa

SEQ ID NO: 172780 - DNA, 75 bp, Artificial Sequence
  Synthetic
acgagggcatctccagcaacttattaagcttgtacgagggataaaccctaaatctagtctcgacgtccatccatt

SEQ ID NO: 172781 - DNA, 75 bp, Artificial Sequence
  Synthetic
tgattcttttaagtttataaagagacaacaattcgagaactttgcactgccgatacacgaaatacagataggcga

SEQ ID NO: 172782 - DNA, 75 bp, Artificial Sequence
  Synthetic
gcaaaacaaaaagaccctttgtcataaccattttgttaaaaagtcgcttagtgataaatcgtgtctccggcctgc

SEQ ID NO: 172783 - DNA, 75 bp, Artificial Sequence
  Synthetic
aacgcagccaaattgcaaaaaactcattgtaaaatttttccgttacttccttattcaggaattttttatttgtca

SEQ ID NO: 172784 - DNA, 75 bp, Artificial Sequence
  Synthetic
agaacattgtaagaacacattttcctggcacacaggcgtcacccatcacaaacaattgcaaatgagtgtacggcc

SEQ ID NO: 172785 - DNA, 75 bp, Artificial Sequence
  Synthetic
catgtttacacaacggggccagaagctggcgtaggagtttttttaagtagaacataacaaaaatacaaggctaaa

SEQ ID NO: 172786 - DNA, 75 bp, Artificial Sequence
  Synthetic
agaaagcagatgctgacaatcgcaacccgacaatgcctttcacttagtctcgaaaacttcacaccggacaggaat

SEQ ID NO: 172787 - DNA, 75 bp, Artificial Sequence
  Synthetic
gacttttctttttcatagaactggtttatactctcctgtgatgtcacaaccgcagaagctttatttgcaatttct

SEQ ID NO: 172788 - DNA, 75 bp, Artificial Sequence
  Synthetic
ccgctacttccgagttgccccttttccaaaacatgtgaagaccttcttcgcaaaccttgacaaaacctattcgat

SEQ ID NO: 172789 - DNA, 75 bp, Artificial Sequence
  Synthetic
cggtgcaggagttgtctattttcagagagagattgtcgtatatttactatgtgctcgggttagatgttgatatcg

SEQ ID NO: 172790 - DNA, 75 bp, Artificial Sequence
  Synthetic
agagagattgtcgtatatttactatgtgctcgggttagatgttgatatcgtagcgcggacagagagggagatttt

SEQ ID NO: 172791 - DNA, 75 bp, Artificial Sequence
  Synthetic
tcgagatgctgtttccccatagaacacttctttaagaaaattgccttcaaaagcgaaatgtattcagattcgttt

SEQ ID NO: 172792 - DNA, 75 bp, Artificial Sequence
  Synthetic
tcaggcccaaacgccacaaactccacaacgtaagtttcgtctcgattacgcctaattatacatttcgtgaacact

SEQ ID NO: 172793 - DNA, 75 bp, Artificial Sequence
  Synthetic
gcaaaagttgaaggcttcatagccactatgtcgctcatgcgaacagtcaaacattcattaacacgcagaatgttg

SEQ ID NO: 172794 - DNA, 75 bp, Artificial Sequence
  Synthetic
cattctctcacagcatgatggccttctgctttaaccggggcatgcaaatagcaagacatcgacacagctccgcct

SEQ ID NO: 172795 - DNA, 75 bp, Artificial Sequence
  Synthetic
gtgtttttgaacacaaatctcggttcctgcttagttacatgttcccagagactcaacagatattctagattataa

SEQ ID NO: 172796 - DNA, 75 bp, Artificial Sequence
  Synthetic
gcgtagtctaacttgagaataatatcacacaaaggaaatttcggatttttcgacaataaattccgctcagtcatc

SEQ ID NO: 172797 - DNA, 75 bp, Artificial Sequence
  Synthetic
ctatagtcatgagaccccaactttaagatacgacaggtcgcactcagtagttcatcgtacatcttttctttgagt

SEQ ID NO: 172798 - DNA, 75 bp, Artificial Sequence
  Synthetic
acgttagccatttcacctatttaaaagctattccgtatttaaatattcttgatgttctaatattccatttacatt

SEQ ID NO: 172799 - DNA, 75 bp, Artificial Sequence
  Synthetic
agctattccgtatttaaatattcttgatgttctaatattccatttacatttaacagctttgacaatatcgaagtg

SEQ ID NO: 172800 - DNA, 75 bp, Artificial Sequence
  Synthetic
gatgttctaatattccatttacatttaacagctttgacaatatcgaagtgagaagtaccattttctgagccatga

SEQ ID NO: 172801 - DNA, 75 bp, Artificial Sequence
  Synthetic
cctctcgatgcacgcaatcgacatccccgtgaacgtatctagaaaaagcaacgtgtctatatccaacactaagaa

SEQ ID NO: 172802 - DNA, 75 bp, Artificial Sequence
  Synthetic
aattcagtcgcgcctccaaagaaggaagcatcatttcatataatcgtggcagcattggataaaacacgacctcaa

SEQ ID NO: 172803 - DNA, 75 bp, Artificial Sequence
  Synthetic
actcccttccctgctcacagacttgctcatacaaaagttcaagattcgtcttttcaggtgaggagtccatcatgt

SEQ ID NO: 172804 - DNA, 75 bp, Artificial Sequence
  Synthetic
acaaaggatgggactcagaagcgttgtctatacaatctgagatagtaaacgagattctgttatattgctacctca

SEQ ID NO: 172805 - DNA, 75 bp, Artificial Sequence
  Synthetic
ctccccaaccaccaattccttccgagacgacaacagccaccagccccacgaacatagaaaacgaaatctccaatt

SEQ ID NO: 172806 - DNA, 75 bp, Artificial Sequence
  Synthetic
tagaaagctctgaaaacctagaggaattaaagcgattatccgtcgcattaaatatagacagacgatgcaatatct

SEQ ID NO: 172807 - DNA, 75 bp, Artificial Sequence
  Synthetic
gctccatcgtaaatctgtgcctcaaacaaaacaaatcatggatctacgactacagtctactgtgctacaaatgca

SEQ ID NO: 172808 - DNA, 75 bp, Artificial Sequence
  Synthetic
actacgcgccaaagactccattgtctcttctgattgtctccgcggaatttataatgttaatacgagaacgatttc

SEQ ID NO: 172809 - DNA, 75 bp, Artificial Sequence
  Synthetic
caaacatcaattttgacggcctttttcagaacaacattgtctccatctttgacttccacgttcatttttttattc

SEQ ID NO: 172810 - DNA, 75 bp, Artificial Sequence
  Synthetic
gacttccacgttcatttttttattcacagatgcttcgcaaatacggtcaacgatcacatccaaagcgaaaacata

SEQ ID NO: 172811 - DNA, 75 bp, Artificial Sequence
  Synthetic
cgatcacatccaaagcgaaaacataaccctgaatcacatggccataatccgatcgaccctactaaaagaagacag

SEQ ID NO: 172812 - DNA, 75 bp, Artificial Sequence
  Synthetic
tataccgcacatcaaaataaaaaaatttctaaccaaaaaaatgaacccgaaaaaaacacaaagccccgaactgaa

SEQ ID NO: 172813 - DNA, 75 bp, Artificial Sequence
  Synthetic
taaaaaactcacagtgcccatgaagactcgcttcacgacactcttattctatatgtggtctggcacaaacgtctt

SEQ ID NO: 172814 - DNA, 75 bp, Artificial Sequence
  Synthetic
cgaccgagttcccttcacggacctaactatccgcaaacatcgcttcatcaaaaacctgtattccaacaaaaccga

SEQ ID NO: 172815 - DNA, 75 bp, Artificial Sequence
  Synthetic
catcgaactcacagctggtcccattctcttggcacagattccattttccatcaccaaaaacaaaacaaccagcgt

SEQ ID NO: 172816 - DNA, 75 bp, Artificial Sequence
  Synthetic
ctgtctgctatgtgaactgatggcagcttccaaacaagattacctatttttaaaatatctacatcaaagcatcat

SEQ ID NO: 172817 - DNA, 75 bp, Artificial Sequence
  Synthetic
ggactactgtcaaaacaacctaaagatgatagatagagttcagttcgtcattgccgatatcttcgagaagacaaa

SEQ ID NO: 172818 - DNA, 75 bp, Artificial Sequence
  Synthetic
aatacacatgcacgtcaagaatctttccgactacagcaaggcgatattcgataacgaattctcattctccgatga

SEQ ID NO: 172819 - DNA, 75 bp, Artificial Sequence
  Synthetic
taacttcactctcgatacccacgtttacctgatactccgccagactggaacagtgggagtctataagcacttctt

SEQ ID NO: 172820 - DNA, 75 bp, Artificial Sequence
  Synthetic
ctgtgatcctctgtgtctggcaaactgtaaaaccattaacccggaggttctcttcaacactacagacgccggaga

SEQ ID NO: 172821 - DNA, 75 bp, Artificial Sequence
  Synthetic
aatccaagacttgaaagtcaccatatgctaccgtaacgaatatttaagcatcgtcgaaaaacatgtttggctagc

SEQ ID NO: 172822 - DNA, 75 bp, Artificial Sequence
  Synthetic
gatacatcttttcaaagcttttcagattattaaaccaaaccataaaaataaaactcaaattgcagagtttctcaa

SEQ ID NO: 172823 - DNA, 75 bp, Artificial Sequence
  Synthetic
agacttcactaacttattagcgcttcaccacttcgatatcgtcgatcccattttcaccgtcaactactacgttta

SEQ ID NO: 172824 - DNA, 75 bp, Artificial Sequence
  Synthetic
aagaatgactgtacacaaaaaccgttttcgacgatcgcgaagcctgtccgtgacacacagaatacaaaaacgacc

SEQ ID NO: 172825 - DNA, 75 bp, Artificial Sequence
  Synthetic
tgatcacagagaaaaaacaaagctttacttacaactgaaactccacgatctacacgccgtcttcaacctgtttcc

SEQ ID NO: 172826 - DNA, 75 bp, Artificial Sequence
  Synthetic
agaatacgaacagaaatttctagcgatcataaaactgccaattaccggtaaagaacccatcgacgtcccattcag

SEQ ID NO: 172827 - DNA, 75 bp, Artificial Sequence
  Synthetic
tctcagcaatcaccatcaacacacctgcctagaattctctccctacgctaacgaacaaatctccaaaagcgcctg

SEQ ID NO: 172828 - DNA, 75 bp, Artificial Sequence
  Synthetic
cctacactgcgaatccgtctccgttccaacctcctcagatgcaatggtcgcccacttgaaccaagtcaccaacgt

SEQ ID NO: 172829 - DNA, 75 bp, Artificial Sequence
  Synthetic
catgcaaaacagattttacttctacggctttcgaaaggacatggagctgatacgcatgtccgccaaacaacccac

SEQ ID NO: 172830 - DNA, 75 bp, Artificial Sequence
  Synthetic
tatctttcaaatcttttatattgtccacaacacgatcaacaacatattccctatcatgttcgaaaaaaaacaaaa

SEQ ID NO: 172831 - DNA, 75 bp, Artificial Sequence
  Synthetic
gctcggaatgcacatagttttccagtctcgcactctgcacattccttgtgaatgcattaaacaaataatagcggt

SEQ ID NO: 172832 - DNA, 75 bp, Artificial Sequence
  Synthetic
atcttcgggctacaacgtttatctagatatactacaagacagtgtaatcctaactgtcctctgcgaaacactaga

SEQ ID NO: 172833 - DNA, 75 bp, Artificial Sequence
  Synthetic
tactaatactaatattcacattgacatagggatgcttcaaaaaaagctcgaagaaatggacatcccgaacgaaat

SEQ ID NO: 172834 - DNA, 75 bp, Artificial Sequence
  Synthetic
cgtcagaggcttaaaggcaaccggcaatgcaaagccgatgcagattcccgctcatgtcaacgaaaaaatgaccga

SEQ ID NO: 172835 - DNA, 75 bp, Artificial Sequence
  Synthetic
cagcgatagactcgaaaaatacaaaggacatctaataggtttccattaaaccactttattgttaacatgtacaaa

SEQ ID NO: 172836 - DNA, 75 bp, Artificial Sequence
  Synthetic
cgacaaaaccgaaatacgttcacattacctctgcaatagcagaaaacgtttcatccaaatacactttcataggaa

SEQ ID NO: 172837 - DNA, 75 bp, Artificial Sequence
  Synthetic
gtaaatacaatagtaacttctctttttttatatcggtcttcggaaaaatgggtgaaatcgcattagtcacagcct

SEQ ID NO: 172838 - DNA, 75 bp, Artificial Sequence
  Synthetic
tgataatctgatcgaaatacttctccgcatgtataggaatcttgtgttctaacacatagtttggatcttctgcta

SEQ ID NO: 172839 - DNA, 75 bp, Artificial Sequence
  Synthetic
attcatagttatgcgtctgtttattaccagtagatggtgctattaacacatacataattcggtcaccaacattcg

SEQ ID NO: 172840 - DNA, 75 bp, Artificial Sequence
  Synthetic
gaatttcttcctttctctgcgccaaccttctaatgacgctaaggtgagccagattcggctgcttatatgcagcca

SEQ ID NO: 172841 - DNA, 75 bp, Artificial Sequence
  Synthetic
cctccttggaaagcacagaagacaacatcaaatgtctcacgtctgcccgattttgaaaaagctcctcccgcgctt

SEQ ID NO: 172842 - DNA, 75 bp, Artificial Sequence
  Synthetic
ttttgaaaaagctcctcccgcgctttgcacagacgacgcaaaattttatgaatacccacaggcactccttgctca

SEQ ID NO: 172843 - DNA, 75 bp, Artificial Sequence
  Synthetic
cgcaactgtgtttgcgtcatgtgagaaaactccacagcagcagtctgaacctcttcatcaaagaacaacaagtcc

SEQ ID NO: 172844 - DNA, 75 bp, Artificial Sequence
  Synthetic
acgatgtctttcaccacacctttcacaaaatcgcaagaagtctttctcaccagatctacccccttaaaaattaaa

SEQ ID NO: 172845 - DNA, 75 bp, Artificial Sequence
  Synthetic
agcgagtcatcctgtctaccaatatatctttttttacaaatcaaaatgagcggacataaaatcttctcgaactcg

SEQ ID NO: 172846 - DNA, 75 bp, Artificial Sequence
  Synthetic
agcttgataggcgatttgaacaagcgatctgtgatatgtttggcgatcatcggcgcaatcctccgcagagactca

SEQ ID NO: 172847 - DNA, 75 bp, Artificial Sequence
  Synthetic
ttagccatatttctgacagacataaagatgctatccgtatcaccatagattacctccacttttaaatcaccagta

SEQ ID NO: 172848 - DNA, 75 bp, Artificial Sequence
  Synthetic
aaatctgatgccgttagacccaattcttcgcaaaagaattgctcggactgcatcttggaattaacataatccacc

SEQ ID NO: 172849 - DNA, 75 bp, Artificial Sequence
  Synthetic
tttgaccggaataatgaaatttaagaagaaacaggttgcggaagggctctgttactatgtattggaattgggaag

SEQ ID NO: 172850 - DNA, 75 bp, Artificial Sequence
  Synthetic
gttactatgtattggaattgggaagcataagccctgtggatttgagctttatcccaaaatataattctgactgtg

SEQ ID NO: 172851 - DNA, 75 bp, Artificial Sequence
  Synthetic
gtggaacaaagcatctctcttccaagacaggttacagaagcagcaatcgcaacacacggcaataacccgtgcgcc

SEQ ID NO: 172852 - DNA, 75 bp, Artificial Sequence
  Synthetic
gctcccgtgacaccgtacaccgagttacatgttgttttgagagcgagctgctttttatccagaaggagtttcatc

SEQ ID NO: 172853 - DNA, 75 bp, Artificial Sequence
  Synthetic
ggagcttatttatgaaaattgctctattgtgtgtcccgaagaggcaagtcgcctcacagtaaaagggcccgggga

SEQ ID NO: 172854 - DNA, 75 bp, Artificial Sequence
  Synthetic
attggatccgaacagttttgcatctccgccttcacttctcgtctcttggccagccagtcctttagtagacttcca

SEQ ID NO: 172855 - DNA, 75 bp, Artificial Sequence
  Synthetic
caataaattgattcctttaggtgggtgtggagtatggtgtctgaaaaatggtggcgatctgtatatctatgcttt

SEQ ID NO: 172856 - DNA, 75 bp, Artificial Sequence
  Synthetic
tgtggagtatggtgtctgaaaaatggtggcgatctgtatatctatgctttcgtactcgtttacgatctttacgta

SEQ ID NO: 172857 - DNA, 75 bp, Artificial Sequence
  Synthetic
agcacagactcgcgaacacaaggcttcacaaaccgatgggtctcatcccccaacttcacggttaagatgtcactc

SEQ ID NO: 172858 - DNA, 75 bp, Artificial Sequence
  Synthetic
tctgataatccagctatttgccgttcatccaaaactaaggtactataacacagattatgcgccatcataatgctc

SEQ ID NO: 172859 - DNA, 75 bp, Artificial Sequence
  Synthetic
ggatacaaactctgaaaatcaaacaccacagtgggcacagcataataacccgtcttaggctccaagacggtagcc

SEQ ID NO: 172860 - DNA, 75 bp, Artificial Sequence
  Synthetic
cctttgtaacctatcccttgtctattatgcgaagacaccatactcggaagaatcatgttacgacgttttgcttcc

SEQ ID NO: 172861 - DNA, 75 bp, Artificial Sequence
  Synthetic
gtaagaatgcagggaaatatcttcttctgctgaccctcgaacaccacacatctagccgtgacgtgtgccaatctg

SEQ ID NO: 172862 - DNA, 75 bp, Artificial Sequence
  Synthetic
gcgacctcggcaacctcataatgataattaatctgtttaaagagacgcacaactaagacagagtcctgcagacaa

SEQ ID NO: 172863 - DNA, 75 bp, Artificial Sequence
  Synthetic
tatttaccgacaacagccctgccactgggtccgctaataaatttctttggtatttccttgtacgataactgctct

SEQ ID NO: 172864 - DNA, 75 bp, Artificial Sequence
  Synthetic
ttttcttgctggagacagatcttagcaatagtatccagtttgtaattctgcgccgttatcttactagaatagact

SEQ ID NO: 172865 - DNA, 75 bp, Artificial Sequence
  Synthetic
ggatacatatccagatataacactccggaagtaaacaccttggtttgcgcctgaaggaaccccttcttgtactgt

SEQ ID NO: 172866 - DNA, 75 bp, Artificial Sequence
  Synthetic
tcatgaggaacagagattccaatctttccattcttcagtttagaaaaacaaccaatctcatagtggtaaatctta

SEQ ID NO: 172867 - DNA, 75 bp, Artificial Sequence
  Synthetic
tccatccttatacacaaatattttaaatcaaaattgttaatattataaccggtaataaactccggagactcaatc

SEQ ID NO: 172868 - DNA, 75 bp, Artificial Sequence
  Synthetic
cttaaaaatatgaaaaatcccaaaagtaattcaaactctgacgcaaattcatatatatgcacgccgtcaatttgt

SEQ ID NO: 172869 - DNA, 75 bp, Artificial Sequence
  Synthetic
tcacaggttcccagagtaaacagatgtctctcatcacggtcgccctcagtatcaaaactaactacagaaatctga

SEQ ID NO: 172870 - DNA, 75 bp, Artificial Sequence
  Synthetic
ataactatatcacccaaattttcggcatccgggaaattcccattttggcccaaacactctatgtcgaaggaccag

SEQ ID NO: 172871 - DNA, 75 bp, Artificial Sequence
  Synthetic
catccatataagggccaattgacgttttccaaagaaactaaatccgagacatgacagttaatttccacctcaaga

SEQ ID NO: 172872 - DNA, 75 bp, Artificial Sequence
  Synthetic
ttactcccttttcccatatcttgaggaatatatttttttacattataccatccgaaactcaaaaaaccattatcg

SEQ ID NO: 172873 - DNA, 75 bp, Artificial Sequence
  Synthetic
acgaagaaacgagtcaaaacatctacatcgatttcataaactacgaatccctcattctgcagaatcttcccaata

SEQ ID NO: 172874 - DNA, 75 bp, Artificial Sequence
  Synthetic
cgttgagatacataaaaatttccaaaactcactttaaacagattaacaacagtgttggcattgtacccatacaat

SEQ ID NO: 172875 - DNA, 75 bp, Artificial Sequence
  Synthetic
gacaacttatcagccggctcaatgacaaaagaacacgacatcttaacctcgccggttaacatcaaattgtttata

SEQ ID NO: 172876 - DNA, 75 bp, Artificial Sequence
  Synthetic
gtagccttcaggctttttccgtcgacacattcgcagtaaaaatattgctcctgtccaaacacgttcacacaaatc

SEQ ID NO: 172877 - DNA, 75 bp, Artificial Sequence
  Synthetic
ttctcaccgtcctcagatctcccaaacatcctaatcactgtccccgaaggaatcacaaaatgtctatactgaaaa

SEQ ID NO: 172878 - DNA, 75 bp, Artificial Sequence
  Synthetic
ggaagattctcgatcgaatccgtaaacattaacgtttctacagcatcatagatgtggaacttcatcctcgtatga

SEQ ID NO: 172879 - DNA, 75 bp, Artificial Sequence
  Synthetic
tcataatccttggaccgaactctgtctaaactcggccaagtcatttctttgctcagtaaatactgtcggtctcga

SEQ ID NO: 172880 - DNA, 75 bp, Artificial Sequence
  Synthetic
taaaacatacgcggttcagagtcacaaacatcctttattaagcccgcagcaccatcatgcattataccgcgagga

SEQ ID NO: 172881 - DNA, 75 bp, Artificial Sequence
  Synthetic
agtatacgaatgtaactcgatctgctttttttctttaagcgattcgcttccaaatatggattaaaaaatgacacc

SEQ ID NO: 172882 - DNA, 75 bp, Artificial Sequence
  Synthetic
gaatccatcacgcttcttctacatttacactcttataacctctatacctgatcctgtctatcaaactaggttttg

SEQ ID NO: 172883 - DNA, 75 bp, Artificial Sequence
  Synthetic
aggcatgagactcagaagacgaaggttttcttctgtaggactcgtctaaagactttatggccttgagcattttta

SEQ ID NO: 172884 - DNA, 75 bp, Artificial Sequence
  Synthetic
aagcatcttcttgtgaatattcatcaccacttatttgtccactgacgtcagccataccctcctctttttccgaaa

SEQ ID NO: 172885 - DNA, 75 bp, Artificial Sequence
  Synthetic
ccgcaacagatgtgcccccgtcagcatctttaacactaggcgtcttgacgacagtggtccccgtaacactggaca

SEQ ID NO: 172886 - DNA, 75 bp, Artificial Sequence
  Synthetic
cagtagtcaccggattggtggcataaggaaacatcatgtcaataggcttactaagcacatgtttttgtctaacga

SEQ ID NO: 172887 - DNA, 75 bp, Artificial Sequence
  Synthetic
aaaccacaattattataacgacaactactatcgctaaaatcaacatgagaccacccccgaatggattttttaaaa

SEQ ID NO: 172888 - DNA, 75 bp, Artificial Sequence
  Synthetic
aagacaccactccacccacaatatccccaagtgctcctgccgtaacacttataaccgagcccaatccagtgccta

SEQ ID NO: 172889 - DNA, 75 bp, Artificial Sequence
  Synthetic
tagccccaagcccttgtaaaaaagaattaatcccattgacatacgacggcgtattagtagcaattttagcttcta

SEQ ID NO: 172890 - DNA, 75 bp, Artificial Sequence
  Synthetic
tagtatatagtgcgctcttatatgagttatattcacgaagaatattctctaaatcgaaaacgtttgctctactca

SEQ ID NO: 172891 - DNA, 75 bp, Artificial Sequence
  Synthetic
attcgtccggcgaatataaatcaagtagtttaaaatcagcattttcgagagggtcgatctttagtctaataaaag

SEQ ID NO: 172892 - DNA, 75 bp, Artificial Sequence
  Synthetic
catccaatacctcaatgtcttctatgggcgtcgaattcgtatgcgtataatcggtatacacgtgtgcatgatttc

SEQ ID NO: 172893 - DNA, 75 bp, Artificial Sequence
  Synthetic
agaagagttttttaaaagtgcaacaaagagctttaaagcagctagagaaattggacgtcgatgaaataattgata

SEQ ID NO: 172894 - DNA, 75 bp, Artificial Sequence
  Synthetic
aagagctttaaagcagctagagaaattggacgtcgatgaaataattgatacgacggcggaagtgaaagcggtcag

SEQ ID NO: 172895 - DNA, 75 bp, Artificial Sequence
  Synthetic
cagatagaaatatctttgtactaggtatctcacattcctctgtcctatgatcacccaacagaatctcattatcta

SEQ ID NO: 172896 - DNA, 75 bp, Artificial Sequence
  Synthetic
accctagctgaccaaggacaacctcaggcgtggagttcacaaagctaaacgtcaccaagggccgattataacaca

SEQ ID NO: 172897 - DNA, 75 bp, Artificial Sequence
  Synthetic
gtcaccaagggccgattataacacatcgtttcactccttactcccttcgcatcgacgacccgcatactcttataa

SEQ ID NO: 172898 - DNA, 75 bp, Artificial Sequence
  Synthetic
agctgaacggatgattgattaacttctatgcatttcgagatagctaacacatcaccatgcaactgtgcagatatc

SEQ ID NO: 172899 - DNA, 75 bp, Artificial Sequence
  Synthetic
ggacgaccgtaaacctcagacacgatactcgatggactgatcttactaagttcgtgcaacatcgttatcgttcgt

SEQ ID NO: 172900 - DNA, 75 bp, Artificial Sequence
  Synthetic
ttttgatcgaggcaccaagattctgccaaattccccaaggcatcgttgatataatctttcaaagtatcatagagg

SEQ ID NO: 172901 - DNA, 75 bp, Artificial Sequence
  Synthetic
tactgtaattgcacataaagaatatcatgtctagacttgacatccaccaaatctcgcctcctacgtaagtttact

SEQ ID NO: 172902 - DNA, 75 bp, Artificial Sequence
  Synthetic
gaaccctgctcaagaaccataagagatttttgcacaagaggctgccaaatcaaaatcagatctcccgtagtctta

SEQ ID NO: 172903 - DNA, 75 bp, Artificial Sequence
  Synthetic
caaaatcagatctcccgtagtcttaaaaatttgataactaccgttcatgctgtatgcatcattataatctgacat

SEQ ID NO: 172904 - DNA, 75 bp, Artificial Sequence
  Synthetic
atagacatctgtaattatcttctcaaattcattcttaatacacgtttgtttgggatcggtaagatttaaagactc

SEQ ID NO: 172905 - DNA, 75 bp, Artificial Sequence
  Synthetic
aattcattcttaatacacgtttgtttgggatcggtaagatttaaagactccttggaggcgacgaaagcggctgtc

SEQ ID NO: 172906 - DNA, 75 bp, Artificial Sequence
  Synthetic
aactccttagaaataaagtgataagtctcatccgtctccgctcgaagcccgtgagtcaccgtagtccagtgcttt

SEQ ID NO: 172907 - DNA, 75 bp, Artificial Sequence
  Synthetic
gtgagtcaccgtagtccagtgctttagcatacacaccgattcattctcttccttgatttcccaagaaaacaaagt

SEQ ID NO: 172908 - DNA, 75 bp, Artificial Sequence
  Synthetic
atcccctttctccagaaaagcgatcttccttactaacgtagtagccccattcataccattcattagatcttctat

SEQ ID NO: 172909 - DNA, 75 bp, Artificial Sequence
  Synthetic
catagtatagttttccaagattgtcaatttttctaacggctctgcaaaatgtttaccgtttgaaccgtcgaagaa

SEQ ID NO: 172910 - DNA, 75 bp, Artificial Sequence
  Synthetic
cggagacccttccacgatttcaccagtcgtcaaagcaaagtaactaaacggatatttcgccttagccgtagcctc

SEQ ID NO: 172911 - DNA, 75 bp, Artificial Sequence
  Synthetic
cgtcacaatacaattgagagacgtcgatgtagaatagagccacaaaggaccccttgcaaagtagggttctttcgt

SEQ ID NO: 172912 - DNA, 75 bp, Artificial Sequence
  Synthetic
agtgataaatcttttattagtaacagacttgaaattcagaggaaataattctagagtttcgtttttattattatc

SEQ ID NO: 172913 - DNA, 75 bp, Artificial Sequence
  Synthetic
ctcatgataggcactaaacaccgtaccatcgggtcgttttatcgctacggctgaataacactgcgcacgagaatt

SEQ ID NO: 172914 - DNA, 75 bp, Artificial Sequence
  Synthetic
ccatcgggtcgttttatcgctacggctgaataacactgcgcacgagaattaactaaatttgcttcgtacaccggc

SEQ ID NO: 172915 - DNA, 75 bp, Artificial Sequence
  Synthetic
aactaaatttgcttcgtacaccggcatggccaaacccatcaccgtccgatccagaaaataaaccacacccacatc

SEQ ID NO: 172916 - DNA, 75 bp, Artificial Sequence
  Synthetic
atggccaaacccatcaccgtccgatccagaaaataaaccacacccacatcacggtaactggttgggaacgtcagc

SEQ ID NO: 172917 - DNA, 75 bp, Artificial Sequence
  Synthetic
tcgtttttatatgttctcactggaaaagtgtaggtctcgatatttgttttgtaaatgatgaaaaaaccctccgac

SEQ ID NO: 172918 - DNA, 75 bp, Artificial Sequence
  Synthetic
gtaaatgatgaaaaaaccctccgacatctttgcattagacttatatggcgaacacgaaatatctctgtcgaaccg

SEQ ID NO: 172919 - DNA, 75 bp, Artificial Sequence
  Synthetic
atctttgcattagacttatatggcgaacacgaaatatctctgtcgaaccgcatcaaatcagtgcctttggcaatc

SEQ ID NO: 172920 - DNA, 75 bp, Artificial Sequence
  Synthetic
gaacaaatccgaaaaggatatttgtgattatagcccgctctgatataatcatccgaatcgcaatatatcattaaa

SEQ ID NO: 172921 - DNA, 75 bp, Artificial Sequence
  Synthetic
acactattcatcaaaaagacagccaggaataatactctcatcttgctcattctccctaacgagatctagtagatt

SEQ ID NO: 172922 - DNA, 75 bp, Artificial Sequence
  Synthetic
aggcgttcgaacagagtaacttactccttccggcacgtctacagtctccctcgacaactgagcttgcaaatcaca

SEQ ID NO: 172923 - DNA, 75 bp, Artificial Sequence
  Synthetic
atataacagcgaatacacgtctttaaactttgtcatgccaccaccggtgtgaaataatagaggagactcgtgatt

SEQ ID NO: 172924 - DNA, 75 bp, Artificial Sequence
  Synthetic
aaatgtcaaaacgacatttccattcaaatcctcctcctcatctatacgtacaatttttaatcgctttccgaaaac

SEQ ID NO: 172925 - DNA, 75 bp, Artificial Sequence
  Synthetic
atcattatatagtgcaacagaaagtgttaactctctgatgaaattccacatttttttctgcatgtcatttacatc

SEQ ID NO: 172926 - DNA, 75 bp, Artificial Sequence
  Synthetic
agttacaccggaaaagttaaaaaactcattatattcgcacaccatccacacactgggatgaatagtgccctctat

SEQ ID NO: 172927 - DNA, 75 bp, Artificial Sequence
  Synthetic
gcatctcgctaaatcttccttcatatgcggtaacatttctgcgtggtcgcaaccatacgccattgagatattcgc

SEQ ID NO: 172928 - DNA, 75 bp, Artificial Sequence
  Synthetic
cggaagtggataggcagatttatgaaaatccgataacggacccgttaacaatgtgtacataatctcacttaaatc

SEQ ID NO: 172929 - DNA, 75 bp, Artificial Sequence
  Synthetic
cggcaaaagctccaaagggagcttcttcggcatcagattatttttaatataaagatgttcatcgtatgtacagct

SEQ ID NO: 172930 - DNA, 75 bp, Artificial Sequence
  Synthetic
atctacacgaatagagccatccaagtacatttttctgagaacgaaaccgttcataatcttcgataaagcctcaaa

SEQ ID NO: 172931 - DNA, 75 bp, Artificial Sequence
  Synthetic
aataaaattcccatacacgttcacactcactaccttattgatgagtgattcctgctctcgaatacatgccatcac

SEQ ID NO: 172932 - DNA, 75 bp, Artificial Sequence
  Synthetic
cctattataaccagattcagaaaccttttgaaaatacgcctttttccgagccaagacttcctgctgaagattatg

SEQ ID NO: 172933 - DNA, 75 bp, Artificial Sequence
  Synthetic
agtttgaagcatgcaattgatcgtgttcagccttcccggtgtttctgtcgtctgtggatcccgaatgtcatgcaa

SEQ ID NO: 172934 - DNA, 75 bp, Artificial Sequence
  Synthetic
cagactcttaattttatgttgaacctcatcttcctcagccaatcttttaaatattggactttcctcgagattttt

SEQ ID NO: 172935 - DNA, 75 bp, Artificial Sequence
  Synthetic
aatgctcagaccagtgacaagatctatcaacctcgaaggagacacataaatagagccaacgtacaagcgctcgtc

SEQ ID NO: 172936 - DNA, 75 bp, Artificial Sequence
  Synthetic
atgcgtgagcaaattttcactcaaagccaagaagtcttcagagacttcaccgtaaagataaagactaacatcatt

SEQ ID NO: 172937 - DNA, 75 bp, Artificial Sequence
  Synthetic
ctgtaattgcttatacaacgtgtgacaactatttaactgctgaagcgtaatagcaacatttcttactatcgtttc

SEQ ID NO: 172938 - DNA, 75 bp, Artificial Sequence
  Synthetic
tgatattttagaccaatacgtaaactcacttaaagaatatatcacgtcaggtaccttgctaaaaatattatactt

SEQ ID NO: 172939 - DNA, 75 bp, Artificial Sequence
  Synthetic
tttcagagttttctcagcatcactaacatgcaacgattcggctgaacgctgctgcttaaaaatcttcttgatttc

SEQ ID NO: 172940 - DNA, 75 bp, Artificial Sequence
  Synthetic
agtcacaacagactgaatagtcccatagttcaaaatggcctctcctaagtctttttctatcgtctcaatattttt

SEQ ID NO: 172941 - DNA, 75 bp, Artificial Sequence
  Synthetic
ttcaatattaaaaaaagctttttgctcggtcaaatgattacagaactttccatgtaatcttttccgaagtgattt

SEQ ID NO: 172942 - DNA, 75 bp, Artificial Sequence
  Synthetic
tccttggtttggagtcaaagtcaattcttcataacacttcatgcaagtcttggtttcgagataactctccggttt

SEQ ID NO: 172943 - DNA, 75 bp, Artificial Sequence
  Synthetic
cgcaaccatacatgcgccacacatgatagttagcaagtctataatttttccgcaaatctgcaacccttcttgggg

SEQ ID NO: 172944 - DNA, 75 bp, Artificial Sequence
  Synthetic
cagaagtaaagcatatacggagttgatcttactgattaattgttctatatcatttagcgtagataattgcacgat

SEQ ID NO: 172945 - DNA, 75 bp, Artificial Sequence
  Synthetic
aaactcaacaccgttatttaatgaaatgtttattgacaagtgctcagcacaacgtttcaaacacaacaccttttc

SEQ ID NO: 172946 - DNA, 75 bp, Artificial Sequence
  Synthetic
aaaatatttttttctatcctggtctaccataaagctttccaacgctgcatccaaaagaagcacctgttcatacat

SEQ ID NO: 172947 - DNA, 75 bp, Artificial Sequence
  Synthetic
agcttttagcagcacctgcatataaaccgtcaaagctgacgcacaaagaagattctgttctttgataccttcaaa

SEQ ID NO: 172948 - DNA, 75 bp, Artificial Sequence
  Synthetic
aaaagtttgatataaatgcagaatgacaatcccattctttttgaaatttgccatatcagacaatactattacagg

SEQ ID NO: 172949 - DNA, 75 bp, Artificial Sequence
  Synthetic
atcacaaaactttaaacattcaaggtccaaagcacattcattaagcctagcgcacaacacacacagagattgtaa

SEQ ID NO: 172950 - DNA, 75 bp, Artificial Sequence
  Synthetic
cgaattcatactctgattataatcggtttttcttagtcatcggctcatccgtttcggtttccgtttcatcacatt

SEQ ID NO: 172951 - DNA, 75 bp, Artificial Sequence
  Synthetic
ttaatacaccgcttgcttgatcgtcctcctccgctagaatttcagaaaagtcatagaccggagcatcgtttgaag

SEQ ID NO: 172952 - DNA, 75 bp, Artificial Sequence
  Synthetic
acaccgcctcaaataccgactgcaaattagctattgaaaaatctctcacattcatatcaactaagtgattcagtt

SEQ ID NO: 172953 - DNA, 75 bp, Artificial Sequence
  Synthetic
taagcattatggatgccgctaaagcttccctaccatccacaaaaaaaagcatatcatccatagtcggcttgtcct

SEQ ID NO: 172954 - DNA, 75 bp, Artificial Sequence
  Synthetic
ccctatccctcatcacctcagctattattaataattctggatcaatatcgttagttaaattctcaacaatgctga

SEQ ID NO: 172955 - DNA, 75 bp, Artificial Sequence
  Synthetic
gaaccttgcccttgaccacttccgtatcaaacataattgtctcacgccgaacctttttcactataacttctgaga

SEQ ID NO: 172956 - DNA, 75 bp, Artificial Sequence
  Synthetic
actttgtagcaataatcgttttctgcctcataaatctaaaatcttgcaatgcagaagaggtagggtttaagttcc

SEQ ID NO: 172957 - DNA, 75 bp, Artificial Sequence
  Synthetic
tatccacgccacttccacctatccaacctaactggccaaactgaaaatattccctattagccaagctcacaaatt

SEQ ID NO: 172958 - DNA, 75 bp, Artificial Sequence
  Synthetic
tctctaatgtcaaaccaaatgtaaccaaagatcgacttgtaaaaattgtaccaaaattgggttctttggacagtg

SEQ ID NO: 172959 - DNA, 75 bp, Artificial Sequence
  Synthetic
acgcaatcacaggattcggaacgccatccaaaactaactttttaacataaactaaatattcctgaatagaagaaa

SEQ ID NO: 172960 - DNA, 75 bp, Artificial Sequence
  Synthetic
atttaggctgcttgtctaacaccacaggaaacaacacaggattctgcgtaaccagcttagatgtaagaccatgta

SEQ ID NO: 172961 - DNA, 75 bp, Artificial Sequence
  Synthetic
agctagtcaagtagtcatgaaaacctaaagccgacaaaaacttgttatgaaagtaacaatctataaaagttgaga

SEQ ID NO: 172962 - DNA, 75 bp, Artificial Sequence
  Synthetic
gacactctggctgtatgtcgataatgtctatctcatcataggtattcgtaatactgaatgcaaatttgataaaag

SEQ ID NO: 172963 - DNA, 75 bp, Artificial Sequence
  Synthetic
tcttaacttcttcggggttaccaatatctaaagttttcggaacattgttgagcagaaaacgttgccataactcta

SEQ ID NO: 172964 - DNA, 75 bp, Artificial Sequence
  Synthetic
agcacgaaattttgacattcggaaacaatttatcatgatatttaaataaaagaaaggagatacagccagacaagg

SEQ ID NO: 172965 - DNA, 75 bp, Artificial Sequence
  Synthetic
gattcttcttgtgtttcacgttctttttaaaataagggttgttgtgtgctgtcttactggacttgttgaacggtc

SEQ ID NO: 172966 - DNA, 75 bp, Artificial Sequence
  Synthetic
tattttttattctaaaatctcgaagacattgcatagacaaacggcaaagtttcgcctgaatcgtagttttcacat

SEQ ID NO: 172967 - DNA, 75 bp, Artificial Sequence
  Synthetic
atttacccgatttatatagatcgcaatctaagatctgctccatatcaacattcgaagcgactttaaccgttctcg

SEQ ID NO: 172968 - DNA, 75 bp, Artificial Sequence
  Synthetic
tattcagaaaaccctttttgagataactgctgtgaaacgttccgtacagtgattgatactgctgaacgagccatt

SEQ ID NO: 172969 - DNA, 75 bp, Artificial Sequence
  Synthetic
tagaaattgaattaccagtacaaggtctgtcgacaacatgacctgaagccactatcaatgcgaggttctgcaaaa

SEQ ID NO: 172970 - DNA, 75 bp, Artificial Sequence
  Synthetic
ccgttaaaatgaccttataatatgcaaacgtcaaaaaaggagaaaatgcagttgcataaggggtcgtatctacat

SEQ ID NO: 172971 - DNA, 75 bp, Artificial Sequence
  Synthetic
taaatgattgtagacaattttctatctgttctctaggcgtttgtgtccttctcatttcaacaatgcatctagaaa

SEQ ID NO: 172972 - DNA, 75 bp, Artificial Sequence
  Synthetic
cacattcctcgatacattgtgtcaatccgtggattatagaaacaaaatcttttttacttcggacattgaaagtat

SEQ ID NO: 172973 - DNA, 75 bp, Artificial Sequence
  Synthetic
cttcgcctgttacaggatcaatcagagaattttttttacagtaatcgaagatctgagatacaaatttacccctgt

SEQ ID NO: 172974 - DNA, 75 bp, Artificial Sequence
  Synthetic
ccagtgagagcgtgttttgttgatcttttccaatctctttgagctcgctgacaggcttcctgccaaaagaaccta

SEQ ID NO: 172975 - DNA, 75 bp, Artificial Sequence
  Synthetic
atatatcaacctcggcataataccgagaaaacatgctcataacaagtggttcctttttaacattttttggtattg

SEQ ID NO: 172976 - DNA, 75 bp, Artificial Sequence
  Synthetic
ccggcaaacgagtaccaacccgcaccatggcagttccaatacacgattgacaacatttcccatcacagaattcac

SEQ ID NO: 172977 - DNA, 75 bp, Artificial Sequence
  Synthetic
ataaattcgccgaacaatttaccagatgattgtaaatttcagtgtacgcattacccgcgttataaacgctcatac

SEQ ID NO: 172978 - DNA, 75 bp, Artificial Sequence
  Synthetic
gatttaaattccacactacataagaaagcagctgtgggcaagtcgcacaggcataagccaagtgattagctgaaa

SEQ ID NO: 172979 - DNA, 75 bp, Artificial Sequence
  Synthetic
atttgtcatctttgcctgatgtcgaatcacatttgatgatttttctattatcgttatacacatcctcagtcaaag

SEQ ID NO: 172980 - DNA, 75 bp, Artificial Sequence
  Synthetic
acgacaacgcattacaaaaagacaaagatcgcagcagtaattcttgagtcatcaccgaattaaacgcttgtttca

SEQ ID NO: 172981 - DNA, 75 bp, Artificial Sequence
  Synthetic
cgtttggtataaatgccaattttgagcaatataagatagaatttggcgcaaagatcaaaacggcaagatgactag

SEQ ID NO: 172982 - DNA, 75 bp, Artificial Sequence
  Synthetic
ttttgtgaacgtctggttacaaaaatgtgtgtctgctggtgtagaaagcacgcgaatcgaaagagtttttactga

SEQ ID NO: 172983 - DNA, 75 bp, Artificial Sequence
  Synthetic
acagatgtaactttaaattcgtgagctgcgccatgcgttcagcgtgtgtctctgagtttcttatgattggccagt

SEQ ID NO: 172984 - DNA, 75 bp, Artificial Sequence
  Synthetic
gcgaattaagtcttatgtgctgccgaagagttttttgtgcgatgagtactttgttctaggtgacatctctggggt

SEQ ID NO: 172985 - DNA, 75 bp, Artificial Sequence
  Synthetic
cattgaaattcattatctgactggggtcatacaccgaatccaggtattcggctacatgactaaacgataattctg

SEQ ID NO: 172986 - DNA, 75 bp, Artificial Sequence
  Synthetic
tcacaacggaatcaaccaacatcaaaaaatctttctcgaccgctgaaattttctgtccggagatacccagataag

SEQ ID NO: 172987 - DNA, 75 bp, Artificial Sequence
  Synthetic
ttttgtggggtgctaatttgacagtttgctccccatcctgtgtaaattgtttcaggccagcatcgattaattcct

SEQ ID NO: 172988 - DNA, 75 bp, Artificial Sequence
  Synthetic
tagtattagaaaatcgtaacgttgtaccccatgatgtaaaaacataataaaaaagcgtttcacttaacgcaggca

SEQ ID NO: 172989 - DNA, 75 bp, Artificial Sequence
  Synthetic
gaaaaaatcctcgttcctgaataaattctgtacaggaagataaagaaatcgtttcttcagtttcaaataaagttg

SEQ ID NO: 172990 - DNA, 75 bp, Artificial Sequence
  Synthetic
cagagtatagaggaattttcacacacgaatactccccaacttgtacttgaatttgttcttcaacacaaggaatta

SEQ ID NO: 172991 - DNA, 75 bp, Artificial Sequence
  Synthetic
acagaccagcgaacaacaactctttgaaaccgtttccacacgcaacatggcaaataacagaatctgcatctttgc

SEQ ID NO: 172992 - DNA, 75 bp, Artificial Sequence
  Synthetic
cgacagcagaacaaagagctttgatatcgattactttgcgtgctgtaggcacctcaaacgactgcaagtgaaatt

SEQ ID NO: 172993 - DNA, 75 bp, Artificial Sequence
  Synthetic
tctgtctggtttgctcacataatcgaataagatcaccatgatcttcggccataccaactaactgctcagttccat

SEQ ID NO: 172994 - DNA, 75 bp, Artificial Sequence
  Synthetic
ggaaaaaaaaacacacgggcataaaagacgtaattttagttagaattgtgcctccaaagttagtgataggtgttt

SEQ ID NO: 172995 - DNA, 75 bp, Artificial Sequence
  Synthetic
taaccgtggtcgagaaatcgttttctacagtcaaattcattaacaacggcgaaataactacaggagaatttctct

SEQ ID NO: 172996 - DNA, 75 bp, Artificial Sequence
  Synthetic
ccattaacgataaaacagataaaacatccaaaagttctttctcttttggaaaaacatagatccaagcagcagtag

SEQ ID NO: 172997 - DNA, 75 bp, Artificial Sequence
  Synthetic
aaacaggagcagaaaccaccgtttcgttttcatcagccatctttgtggattcgatcacaaaaacaaagataatgg

SEQ ID NO: 172998 - DNA, 75 bp, Artificial Sequence
  Synthetic
gtttttgtggtgaaatccttatatattatgtttgacgtaacataacacgcgtcatcaaacataaaagtaaaccac

SEQ ID NO: 172999 - DNA, 75 bp, Artificial Sequence
  Synthetic
aagttgaaatataccgttttctatatgagttttacggacaaaagaaaaacgattttcttatgcaaatattttcca

SEQ ID NO: 173000 - DNA, 75 bp, Artificial Sequence
  Synthetic
cgcagatgacatgacacgccccttaatttaaatttatgtaaatcgtcgtccacctcaggtacaatagtatattat

SEQ ID NO: 173001 - DNA, 75 bp, Artificial Sequence
  Synthetic
atatatagttttttaataaacttattgaggacgggagaacgaaggcgtggcgtttacgtcatagcctaattatac

SEQ ID NO: 173002 - DNA, 75 bp, Artificial Sequence
  Synthetic
attctcagaacaggatttaaaaaggctgcgagcggccggctgttcagagggacgctggggtacgacttgagacgt

SEQ ID NO: 173003 - DNA, 75 bp, Artificial Sequence
  Synthetic
ttgactgaaaatgatccttcgtgtactattttctacaaaaaaattaatttgccggcgacagtaaacttttcagcg

SEQ ID NO: 173004 - DNA, 75 bp, Artificial Sequence
  Synthetic
gaatttcaaaaattaattccacatgtaatttaagcattttaaaacgtataactcacaaggtgaaaacatatttac

SEQ ID NO: 173005 - DNA, 75 bp, Artificial Sequence
  Synthetic
gaatacagtagttttcgtgatattttttaaaaattaataaattttaaatcgtgtaagtaataaagcatactatta

SEQ ID NO: 173006 - DNA, 75 bp, Artificial Sequence
  Synthetic
gattcttcacgttaacagagcaagctcttcgaggttttcagtagaatttcaatatttaattccacatgtaattta

SEQ ID NO: 173007 - DNA, 75 bp, Artificial Sequence
  Synthetic
agcattttaaaatgtagaattcacaaagtgacaaaacattcacaaatacagtagttttcacggtatttttgaaat

SEQ ID NO: 173008 - DNA, 75 bp, Artificial Sequence
  Synthetic
taataaattttaaatcgggtaaatggtaaagcatgctgttaaattcacgttaacagagcaagttcttcgaggttt

SEQ ID NO: 173009 - DNA, 75 bp, Artificial Sequence
  Synthetic
gctatgtgtttatcagtgaatgtatttagtatttcaattttagatcatggttcggtaaagatataagtccgtgta

SEQ ID NO: 173010 - DNA, 75 bp, Artificial Sequence
  Synthetic
aaattttttggtttagttttcatatctactagactgtgaggtgtttgaagtcgatggtttagctcatgtcaaaac

SEQ ID NO: 173011 - DNA, 75 bp, Artificial Sequence
  Synthetic
gcaatgtcaaattgtaataagtcgttcatttcgtgtttagaaataaggaattggtatttagaatagctttgtcgc

SEQ ID NO: 173012 - DNA, 75 bp, Artificial Sequence
  Synthetic
atttttagccgcgacgagaaggttatgacgacgttttcgattgcattgtttgaacctttttcggagtttgaattt

SEQ ID NO: 173013 - DNA, 75 bp, Artificial Sequence
  Synthetic
accgtttaaagaaaaacagtttcacgaatagaatctaaaacaggcttccaaattttagttaatatttatttcgaa

SEQ ID NO: 173014 - DNA, 75 bp, Artificial Sequence
  Synthetic
tttcacttggggtacagaaagctttggcatcgagatttttttgattttaaaaagaaatagttcagagtgtgacag

SEQ ID NO: 173015 - DNA, 75 bp, Artificial Sequence
  Synthetic
caaaaacctttgtacaaaacatacttgtaagaatttgtttacagtaagatagttattctgagtcagaagaatatg

SEQ ID NO: 173016 - DNA, 75 bp, Artificial Sequence
  Synthetic
tgtttaagttagtttcacaggtgtcagcttcatagtctaaatctaagtccatttcaacacttgattcactttcat

SEQ ID NO: 173017 - DNA, 75 bp, Artificial Sequence
  Synthetic
gtttagagttgacgttttcattaatgttaataatcacaatttcgtcttgttttgcttgattgaagtttagttctc

SEQ ID NO: 173018 - DNA, 75 bp, Artificial Sequence
  Synthetic
taggatctggtattttgttgtcggtttccattgattcttctatgagaatttcggtagttgtttttgtcgttgtta

SEQ ID NO: 173019 - DNA, 75 bp, Artificial Sequence
  Synthetic
ggtttgaggtgtctggtttttcgacgcaaactttggatttaaccttaggcgtaccttggtttttatgtgaacgat

SEQ ID NO: 173020 - DNA, 75 bp, Artificial Sequence
  Synthetic
gagaggtctgaggtaggtcgcgacttgttgaatagctgcatgaaggttccatgtcgacctttggacaagtaaaag

SEQ ID NO: 173021 - DNA, 75 bp, Artificial Sequence
  Synthetic
aaagatttcggtattcgtgaggaagatttggaaacagcttaaactttggtgcgtctttggcgaaataagtgcaga

SEQ ID NO: 173022 - DNA, 75 bp, Artificial Sequence
  Synthetic
aaaatagacttggtttccaaggagccatgattcgttcgattctattttgacagctaacatcatcgcatttatggt

SEQ ID NO: 173023 - DNA, 75 bp, Artificial Sequence
  Synthetic
tgctgaattgctttccgatgagcctgcttatcagaccgcattcgtatcgctcggctacacgttctgtgtcgaaat

SEQ ID NO: 173024 - DNA, 75 bp, Artificial Sequence
  Synthetic
cgcggatgaattgcggtttctttgttcgtatgatatgttctttaatttgtcgtagtattcgagcgaacgtcacaa

SEQ ID NO: 173025 - DNA, 75 bp, Artificial Sequence
  Synthetic
cgatggacatggcttgttgaattgggtgtctaaatgagtctggagtttgttgttgtacttcaaattcggagtttg

SEQ ID NO: 173026 - DNA, 75 bp, Artificial Sequence
  Synthetic
gcatctctcgatctagtacaggtttaccgcagagttgcctgagttttcggtattcgatgtcgccgtgtccgttgt

SEQ ID NO: 173027 - DNA, 75 bp, Artificial Sequence
  Synthetic
cgttgaaaacacaggttaatttcgccatgttgagtttgttgaaaaattcgaatttcatgacggtgatggtataca

SEQ ID NO: 173028 - DNA, 75 bp, Artificial Sequence
  Synthetic
tgaataagtcttgtgggttgaccggtaggttgtgcagatcgtgaaatttaaaataactgcaggcttcttctactg

SEQ ID NO: 173029 - DNA, 75 bp, Artificial Sequence
  Synthetic
tagcaactgtaaaagcaagacaaggtgagttggtcagggagaatatccggtcgcccattagttgctgattttctt

SEQ ID NO: 173030 - DNA, 75 bp, Artificial Sequence
  Synthetic
ctcgcgtgagcgagtcgagacattgtcgatagcgaagcagcaggtcggtttccagtatgtcattagttaggagac

SEQ ID NO: 173031 - DNA, 75 bp, Artificial Sequence
  Synthetic
aaattcgttcatgcgtctgtggaaatctgtctcggatgcgttgttttggatcacgggcgtctccgttgtaaggtc

SEQ ID NO: 173032 - DNA, 75 bp, Artificial Sequence
  Synthetic
tcaggccaagagattttatcgaaaagtttgtgtcggcaaaggggactgttggaaggttaggcagaaaggtgattg

SEQ ID NO: 173033 - DNA, 75 bp, Artificial Sequence
  Synthetic
cattgttttgagcgcgtttttcttgttgtttctcttcgatgatggtcttcagctgttctaactctgtcagactta

SEQ ID NO: 173034 - DNA, 75 bp, Artificial Sequence
  Synthetic
gtgcgtctagtctagattcatccagttgtttcagaggtgcgagttttcctcgaaaatttttggcgaaatggctga

SEQ ID NO: 173035 - DNA, 75 bp, Artificial Sequence
  Synthetic
tgaacttgctggttggtctatgcgtgatggaacgttttatcgttctgaaggcggtttgtttatgacgatcatgtt

SEQ ID NO: 173036 - DNA, 75 bp, Artificial Sequence
  Synthetic
tactgtgaaaaaaaactgtttgcgactgatctggtgtcatctatggaaacgctagtgaatgggagcctttgaact

SEQ ID NO: 173037 - DNA, 75 bp, Artificial Sequence
  Synthetic
gtgagcgttttactccacgaggatacatgtttgcttataataaatgaaatgacataaattggcctctttatatgt

SEQ ID NO: 173038 - DNA, 75 bp, Artificial Sequence
  Synthetic
tttttgagatgctttccgttggcgcttttttgcggttaagttgtgtgaaagaacgaaggacggtgttgctaatgc

SEQ ID NO: 173039 - DNA, 75 bp, Artificial Sequence
  Synthetic
tttaatctccggaaatgctgtgatatggcgcgatttagttagcatgtgcgttggagtcaaatggtaaatactaaa

SEQ ID NO: 173040 - DNA, 75 bp, Artificial Sequence
  Synthetic
tcatccatctgtgtttgtatctgctcctccatgcacttgatgatttgttttttgaacagatctcgaacgtctctc

SEQ ID NO: 173041 - DNA, 75 bp, Artificial Sequence
  Synthetic
agaaggtctgggtttataggtagtaagttagttttttaattgctctaaggcgatggaacaatgtacttgtttgct

SEQ ID NO: 173042 - DNA, 75 bp, Artificial Sequence
  Synthetic
gttggactggcatttagtagcaaagcatgtgctccacaagatgagaattaaccgatttccgtcggctttgagttg

SEQ ID NO: 173043 - DNA, 75 bp, Artificial Sequence
  Synthetic
tatgtaaactaggacgttatctcgatttcctctatgttgtctgttcaggcagctaaaatccgaaactcttccaaa

SEQ ID NO: 173044 - DNA, 75 bp, Artificial Sequence
  Synthetic
ttgtgtttttttgatctgaaggttctttgaatctattttgagaaaagttacttgtgaaaactgttgcgctatcct

SEQ ID NO: 173045 - DNA, 75 bp, Artificial Sequence
  Synthetic
agtctcgtaatgagtaattaattgcgttttaatgattggccatccgattaatctaataaacgataaaagggagtc

SEQ ID NO: 173046 - DNA, 75 bp, Artificial Sequence
  Synthetic
atccgctgatgttgcattgttgttaaaaccatgcgtgttcaggtacttggtgattagagtgtctgtagctatgtt

SEQ ID NO: 173047 - DNA, 75 bp, Artificial Sequence
  Synthetic
aactttgttccacagttgtctggattttaaatccatgaaacttaggttttctttagggcagcctttatccgttat

SEQ ID NO: 173048 - DNA, 75 bp, Artificial Sequence
  Synthetic
gctatagattaattcttcgatgggagccttcttagtaccgtgatgtagaaggttgtttaaatccatttgcatctg

SEQ ID NO: 173049 - DNA, 75 bp, Artificial Sequence
  Synthetic
aataaacgtcttgcaagaatttcggtaaccttctgggacgataaatatgggagttagccgtccatgtagcatttt

SEQ ID NO: 173050 - DNA, 75 bp, Artificial Sequence
  Synthetic
ccctttgtccatgtctgtcttgtacatatagcctattctgatgcagtgacctgtgtggtaaatgccgatgtcgaa

SEQ ID NO: 173051 - DNA, 75 bp, Artificial Sequence
  Synthetic
acattctccgggaaatgttagggaattgaggatctgactaagctcttgatctaaacacataacgtgatttaaaat

SEQ ID NO: 173052 - DNA, 75 bp, Artificial Sequence
  Synthetic
cttggataattgttttaatggttctcccccggcgatcgctgtgccattaggtaatgggattgatattctaagacc

SEQ ID NO: 173053 - DNA, 75 bp, Artificial Sequence
  Synthetic
gatctttttccgacaaatacagaattgtttgatttcggttggatcttcagtatagtctagtgcgtcgttagtcgt

SEQ ID NO: 173054 - DNA, 75 bp, Artificial Sequence
  Synthetic
gtcgcactgggttttgaagaagaagatgggatgtgtgtgtgtgtcgatgcttggaaaaatttttttccaggcgtt

SEQ ID NO: 173055 - DNA, 75 bp, Artificial Sequence
  Synthetic
gatgagggtaagtcttatgaggcgacacatcgagaaaaatgtttcctccgtaatggttgctgtatcttgcagcgg

SEQ ID NO: 173056 - DNA, 75 bp, Artificial Sequence
  Synthetic
aagatccaagtctcctatgtaatttgtgactggtatgcgttcgttgaatatttcgtgtcgtgtagtatagaattg

SEQ ID NO: 173057 - DNA, 75 bp, Artificial Sequence
  Synthetic
tttttcgaagtcgtcgcagagaaaatgtgtgtcttgtagccagatggcgcgagttagagcttcatcagagatata

SEQ ID NO: 173058 - DNA, 75 bp, Artificial Sequence
  Synthetic
ttcgtcggggagatactgtaagatgcggttaaatcccatgttttcgtaccaatcttcagagttcccgaagcaaaa

SEQ ID NO: 173059 - DNA, 75 bp, Artificial Sequence
  Synthetic
aatatttttatgtaaaagctgcactctgaatacaggaaagggacggtgataatctttgtgtaggtgttgtcttct

SEQ ID NO: 173060 - DNA, 75 bp, Artificial Sequence
  Synthetic
gtagatgcgcttatcttgtatctgaacgtatttatcggaagcggagatttctaataatccttgtaatcctggttt

SEQ ID NO: 173061 - DNA, 75 bp, Artificial Sequence
  Synthetic
tactggagaaaaaagaccttctccgtttttattacatttcgctatggcacgcgttatttgttcggaagttaatgc

SEQ ID NO: 173062 - DNA, 75 bp, Artificial Sequence
  Synthetic
ttggatggtcttctttttagaggccagagcatactcgtattctgtaacgtttagatctggatttttcagtctttt

SEQ ID NO: 173063 - DNA, 75 bp, Artificial Sequence
  Synthetic
tatatcgatgtatgttttaaagtaacaatccgcattgaagtattgcttcatgatacacagtaaattttcgtgcag

SEQ ID NO: 173064 - DNA, 75 bp, Artificial Sequence
  Synthetic
ggaatttccaagaatgtggacatttctctggcattgttgtcctattggtaaattagagtcgtaagaagtgatatt

SEQ ID NO: 173065 - DNA, 75 bp, Artificial Sequence
  Synthetic
gcagtaattgacgaattttgtcgtctctagggccgtgttgtaagcgatatatatgtaatggacacggaatgtgtt

SEQ ID NO: 173066 - DNA, 75 bp, Artificial Sequence
  Synthetic
ggttagatgtgaactctttctaaatagattgatttgagtgtctagatatttaaattcttccttatcgcggagatt

SEQ ID NO: 173067 - DNA, 75 bp, Artificial Sequence
  Synthetic
tttttgtctggcgtacgttgcgaagtctgcaaatagttttctaaattttgatttcaaagtaatgtttataaattc

SEQ ID NO: 173068 - DNA, 75 bp, Artificial Sequence
  Synthetic
ggacatggaagaatacgtgaacaccatgcttcctgtgttttccgtaaagcattgaacataatttttggtagttgt

SEQ ID NO: 173069 - DNA, 75 bp, Artificial Sequence
  Synthetic
gatggtgctcttttgttcctcgaacaaatagtaatacatcgttaataaaagcagaccttctgtttgcccgtaggt

SEQ ID NO: 173070 - DNA, 75 bp, Artificial Sequence
  Synthetic
cgatagaaaccaaaagggggaagtgggcaataggaatttaccggtgagatatttgataatgagcgatttgtggaa

SEQ ID NO: 173071 - DNA, 75 bp, Artificial Sequence
  Synthetic
ataggccatgtatttaaattcgacgtcctctttttcttttccagtttgagataatatcatgtcgacatataacaa

SEQ ID NO: 173072 - DNA, 75 bp, Artificial Sequence
  Synthetic
ttcggtttctttgtcgttgaggctgttggcaacatcttcagcctttatcggacttgcagtttgtatgtagtggct

SEQ ID NO: 173073 - DNA, 75 bp, Artificial Sequence
  Synthetic
gagatttaatttctcggcgtggcagacgaataccgtgtcgattcgctttgaatttttgcatttttgagtttgaag

SEQ ID NO: 173074 - DNA, 75 bp, Artificial Sequence
  Synthetic
gcagaagctgacgttatttgatggtttatatttaacaataatcggaaagattaaatgttcactgggacttctaca

SEQ ID NO: 173075 - DNA, 75 bp, Artificial Sequence
  Synthetic
taggatactaaaaatgacgtttgcggcatcgtattcagtcgcaaacactacgatggtcattgtgtagagctctgt

SEQ ID NO: 173076 - DNA, 75 bp, Artificial Sequence
  Synthetic
tgattacagatgaatttggctttaaatgcccttagggtattggggtgttatgggaaattgttttcgacgattatc

SEQ ID NO: 173077 - DNA, 75 bp, Artificial Sequence
  Synthetic
tctgtttggacagccgactcaggcaaattatgagatgttgtgctcttccgacgatttagaaagtgaagagctgac

SEQ ID NO: 173078 - DNA, 75 bp, Artificial Sequence
  Synthetic
gtattttctggatatgacgtataaagattttggagtttatcagaatgatattataagtcatcaaaaagacacgga

SEQ ID NO: 173079 - DNA, 75 bp, Artificial Sequence
  Synthetic
aactatgaaaactctgttaggtttattaccaatgtacaaaaaaactaagctcaggcataccattatggagcgatg

SEQ ID NO: 173080 - DNA, 75 bp, Artificial Sequence
  Synthetic
tttatccaattgtcctaaccacgttaaagatgcactctgtgtagagcttatgaaagctgaaaaaatattacaaac

SEQ ID NO: 173081 - DNA, 75 bp, Artificial Sequence
  Synthetic
gatggatgtcgtttttatgaaaactttaattggcgagttttctatgtgcaccgataatcttaatcagttgcttaa

SEQ ID NO: 173082 - DNA, 75 bp, Artificial Sequence
  Synthetic
caaattcgctacagatcagtcaacacttagcgatgtcgagaaaataaacagtctcatagagattgatggcgaaaa

SEQ ID NO: 173083 - DNA, 75 bp, Artificial Sequence
  Synthetic
cagcaagcgtcttttagtagagttggatccgattctccatgaggagacaggattatatcaagcgctgccaaatgt

SEQ ID NO: 173084 - DNA, 75 bp, Artificial Sequence
  Synthetic
tgtgacggaagctccgagtgaaaaggttaaatcgatacacgtcgagtctgaaggtgagagtgtatggtcaagcgt

SEQ ID NO: 173085 - DNA, 75 bp, Artificial Sequence
  Synthetic
tactgaaggcggcataatgaaacaagaaaaaggaactggcgtctagtacctgtagccggtttattgcgcgttcag

SEQ ID NO: 173086 - DNA, 75 bp, Artificial Sequence
  Synthetic
gcattaaactgaggcagaaatgtccgcaagtaaaaattattctggcgatgcagatgcctgtagggatgtagatag

SEQ ID NO: 173087 - DNA, 75 bp, Artificial Sequence
  Synthetic
ttttgcgtgtagagttgaagatctttatggagggaattgtgtctttgttccagatgtaggtttcaatcaataagc

SEQ ID NO: 173088 - DNA, 75 bp, Artificial Sequence
  Synthetic
cgagtttgataatttctttggagggaatcatgagagcctttagttcatcggcgcaaacgtacatggcgtcgaagc

SEQ ID NO: 173089 - DNA, 75 bp, Artificial Sequence
  Synthetic
gtccgttttttctgcaaaacaaaagtagtacagggatttagtacagtatgtctcgaaaaagacaagggtgtgaaa

SEQ ID NO: 173090 - DNA, 75 bp, Artificial Sequence
  Synthetic
attgtatcgtatagctgttcggtttaattataaattctctgcatgtctttagatggaaaactgcagattcggggg

SEQ ID NO: 173091 - DNA, 75 bp, Artificial Sequence
  Synthetic
tagtacagggatttagtacagtatgtctcgaaaaagacaagggtgtgaaactttatgaggaactgatgagaaatg

SEQ ID NO: 173092 - DNA, 75 bp, Artificial Sequence
  Synthetic
gagacagattgatcatctcccatggttccgggatgtagcaagggagaaagttgattgagaattcgacatctcctg

SEQ ID NO: 173093 - DNA, 75 bp, Artificial Sequence
  Synthetic
ggagaagcattagggagtgctcggataagttcattagaaaaactgaaatgtcggtttcgtcggttataatttcag

SEQ ID NO: 173094 - DNA, 75 bp, Artificial Sequence
  Synthetic
tgatgcattcgcagaatacgtcgttgctatggccaataatgactccgaagaaaccatccgggatgcacagggaaa

SEQ ID NO: 173095 - DNA, 75 bp, Artificial Sequence
  Synthetic
tatctagttttacgattcgaacttgatcgtgcggcacccatatgagttctctatttacgagtgtgattttgttgg

SEQ ID NO: 173096 - DNA, 75 bp, Artificial Sequence
  Synthetic
cgtccataaaaacgtccattttactattcctgtgatggcttactaagatagatggttcttccgaaatacaagtgt

SEQ ID NO: 173097 - DNA, 75 bp, Artificial Sequence
  Synthetic
ccgtatttgcatttctttttgcgcggtgtcttgggtagaaagttactgggttgccatgtttccttacatagttaa

SEQ ID NO: 173098 - DNA, 75 bp, Artificial Sequence
  Synthetic
cacaatcggtttctctttgcttttctcttttgcaggtcttcgacactgttccattttgcggaatacctagaagcg

SEQ ID NO: 173099 - DNA, 75 bp, Artificial Sequence
  Synthetic
agattgggcgttgataagaggttagttcgttttctagaaattttttaaatgatttctcatttatagctggccaca

SEQ ID NO: 173100 - DNA, 75 bp, Artificial Sequence
  Synthetic
catcgtgcgttttgtcttcagatatgtctgtagtccaaagttcattgatgtccacgtttcgaaagacgaaaaatt

SEQ ID NO: 173101 - DNA, 75 bp, Artificial Sequence
  Synthetic
caatgtatcttgagctcgtttgtctctgtagggtaatcgtttcagagatcttttctgaaattacgctgtacattt

SEQ ID NO: 173102 - DNA, 75 bp, Artificial Sequence
  Synthetic
ttccaggtgacagagggctgtctgctgttaatcacgtcgacgcgaagactagttcaaaataacacttaagatgag

SEQ ID NO: 173103 - DNA, 75 bp, Artificial Sequence
  Synthetic
ccgcctttgccgtcttcatgagcgtcaaacactcatgaggtccgtatcttacaacacaatatatgaaatactgtg

SEQ ID NO: 173104 - DNA, 75 bp, Artificial Sequence
  Synthetic
ttgtaagaaaggcgcaaggcaacgcttatatgtcagtctctggctcttttacattcttgtttttgcggccgctac

SEQ ID NO: 173105 - DNA, 75 bp, Artificial Sequence
  Synthetic
caaacactcatgaggtccgtatcttacaacacaatatatgaaatactgtgagcgaggttaccggtgtccgagtcg

SEQ ID NO: 173106 - DNA, 75 bp, Artificial Sequence
  Synthetic
ggaaatggacttttattcttcagagtgccattcgcacacctatgagatcgtcttgaattcattttcttcgatctg

SEQ ID NO: 173107 - DNA, 75 bp, Artificial Sequence
  Synthetic
gcttttgataaatctttttttactcttgtgttcttttgcgattttcttgaagtactggtgttataagacttttgc

SEQ ID NO: 173108 - DNA, 75 bp, Artificial Sequence
  Synthetic
ttcagagacggtgaagggctattagatcgcatgagacgcctattctaattataaatgtagcacacgacaaataaa

SEQ ID NO: 173109 - DNA, 75 bp, Artificial Sequence
  Synthetic
agcattttttgatgtaattggatcgtgttttattatctccaatagatttcataacgacaaaagacaaacctgatt

SEQ ID NO: 173110 - DNA, 75 bp, Artificial Sequence
  Synthetic
tcagaattgagtttttattgaagactgaggatgagtagctttgacaaacgtatgcggttatgtgctatctgtgtt

SEQ ID NO: 173111 - DNA, 75 bp, Artificial Sequence
  Synthetic
attctatgagaaccacagccagaagcaattgacgacaatagagaaaataagcaagcatactcatctcgtatagaa

SEQ ID NO: 173112 - DNA, 75 bp, Artificial Sequence
  Synthetic
gtttaaatcgtgtcgttcgttgtatgtgtaatgcgttgcattttgggttgagtatgctttggtagtgaggttatc

SEQ ID NO: 173113 - DNA, 75 bp, Artificial Sequence
  Synthetic
tggatggttgtgtgagtttttatcggtgacgcggtagtcgtttccaggcagagttttgttagcttcccgactttc

SEQ ID NO: 173114 - DNA, 75 bp, Artificial Sequence
  Synthetic
tgtggaacttttttttttaacgtccgtagatcgttccgtgattgtttgggggtagatgttagtcgtttgtgacga

SEQ ID NO: 173115 - DNA, 75 bp, Artificial Sequence
  Synthetic
aactatacgctggaaactaaactaacttacatcttggttgataaacgattttctattaaaaagactaaaggggtt

SEQ ID NO: 173116 - DNA, 75 bp, Artificial Sequence
  Synthetic
gacgtgagcttttgttagtttggctgattgagttctgttgctagtcgttagctgtgttgtgatatgatttgtcga

SEQ ID NO: 173117 - DNA, 75 bp, Artificial Sequence
  Synthetic
tttttggcatatacaaaattgtattgagctcttggaagtgcgtagatgcaaaataggttaaatcttaccttgaag

SEQ ID NO: 173118 - DNA, 75 bp, Artificial Sequence
  Synthetic
ccttagacttgtattcgttaatggttcctttggcgttgttagtaagtttgaccaggttagaatggcagactttga

SEQ ID NO: 173119 - DNA, 75 bp, Artificial Sequence
  Synthetic
agatgtcgttaaggacgtttcagcggtgaagggccattgaggtgtagtcgatttttcccatgtgtgagcgttaag

SEQ ID NO: 173120 - DNA, 75 bp, Artificial Sequence
  Synthetic
aattggtgtcattcgtggtatttctgtgtggttgatctctccgtgagtggacgccgacattctattttgctttgg

SEQ ID NO: 173121 - DNA, 75 bp, Artificial Sequence
  Synthetic
ttcttcggtgactttagtgattgagtgtgatgaattactagatggtaaagcattgttagttacctgtacttcagt

SEQ ID NO: 173122 - DNA, 75 bp, Artificial Sequence
  Synthetic
tttggcagttacatttgacggtagttttttttttggagtgacagacaacgtctgaacggtaggtggctcgcttga

SEQ ID NO: 173123 - DNA, 75 bp, Artificial Sequence
  Synthetic
ggatttcaaagttgtcctctggaatctgtcctctttgaaggttttgacggtctgcacttctgtgctatgggtttc

SEQ ID NO: 173124 - DNA, 75 bp, Artificial Sequence
  Synthetic
gatgtggttaaccgttagtaaaaagtcgttacagtaaaaaagccgaacggtatttttagatgtcggaccacatat

SEQ ID NO: 173125 - DNA, 75 bp, Artificial Sequence
  Synthetic
gtttgcgtattctgtttggttttttacgttgagaagttgggtaggatttgtgggttctttaggcgtgattcccat

SEQ ID NO: 173126 - DNA, 75 bp, Artificial Sequence
  Synthetic
cggtttaatagatttttatatcgtgttcgttgtctgacttagatatgtcgtttcatgggagaaataaatcgtttt

SEQ ID NO: 173127 - DNA, 75 bp, Artificial Sequence
  Synthetic
cgtttctccaagagaaattttaataaaattttcggtcatgttttgtacttccgtgttgtggctcatgtatgtgcg

SEQ ID NO: 173128 - DNA, 75 bp, Artificial Sequence
  Synthetic
agttgtgtgctgtagtttttggatcgcaaacgctcgagcccggaagtgtgattcgtgcgcataaaagggcgctgg

SEQ ID NO: 173129 - DNA, 75 bp, Artificial Sequence
  Synthetic
cgccgcgtcttgccaagtggtaaactttaaaatcggagtggtgtgttcggtgtcggtgaattttgtcgtgctctg

SEQ ID NO: 173130 - DNA, 75 bp, Artificial Sequence
  Synthetic
tgtctgtgctcgctagctcatttgtgctggatgagcggcaaagaactcatctttctgagatttttctgggattct

SEQ ID NO: 173131 - DNA, 75 bp, Artificial Sequence
  Synthetic
gctggatgagcggcaaagaactcatctttctgagatttttctgggattcttttggtaaaaatgtatgtctcgttt

SEQ ID NO: 173132 - DNA, 75 bp, Artificial Sequence
  Synthetic
ctgtgatttgctcttaagataaatagagttttttggtgaagaatagatattgtcgctaatttcctcgattcctat

SEQ ID NO: 173133 - DNA, 75 bp, Artificial Sequence
  Synthetic
tgttgttgcgaaggtggtgctttcgagcttttgagtcgtgtttgttgccactgtagtgctctcaaacgtttcggg

SEQ ID NO: 173134 - DNA, 75 bp, Artificial Sequence
  Synthetic
aattctgattgtggtattttcaaaatttgttggttttggtggactttttgggttttcggtagggttttcggtgtt

SEQ ID NO: 173135 - DNA, 75 bp, Artificial Sequence
  Synthetic
ttgttcggttttaatagtggcgttacgacggattgtaagagttggaatgtcagtcggggtgtacatcggtcgagg

SEQ ID NO: 173136 - DNA, 75 bp, Artificial Sequence
  Synthetic
aaaatctgaacgtttaactacttttttgatgctttccgttgtttgcgctgttatggtgggtgtgttcggtgtaac

SEQ ID NO: 173137 - DNA, 75 bp, Artificial Sequence
  Synthetic
ttttatggtgtctgtctgcaattctgtaaagttttttgttacgggggaaggttctggggttggtgtgttggtact

SEQ ID NO: 173138 - DNA, 75 bp, Artificial Sequence
  Synthetic
agggatatgtggtgatgtgatagacgctgacgtcgatgatggcgtcgatgatggcgtcgtagtcagtatcgaatg

SEQ ID NO: 173139 - DNA, 75 bp, Artificial Sequence
  Synthetic
aaagtttacgatggctcgtccaaaggaagtggtaacatttataggttttggcgaatgttcgaaatattgatcatt

SEQ ID NO: 173140 - DNA, 75 bp, Artificial Sequence
  Synthetic
tgaacggatgcatgatgttgtgttatagagcaagaagtaaacaaagctggtgtaattaaagaagatttcaggagt

SEQ ID NO: 173141 - DNA, 75 bp, Artificial Sequence
  Synthetic
gaacggagtcaatgaccgtgtcagattcgagttggaaaatttactgattgccatctgcaaggattcgtcggtcag

SEQ ID NO: 173142 - DNA, 75 bp, Artificial Sequence
  Synthetic
ttttatgtcaaataactgtgttcccagaattttaaacggtagtagctctacgcatggtggatctgcggtatatgt

SEQ ID NO: 173143 - DNA, 75 bp, Artificial Sequence
  Synthetic
agatagtgtggcaaacagaagataaaatagagaaaaactgctagcgacgatagatttgtttgcagctgttgagga

SEQ ID NO: 173144 - DNA, 75 bp, Artificial Sequence
  Synthetic
tagcactattttggtttctgcccgcggtaaattctgtaatggagacaagttaaccgcagacttgcattgtaaatc

SEQ ID NO: 173145 - DNA, 75 bp, Artificial Sequence
  Synthetic
tcgaatgttccaagagaaaacgttagttaaaatttgagtgaagcagtcgagggatagatttctctgacaaaaagt

SEQ ID NO: 173146 - DNA, 75 bp, Artificial Sequence
  Synthetic
tgtatacaagtttcggaggtcgtaaaaatgttctctttgttcgtcgctccaattgtggcggttgacggttttgaa

SEQ ID NO: 173147 - DNA, 75 bp, Artificial Sequence
  Synthetic
agcttctaagggatcagatgtgtattttattagattaacggagtgcatgactatcgcgaaaagggccagaaaaag

SEQ ID NO: 173148 - DNA, 75 bp, Artificial Sequence
  Synthetic
gccgagtcgcgagatgtgaagcatgtcgggtgagttgaccacagtgaatttttacaaggagaatgtgtaactaaa

SEQ ID NO: 173149 - DNA, 75 bp, Artificial Sequence
  Synthetic
atagtatttgctttttttatagggttggacgatgacctccaaatgcatgctgtgctggactgcgattgtgaatgc

SEQ ID NO: 173150 - DNA, 75 bp, Artificial Sequence
  Synthetic
cctggctatcttaatgttcttactagtaatttatcgggcgctaatcggatttaatgacgatattttcacgagcac

SEQ ID NO: 173151 - DNA, 75 bp, Artificial Sequence
  Synthetic
gttgtcggcgtttagctgtatacggacaaatctatctaatgccaaatataaataaaacgtttattcaacacaatc

SEQ ID NO: 173152 - DNA, 75 bp, Artificial Sequence
  Synthetic
tgatgagtctatataagccgaataaagcaattattgcgatcagaacataaatgataaccaatatgatagatactt

SEQ ID NO: 173153 - DNA, 75 bp, Artificial Sequence
  Synthetic
ggtctatatcgattccgacttcagacatctcaaaaacagagccgtttttggctaacaaaaggtagtgcgtcctgg

SEQ ID NO: 173154 - DNA, 75 bp, Artificial Sequence
  Synthetic
tgttgggaacaagtaaattgttgttgggatcggtcagtgtttttagttcgtctatgttttttatgtagatgtatt

SEQ ID NO: 173155 - DNA, 75 bp, Artificial Sequence
  Synthetic
gtaagggaccgtcgatatcatcatattccatgactacgctctgacaaaactcgcatgtttgagatgatatgtttc

SEQ ID NO: 173156 - DNA, 75 bp, Artificial Sequence
  Synthetic
gtagcacaagcagatcttgtcctgcatatttataatttgttgaaacgcaggtagaattgagaggtatggctgtga

SEQ ID NO: 173157 - DNA, 75 bp, Artificial Sequence
  Synthetic
ttattatactcgtagccacgattgtcgttgtaattgttaaactcactcctttaatcacataagagggagaaatta

SEQ ID NO: 173158 - DNA, 75 bp, Artificial Sequence
  Synthetic
caaatgtcacattcggcagaggcagagaagctgctggctcacttggagagagacactgaatggccgctactctcg

SEQ ID NO: 173159 - DNA, 75 bp, Artificial Sequence
  Synthetic
ccatatctggcggtctgtatacggatagcatctccatcatgtctgatcgataacggtcgagggaagcgtacgtga

SEQ ID NO: 173160 - DNA, 75 bp, Artificial Sequence
  Synthetic
gaactgtttttacaaaagaatttgttacatctctgcgtacgggagaggcacaaggcgaataaatattttctagat

SEQ ID NO: 173161 - DNA, 75 bp, Artificial Sequence
  Synthetic
tcggtgccttgtcagctgtaagcatgtgggcccatgaaactatttctacggggttacacaggtttccaattagta

SEQ ID NO: 173162 - DNA, 75 bp, Artificial Sequence
  Synthetic
gttgcatgtgcctctgcatgcgttcatcggcagggatgaaattcgctatttcggctagcatgaatagagtttccc

SEQ ID NO: 173163 - DNA, 75 bp, Artificial Sequence
  Synthetic
tatcggaaaatgtcagattcgtaaaaaacatgtgtttttcatagatcttttgtagagtgttggcaatgtcagacc

SEQ ID NO: 173164 - DNA, 75 bp, Artificial Sequence
  Synthetic
acttgtacctggaaatcgttacattggtttcgtacgctgtcgctaagtacgtgagcagcgtagatacgggaatgg

SEQ ID NO: 173165 - DNA, 75 bp, Artificial Sequence
  Synthetic
atttgtttttggtgatgtagctatagtccgagggctcgtattttaaaaattccttcatttttgggtattgtatcg

SEQ ID NO: 173166 - DNA, 75 bp, Artificial Sequence
  Synthetic
taccttccgagacgttcacacatcggttgacaaatgagtcgatggacaagagattttcgtgtgtctttaacactc

SEQ ID NO: 173167 - DNA, 75 bp, Artificial Sequence
  Synthetic
ttaacacgggcatcggtcctgtgttttttgtgctatatgagaaatgtacgataccgtaaagaaacatcatctgcg

SEQ ID NO: 173168 - DNA, 75 bp, Artificial Sequence
  Synthetic
gtatgccggcatagtcgggttttttacagtctccccttaatagggtttggattcctaggttattaaatttgagta

SEQ ID NO: 173169 - DNA, 75 bp, Artificial Sequence
  Synthetic
gtagagcttctacttcatctacgtcatccaacgtttcgtctacgaatgtcgcatctgatatgaaacggtattctt

SEQ ID NO: 173170 - DNA, 75 bp, Artificial Sequence
  Synthetic
catcgactacgtctttttcgactatcaatagtagatcgtctgtcaatgtctgtttgaatatgaatgaacttttcc

SEQ ID NO: 173171 - DNA, 75 bp, Artificial Sequence
  Synthetic
tataaggggctttaaagtttatgtcggtggtatttccatacatcatagtcagatctcctgcgggattttggatgt

SEQ ID NO: 173172 - DNA, 75 bp, Artificial Sequence
  Synthetic
acagtatcataaagtccggagtaaagaaatgggtatagatgttttcgcccgcatagcgtgtaattttagcgcatc

SEQ ID NO: 173173 - DNA, 75 bp, Artificial Sequence
  Synthetic
taacttggactggaaagatcagttcgttgagagaattaggcagcttacaggaaacgttgtcgtattgcatctgtc

SEQ ID NO: 173174 - DNA, 75 bp, Artificial Sequence
  Synthetic
ggacttccacaaccctgatgtaataaattccgtgtgaagggtacaggtttaaggaatagacaatctgcggttgga

SEQ ID NO: 173175 - DNA, 75 bp, Artificial Sequence
  Synthetic
agcagtattgacataacgtcttcattatataccggagcttggtagattggttctagtaatagaggtacttcggat

SEQ ID NO: 173176 - DNA, 75 bp, Artificial Sequence
  Synthetic
tagagtgatccaggttaaattgcttgaccgcaggtacggtagaaagtcttaaaatatcgttcattggcggctcat

SEQ ID NO: 173177 - DNA, 75 bp, Artificial Sequence
  Synthetic
agaaacgtgtgacgcgtttttcataattggttaacgattctgtcgtgttgatggcatcaaacagatggtacgtga

SEQ ID NO: 173178 - DNA, 75 bp, Artificial Sequence
  Synthetic
tatcggatccgagtaagcatttagggacttgatatatccgagtgtcgttttttgtataaaagttaaaagttataa

SEQ ID NO: 173179 - DNA, 75 bp, Artificial Sequence
  Synthetic
agcccgggcgaacaattggattttcagagtttccatttttacaatggctctcgtccgatatggtccacggtctcc

SEQ ID NO: 173180 - DNA, 75 bp, Artificial Sequence
  Synthetic
aactgtaacagggagtcaacagaacaaagacccagagtcggaagagcatagttgttcttcatcgatgaaatgtga

SEQ ID NO: 173181 - DNA, 75 bp, Artificial Sequence
  Synthetic
aagggttctgctattctttgaaagttgaacactttttgatctttccatattaaatagattacaaaaatgatgtgt

SEQ ID NO: 173182 - DNA, 75 bp, Artificial Sequence
  Synthetic
tatggaactcggaattgtttctaaattctccgcgtctttttttccccgtcaaataacatgtctttgacaggtttg

SEQ ID NO: 173183 - DNA, 75 bp, Artificial Sequence
  Synthetic
cctgatattcggaaaaaaattggacagtttcaccatttgaggatctataagcagatcttatctttgcaaggaaat

SEQ ID NO: 173184 - DNA, 75 bp, Artificial Sequence
  Synthetic
tttgcgcgactaaattattttttaggagatgtgtttccggctaatttgcgatcggcatctgtctcggtgtttttc

SEQ ID NO: 173185 - DNA, 75 bp, Artificial Sequence
  Synthetic
gaggtgcgtctagggccacgcattccggattgtatcgtcttgctaaagagtgtagatgccaaagatgagtttgct

SEQ ID NO: 173186 - DNA, 75 bp, Artificial Sequence
  Synthetic
tttcattgttatttttttgagtttaagacgactttggggaagtcgacgatgcagtctgtgcatcacaactgcatt

SEQ ID NO: 173187 - DNA, 75 bp, Artificial Sequence
  Synthetic
aagagttgtatatggtgatgtgttctcgaaggagcatcggttgtgttacgttcgcgatattcagagtaatctcgt

SEQ ID NO: 173188 - DNA, 75 bp, Artificial Sequence
  Synthetic
catcaggcgcaatatttgcaaggtttgagacagttgcatcagtctatttcgttcttggatcaatatttaattgca

SEQ ID NO: 173189 - DNA, 75 bp, Artificial Sequence
  Synthetic
gacgaggttttgtggaacgttgttcccgtaatttgttttttcaggcagtggggactcaagttagatttttttaaa

SEQ ID NO: 173190 - DNA, 75 bp, Artificial Sequence
  Synthetic
aagttttcggggaagaccaagcggttgtcattttcgtttatatgtgatttgttcgctaggtctcaggatggcgca

SEQ ID NO: 173191 - DNA, 75 bp, Artificial Sequence
  Synthetic
gtgcaatctcttttatcaatacccaattacaccaattttagaagggcatgtcagaaacatactgatttgtacaga

SEQ ID NO: 173192 - DNA, 75 bp, Artificial Sequence
  Synthetic
agaagatatcagaaggcttcaaagtcagtcctcactaagacttcgggagaaaatagatcaagggcatcgcgacaa

SEQ ID NO: 173193 - DNA, 75 bp, Artificial Sequence
  Synthetic
gttgctaagaatgcgcctaaaaaccgaattagacgcactgcaaagaaagatgcaaaaagacagtgacgttttgaa

SEQ ID NO: 173194 - DNA, 75 bp, Artificial Sequence
  Synthetic
ttctcatttaaaagcgatagaggatgctttgctgtttacgaatgatggggaggtaaacgtcgaaacgaaagctga

SEQ ID NO: 173195 - DNA, 75 bp, Artificial Sequence
  Synthetic
tacacaactgttaccgaaatctcctgagaggctggaaaaatttaatcaagttgccataaccccactcgacccctt

SEQ ID NO: 173196 - DNA, 75 bp, Artificial Sequence
  Synthetic
tataagatttacagacgattttagaggagaaatgatcaatacttttttcaataatgctcagatgtggaattttac

SEQ ID NO: 173197 - DNA, 75 bp, Artificial Sequence
  Synthetic
gttcgggtcttggttttataagctcaagagggttttttacaatgagcctggcttaagaagggctttaaaaattac

SEQ ID NO: 173198 - DNA, 75 bp, Artificial Sequence
  Synthetic
acgggtttatcggtttggacggtttgcgaagatagattgttttgtaatcgattatttcgtatagtcgttttagtg

SEQ ID NO: 173199 - DNA, 75 bp, Artificial Sequence
  Synthetic
taatgtggattctttgactatttcgaaagagttattaacagttaccgtcaatgcgttggagcaagcgacggtgta

SEQ ID NO: 173200 - DNA, 75 bp, Artificial Sequence
  Synthetic
attatttcgtatagtcgttttagtggttagattttttttccgttctgtagacggtttcgttgtttttctagttcg

SEQ ID NO: 173201 - DNA, 75 bp, Artificial Sequence
  Synthetic
tcctatattcggaagtgagatgtcagacctggaagcagccttgtgtatcctggcagctttttattccacttatga

SEQ ID NO: 173202 - DNA, 75 bp, Artificial Sequence
  Synthetic
gaattcacagatcgacgaacgtacaaccctagtagatattataacccttctgcccgtgatatttagattactcgg

SEQ ID NO: 173203 - DNA, 75 bp, Artificial Sequence
  Synthetic
tagtgaaattacagcattgaaaaatgtctctccttctggcacctattttggatttaatgatccttcttgtatgaa

SEQ ID NO: 173204 - DNA, 75 bp, Artificial Sequence
  Synthetic
attttttgttcccatgagaaaaggcaagcattatgcagaaaacacatttgggaatcatgtgcttgtaaagatgtt

SEQ ID NO: 173205 - DNA, 75 bp, Artificial Sequence
  Synthetic
gtgattttgcacagtgtgttcgccggaagttacgagagcgctacgcttttggttggtaaaccagctcgacgctag

SEQ ID NO: 173206 - DNA, 75 bp, Artificial Sequence
  Synthetic
gctaggtagaggagtgatgcaaaaaattcccggtgagaaagacagccaaaattttgatgttgaagctcgcttaca

SEQ ID NO: 173207 - DNA, 75 bp, Artificial Sequence
  Synthetic
cggagccattaagaatgatgttctggtgtattggacgtatcagctaatgagaccaaaattgggaaataatgttcc

SEQ ID NO: 173208 - DNA, 75 bp, Artificial Sequence
  Synthetic
aatctttatacacgatcaacattatttacggtctggcttggttgcaattgaaagtctctttttattgtggcggat

SEQ ID NO: 173209 - DNA, 75 bp, Artificial Sequence
  Synthetic
cttgaactcagaaagtttgtttaacaagagagttgggaagtttctcctgacttcgatttttccacagctggagaa

SEQ ID NO: 173210 - DNA, 75 bp, Artificial Sequence
  Synthetic
tgttgatttcgccgaaaataactttgaagctggaaatattcaaaattttgaatacttaatgcaccattacgttgt

SEQ ID NO: 173211 - DNA, 75 bp, Artificial Sequence
  Synthetic
gcctatgtacaacctgcagaatgacatatcaatttcgactctttttcccggtctcgtggccgtgtgtgtaaatga

SEQ ID NO: 173212 - DNA, 75 bp, Artificial Sequence
  Synthetic
ttatttagttcgtgtataaagacgtagccatcgtcagtgcccgataagttgtccatgttttgtacctcatgattc

SEQ ID NO: 173213 - DNA, 75 bp, Artificial Sequence
  Synthetic
gagtgtgagattgggatgggaacataagtgtgcaggggctccgtccgatgccgttcaggttcaatctaaagaaaa

SEQ ID NO: 173214 - DNA, 75 bp, Artificial Sequence
  Synthetic
tccgttcgtggagtatatccgcgcacaaatggaacaacaggcggatgtggctatacttgaaaagcatgactgcat

SEQ ID NO: 173215 - DNA, 75 bp, Artificial Sequence
  Synthetic
tctctttcattttgaaaacggtttaaacattactctatcttttacattaccgagacagagattgtttgcaatggc

SEQ ID NO: 173216 - DNA, 75 bp, Artificial Sequence
  Synthetic
ctcttcattatttaatgtaaatgatacttatgatttcatctattttctagttttaggttttctgccaataccggc

SEQ ID NO: 173217 - DNA, 75 bp, Artificial Sequence
  Synthetic
atagcggtttcggatatatataagtcacacccaaaataaaaaaaagtcaaggatttccgttatactgttttattt

SEQ ID NO: 173218 - DNA, 75 bp, Artificial Sequence
  Synthetic
cattatataaggcgggatgttgttgtgttgattacgtcaatacggatggggttttgaatataaagacttacagag

SEQ ID NO: 173219 - DNA, 75 bp, Artificial Sequence
  Synthetic
cttttaatgaatcattgcttcgtttcttcgggatggagaaagaaacaaagtctttggcttggccagccactgcgg

SEQ ID NO: 173220 - DNA, 75 bp, Artificial Sequence
  Synthetic
agttttatggctgggtattcattttttcgtccatccagttgtgtacggtggttttcctgacggttagatttaatg

SEQ ID NO: 173221 - DNA, 75 bp, Artificial Sequence
  Synthetic
gtttcaaagtcggtcgagaatacgctgtgtttacatttgccgggatgagcttcaattgttttttacttccgataa

SEQ ID NO: 173222 - DNA, 75 bp, Artificial Sequence
  Synthetic
agatgggattgctgagtggacattggactttgccgcgagatttttgcgcaattcttctctacatcgatgattttt

SEQ ID NO: 173223 - DNA, 75 bp, Artificial Sequence
  Synthetic
ctgcctatttctcttcgtggtcgttggtgtttatggcgattgagcgcatcaactacttctgttacagcacaccgt

SEQ ID NO: 173224 - DNA, 75 bp, Artificial Sequence
  Synthetic
tgttgaacgagaattccaaggctctggcaaaggtgtgtttcccgatagtttgggtcgtatcgggagtgcaagctc

SEQ ID NO: 173225 - DNA, 75 bp, Artificial Sequence
  Synthetic
ttcagatgctgaataattacaaagccacagctttgcagaacgagactggacagtgttttctcgcgtttttaagga

SEQ ID NO: 173226 - DNA, 75 bp, Artificial Sequence
  Synthetic
gcggacacgacatgtggttaatgttggtttattcggttgtgattccagtcatgttggtgtttttttacctataca

SEQ ID NO: 173227 - DNA, 75 bp, Artificial Sequence
  Synthetic
ctgtttgtattcaaatgctcgtatggtatttctaaagagttttctaaaatcttttgtagacaccctgccgcgatg

SEQ ID NO: 173228 - DNA, 75 bp, Artificial Sequence
  Synthetic
gcaaaaatttcatgcttttgaaagatgaactttcgtccgtgactacgtatctctgtatttatttgctgctgggta

SEQ ID NO: 173229 - DNA, 75 bp, Artificial Sequence
  Synthetic
aattttaaattttgccgattcttttttttcttttcgtctaacatattctctataagacaactcttcttcaatttc

SEQ ID NO: 173230 - DNA, 75 bp, Artificial Sequence
  Synthetic
caatagcgcatctgccgaaagctgccttaagtgaaattgagagtgacaaaattttttatggtctgcgcgatattt

SEQ ID NO: 173231 - DNA, 75 bp, Artificial Sequence
  Synthetic
ttatggcgcttcctgttctaaaagtttattatatatccgctatggcctattgcatggcatgtgatgatcacaccg

SEQ ID NO: 173232 - DNA, 75 bp, Artificial Sequence
  Synthetic
tgcccgttcgtttgtgcagtatctggctggtcaatttatgtaagaaatgtttttcgtgtacgcggcgcgaaaagg

SEQ ID NO: 173233 - DNA, 75 bp, Artificial Sequence
  Synthetic
ggtcggatttagaggttggaataaaaatgttaaaatgagtaaggagtttatcgtttttattcataagagaataga

SEQ ID NO: 173234 - DNA, 75 bp, Artificial Sequence
  Synthetic
aatgttaaaatgagtaaggagtttatcgtttttattcataagagaatagatcttcggcgctgattcctgtaaggt

SEQ ID NO: 173235 - DNA, 75 bp, Artificial Sequence
  Synthetic
tcgtttttattcataagagaatagatcttcggcgctgattcctgtaaggtcaaatatggcagagctgtcgagtaa

SEQ ID NO: 173236 - DNA, 75 bp, Artificial Sequence
  Synthetic
ctgtgggttttcagacatgccgcagaagactttaaagtcgttttggagaaatgaaaacagtccggctttgtgctc

SEQ ID NO: 173237 - DNA, 75 bp, Artificial Sequence
  Synthetic
ggctctttgctgattgtacgccagcgtggatatctcaaattttccaaacattataaggtaggcgaaccataggtg

SEQ ID NO: 173238 - DNA, 75 bp, Artificial Sequence
  Synthetic
acttttgcgccaggattttgatctggaactggaacatgatgaagagactgatgatgatgatgccgatgatgatct

SEQ ID NO: 173239 - DNA, 75 bp, Artificial Sequence
  Synthetic
tttgcagataagccgtactgctggttctcgttcttgatccccccaaaatcggttaaagaatctgcagatttttaa

SEQ ID NO: 173240 - DNA, 75 bp, Artificial Sequence
  Synthetic
aagtcggtgattatagatagctccaacggagaaaactatattgccttcgcagattatttcttccggaattttgag

SEQ ID NO: 173241 - DNA, 75 bp, Artificial Sequence
  Synthetic
acttagaccaaactcgtccatgaagagaaaattaattatgtgactgacatttccgctgtagtgcagcttttttga

SEQ ID NO: 173242 - DNA, 75 bp, Artificial Sequence
  Synthetic
aatatatgctgagtgactttcgttaaacatatgtcggagtagttccgcgtcagaatgctgtttcagaatagaaaa

SEQ ID NO: 173243 - DNA, 75 bp, Artificial Sequence
  Synthetic
tagtcgaaaccagtagttgttgctgattttgcgattcaaaatcactatgtctccgattccagaattgtataaact

SEQ ID NO: 173244 - DNA, 75 bp, Artificial Sequence
  Synthetic
ctcgcgtagtagtaagatcttgattccgtgtgacagcattgatgtacagacatgttgaattaaaagtagttcttc

SEQ ID NO: 173245 - DNA, 75 bp, Artificial Sequence
  Synthetic
ctgatacttcagcttctgtactaattgaggtgtcatgtggatatatttgtcttttattagaatcgcaacaaattt

SEQ ID NO: 173246 - DNA, 75 bp, Artificial Sequence
  Synthetic
ttgtttaaagctagtcagattctcgtttctaagcagttttgtggttatgtgtaatattaaattagggacggcgtc

SEQ ID NO: 173247 - DNA, 75 bp, Artificial Sequence
  Synthetic
gcctcggtttacgtttgtttgaagttttttcacaagtttgaggggaaggtatgttggacattaatttattgttag

SEQ ID NO: 173248 - DNA, 75 bp, Artificial Sequence
  Synthetic
gttcagttttatgtactgtcctatctgggtcatctcaagatgtctaaagtttgggtaggtggattcctctgtgtc

SEQ ID NO: 173249 - DNA, 75 bp, Artificial Sequence
  Synthetic
gggttttaccggagctctgctggaggccctgctggaggccctgctggaggccctgctggaagccctgctggaagc

SEQ ID NO: 173250 - DNA, 75 bp, Artificial Sequence
  Synthetic
ccctgctggaagccctgctggaagccctgctggaggctctgctggaagccctgccggagcctgctggaggctctg

SEQ ID NO: 173251 - DNA, 75 bp, Artificial Sequence
  Synthetic
tatggtgaagaaccgtcggaagaatgtttagctctgcccagagacacggttcaaaaagaactgcggtccggaaat

SEQ ID NO: 173252 - DNA, 75 bp, Artificial Sequence
  Synthetic
attcctttgccgttgaatattaatcacaacgaaaaggccactattggaatggtacgtggtcttttcgatttagag

SEQ ID NO: 173253 - DNA, 75 bp, Artificial Sequence
  Synthetic
gaggctctgctggaggccctgctggaggctctgctggaagctctgctggaggccctgctggaggctctgctggaa

SEQ ID NO: 173254 - DNA, 75 bp, Artificial Sequence
  Synthetic
catgggcttttctgcgttgcgcagatacagtctcaaacgttcatggacatcataagaaatattgctagtaagtca

SEQ ID NO: 173255 - DNA, 75 bp, Artificial Sequence
  Synthetic
gctctgctggaggctctgctggaggccctgctggaggctcttctggaggccctgctggaagctttgctagagact

SEQ ID NO: 173256 - DNA, 75 bp, Artificial Sequence
  Synthetic
aagttgatcgcagcaggttcggtaattgaacctttaccaccggacccggaaattgagtgtttaagttcaagtttt

SEQ ID NO: 173257 - DNA, 75 bp, Artificial Sequence
  Synthetic
ccgctggaagctttgctggaagccctaccggacgccctgctggaggctctgctggaggccctgctggaggccctg

SEQ ID NO: 173258 - DNA, 75 bp, Artificial Sequence
  Synthetic
cctggtctatcgctttctagcaaagttttacaggatgaaaatttagacggtaaaccgttttttcatcatgtgtct

SEQ ID NO: 173259 - DNA, 75 bp, Artificial Sequence
  Synthetic
ctggaggccctgctggaggccctgctggaggctctgctggaggctctgctggaggctctgctggaggccttgctg

SEQ ID NO: 173260 - DNA, 75 bp, Artificial Sequence
  Synthetic
gtatgtggagtcggtcggagaccgggaactatagcgattttcggacgagaaataagctggattctagataggttt

SEQ ID NO: 173261 - DNA, 75 bp, Artificial Sequence
  Synthetic
aaggctctgctggaggccctgctggaggtcttgctggaggctctgctggaggctctgctggaggctctgctggag

SEQ ID NO: 173262 - DNA, 75 bp, Artificial Sequence
  Synthetic
tcatgcatcagcgagagtgaaaagagacaagttttggagggggtcaatgtttattctcagggtttcgatgaaaat

SEQ ID NO: 173263 - DNA, 75 bp, Artificial Sequence
  Synthetic
ttattttcggcggatttatatgacttgctcgcggatagtttggatacatcctatattagaaaacggtttccaaag

SEQ ID NO: 173264 - DNA, 75 bp, Artificial Sequence
  Synthetic
ttgcagttggataaacagctatgtggtttgtctaaatgtacgtatattaaagctagtgaaccaccggtggagatt

SEQ ID NO: 173265 - DNA, 75 bp, Artificial Sequence
  Synthetic
attgtagcaacgggcaaagttgccggtgatcaagttcagttaactacggaacctgggtctgaattagcggttgaa

SEQ ID NO: 173266 - DNA, 75 bp, Artificial Sequence
  Synthetic
acgtgtgacgtgtcggttgtgcacgggaattacgacgccgttgaatctgcgacagctacaacggctatgagtaat

SEQ ID NO: 173267 - DNA, 75 bp, Artificial Sequence
  Synthetic
caaaatctgccaaatactacccctttgctgtcaagtccaccgttttcggattgtgtttttttaccgaaagatgct

SEQ ID NO: 173268 - DNA, 75 bp, Artificial Sequence
  Synthetic
tttttttctcttttaaatgttacaactggacagcagccgaaagtagttccacctgtttctgttcatccgcccgtg

SEQ ID NO: 173269 - DNA, 75 bp, Artificial Sequence
  Synthetic
actgaacagtatcaaatgctaccgtattcggagtcggctgctaagattgcagaacaggagtcgaatcgatatcac

SEQ ID NO: 173270 - DNA, 75 bp, Artificial Sequence
  Synthetic
agtccttgtcagacaatgtatccctattggcaatattcccccgttccccagtatccggccgtgttacacggttat

SEQ ID NO: 173271 - DNA, 75 bp, Artificial Sequence
  Synthetic
cgtcaaccgaaaacgtttaaaaagcggcatttccagagtgattcggaagatgaattaagtttcccgggagatccg

SEQ ID NO: 173272 - DNA, 75 bp, Artificial Sequence
  Synthetic
gaatacacaaaaaaaaggaggcgccataaagttgacaacgacgacgataaggagatggctcgagaaaagaacgat

SEQ ID NO: 173273 - DNA, 75 bp, Artificial Sequence
  Synthetic
ttaagagaattggtggatatgataggaatgttaagacaagagattaatgctttgaagcacgttcgcgctcaatcg

SEQ ID NO: 173274 - DNA, 75 bp, Artificial Sequence
  Synthetic
ccgcagagacatgtcgttccgatggagactctacctacgatcgaggagaaaggcgccgcgtccccaaagccgtct

SEQ ID NO: 173275 - DNA, 75 bp, Artificial Sequence
  Synthetic
attttaaacgcttctttgacgcctgaaacggtaaacaggagccttgctggtcagaacgaatccatggatctgcta

SEQ ID NO: 173276 - DNA, 75 bp, Artificial Sequence
  Synthetic
aaactcaacaagaaattgtttgttgacgcgttaaataaaatggatagctaaaatgtgtttttttatgttgtgatc

SEQ ID NO: 173277 - DNA, 75 bp, Artificial Sequence
  Synthetic
aagtggtgtttaggtgcgtgttatggggaagatctatgagaattatgactgacaaggtatatggcgaatgcccac

SEQ ID NO: 173278 - DNA, 75 bp, Artificial Sequence
  Synthetic
atttccttcaaagtgaattcctggacatggtgaaacttaacacataattgtttaccgacgcgttaaataaaacgg

SEQ ID NO: 173279 - DNA, 75 bp, Artificial Sequence
  Synthetic
atagttaaaagttgttgttttggttttttattttcgtataaaatggtatttaggagctagttacggggaagatct

SEQ ID NO: 173280 - DNA, 75 bp, Artificial Sequence
  Synthetic
atgggagtaattattgtgacaaggtatgaaacgaatgccgacgtctccttctaatatcgttaggctttgtggggt

SEQ ID NO: 173281 - DNA, 75 bp, Artificial Sequence
  Synthetic
ttcaggcggcatgaattccatgcgagtagattctccgggttttagaaaaaagtgcaagggtaccaaatgttcttt

SEQ ID NO: 173282 - DNA, 75 bp, Artificial Sequence
  Synthetic
gtcgaacgcgatgcggagtgatttcaaaaaaatgcccatgctgatctctggtgttacgtgcgcgaccgtggttag

SEQ ID NO: 173283 - DNA, 75 bp, Artificial Sequence
  Synthetic
acttggtgctcgcgatactggctggcttgcgagagctacaatgtcttttacgggaccatttggagattctatgtt

SEQ ID NO: 173284 - DNA, 75 bp, Artificial Sequence
  Synthetic
tacataaatgttgctcatttctgtccagctgaattcgatattattccccggtggtaaaatttgcttggggaagaa

SEQ ID NO: 173285 - DNA, 75 bp, Artificial Sequence
  Synthetic
gaatactttgcctagttcttgcgagtaattgatgcgacagttctttttctgtgctttcatggtgatgtagagagg

SEQ ID NO: 173286 - DNA, 75 bp, Artificial Sequence
  Synthetic
ccgcgtctcgtcccaaatgcaggtggttatagagattccgtgcaagagtttggggataaagaaacccgtaaagtt

SEQ ID NO: 173287 - DNA, 75 bp, Artificial Sequence
  Synthetic
tgaatttgattcgaagatagtgtggaaagagcaatggaaaggcgtaatcaggttagagacgatatttttagttgc

SEQ ID NO: 173288 - DNA, 75 bp, Artificial Sequence
  Synthetic
gccgacagttattgaaccgacgttgcattttagaagtgtttcttgattctgcgacattgtgatgtctgcggtgtg

SEQ ID NO: 173289 - DNA, 75 bp, Artificial Sequence
  Synthetic
gggggtcagtgaaagttgtatgttaagtttttcgggaaaaaaagtatcatcaaggagatagtcgttttcgtacac

SEQ ID NO: 173290 - DNA, 75 bp, Artificial Sequence
  Synthetic
tgtcttcaaaattaatagatttccacaaagtaagattctagagatggagacgtgtcggtgtgatataaattcaat

SEQ ID NO: 173291 - DNA, 75 bp, Artificial Sequence
  Synthetic
tttagcagagttaaaaatttggtcgagcggagtgttttggagattgatccatatatctgcgttaaataaataacg

SEQ ID NO: 173292 - DNA, 75 bp, Artificial Sequence
  Synthetic
tgttggctcttctggtgttttttctgtccatcgtatatcagccgcgtaaattttaatgcgcgtgagagggccata

SEQ ID NO: 173293 - DNA, 75 bp, Artificial Sequence
  Synthetic
tagaataaactgcgcctcgcactgtccgtggggtatggcgtggcgatcgtaggcttctatgcgttgcaccggtaa

SEQ ID NO: 173294 - DNA, 75 bp, Artificial Sequence
  Synthetic
atttgatacagtcacgttcgcgtaagggagtgcgaatatgttaagaacgatgggtaatctgccgagatccagatc

SEQ ID NO: 173295 - DNA, 75 bp, Artificial Sequence
  Synthetic
tagatctgagatgttatgcaccgcaaagggtatgttgccataatcttttggatcgatgtaagtaaaaggcgatgc

SEQ ID NO: 173296 - DNA, 75 bp, Artificial Sequence
  Synthetic
tgcaaaactgctttcgtctctacaagtgcacaccacgctggatgaaggggggcagatacctaatccgcatttaaa

SEQ ID NO: 173297 - DNA, 75 bp, Artificial Sequence
  Synthetic
atatctcagttcgccgggttttaatatggcggcagttgttaatcttagctgtagtacgtacgaagaccattgtag

SEQ ID NO: 173298 - DNA, 75 bp, Artificial Sequence
  Synthetic
agtggcgggttgcatgtttgcttttctggatgtatgaggggaatcctgttagtgtattttggatgttaaatagtt

SEQ ID NO: 173299 - DNA, 75 bp, Artificial Sequence
  Synthetic
gatgtaaacgtagagagtcatatgcgcatttttataatagagtgtttttccacggacgggaggatctgcgggttt

SEQ ID NO: 173300 - DNA, 75 bp, Artificial Sequence
  Synthetic
ccacgcgcaggcttgtcttcgtattctaaaggatgtagtgtgagttccggtagcaagtatgctggaaaacaattg

SEQ ID NO: 173301 - DNA, 75 bp, Artificial Sequence
  Synthetic
attggtttcttaaggatgtatatcgtgcgatgtgttattaactagttagatgtggattactaataatgggggggg

SEQ ID NO: 173302 - DNA, 75 bp, Artificial Sequence
  Synthetic
cccatgaagtgtacttcgaatggcttgtcggtattctccgtgtgtgttaaaagagatttcatgtcgctgtttgag

SEQ ID NO: 173303 - DNA, 75 bp, Artificial Sequence
  Synthetic
ggaattattcgcataacatgcaattaaaattcaattcaaaatttatgaaattgacattatttggagaaattttat

SEQ ID NO: 173304 - DNA, 75 bp, Artificial Sequence
  Synthetic
agggaacgaaacggctttctaaacaacttcttcgtcacaaaaaagatacgacctaacatgtcgtgttcggttacg

SEQ ID NO: 173305 - DNA, 75 bp, Artificial Sequence
  Synthetic
gaaactgttttttcgcacgaaatccgcaattttaacggttcttgggcaaaccataaaaatgggtacagcttgaag

SEQ ID NO: 173306 - DNA, 75 bp, Artificial Sequence
  Synthetic
acatgtgtctgaacagggatgaagatgcctacgatttttttgttagtgaacttgccgcgtagcgtgatctctttg

SEQ ID NO: 173307 - DNA, 75 bp, Artificial Sequence
  Synthetic
tttgtattaattactaaggacatatcgctgggaaagaaaacctctagactctttccgtctgcgcagattttgaaa

SEQ ID NO: 173308 - DNA, 75 bp, Artificial Sequence
  Synthetic
tacggcatattcatattcagcgtgacggtactccgattcggaggggaaaaggtcaagcgaagataacattctttc

SEQ ID NO: 173309 - DNA, 75 bp, Artificial Sequence
  Synthetic
gtgattggaaaccgtcgctcgttttccggcaacactacgttacgtaaaaagattgtgagaaaaggatcgttaaat

SEQ ID NO: 173310 - DNA, 75 bp, Artificial Sequence
  Synthetic
tctattttgtagatagaaatgccgggttcggaaatcatgttgactctgcagagtggaatcatacttttgaatagg

SEQ ID NO: 173311 - DNA, 75 bp, Artificial Sequence
  Synthetic
tttttccaataggaacattttctggtatcgatgctgaacacgctaaaaactattagcagctttctgccatagcgg

SEQ ID NO: 173312 - DNA, 75 bp, Artificial Sequence
  Synthetic
tctaatttttgagactgataaggactttctgtccagcttaggttaagtaagatcaaagacgtttcaacgctatca

SEQ ID NO: 173313 - DNA, 75 bp, Artificial Sequence
  Synthetic
gtaaatccagtataatgggtaaaagtgagatttattgaagggggggggggaaatgtataatatccatgtttttaa

SEQ ID NO: 173314 - DNA, 75 bp, Artificial Sequence
  Synthetic
ttcgaaacgactttaaattgatttatcacgttggttgtcgagatcggcatgttggtcaggccatattgttcgtat

SEQ ID NO: 173315 - DNA, 75 bp, Artificial Sequence
  Synthetic
acgattggatcgatgttttctttttggcatagcgcattgatgtcgtcaatctccagtgcaggtgacggcagataa

SEQ ID NO: 173316 - DNA, 75 bp, Artificial Sequence
  Synthetic
atgggtatggagaataaatgaatccgtacgggaactgtcctagaaataggtaaaatttttattttgatagtcatt

SEQ ID NO: 173317 - DNA, 75 bp, Artificial Sequence
  Synthetic
gtattttcgagaaactgtacatcgaacaggacgtcctcagtttctgattcagtgccatctgttatgaataggatt

SEQ ID NO: 173318 - DNA, 75 bp, Artificial Sequence
  Synthetic
cctggttttgtgcttgagattcgacatttcaacgtgatttcttggtaagaattcggaacaatgtgattgcaatca

SEQ ID NO: 173319 - DNA, 75 bp, Artificial Sequence
  Synthetic
aaaacaagctgtaagacatgatttagttgaggagaatacatgttggtacaaaaaaacattttatgtttcaccttg

SEQ ID NO: 173320 - DNA, 75 bp, Artificial Sequence
  Synthetic
ctttttaaatactgtgtttttttaagggatgaggtaattttacatgacggatggaggacgcgggtgttcaggcgg

SEQ ID NO: 173321 - DNA, 75 bp, Artificial Sequence
  Synthetic
ggtgtgtttttataatcctgcgtataagtgatagaaaagttatagtaggccagtgtgtttttaaaaagcatttaa

SEQ ID NO: 173322 - DNA, 75 bp, Artificial Sequence
  Synthetic
tttttataaatacatgtagccattctgttatctgcggaaacgtcacagacaacaaaatacgttttctcgttggtc

SEQ ID NO: 173323 - DNA, 75 bp, Artificial Sequence
  Synthetic
aaagaattaatttggtcgatcatagttaagactgatttgattttttttaattcgtctttgatgtccgtagcgtga

SEQ ID NO: 173324 - DNA, 75 bp, Artificial Sequence
  Synthetic
ttaaacctaaataatttcatctattgtgctttttgttaagatgctgagtttgtgtgtttgtgtgtgttgtgtttg

SEQ ID NO: 173325 - DNA, 75 bp, Artificial Sequence
  Synthetic
gtgctttttgttaagatgctgagtttgtgtgtttgtgtgtgttgtgtttgtgtgtgttgtgtttgtgtgttgtgt

SEQ ID NO: 173326 - DNA, 75 bp, Artificial Sequence
  Synthetic
agttgtccgcagcgctgtgtgcttaacgttgttcttttagataatagttcttggcatttgatcaaaagcattgaa

SEQ ID NO: 173327 - DNA, 75 bp, Artificial Sequence
  Synthetic
tttgtgtgtgtgagagagaaagagatagagagagatagatatatggggggggggggggaatatataaatatagta

SEQ ID NO: 173328 - DNA, 75 bp, Artificial Sequence
  Synthetic
tggtcttccagcgttagccgatctatgtaagttctcacgatgtctggggccatggccgtgatcatggacagcgag

SEQ ID NO: 173329 - DNA, 75 bp, Artificial Sequence
  Synthetic
atgcaggctgttttcatggagtacattgattgtttgtcgttgactatgtctggtaatttaatgagtacgtctctg

SEQ ID NO: 173330 - DNA, 75 bp, Artificial Sequence
  Synthetic
tattggatagagcataactcatcgatgattgtttgcatctcattgtattctctgtgaactgctataagaccaatg

SEQ ID NO: 173331 - DNA, 75 bp, Artificial Sequence
  Synthetic
ggtggaaaacagatagaacaatggaacgttgtctctgaaaaaaaaaactagtagtgtgacatttaggaaatgtgg

SEQ ID NO: 173332 - DNA, 75 bp, Artificial Sequence
  Synthetic
catagcaatctgatgttgatctcggccgcaattgcggtcggaacgactaaaggtacagtgagctcccaatcaccc

SEQ ID NO: 173333 - DNA, 75 bp, Artificial Sequence
  Synthetic
tttggatactttcatcgtgtaaaaagtcaaaaggttgaaaatgttttttttttttttcatgaataggagctatta

SEQ ID NO: 173334 - DNA, 75 bp, Artificial Sequence
  Synthetic
agtttcaatagcttttcttccgagtgcgtcgataaaggtggaatcaatgtcaaggtgtcacccttttcccagggg

SEQ ID NO: 173335 - DNA, 75 bp, Artificial Sequence
  Synthetic
aagggtcctgtgttctttatggcatactgctggccggtcatcggctttctcaaaactagttgattaccttccacc

SEQ ID NO: 173336 - DNA, 75 bp, Artificial Sequence
  Synthetic
ttctgcagaatggttacgaccatggtccgtaatacgttccggatgtggacgtaatctttgttggaggagacgatg

SEQ ID NO: 173337 - DNA, 75 bp, Artificial Sequence
  Synthetic
ggataaagacctaaattgccgctacctattagatggtggtgagctgggatcggtatgacgatgttcatgagcttg

SEQ ID NO: 173338 - DNA, 75 bp, Artificial Sequence
  Synthetic
cagagggtgctgatatcggaaagtgacagtttgtgatcgaaagtgcagtagacggtttccattttatatggaaga

SEQ ID NO: 173339 - DNA, 75 bp, Artificial Sequence
  Synthetic
ttcgataataagttggagaggtatggtttctcctatggcgtagttacaataatgggtttcgctgatctgcgtatt

SEQ ID NO: 173340 - DNA, 75 bp, Artificial Sequence
  Synthetic
gtttctcctatggcgtagttacaataatgggtttcgctgatctgcgtattgccggttttagaccgactctctaat

SEQ ID NO: 173341 - DNA, 75 bp, Artificial Sequence
  Synthetic
agagcttggttggatgaacagtgaaggggcagagcgttttgtaagaactggcatggtctgcttacgaagctatcc

SEQ ID NO: 173342 - DNA, 75 bp, Artificial Sequence
  Synthetic
ctaatctatagcaacataaagagttacacagtatgggaaaagtatgtattttacaacaatataagcatatttaca

SEQ ID NO: 173343 - DNA, 75 bp, Artificial Sequence
  Synthetic
gtgccctcagagcacgagtattgtatttcgctatcgctgtttaaacatgaatttgatttcatgcagtattcgttt

SEQ ID NO: 173344 - DNA, 75 bp, Artificial Sequence
  Synthetic
taatacacatctgtatgctaatgattgctaatcaatttacatcttggtttcatctagctaataaatttgagcatt

SEQ ID NO: 173345 - DNA, 75 bp, Artificial Sequence
  Synthetic
catctagctaataaatttgagcattttcttcgaatggatcataatcagagggatagccatctaatttaaagactt

SEQ ID NO: 173346 - DNA, 75 bp, Artificial Sequence
  Synthetic
atcactttgtacatcatcttgttcgtttttaagatgtcagattcggtaaaaaattgagcgttaggactgtatgtc

SEQ ID NO: 173347 - DNA, 75 bp, Artificial Sequence
  Synthetic
ttgggattgtaacatagttgttctctgtgtgccgtgttgtacaggatatcgcctaaggagcctggtagagatgcc

SEQ ID NO: 173348 - DNA, 75 bp, Artificial Sequence
  Synthetic
tctaatggtacatttttcattatcattacttgtaccttccatacatctgttctcatcattgtgacatgttgtgtc

SEQ ID NO: 173349 - DNA, 75 bp, Artificial Sequence
  Synthetic
caaggatttgtggttgcggcaaatgtatcgctgtctgtttgggtgtgatcgtacaatgcttttctagccgcctct

SEQ ID NO: 173350 - DNA, 75 bp, Artificial Sequence
  Synthetic
attgataatatttagtatgggggagttatttcctgttccctgcgggtcaaatatttgagtttcggctgttacaag

SEQ ID NO: 173351 - DNA, 75 bp, Artificial Sequence
  Synthetic
tcgttgtgtgggtccgttcccatcatacacgattccctgcctctggggttatggggcaatttgaaaaagttaata

SEQ ID NO: 173352 - DNA, 75 bp, Artificial Sequence
  Synthetic
actttgggaatttgtcacatttaaatttttctcacatgcagtagaggtgataacagtatatttactggaaagatc

SEQ ID NO: 173353 - DNA, 75 bp, Artificial Sequence
  Synthetic
tttgtcgtgaccggagtcagtatgacttcgcagatagcttgttgaccatgcagcagtatggagggtgggtttttg

SEQ ID NO: 173354 - DNA, 75 bp, Artificial Sequence
  Synthetic
ttaatgatatcagttagatccataaaattttccatgaccatttctgtgataagtttcttggttggtgttatgact

SEQ ID NO: 173355 - DNA, 75 bp, Artificial Sequence
  Synthetic
ttaattccgccgaatgttatgatgtttagtgcctcgccctcggagggattaggtttttctatcccgacgtgatgc

SEQ ID NO: 173356 - DNA, 75 bp, Artificial Sequence
  Synthetic
cccaagtctgttttgctatcctgtattttactataagtatatgagacattatccttattatattcttcatcatcc

SEQ ID NO: 173357 - DNA, 75 bp, Artificial Sequence
  Synthetic
cgaatccacgtatttatgtccgtgttggtaaacgcgtgtatcgggaaggcggagaaaaggttttgtatcttgctt

SEQ ID NO: 173358 - DNA, 75 bp, Artificial Sequence
  Synthetic
attttaatggggacaaagtgattgatgaagcagtgattggcttctgtcccatcactgtcattttttacattcatt

SEQ ID NO: 173359 - DNA, 75 bp, Artificial Sequence
  Synthetic
cccatgtctgatttaattcgcttaagattggcagtggcggtggtagaactaaaacctaagcccatatctacaaaa

SEQ ID NO: 173360 - DNA, 75 bp, Artificial Sequence
  Synthetic
cttagatgctgggtgaagttgtaagtggttacgatatctttagcttccgcggtgaccgtgggatcgtctaaaatt

SEQ ID NO: 173361 - DNA, 75 bp, Artificial Sequence
  Synthetic
tacccggcattgaccttattgggatggtaaacactggggatacaaaacctttacttttacaatgaccattattga

SEQ ID NO: 173362 - DNA, 75 bp, Artificial Sequence
  Synthetic
atagatgtggctgccctggagctgtacaacaggcactcgacgtcgaaattatccgtccggactagtgtggccgca

SEQ ID NO: 173363 - DNA, 75 bp, Artificial Sequence
  Synthetic
aagcccggatggattttgcttttgctttggatcgctatggcaacgggagacagttttgagtgcatggcggcaagc

SEQ ID NO: 173364 - DNA, 75 bp, Artificial Sequence
  Synthetic
taagtaattatcttcagatgtacagtcatctgactcgctgctcgattcagaattaggttctgatttaatagtttt

SEQ ID NO: 173365 - DNA, 75 bp, Artificial Sequence
  Synthetic
gtcataatgctcaacagggaattggggcagaaggctgagtacacggaaaacggtgttcgttgccaattataaaat

SEQ ID NO: 173366 - DNA, 75 bp, Artificial Sequence
  Synthetic
ttttaagattgagctatcaatattattgttaccatcctcttcatcttcactctctgaacttataacaattacgtt

SEQ ID NO: 173367 - DNA, 75 bp, Artificial Sequence
  Synthetic
tctaatgctaatgggggcgggagaggaaaaccgccgtcgtttctttgatagtgaggaaatgtatttaggaatact

SEQ ID NO: 173368 - DNA, 75 bp, Artificial Sequence
  Synthetic
tgtggtttcaggtaacttatctatcttaatctttttagatttggatggtttaattggaacatttttccttttagc

SEQ ID NO: 173369 - DNA, 75 bp, Artificial Sequence
  Synthetic
tggatatcagcattcatggtgccgcagattcccgggtcagagaagaatcgatgaaatgggattggctgatagtac

SEQ ID NO: 173370 - DNA, 75 bp, Artificial Sequence
  Synthetic
tgtcctctttttagatttgcatttctgagtcacaggcacaattttctcagttttgtcattttccttagaaggagt

SEQ ID NO: 173371 - DNA, 75 bp, Artificial Sequence
  Synthetic
tgagtcacaggcacaattttctcagttttgtcattttccttagaaggagtgacctctggtggtgaatatagagac

SEQ ID NO: 173372 - DNA, 75 bp, Artificial Sequence
  Synthetic
cgtcttagggtggtgatcggtgagatcaggcaaagcccattgtatagaatgtgttgtagtgattgaaaatgaacg

SEQ ID NO: 173373 - DNA, 75 bp, Artificial Sequence
  Synthetic
gaattgccgtgtcgctgcgcagggtctaaggagacctccacttccagtattttcgtattttcattaatgtagatt

SEQ ID NO: 173374 - DNA, 75 bp, Artificial Sequence
  Synthetic
ctaaggagacctccacttccagtattttcgtattttcattaatgtagattagcgatttaaacagctgttttgcga

SEQ ID NO: 173375 - DNA, 75 bp, Artificial Sequence
  Synthetic
tagatgatgtattggctacggtgtagccaggacccatagcttctcgtatcagagacattaggacgtcgctgctga

SEQ ID NO: 173376 - DNA, 75 bp, Artificial Sequence
  Synthetic
atcatttctgatattaaagggttgtcatggaaaccatcacatagattcactagactttctacagctcccaattct

SEQ ID NO: 173377 - DNA, 75 bp, Artificial Sequence
  Synthetic
tcggattctcctggaaacaatcatctggacagataaacggttccgtgtagaataagtctagaactagttccttta

SEQ ID NO: 173378 - DNA, 75 bp, Artificial Sequence
  Synthetic
ttgtctattttactttctggatttaaagtatcctgaattgcatcatgacttttgacaggagttgctgagtcggta

SEQ ID NO: 173379 - DNA, 75 bp, Artificial Sequence
  Synthetic
cgttgacgccagcgccacaggccttgttatttgatagtgccgggagtacgcagaagtaaaagatcttgctcagga

SEQ ID NO: 173380 - DNA, 75 bp, Artificial Sequence
  Synthetic
aaggtcatacaaggaagcgtttcggtacacttggagttagaacctttttcctgaatcctttcttttgtctgtgac

SEQ ID NO: 173381 - DNA, 75 bp, Artificial Sequence
  Synthetic
tacacttggagttagaacctttttcctgaatcctttcttttgtctgtgacctttgatcggggctgtaagccaaaa

SEQ ID NO: 173382 - DNA, 75 bp, Artificial Sequence
  Synthetic
tggtgttttcgttcgatggtctgtcattgtcggtgaagacgacgcttgaatctattagattcattctttgcacat

SEQ ID NO: 173383 - DNA, 75 bp, Artificial Sequence
  Synthetic
tgtcttgttgttcagacccggtctctacaactactgagtcgggttgagtttcaagtagtttttctatcaagacgt

SEQ ID NO: 173384 - DNA, 75 bp, Artificial Sequence
  Synthetic
cggagatttcgtaatttctaactcttaccgtgttctgtgtcagtggtgtatcatccgctgttatttttgcattcg

SEQ ID NO: 173385 - DNA, 75 bp, Artificial Sequence
  Synthetic
gtttacaactttcaaggccagtaatggatttaaagttattagggccgcccagatctgtcactgaggctgtacata

SEQ ID NO: 173386 - DNA, 75 bp, Artificial Sequence
  Synthetic
tgtcgtttctgggcatggtatgaacgaacgggcagaacagacgtccgtcgaacaacgcgttggcgaaattcacca

SEQ ID NO: 173387 - DNA, 75 bp, Artificial Sequence
  Synthetic
cacagttagggcttgtttgttttttccctatctgtctgctattttcaatgaatgtttttgcctctttggatttcc

SEQ ID NO: 173388 - DNA, 75 bp, Artificial Sequence
  Synthetic
gaggttcgccgcaaagttgctcgttgatgttggagatagagattgtcctcttcactaggcgaattagcgacacaa

SEQ ID NO: 173389 - DNA, 75 bp, Artificial Sequence
  Synthetic
ctggcacatctggagaaggagtatctggatacattttttctacatctttttcatgtatgtttgtaagtttttgtc

SEQ ID NO: 173390 - DNA, 75 bp, Artificial Sequence
  Synthetic
gatttctgtagtgagcgaaagctgctcctgggatcagttcgtcacccatgtggttagagattagcatgatcatct

SEQ ID NO: 173391 - DNA, 75 bp, Artificial Sequence
  Synthetic
tagttggggattcattgttctttgatggggtgggagtattattatcagtaggagattgtacttccatgtatttta

SEQ ID NO: 173392 - DNA, 75 bp, Artificial Sequence
  Synthetic
cgaagctgttgcaaaaaagaagtatatgtttcatgttaaaccaataagaaatacactggctaattacttgtttta

SEQ ID NO: 173393 - DNA, 75 bp, Artificial Sequence
  Synthetic
atacactggctaattacttgttttaagatcatgaaagcatgcttgtttccatgcactaagatctcgataacgtaa

SEQ ID NO: 173394 - DNA, 75 bp, Artificial Sequence
  Synthetic
tctgaatattttccatgttcatcaaattcagctaactctaatagtattgattctgaagggtctatgtttaaatca

SEQ ID NO: 173395 - DNA, 75 bp, Artificial Sequence
  Synthetic
attcagctaactctaatagtattgattctgaagggtctatgtttaaatcacagatggaagactctctatctttat

SEQ ID NO: 173396 - DNA, 75 bp, Artificial Sequence
  Synthetic
tcaagctttcggtgacaattttgagggtgaagtcgtagttgtgggagttcgtctttgcatgttccagcatttgat

SEQ ID NO: 173397 - DNA, 75 bp, Artificial Sequence
  Synthetic
ttatagcaatgtagccttccattatatcagaggaagttaaaggtttaatcaaaccagtatcatcataaactgttt

SEQ ID NO: 173398 - DNA, 75 bp, Artificial Sequence
  Synthetic
gtctttgcatgttccagcatttgatttgtacgggcttcgtggaaagagattggagctagtggtaaaggcatgttg

SEQ ID NO: 173399 - DNA, 75 bp, Artificial Sequence
  Synthetic
ctaagtattcacatgcgtgggtgatcatattcattatggtaattttaaactggtgtctgtgaggtttgaggtatt

SEQ ID NO: 173400 - DNA, 75 bp, Artificial Sequence
  Synthetic
cctatcattattcttggtgtgcagagtacttctgtggctcggtttttctggatatacgtgagatcaaagaagggg

SEQ ID NO: 173401 - DNA, 75 bp, Artificial Sequence
  Synthetic
gccatgaaaattcactgctgcatagaacaatactttggagaacagcagtgctaatatttttggcggcagtaatta

SEQ ID NO: 173402 - DNA, 75 bp, Artificial Sequence
  Synthetic
tgtctttcggtcggcagcgttggattgtccggtttgtaaaagtcttcaacgtttagttcgttttttaagacgttg

SEQ ID NO: 173403 - DNA, 75 bp, Artificial Sequence
  Synthetic
ctaatatttttggcggcagtaattaaatttttacaattcacatgaattttaaggaatgttctatcacagttatcc

SEQ ID NO: 173404 - DNA, 75 bp, Artificial Sequence
  Synthetic
gtgttcttgggtacttcttgtcgactttcgtataagttgtataaggtctgtaagatcctggttgggttttctcgg

SEQ ID NO: 173405 - DNA, 75 bp, Artificial Sequence
  Synthetic
gtaattttcagttgacatagttgagaaaagcggtggccggtaggcaatggttcgtttttcatgagtcgttcgacg

SEQ ID NO: 173406 - DNA, 75 bp, Artificial Sequence
  Synthetic
atttttaacatggttttctattatctcatttctactttccagtagttcctgtttaagtaaatttactcgcccaca

SEQ ID NO: 173407 - DNA, 75 bp, Artificial Sequence
  Synthetic
atggtcgagtcgtggacaatgggatggcaaaccgacggcagtatgtcggcaaaatcaattcgctgcacgacttgg

SEQ ID NO: 173408 - DNA, 75 bp, Artificial Sequence
  Synthetic
aaaatccttattggagatgtcaggattggacatctctttgttgtgtgccatcaacaacaatgaggtggaaaccat

SEQ ID NO: 173409 - DNA, 75 bp, Artificial Sequence
  Synthetic
tctttattgtggaaaaaaacgctggtgggtaggttgttttccatggtgtcgtttaatttcacacgtgtttccatt

SEQ ID NO: 173410 - DNA, 75 bp, Artificial Sequence
  Synthetic
gttcaatttttcacaatctaatgccacataagctttggaaaaaatgtttttgatggctataacaaattgattgtt

SEQ ID NO: 173411 - DNA, 75 bp, Artificial Sequence
  Synthetic
acataagctttggaaaaaatgtttttgatggctataacaaattgattgttcatattagctttcaaatccatgagc

SEQ ID NO: 173412 - DNA, 75 bp, Artificial Sequence
  Synthetic
gtactgaaaccggtttctgtcggtatgtagatacccaaagggaaaaagaatgtcagttgtaagctttgttctagc

SEQ ID NO: 173413 - DNA, 75 bp, Artificial Sequence
  Synthetic
ggatcgttgacgtctgtgtttttgtaaactttgtgtaggtggtcgaatgcgactaatttatctcccagttttaac

SEQ ID NO: 173414 - DNA, 75 bp, Artificial Sequence
  Synthetic
acatgcaaaaacaatgaatcgcggttcgcaccaattaaaaaaatccaagttttttccagataacatttttgcata

SEQ ID NO: 173415 - DNA, 75 bp, Artificial Sequence
  Synthetic
tttttccagataacatttttgcataacttgaaacaaatttagatgaaacactacttagtaaattaatatttatca

SEQ ID NO: 173416 - DNA, 75 bp, Artificial Sequence
  Synthetic
gtgttcagttttaggtcggcgtacgcgcggcttttgtcaaagatttctgatttgttgttagtgtcttgttgttct

SEQ ID NO: 173417 - DNA, 75 bp, Artificial Sequence
  Synthetic
gtcccggcgttcacggtgaattgagtaaaatcggccatgattgcacggtatgcaatcgcagtcactgcgttttct

SEQ ID NO: 173418 - DNA, 75 bp, Artificial Sequence
  Synthetic
gttaataagccagcggagttaattaaatcgtcttccatgttagacagttcctgtttcatggcagccttcactgat

SEQ ID NO: 173419 - DNA, 75 bp, Artificial Sequence
  Synthetic
ttgcccataataaagtgaccatatgagatgggggcggagacgacctgtgtggagatgtactgggagagtatgttg

SEQ ID NO: 173420 - DNA, 75 bp, Artificial Sequence
  Synthetic
gtgagtttttggatagagccgatcggtcctaataaaacaccgtctagggggatgttttctttggaagtgtagttg

SEQ ID NO: 173421 - DNA, 75 bp, Artificial Sequence
  Synthetic
ttcgtatcatttagaatgctttccgtgaccgattccatcatgtcgttcagaattctatagatatacgaactatta

SEQ ID NO: 173422 - DNA, 75 bp, Artificial Sequence
  Synthetic
ttattcctgttcaagaaaaataatgacgttaacaatctgttttttaggctctgaaacatgttgctgcgctgtact

SEQ ID NO: 173423 - DNA, 75 bp, Artificial Sequence
  Synthetic
cggctcagagcttgtttattatgtactttgttctcattcatggtcaggacgataaattgcgggggagattttctc

SEQ ID NO: 173424 - DNA, 75 bp, Artificial Sequence
  Synthetic
aataaggtttgcatgaatgcgtgaatcagacctcgttcgagcgaatcggctgaattctttaaagatcttaaaact

SEQ ID NO: 173425 - DNA, 75 bp, Artificial Sequence
  Synthetic
gtatgcaacgcattgatgtttaaaatctgatcgatgactgtgtttttaaatgtgttttccagatgctccagacag

SEQ ID NO: 173426 - DNA, 75 bp, Artificial Sequence
  Synthetic
gcagcactcaaatcgaacgatatgtttatggggtgtttttctgagtgtttggctaccatgatggtggtttctttt

SEQ ID NO: 173427 - DNA, 75 bp, Artificial Sequence
  Synthetic
ggagcagttacgtcgtttcctgtggcgactctgggtaattggataaagaagagaaccttcccgagggtcattcga

SEQ ID NO: 173428 - DNA, 75 bp, Artificial Sequence
  Synthetic
ctcacatcgttgaagcgaattacgttcgccgcaacggcgatcggcgtggtgaaaaagttgatccattctattttg

SEQ ID NO: 173429 - DNA, 75 bp, Artificial Sequence
  Synthetic
ttgcagtagattccgagcaaggcttcaaaactgatgttgtaacggctcggatcgtcaccgaaataaattcgcaaa

SEQ ID NO: 173430 - DNA, 75 bp, Artificial Sequence
  Synthetic
ttgtcaaaaagttgttcggccgtgtatgttttaatgtcattgaaaatatttagaggtgcttcgattttaggtaaa

SEQ ID NO: 173431 - DNA, 75 bp, Artificial Sequence
  Synthetic
atttcggtcgcctgccaattttccatgtttcggcgttatgcagcacaccggtaattgtgaaactttaatagttaa

SEQ ID NO: 173432 - DNA, 75 bp, Artificial Sequence
  Synthetic
ttcatgttttggttccacttgtgcacggtcgattccagtttttatagattcctgtgatctgaccgctgaagtgtc

SEQ ID NO: 173433 - DNA, 75 bp, Artificial Sequence
  Synthetic
ggatggtttgtttttagattctgtgacgagccaacccacgaaaaacaaagaatcgaggaaaaaaattgaagggaa

SEQ ID NO: 173434 - DNA, 75 bp, Artificial Sequence
  Synthetic
tcgcgacgaggaaactcgtttagcgcgatctgtgcctgtagttctggaaaagatcgagtcaatcatagagaaaat

SEQ ID NO: 173435 - DNA, 75 bp, Artificial Sequence
  Synthetic
ttttcaaacgtctgggccaaatatcgttcacgataaagacagggctaaaattgccttgtgtcgtctgttgttagg

SEQ ID NO: 173436 - DNA, 75 bp, Artificial Sequence
  Synthetic
accggttgcggtgccatgtttctgtgaagaatgggacaccaacgactatttatcgaaatctggatgtaaatgctt

SEQ ID NO: 173437 - DNA, 75 bp, Artificial Sequence
  Synthetic
aggtccgatcttatatattcataccagtcgatgtcgctgtagcgatattccggtttttaagttttccattatgaa

SEQ ID NO: 173438 - DNA, 75 bp, Artificial Sequence
  Synthetic
agattactacgcttcacacgtgttcagaggtttattatctctgaaagagtggaatacacatctaccgaatgtatt

SEQ ID NO: 173439 - DNA, 75 bp, Artificial Sequence
  Synthetic
gtgtacgtgcgagttgtcgatgagtgatagatatgtggcgaccgtgtttcctaagcagaattctatatatctaga

SEQ ID NO: 173440 - DNA, 75 bp, Artificial Sequence
  Synthetic
atactatccgtattttttgtgttatctgtgtcgctatcttactgtcattgagattgagcagtgtacaaatgattt

SEQ ID NO: 173441 - DNA, 75 bp, Artificial Sequence
  Synthetic
aatttcgcttcttggtcctaaagtagctcagcgagtcataattcattttaaactgcttttcggttttcgtcacaa

SEQ ID NO: 173442 - DNA, 75 bp, Artificial Sequence
  Synthetic
gccgcatatgggcactgttgattcgtggttctgggaaaatttttttatgctagaattgcataagctttggttaac

SEQ ID NO: 173443 - DNA, 75 bp, Artificial Sequence
  Synthetic
cgtagtcaaacataaccgggtgacaacagatttctttaatgtagtctatgagaaaattcaaaactataaacaata

SEQ ID NO: 173444 - DNA, 75 bp, Artificial Sequence
  Synthetic
acagatttctttaatgtagtctatgagaaaattcaaaactataaacaatacgccatcaagactttgaggatgtcg

SEQ ID NO: 173445 - DNA, 75 bp, Artificial Sequence
  Synthetic
tctaaggcggttcctgcaatacagaggttttgtttggcaaaatttaagcagcaactcttgtatctaaatattaag

SEQ ID NO: 173446 - DNA, 75 bp, Artificial Sequence
  Synthetic
gttacggtaaaaaaaaataagcgagaactgtgtttaaatggttttgtttacggtaaaacattgtatgtcgttgaa

SEQ ID NO: 173447 - DNA, 75 bp, Artificial Sequence
  Synthetic
cggtaaaacattgtatgtcgttgaatcttctcagttaatctttcgaaatttgcttctgttgtattacgattacag

SEQ ID NO: 173448 - DNA, 75 bp, Artificial Sequence
  Synthetic
tcttctcagttaatctttcgaaatttgcttctgttgtattacgattacagtttgccggacgaatgcaaaacaaaa

SEQ ID NO: 173449 - DNA, 75 bp, Artificial Sequence
  Synthetic
gaagaaaacgttttgacgactcattacatacgggtaatttcgagattgtcgtttaagcagtctcgaagtgcggtc

SEQ ID NO: 173450 - DNA, 75 bp, Artificial Sequence
  Synthetic
aagaacactttactgataaattgtcatgttttttttttaaaaacatctgctacacatcatgaaacaggaatgtgg

SEQ ID NO: 173451 - DNA, 75 bp, Artificial Sequence
  Synthetic
ccgccaggcgtgaaaccagattttaccttcgtggcacaactgcctaaacgtaaagagttgcctaatgttcctggt

SEQ ID NO: 173452 - DNA, 75 bp, Artificial Sequence
  Synthetic
ttttggtgttagcgcttctcacgaaataaatgacttagtcaggggaaaatgttgtaaccgcggtacacactgacc

SEQ ID NO: 173453 - DNA, 75 bp, Artificial Sequence
  Synthetic
ggtattgattttgctgaaattacctcagtgaggcatggcgcggtaattcttaacgcgtttaatacgaacaaagtc

SEQ ID NO: 173454 - DNA, 75 bp, Artificial Sequence
  Synthetic
atgaatttaaaagcaaccatttcaaaaagggctaattttgtgtatcatcgcattcctaagacaatgactcacagt

SEQ ID NO: 173455 - DNA, 75 bp, Artificial Sequence
  Synthetic
aaagaccccaaccacagtacccactaacctttaacttaatgagaaaaacaggaactcggttgcttcgttagcagt

SEQ ID NO: 173456 - DNA, 75 bp, Artificial Sequence
  Synthetic
cattcctaagacaatgactcacagttttgtcatgtacaagcatacatttaaagaacctgcgtttaccgtaagcac

SEQ ID NO: 173457 - DNA, 75 bp, Artificial Sequence
  Synthetic
tttgtcatgtacaagcatacatttaaagaacctgcgtttaccgtaagcacgtttgtttcaaacgatgatttagat

SEQ ID NO: 173458 - DNA, 75 bp, Artificial Sequence
  Synthetic
aggaaagacttcaaccgcaatatctgctaatttttaactttataagaaaaacaggaactgcggttgccgcgttac

SEQ ID NO: 173459 - DNA, 75 bp, Artificial Sequence
  Synthetic
atgagttcattgaatatcaatatacgtggaccttactgcgactttttatatgccttaggcgtttataagatgcat

SEQ ID NO: 173460 - DNA, 75 bp, Artificial Sequence
  Synthetic
gtttctatccaagatctgtttttgccggcgttcgtttgcaatagcaataattcagtggatttacagggactggaa

SEQ ID NO: 173461 - DNA, 75 bp, Artificial Sequence
  Synthetic
cggcgttcgtttgcaatagcaataattcagtggatttacagggactggaagatcaggatgttgtgagaaatagaa

SEQ ID NO: 173462 - DNA, 75 bp, Artificial Sequence
  Synthetic
agaaaaaggtgtattggattactaactttccgtgcatgatttctaatgccaacaaagtgaatgtgggatggttta

SEQ ID NO: 173463 - DNA, 75 bp, Artificial Sequence
  Synthetic
gcctggacaggaaatacttcaaccgcggtacccgctgatctttaactttatgggaaaaacaggaactcggttgcc

SEQ ID NO: 173464 - DNA, 75 bp, Artificial Sequence
  Synthetic
aagcaggaacaggtattattcctcgggtgtctggaaaagaccttcaaaatgttttgcttcaggaattaaataacg

SEQ ID NO: 173465 - DNA, 75 bp, Artificial Sequence
  Synthetic
gcgttacgagcttttagagttctcattcgcctgggcaggaaatacttcaaccgcggtacccgctgatctttaact

SEQ ID NO: 173466 - DNA, 75 bp, Artificial Sequence
  Synthetic
ccgcggtacccgctgatctttaactttatgagaaaaacaggaactgcggttgccgcgttacgagattttgaagtt

SEQ ID NO: 173467 - DNA, 75 bp, Artificial Sequence
  Synthetic
ttcgagagattccagggttagtctttgatatggatttgcatcaattgcttgttttgctggaacagcggaatctac

SEQ ID NO: 173468 - DNA, 75 bp, Artificial Sequence
  Synthetic
gtttcttatttttttacgtcttggcctgttaatgggttacggaaactctcggcgcaacaaggtgcatgatatcat

SEQ ID NO: 173469 - DNA, 75 bp, Artificial Sequence
  Synthetic
gttacacttaatttcgaatggcctgtttgattttaataagaactccgtagcaaatacaaaaatcaaacacgggtg

SEQ ID NO: 173470 - DNA, 75 bp, Artificial Sequence
  Synthetic
tgctttggttgggacgcggctcgccaacaatgttccgaaaatcattgctaggcagaagaaaatgaagctagatca

SEQ ID NO: 173471 - DNA, 75 bp, Artificial Sequence
  Synthetic
catgggacgaaatgctaattcgcttgccgtgttgcgttttatcgttaaaagtggggaacataaaaataaaactgt

SEQ ID NO: 173472 - DNA, 75 bp, Artificial Sequence
  Synthetic
aggttttagggttctcgttagcctgggtaggaaagaccccaaccgcagtacccactaacctttaactttatgaga

SEQ ID NO: 173473 - DNA, 75 bp, Artificial Sequence
  Synthetic
tttcattaaactgttggaatatttagcggaaacctcaactgccataaatacgcggaatgaagtcgccagattact

SEQ ID NO: 173474 - DNA, 75 bp, Artificial Sequence
  Synthetic
cccactaacctttaactttatgagaaaaacaggaactcggttgctccgttagcaggttttagggttctcgttagc

SEQ ID NO: 173475 - DNA, 75 bp, Artificial Sequence
  Synthetic
tctgactctgacgactaatatgaaaacatgaatgtacccatggccgacgaatggttcgattgcgcgattaggtta

SEQ ID NO: 173476 - DNA, 75 bp, Artificial Sequence
  Synthetic
ctgggtaagaaagaccccaaccgcagtacccactaacctttaactttatgagaaaaacaggaactgcggttgctc

SEQ ID NO: 173477 - DNA, 75 bp, Artificial Sequence
  Synthetic
gattcggaaaccatagctgtccatgaaattttcaattcggatttaagtaaactgcttaacttgcactcgaaaaca

SEQ ID NO: 173478 - DNA, 75 bp, Artificial Sequence
  Synthetic
gtctatatgtccgatctgtgcgcctttatttctggttgtgttaatcggaatgttggtaaacttaccatatattgg

SEQ ID NO: 173479 - DNA, 75 bp, Artificial Sequence
  Synthetic
cacgtgtacggagacataatctacgcattgacgggtattttacattgtgtaaaaataacgatagagtgcggggag

SEQ ID NO: 173480 - DNA, 75 bp, Artificial Sequence
  Synthetic
agaattgccgatggtcgatatagattatacgaaattccgaaattatttttaatgagaggacagtcaacacccctg

SEQ ID NO: 173481 - DNA, 75 bp, Artificial Sequence
  Synthetic
gaactgaagtggaagcacgccgtgggtatcgcgacgacgaataagcctttgctgacgcacgttttaacagatgtg

SEQ ID NO: 173482 - DNA, 75 bp, Artificial Sequence
  Synthetic
ttggaaacctctccttttaccttgccagatacgcttctgtcggtgcaggagttgtctattttcagagagagattg

SEQ ID NO: 173483 - DNA, 75 bp, Artificial Sequence
  Synthetic
ggaactgcggttgccgcgttacgagacttttgaagttctcatccttattagcaggaaagatttaaaccgcagtac

SEQ ID NO: 173484 - DNA, 75 bp, Artificial Sequence
  Synthetic
gttgtctattttcagagagagattgtcgtatatttactatgtgctcgggttagatgttgatatcgtagcgagaac

SEQ ID NO: 173485 - DNA, 75 bp, Artificial Sequence
  Synthetic
acttttgaagttctcatccttattagcaggaaagatttaaaccgcagtacccactaacctttaagtttatgagga

SEQ ID NO: 173486 - DNA, 75 bp, Artificial Sequence
  Synthetic
agagagggagatttttcaaaaatgtgcagaactagctcgcctacaacaagtctttcttattcaaggaaatattat

SEQ ID NO: 173487 - DNA, 75 bp, Artificial Sequence
  Synthetic
ggaaaactttgtcctcgttcaggcgtgtctatttcagctgggggctgatggtttgtgggaagagatgtctggctc

SEQ ID NO: 173488 - DNA, 75 bp, Artificial Sequence
  Synthetic
ggtacccactgatctttaactttatgaagaaaaacaggaactttgttgctttgttagcagattttaaagttctca

SEQ ID NO: 173489 - DNA, 75 bp, Artificial Sequence
  Synthetic
tgtacgtcctaggccggagttgatgtctagtgcgttcattcaacacagagtaatggtgaataattgttattgtct

SEQ ID NO: 173490 - DNA, 75 bp, Artificial Sequence
  Synthetic
cgctgtcatcttcaatgccatttataaacacaaagtttccctgcctaccgtagaaagaagccacgaaatcgttca

SEQ ID NO: 173491 - DNA, 75 bp, Artificial Sequence
  Synthetic
ttcaaccgcggtacccactgatctttagctttatcagaaaaaacagaaactgcggttgccccattagcggatttt

SEQ ID NO: 173492 - DNA, 75 bp, Artificial Sequence
  Synthetic
tcgtgtagttcaggaatattataagtcttatgtgaatgctcctctctctgttcttgtgtgtgcgactaaggtgct

SEQ ID NO: 173493 - DNA, 75 bp, Artificial Sequence
  Synthetic
agggtcctcacccacttgagtaggaaagaccctaaccgcggcacccactgacctttaactgtatgaagagaaaca

SEQ ID NO: 173494 - DNA, 75 bp, Artificial Sequence
  Synthetic
taccttgtttacagaagaatataactttcagtcagctctcgtatttgtcagtcagtttttccaggtggacgtcga

SEQ ID NO: 173495 - DNA, 75 bp, Artificial Sequence
  Synthetic
ggcttcgagagcggatgtgattcgtctgtttttagcgtgtctgaagggtgattagatctctcggaaagaggctga

SEQ ID NO: 173496 - DNA, 75 bp, Artificial Sequence
  Synthetic
actgtttccagagcacacataaatcgccataattatggcgataattaagtcgtcagaacaggcttgttttttagc

SEQ ID NO: 173497 - DNA, 75 bp, Artificial Sequence
  Synthetic
gctgtatgttatgtaattgttaacggagatctggtgaatgtttctgatttgttctagtgcgtattctacgggatc

SEQ ID NO: 173498 - DNA, 75 bp, Artificial Sequence
  Synthetic
gtaggtgatttttattgtaaacgatatcaattcctgtgatgccttgatgtttcctgaattaaaattcgagatgaa

SEQ ID NO: 173499 - DNA, 75 bp, Artificial Sequence
  Synthetic
aaactcaactgctagttttttttctttaccgagtaggtaaaatggctgtgctatctgattctggtctggggtgtg

SEQ ID NO: 173500 - DNA, 75 bp, Artificial Sequence
  Synthetic
gaaaaaagtcacctgtatagatttattagccgtgatgttttcctttatgatacatgcgatttttacggcagaagc

SEQ ID NO: 173501 - DNA, 75 bp, Artificial Sequence
  Synthetic
ttgattggaattcccttctatgatgatttttacttccgtgaagaaaggatgtaggtctaggattgacaatatcat

SEQ ID NO: 173502 - DNA, 75 bp, Artificial Sequence
  Synthetic
atgcgcggcacattcagctattgctgtgtcggaactcgtcattaaactttctagaaagtagtgctccatgccgta

SEQ ID NO: 173503 - DNA, 75 bp, Artificial Sequence
  Synthetic
ccgtgaagtagaatattttaatgatgtattaatcatcatttcctaccacgcctattaacttcagtatttatagga

SEQ ID NO: 173504 - DNA, 75 bp, Artificial Sequence
  Synthetic
gtattaatcatcatttcctaccacgcctattaacttcagtatttataggataggcaatttgccgctatacgccat

SEQ ID NO: 173505 - DNA, 75 bp, Artificial Sequence
  Synthetic
gacgatatattgatctagataggtgcctatcgctgctatgccagtgccagaagcacggcggttgcctgtataggc

SEQ ID NO: 173506 - DNA, 75 bp, Artificial Sequence
  Synthetic
aggatctaggtatacgtacagatctttacctaaaaaaggaattagatttttattgatggtgctgtatcggaaaaa

SEQ ID NO: 173507 - DNA, 75 bp, Artificial Sequence
  Synthetic
ctcgaattcggtttgtccttgttccgtaattaaaacgtcgttgatcacattgcaagtggctccgcccatgatttc

SEQ ID NO: 173508 - DNA, 75 bp, Artificial Sequence
  Synthetic
atggatgaaagctccttctaggaagaggttggccgtttttttaacttcggcgttaatgctgatgaacttgggttt

SEQ ID NO: 173509 - DNA, 75 bp, Artificial Sequence
  Synthetic
gtggagtcggtagcaagaacaggctgtggcgttaccgcgttcgtttagcatatgggcgtgatcttcgcatacgta

SEQ ID NO: 173510 - DNA, 75 bp, Artificial Sequence
  Synthetic
agaaactacggagagcatttcaaacggagagttgttcagcttcattaaaaaagaagttgaatggtttccggaatt

SEQ ID NO: 173511 - DNA, 75 bp, Artificial Sequence
  Synthetic
ggtcgaagatataaataggatcttggtagatgcttggggcaggaaacctaaaatcgtgctgaacgcgtctttctt

SEQ ID NO: 173512 - DNA, 75 bp, Artificial Sequence
  Synthetic
tataaagtggctctcgtcgacaataagtagattgaagctttgtccgcgtatactctgagaggggaatgaattcgg

SEQ ID NO: 173513 - DNA, 75 bp, Artificial Sequence
  Synthetic
cgttaaacgagataaaagacgattttgagaactgtgaaacgaaaaacgacctttttaaaataattgataaaataa

SEQ ID NO: 173514 - DNA, 75 bp, Artificial Sequence
  Synthetic
gcaaaaattgcaattttatagtggaacaggtcgagtccttgcctcggagggtggattcagcggctatcctatttg

SEQ ID NO: 173515 - DNA, 75 bp, Artificial Sequence
  Synthetic
ataatctcgcggtggagatatttaacgatgtaatatatcgacaaaatggagatggcgttgccgcgaaaatacgac

SEQ ID NO: 173516 - DNA, 75 bp, Artificial Sequence
  Synthetic
agggtaacgggcagaatattgacacataagaataaccagatgtgcacaaccgaatgttctcagatgtataattta

SEQ ID NO: 173517 - DNA, 75 bp, Artificial Sequence
  Synthetic
cacaatcctatcacgtttgagttgggacttggaaacgtgtttgtctgtatgcggtgtttgacggttcaccactgt

SEQ ID NO: 173518 - DNA, 75 bp, Artificial Sequence
  Synthetic
gatatgcaaactgactgtaccattgtcaacacgcatgaggggtatgtctgtgcgaaaacgggtttattttatagc

SEQ ID NO: 173519 - DNA, 75 bp, Artificial Sequence
  Synthetic
ggttggatgcctacatatgccgactgtttcttagaaccaatctgtgagccgaatatcgaaacggttaatgtcgtg

SEQ ID NO: 173520 - DNA, 75 bp, Artificial Sequence
  Synthetic
gtggtcttgttatcttatgtatatagttttctgatggaaaacaaggaacgatatgctgccattattgatagcatt

SEQ ID NO: 173521 - DNA, 75 bp, Artificial Sequence
  Synthetic
atatgctgccattattgatagcattattaaagatggaaaatttataaaaaacgtggaagacgctgtgttttatac

SEQ ID NO: 173522 - DNA, 75 bp, Artificial Sequence
  Synthetic
ttttaatgcggtttttacgaactcaactttcaataagattcctttgacgacgataagtcggctttttgttcagtt

SEQ ID NO: 173523 - DNA, 75 bp, Artificial Sequence
  Synthetic
gattataggaggacacgctaaaggaacgatttatgacagcaatgtaattcgcgtcagtcgtcggaaacgagaaga

SEQ ID NO: 173524 - DNA, 75 bp, Artificial Sequence
  Synthetic
cagtttactaaaaaagatgagattggagtatggaaacgcacttatactatgacaccctgtaccaatatcaaggcg

SEQ ID NO: 173525 - DNA, 75 bp, Artificial Sequence
  Synthetic
gagtgtatccggcccatatttgcctgccgacagatgcgtatcttccgatgagagtggattgtatcgagtctttat

SEQ ID NO: 173526 - DNA, 75 bp, Artificial Sequence
  Synthetic
attttcggtgtgtttttttcaagaatgggatgcattatactgaatggagtaaattaaagtttactgtgatttcac

SEQ ID NO: 173527 - DNA, 75 bp, Artificial Sequence
  Synthetic
gtgaaataaagtttaaagatgtgttaaagaatgctgactttgacgaactttttaccggtttggtggtaatgacta

SEQ ID NO: 173528 - DNA, 75 bp, Artificial Sequence
  Synthetic
ttccaattccaatagtagattttcattttgatatcgattctgtaattttgaaattggtttatccgcagttagtgc

SEQ ID NO: 173529 - DNA, 75 bp, Artificial Sequence
  Synthetic
accgagaaatagtgctgaggctctacgatctcatatgcatcagaccttcgtcagaccggccgtcggaagtatcag

SEQ ID NO: 173530 - DNA, 75 bp, Artificial Sequence
  Synthetic
ctaaaaatattggtattgatttctatcaactaacttcacagggaaataaacaaacacccgatgaggaaaaacgtt

SEQ ID NO: 173531 - DNA, 75 bp, Artificial Sequence
  Synthetic
caaacacccgatgaggaaaaacgttgtctattttttcagcagggacctttagagccaccctctaccgtcagaggc

SEQ ID NO: 173532 - DNA, 75 bp, Artificial Sequence
  Synthetic
agagccaccctctaccgtcagaggcttaaaggcagctggcaatgcaaagccgatgcagtttcccgcccatgtcaa

SEQ ID NO: 173533 - DNA, 75 bp, Artificial Sequence
  Synthetic
cgaaaaaatgaccgaatcttttttaagcgatagttggttcgaacaaaaggtcagatgcaaaaaaatattggattt

SEQ ID NO: 173534 - DNA, 75 bp, Artificial Sequence
  Synthetic
tacgcaaacgtatcgagtcgtggtatgttggtacgagctttcgttttcccgcgagatgcagatcgagaataattt

SEQ ID NO: 173535 - DNA, 75 bp, Artificial Sequence
  Synthetic
actgtccgcttcccagctaaagcgggttaacgctgcggatttttgggatagaactgatcggtatttgcgagatat

SEQ ID NO: 173536 - DNA, 75 bp, Artificial Sequence
  Synthetic
tgggagcagggtattgacacacatcgtgaaaacgcttcagattcataataggcaatttaaacagaaatttaattg

SEQ ID NO: 173537 - DNA, 75 bp, Artificial Sequence
  Synthetic
gggaaatgccggtataagacccggggaatatcagtctgtccataatcaatcttctggaaacgggtctaagtctta

SEQ ID NO: 173538 - DNA, 75 bp, Artificial Sequence
  Synthetic
caatttcccagttaatttcagctttgaacatctattatcatttatgcagctcgggaaagatttttggattttaaa

SEQ ID NO: 173539 - DNA, 75 bp, Artificial Sequence
  Synthetic
gaatatcagtctgtccataatcaatcttctggaaacgggtctaagtcttatgagatcaccacggcatccggcgat

SEQ ID NO: 173540 - DNA, 75 bp, Artificial Sequence
  Synthetic
cttaactttagacagctgcattattaaggcaattatctgtttcctaggttttcgaaacgggagaaaatctttttt

SEQ ID NO: 173541 - DNA, 75 bp, Artificial Sequence
  Synthetic
agctcaagatgaagtttggggagatttaatagactgttctaaaggatcggtgatctacggggaaaagatccaatg

SEQ ID NO: 173542 - DNA, 75 bp, Artificial Sequence
  Synthetic
gattttagattcgactaacaatttatattcgacgcgtcgtgaaaaacagaataagtcgtgggaattatatgttga

SEQ ID NO: 173543 - DNA, 75 bp, Artificial Sequence
  Synthetic
cactcctgtgtgcgaaacacagaatatgaacaactcacaggcgacacaactaagcgcatccatgaactgcataaa

SEQ ID NO: 173544 - DNA, 75 bp, Artificial Sequence
  Synthetic
ttgctgtgctttgtatgtatctgaaaagttagagttggattttgtgctacccggcggttttgcgatcaccggtaa

SEQ ID NO: 173545 - DNA, 75 bp, Artificial Sequence
  Synthetic
atgaacaactcacaggcgacacaactaagcgcatccatgaactgcataaatgcgttatcaactactatggatgcg

SEQ ID NO: 173546 - DNA, 75 bp, Artificial Sequence
  Synthetic
attcgctcttactgatggcgatatcgactttttcaattggcgatttgggttatcttagaaattttttgcagaatg

SEQ ID NO: 173547 - DNA, 75 bp, Artificial Sequence
  Synthetic
aatgtaactggttcaggatttgtaaaaaaacattctatcgcgaatatcgcagcgttgcgacatcgtctcctatat

SEQ ID NO: 173548 - DNA, 75 bp, Artificial Sequence
  Synthetic
tttcgttgaagaataagcctaagaaatattgcatgcattgcgagatggtagtgctcaagcgaagtcatgaattta

SEQ ID NO: 173549 - DNA, 75 bp, Artificial Sequence
  Synthetic
tgttcagccttgcggtaaacggcatacattttggacagtttttgaccggaataatgaaatttaagaagaaacaag

SEQ ID NO: 173550 - DNA, 75 bp, Artificial Sequence
  Synthetic
ttgcggaagggctctgttactatgtattggaattgggaagcataagtcctgtcgatttgagctttatcccaaaat

SEQ ID NO: 173551 - DNA, 75 bp, Artificial Sequence
  Synthetic
ataattctgactgcgttacaagcatgcattgtgttacaccggagcttatttatgaaaattgctctattgtgtgtc

SEQ ID NO: 173552 - DNA, 75 bp, Artificial Sequence
  Synthetic
gcattgtgttacaccggagcttatttatgaaaattgctctattgtgtgtcccgaagaggcaagtcgcctcactgt

SEQ ID NO: 173553 - DNA, 75 bp, Artificial Sequence
  Synthetic
tatgaaaattgctctattgtgtgtcccgaagaggcaagtcgcctcactgtaaaagggctcggggacaataaattg

SEQ ID NO: 173554 - DNA, 75 bp, Artificial Sequence
  Synthetic
attcccttaggtgggtgtggagtatggtgtctgaaaaatggtggcgatctgtatatctatgcttttgtactcgct

SEQ ID NO: 173555 - DNA, 75 bp, Artificial Sequence
  Synthetic
tacgatctttacgtagcttgttatgacaaaaccatctttccatctctggcgaaaattgtttttgatatgatagct

SEQ ID NO: 173556 - DNA, 75 bp, Artificial Sequence
  Synthetic
tgcgattccgaagattgcgtcttttgtaaagatcacaacaaacatgtatcgcaagccggacatattgtagggtgc

SEQ ID NO: 173557 - DNA, 75 bp, Artificial Sequence
  Synthetic
gtctctaatcaagaaacctgtttttgctacacaccgtgtcaaaaaaaaatgactgatattaacaatccggagtta

SEQ ID NO: 173558 - DNA, 75 bp, Artificial Sequence
  Synthetic
atctctttgctctgtgatcaggaaattaataagatagatattatgtatcccgagaaaaaagcatcgttatcactt

SEQ ID NO: 173559 - DNA, 75 bp, Artificial Sequence
  Synthetic
gacattaattcttacgttcatgggtacctcggcgacgagccttgtgcgttaaaatgtgttaattggatgccaatc

SEQ ID NO: 173560 - DNA, 75 bp, Artificial Sequence
  Synthetic
aggatcagctcagctctgagcaggctgattattttgtcgtgtcctgtgtgtaagcgtgtggtaatggactaagtg

SEQ ID NO: 173561 - DNA, 75 bp, Artificial Sequence
  Synthetic
ttctgaagaagatgatgtgctttccagtgcagcctctgtcagctgtaatgacaactgcgtcatgaagatcggact

SEQ ID NO: 173562 - DNA, 75 bp, Artificial Sequence
  Synthetic
tgcgttattttctgtattaattttttgtttctgaaaataaagttgaattgatagtacttacgtgtgtattgtagc

SEQ ID NO: 173563 - DNA, 75 bp, Artificial Sequence
  Synthetic
tcagcagcaaggtaccactgtggctgatttacaacaagggtttaagcaacaaatgaacggagaattctccatgtt

SEQ ID NO: 173564 - DNA, 75 bp, Artificial Sequence
  Synthetic
agctggcgaaaagtgctgtgctctttatattttgatggtcgattgtaattacattatccaggcatgtgattgtct

SEQ ID NO: 173565 - DNA, 75 bp, Artificial Sequence
  Synthetic
tgcagtggacgagaacattaaaacacaggagatgtcgaatgactgcgcgacaaacgtcacggataatgtatgcgc

SEQ ID NO: 173566 - DNA, 75 bp, Artificial Sequence
  Synthetic
tttctggaaacattcggcggcatttaaactcgacttctttcatcacaaagtgagatacatgtttttgatgtgcta

SEQ ID NO: 173567 - DNA, 75 bp, Artificial Sequence
  Synthetic
cgtaaccgatgctgattccttcaatgtttttcaataaaaaacttataattggaactatgaaccacgtttttccat

SEQ ID NO: 173568 - DNA, 75 bp, Artificial Sequence
  Synthetic
gtcttctcgggactaggaatacgttagttttttgtttcagcgtattcagagtactttcgtttacgaattcaatgt

SEQ ID NO: 173569 - DNA, 75 bp, Artificial Sequence
  Synthetic
cgaacacgtgggtcagatagttgataacacgattggctaaagccggaagtttggtgacggcgatgaaaaagatta

SEQ ID NO: 173570 - DNA, 75 bp, Artificial Sequence
  Synthetic
catgtatgagaatgttcttctgaaatggttccagttgtattttgcgcgtgtctccaaagtcgttgaattctcctt

SEQ ID NO: 173571 - DNA, 75 bp, Artificial Sequence
  Synthetic
tgatccattttctgaaatctttgataaaaccatctatttgcaagaatagcggttcacgatatagaatcttaaagg

SEQ ID NO: 173572 - DNA, 75 bp, Artificial Sequence
  Synthetic
attcgagaaactctgtgtattgtgattcaaaggatttgtcggaagcgggtaagaacttcatttcttgtagcttgc

SEQ ID NO: 173573 - DNA, 75 bp, Artificial Sequence
  Synthetic
gcgtaaggctcggtagtatagtaagaggcttacggtttttaagatgtcgctgtttttcacagaatgtatatagag

SEQ ID NO: 173574 - DNA, 75 bp, Artificial Sequence
  Synthetic
gttttacctgttggttatatgaatgggcaaacccgagttctggcgtgagcattataaaacgcttcttatagaaga

SEQ ID NO: 173575 - DNA, 75 bp, Artificial Sequence
  Synthetic
tggcactgttggggtatttggtagatatcgtagagcagtttctttcgcctttccatatgatcgcttcatagttgt

SEQ ID NO: 173576 - DNA, 75 bp, Artificial Sequence
  Synthetic
tttttatgtgggttatgtcgcaggtacgtagcatggagcccgaccttacgttggcggcggtctatcaggcggcgg

SEQ ID NO: 173577 - DNA, 75 bp, Artificial Sequence
  Synthetic
cgaatctcacagagcaggataaggagattttttccgaagcggtaaaaactgcgttttcagtgtgtagttcggcag

SEQ ID NO: 173578 - DNA, 75 bp, Artificial Sequence
  Synthetic
ccccgagcgctaggttgagaatgatcgaaacgcctacacagaattttatgtttgtgacgagcgttattccttcgg

SEQ ID NO: 173579 - DNA, 75 bp, Artificial Sequence
  Synthetic
gtgtgccgtctggtgaaaaaaaaacaaagttaaatatcgatgccgctctggataatttggctttgtcgtttgcga

SEQ ID NO: 173580 - DNA, 75 bp, Artificial Sequence
  Synthetic
aaagttaaatatcgatgccgctctggataatttggctttgtcgtttgcgaacaaaaaatcaaagaagatggctag

SEQ ID NO: 173581 - DNA, 75 bp, Artificial Sequence
  Synthetic
aacgtatttgctacagaacgtttcgcggactcaagatcaacaagttgccatttcggggacgtacattttatatac

SEQ ID NO: 173582 - DNA, 75 bp, Artificial Sequence
  Synthetic
aaaaaaacacattgaaacgtctttgatgctcgataagacgaagttagttaaacaaattcttgagtatgctgagac

SEQ ID NO: 173583 - DNA, 75 bp, Artificial Sequence
  Synthetic
ccctaatttgttagggtataccgatgtgcgtgatcttgaatgtttactttggttggtgttctgtggccctaaaag

SEQ ID NO: 173584 - DNA, 75 bp, Artificial Sequence
  Synthetic
tttttgccagtcagacagttgtttcggatacagtaagacgggatataatgccgcatttccgaatctattgcctcc

SEQ ID NO: 173585 - DNA, 75 bp, Artificial Sequence
  Synthetic
gtatctgtacgaatgcggccagaataatggactgttttttggcattgtgcaagcttacgtgttttcttggtactc

SEQ ID NO: 173586 - DNA, 75 bp, Artificial Sequence
  Synthetic
agattttgatttttcagcgctagagatttcagaacgcgctcgtcgtcgaatcaggtcactcctgtacgacttaaa

SEQ ID NO: 173587 - DNA, 75 bp, Artificial Sequence
  Synthetic
tctcaggaaggtaaataagaattgctatgtcaagagttttccttgacagttcccaccctctttttttaattaaaa

SEQ ID NO: 173588 - DNA, 75 bp, Artificial Sequence
  Synthetic
acagaagttttcggagcaagaaatttctgttttaccggtagcgtcacagatgtgtatcttctgtgcattatataa

SEQ ID NO: 173589 - DNA, 75 bp, Artificial Sequence
  Synthetic
cagaaaggccattgattccatccgctaagagatttactgtttctttgacatttatcagagatacgtaatactcgg

SEQ ID NO: 173590 - DNA, 75 bp, Artificial Sequence
  Synthetic
acaaaacaaacttagtctagaatacgtttctggtgacttaaagacttctgtttttagtccaattataataaagga

SEQ ID NO: 173591 - DNA, 75 bp, Artificial Sequence
  Synthetic
tctactgtgtattgtgtaccttgtaatctctaggtaaacttctgctatttttaatgttgattaattggacattgt

SEQ ID NO: 173592 - DNA, 75 bp, Artificial Sequence
  Synthetic
ttgtttatgcgtgcagacgacaatttctacaactcagatgctgccaggtacaaagagctcagcgatatttccggt

SEQ ID NO: 173593 - DNA, 75 bp, Artificial Sequence
  Synthetic
atatgaccttcgtaagctgctcagtgcacttgtcatttcggaaggtagcgtcagattcgatatataatgtctttg

SEQ ID NO: 173594 - DNA, 75 bp, Artificial Sequence
  Synthetic
gtgatagggaaggtttgtaaggacaaaggacaaagttcagtaagatttaataaaataacatgtgacacaatttct

SEQ ID NO: 173595 - DNA, 75 bp, Artificial Sequence
  Synthetic
aaggacaaagttcagtaagatttaataaaataacatgtgacacaatttctgactctccctttcagtaattttttt

SEQ ID NO: 173596 - DNA, 75 bp, Artificial Sequence
  Synthetic
aaggactatctgagacagtcaatttctaaagatttggaggtgagacatcgagattctttaaagattagattaggg

SEQ ID NO: 173597 - DNA, 75 bp, Artificial Sequence
  Synthetic
gagagacatccgttgagtgtgcatcagcatatgatcgccgctaggcagatcattaaatcggacaatgcggaacac

SEQ ID NO: 173598 - DNA, 75 bp, Artificial Sequence
  Synthetic
cagcatgtcatatcttctttgagtggttttttggataagcagaagagttttttaaaagtgcaacaaagagcttta

SEQ ID NO: 173599 - DNA, 75 bp, Artificial Sequence
  Synthetic
agatatcttggcccgtttttgtgtgctgacatagcactttcggttaaattttctatcacagctctcccgtagtca

SEQ ID NO: 173600 - DNA, 75 bp, Artificial Sequence
  Synthetic
ctgacatagcactttcggttaaattttctatcacagctctcccgtagtcacttaaaaaaaaaacaaaaaaaaaga

SEQ ID NO: 173601 - DNA, 75 bp, Artificial Sequence
  Synthetic
tttaaaagtgcaacaaagagctttaaagcagctagagaaattggacgttgatgaaataattgatacggcggcgga

SEQ ID NO: 173602 - DNA, 75 bp, Artificial Sequence
  Synthetic
agtgaaagcagtcagtaataatataaaagaaactcttatggcaagcactgaattagaataattatggacaacggt

SEQ ID NO: 173603 - DNA, 75 bp, Artificial Sequence
  Synthetic
gtggagacacctcaaggtcaaaaaactcagccgataaatttgccaccagataggaaaaggttgagaaaacatgac

SEQ ID NO: 173604 - DNA, 75 bp, Artificial Sequence
  Synthetic
ggacttggaaaaggtgttaaacgaaaactttttgccgaagatagctctccgttaaagaaacagatccccgcctgc

SEQ ID NO: 173605 - DNA, 75 bp, Artificial Sequence
  Synthetic
agcgatatggaaacactttcttcgcctgtaaagtttggatgcaagtcgcgaagtgcttctgctctcgatgaaagt

SEQ ID NO: 173606 - DNA, 75 bp, Artificial Sequence
  Synthetic
tttggaaaatgtaaacacgaaactgcttgcgattgttctgcgatagaggaattgctttgtcacgagtcgctttta

SEQ ID NO: 173607 - DNA, 75 bp, Artificial Sequence
  Synthetic
gactcgccgatgaaactgtcgaatgcccacaccatcttcagctcagacaaatggaaactggagctagagaaaatt

SEQ ID NO: 173608 - DNA, 75 bp, Artificial Sequence
  Synthetic
atggaaactggagctagagaaaattatagcttcaaagcagatctttctagacatgagcgagaatgttgaacttgt

SEQ ID NO: 173609 - DNA, 75 bp, Artificial Sequence
  Synthetic
acatgagcgagaatgttgaacttgtagcctacggcgagactttgtgtaacctgagaattttcgaaaagatcagct

SEQ ID NO: 173610 - DNA, 75 bp, Artificial Sequence
  Synthetic
cgccgtttttgtttgacgtgcaaagcgaggagcgttcgtattcagtggtttacgtccctcacaacaaagaacttt

SEQ ID NO: 173611 - DNA, 75 bp, Artificial Sequence
  Synthetic
cacagccacgaaatgcataattatctagcagcaatagtttgttatttaaacaatgtttttttatgttcatttaaa

SEQ ID NO: 173612 - DNA, 75 bp, Artificial Sequence
  Synthetic
gtggacagttttgtcaacctgaaaagactatggctcgagttctcggagtgggtgcctacgggaaggtgtttgatc

SEQ ID NO: 173613 - DNA, 75 bp, Artificial Sequence
  Synthetic
tatagtatgaatatttacaactaaatatacaatcgactatacacatggtcgttaacgcactattacatgtgttcc

SEQ ID NO: 173614 - DNA, 75 bp, Artificial Sequence
  Synthetic
tagataaagtggccataaagacggccaacgaagacgagagtgtcatttcggcttttatagccggtgtcatccgtg

SEQ ID NO: 173615 - DNA, 75 bp, Artificial Sequence
  Synthetic
aaaaaacagaggtttatcgggagttatcgttatctacatcgataaagtgtacaagtctacatgtaaacatcacag

SEQ ID NO: 173616 - DNA, 75 bp, Artificial Sequence
  Synthetic
caaaatcgggagccgacttattatctcacgactgtgttattaataaccttctgatttcaaattccgtttgtatgg

SEQ ID NO: 173617 - DNA, 75 bp, Artificial Sequence
  Synthetic
acaagtctacatgtaaacatcacaggaaaatatagaagtccgaggccgtgtacatccaaacacgcacaaataacg

SEQ ID NO: 173618 - DNA, 75 bp, Artificial Sequence
  Synthetic
atcataaagtgtctttgtcacgtacttatgatgttgatctctataagttcgaagattgggatgtcaggaatgtaa

SEQ ID NO: 173619 - DNA, 75 bp, Artificial Sequence
  Synthetic
tgaattattacagtgtgttttgtaagttagctgatgctgtaaggtttctaaatctgaaatgtagaattaatcatt

SEQ ID NO: 173620 - DNA, 75 bp, Artificial Sequence
  Synthetic
tcgatatctcacctatgaatatctttataaatcataaaaaagagataatctttgatgccgtgttggcggattaca

SEQ ID NO: 173621 - DNA, 75 bp, Artificial Sequence
  Synthetic
gcttgtccgaaatacatcccgagtataacggcacgtgtgctattgctaaagagtatgacagaaatcttcaacttg

SEQ ID NO: 173622 - DNA, 75 bp, Artificial Sequence
  Synthetic
tgccaatcagtcgtaacaaattctgtgacatgtttaatcctggatttcgaccacttgtcgccaatgcaatgatat

SEQ ID NO: 173623 - DNA, 75 bp, Artificial Sequence
  Synthetic
tctaatccaaagaaagtgaaattaaacgtaaaaaaaaaactctacatacagattgatagtttaacagcgctcacc

SEQ ID NO: 173624 - DNA, 75 bp, Artificial Sequence
  Synthetic
tggtcaatgtatgcgaggcttttgatggtgaaaataatcctcttagacactgtaatttggatctgtgcgcctttg

SEQ ID NO: 173625 - DNA, 75 bp, Artificial Sequence
  Synthetic
gattgatagtttaacagcgctcaccataatgcgggactcatatgggtcggactggctatatcgtatttaatatta

SEQ ID NO: 173626 - DNA, 75 bp, Artificial Sequence
  Synthetic
ctcaggtcgtattattgtgtgtcctgagaatgacagataaacgcggatgtcgcgaagctcagctatactacgaga

SEQ ID NO: 173627 - DNA, 75 bp, Artificial Sequence
  Synthetic
gtcgttgtcagtttttctggcaaagagtgccacaatgcgcttacgatggccggatctatgttgctgtgcataacc

SEQ ID NO: 173628 - DNA, 75 bp, Artificial Sequence
  Synthetic
aaaggttgtttgcgttggctaacgaggcctgtcgattgaatcctcttagatatccatttgcttacagggacgctt

SEQ ID NO: 173629 - DNA, 75 bp, Artificial Sequence
  Synthetic
gaaaaagcaaaaaaaaaaaaaaaaataaatataacaggttactaaaaaaaattcgttcctatcaatcccctatta

SEQ ID NO: 173630 - DNA, 75 bp, Artificial Sequence
  Synthetic
gctgtaaagtattggctgagcatgtagtgttgctagggttattgttttaccgagacgtggttgatatatatgaaa

SEQ ID NO: 173631 - DNA, 75 bp, Artificial Sequence
  Synthetic
aaatatacgattttctagatgaaagaggggaatttgggttacgagacctgtttgaggcaacttttttaaataata

SEQ ID NO: 173632 - DNA, 75 bp, Artificial Sequence
  Synthetic
gtaaacttaccagacgtcagccaatcagaggaggtcttgcgtctctacagtcgtccgagtatggagaaaaacttt

SEQ ID NO: 173633 - DNA, 75 bp, Artificial Sequence
  Synthetic
tataaactctttcaaacgatacatcgcagatagtataaactcgaactcacgttcaaagaagagaaaataagctta

SEQ ID NO: 173634 - DNA, 75 bp, Artificial Sequence
  Synthetic
tacatgaccttagagcgttgttcttgatcacttcttctgcagatctggataaagatacatcatctctctttcaga

SEQ ID NO: 173635 - DNA, 75 bp, Artificial Sequence
  Synthetic
cttacagtacggaagataaataattcttcgtgtcgttcttattcaaacgtgaacaccattcgtgaccttgcaggg

SEQ ID NO: 173636 - DNA, 75 bp, Artificial Sequence
  Synthetic
cttcgtgtcgttcttattcaaacgtgaacaccattcgtgaccttgcagggtttgaaatctgacaaaaaaagcgaa

SEQ ID NO: 173637 - DNA, 75 bp, Artificial Sequence
  Synthetic
tgtgatatagtaatggatcttaatcagatatctgaaacactaagtgccgtggcagaagaagagcctttaaccatg

SEQ ID NO: 173638 - DNA, 75 bp, Artificial Sequence
  Synthetic
tttccaaattagaatttcagaattgtgttccactgctatatggcaaaaccaataaaaaacatagatgtagttttt

SEQ ID NO: 173639 - DNA, 75 bp, Artificial Sequence
  Synthetic
tgttccactgctatatggcaaaaccaataaaaaacatagatgtagttttttttttaaaaaattagcatgaatcac

SEQ ID NO: 173640 - DNA, 75 bp, Artificial Sequence
  Synthetic
tttttacttgataaactgtacgccatacgggaaaagatcaagcaagttccattttcgattgttcgcttgtgtcat

SEQ ID NO: 173641 - DNA, 75 bp, Artificial Sequence
  Synthetic
gtttactgcatgctaataaaatataacgcttctaacaataattgcattttgggccgtaaacttattgaggaaatg

SEQ ID NO: 173642 - DNA, 75 bp, Artificial Sequence
  Synthetic
gggccgtaaacttattgaggaaatgcagcagtttttgtgcggcgcgagagtagatggatcggaagacgtttctat

SEQ ID NO: 173643 - DNA, 75 bp, Artificial Sequence
  Synthetic
ggatatgagtgaattgtgcaagctgtacgattactgtccgttattgtgttctgctctgtgtcgtgcgccttgtgt

SEQ ID NO: 173644 - DNA, 75 bp, Artificial Sequence
  Synthetic
atttgtgaacaagttatttaaaatcgtagagcgtgaaactcgggggcagtcggaaaatccgctctggcatgcgtt

SEQ ID NO: 173645 - DNA, 75 bp, Artificial Sequence
  Synthetic
acggagatataccgtgacagcaactaagctgtatgacatctacacgacaagaaattttttagaacataagggaca

SEQ ID NO: 173646 - DNA, 75 bp, Artificial Sequence
  Synthetic
agtggatgaatacatgtgtgccgcacaaagaggcaagatacaaggaacgagaaaaaattttcttgttacgaagct

SEQ ID NO: 173647 - DNA, 75 bp, Artificial Sequence
  Synthetic
gcagttttttggggaagcggtgatttacggcgcgaaacatgagcgtgttattagacacctcgtagcgatctttta

SEQ ID NO: 173648 - DNA, 75 bp, Artificial Sequence
  Synthetic
tccagccccatagtttctgctctgaaaggatgtaggtatgcgtgtggggttgacacgtatgcgcgtacatgggtg

SEQ ID NO: 173649 - DNA, 75 bp, Artificial Sequence
  Synthetic
cgttaaaagggaagtcaaggaaacgttgggattgctgcttgatccttcatctggagttttcggtgcgtctctaga

SEQ ID NO: 173650 - DNA, 75 bp, Artificial Sequence
  Synthetic
cgcgtgttttggaatttcattcaatgaggatggattcctgatggttaaggaaaaagccttgatttttgagattaa

SEQ ID NO: 173651 - DNA, 75 bp, Artificial Sequence
  Synthetic
attcagatataaatatttacgggataaagaagatcactttgtttctgaactattaaaaaaccccacggagaaatc

SEQ ID NO: 173652 - DNA, 75 bp, Artificial Sequence
  Synthetic
tttttcggattttattttatctcatccggtgcctgccatagagtttcgagaaagagggaagattccgtcatctag

SEQ ID NO: 173653 - DNA, 75 bp, Artificial Sequence
  Synthetic
agaatatttaatgacgtatgattttcaatatcgtcctcagagaaagttgcgcacttgccccactccagctatttt

SEQ ID NO: 173654 - DNA, 75 bp, Artificial Sequence
  Synthetic
gacacctcatatcaaacaactgttgtgtttgaacgagacacagacgtctacggtaatcgtttttgattgtaagag

SEQ ID NO: 173655 - DNA, 75 bp, Artificial Sequence
  Synthetic
aaagcgccatatagcagagagaagtgaaggccgaggccgctagagagaatctgtgatagacccataggcattaat

SEQ ID NO: 173656 - DNA, 75 bp, Artificial Sequence
  Synthetic
ccacttgagtgagcagaagctgtctgtgtttcagaaggctgtgtttaccgtgaacgtattcgtaaatccgaaaca

SEQ ID NO: 173657 - DNA, 75 bp, Artificial Sequence
  Synthetic
ctgtttttcaaatttctcactcctctgctttcggccgagagaggaacgcagattatgatatctccgaacatgatg

SEQ ID NO: 173658 - DNA, 75 bp, Artificial Sequence
  Synthetic
caggtatttttttcagagtctgttacaacaatatgtaatgactcagttttatattaatgatcatagtaatccaga

SEQ ID NO: 173659 - DNA, 75 bp, Artificial Sequence
  Synthetic
tgctttcggccgagagaggaacgcagattatgatatctccgaacatgatgctgcggggaattaactatgattatt

SEQ ID NO: 173660 - DNA, 75 bp, Artificial Sequence
  Synthetic
atatatcgagagtacggaagtgccttctgttcacattgtgacggctctcttcaggagaagaacagaggaagaaag

SEQ ID NO: 173661 - DNA, 75 bp, Artificial Sequence
  Synthetic
atatattcatttatttgttatctcggcggattccgacatcggtgtccgggagaatgagcgcgtggcaaataaaca

SEQ ID NO: 173662 - DNA, 75 bp, Artificial Sequence
  Synthetic
gagtttgcatttggtgattgatgagacggaatatatagaagaagaaatacctttggccttgattgtgactccggt

SEQ ID NO: 173663 - DNA, 75 bp, Artificial Sequence
  Synthetic
agacgaaataaaataaaacgctagatccttaccgtgcctctgtctctatgagacaaccgcagctgttatcatcgc

SEQ ID NO: 173664 - DNA, 75 bp, Artificial Sequence
  Synthetic
ggcaccgaatccggaatttacttgtcgtgttataacagacatatgcaatctgtgggaaaataatatttgcaagca

SEQ ID NO: 173665 - DNA, 75 bp, Artificial Sequence
  Synthetic
gaccagtttacaagtatgggcacaaagtgctgtaaaccagtatcttgcggcatgtgtaagaaaaccgaaaacacc

SEQ ID NO: 173666 - DNA, 75 bp, Artificial Sequence
  Synthetic
ctgatggattacaagggaaatcctatattactaacgacggaatttactgttttgaccgataccgaatcggaagag

SEQ ID NO: 173667 - DNA, 75 bp, Artificial Sequence
  Synthetic
gaagggatggcagatcttgaaaagcccctgcttgaaagagtacaggccacattagctgctaaatgtgatacggaa

SEQ ID NO: 173668 - DNA, 75 bp, Artificial Sequence
  Synthetic
ttcgacagggctgtcgccatggaaatcgcgcacacgagtatcggcgcagaacatctcggcggtctcatagcgctt

SEQ ID NO: 173669 - DNA, 75 bp, Artificial Sequence
  Synthetic
gttgaaaaaaaactgccgcttaaatcaaaaaaatgatagacgacgcagatttacgacacgctcgtattttatttt

SEQ ID NO: 173670 - DNA, 75 bp, Artificial Sequence
  Synthetic
tcgcgcacacgagtatcggcgcagaacatctcggcggtctcatagcgcttagcgttgcggtcgccgttctccgtc

SEQ ID NO: 173671 - DNA, 75 bp, Artificial Sequence
  Synthetic
gtggctatttgacaataaacatgattgtaataaaaaaaagtgtcattcgttttcatccattaggctcgagctttc

SEQ ID NO: 173672 - DNA, 75 bp, Artificial Sequence
  Synthetic
agcgttaagtagttgcttgtaccgacgcttctttttaactaggtagcgtacgagtcgacaaattatgaaaccgat

SEQ ID NO: 173673 - DNA, 75 bp, Artificial Sequence
  Synthetic
cgaaattatggcgacgaccgataaattgataataagtcctgtgctccactcggattcaaagaaagtttcgtactg

SEQ ID NO: 173674 - DNA, 75 bp, Artificial Sequence
  Synthetic
aactagagacttcccaaagatgatatatggctaacgagcaacgtctggcgcgttcacactcgtttaccgtgtgtg

SEQ ID NO: 173675 - DNA, 75 bp, Artificial Sequence
  Synthetic
gagaatagggaaagataggcctacggcgccacaaaacataccgacgtaatagccgaacaagggtttaacgtagcg

SEQ ID NO: 173676 - DNA, 75 bp, Artificial Sequence
  Synthetic
cgttcacactcgtttaccgtgtgtgactgagacacgtagtcttcaatctctgccttgtaaaatcatacgtgggtg

SEQ ID NO: 173677 - DNA, 75 bp, Artificial Sequence
  Synthetic
agccgaacaagggtttaacgtagcgaaccaggacggcttctattactatactatatatacaagccatgacaagaa

SEQ ID NO: 173678 - DNA, 75 bp, Artificial Sequence
  Synthetic
aggtattgatggaagagaaagcgacggtgatggaacgtatgtagatactatttccgacgcccaggcaagtagtaa

SEQ ID NO: 173679 - DNA, 75 bp, Artificial Sequence
  Synthetic
tgccgagaaacatcgtagagtaacctagcatgagttcgcttagattgatgacaacggtcttgaattgtacggtcc

SEQ ID NO: 173680 - DNA, 75 bp, Artificial Sequence
  Synthetic
accggcgtgtgtgtagactttagttttggtggtcagatattaagtcttgatcacacgcgtacccgcgcgtttgta

SEQ ID NO: 173681 - DNA, 75 bp, Artificial Sequence
  Synthetic
cctttaggttaggatgaattttctgaaaggcgaaaaacgacttgtccgctgactgaaattgcgttatcagcgtaa

SEQ ID NO: 173682 - DNA, 75 bp, Artificial Sequence
  Synthetic
gcggcttctcgggtgtcttattttcaccccgcagctgaaccgcactccggtcgggccacttcttttcatacaggc

SEQ ID NO: 173683 - DNA, 75 bp, Artificial Sequence
  Synthetic
cgttaaaggtggtgaaacacacgaagaagatggaataggcaaatgcacctagggcgaccagtctgaaagacaggg

SEQ ID NO: 173684 - DNA, 75 bp, Artificial Sequence
  Synthetic
tcgggccacttcttttcatacaggcgttgtctgtctgctccggggagctgggctgcgctcgggccgggacactta

SEQ ID NO: 173685 - DNA, 75 bp, Artificial Sequence
  Synthetic
cggtgacgaataactgaaatgtatccatgattaagatgaattgaaagcaggatgaggtgtcccccatccaggtaa

SEQ ID NO: 173686 - DNA, 75 bp, Artificial Sequence
  Synthetic
ttcccatacaggcgctgccttctctgctttgggaggtcggactgcgctcgggccgggatacttattcccatacag

SEQ ID NO: 173687 - DNA, 75 bp, Artificial Sequence
  Synthetic
ggctgcgctcgggccgggacacttattcccatacaggcgctgccttctctgctttgggaggtcggactgcgctcg

SEQ ID NO: 173688 - DNA, 75 bp, Artificial Sequence
  Synthetic
tatccctcgttgtttggttaacgttagatgttttgttagaggagaacacttttgcacagcagacaatgtaataaa

SEQ ID NO: 173689 - DNA, 75 bp, Artificial Sequence
  Synthetic
gcgctgctttctctgcatcgggaagtcggactgcgcccgggccgggacacttattcccatacaggcgctgccttc

SEQ ID NO: 173690 - DNA, 75 bp, Artificial Sequence
  Synthetic
taataatcaggaggaataagatagccattatcagtacgtagcatataatctgcacagggtttatgtaaagttgat

SEQ ID NO: 173691 - DNA, 75 bp, Artificial Sequence
  Synthetic
tcgggccgggacacttattcccatacaggcgctgctttctctgcatcgggaagccggactgcgctcgggccggga

SEQ ID NO: 173692 - DNA, 75 bp, Artificial Sequence
  Synthetic
gcgtcatctgatatatttcattattagcggagagattgaccgctttgaggtcattgatttcaaagtaggcgcacg

SEQ ID NO: 173693 - DNA, 75 bp, Artificial Sequence
  Synthetic
gaaatcctaaatttggaaagtttatggctatcagatggaccgtgacgtttataaatgacaaggctgcacagatta

SEQ ID NO: 173694 - DNA, 75 bp, Artificial Sequence
  Synthetic
tagagaccagccagatccgtaaattaatggtgtctacacgactggaggccataccagctctgtgatggagaacag

SEQ ID NO: 173695 - DNA, 75 bp, Artificial Sequence
  Synthetic
gggaagccggactgcgctcgggccgggacacttttttgtgcgatactgttgctctggaagacagatatcctcgcg

SEQ ID NO: 173696 - DNA, 75 bp, Artificial Sequence
  Synthetic
gtttcagaacgatactctgttctcagagtggttcggccagagtttgtccgatgtaagatttccggacaatgtcac

SEQ ID NO: 173697 - DNA, 75 bp, Artificial Sequence
  Synthetic
tttcaaaaattactttaaactccccgggggggttaaaaaaaggggggtattaaccctaaccctaaccctaggcct

SEQ ID NO: 173698 - DNA, 75 bp, Artificial Sequence
  Synthetic
cgtttattctcaagccgactcggcggtgagttttgaaaacgtcaggcagccgataaaactggttcgcgcagcgat

SEQ ID NO: 173699 - DNA, 75 bp, Artificial Sequence
  Synthetic
gggttcagggaaaacaacagctttgattcattttttgaaacaggtacccaaggaactatctgtccttttgatttc

SEQ ID NO: 173700 - DNA, 75 bp, Artificial Sequence
  Synthetic
ttgccgtaaaacgttcgctgcggaaattttgcaccgttttactctcaatgggttggaggattttgaattatattg

SEQ ID NO: 173701 - DNA, 75 bp, Artificial Sequence
  Synthetic
cgatattacggagcggcagataaacaacagaaaagtcattgtccagatagaaagcttgcatcgtcttacagaaaa

SEQ ID NO: 173702 - DNA, 75 bp, Artificial Sequence
  Synthetic
ttacgatgttttaatattagatgaaattatgtcgattataaagcagttttattccaaaacgatgacaaaaaccaa

SEQ ID NO: 173703 - DNA, 75 bp, Artificial Sequence
  Synthetic
agaagttgattgcaagtttttatcgctgatcaaaaattccagtcatgtaatagctatggatgcgacgctgactcg

SEQ ID NO: 173704 - DNA, 75 bp, Artificial Sequence
  Synthetic
gcatgtggtggagttttttgccgcgttcaagccagatactcaaatcgccctcatcagaaatacatttgtgtccgc

SEQ ID NO: 173705 - DNA, 75 bp, Artificial Sequence
  Synthetic
gatgttttccaatagggtcgcttacttttgtgacacgttttttggtaaagagttttctttttttgcgcgcttgga

SEQ ID NO: 173706 - DNA, 75 bp, Artificial Sequence
  Synthetic
agacaagctacgatgggataagaaattgtgtttgttttgcagcaccgtgttggcagcggaatacatgcatgattt

SEQ ID NO: 173707 - DNA, 75 bp, Artificial Sequence
  Synthetic
gatacgttctcggttttcactcaaaaaagttctcttgttgacgtctaaacaagggaaatgctcttccatagaatc

SEQ ID NO: 173708 - DNA, 75 bp, Artificial Sequence
  Synthetic
gtggatacggtatgacgtagtgatttatacgtccgtcgtgactgtcggtctgagtttcgaaccggtttatttcag

SEQ ID NO: 173709 - DNA, 75 bp, Artificial Sequence
  Synthetic
ctctttgtttgtttacattcagttggccaaaggagggccggacatggtttcaatatttcaatccattggtcgtgt

SEQ ID NO: 173710 - DNA, 75 bp, Artificial Sequence
  Synthetic
gaggcgagttatcgatgaagatatatacatttacatgaatcccgtactaattaaaagctatgatcctttggcgcc

SEQ ID NO: 173711 - DNA, 75 bp, Artificial Sequence
  Synthetic
tattgccatgcctccttgcagtgattggagtgtcgctgagcagtctatcatctcagagagttgcattgacttccg

SEQ ID NO: 173712 - DNA, 75 bp, Artificial Sequence
  Synthetic
cggaaagtgcagcggagcgcataaatataatttctgttccgtactgaagtgtctttttcgatacaggcattatat

SEQ ID NO: 173713 - DNA, 75 bp, Artificial Sequence
  Synthetic
cgaaaagactactattacaagtttatctgatagtctctttctgctctgcagtctgttatgtgagaattctattaa

SEQ ID NO: 173714 - DNA, 75 bp, Artificial Sequence
  Synthetic
ggtggacattgttggaaatggattcccgatgcgcaaagaggtttttttgagtttcttgcaaattctagtcgagga

SEQ ID NO: 173715 - DNA, 75 bp, Artificial Sequence
  Synthetic
gtgtcattttatcgaaaagaagattactttgccgggtgacaacatgacgttccaagagatcataagtagcagaga

SEQ ID NO: 173716 - DNA, 75 bp, Artificial Sequence
  Synthetic
aactatcatgaacggagatttttatgaaaacggtaatcagctattacataaggactatattaccgacatgggaaa

SEQ ID NO: 173717 - DNA, 75 bp, Artificial Sequence
  Synthetic
gttcagagcgacttttttatctccgggcgttgacattttcattgcatcggacattgtatctgatctgaaaaatga

SEQ ID NO: 173718 - DNA, 75 bp, Artificial Sequence
  Synthetic
aagcaaacgctatgtttttgtgaacgtctggttacaaaaatgtgtgtctgctggtgtagaaagcacgcgaatcga

SEQ ID NO: 173719 - DNA, 75 bp, Artificial Sequence
  Synthetic
tcttatgtgctgccgaagagttttttgtgcgatgagtactttgttctaggtgacatctctggggtttacgagtgg

SEQ ID NO: 173720 - DNA, 75 bp, Artificial Sequence
  Synthetic
ggaatgttaatagatctggccttcctggcggaaatgatccgaaaagatttgaaactgaaatcgtgcacagatact

SEQ ID NO: 173721 - DNA, 75 bp, Artificial Sequence
  Synthetic
actactgacatttctgaagatgatctccttttgtgtgcggccaggaggtcgagtgacatcttacaaataatgcaa

SEQ ID NO: 173722 - DNA, 75 bp, Artificial Sequence
  Synthetic
ttagtgtttacggtgcatgtgcaattttttcaaagatacagtctgcagactctgcagctttttaacaagttgaga

SEQ ID NO: 173723 - DNA, 75 bp, Artificial Sequence
  Synthetic
ggcatgcggattgtgacgggtgtgttttctatagaaaaattcagcatttccatcctcaggcttttctttaaatgt

SEQ ID NO: 173724 - DNA, 75 bp, Artificial Sequence
  Synthetic
gcatttaatatgactttgtccgccagcaaacctcggtacatcccgggaaaggcgtatcgcaatctaacaaaaaat

SEQ ID NO: 173725 - DNA, 75 bp, Artificial Sequence
  Synthetic
gatctggagaacatgctagacaattgggagatttcgcgcaccaatcttaagacttgtaaagaactacgtaaagcc

SEQ ID NO: 173726 - DNA, 75 bp, Artificial Sequence
  Synthetic
ctcaccgaggcctcgagagcaaggcggaaacaaacaatttataaactgcaaggctcggatataagcctttccgtt

SEQ ID NO: 173727 - DNA, 75 bp, Artificial Sequence
  Synthetic
agtgaagttggagtttttgggcaacatgcatctccgggggtgtgcgtgtcatcttagcctttattgtgtgtacaa

SEQ ID NO: 173728 - DNA, 75 bp, Artificial Sequence
  Synthetic
cgactgggagaataagatctacagagtaccgatttttcagtgtttgtttttagaagcggagactcgttcgttaaa

SEQ ID NO: 173729 - DNA, 75 bp, Artificial Sequence
  Synthetic
aacgtttttgattaggggacagagcctagaccaagaatcgttaaatgagatagaagttacaagaaaagaaacaat

SEQ ID NO: 173730 - DNA, 75 bp, Artificial Sequence
  Synthetic
gctttgggaccttcaggaacaaagtaatatgatggacaaaaaaatagcagcaatcagcagcctcattatgaataa

SEQ ID NO: 173731 - DNA, 75 bp, Artificial Sequence
  Synthetic
cggagagcttcttaggaaactttcaaaatttttcgtgcctctaactgttgttcttggagacgacgggttagagat

SEQ ID NO: 173732 - DNA, 75 bp, Artificial Sequence
  Synthetic
tttggaagcatacgtctgtggcgaggaacccatgctgcctttggacacggtacctgttatattacgatgtgtcgg

SEQ ID NO: 173733 - DNA, 75 bp, Artificial Sequence
  Synthetic
agactacgcagccttggacaccaagcatctcttgagtaacgaatgtacacaggcgtctaaaaaacttcgctttgg

SEQ ID NO: 173734 - DNA, 75 bp, Artificial Sequence
  Synthetic
atacagtgtaatggactttcacttttcgctaactgtgtctgatgtaaaaatttgcttttcacacacggacaccgg

SEQ ID NO: 173735 - DNA, 75 bp, Artificial Sequence
  Synthetic
tgaggctgtatgtgaaaaaatgaaacaaattttttatttttctgtgtgtgcttttggtggtgagcaagttctctt

SEQ ID NO: 173736 - DNA, 75 bp, Artificial Sequence
  Synthetic
agtgacgccaaaaaatgcttatgccttattgttcgacgatgatttgtgtttgcttttactgcagagcgtgtttgc

SEQ ID NO: 173737 - DNA, 75 bp, Artificial Sequence
  Synthetic
gacgaagaagacgaagaaacgaggacgaaaggaggggaatacaccggagaccgagcggcggatggagcccgctcg

SEQ ID NO: 173738 - DNA, 75 bp, Artificial Sequence
  Synthetic
tttcctgcacgagaagatattcgcagtttataaacaggtgttagttcagctttgcgaatacatcggtcccgactt

SEQ ID NO: 173739 - DNA, 75 bp, Artificial Sequence
  Synthetic
atggccctttgggaatgaaagatcggtttcttttataggatatccgaatctgtggcttttgtctgtatcggactt

SEQ ID NO: 173740 - DNA, 75 bp, Artificial Sequence
  Synthetic
agaaaggcgggttccggatacaacttatatctgccgtgaaattctctcattttgcggtttggcgcctatcctggg

SEQ ID NO: 173741 - DNA, 75 bp, Artificial Sequence
  Synthetic
acctcgtggtagacacgcgatccccgtaattagggagctaagtgttgaaatgcctggaagtgaaacctctttgca

SEQ ID NO: 173742 - DNA, 75 bp, Artificial Sequence
  Synthetic
taacggagtctatgcgcgcgccgtgacacggaaaaccaagcggagcgagacgatcgaccgactcctgctatcctt

SEQ ID NO: 173743 - DNA, 75 bp, Artificial Sequence
  Synthetic
acgtttcaggttcaatagtcagtatgtttcaagtgagtctctgtgttttcagacaggtcccgaggacacacatct

SEQ ID NO: 173744 - DNA, 75 bp, Artificial Sequence
  Synthetic
attctttagtgacagtgatatgtatgtagtgactttgccagattgtctgaggctattattgaagtccacggttcc

SEQ ID NO: 173745 - DNA, 75 bp, Artificial Sequence
  Synthetic
tagggcctttctgccatgttttgatgaaaacgccacggaaatcgaactgcttttaaaatttatgtcgaggctgca

SEQ ID NO: 173746 - DNA, 75 bp, Artificial Sequence
  Synthetic
acacagatcgtacgctttattcgatgcggtgatctttatgttagatgcttttgtttccgcttttcagcgagcatg

SEQ ID NO: 173747 - DNA, 75 bp, Artificial Sequence
  Synthetic
tactctaatggaaatgcgatggctgttagtgagggacttacacgtgttttatttaacctgtgacggtaaagattc

SEQ ID NO: 173748 - DNA, 75 bp, Artificial Sequence
  Synthetic
acatgttgtcatgcctttactgcaaacggccgttgaaaactgttgggaaaaaattacggaaatcaagcaaagacc

SEQ ID NO: 173749 - DNA, 75 bp, Artificial Sequence
  Synthetic
tgcatttcagtgtatggaaatttcgcgctgtggatttgtcttctacgctagattttttttaagcagtggattgtc

SEQ ID NO: 173750 - DNA, 75 bp, Artificial Sequence
  Synthetic
acaatctaaagaagcgcactggacagtaacggcaagtaaatatttatctgcatgtattcgggccaataagacagg

SEQ ID NO: 173751 - DNA, 75 bp, Artificial Sequence
  Synthetic
tctttgctttgccagtataactgtttattttcaggatatgatgtgtgtttttatagctaataggtataatgtttc

SEQ ID NO: 173752 - DNA, 75 bp, Artificial Sequence
  Synthetic
ttattggatcgaagagttcgatcctaatgattattgcctggaatatcatgaaggacttctggactgcagtagata

SEQ ID NO: 173753 - DNA, 75 bp, Artificial Sequence
  Synthetic
tacggccgtgatgtctgaagatggacagcttgtcagacaagcacgtggaattgcattgactgacaaaataaactt

SEQ ID NO: 173754 - DNA, 75 bp, Artificial Sequence
  Synthetic
ttcttattacattctcgttacattgagagtgttgaggagatgggtggagagtaaatttgaagacgttgaacaggc

SEQ ID NO: 173755 - DNA, 75 bp, Artificial Sequence
  Synthetic
agagtttattaggtgggaaaacaggatgctctatgaacacattcatttgctacatttgaattaattttgtttctt

SEQ ID NO: 173756 - DNA, 75 bp, Artificial Sequence
  Synthetic
tacataacatagaaaaataagacttagctagacgtgtcttcattcttcgaataaaaaatttgtgcgaattgtgtt

SEQ ID NO: 173757 - DNA, 75 bp, Artificial Sequence
  Synthetic
gctagttgtatgacttggagagaactgtcttgcagctgtctagattctaaggataaattgatgaaattgtgacta

SEQ ID NO: 173758 - DNA, 75 bp, Artificial Sequence
  Synthetic
cgttttgtgttaaaataaagttccaaaacttctatatgcgtgtttttcatttcattgtatagtctaatcatcgga

SEQ ID NO: 173759 - DNA, 75 bp, Artificial Sequence
  Synthetic
ggcaccttgtggaggatttctgaggcgtgttcgttaaaaaaaatgtgtcttagtgtacaaaccaatttgtcgcac

SEQ ID NO: 173760 - DNA, 75 bp, Artificial Sequence
  Synthetic
gtgttgaataatattttcgttaccggagataggacggggaaaagaacgagcctagcgattagtttgtgcagggtg

SEQ ID NO: 173761 - DNA, 75 bp, Artificial Sequence
  Synthetic
ctttgcttcagtggaagattctctaatgcgaacactagtccgcaaagcataaattcttctggcgtatccactttc

SEQ ID NO: 173762 - DNA, 75 bp, Artificial Sequence
  Synthetic
atatggattagtctgcgtttgaactgaaaaggattgagtcgcagttcttgcagtgtatcttccgagtctagtatt

SEQ ID NO: 173763 - DNA, 75 bp, Artificial Sequence
  Synthetic
atgatgccaatgaagccttggaatcccaactctttttcgcagatggtcttgtattccaggccgttgatcatggtt

SEQ ID NO: 173764 - DNA, 75 bp, Artificial Sequence
  Synthetic
ccgtcttccaagtggaaccatattccgtcgtctcctactgttatatttactaacgaatgtcgtgcgagggataca

SEQ ID NO: 173765 - DNA, 75 bp, Artificial Sequence
  Synthetic
cacttatcaatcttgatcacctttaggatagttcggacgtgtaaggtgttgaatacgtctgaggtttctaattct

SEQ ID NO: 173766 - DNA, 75 bp, Artificial Sequence
  Synthetic
tttaattttttcaaggatttcattctccgggtttggggagaaaatgttcgaatcgaaaatcggctcgttgttttc

SEQ ID NO: 173767 - DNA, 75 bp, Artificial Sequence
  Synthetic
ggggtgcgtttgggttaaattatacacttctgagatctgatttagctctcggacgtatacgagtcttaaataatg

SEQ ID NO: 173768 - DNA, 75 bp, Artificial Sequence
  Synthetic
cttgattttgctgctttcgtagatggctaataagatttcaccgagggatagaaagagaaattcctcgggaattga

SEQ ID NO: 173769 - DNA, 75 bp, Artificial Sequence
  Synthetic
ttcgaggttgtaaatatttaagagtcgccttaggaaaggcacgatgagcagctcgatgctatagttagagtatgt

SEQ ID NO: 173770 - DNA, 75 bp, Artificial Sequence
  Synthetic
gatactttcttcctgtccttgattattaacgttttttcttaaccgaaaggttcgcatgtattccatttcccatag

SEQ ID NO: 173771 - DNA, 75 bp, Artificial Sequence
  Synthetic
ttggtctattcgtttgtcggcatattgtgtgtccgggatatactgtgaaaaaaaactgtttgcgactgatctggt

SEQ ID NO: 173772 - DNA, 75 bp, Artificial Sequence
  Synthetic
gggagcctttgaactatgttcagcgctcgcgataaagagagattctcgaggtcatggtccagatccgggttatag

SEQ ID NO: 173773 - DNA, 75 bp, Artificial Sequence
  Synthetic
cgatcacaatcgttattcgtctcgagcaaagagtgtagatctttgattttcctttcgaacatttggtttgttgtt

SEQ ID NO: 173774 - DNA, 75 bp, Artificial Sequence
  Synthetic
cctttcgaacatttggtttgttgttttcagtgtttcgatttcatccatctgtgtttgtatctgctcctccatgca

SEQ ID NO: 173775 - DNA, 75 bp, Artificial Sequence
  Synthetic
ttcagtgtttcgatttcatccatctgtgtttgtatctgctcctccatgcacttgataatttgttttttgaacagg

SEQ ID NO: 173776 - DNA, 75 bp, Artificial Sequence
  Synthetic
tctcgaacgtctctctctcctgtgtcgatcgcagagcgttttcggaactgtcctcggttcagcataagtttattt

SEQ ID NO: 173777 - DNA, 75 bp, Artificial Sequence
  Synthetic
tggtctattatagagggggtgatttcttgaataaatccttcaacgctgtccctaatgcctattttagatttgctg

SEQ ID NO: 173778 - DNA, 75 bp, Artificial Sequence
  Synthetic
tccgacaagttcagtaaaaatttgattaaactttttttcgcgtcgctgtttttttcttctttttctatcatgtcc

SEQ ID NO: 173779 - DNA, 75 bp, Artificial Sequence
  Synthetic
attatctttttgttggttacatctgtctttgctgcggttagcacctttatgggaaatgtattcaataattggcac

SEQ ID NO: 173780 - DNA, 75 bp, Artificial Sequence
  Synthetic
attttttgatgacgccgcagactattgtgtttttttagttctggagaaaggtgggcgaggggtgtagtcagcatt

SEQ ID NO: 173781 - DNA, 75 bp, Artificial Sequence
  Synthetic
aggcgatttctaataacatatggggtgctgtacgtgaaaaacgctatagccttcttgtttttaaagcaagaaatt

SEQ ID NO: 173782 - DNA, 75 bp, Artificial Sequence
  Synthetic
tgctccgaattccgatctcggaaaatcttaatattatgaaaatccggaatgatcacggaagatagacccagtaaa

SEQ ID NO: 173783 - DNA, 75 bp, Artificial Sequence
  Synthetic
atgggagtgacaatgttttgtttatgccgcactatgtcgtggattagtttagatgacacttgttgtagaagattg

SEQ ID NO: 173784 - DNA, 75 bp, Artificial Sequence
  Synthetic
tataagttcggggccgtaggggtggttctcatgaacggaacgattcctacggtacagatccagtctacatatctg

SEQ ID NO: 173785 - DNA, 75 bp, Artificial Sequence
  Synthetic
ttatagtgactgttgtctatgctctgaaggataaaattaattatattagatatatctcccaagatcacctgttta

SEQ ID NO: 173786 - DNA, 75 bp, Artificial Sequence
  Synthetic
atcgcgtgagcccagacactaaaataatcttgaaatgacaattttttgttgtggaacggaaatgacctcacatga

SEQ ID NO: 173787 - DNA, 75 bp, Artificial Sequence
  Synthetic
cgtttccattcatcgtggatttgttgaatagaaacgctgtttaaaagggcttgagctactccataggctatttgt

SEQ ID NO: 173788 - DNA, 75 bp, Artificial Sequence
  Synthetic
tttttcagtacggcagaatctcggagagcgttgtggattgtttgacctttgaaaaaatttttgtgtccgtgtagc

SEQ ID NO: 173789 - DNA, 75 bp, Artificial Sequence
  Synthetic
atttcaataaaagtcattatctgctcagagggataaatcatgtctatctcttcgttgttcggaggtagatacgat

SEQ ID NO: 173790 - DNA, 75 bp, Artificial Sequence
  Synthetic
aataagtttttgcttaacatgtcttcggctcccaaaatagagttgattgtagataaggtggcttcgttatcagaa

SEQ ID NO: 173791 - DNA, 75 bp, Artificial Sequence
  Synthetic
agacgcttggaggggcgtctgccagaagattggtttcgccacatcatggatcctgaaaccgagttcaacggcgaa

SEQ ID NO: 173792 - DNA, 75 bp, Artificial Sequence
  Synthetic
tttgctgatgctctgtgcatcggtattgatgaattcgctcaacctctgccttttttgccgtttaaggccttgtta

SEQ ID NO: 173793 - DNA, 75 bp, Artificial Sequence
  Synthetic
gtaaccggtacggccggggcagggaaaacgaacagcattcagaccttagcggccaacttagattgtatcgttact

SEQ ID NO: 173794 - DNA, 75 bp, Artificial Sequence
  Synthetic
gcaacgacatctatcgccgctcagaatttgagcgttgttttaaacagaagtaaatccgcgcaagttaaaacaatt

SEQ ID NO: 173795 - DNA, 75 bp, Artificial Sequence
  Synthetic
tttaagacttttgggtttaatagttcacatgtatctatgagcgaacgtcaaagttatattgcaaatgacgagagg

SEQ ID NO: 173796 - DNA, 75 bp, Artificial Sequence
  Synthetic
tcgattcaaattcaacaaaagcaagacctgtctatctattggaatgttatctccgacatagcggagagggcgttg

SEQ ID NO: 173797 - DNA, 75 bp, Artificial Sequence
  Synthetic
ggtgctgtcgcgtgcaaaactaaagagttacctgatttgtgtgagagtagtgttatagttatcgacgaggcaggc

SEQ ID NO: 173798 - DNA, 75 bp, Artificial Sequence
  Synthetic
gaccgtatccctccctgcctttaacccgatgagaaataaaatcggcgaatgtacacaatcacacacaatgtgctt

SEQ ID NO: 173799 - DNA, 75 bp, Artificial Sequence
  Synthetic
gtaatattacgacatattctgcacactgttgtttttttctattggttttataacgcgttgtataaaacccctttg

SEQ ID NO: 173800 - DNA, 75 bp, Artificial Sequence
  Synthetic
tatgagaacggaattgttccgtgcatcgtgtgtgtggggtcgcccacgcagagtaacgctttggtgacttcattt

SEQ ID NO: 173801 - DNA, 75 bp, Artificial Sequence
  Synthetic
aatccgctgactcaaaacaaggacgtgaagagaggaatagatgtactttcagccttgatctgcgacgacgtgctc

SEQ ID NO: 173802 - DNA, 75 bp, Artificial Sequence
  Synthetic
tctaaatattgcgaagtcgataataactggataatctttgtaaacaacaaaagatgtgcggatcatgcgttcgga

SEQ ID NO: 173803 - DNA, 75 bp, Artificial Sequence
  Synthetic
gactttttaaagcacatagaatttggcttgccgttaaagccggagcttatagagtatgtcgatcagtttgtgaag

SEQ ID NO: 173804 - DNA, 75 bp, Artificial Sequence
  Synthetic
cccgcttcgtacataagaaatcccatgaacgaaatagaaacgacccgcttgtttttatcgcataacgaggtaaag

SEQ ID NO: 173805 - DNA, 75 bp, Artificial Sequence
  Synthetic
aactatttccgctcattgcatgagcaggttgaagttaccaacagaaataacttgtttgtgtttccggtttatttt

SEQ ID NO: 173806 - DNA, 75 bp, Artificial Sequence
  Synthetic
ctaataaaaaacaagactttcgaagactacaaaagtgaaattggtaatttctccttagaaattgaaccgtggttt

SEQ ID NO: 173807 - DNA, 75 bp, Artificial Sequence
  Synthetic
aaatctaatattcatcggctgaatacttattctcagttcgcggatcaggatttatcgaaaactgttcaattggag

SEQ ID NO: 173808 - DNA, 75 bp, Artificial Sequence
  Synthetic
gagattgttttggaagatgggtcggtggaagagactttgataacctgtcatctgaaacatatcagaaacagttca

SEQ ID NO: 173809 - DNA, 75 bp, Artificial Sequence
  Synthetic
ataggtgtgacgtccaagatcaaggcttcgaccgtggggttttccggaacttatgaaaaatttgtagaactgtta

SEQ ID NO: 173810 - DNA, 75 bp, Artificial Sequence
  Synthetic
cagagcgatttgtttatcgaaaaaacgtcatgtgagcagactattcacgcatattcttttttatccggtcttatg

SEQ ID NO: 173811 - DNA, 75 bp, Artificial Sequence
  Synthetic
ttcggagggatgtattctttctgctgttcggaattcaccacccctgaagtgttaatggagatcaaaaacataaag

SEQ ID NO: 173812 - DNA, 75 bp, Artificial Sequence
  Synthetic
caacgcgcgcgcgcgcgcctctatgggaggcgccgtgtttttcaccaaaacgcgcgccactgcgagaggcgcgtg

SEQ ID NO: 173813 - DNA, 75 bp, Artificial Sequence
  Synthetic
atgcccagtattgaattcttagaaagtgaaatgtcgaggatgtctcgagacgtgcaaaccgtagagacagatgaa

SEQ ID NO: 173814 - DNA, 75 bp, Artificial Sequence
  Synthetic
aggtatgatttcggattagtcgatgatgggttatcagatatggacctattagaaattgatccttgcggagatcca

SEQ ID NO: 173815 - DNA, 75 bp, Artificial Sequence
  Synthetic
ttttttactaggtatagtaagttgcctttaactaattctctgtcgttcgaggaaattagtttgctttatacgacg

SEQ ID NO: 173816 - DNA, 75 bp, Artificial Sequence
  Synthetic
tttaaggatatctttatatctaggtttgccattctgcagaagcatacaaaagggaagttcggaaagactctccta

SEQ ID NO: 173817 - DNA, 75 bp, Artificial Sequence
  Synthetic
gtgacttataacagaaacaacgtttctagaaaacagtgcggtgagatatattcccatttaaagagtttttatggt

SEQ ID NO: 173818 - DNA, 75 bp, Artificial Sequence
  Synthetic
atgctcacctacgctatccctgccaataattatactctggagggttatacaaatgataatgtagttcatttagga

SEQ ID NO: 173819 - DNA, 75 bp, Artificial Sequence
  Synthetic
acggataaacaattaccgcagatcttatataaaaaaggattacctagattagttataaaagatgaaatggggttc

SEQ ID NO: 173820 - DNA, 75 bp, Artificial Sequence
  Synthetic
atttctgttttagataataacgtgtcgaaatttgtcgatgtcgtaaatggtcagagttttcatctatgtacaacg

SEQ ID NO: 173821 - DNA, 75 bp, Artificial Sequence
  Synthetic
gtcgattacgccactgtttctaaagtttctatgaccatcacgaaaagtcaagggctttccatacaaaaggtcgca

SEQ ID NO: 173822 - DNA, 75 bp, Artificial Sequence
  Synthetic
atagatttcgggagtgatccaaaaaatttaaaattgagttctatttatgttgggatgtcacgagtaaccgacccg

SEQ ID NO: 173823 - DNA, 75 bp, Artificial Sequence
  Synthetic
aataatttaataatgaatgttaatcccttgagactgaattatgagaatgataattttattgctccgcatattgta

SEQ ID NO: 173824 - DNA, 75 bp, Artificial Sequence
  Synthetic
aaagcgttaaagaacgaaaataccatgttaatattttagggaggttttttatgagaatatataaaaaaaactaaa

SEQ ID NO: 173825 - DNA, 75 bp, Artificial Sequence
  Synthetic
acatcagatgaattgtgcgtgtaattgttgaaattccatacggtcgaatgagcttattcccgtcggtccgttttt

SEQ ID NO: 173826 - DNA, 75 bp, Artificial Sequence
  Synthetic
tctgcaaaacaaaagtagcacggggatttagtgcagtatgtctcgaaaaagacaagggtgtgaaactatgaggaa

SEQ ID NO: 173827 - DNA, 75 bp, Artificial Sequence
  Synthetic
ctgatgagaaatgacttacggccatgattttgtttcgtcgctaaattgaatacagctgcagggatgtggtatgag

SEQ ID NO: 173828 - DNA, 75 bp, Artificial Sequence
  Synthetic
ctgacatctgcaaaaacaaatgaaagtctcccccggagtacacgtatgtactccgggggaaacctcaaaaatgca

SEQ ID NO: 173829 - DNA, 75 bp, Artificial Sequence
  Synthetic
caatttagcctattaagcagccgcgaactcgttaatagttactttgatgttaactcaggtggtggcttggatggt

SEQ ID NO: 173830 - DNA, 75 bp, Artificial Sequence
  Synthetic
gtcctaagtatcaatcgaagctcctttattttttgcactactgaagttattctaggtatcggggtaagaataaga

SEQ ID NO: 173831 - DNA, 75 bp, Artificial Sequence
  Synthetic
tgacgaaaaaaatatgctagatccgtccattaaatcctagagttgtttttagtaataataggttatttacaaaag

SEQ ID NO: 173832 - DNA, 75 bp, Artificial Sequence
  Synthetic
cctgcatatgatccaatgtttctgtatgaatccagataaacaaaaatccaggagtaatgattggaatcacaaaat

SEQ ID NO: 173833 - DNA, 75 bp, Artificial Sequence
  Synthetic
gattagttagatgcttaacttacttaataactacacttatagactaaacttaacttatcaactatacttaacttt

SEQ ID NO: 173834 - DNA, 75 bp, Artificial Sequence
  Synthetic
taggtccttataatgtgaactaaataatcaactgttttgtgcccaaccccccactactaaagcaatcgtctttga

SEQ ID NO: 173835 - DNA, 75 bp, Artificial Sequence
  Synthetic
tttatgaaacaacgaggcccacttcacgttattacatagatcaaggtctatctcttggcggttttttaattcttc

SEQ ID NO: 173836 - DNA, 75 bp, Artificial Sequence
  Synthetic
cgagagcgtagcggtttctaggtttcagacacgtttatccattcgccgggtattgatcgggtcatatcattagcc

SEQ ID NO: 173837 - DNA, 75 bp, Artificial Sequence
  Synthetic
gtgaataatctctggcttcatttcgatacaacgtgtgaaaactagtaaaaaggacaaaagcagccgcctttgccg

SEQ ID NO: 173838 - DNA, 75 bp, Artificial Sequence
  Synthetic
tcttcatgagcgtcaaacactcatgaggtccgtatcttacaacacaatatatgaaatactgtgagcgaggtttac

SEQ ID NO: 173839 - DNA, 75 bp, Artificial Sequence
  Synthetic
cggtgtccgagtcgcaatccgaaaatcatatattgaaatttgtaacaatgttatgcagttgtactcaaagtatat

SEQ ID NO: 173840 - DNA, 75 bp, Artificial Sequence
  Synthetic
ggtgatgaattgaacatgtttttgatgttttcaatggtattcgaaaaatattttagatatcctgtagtttttttc

SEQ ID NO: 173841 - DNA, 75 bp, Artificial Sequence
  Synthetic
tgatgacttttctgatgacttttctgatgacaatatagaagatggcaaaacaacaagttactggtagttcttgat

SEQ ID NO: 173842 - DNA, 75 bp, Artificial Sequence
  Synthetic
gttagataaaatgaatcggagatatgacaagtagagagaggtaggtgatacgagtaaaattgaagggtgtttcca

SEQ ID NO: 173843 - DNA, 75 bp, Artificial Sequence
  Synthetic
cgagtaaaattgaagggtgtttccacacagacgggggaaattctatgagaaccacagccagaagcaattgacgac

SEQ ID NO: 173844 - DNA, 75 bp, Artificial Sequence
  Synthetic
cacagacgggggaaattctatgagaaccacagccagaagcaattgacgacaatagagaaaaataagcaagcatac

SEQ ID NO: 173845 - DNA, 75 bp, Artificial Sequence
  Synthetic
tcatctcgtatagaaagaaccagtgacctacgattttccattcaggctagcatggtgtgaacgagggttttttcc

SEQ ID NO: 173846 - DNA, 75 bp, Artificial Sequence
  Synthetic
gaaaactagatgactatttctttaagcaagtgtaatttttagcagtccaagtttttatgcaacgcagattttaat

SEQ ID NO: 173847 - DNA, 75 bp, Artificial Sequence
  Synthetic
gatgtgtccctcgataactatacgctggaaactaaactaacttacatcttggttgataaacgattttctattaaa

SEQ ID NO: 173848 - DNA, 75 bp, Artificial Sequence
  Synthetic
tacaaaattgtattgagctcttggaagtgcgtagatgcaaaataggttaaatcttaccttgaagctacaacaggt

SEQ ID NO: 173849 - DNA, 75 bp, Artificial Sequence
  Synthetic
caacgttcgagtagacgtaaattccatatgtcgaatgcgctgtaaactttttcacggaacatcaaaaacaccgaa

SEQ ID NO: 173850 - DNA, 75 bp, Artificial Sequence
  Synthetic
tttattcacgtttacataagcatgaatctgcaattttaatagtcccataaagctttcatttcgatctaactacat

SEQ ID NO: 173851 - DNA, 75 bp, Artificial Sequence
  Synthetic
tttagtatttatgcttcataatgtatcaaagtgtatacattcaatctgtataagagtctgcatcaagcttcacgt

SEQ ID NO: 173852 - DNA, 75 bp, Artificial Sequence
  Synthetic
gatttgtagttcgcggtttagcattcgctgttttgccgtgtatgagacttacagtttgatccctaatacttctga

SEQ ID NO: 173853 - DNA, 75 bp, Artificial Sequence
  Synthetic
cgggcgacaagcctttttatatgcattttacggcaaagtccacgcccttgtcgctgacgcaatacgtaaaggttt

SEQ ID NO: 173854 - DNA, 75 bp, Artificial Sequence
  Synthetic
tcggtttggatgaggatgtggttaaccgttagtaaaaagtcgttacagtaaaaaagccgaacggtatttttagat

SEQ ID NO: 173855 - DNA, 75 bp, Artificial Sequence
  Synthetic
ccgttagtaaaaagtcgttacagtaaaaaagccgaacggtatttttagatgtcgggccacatttcggtttaatag

SEQ ID NO: 173856 - DNA, 75 bp, Artificial Sequence
  Synthetic
atttttatatcgtgttcgttgtctgacttagatatgtcgtttcatgggagaaataaatcgttttagttgtatgca

SEQ ID NO: 173857 - DNA, 75 bp, Artificial Sequence
  Synthetic
gtagtttttggatcgcaaacgctcgagcccggaagtgtgattcgtgcgcataaaagggcgctggtgactgtgttc

SEQ ID NO: 173858 - DNA, 75 bp, Artificial Sequence
  Synthetic
gctagctcatttgtgctagatgagcggcaaagaactcatctttctgagatttttctgggattattctggtaaaaa

SEQ ID NO: 173859 - DNA, 75 bp, Artificial Sequence
  Synthetic
tgtatgtctcgtttgtagtcgtttttggatttctgtaatgttacgatttgctatgtgtattttgatggtgtcgag

SEQ ID NO: 173860 - DNA, 75 bp, Artificial Sequence
  Synthetic
catgtttattttgttcttattttcacacagataagatgtatgctgaagaacgtggatatgggtcatttgacaatg

SEQ ID NO: 173861 - DNA, 75 bp, Artificial Sequence
  Synthetic
ttatacaggcttatgaacaaattattagtcagtctcttcatttgaaaaggtttgaattcgacaatggctgtttca

SEQ ID NO: 173862 - DNA, 75 bp, Artificial Sequence
  Synthetic
ttgagttcttagctgactctggaacgtgtgaaacgttttctaaaggatggatatcaatgatttattggacatcgg

SEQ ID NO: 173863 - DNA, 75 bp, Artificial Sequence
  Synthetic
agacagattcaatgggttctctaacggtggatattgggatggatgaaggaaaatgcagaacgtacagagctcggg

SEQ ID NO: 173864 - DNA, 75 bp, Artificial Sequence
  Synthetic
gccttttactgtgttcaaaatcaatcacgtcgatttctcagaatactgagggcagagagaggattttgactgttt

SEQ ID NO: 173865 - DNA, 75 bp, Artificial Sequence
  Synthetic
cccatgaaaacggaaaacttcaaataacgtttgttactattgctaaagtttcctcggagcccgagctacgaaatc

SEQ ID NO: 173866 - DNA, 75 bp, Artificial Sequence
  Synthetic
tgggcgatttgaaatttatggaaaagtttgaaaaagaatgtcgagctctagacaggaaaaaacacgacgatgaac

SEQ ID NO: 173867 - DNA, 75 bp, Artificial Sequence
  Synthetic
acagaaaacgctcggggaagcagaaagaaaaaagaaaagtggaggacattgacaaaaaaaaagaagatgagaaac

SEQ ID NO: 173868 - DNA, 75 bp, Artificial Sequence
  Synthetic
gaaaacaagaagaaaaaaaacgaaacgacgaagacaagcggccggacaaaaaggatgaatttgatggtaaatatg

SEQ ID NO: 173869 - DNA, 75 bp, Artificial Sequence
  Synthetic
aatgtgtagctgttgtaaatttttttattattggtgtgtcacggtcgtggacttttttaaatagtatctgttttg

SEQ ID NO: 173870 - DNA, 75 bp, Artificial Sequence
  Synthetic
ttgtgatttcagaaccccctaaggagaagagacagaaatctcaccacgaaacgaaacgtaatttggaagaacaaa

SEQ ID NO: 173871 - DNA, 75 bp, Artificial Sequence
  Synthetic
gtcacgaagatggcatagcaccgacttctacgacattcgtgaatggagcggttgagggtgcgttatcgccctgtg

SEQ ID NO: 173872 - DNA, 75 bp, Artificial Sequence
  Synthetic
tttctattgataatcacgaagatcaacaacatgatgaattagacaagcgcgtttatgcgcaggtgggtggagttt

SEQ ID NO: 173873 - DNA, 75 bp, Artificial Sequence
  Synthetic
tgggttcaccaaaacctaggtctttggagtctttgttgtgcgtatctaaagctgatctttttcttttaggggacg

SEQ ID NO: 173874 - DNA, 75 bp, Artificial Sequence
  Synthetic
aaccgagaaggtctatccaatgaagataattatggaaattttcagcttaataagtctttagaacagcttagggcc

SEQ ID NO: 173875 - DNA, 75 bp, Artificial Sequence
  Synthetic
agacttgttgcaagcagcggcgaggttgtagaaagatcgctttcgaaattgaaagagcgtttggattatgtaaag

SEQ ID NO: 173876 - DNA, 75 bp, Artificial Sequence
  Synthetic
gataatttaataaaaaatgtacttgaatgtgctgatgttactgttccaagtaaatgtttaagtaaaacaaaacat

SEQ ID NO: 173877 - DNA, 75 bp, Artificial Sequence
  Synthetic
atcgagcaaaagaaacagatagtgttttctgattgtgtcaggtcggtacctgtgtgtgagattaaaccgtttatc

SEQ ID NO: 173878 - DNA, 75 bp, Artificial Sequence
  Synthetic
gacatgcgagtatttgaaactgaaacaacgcagaacgcaagaagagttcgacaacggaccagaacaaccgtcgga

SEQ ID NO: 173879 - DNA, 75 bp, Artificial Sequence
  Synthetic
tcaacagatggtgcaatcgggcagcagcgtgttatttcaggacaaaaccggggcagagcacgaggacgtggccga

SEQ ID NO: 173880 - DNA, 75 bp, Artificial Sequence
  Synthetic
gggagagttcccaggagacggaattccaatctaaataatttaaggacacaaaattctgcaattgtcatagacgat

SEQ ID NO: 173881 - DNA, 75 bp, Artificial Sequence
  Synthetic
agcagcgaaaccgaaaactttgaaaatgctgggagttttaatgaagacttactggcaaccacaatattggaaaca

SEQ ID NO: 173882 - DNA, 75 bp, Artificial Sequence
  Synthetic
ctgtgaattttattgctgtattgtaattcttatgtaaactaaataggttctattcgttcagaatgttccaattga

SEQ ID NO: 173883 - DNA, 75 bp, Artificial Sequence
  Synthetic
ttgggtctttcccgtgctcagtaagaaataaatttgttcgcacaaaatgattgcaaccaataaatggcattcttg

SEQ ID NO: 173884 - DNA, 75 bp, Artificial Sequence
  Synthetic
cagatttcactttgggtgatggatgtgcactttctaagacgagatgtttctgtgcgtctattagataagagagtt

SEQ ID NO: 173885 - DNA, 75 bp, Artificial Sequence
  Synthetic
tccgggcatgttttccccacaacaagaaaacgagagagttcatttgttccgatagtctgctgataatcttgtagc

SEQ ID NO: 173886 - DNA, 75 bp, Artificial Sequence
  Synthetic
tcagtgtttgccaaccaaatgcctcgtgggacattggtaatccatgaactacagtgaatatcgagtttagcagta

SEQ ID NO: 173887 - DNA, 75 bp, Artificial Sequence
  Synthetic
ggactccttctctacaccaggagtttaaacagccgttgtcagggggggaaaaattcgggatgcttctttccagtt

SEQ ID NO: 173888 - DNA, 75 bp, Artificial Sequence
  Synthetic
ctttaaatatattctttagagattctggaatcgagcactctttcactgtaccgaaggccaaaccgcaacctctgc

SEQ ID NO: 173889 - DNA, 75 bp, Artificial Sequence
  Synthetic
cgtcgggatacggatcctgtcccagaatcacaactttaacatcggtgggtttgcacaaaaaactccaggcgtgga

SEQ ID NO: 173890 - DNA, 75 bp, Artificial Sequence
  Synthetic
cgttatccgaagaggggtggacggttagatgaactctatcgttgtccaccaatttataaacatgcttaagatgtg

SEQ ID NO: 173891 - DNA, 75 bp, Artificial Sequence
  Synthetic
taatttctaacttggagagttgcaggaaactcaaccagtctctgtttatgccgaagagtgaatgctgatcatcta

SEQ ID NO: 173892 - DNA, 75 bp, Artificial Sequence
  Synthetic
ttgaaaggttttcatagtttttttcttcatcctgaacgtgatctaacatccactgtagtagggccatggttggga

SEQ ID NO: 173893 - DNA, 75 bp, Artificial Sequence
  Synthetic
aatgaaatgcagtggattaaattccctaggagcattttatgtgaatgggacgtgatgtcatagccaattatgtgt

SEQ ID NO: 173894 - DNA, 75 bp, Artificial Sequence
  Synthetic
ttctaatcagaatcgtagggcgggaacttcggaaaggtagtttagaattgtaggcttccatctgttttagcaggt

SEQ ID NO: 173895 - DNA, 75 bp, Artificial Sequence
  Synthetic
cgaattctactccggttttcaagtggaaatactttaaacaattcaaaatcgtatcaaagagagtcaaagagttaa

SEQ ID NO: 173896 - DNA, 75 bp, Artificial Sequence
  Synthetic
aagggaacctgataatttttgtgatgcctgtagcaggattctccaagtataataaaaaaccaatgttgctgtaaa

SEQ ID NO: 173897 - DNA, 75 bp, Artificial Sequence
  Synthetic
aactgtctgtgttttctgaaatgttaaactcgagacctgcaatgttatcaacaaaaaagttattgacgtacgtaa

SEQ ID NO: 173898 - DNA, 75 bp, Artificial Sequence
  Synthetic
ttctttcaggcaaatattttctacagttatcgctgatgcaggttgttattccgacggaaggcgaacatgtctgga

SEQ ID NO: 173899 - DNA, 75 bp, Artificial Sequence
  Synthetic
agccattgaaaaagtttagccaattgtcccgagattctgggtcccctatcagcgcaaacaatgtgcgtagttgct

SEQ ID NO: 173900 - DNA, 75 bp, Artificial Sequence
  Synthetic
ctgggttatcctgcagaagtaagaagtcgctgaggaattcattggttaccattatacggctaaaaggcttttttt

SEQ ID NO: 173901 - DNA, 75 bp, Artificial Sequence
  Synthetic
attatacggctaaaaggctttttttttgttgggggttttagcagtattgacataacgtcttcattatataccgga

SEQ ID NO: 173902 - DNA, 75 bp, Artificial Sequence
  Synthetic
ttgttgggggttttagcagtattgacataacgtcttcattatataccggaggctggtagattggttctagtaata

SEQ ID NO: 173903 - DNA, 75 bp, Artificial Sequence
  Synthetic
gaggtacttcggatctcgtgcaatttattacagctgcgatacagtcgtcaagtttttcaaaatagaaagaattgt

SEQ ID NO: 173904 - DNA, 75 bp, Artificial Sequence
  Synthetic
ggtcgaaaagaggcatcgctttcgagaaggttagtaatatgagtgacattacaaatagtaaaagttccatggtta

SEQ ID NO: 173905 - DNA, 75 bp, Artificial Sequence
  Synthetic
ttttttatttggagaagttaacacgacgggaacaacatcttatatacagtagggaaaaagacttgtcgaaatgtt

SEQ ID NO: 173906 - DNA, 75 bp, Artificial Sequence
  Synthetic
catttggctttttattgtttttttttatgcggcatatattggtatggctatcggatttatcggtagttcccccga

SEQ ID NO: 173907 - DNA, 75 bp, Artificial Sequence
  Synthetic
tgcggagctgtcttcagaaaattcacgtatttcgtcttctgtcttattaggatgtttgttgtgttgcacagattg

SEQ ID NO: 173908 - DNA, 75 bp, Artificial Sequence
  Synthetic
gtccgctgtcgtacctgggaagacagagactttcagaaaaccttttgttgcaatcatgattaaaaagctaaaaag

SEQ ID NO: 173909 - DNA, 75 bp, Artificial Sequence
  Synthetic
ttgttttgctgcttacctgtctgatttagagcagggctcgatgtgtgatatggcaaacgcatcgccgacaagtct

SEQ ID NO: 173910 - DNA, 75 bp, Artificial Sequence
  Synthetic
tgaattaggattgtcgaaattagacaaagaatcatgaaactattcgaagacattaatactggttttctttctcgt

SEQ ID NO: 173911 - DNA, 75 bp, Artificial Sequence
  Synthetic
tatgacgatcaatatagaggacgcaaagagagaccaatttagattcgagccaaaaaagtttattttgtcagttta

SEQ ID NO: 173912 - DNA, 75 bp, Artificial Sequence
  Synthetic
atagtttgccataatcatcccaataaatatatttgttgaaagagttgtatatggtgatgtgttctcgaaggagca

SEQ ID NO: 173913 - DNA, 75 bp, Artificial Sequence
  Synthetic
aatatatttgttgaaagagttgtatatggtgatgtgttctcgaaggagcatcggttgtgttagcttcgcgatatt

SEQ ID NO: 173914 - DNA, 75 bp, Artificial Sequence
  Synthetic
cagagtaatctcgttgggatggcagattgcaaaattgatacaaacgtgagcggcgcataataaatctttttccgt

SEQ ID NO: 173915 - DNA, 75 bp, Artificial Sequence
  Synthetic
cggcgcgtttatcatgagagagcaaatgccgacaagctttttttttgaggcgtttaccggtataggagctacagc

SEQ ID NO: 173916 - DNA, 75 bp, Artificial Sequence
  Synthetic
gttttttcgaagtgcgtccgtatgtgggacggtccctctaaaaaactgattgattgcaatagcgactaccggttc

SEQ ID NO: 173917 - DNA, 75 bp, Artificial Sequence
  Synthetic
atggtgaaccgattcagaaattatttgctcgcccacgttaataaccatgttgccaatggacatcaatttttcttg

SEQ ID NO: 173918 - DNA, 75 bp, Artificial Sequence
  Synthetic
catggcgtttattaagattttatttcgggaataaacctgtatttgcacaattgaagcgttgtaacagcggaataa

SEQ ID NO: 173919 - DNA, 75 bp, Artificial Sequence
  Synthetic
tctgtaaatttctgacataaaatttttaggtgagcacggggagtagggtggagatgtttcgtaagattgaaaaat

SEQ ID NO: 173920 - DNA, 75 bp, Artificial Sequence
  Synthetic
gagatgtttcgtaagattgaaaaattttgaaagcgttaactgcattcggatcttgcctttggcattccgtagact

SEQ ID NO: 173921 - DNA, 75 bp, Artificial Sequence
  Synthetic
tcttgcctttggcattccgtagacttgacaatttcctttttctgcgtcgttgatgtctttacaggcatgttgaat

SEQ ID NO: 173922 - DNA, 75 bp, Artificial Sequence
  Synthetic
tgatgtctttacaggcatgttgaatgataggtcggcgagaggtttgtccgtaaatgcggaaaaacgattaatttc

SEQ ID NO: 173923 - DNA, 75 bp, Artificial Sequence
  Synthetic
tttatcttggtgaaacacggcgtttgagattttccgtagtttggaatgggcgtagattgcgttatttcgatattt

SEQ ID NO: 173924 - DNA, 75 bp, Artificial Sequence
  Synthetic
ttccttattaaattttatgtcgggcgaggtgtgctggggaaaggctcttgcagtggcagaatcgacgggtttatc

SEQ ID NO: 173925 - DNA, 75 bp, Artificial Sequence
  Synthetic
ttgttttgtaatcgattatttcgtatagtcgttttggtggttacattttttttccgttctgtggacggtttcgtt

SEQ ID NO: 173926 - DNA, 75 bp, Artificial Sequence
  Synthetic
gtttttctagttcggcgagatttgacggtcggtcttgttttagaggtgtttttattacctctgtctttcatctct

SEQ ID NO: 173927 - DNA, 75 bp, Artificial Sequence
  Synthetic
tctgaacttaagccatataaattttaacttttaaatgcaacgatgcacatcgaaatcagtagcaccataactgat

SEQ ID NO: 173928 - DNA, 75 bp, Artificial Sequence
  Synthetic
attatcaatatcagaattaatggtacgatccaggtaaatacggtttcgtcagaatttgagccttttaccgcttct

SEQ ID NO: 173929 - DNA, 75 bp, Artificial Sequence
  Synthetic
agaatttgagccttttaccgcttctttactgtattcgtcgtgattttgcacagtgtgttcgccggaagttacgag

SEQ ID NO: 173930 - DNA, 75 bp, Artificial Sequence
  Synthetic
ttactgtattcgtcgtgattttgcacagtgtgttcgccggaagttacgagagcgctagccttttggttggtaaac

SEQ ID NO: 173931 - DNA, 75 bp, Artificial Sequence
  Synthetic
cagctcgacgctagacatgagatggtttttccgacaaattccagcttggttcgtcttttgaaagtaaagctcaca

SEQ ID NO: 173932 - DNA, 75 bp, Artificial Sequence
  Synthetic
ctaacggttgacgatccgttttcattctgtctaaccattggtatgtctctcttatatacttctccaagaaattta

SEQ ID NO: 173933 - DNA, 75 bp, Artificial Sequence
  Synthetic
ataaccacatttggttttggataagacgtcacggtacacgtaacgtctaaaaaattgtttaggtaacgaaaatac

SEQ ID NO: 173934 - DNA, 75 bp, Artificial Sequence
  Synthetic
aaaacgacgatgggtttcataatgagttttaagcaactagtcgcagatgttttctcgttatccactgtgaatgta

SEQ ID NO: 173935 - DNA, 75 bp, Artificial Sequence
  Synthetic
caggttaaacatgtcgcgtcatatgctgatctggctttaattttcaacagagatgtagttctatcgtgttttatg

SEQ ID NO: 173936 - DNA, 75 bp, Artificial Sequence
  Synthetic
tggaaatacaatttactgtccacgtcaagattgttgatcttatttagttcgtgtataaaaacgtagccatcgtca

SEQ ID NO: 173937 - DNA, 75 bp, Artificial Sequence
  Synthetic
caagattgttgatcttatttagttcgtgtataaaaacgtagccatcgtcagtgaacgataagttgtccatgtttt

SEQ ID NO: 173938 - DNA, 75 bp, Artificial Sequence
  Synthetic
gtatctcatgattcgatataagtcggcttttattgtaccacgagacgctttggatgtttgtcgttgtgttgaggc

SEQ ID NO: 173939 - DNA, 75 bp, Artificial Sequence
  Synthetic
gacaatggaaagtaacagttgaccctatttcgtatactaaagaaggactcgtctccgggcggggtacaaaatgtg

SEQ ID NO: 173940 - DNA, 75 bp, Artificial Sequence
  Synthetic
cgcttatgataatacatagaagcggcaataatcgaagcatcaagggactcatagtgtacacctgtgccaaatagc

SEQ ID NO: 173941 - DNA, 75 bp, Artificial Sequence
  Synthetic
atagtgtacacctgtgccaaatagcagtttctgcgccaaatagcggtttcggatatatataagtcacacccaaaa

SEQ ID NO: 173942 - DNA, 75 bp, Artificial Sequence
  Synthetic
agtttctgcgccaaatagcggtttcggatatatataagtcacacccaaaataaaaaaagtcaaggatttccgtta

SEQ ID NO: 173943 - DNA, 75 bp, Artificial Sequence
  Synthetic
tactgttttatttttttatttaaaaaaaaagttaggagttaacattttgaaagtgtaagatatttcgatttaaaa

SEQ ID NO: 173944 - DNA, 75 bp, Artificial Sequence
  Synthetic
tctctgctgacagaattatagatagagatagaattgtcaccatcaatgattgagcagacccgaaggacaatttct

SEQ ID NO: 173945 - DNA, 75 bp, Artificial Sequence
  Synthetic
ttaggtttatctttggcatacttattgcatattttagaagccattacaaagtcgatgggcgtagcggcgtaaacc

SEQ ID NO: 173946 - DNA, 75 bp, Artificial Sequence
  Synthetic
ataagagtttttacgtccgaatgtctcgtaaatagatcatgtgtgttgttttcaagtttatcccacaattcttga

SEQ ID NO: 173947 - DNA, 75 bp, Artificial Sequence
  Synthetic
ggtccttgtttttgtagttctataaattgattaattgcatctttatcataatagttaggcggtgcatgattcatc

SEQ ID NO: 173948 - DNA, 75 bp, Artificial Sequence
  Synthetic
ttaaatggctctgaaacagtgatgttgggtcgaatcattaattctctttgcatcgtcttaatgatttctgctact

SEQ ID NO: 173949 - DNA, 75 bp, Artificial Sequence
  Synthetic
tgttttgatcttgtaaagtacataatgatggctccggtgttagagcatccattagaacagatgttgtatacagct

SEQ ID NO: 173950 - DNA, 75 bp, Artificial Sequence
  Synthetic
tcttttagcttgttttcagggaaaggttttttgggaatctgtttgtattcaaatgctcgtatggtatttctaaag

SEQ ID NO: 173951 - DNA, 75 bp, Artificial Sequence
  Synthetic
tgccgattcttttttttcttttcgtctaacatattctctataagacaactcttcttcaatttcacttatttcaga

SEQ ID NO: 173952 - DNA, 75 bp, Artificial Sequence
  Synthetic
atctgttttctgcgttccagatattcttttcttgaagaaattttgcatactggaatctgaatcatcatcccgggt

SEQ ID NO: 173953 - DNA, 75 bp, Artificial Sequence
  Synthetic
gcgcttttttttgcattttgttgtgttgcgtgatatgttactttggttatcccgtgggcgataaattgtgttagt

SEQ ID NO: 173954 - DNA, 75 bp, Artificial Sequence
  Synthetic
ggtggtgttcgtggtcttaggtgtctttttttgttcttgatcaatggcgttttctaaatgattggattgttcatg

SEQ ID NO: 173955 - DNA, 75 bp, Artificial Sequence
  Synthetic
tgtgttagatggactagaattgtctaggggaaatttttcacctgttttctgggagtttctaaacatatctgcatg

SEQ ID NO: 173956 - DNA, 75 bp, Artificial Sequence
  Synthetic
tctatgttttgattcgtgatttggagatttgattttggttttgtctcttgaagctgatttaggtcttgtttgttt

SEQ ID NO: 173957 - DNA, 75 bp, Artificial Sequence
  Synthetic
ttctagttgttgtagtctagatctaggtgaatatgtggcaggatcttcactgtttttatatcgacttttgcgcca

SEQ ID NO: 173958 - DNA, 75 bp, Artificial Sequence
  Synthetic
tgtttttatatcgacttttgcgccaggattttgatctggaactggaacatgatgaagagactgatgatgatgatg

SEQ ID NO: 173959 - DNA, 75 bp, Artificial Sequence
  Synthetic
atgatctagttctggagtgctgatagttaaatgttataagcttgtctgttccggtttctgtacgtgaattagatc

SEQ ID NO: 173960 - DNA, 75 bp, Artificial Sequence
  Synthetic
tggaattttcttcaatactggaagagatgcttgatgatccagatttgtgtttttttctttttggagtattgagtg

SEQ ID NO: 173961 - DNA, 75 bp, Artificial Sequence
  Synthetic
aatctggtgaataacgagagtgagatctggatctagatgtagaactttctgaatcggtgtaattggtggattctg

SEQ ID NO: 173962 - DNA, 75 bp, Artificial Sequence
  Synthetic
atttttttctgttggttcttatatgaggtctgaatcgggggttgtaaaattgatcattgtggttaaaggactgga

SEQ ID NO: 173963 - DNA, 75 bp, Artificial Sequence
  Synthetic
aggtctgaatcgggggttgtaaaattgatcattgtggttaaaggactggagtcgagctgcagcatttttgtagaa

SEQ ID NO: 173964 - DNA, 75 bp, Artificial Sequence
  Synthetic
attgagttcaggcccgcaccgaaatttgatttctgatacttcagcttctgtactaattgaggtgtcatgtggata

SEQ ID NO: 173965 - DNA, 75 bp, Artificial Sequence
  Synthetic
ttgatttctgatacttcagcttctgtactaattgaggtgtcatgtggatatatttgtcttttattagaatcgcaa

SEQ ID NO: 173966 - DNA, 75 bp, Artificial Sequence
  Synthetic
tactaattgaggtgtcatgtggatatatttgtcttttattagaatcgcaataaatctgcctcggtttacgtttgt

SEQ ID NO: 173967 - DNA, 75 bp, Artificial Sequence
  Synthetic
ttgttaggggttttaccggaggctctgctggaggccctgctggaagctttgctggaagccctgccggaggccctg

SEQ ID NO: 173968 - DNA, 75 bp, Artificial Sequence
  Synthetic
tgctggaggccctgctggaagctttgctggaagccctgccggaggccctgctggaggccctgctggaggccctgc

SEQ ID NO: 173969 - DNA, 75 bp, Artificial Sequence
  Synthetic
aggctctgctggaggctctgctggaggctctgctggaggccctgctggaggccctgctggaggccctgctggagg

SEQ ID NO: 173970 - DNA, 75 bp, Artificial Sequence
  Synthetic
gccctgctggaggccctgctggaggccctgctggaggctctgctggaggctctgctggaagctttgctagagact

SEQ ID NO: 173971 - DNA, 75 bp, Artificial Sequence
  Synthetic
ctgctggaagctctgctggaggccctgctggaggccctgctggaggccctgctggaggccctgctggaagctctg

SEQ ID NO: 173972 - DNA, 75 bp, Artificial Sequence
  Synthetic
gctggaggccctgctggaagctctgctagagactctgctggaagctctgctggaggccctgccggaggccctgcc

SEQ ID NO: 173973 - DNA, 75 bp, Artificial Sequence
  Synthetic
ggaggccctgctggaggccctgctggaggccctgctggaggccctgctggaggctctgctggaggctctgctgga

SEQ ID NO: 173974 - DNA, 75 bp, Artificial Sequence
  Synthetic
gaggccctgctggaggccctgctggaggctctgctggaggctctgctggagactctgctggaggccctgctgaag

SEQ ID NO: 173975 - DNA, 75 bp, Artificial Sequence
  Synthetic
tctgctggaggctctgctggaggctctgctggaggctctgctggaggctctgctggaggctctgctggaggctct

SEQ ID NO: 173976 - DNA, 75 bp, Artificial Sequence
  Synthetic
gtcagagacctcggtgaaagttttactcagaggtttatcagagttttcgccattagtttggttagaagtttcaga

SEQ ID NO: 173977 - DNA, 75 bp, Artificial Sequence
  Synthetic
tttattttcggtggaactgcagttaggtttcttgtcagtacattcatcaccgttagaagtgctattcatggtgct

SEQ ID NO: 173978 - DNA, 75 bp, Artificial Sequence
  Synthetic
gttgccactgttggatttgttaaaagcagtaaatgagctaggattggaatgactccgaataggtgaattgtctgt

SEQ ID NO: 173979 - DNA, 75 bp, Artificial Sequence
  Synthetic
taaatttttgttggcgcctgcagagtgttttttagacgcacagtttctgttcatagttgaaggagtttcttgcgt

SEQ ID NO: 173980 - DNA, 75 bp, Artificial Sequence
  Synthetic
ggggcatgcagaagttgatggaataatagtttcattacaaaatagttgtgaaaatggctgaataatattagagtc

SEQ ID NO: 173981 - DNA, 75 bp, Artificial Sequence
  Synthetic
ctctatttctgttttatttgtattttcattggaaaaactgtttaagtccgtattttcggtactttcttctgtttt

SEQ ID NO: 173982 - DNA, 75 bp, Artificial Sequence
  Synthetic
atggtttgttttgctgttgggggttgttttagtgaaattatcatagaatttatctgataaacaatttccataatt

SEQ ID NO: 173983 - DNA, 75 bp, Artificial Sequence
  Synthetic
gctttcactgttgttgggggatttgtattggccttcttcagagctactggaatcatgtatacaatggtgcgtttt

SEQ ID NO: 173984 - DNA, 75 bp, Artificial Sequence
  Synthetic
tgattttggtggtgtagatatcttttcattgtcgggtgaggttttatattgttcatcagatgttttgccgtgtag

SEQ ID NO: 173985 - DNA, 75 bp, Artificial Sequence
  Synthetic
gttatgtgagggatcagacttttttgatgtatttttggcggctttccctgaaacatttttaacggctacttccct

SEQ ID NO: 173986 - DNA, 75 bp, Artificial Sequence
  Synthetic
aacgtcttggtgtccgttggagtttgcagtattttttttagatgtcgtacgtccccgagaatgtttcattttagg

SEQ ID NO: 173987 - DNA, 75 bp, Artificial Sequence
  Synthetic
atcattagtgtcttttgggtcatgatgttttttgtaagagttatctttggtcggggctcttggagcatgttttga

SEQ ID NO: 173988 - DNA, 75 bp, Artificial Sequence
  Synthetic
tatgagaactctgtcttgtagagaagtttttgatcggtgtatatttttttttgtgtggtggagttccgagtcaga

SEQ ID NO: 173989 - DNA, 75 bp, Artificial Sequence
  Synthetic
atgaattttagttttatgaaccgcaaagtttaaggtgggctcaggtgtcatcggaagaggagatagcaggggatc

SEQ ID NO: 173990 - DNA, 75 bp, Artificial Sequence
  Synthetic
taattttgaaaaatctctagcttcagtaacggcttcatcttcatgctgattagattttctctgtttaagatcaga

SEQ ID NO: 173991 - DNA, 75 bp, Artificial Sequence
  Synthetic
acgcgatggaacatggttttcattatgtttttgtactttatgtttgtttattgtttgagaactgtgtccttttgt

SEQ ID NO: 173992 - DNA, 75 bp, Artificial Sequence
  Synthetic
cttttggattgatctacaacggatatgtgtttttttgtacttctgagtatccacgccacaatatgagccattgtc

SEQ ID NO: 173993 - DNA, 75 bp, Artificial Sequence
  Synthetic
tattagtgcttccttcggtaacgggataacttcagtgtcatatatttttttaatgagatccattttttgggaact

SEQ ID NO: 173994 - DNA, 75 bp, Artificial Sequence
  Synthetic
aggtctgtatgataaactgattgcgtcaggagacgttgaaacttgctgttttttgtgttctttgttatccttagc

SEQ ID NO: 173995 - DNA, 75 bp, Artificial Sequence
  Synthetic
attctcatgttctttagttttcgtagtttctggtgttgtctgtgtttttgttggataattgtgattgtcagattg

SEQ ID NO: 173996 - DNA, 75 bp, Artificial Sequence
  Synthetic
tacgtatgtggggtctgttgttattgaagtctgtgaaaatgccatgctatagtcttgggcttgaaaattgaagtt

SEQ ID NO: 173997 - DNA, 75 bp, Artificial Sequence
  Synthetic
ggttgttagttgtgtaacatctttatagttattcatacggagatctggattatattgttcatagtttggatgcat

SEQ ID NO: 173998 - DNA, 75 bp, Artificial Sequence
  Synthetic
gtattgttgatatgataaatctgcgggtctgtttgagaaatcgtgtagtctgtggcctcttccgcgtctgttata

SEQ ID NO: 173999 - DNA, 75 bp, Artificial Sequence
  Synthetic
acttctgggaaaaaatcttccatatggctgttgatactttgagtttggattgaagtaattacgactatcgtatct

SEQ ID NO: 174000 - DNA, 75 bp, Artificial Sequence
  Synthetic
tccctttcctcctctgggcctatgggaatgatgtctaaagttagagtcatatcctctatcggtatttctagattc

SEQ ID NO: 174001 - DNA, 75 bp, Artificial Sequence
  Synthetic
tctgtaggaactctctatactcctgtatgcatcataattaggttgatacggcaacgaggtgaaattgcactgtga

SEQ ID NO: 174002 - DNA, 75 bp, Artificial Sequence
  Synthetic
atttgtagtttggttctgtgatgcgtacatgggctgtaggacttgatctggcagttcggaagcaaagcgcatatg

SEQ ID NO: 174003 - DNA, 75 bp, Artificial Sequence
  Synthetic
gatcgaattgtttccgtttgatggtagattggaagcagaggatgtgcattgtctgtggatctgagctgctctccg

SEQ ID NO: 174004 - DNA, 75 bp, Artificial Sequence
  Synthetic
tggatcctggggagttcttgaattttttctggaatcttgagaagatatgggatcttgatgcgtattctcactcaa

SEQ ID NO: 174005 - DNA, 75 bp, Artificial Sequence
  Synthetic
tggttgtctatgtgtgacgtccgcatcatggtatagtccggataatttcatggcttggtggacaacgtcgttatg

SEQ ID NO: 174006 - DNA, 75 bp, Artificial Sequence
  Synthetic
agcatttgcttgtttggatttttgttctggaaaacatgtttataaaattcaagcttaatagatagtatttttccg

SEQ ID NO: 174007 - DNA, 75 bp, Artificial Sequence
  Synthetic
tcgattagtgatacgcttaatgtatttaataaattatggataatcattttgattatgatacatcccgtgcagaga

SEQ ID NO: 174008 - DNA, 75 bp, Artificial Sequence
  Synthetic
atgatgtttatacagattgtgcgtagtatgcaaatgaaagttattccatcgttttgtaatatgaaaagtttcaaa

SEQ ID NO: 174009 - DNA, 75 bp, Artificial Sequence
  Synthetic
tatagtaaagaaaagtacatatacgttttcaaggtgtgttctaataaaatgatgaataaaatagtagttttctat

SEQ ID NO: 174010 - DNA, 75 bp, Artificial Sequence
  Synthetic
agaacgtattatagacttttattgcataataatcattgagtaaatacgtggagacattaaattcgtattttgttt

SEQ ID NO: 174011 - DNA, 75 bp, Artificial Sequence
  Synthetic
tttagattgttgagctatatagataaatttggatgataaagacgttataatttgtagtgaaattcactaaatcgt

SEQ ID NO: 174012 - DNA, 75 bp, Artificial Sequence
  Synthetic
tttaagcttttatatttatcaattaagtagtaactttccgtggaaatgtcgcagaagcggaataatgcatttact

SEQ ID NO: 174013 - DNA, 75 bp, Artificial Sequence
  Synthetic
aattggaaaagatgtaggagagtggtaaaagcctattggtttcttaagtatgtatatcgtgcgatgtgttattaa

SEQ ID NO: 174014 - DNA, 75 bp, Artificial Sequence
  Synthetic
tgtatatcgtgcgatgtgttattaactagttagatgtggattactaataatgggggggggggaaattattcgcat

SEQ ID NO: 174015 - DNA, 75 bp, Artificial Sequence
  Synthetic
aacatgcaattaaaattcaattcaaaatttatgaaattgacattatttggagaaattttatgggacgcatgattt

SEQ ID NO: 174016 - DNA, 75 bp, Artificial Sequence
  Synthetic
atataattgatctattaacaggccaagcgacgggatttagtgagcatgatattaaatcttttcattcagtagttg

SEQ ID NO: 174017 - DNA, 75 bp, Artificial Sequence
  Synthetic
aagttattttcgtggttgattacatttttgaataattaatggtatataattaataataagtagggctaatagtac

SEQ ID NO: 174018 - DNA, 75 bp, Artificial Sequence
  Synthetic
aatttattatcactattcttatgcgatgagttcaagttcgggcgctgaaaaaatacgtgtaatgaacactttttt

SEQ ID NO: 174019 - DNA, 75 bp, Artificial Sequence
  Synthetic
tagagaacttatgttattagagaatttatgttaattagtagttcaataatagaatttatgatttatcaatcacgt

SEQ ID NO: 174020 - DNA, 75 bp, Artificial Sequence
  Synthetic
gatatgccatatatttggaaatcgcgtgtaatagtatattaggtgtcatatattaatttcatttaaaactaggat

SEQ ID NO: 174021 - DNA, 75 bp, Artificial Sequence
  Synthetic
gaacattaacataaattatatataatacctgatgaagttaatggcaattgaattggatggtatattaatttatat

SEQ ID NO: 174022 - DNA, 75 bp, Artificial Sequence
  Synthetic
ttacttatttgcattagattatattataataaaattgttttaatgttaaaaatttaaattattgatgcattcatt

SEQ ID NO: 174023 - DNA, 75 bp, Artificial Sequence
  Synthetic
ataataaaattgttttaatgttaaaaatttaaattattgatgcattcattattggcgtgcagtaaatccagtata

SEQ ID NO: 174024 - DNA, 75 bp, Artificial Sequence
  Synthetic
attggcgtgcagtaaatccagtataatgggtaaaagtgagatttattggaggggggggggatgtataatatccat

SEQ ID NO: 174025 - DNA, 75 bp, Artificial Sequence
  Synthetic
gtttttaagatatggtaatatttatcaattatctaattgtctaattctgttggttgtctacagggaacctataga

SEQ ID NO: 174026 - DNA, 75 bp, Artificial Sequence
  Synthetic
tatattcaggaataattggagttgaaattgctgaagtttgtgactaccaaagggttaatatgcataatcaaatag

SEQ ID NO: 174027 - DNA, 75 bp, Artificial Sequence
  Synthetic
atactgatgctaccgtggggatggatatgatttgataattaggatacaattatatattatttattatgtattatg

SEQ ID NO: 174028 - DNA, 75 bp, Artificial Sequence
  Synthetic
gagatgacataatttaatataatacattatatgataatttaaagtttatagtagactagttttattatgtttcta

SEQ ID NO: 174029 - DNA, 75 bp, Artificial Sequence
  Synthetic
atgtgatagcgccctccgctgttcaggtaaattatatgatattgaatgttttgagtagactagtttgattatgtt

SEQ ID NO: 174030 - DNA, 75 bp, Artificial Sequence
  Synthetic
tatgatgtgatagcgccctccgctgttcaggtaaattatatgatagtgaaagttttgagtagactagttcgatta

SEQ ID NO: 174031 - DNA, 75 bp, Artificial Sequence
  Synthetic
tgtttctgttgtgatagcgcccttcgctgttcaagtaaattatatgatattgaaagttttgagttgactagtttg

SEQ ID NO: 174032 - DNA, 75 bp, Artificial Sequence
  Synthetic
attatgtttctgatgtgatagcgccctccgctgttgaggtaaattatatgatattgaaagttttgagtagactag

SEQ ID NO: 174033 - DNA, 75 bp, Artificial Sequence
  Synthetic
tttgattatgtttctgatgtgatagcgccctccgctgttcaggtcaaaatttaagggttgtaaatagacattttt

SEQ ID NO: 174034 - DNA, 75 bp, Artificial Sequence
  Synthetic
cgccctccgctgttcaggtcaaaatttaagggttgtaaatagacatttttaaaatattttaaacctaaataattt

SEQ ID NO: 174035 - DNA, 75 bp, Artificial Sequence
  Synthetic
aaaatattttaaacctaaataatttcatttattgtgctttttgttaagatgctgagtttgtgtgtgtgttgtgtt

SEQ ID NO: 174036 - DNA, 75 bp, Artificial Sequence
  Synthetic
gctgagtttgtgtgtgtgttgtgtttgtgtgttgtgtttgtgtgttgtgtttgtgtgttgtgtttgtgtgttgtg

SEQ ID NO: 174037 - DNA, 75 bp, Artificial Sequence
  Synthetic
tttgtgtgttgtgtttgtgtgttgtgtttgtgtatgtgagagagaaagagatagagagagatagatatatggggg

SEQ ID NO: 174038 - DNA, 75 bp, Artificial Sequence
  Synthetic
ggggggaatatataaatatagtaattttgaatctgtgtttccaaaattgggaattatgcgtagcatcccactttc

SEQ ID NO: 174039 - DNA, 75 bp, Artificial Sequence
  Synthetic
aaagtgatttcagttaataagatgttggattaaagatggatttggtattttagatttatactttcaagtgtttgg

SEQ ID NO: 174040 - DNA, 75 bp, Artificial Sequence
  Synthetic
tggattaaagatggatttggtattttagatttatactttcaagtgtttggtggaaaacagatagaacaatggaac

SEQ ID NO: 174041 - DNA, 75 bp, Artificial Sequence
  Synthetic
tagatttatactttcaagtgtttggtggaaaacagatagaacaatggaacgttgtctctgaaaaaaaaaaactag

SEQ ID NO: 174042 - DNA, 75 bp, Artificial Sequence
  Synthetic
tagtgtgacatttaggaaatgtggtttggatactttcatcgtgtaaaaagtcaaaaggttgaaaatgtttttttt

SEQ ID NO: 174043 - DNA, 75 bp, Artificial Sequence
  Synthetic
ttcatgaataggagctattatgtgaatgttgaacaaaaacagattaaatagacctgaaaggataatattgtgtag

SEQ ID NO: 174044 - DNA, 75 bp, Artificial Sequence
  Synthetic
agtgctacggtctagctacaactaatgtaatacattttttagcagtactatgatttataaaattaagatgtcccc

SEQ ID NO: 174045 - DNA, 75 bp, Artificial Sequence
  Synthetic
ggggcattagtcttaataaactggtttagtttggaaaagagaaagtgaaaatctgaatacttggcatctgtataa

SEQ ID NO: 174046 - DNA, 75 bp, Artificial Sequence
  Synthetic
ggttttccaagaatacaattgtttatagtatcacatcttcaagaaagctggaattaacttatggaaatattgtat

SEQ ID NO: 174047 - DNA, 75 bp, Artificial Sequence
  Synthetic
gatgacttataagtcagtttatgtacgtgacttggaattaaaaagagaaagcaatgtctgtatgactttttatta

SEQ ID NO: 174048 - DNA, 75 bp, Artificial Sequence
  Synthetic
tttgtaaggtgatattgaaaataaattcctttgagaaatcacatgtttgctgaggttttacataatagaaagagt

SEQ ID NO: 174049 - DNA, 75 bp, Artificial Sequence
  Synthetic
ttcctttgagaaatcacatgtttgctgaggttttacataatagaaagagttacatttgcttatgtaatttctaat

SEQ ID NO: 174050 - DNA, 75 bp, Artificial Sequence
  Synthetic
tacatttgcttatgtaatttctaatctatagcaatataaagagttacacagtatggggaaagtatgtattttaca

SEQ ID NO: 174051 - DNA, 75 bp, Artificial Sequence
  Synthetic
acaatataagcatatttacataatacacatctgtatgttaatgattgctaatcaatttacatctcagtttcatct

SEQ ID NO: 174052 - DNA, 75 bp, Artificial Sequence
  Synthetic
atcaatttacatctcagtttcatctagctaataaatttgagcattttcttcgaatggatcataatcagaggggta

SEQ ID NO: 174053 - DNA, 75 bp, Artificial Sequence
  Synthetic
gccatctaatttaaagacctccattttatcactgttgcaatcacttctaatggtacatttttcattatcattact

SEQ ID NO: 174054 - DNA, 75 bp, Artificial Sequence
  Synthetic
ttatcactgttgcaatcacttctaatggtacatttttcattatcattacttgtaccttccgtacatctgttctca

SEQ ID NO: 174055 - DNA, 75 bp, Artificial Sequence
  Synthetic
tggtacatttttcattatcattacttgtaccttccgtacatctgttctcatcattttgacatgttgtgtcattga

SEQ ID NO: 174056 - DNA, 75 bp, Artificial Sequence
  Synthetic
tgagtttcggctgttacaagattttgggaatttgccacatttaaatttttctcacatgcggtatgggtgataaca

SEQ ID NO: 174057 - DNA, 75 bp, Artificial Sequence
  Synthetic
gtatatttactggaaagatcttggcaatgtttggctatgccgtgtttaatgatatcagttagatccataaaattt

SEQ ID NO: 174058 - DNA, 75 bp, Artificial Sequence
  Synthetic
gatatcagttagatccataaaattttccatgaccatttctgtgataagtttcttggttggtgttatgtcttccaa

SEQ ID NO: 174059 - DNA, 75 bp, Artificial Sequence
  Synthetic
gtctgttttgctatcctgtattttactataagtatatgagacattttccttctcatattcttcatcatccgtttt

SEQ ID NO: 174060 - DNA, 75 bp, Artificial Sequence
  Synthetic
tctcatattcttcatcatccgttttaatgggaacaaagtgattgatgaagcagtgattagcttctgtcacatcac

SEQ ID NO: 174061 - DNA, 75 bp, Artificial Sequence
  Synthetic
tgtcattttttacattcatttttgcagaactgtgtataacacaattgtctactttgtgagttttcctcataaacc

SEQ ID NO: 174062 - DNA, 75 bp, Artificial Sequence
  Synthetic
acaaccaatgttttttgggaacaaatttgtttctgatatcatgggtacccggcattgaccttattgggatggtaa

SEQ ID NO: 174063 - DNA, 75 bp, Artificial Sequence
  Synthetic
tttgtttctgatatcatgggtacccggcattgaccttattgggatggtaaacactggggatggaaaacctttact

SEQ ID NO: 174064 - DNA, 75 bp, Artificial Sequence
  Synthetic
ttgacaatgaccattattgatcactttatcataatcactcaaatgtaagtaattatcttcagatgtacagtcatc

SEQ ID NO: 174065 - DNA, 75 bp, Artificial Sequence
  Synthetic
aattatcttcagatgtacagtcatctgactcgctactcgattcagaattaggttctgatttaatagttttttcta

SEQ ID NO: 174066 - DNA, 75 bp, Artificial Sequence
  Synthetic
acattgacttatcaataatattgttaccatcctcttcatcttcactctctgaacttataacaattacgtttgtgg

SEQ ID NO: 174067 - DNA, 75 bp, Artificial Sequence
  Synthetic
tttcaggtaacctatctagcttaatttttttagatttggatggtttaattggaacatttttccttttagctgttc

SEQ ID NO: 174068 - DNA, 75 bp, Artificial Sequence
  Synthetic
tctttttagatttgcatttttgagacacagccacaattttctcagttttgtgatcttccttagaaggagtgacct

SEQ ID NO: 174069 - DNA, 75 bp, Artificial Sequence
  Synthetic
ctggtggtgaatatagagacttgctaaatggtgtattctcattagtgttattcatatgaatgttattagttctga

SEQ ID NO: 174070 - DNA, 75 bp, Artificial Sequence
  Synthetic
cagttgaatcacagtctgcaatgtaatcagtttcatcattgttatcgctttcactctcataaggtgctgagtgat

SEQ ID NO: 174071 - DNA, 75 bp, Artificial Sequence
  Synthetic
cagtttcataaccaaatgttatcatttctgatattaaagggttgtcatggaaaccatcacatagattcactagac

SEQ ID NO: 174072 - DNA, 75 bp, Artificial Sequence
  Synthetic
tctctacagcttccatttctttgtctaatttgctttctggatttagagtatcctgaattgcaccatgacttttga

SEQ ID NO: 174073 - DNA, 75 bp, Artificial Sequence
  Synthetic
caggagttgctgagttggtaaaggtcataccaggaagcgtttcggtacacttggagttagaacctttttcctgaa

SEQ ID NO: 174074 - DNA, 75 bp, Artificial Sequence
  Synthetic
cataccaggaagcgtttcggtacacttggagttagaacctttttcctgaatccattcttttgtctgtgacctttt

SEQ ID NO: 174075 - DNA, 75 bp, Artificial Sequence
  Synthetic
atcggggctgtaagccaaaatgtcttgttgtccagacccggtctctacaactactgagtcgggttgagtttcaag

SEQ ID NO: 174076 - DNA, 75 bp, Artificial Sequence
  Synthetic
tagtttttttatcaagaagtgtttaccactttcaaggccagtaatggatttaaagttatcagggccgcccagatc

SEQ ID NO: 174077 - DNA, 75 bp, Artificial Sequence
  Synthetic
tgtcactgaggctgtacatacacagttagggcttgtttgttctttccctatctgtctgctatattcaatgaatgt

SEQ ID NO: 174078 - DNA, 75 bp, Artificial Sequence
  Synthetic
ttttgcctctttggatttccctggcacatctggagaaggagtgtctggatacatttttcctacatctttttcatg

SEQ ID NO: 174079 - DNA, 75 bp, Artificial Sequence
  Synthetic
tatgtttgtaagtttttgtcttgttggggattcattgttctttgacggagtgggaatattattatcagtaggaga

SEQ ID NO: 174080 - DNA, 75 bp, Artificial Sequence
  Synthetic
ttgtacttccatgtattttaaatagtctacattgtcatcatcttcatggatagattcgatagaagattcctctga

SEQ ID NO: 174081 - DNA, 75 bp, Artificial Sequence
  Synthetic
atattttccatgttcatcaaaatcagctaactctaataatattgattctgacgggtctatgtttaaatcacagat

SEQ ID NO: 174082 - DNA, 75 bp, Artificial Sequence
  Synthetic
ggaagactctctatttttatttatagcaatgtagccttccattatatcagaggaagttaaaggtttaatcaaacc

SEQ ID NO: 174083 - DNA, 75 bp, Artificial Sequence
  Synthetic
agtatcatcataaattgtttctatgcattcacatgcgtgggtgatcatattcatcatggtaattttaaactggtg

SEQ ID NO: 174084 - DNA, 75 bp, Artificial Sequence
  Synthetic
tctgcgaggtttgaggtattgccatgaaaattcattgctgcatagaacaatactttggagaacagcaatgccaat

SEQ ID NO: 174085 - DNA, 75 bp, Artificial Sequence
  Synthetic
tactttggagaacagcaatgccaatatttttggcggcagtaattaaatttttacaatttatatgaattttgagga

SEQ ID NO: 174086 - DNA, 75 bp, Artificial Sequence
  Synthetic
atgttttatcacagttatccataaagatttgattcatctgcttattagcaaattcctgaaacattttcatatttt

SEQ ID NO: 174087 - DNA, 75 bp, Artificial Sequence
  Synthetic
aattcctgaaacattttcatatttttaacatggttttctattatctcatttctactttccagtagttcctgttta

SEQ ID NO: 174088 - DNA, 75 bp, Artificial Sequence
  Synthetic
agtaaatttacttgcttacaaaattccttattggagatttcaggattggacatctctttgttgtgtgccatcaac

SEQ ID NO: 174089 - DNA, 75 bp, Artificial Sequence
  Synthetic
aacaatgaggtggcgaccatgttcaattttccactatctaatgccacataagctttggaaaaaatgtttttgagg

SEQ ID NO: 174090 - DNA, 75 bp, Artificial Sequence
  Synthetic
attttccactatctaatgccacataagctttggaaaaaatgtttttgagggctgtaataaattgattgttcatat

SEQ ID NO: 174091 - DNA, 75 bp, Artificial Sequence
  Synthetic
tagctttcaaatccatgagcaaatctctggattctgatgctatctttttcactaacccatcaaatttatcacatg

SEQ ID NO: 174092 - DNA, 75 bp, Artificial Sequence
  Synthetic
ccaattaaaaaaatccaagttttttccagacaacatttttgcataacatgaaacaaattgagatgaagcactact

SEQ ID NO: 174093 - DNA, 75 bp, Artificial Sequence
  Synthetic
tagtaaattaatatttatcaactgtcctaattgttctaataccagcctctccaacatggatctgtgcagcgttaa

SEQ ID NO: 174094 - DNA, 75 bp, Artificial Sequence
  Synthetic
ccaacatggatctgtgcagcgttaataagccagcggagttaattaaattgtcttccatgttagactgttcctgtt

SEQ ID NO: 174095 - DNA, 75 bp, Artificial Sequence
  Synthetic
tcatggcagccttcactgatgcaccaatactttggatgcaattgccaacggactgagctaggatgtaaaagaaga

SEQ ID NO: 174096 - DNA, 75 bp, Artificial Sequence
  Synthetic
tattctaagtatgctatatgttacatgcttaaaactatgtttttttcttgttttctatcttgggacatataatat

SEQ ID NO: 174097 - DNA, 75 bp, Artificial Sequence
  Synthetic
ataattcatgtactcaccaaccaaagttttgaattcgtcagatgctccttcttccacattactggaataggacac

SEQ ID NO: 174098 - DNA, 75 bp, Artificial Sequence
  Synthetic
attcttggaagcgatgtcgttggaagactctgggatgaaaagatcaaaggcttccagttctggaaaaagcaggct

SEQ ID NO: 174099 - DNA, 75 bp, Artificial Sequence
  Synthetic
ttcaaaggacacatcacacttgagactctcttccaatatttctttgatggattcttccaccactggatcgggatg

SEQ ID NO: 174100 - DNA, 75 bp, Artificial Sequence
  Synthetic
gtagctgtaagtatgaatatttcttagtacttagaaaaactcccatatagttttaaataagatagatctaataag

SEQ ID NO: 174101 - DNA, 75 bp, Artificial Sequence
  Synthetic
gactaatcatacttacttttgcatacgttcctcattggattccatgttgtttccagagggttttccgagaatgaa

SEQ ID NO: 174102 - DNA, 75 bp, Artificial Sequence
  Synthetic
catagaagtagaggttgtatcttttgctgactccattgtatattaagatgcaaattcagacaccgcctactgttc

SEQ ID NO: 174103 - DNA, 75 bp, Artificial Sequence
  Synthetic
tgttagccaatgaaaaaatatcttctgtcagcagatataatactatataaggagattaccaccacctctttcttt

SEQ ID NO: 174104 - DNA, 75 bp, Artificial Sequence
  Synthetic
gcagagattattctctgcttgaaaatctgtaacactgatcatgatgggatatgaggaaaaagtgtcagctactgg

SEQ ID NO: 174105 - DNA, 75 bp, Artificial Sequence
  Synthetic
aaagactcgtttaaagatactggcatgtctgatcgttttaatactagctgcggcaataactatgttaacgctgga

SEQ ID NO: 174106 - DNA, 75 bp, Artificial Sequence
  Synthetic
aattatatcgaaccaaaaacgtaccactactgatctcgaagctgtgactgtggcgctgaagcatgtaagcacatc

SEQ ID NO: 174107 - DNA, 75 bp, Artificial Sequence
  Synthetic
tcttgccaactgcactgaatccactacttctgtacataccggttagtgaaagatatgtcttttttatgttaatgt

SEQ ID NO: 174108 - DNA, 75 bp, Artificial Sequence
  Synthetic
attgattatatatttgcatacattccttaagaatggaaaaatcacggatggtttgtttttagattctgtgacgag

SEQ ID NO: 174109 - DNA, 75 bp, Artificial Sequence
  Synthetic
cttaagaatggaaaaatcacggatggtttgtttttagattctgtgacgagccaacccacgaaaaaacaaagaatc

SEQ ID NO: 174110 - DNA, 75 bp, Artificial Sequence
  Synthetic
gaggaaaaaaattgaagggaaatctccaagttgggttcaggctttaactacagcatctggaattatcctactgtt

SEQ ID NO: 174111 - DNA, 75 bp, Artificial Sequence
  Synthetic
ttgtataatgatgatattcattacatgttcctggaccacagaaaaagatacagagaagagtgaagtgcaatctta

SEQ ID NO: 174112 - DNA, 75 bp, Artificial Sequence
  Synthetic
tgcttcttcagtagagactttagactctttaaatgaggctattataccgaaaactgaaatgaatgtgtaatgtct

SEQ ID NO: 174113 - DNA, 75 bp, Artificial Sequence
  Synthetic
gtatttttctttacagagatgtacggagagtttatatttggggaaaatacctgactgttctgcctatatgcgaat

SEQ ID NO: 174114 - DNA, 75 bp, Artificial Sequence
  Synthetic
gttaaagtatgtataatataaattcttaccttttaagagtgattcaaggtggaggtttctttggagattgattcc

SEQ ID NO: 174115 - DNA, 75 bp, Artificial Sequence
  Synthetic
aggtggtggtttcgggtgcaatcaatctttcttctgggcgggaagaaaatccagcaatccaataattgatgggat

SEQ ID NO: 174116 - DNA, 75 bp, Artificial Sequence
  Synthetic
gtaatcaatgtcacaaatctgtaagattaaatgtgaacagtataaattcttttgtgcttatcaaattacaattat

SEQ ID NO: 174117 - DNA, 75 bp, Artificial Sequence
  Synthetic
gcgcatgaaaatatcattaaattgttttaaacattcttaaattcaatttaaaataatttttgtagcaattttaaa

SEQ ID NO: 174118 - DNA, 75 bp, Artificial Sequence
  Synthetic
tattaatagttaaaaaattgacttaccagactgcagcgatataagaaagaatctctgtgatgagaatgttctccg

SEQ ID NO: 174119 - DNA, 75 bp, Artificial Sequence
  Synthetic
gagccacttcttgagaaaagtggcactgaactggctgtaacttctgcttatatacaattctatagcgggtgtgat

SEQ ID NO: 174120 - DNA, 75 bp, Artificial Sequence
  Synthetic
gtacaggaaaatgacgaggatgaaggagccaatcgctgtataatgttaaaccgcaagtgtagaaatacacccctt

SEQ ID NO: 174121 - DNA, 75 bp, Artificial Sequence
  Synthetic
ttagacaaatatggaatggaaattagctgatgcttacaaaaatttagggttttgtcatatcttactcaaaaacag

SEQ ID NO: 174122 - DNA, 75 bp, Artificial Sequence
  Synthetic
gaatttgtggtctggattttttgaggttttcttcttatggctgacttgtatttttttatgagaaagacggagttt

SEQ ID NO: 174123 - DNA, 75 bp, Artificial Sequence
  Synthetic
tttttttatgagaaagacggagtttgcggttaaaggcgggataataaagaacactttactgataaattgtcatgt

SEQ ID NO: 174124 - DNA, 75 bp, Artificial Sequence
  Synthetic
acactttactgataaattgtcatgtttttttttaaaaaaaaacatctgctacacatcatgaaacaggaatatggt

SEQ ID NO: 174125 - DNA, 75 bp, Artificial Sequence
  Synthetic
agggttctcgttagcctgggtaggaaagaccccaaccacagtacccactaacctttaactttatgagaaaaacag

SEQ ID NO: 174126 - DNA, 75 bp, Artificial Sequence
  Synthetic
aagaccccaaccacagtacccactaacctttaactttatgagaaaaacaggaactgcggttgcttcgttagcagt

SEQ ID NO: 174127 - DNA, 75 bp, Artificial Sequence
  Synthetic
ttttagagttttaattcgcatgaacaggaaagactccaaccgcaatatctgctaatttttaactttataagaaaa

SEQ ID NO: 174128 - DNA, 75 bp, Artificial Sequence
  Synthetic
gctaatttttaactttataagaaaaacaggaactgcggttgccgcgttagcagcttttagagttctcattcgcct

SEQ ID NO: 174129 - DNA, 75 bp, Artificial Sequence
  Synthetic
gggcaggaaatacttcaaccgcggtacccgctgatctttaaatttatgagaaaaacaggaactgcggttgccgcg

SEQ ID NO: 174130 - DNA, 75 bp, Artificial Sequence
  Synthetic
cgcgttagcagcttttagagttctcgttcgcctgggcaggaaatacttcaaccgcggtacccgctgatctttaac

SEQ ID NO: 174131 - DNA, 75 bp, Artificial Sequence
  Synthetic
cagattttgaagttctcatccttattagcaggaaagatttcaaccgcggtacccactaacctttaattttatgag

SEQ ID NO: 174132 - DNA, 75 bp, Artificial Sequence
  Synthetic
aaaaactggaactgcggttgctccgttagcagattttagggttctcgttagcctaggtaggaaagaccccaaccg

SEQ ID NO: 174133 - DNA, 75 bp, Artificial Sequence
  Synthetic
cggtacccactgatctttaactttatgagaaaaacaggaattgcggtttcccccattagcagattttgaagttct

SEQ ID NO: 174134 - DNA, 75 bp, Artificial Sequence
  Synthetic
aaccgcggtacccactaacctttaactttatgagaaaaacaggaactgcggttgctccgttagcagattttaggg

SEQ ID NO: 174135 - DNA, 75 bp, Artificial Sequence
  Synthetic
gttgctccgttagcagattttagggttctcgttagcctgggtaggaaagacccaaccgcgatacccactgatctt

SEQ ID NO: 174136 - DNA, 75 bp, Artificial Sequence
  Synthetic
acctttaactttatgagaaaaacaggaactgcggttgctccgttagcagattttagggttctcgttagcctgggt

SEQ ID NO: 174137 - DNA, 75 bp, Artificial Sequence
  Synthetic
ttttagggttctcgttagcctgggtaggaaagaccccaaccgcagtacccattaaccctttaactttatgagaaa

SEQ ID NO: 174138 - DNA, 75 bp, Artificial Sequence
  Synthetic
aacaggaactgcggttgctccgttagcaggttttagagttttaattcgcataatcaggaaagacttcaaccgcgg

SEQ ID NO: 174139 - DNA, 75 bp, Artificial Sequence
  Synthetic
agcctgggtaggaaagaccccaaccgcagtacccactaacctttaactttatgagaaaaacagaaactgcggttg

SEQ ID NO: 174140 - DNA, 75 bp, Artificial Sequence
  Synthetic
ctccgttagcagcttttagagttttaattcgcatgaacaggaaagacttcaaccgcggtacccgctgatctttaa

SEQ ID NO: 174141 - DNA, 75 bp, Artificial Sequence
  Synthetic
aattcgcatgaacaggaaagacttcaaccgcggtacccgctgatctttaactttatgagaaaaacaggaactgcg

SEQ ID NO: 174142 - DNA, 75 bp, Artificial Sequence
  Synthetic
ctttatgagaaaaacaggaactgcggttgccgcgttagcagattttgaagttctcatccttattagcaggaaaga

SEQ ID NO: 174143 - DNA, 75 bp, Artificial Sequence
  Synthetic
gttgccgcgttagcagattttgaagttctcatccttattagcaggaaagatttcaaccgcagtacccactaacct

SEQ ID NO: 174144 - DNA, 75 bp, Artificial Sequence
  Synthetic
ttaagtttatggggaaaaacaggaactgcggttgctttgttagcatcttttagagttctcattcgtattggcagg

SEQ ID NO: 174145 - DNA, 75 bp, Artificial Sequence
  Synthetic
tagagttctcattcgtattggcaggaaatacttcaaccgcggtacccactgatctttaactttatgaagaaaaac

SEQ ID NO: 174146 - DNA, 75 bp, Artificial Sequence
  Synthetic
aaatacttcaaccgcggtacccactgatctttaactttatgaagaaaaacaggaactgttgttgctttgttagca

SEQ ID NO: 174147 - DNA, 75 bp, Artificial Sequence
  Synthetic
gattttaaagttctcatcctcattatcaggaaagacttcaaccgcagttcccactgacctttaagtttatgagga

SEQ ID NO: 174148 - DNA, 75 bp, Artificial Sequence
  Synthetic
aaaacaggaaatgcggttgctttgttaacagcttttagagttctcatccgtatgggcaaaaaaaatttcaaccgc

SEQ ID NO: 174149 - DNA, 75 bp, Artificial Sequence
  Synthetic
tatgggcaaaaaaaatttcaaccgcggtacccactgatctttagctttatcagaaaaaacagaaactgcggttgc

SEQ ID NO: 174150 - DNA, 75 bp, Artificial Sequence
  Synthetic
ggtacccactgatctttagctttatcagaaaaaacagaaactgcggttgccccgttagcgaattttagggtcctc

SEQ ID NO: 174151 - DNA, 75 bp, Artificial Sequence
  Synthetic
acccacttgagtaggaaagaccctaaccgcggcacccactgacctttaactgtatgaagagaaacagaaactgcg

SEQ ID NO: 174152 - DNA, 75 bp, Artificial Sequence
  Synthetic
ttctcacccgcttgggtaggaaagaccctaaccgcggcacccactgacctttaactttatgaggaaaaacagaaa

SEQ ID NO: 174153 - DNA, 75 bp, Artificial Sequence
  Synthetic
ctgcggttgccccgttagcaatttttaaggttctcacccgcttgggtaggaaagaccctaaccgcggcacccact

SEQ ID NO: 174154 - DNA, 75 bp, Artificial Sequence
  Synthetic
aaagaccctaaccgcggcacccactgacctttaactttttgatgaaaaacagaagctgcggttgccccgttagca

SEQ ID NO: 174155 - DNA, 75 bp, Artificial Sequence
  Synthetic
atttttaaggttctcacccgtttgggtaggaaagaccctaaccgcggcacccactgacatttaaatttatggaaa

SEQ ID NO: 174156 - DNA, 75 bp, Artificial Sequence
  Synthetic
aacaaacttttttgttcatcatgcacttttttatatatcattatatctctatccaatcagcactcttgagggtgc

SEQ ID NO: 174157 - DNA, 75 bp, Artificial Sequence
  Synthetic
atacattaaggcagtgttgattttttttcattgtacccacttacgaataacgaatcaaaagccatgaagtagaat

SEQ ID NO: 174158 - DNA, 75 bp, Artificial Sequence
  Synthetic
attttaatgatgtattaatcatcatttcctaccacgcctattaacttcagtatttataggataggcaatttgcgc

SEQ ID NO: 174159 - DNA, 75 bp, Artificial Sequence
  Synthetic
tatacgccattagctgttcttctgctagcttggacacagcggtacagggtgagttatcagcgtcttataatgtga

SEQ ID NO: 174160 - DNA, 75 bp, Artificial Sequence
  Synthetic
tgtctttttttttattttcttgtcggtattttaaaagtagtctgttaagatgtttttaaatagatagttataaaa

SEQ ID NO: 174161 - DNA, 75 bp, Artificial Sequence
  Synthetic
tttttggaaccgtgtagtcaataaaacaatttatagaacggtttctggcccagaacagaaattgatttatgtcgt

SEQ ID NO: 174162 - DNA, 75 bp, Artificial Sequence
  Synthetic
ctttctgaattacaggaaaattgcgagggataactttatcaaatgtaaaattatataccctctgtgatagattta

SEQ ID NO: 174163 - DNA, 75 bp, Artificial Sequence
  Synthetic
ttttgtggatatttgaatgtaccatcgagcgtatatcaacgcaagatgtggctatgatgggacacggtcctatct

SEQ ID NO: 174164 - DNA, 75 bp, Artificial Sequence
  Synthetic
gtacgtggtcgttttcattaattgggaatattattttttgacccccaaggagggattttataatattaaaatttt

SEQ ID NO: 174165 - DNA, 75 bp, Artificial Sequence
  Synthetic
caaagttgatacttatgtctttccaccacaagactaaaacctgtccgtaagctcttaaatttttagtattcaaag

SEQ ID NO: 174166 - DNA, 75 bp, Artificial Sequence
  Synthetic
atccgtgtaatattccatgtaacgggatattttcaagaatggctcccgttaacatcgattttccacatccgggtg

SEQ ID NO: 174167 - DNA, 75 bp, Artificial Sequence
  Synthetic
gaccaataaaactaacggtgttttttttccctcttctgtggcttagccactgatataatatggttcctgctaata

SEQ ID NO: 174168 - DNA, 75 bp, Artificial Sequence
  Synthetic
tagggtcaaaagactgcagacagaacaactggtaaaccgggttttcatagatttcaaagtcagtgtctatgtgcg

SEQ ID NO: 174169 - DNA, 75 bp, Artificial Sequence
  Synthetic
ctataaaatcgatagcttttctagttgctcttattctttttttagatatagatagagccctatgaattagcacgt

SEQ ID NO: 174170 - DNA, 75 bp, Artificial Sequence
  Synthetic
ccccgtgtgttagtgtcaataattgcatgtatgatctaacgtctcttcgtatccacgcgtcttccgtgactattc

SEQ ID NO: 174171 - DNA, 75 bp, Artificial Sequence
  Synthetic
caagatcagacagccattcgatggttcccagaaatttagattttaaagatattctgttggtcccatcctttggaa

SEQ ID NO: 174172 - DNA, 75 bp, Artificial Sequence
  Synthetic
acagcataagtttaacattaggttttttattgaaatgggatatgatgtgttttcgatgtatttcatcgcatacgt

SEQ ID NO: 174173 - DNA, 75 bp, Artificial Sequence
  Synthetic
ctcccagttcgttaatatttgtccatgcccattggaactgtggtctaataatttgaagaagggcaaaggggatat

SEQ ID NO: 174174 - DNA, 75 bp, Artificial Sequence
  Synthetic
aacttagactgaagacctgggttccgccaccatttttctttgttttggcatacgtgcaccaatcatctattttag

SEQ ID NO: 174175 - DNA, 75 bp, Artificial Sequence
  Synthetic
gggcgttcccgtcgaagaaatctttaattaatacacccctgatttccgttgtgtgttttcctatcgttgcggtgg

SEQ ID NO: 174176 - DNA, 75 bp, Artificial Sequence
  Synthetic
gaattccatctaaagctatcaataatgttaaggagggtctgccagctttattctccgcttgagcgtaccactttg

SEQ ID NO: 174177 - DNA, 75 bp, Artificial Sequence
  Synthetic
caggggtggggacggcagttttattattccagtaattgagtatgacatcgatcattttggtacatgcagttatcc

SEQ ID NO: 174178 - DNA, 75 bp, Artificial Sequence
  Synthetic
atttaatatcgggcgctcccggtgagtgcatatctctaaaatgtggcacgggcacgttagagaatttgcaaaaaa

SEQ ID NO: 174179 - DNA, 75 bp, Artificial Sequence
  Synthetic
aatccgtagatattccagggatttctgcctcccactccacggggcctttgatagtcaacatgatatatttgtcct

SEQ ID NO: 174180 - DNA, 75 bp, Artificial Sequence
  Synthetic
tagtccaaaaatcatcacttggatttattatggaaaacataccgtttgtgccttccaagatttttatagttgtat

SEQ ID NO: 174181 - DNA, 75 bp, Artificial Sequence
  Synthetic
acggaaaataaggtaattcccctggcttgtcacctctagatgtcttcaaatctggaagatttgttatggcaacaa

SEQ ID NO: 174182 - DNA, 75 bp, Artificial Sequence
  Synthetic
attctcagtatggatccggcggaacttctgtcggacaatgcaatctcgtccacgtgtgacgaaaacatcgcagct

SEQ ID NO: 174183 - DNA, 75 bp, Artificial Sequence
  Synthetic
ggacatcattttacgcaatctccgcacgttgaaatgtcagtccaatcaacgacatcggcgggtcatactggagtg

SEQ ID NO: 174184 - DNA, 75 bp, Artificial Sequence
  Synthetic
atgacgacacagtcgcagttttccaatggcgtacgggatcaaaaccgcgaatcactgtcgactctgacgggcctc

SEQ ID NO: 174185 - DNA, 75 bp, Artificial Sequence
  Synthetic
tcgctggaaagcatcaacaatcaaatcaatgttcaacccactcagatgacctttcaacccatttccccgccgatg

SEQ ID NO: 174186 - DNA, 75 bp, Artificial Sequence
  Synthetic
cagggtcagaattatgtctatagcaataatatgatcaatcccatcaaacctagatcaattatcaaatcacatggt

SEQ ID NO: 174187 - DNA, 75 bp, Artificial Sequence
  Synthetic
cattcgatgggggagatgtcatttgcagaccattccttgtatgttaatgctcaaccgcctgtccaacagcctcaa

SEQ ID NO: 174188 - DNA, 75 bp, Artificial Sequence
  Synthetic
cttaaatcccttgtaggtatgcatccatgcatgaccgctacctcacagggtaaatatcagacaaataaaactgtg

SEQ ID NO: 174189 - DNA, 75 bp, Artificial Sequence
  Synthetic
gggccaccctctatttcagcttcccaaattactacgggaaatgccggtataagacccggggaatatcagtctgtc

SEQ ID NO: 174190 - DNA, 75 bp, Artificial Sequence
  Synthetic
aagacccggggaatatcagtctgtccataatcaatcttctgtaaacgggtctaagtcttatgagatcactacggc

SEQ ID NO: 174191 - DNA, 75 bp, Artificial Sequence
  Synthetic
atctggcgatgaatggatactgactacacccggcgggcaatcctggactctgaaacggaacccccctaatcctcc

SEQ ID NO: 174192 - DNA, 75 bp, Artificial Sequence
  Synthetic
gaataacagaactaattcagttgtcaacaaggcacaacaggtctcgcatgcccaaccttatgtctctgggtctag

SEQ ID NO: 174193 - DNA, 75 bp, Artificial Sequence
  Synthetic
cgacggtttctatcagggggctgctctccaatcatgtgcgtatgtaaatacgccaggtttcactcctgtgtgcga

SEQ ID NO: 174194 - DNA, 75 bp, Artificial Sequence
  Synthetic
aacacagaatatgaacaactcacaggcgacacaactaagcgcatccatgaactgcataaatgcgttacaaactac

SEQ ID NO: 174195 - DNA, 75 bp, Artificial Sequence
  Synthetic
tatggatgcgattgtcacttctacttccaagccggtgggggcggtatcaaataatcggggtgctaattttggaat

SEQ ID NO: 174196 - DNA, 75 bp, Artificial Sequence
  Synthetic
gggaggcatggagaattatatggataataacagtccatggaaccaatactgtaaagttcaagacattgtatctca

SEQ ID NO: 174197 - DNA, 75 bp, Artificial Sequence
  Synthetic
aaactgctcccagggaaaagttgtttcttcgacaccgggaatcgctcctaatctgatgaagggcaacgggttgaa

SEQ ID NO: 174198 - DNA, 75 bp, Artificial Sequence
  Synthetic
tgtttatggccatgtggggtgtgtagatgcggccatttccgataaacaaggtggcaccgctaacgtcgcatcttc

SEQ ID NO: 174199 - DNA, 75 bp, Artificial Sequence
  Synthetic
tctattgaatccggaacatcaagattggatgcgggtgaccgggacgagcacaaatctgttaaacaatataaatgc

SEQ ID NO: 174200 - DNA, 75 bp, Artificial Sequence
  Synthetic
tgaaacaaaaatggagaactatggttttccggaaaatgggaatgtccacggagccgtcaatacagctttaccact

SEQ ID NO: 174201 - DNA, 75 bp, Artificial Sequence
  Synthetic
aactctatccagtggtcagccctacacatctgtgccacaacatggcgcatgtgaaggaaatggaacaattcccgt

SEQ ID NO: 174202 - DNA, 75 bp, Artificial Sequence
  Synthetic
ggtacagatctgcagtcccaatacagcgttcaaagcgcactacagtttgctcggtacagtggatgaaaacaaccc

SEQ ID NO: 174203 - DNA, 75 bp, Artificial Sequence
  Synthetic
cttgtccgtcagagagagcatacaggacacaagttttagtaatggatgtgctcctcagttgtcctcgcctggagg

SEQ ID NO: 174204 - DNA, 75 bp, Artificial Sequence
  Synthetic
aaacccgacaataattgcacattcaatgattggaaataacggaaccccgaataaagatgtatgcaagcctacccc

SEQ ID NO: 174205 - DNA, 75 bp, Artificial Sequence
  Synthetic
cagcctacgtgcaataaaaaaattaaactttgactatgatgaccgaggggaaaatataggatttccttccaaatt

SEQ ID NO: 174206 - DNA, 75 bp, Artificial Sequence
  Synthetic
ggcagcccttctgtctatgggagaaaacatgtcaaagatggacaatccttgttatggaacttctctagcgcagtt

SEQ ID NO: 174207 - DNA, 75 bp, Artificial Sequence
  Synthetic
cgaggaatcacatcagcagaatgcatcggagggtaaaatatccattgcggatttagagttttctgaagaagatga

SEQ ID NO: 174208 - DNA, 75 bp, Artificial Sequence
  Synthetic
atttagagttttctgaagaagatgatgtgctttccagtgcagcctctgtcagctgtaatgacaactgcgtcatga

SEQ ID NO: 174209 - DNA, 75 bp, Artificial Sequence
  Synthetic
agatcggagcttcgcagcaaggtaccactgtggctgatttacaacaagggtttaagcaacaaatgaacggagaat

SEQ ID NO: 174210 - DNA, 75 bp, Artificial Sequence
  Synthetic
tctccatgtttgcagtggatgggaacattaaaacacaggagatgtcgaatgactgcgcgtcaaacgtcacggata

SEQ ID NO: 174211 - DNA, 75 bp, Artificial Sequence
  Synthetic
atgcatgcgccattcgacaaaataaacgtatgcactgtgaaattgggatttcagaggatggccgggtgcgggaag

SEQ ID NO: 174212 - DNA, 75 bp, Artificial Sequence
  Synthetic
aggagaaatgctcagacgtcgcaattcacgttccgcggaaaagtgcgcgtattcataacatgaagtccgaaggcg

SEQ ID NO: 174213 - DNA, 75 bp, Artificial Sequence
  Synthetic
tgacttgcggtatgtgtgtgacggctgcggattccacacggcaggatgcgtctggaggttcgagcagcggaacca

SEQ ID NO: 174214 - DNA, 75 bp, Artificial Sequence
  Synthetic
agaaaggcgaaaagttgcaaggactttggaagggataccaggatgacgacgattcggaattaaccgaactgtcgg

SEQ ID NO: 174215 - DNA, 75 bp, Artificial Sequence
  Synthetic
atacagacagcgacaacgatgtccaaaactgtcacggagtaagaaagaccggttccaagacgtactcctcagtat

SEQ ID NO: 174216 - DNA, 75 bp, Artificial Sequence
  Synthetic
tttttaatcctgactatcgccaagccaagagattgcttgccgacattccatacagaagatggattccggacacat

SEQ ID NO: 174217 - DNA, 75 bp, Artificial Sequence
  Synthetic
tcaacatggaagaacacgagggtccattccttccaatagtgactagaccacccactgtgtttatgggcggtagac

SEQ ID NO: 174218 - DNA, 75 bp, Artificial Sequence
  Synthetic
gccggaggacttacctccggcgaagtgtcacctctatcggtcctctgagtaaattaacttacttcaaggaattac

SEQ ID NO: 174219 - DNA, 75 bp, Artificial Sequence
  Synthetic
tgcagagctacgtgttgagaaatagcaactgttatttaagtatcggttggcctgccaaacacagggtgtatatca

SEQ ID NO: 174220 - DNA, 75 bp, Artificial Sequence
  Synthetic
tgtcagaagagaaattggggtataatcatatacctaccttgagggagatgtttccactgccacccggatggatga

SEQ ID NO: 174221 - DNA, 75 bp, Artificial Sequence
  Synthetic
ttgtccttggaattgtcggttcagagacgcccgcggctctgtataaacacatggtggttctcctgtgtgaaaata

SEQ ID NO: 174222 - DNA, 75 bp, Artificial Sequence
  Synthetic
aatgggtgcttctgcataattaccgggactctaaacacgagctgtatttcgccgcctcggatttgaaacagttta

SEQ ID NO: 174223 - DNA, 75 bp, Artificial Sequence
  Synthetic
tggaggagggtctgtctagatgtgactgcatatattatgaaaagtcagtgccgtacggcgtggccatggaagact

SEQ ID NO: 174224 - DNA, 75 bp, Artificial Sequence
  Synthetic
ctgttcgagagttcttgagaaacagtaaaacgtttcagagtcttatggagtataggaagaatatgcacggatcta

SEQ ID NO: 174225 - DNA, 75 bp, Artificial Sequence
  Synthetic
cctggacctttaacggaatgcctggtagactgggcgacagagttatacatatctgcaatcctgaattggttaact

SEQ ID NO: 174226 - DNA, 75 bp, Artificial Sequence
  Synthetic
caatcccggcagacgaggccatcagatatgaaggaaaacctttgtatttctttgcatttgtcaccactttcaaat

SEQ ID NO: 174227 - DNA, 75 bp, Artificial Sequence
  Synthetic
cgcaccccggtagcaaggccaacgtattgatcgctgcggataagaacttagggatatacggctatcataaaggtc

SEQ ID NO: 174228 - DNA, 75 bp, Artificial Sequence
  Synthetic
gccccaggatacggtacttgtgcaagaacgtacaggctttttttagagccggagttagaaagatgtatttggatt

SEQ ID NO: 174229 - DNA, 75 bp, Artificial Sequence
  Synthetic
ggagttagaaagatgtatttggattatgagattccatcgaaaacgttgcttgccgtcagcgaagatgactatctg

SEQ ID NO: 174230 - DNA, 75 bp, Artificial Sequence
  Synthetic
tgtattctacaaaaagctccttgtctgctcttaaaaccagctgtgtttagaaagactttctctcaggaaggtaaa

SEQ ID NO: 174231 - DNA, 75 bp, Artificial Sequence
  Synthetic
aaagactttctctcaggaaggtaaataagaattgctatgtcaagagttttccttgacagttcccaccctcttttt

SEQ ID NO: 174232 - DNA, 75 bp, Artificial Sequence
  Synthetic
taattaaaacagaaaggccattggattccatccgctaagagatttactgtttctttgacatttaccagagatacg

SEQ ID NO: 174233 - DNA, 75 bp, Artificial Sequence
  Synthetic
tgatactcggtctactgtgtattgtgtaccttgtaatctctaggtaaacttctgctatttttttaatgttgagta

SEQ ID NO: 174234 - DNA, 75 bp, Artificial Sequence
  Synthetic
attggacattgttgataggtaaactgttctttcaaaatgaccagagattctatgtactgatctctttgttttttt

SEQ ID NO: 174235 - DNA, 75 bp, Artificial Sequence
  Synthetic
ttttctgtgtattgtgatagggaaggtttgtaaggacaaaggacaaagttcagtaagatttaataaaataacatg

SEQ ID NO: 174236 - DNA, 75 bp, Artificial Sequence
  Synthetic
gtttgtaaggacaaaggacaaagttcagtaagatttaataaaataacatgtgacacaatttctgactctctttca

SEQ ID NO: 174237 - DNA, 75 bp, Artificial Sequence
  Synthetic
gtaatttttttattttaataatgtccgttgccataaggtgagggcaacgtagggtctgagggataaaaaagtaat

SEQ ID NO: 174238 - DNA, 75 bp, Artificial Sequence
  Synthetic
tcgttcatatgagtagtcggataaaacatttgtagttttttctctaaaacataacgattatctcgatgacattca

SEQ ID NO: 174239 - DNA, 75 bp, Artificial Sequence
  Synthetic
taccggaataaatccgatataaacgtttccatctgtagatatcttggcccgtttttgtgtgctgacatagcactt

SEQ ID NO: 174240 - DNA, 75 bp, Artificial Sequence
  Synthetic
gtttttgtgtgctgacatagcactttcggttaaattttctatcacagctcttccgtagtcacttaaaaaaaagca

SEQ ID NO: 174241 - DNA, 75 bp, Artificial Sequence
  Synthetic
aaaaaaaaagacatatgaaattttatagtaggcctacctgcaatttatataagtacggatgaaaacaaagaaaca

SEQ ID NO: 174242 - DNA, 75 bp, Artificial Sequence
  Synthetic
aacatagtggaaataaaatgattcgcatatgaattaatacctaatgactagattgaaatccatccatgttacgga

SEQ ID NO: 174243 - DNA, 75 bp, Artificial Sequence
  Synthetic
ccagggtctttgaacttggtcttgcatagtatatacaattgttctattgtccgtgaaaggtcgacaaaatttctg

SEQ ID NO: 174244 - DNA, 75 bp, Artificial Sequence
  Synthetic
gcctgcattttgaaacagactgaacaaatatcaagttatagattaaccggcgatgtcctgtgttattacgcatac

SEQ ID NO: 174245 - DNA, 75 bp, Artificial Sequence
  Synthetic
tatacgcgtatacatccacatacacgcacacacgagaaaatggtgtattaatcattcaagtttacccgtggtgac

SEQ ID NO: 174246 - DNA, 75 bp, Artificial Sequence
  Synthetic
attttccccgagtagatagaacgacacttacatttcaccgtctaggcaggtcggagtcgaggaagatacagaact

SEQ ID NO: 174247 - DNA, 75 bp, Artificial Sequence
  Synthetic
cagtgaattaagaacgacatagtgatcacaacacgaagtaatcttcggtaacgtgctaaaaaacggtagcgcagc

SEQ ID NO: 174248 - DNA, 75 bp, Artificial Sequence
  Synthetic
cactccaggatatgcatggaaatgtgttaaaatatacacagccacgaaatgcataattatctagcagcaatagtt

SEQ ID NO: 174249 - DNA, 75 bp, Artificial Sequence
  Synthetic
gttaaaatatacacagccacgaaatgcataattatctagcagcaatagtttgttatttaaacaatgattttttta

SEQ ID NO: 174250 - DNA, 75 bp, Artificial Sequence
  Synthetic
tgttcatttaaatatagtatgaatatttacaactaaatatacaatcgactatacacatggtcgataacgcactat

SEQ ID NO: 174251 - DNA, 75 bp, Artificial Sequence
  Synthetic
tacatgcgttccaaaaaacaggtttatcgggggttatcgttatctacatccataaagtgtacaagtccacatgta

SEQ ID NO: 174252 - DNA, 75 bp, Artificial Sequence
  Synthetic
cataaagtgtacaagtccacatgtaaacatcacaggaaaatatagaagtccgaggccgtgtacatccaaacgcgc

SEQ ID NO: 174253 - DNA, 75 bp, Artificial Sequence
  Synthetic
gcaaataacggtcaggttctcacgacagtaggttctgtagctgccattttgatgttctgaaagtatacatctctc

SEQ ID NO: 174254 - DNA, 75 bp, Artificial Sequence
  Synthetic
gggttgtaaaatacgtgcccaccctcgcataaagcttgtccgaggtgttcatatccatatatttttttttcgaac

SEQ ID NO: 174255 - DNA, 75 bp, Artificial Sequence
  Synthetic
atattttgtttactatatctcgcttgcacagtgaagatgttgttaaccatcagtagtcccgcatttctgaaacgt

SEQ ID NO: 174256 - DNA, 75 bp, Artificial Sequence
  Synthetic
cagtagtcccgcatttctgaaacgttgttttgaagttccggtctgtataaagatggtgctgcggattaagaaaaa

SEQ ID NO: 174257 - DNA, 75 bp, Artificial Sequence
  Synthetic
agatggtgctgcggattaagaaaaactgcataaatataaaaaaaaactctggaaaagtcatttgtttaattatgg

SEQ ID NO: 174258 - DNA, 75 bp, Artificial Sequence
  Synthetic
ctgcataaatataaaaaaaaactctggaaaagtcatttgtttaattatggcctttcgtcttctaatccaaagaaa

SEQ ID NO: 174259 - DNA, 75 bp, Artificial Sequence
  Synthetic
cctttcgtcttctaatccaaagaaagtgaaattaaacgtaaaaaaaaactctacatttagattcatagtttaaca

SEQ ID NO: 174260 - DNA, 75 bp, Artificial Sequence
  Synthetic
ctacatttagattcatagtttaacagcgctcaccataatgcgggactcatatgtgtcggactggctatatcgtat

SEQ ID NO: 174261 - DNA, 75 bp, Artificial Sequence
  Synthetic
tttatattagtcgttgtcagtttttctggcaaagagtgccacaatgcgcttacgatggccggatctatgttgctg

SEQ ID NO: 174262 - DNA, 75 bp, Artificial Sequence
  Synthetic
tgcataaccgaaaaaagcgaaaaaaataaattaatataactggttactaaaaaaaaaattcgctcctaccaatcc

SEQ ID NO: 174263 - DNA, 75 bp, Artificial Sequence
  Synthetic
cctattatttaaactcaccgtatagatgttcctcgctgtccgaccagtgacaatatttgtgaggcaagtcgcatt

SEQ ID NO: 174264 - DNA, 75 bp, Artificial Sequence
  Synthetic
ccgatggtttccatcagttcctcagtttcgtacagtgcatttttaaacgctctgtgagaaacacaagttaagaaa

SEQ ID NO: 174265 - DNA, 75 bp, Artificial Sequence
  Synthetic
tttcgtacagtgcatttttaaacgctctgtgagaaacacaagttaagaaatctcaaatataaactctttcaaacg

SEQ ID NO: 174266 - DNA, 75 bp, Artificial Sequence
  Synthetic
tctcaaatataaactctttcaaacgatacatcgcagatagataaactccaacttacgttcaaagaagagaaaata

SEQ ID NO: 174267 - DNA, 75 bp, Artificial Sequence
  Synthetic
atacatcgcagatagataaactccaacttacgttcaaagaagagaaaataagtttacttacagtacagaagataa

SEQ ID NO: 174268 - DNA, 75 bp, Artificial Sequence
  Synthetic
ataattcttcgtgtcgttcttattcaaacgtgaacaccattcgtgaccttgcagggtttgaaatctgacgaaaaa

SEQ ID NO: 174269 - DNA, 75 bp, Artificial Sequence
  Synthetic
aaaagcgaatttcgaaattagaatttcagaattgtgttccactgctatgtagcaaaaccaataaaaaacatagat

SEQ ID NO: 174270 - DNA, 75 bp, Artificial Sequence
  Synthetic
tcagaattgtgttccactgctatgtagcaaaaccaataaaaaacatagatggagttttttattaaaattggcatg

SEQ ID NO: 174271 - DNA, 75 bp, Artificial Sequence
  Synthetic
aatcactcacacgacgtagctatcgtttggacaatgattatcgtttatagggacgtatgcgtcaacgacgtcctg

SEQ ID NO: 174272 - DNA, 75 bp, Artificial Sequence
  Synthetic
ccacggttcgaaatactcagtccgagtccatgagttagaagattgtaacgtaggacgatcatggtgcacgtctcg

SEQ ID NO: 174273 - DNA, 75 bp, Artificial Sequence
  Synthetic
gggaggacaacatgtgccattggcggcaggtttagacctcaatatgtcctctatgctaacggacgcgaagcgcgt

SEQ ID NO: 174274 - DNA, 75 bp, Artificial Sequence
  Synthetic
gcaggtttcccaatcttgcccgtcgctgtcttttcgaacgatcgcaaacgaggttaacgttttgatagtctgtcc

SEQ ID NO: 174275 - DNA, 75 bp, Artificial Sequence
  Synthetic
gccatggttttgtatcttcaagagttcgatattgacgatcagttcgctggattttgagtggatgaatacatgtgt

SEQ ID NO: 174276 - DNA, 75 bp, Artificial Sequence
  Synthetic
attttgagtggatgaatacatgtgtgccgcacaaagaggcaagatacaaggaacgagaaaaaattttcttgttac

SEQ ID NO: 174277 - DNA, 75 bp, Artificial Sequence
  Synthetic
gccgcacaaagaggcaagatacaaggaacgagaaaaaattttcttgttacgaaggcttccagccccatagtttct

SEQ ID NO: 174278 - DNA, 75 bp, Artificial Sequence
  Synthetic
gctctgaaaggatgtaggtatgcgtgtggggttgacacgtatgcgcgtacatgggtgtggtctgtcttctaagag

SEQ ID NO: 174279 - DNA, 75 bp, Artificial Sequence
  Synthetic
ggggtggagtggagggtggaggagaagtgctgcgacatttttagagtgacaggtgcatccgagggcggggcgggg

SEQ ID NO: 174280 - DNA, 75 bp, Artificial Sequence
  Synthetic
tgtataaatgggactctttttagcgaattcgggatatttatacggcggggatcttacgcttttctatgtgaataa

SEQ ID NO: 174281 - DNA, 75 bp, Artificial Sequence
  Synthetic
atacacaatgcatgcctttccttgtcgataaaggagacgtggcgggaaggcacaaaaacttgtacaagtactcac

SEQ ID NO: 174282 - DNA, 75 bp, Artificial Sequence
  Synthetic
catcgagccttttccagtctgtagttctggcgtagctccaatttactagtcattggacaaaaagctatcgccgtc

SEQ ID NO: 174283 - DNA, 75 bp, Artificial Sequence
  Synthetic
atcgcggttagtggtttcaggcgttccatataggccaaactattatagttgctcccgaaagcgccatatagcaga

SEQ ID NO: 174284 - DNA, 75 bp, Artificial Sequence
  Synthetic
gagaagtgaaggccgaggccgctagagagaatctgtgatagacccataggcattattctgctttttaaatttctc

SEQ ID NO: 174285 - DNA, 75 bp, Artificial Sequence
  Synthetic
actcctctgctttcggccgagaggggaacgcagattatgatatctccgaacatgatgctgcggggaattagatat

SEQ ID NO: 174286 - DNA, 75 bp, Artificial Sequence
  Synthetic
gattattatatattcatttatttgttatctcggcggattccgacatcggtgtccgggagaatgagcgcgtggtaa

SEQ ID NO: 174287 - DNA, 75 bp, Artificial Sequence
  Synthetic
tatctcggcggattccgacatcggtgtccgggagaatgagcgcgtggtaaagaaacaagatgaaataaaataaaa

SEQ ID NO: 174288 - DNA, 75 bp, Artificial Sequence
  Synthetic
cgctagatccttaccgtgcctctgtctctatgagacaaccgcagctgttatcatcgcaaatggcgtagttcagga

SEQ ID NO: 174289 - DNA, 75 bp, Artificial Sequence
  Synthetic
ggtcttctatatcttctaaggtagtagttggggtataatctacggggacaaaagctttaaggcctcctagacgtg

SEQ ID NO: 174290 - DNA, 75 bp, Artificial Sequence
  Synthetic
acatttcggaggtagaaaatttagagatgatttcgggtagcgttcgtcttctgggcgtaggatttgtaccgtcgt

SEQ ID NO: 174291 - DNA, 75 bp, Artificial Sequence
  Synthetic
aaatgttaaaataaatgctgtcgtcatagtattttgcggtatagttgtcttcgtcgtccggcggcggtgtggatt

SEQ ID NO: 174292 - DNA, 75 bp, Artificial Sequence
  Synthetic
ccacggttcccgcatctcggtggaccgtagcattcgacagggctgtcgccatggaaatcgcgcacacgagtatcg

SEQ ID NO: 174293 - DNA, 75 bp, Artificial Sequence
  Synthetic
atggaaatcgcgcacacgagtatcggcgcagaacgtctcggcggtctcatagcgcttagcgttgcgttcgccgtt

SEQ ID NO: 174294 - DNA, 75 bp, Artificial Sequence
  Synthetic
ctccgtcttagtcttgcgaaaatgcgtatgcgcgggaggaagaggacagaaaggaagatggtgttagataagatc

SEQ ID NO: 174295 - DNA, 75 bp, Artificial Sequence
  Synthetic
aaggaagatggtgttagataagatctacaggaggagaaacgggagacagatcctacgaggacgggagagcataat

SEQ ID NO: 174296 - DNA, 75 bp, Artificial Sequence
  Synthetic
tcctacgaggacgggagagcataatagagcggtttgcatccggaaacattcgcgtgaatgtaaagccacaagaaa

SEQ ID NO: 174297 - DNA, 75 bp, Artificial Sequence
  Synthetic
agagcggtttgcatccggaaacattcgcgtgaatgtaaagccacaagaaattaatgcaactagagacttcccaaa

SEQ ID NO: 174298 - DNA, 75 bp, Artificial Sequence
  Synthetic
ttaatgcaactagagacttcccaaagatgatatatggctacgagcaacgtctggcgcgttcacactcgtttaccg

SEQ ID NO: 174299 - DNA, 75 bp, Artificial Sequence
  Synthetic
ctggcgcgttcacactcgtttaccgtgtgtgactgagacacgtagtattgaatctccgccttgtaaaatcacacg

SEQ ID NO: 174300 - DNA, 75 bp, Artificial Sequence
  Synthetic
tgggtggaaagatcgtgcggcgtatcgtcgtcggggagcgtactcggagataagtctggggcgatcatttttatc

SEQ ID NO: 174301 - DNA, 75 bp, Artificial Sequence
  Synthetic
cgtcgtcggggagcgtactcggagataagtctggggcgatcatttttatctgcgacgatataaaacgggggaggg

SEQ ID NO: 174302 - DNA, 75 bp, Artificial Sequence
  Synthetic
gggtggtataaatcgataacgaggaagaaatacatctgatcgtcatttggcgatcagtagtttgtcggtgatttc

SEQ ID NO: 174303 - DNA, 75 bp, Artificial Sequence
  Synthetic
agaaatacatctgatcgtcatttggcgatcagtagtttgtcggtgatttcttccgtaaccggcgtgtgtgtagac

SEQ ID NO: 174304 - DNA, 75 bp, Artificial Sequence
  Synthetic
ttccgtaaccggcgtgtgtgtagactctcgttttggtggtcagatattaagtcttgatcacgcgcgtacccgcgc

SEQ ID NO: 174305 - DNA, 75 bp, Artificial Sequence
  Synthetic
gttgtagcggcttctcgggtgtcttttattttcaccccgcaggctgaaccgcactccggccgggccacttctttt

SEQ ID NO: 174306 - DNA, 75 bp, Artificial Sequence
  Synthetic
catacaggcgttgtctgtctgctccggggagctgggctgcactcgggccgggacatttattcccatacaggcgct

SEQ ID NO: 174307 - DNA, 75 bp, Artificial Sequence
  Synthetic
gctttctctgttttgggaggtcggactgcgctcgtgccgggacacttattcccatacaggcgctgctcttctgct

SEQ ID NO: 174308 - DNA, 75 bp, Artificial Sequence
  Synthetic
ttgggaggtcggactgcgctcgggccggaacacttattcccatacaggcgctgcttctctgctttgggaggtcgg

SEQ ID NO: 174309 - DNA, 75 bp, Artificial Sequence
  Synthetic
tctgcgctcgggtcgggacacttattcccatacaggcgctgcttctctgcatcgggaagtcggactgcgctcggg

SEQ ID NO: 174310 - DNA, 75 bp, Artificial Sequence
  Synthetic
atcgggaagtcggactgcgctcgggccgggacacttttttgtgcgatactgttgctctggaagacagatattcct

SEQ ID NO: 174311 - DNA, 75 bp, Artificial Sequence
  Synthetic
gccctaaccctaaccctaggtctaaccctaaccctaaccctaaccctaggtctaaccctaaccctaaccctaacc

SEQ ID NO: 174312 - DNA, 75 bp, Artificial Sequence
  Synthetic
taaccctaaccctaaccctaggtctaaccctaaccctaaccctaaccctaggtctaaccctaaccctaaccctaa

SEQ ID NO: 174313 - DNA, 75 bp, Artificial Sequence
  Synthetic
ggtcgacactcccttcgtcatgtccattcctaccttcgcctgcgcaaaggtctacgccttcctttaccttggccc

SEQ ID NO: 174314 - DNA, 75 bp, Artificial Sequence
  Synthetic
tctgtccgtcccctcgccgtccaccgcgcgtgtccgtttctccctctcctccctctcctcctcctcctcctcctc

SEQ ID NO: 174315 - DNA, 75 bp, Artificial Sequence
  Synthetic
ggtgagtgagcgccgccgcgaccggcgacgctatgcgcacacgggcgagcggcggggagggacgtcggccgcagg

SEQ ID NO: 174316 - DNA, 75 bp, Artificial Sequence
  Synthetic
cgggtggagggtgagcgggtggagggttcgtcgaaaaccaccgaagacattggctggcggagagtggggacaaaa

SEQ ID NO: 174317 - DNA, 75 bp, Artificial Sequence
  Synthetic
gagacgcagacgccgtcgcctccgataggcagcggaggcgtgattctgggaaacgtgcccacgccggggccacgc

SEQ ID NO: 174318 - DNA, 75 bp, Artificial Sequence
  Synthetic
aacgcgcgcgcgcgcgcctctatgggaggcgccgtgtttttcaccaaaaacgcgcgccactgcaagaggggggtg

SEQ ID NO: 174319 - DNA, 75 bp, Artificial Sequence
  Synthetic
cctaaccctaaccctaaccctaggtctaaccgtaaccctaaccctaggtctaaccatagccctaaccatagccct

SEQ ID NO: 174320 - DNA, 75 bp, Artificial Sequence
  Synthetic
aaccatagccctaaccataaccctaaccatagccctaaccatagccctaaccatagcactaaccatagccctaac

SEQ ID NO: 174321 - DNA, 75 bp, Artificial Sequence
  Synthetic
cctagccctaaccatagccctaacactaatcctcgcatctggccctaacactacccctctttcaaccactcacca

SEQ ID NO: 174322 - DNA, 75 bp, Artificial Sequence
  Synthetic
tcaccccacccgctgcccccccccacacacacacacacacacacacaccgccaccgctaccaccacctctgaact

SEQ ID NO: 174323 - DNA, 75 bp, Artificial Sequence
  Synthetic
tcaccttttccctccatctcgccccacttctctctacacttctccgcccctctattcttactcctgttttctagg

SEQ ID NO: 174324 - DNA, 75 bp, Artificial Sequence
  Synthetic
atgccgctgccggcgcgtgtcagccacgccctgcatcgtcttccgctgtcccactattggtggctactgttgggt

SEQ ID NO: 174325 - DNA, 75 bp, Artificial Sequence
  Synthetic
cgacactcccttcgtcatgtccattcctaccttcgcctgcacaaaggtctacgccttcctttaccttggcccgag

SEQ ID NO: 174326 - DNA, 75 bp, Artificial Sequence
  Synthetic
caagaatgcctgcatttacatcctaagccttacaagtttctcctgcgttacccttgtctaacaagacaaccgcat

SEQ ID NO: 174327 - DNA, 75 bp, Artificial Sequence
  Synthetic
atttcggtttctcttttatacatttgtctctattctctcggtctcagggttcgaccctaaaccctaccatcttcg

SEQ ID NO: 174328 - DNA, 75 bp, Artificial Sequence
  Synthetic
gccgacagcaagttgctaccgctgggcctgatcacgctgtccgccttttccatgcgcgtttctgagccgacacac

SEQ ID NO: 174329 - DNA, 75 bp, Artificial Sequence
  Synthetic
aacgaggacgaaaggaggggaatacaccggagaccgagcggcggatggagcccgctcggttttgcacgtccgcga

SEQ ID NO: 174330 - DNA, 75 bp, Artificial Sequence
  Synthetic
taccgagcggactccgtcgccgctccggaccctccacgcccctccgtccaggacccgaggtccgacacgccccca

SEQ ID NO: 174331 - DNA, 75 bp, Artificial Sequence
  Synthetic
cctcgcgcacctcctccgccaccaccgctgacagtcaccgcatatcacccccatacacacccagcagcagaggcc

SEQ ID NO: 174332 - DNA, 75 bp, Artificial Sequence
  Synthetic
cgctgacagtcaccgcatatcacccccatacacacccagcagcagaggccggcgcacacacacgcgcggagcacg

SEQ ID NO: 174333 - DNA, 75 bp, Artificial Sequence
  Synthetic
ctatccttcctccctgggtacggtccacacgccagtctgcggagtcacctgagggccggatccgctccgcgcccc

SEQ ID NO: 174334 - DNA, 75 bp, Artificial Sequence
  Synthetic
cacagatgcaaccgatgacaaaaaaaaacacaccaccacaagcaaacgctcgccggcccgttcaccgtccctctc

SEQ ID NO: 174335 - DNA, 75 bp, Artificial Sequence
  Synthetic
gtcggcgggcagtcccccgaacgcctccacggcaacgctcctcccacgccccctcggtcccccccccccctccct

SEQ ID NO: 174336 - DNA, 75 bp, Artificial Sequence
  Synthetic
aattttgttgtaaataaaaaaaaaatactatgtggaaattaaaaataaaaaaaaaatgaaaataaaggctaaaca

SEQ ID NO: 174337 - DNA, 75 bp, Artificial Sequence
  Synthetic
tacgtcccctttcaataaatggcggacccgacctctccataaacggagacacgccgggagactccggccctccca

SEQ ID NO: 174338 - DNA, 75 bp, Artificial Sequence
  Synthetic
acccgacctctccataaacggagacacgccgggagactccggccctcccaatccacaggtagcccgagacctaat

SEQ ID NO: 174339 - DNA, 75 bp, Artificial Sequence
  Synthetic
cacagaacaccgcggtccgtcgtcaccgttcaaccgcgcggtagttccgcgattctatggttcatctccgctcac

SEQ ID NO: 174340 - DNA, 75 bp, Artificial Sequence
  Synthetic
agcgttctctttcttttatttttcactgagccgctccaccaccaagagtgttactgactacaccgtatacatgtt

SEQ ID NO: 174341 - DNA, 75 bp, Artificial Sequence
  Synthetic
tttttatctctccacccctccccatcacagaccatcaaacaccttgccgtatcgacactgactatactcgaccgc

SEQ ID NO: 174342 - DNA, 75 bp, Artificial Sequence
  Synthetic
atcgacactgactatactcgaccgcggatgacaacggtcgttggtcacaacaagagctacagcggacagcaaaaa

SEQ ID NO: 174343 - DNA, 75 bp, Artificial Sequence
  Synthetic
gggcgagcgggtggagggcgagcgggtggagggcgagcgggtggagggcgagcgggtggagggcgagcgggtgga

SEQ ID NO: 174344 - DNA, 75 bp, Artificial Sequence
  Synthetic
gacaaaacaacgtcacgtcaggggcggagaaatatagggtgcgcagaccgtcaaagcgcgagttacggaaaacga

SEQ ID NO: 174345 - DNA, 75 bp, Artificial Sequence
  Synthetic
gtacggatacacggggggggggggggggaaggaaacatggtgaagtctgtgacacgcgtgaccgtcagccggcaa

SEQ ID NO: 174346 - DNA, 75 bp, Artificial Sequence
  Synthetic
cgcctgccacggcctccggcctcacagacgactcacggagtttcctccagacattgttttttttttttgtattca

SEQ ID NO: 174347 - DNA, 75 bp, Artificial Sequence
  Synthetic
acggtacaggcggtatgacttccggaacacgatgattacggatatcctgcatagtgtacaggagaccgctttttt

SEQ ID NO: 174348 - DNA, 75 bp, Artificial Sequence
  Synthetic
ttaggttccgtataaaacgtacgtcggcgacgtacacacaacggttaaaaaaataaaaaaaaaagaggaaacagt

SEQ ID NO: 174349 - DNA, 75 bp, Artificial Sequence
  Synthetic
aaataaaaaaaaaagaggaaacagtaaagctcctcctttcctctgtgttatcgcgttgagttagtagtcgccatt

SEQ ID NO: 174350 - DNA, 75 bp, Artificial Sequence
  Synthetic
acggtacgcgacaggatacgaatgcgttacacgccgcaaaggcatccctacgatgactctatgcggcatctcccg

SEQ ID NO: 174351 - DNA, 75 bp, Artificial Sequence
  Synthetic
gaggcgtgactctgggaaacgtgcccacgccggggccacgcgaagtggagacggcttgggtgatcgtcacctggc

SEQ ID NO: 174352 - DNA, 75 bp, Artificial Sequence
  Synthetic
gggaccgctgttatcgttctggcccgataacggcaagatctgccgtctggcgaactcgttcgccgccctgtggag

SEQ ID NO: 174353 - DNA, 75 bp, Artificial Sequence
  Synthetic
gatgggccgcgggccatgagaggacattggacgtattcggccccgggtagacatctccccgggaacgcttggcca

SEQ ID NO: 174354 - DNA, 75 bp, Artificial Sequence
  Synthetic
ctcctgtgaacacgtgagaccgccggtcggaaaacttccccggcaaagagcgtacctggattagacgccacggcg

SEQ ID NO: 174355 - DNA, 75 bp, Artificial Sequence
  Synthetic
gagacgtaaggatgcgatatacggccagagacatgaccggaggaagatcatgacaaggatctcgaaatataaaac

SEQ ID NO: 174356 - DNA, 75 bp, Artificial Sequence
  Synthetic
aaaaaaaaaaaagtgaggagtgcgcaaacgcaagaaaagaaaaagcagaaccgcggtggagatgtctatccgcct

SEQ ID NO: 174357 - DNA, 75 bp, Artificial Sequence
  Synthetic
cggcgaatgtacacaatcacacacaatgtgcttacgttccgtgttactgacaccacataacaaaaaaaaaacata

SEQ ID NO: 174358 - DNA, 75 bp, Artificial Sequence
  Synthetic
gcccgatgccaacgcgacacggtgagtcgcatagatcgggactgcttgaaagcgcgccacattcgccttttatat

SEQ ID NO: 174359 - DNA, 75 bp, Artificial Sequence
  Synthetic
gtcgcatagatcgggactgcttgaaagcgcgccacattcgccttttatatagacgccccggggagtgggaggagc

SEQ ID NO: 174360 - DNA, 75 bp, Artificial Sequence
  Synthetic
ggagacacatagccttggcgggaagacgataacaggttcaaagatagacagtgaaaaaaaaaaaaagaggagacc

SEQ ID NO: 174361 - DNA, 75 bp, Artificial Sequence
  Synthetic
atgacattgaatacacgtgcggcggcaatccaatcaacgggacgtgccggggcgcaaaaaaaagtatacggaagt

SEQ ID NO: 174362 - DNA, 75 bp, Artificial Sequence
  Synthetic
gcatgcgacagacagtcacgcggaccgacgacaaaggccgactcctagcatggcaactaggaaaaaaaaataagc

SEQ ID NO: 174363 - DNA, 75 bp, Artificial Sequence
  Synthetic
aacgctgcaaaatactaacaaaggaaacatcccttcaccccctccctaccccgtctaccacaatacccccccccc

SEQ ID NO: 174364 - DNA, 75 bp, Artificial Sequence
  Synthetic
ccgtctaccacaatacccccccccctccgtaatcacttctgtccgcgtttctcccacaggcgcgtgcacacgcag

SEQ ID NO: 174365 - DNA, 75 bp, Artificial Sequence
  Synthetic
acacgcagacacgcacacaccacctctatggcagtcgcgggcgggcaggcggggagcatacggggggcagatgta

SEQ ID NO: 174366 - DNA, 75 bp, Artificial Sequence
  Synthetic
aagtcaatgaggaacggcatagcgcgcgacgtgccgtcgtctcggacccttgctattctggcacgacgccaaggg

SEQ ID NO: 174367 - DNA, 75 bp, Artificial Sequence
  Synthetic
gcgacgtgccgtcgtctcggacccttgctattctggcacgacgccaagggaagcctctggcgcaatctataaccc

SEQ ID NO: 174368 - DNA, 75 bp, Artificial Sequence
  Synthetic
ctaaccctaaccctaaccctaacccatcccccaacgcgcgcgcgcgcgcctctatgggaggcgccgtgtttttca

SEQ ID NO: 174369 - DNA, 75 bp, Artificial Sequence
  Synthetic
ccaaaacgcgcgccactgcgagaggcgcgtgaaaaaacctcccctcccggacgggcccgagtcgtccgcgcgtgt

SEQ ID NO: 174370 - DNA, 75 bp, Artificial Sequence
  Synthetic
cgccggtgcgccccgcgcccgggatccccccacctcccccccccaaagaacgggcgagggtatgggggtggatgg

SEQ ID NO: 174371 - DNA, 75 bp, Artificial Sequence
  Synthetic
gtggcgcgagagagggagaagagcggacgcgtgtagaaacggccaacgggcggatgcgcagagcgccccgccggg

SEQ ID NO: 174372 - DNA, 75 bp, Artificial Sequence
  Synthetic
gacgcgtgtagaaacggccaacgggcggatgcgcagagcgccccgccgggcgattgacctttccacagacccccg

SEQ ID NO: 174373 - DNA, 75 bp, Artificial Sequence
  Synthetic
cgtgagcgaaagcatacacacacacgaaaaaatacacacaagaaaatacacacaagaaaatacacacacacaaaa

SEQ ID NO: 174374 - DNA, 75 bp, Artificial Sequence
  Synthetic
atacacacacaaaaaaatacacacacaaaaaaaaatacacacacacaaaaaaatacacacacaaaaaaatacaca

SEQ ID NO: 174375 - DNA, 75 bp, Artificial Sequence
  Synthetic
aaaaaaatacacacacaaaaaaatacacacacacaaaaaaatacacacacataaaaaaatacacacaaaaaaaaa

SEQ ID NO: 174376 - DNA, 75 bp, Artificial Sequence
  Synthetic
ccacgaaaacgaccacaacaacaacagcagcaacagcatcaactacagcaacagacgagggcaggatcacgaggt

SEQ ID NO: 174377 - DNA, 75 bp, Artificial Sequence
  Synthetic
cacgtcgtccgccgatagcggccgggcgacgagagtccgaacgaacgccgtccatttaacctccggtactgccgc

SEQ ID NO: 174378 - DNA, 75 bp, Artificial Sequence
  Synthetic
atcgcaccgcaggtcacgtcccgcagagaaagagcacgaagaagggcagagagcagcagaggccagactccaaga

SEQ ID NO: 174379 - DNA, 75 bp, Artificial Sequence
  Synthetic
agatatgccgagaaacggagagcgacaaaacattttttttctgtgcggaatccgagataaaattaaaaggataaa

SEQ ID NO: 174380 - DNA, 75 bp, Artificial Sequence
  Synthetic
aaaaaaaaaaaacgataacggcagcgttaccggcagtctcacataaacgtctacgatcacgttaaggacgctaca

SEQ ID NO: 174381 - DNA, 75 bp, Artificial Sequence
  Synthetic
cgatctaccacgcttccattctttttttttaaaaaaaaaaacctaaccttcaacgttagggcgaactatcgaact

SEQ ID NO: 174382 - DNA, 75 bp, Artificial Sequence
  Synthetic
cacctttcagaaaccagtaagccggctccgatccgatctccccccttttcttcacgtgccccagtacgacgaggc

SEQ ID NO: 174383 - DNA, 75 bp, Artificial Sequence
  Synthetic
ctccgatccgatctccccccttttcttcacgtgccccagtacgacgaggcgctcccggaaacacactagatcggc

SEQ ID NO: 174384 - DNA, 75 bp, Artificial Sequence
  Synthetic
tcttataagcctacgtctgaggactattcgcttttgacgtctccggtgctcctgcaacctgatgtcaaacgagcc

SEQ ID NO: 174385 - DNA, 75 bp, Artificial Sequence
  Synthetic
attcgcttttgacgtctccggtgctcctgcaacctgatgtcaaacgagccgccgccggccacagcgtaaggaacg

SEQ ID NO: 174386 - DNA, 75 bp, Artificial Sequence
  Synthetic
tattatgtgattcggaaaataattgcaccctatcacctttcttataaaatttttttctcctgatctcacgtcaca

SEQ ID NO: 174387 - DNA, 75 bp, Artificial Sequence
  Synthetic
caccctatcacctttcttataaaatttttttctcctgatctcacgtcacagttttttttttcatatgtctcgcgt

SEQ ID NO: 174388 - DNA, 75 bp, Artificial Sequence
  Synthetic
gtgcatcccccagccacagtacttctaccgtcccatactcccccccgcaaaggcatcgctccactccaacttcta

SEQ ID NO: 174389 - DNA, 75 bp, Artificial Sequence
  Synthetic
aacgtaagaaaaaaaacgaatagcattctgttcttcatcatcaccaagtctaaggtgactcttctctaaaaacta

SEQ ID NO: 174390 - DNA, 75 bp, Artificial Sequence
  Synthetic
aaaaaaaaacacaccatcaattttattcaaccaatctaagatagttttgcattaaacaataaattactgccagaa

SEQ ID NO: 174391 - DNA, 75 bp, Artificial Sequence
  Synthetic
ttgtctactggttaacatgtacaacaacacaattatcttcctgtaaaagaaaaacacatcaatcggcatacagta

SEQ ID NO: 174392 - DNA, 75 bp, Artificial Sequence
  Synthetic
gcttgtcattctctcttcctgtaacaaaataaacaatttatacaatccaattaaagtcccttgtctttgtatcga

SEQ ID NO: 174393 - DNA, 75 bp, Artificial Sequence
  Synthetic
attaagaatcattggctgcttgcccatccgttaggacatctcattcttaacacatatccaatacaatggtaaaaa

SEQ ID NO: 174394 - DNA, 75 bp, Artificial Sequence
  Synthetic
atccgttaggacatctcattcttaacacatatccaatacaatggtaaaaaaacaggattaaaaaacaaacaacga

SEQ ID NO: 174395 - DNA, 75 bp, Artificial Sequence
  Synthetic
acaaatttgaaactttataaaagaacaaacccatttaagacgcggcaacacaattcagtcatctataatccacat

SEQ ID NO: 174396 - DNA, 75 bp, Artificial Sequence
  Synthetic
cactttcgtgcactcttgtaccagcacttgccacatgcatcaagtaaaaacatccaccatccctaaaactaccct

SEQ ID NO: 174397 - DNA, 75 bp, Artificial Sequence
  Synthetic
tactgcaactccggaaatgggtgtggcataatctctaaaagcaccttaagaaaaaaaacagacactgttaacaaa

SEQ ID NO: 174398 - DNA, 75 bp, Artificial Sequence
  Synthetic
aaaaaccaatttatttaaaaaatctctgttcaaatcacctcacagtcatggaaacattttacaaaggcaacattt

SEQ ID NO: 174399 - DNA, 75 bp, Artificial Sequence
  Synthetic
ccagcaagaacaaaaaaccacaacagcaaaaaggtaaaccgagatgcagtaataaacaaagcgctcatagcgggg

SEQ ID NO: 174400 - DNA, 75 bp, Artificial Sequence
  Synthetic
catttttttcgacgattcacattgaaaacgtaaataacaaaagcaataaacaaaatcattgcgatacgcaagccc

SEQ ID NO: 174401 - DNA, 75 bp, Artificial Sequence
  Synthetic
gtcaaaactaaaaaagcaaacgtctttcgtctcttgttccacaaattccacgctgagcgagatgactgcggaggc

SEQ ID NO: 174402 - DNA, 75 bp, Artificial Sequence
  Synthetic
cgctccatctctgtcaagaacgaagtcctagcaccaactcgcgccttctgtgctttaaaaaacaaatgaaatgac

SEQ ID NO: 174403 - DNA, 75 bp, Artificial Sequence
  Synthetic
cccccccgtttcgtatttcaaatcctaaataacccccggggggtaaaaaaagggggggagctaaccctaacccta

SEQ ID NO: 174404 - DNA, 75 bp, Artificial Sequence
  Synthetic
ctagctctcactgtcaccctaacactagctccaagtcatctgttctagatcctatccatatctgccctgactcct

SEQ ID NO: 174405 - DNA, 75 bp, Artificial Sequence
  Synthetic
cctccgtcccgccctcctcctgttctccatgccctgccttctcaacccttcctcttccacgcccacattgcctct

SEQ ID NO: 174406 - DNA, 75 bp, Artificial Sequence
  Synthetic
tccatgccctgccttctcaacccttcctcttccacgcccacattgcctctgcactccgcgctctcttggctgtgc

SEQ ID NO: 174407 - DNA, 75 bp, Artificial Sequence
  Synthetic
gagcgccgccaaatctgttttgccccgcccctgcgcgcgcgggaactgtcggcgccgcgctgctgctagcccgcc

SEQ ID NO: 174408 - DNA, 75 bp, Artificial Sequence
  Synthetic
cgcccctgcgcgcgcgggaactgtcggcgccgcgctgctgctagcccgccttccagagctccctccctccgtctg

SEQ ID NO: 174409 - DNA, 75 bp, Artificial Sequence
  Synthetic
tccatctcttctatcacagactctgtgttacaccacctatgactgctgcaaccacagaacattttgctctccgcg

SEQ ID NO: 174410 - DNA, 75 bp, Artificial Sequence
  Synthetic
tgttacaccacctatgactgctgcaaccacagaacattttgctctccgcgcggcactcaatcgttactggtggct

SEQ ID NO: 174411 - DNA, 75 bp, Artificial Sequence
  Synthetic
ttggtatgcaactacgtcacagctcatcgccaacagttactgccgctgccgtggcccgaacaggaatttctccaa

SEQ ID NO: 174412 - DNA, 75 bp, Artificial Sequence
  Synthetic
tccgcaaccgtgtcgctcaccatctccatcgcggctggccagcggcacacaacacatgtaagctaccgtacatct

SEQ ID NO: 174413 - DNA, 75 bp, Artificial Sequence
  Synthetic
gagacaagcacaagctcgcgcaatgacattaaaacctcccatcattgtcctttcctgtcgctttgccgataacgt

SEQ ID NO: 174414 - DNA, 75 bp, Artificial Sequence
  Synthetic
acattaaaacctcccatcattgtcctttcctgtcgctttgccgataacgtctttgctctatcgcaggtttcgacc

SEQ ID NO: 174415 - DNA, 75 bp, Artificial Sequence
  Synthetic
agtcaagctgcttccgctcggctccatcacccttaccagatcattctccagtgacgagcctcatcctattggtga

SEQ ID NO: 174416 - DNA, 75 bp, Artificial Sequence
  Synthetic
atcacccttaccagatcattctccagtgacgagcctcatcctattggtgatgatgtgcatcacagtcatgaccgg

SEQ ID NO: 174417 - DNA, 75 bp, Artificial Sequence
  Synthetic
gctggctcacaggaacctccccgatcctagtgctgcttcaaggaccggacggcagcatctattgccacgacgtgt

SEQ ID NO: 174418 - DNA, 75 bp, Artificial Sequence
  Synthetic
ccactctgtatcgttgttcgccaggctaggccttcgccactgcgaacctttatatgcggcacccagatggaagca

SEQ ID NO: 174419 - DNA, 75 bp, Artificial Sequence
  Synthetic
gcgagcccgccagcgtccgccaccctcacgcaaacactcgccgtgagtgccacgcacggtctggacgcgttatac

SEQ ID NO: 174420 - DNA, 75 bp, Artificial Sequence
  Synthetic
tataaccaagaactgataataatttattatgaaagtaatactcgataaaggatagtaagcattctggttgaatat

SEQ ID NO: 174421 - DNA, 75 bp, Artificial Sequence
  Synthetic
tcacgcaaacactcgccgtgagtgccacgcacggtctggacgcgttatactcgctgctaaaaatccacagaggaa

SEQ ID NO: 174422 - DNA, 75 bp, Artificial Sequence
  Synthetic
attatgaaagtaatactcgataaaggatagtaagcattctggttgaatatctaacaaatcaatttcatcatatga

SEQ ID NO: 174423 - DNA, 75 bp, Artificial Sequence
  Synthetic
gaacggctacgtcctggacatgatactgacgggccgctcattccaagaagcaccctgccaaaacactcgcacgtc

SEQ ID NO: 174424 - DNA, 75 bp, Artificial Sequence
  Synthetic
ctgacgggccgctcattccaagaagcaccctgccaaaacactcgcacgtccgttaaaacaacgccacatgtaatg

SEQ ID NO: 174425 - DNA, 75 bp, Artificial Sequence
  Synthetic
catggctgtccatcggctacctagtaaagatgccgcacattcacctggcggtgacccgaacatgtctggtcaccg

SEQ ID NO: 174426 - DNA, 75 bp, Artificial Sequence
  Synthetic
aaagatgccgcacattcacctggcggtgacccgaacatgtctggtcaccgccatagatgtccgacaaaactttct

SEQ ID NO: 174427 - DNA, 75 bp, Artificial Sequence
  Synthetic
ctattcctggtcaccggtagtcttttactactgtcgcggccgaccgcagacttgacgtcttggtcatgtttacag

SEQ ID NO: 174428 - DNA, 75 bp, Artificial Sequence
  Synthetic
tactactgtcgcggccgaccgcagacttgacgtcttggtcatgtttacagcaagaacctgtgtggaggaactgtc

SEQ ID NO: 174429 - DNA, 75 bp, Artificial Sequence
  Synthetic
gacagaagaccaagagatgaaacaaagcacaagcaaaaagcaaaatgagaataaaaaactcaacacctcaaaaaa

SEQ ID NO: 174430 - DNA, 75 bp, Artificial Sequence
  Synthetic
agcacaagcaaaaagcaaaatgagaataaaaaactcaacacctcaaaaaaacacacccgcgtatcgtcggcaatt

SEQ ID NO: 174431 - DNA, 75 bp, Artificial Sequence
  Synthetic
aaacgccgccagaagccaggagcccagccgtcctcgccgccgccacccagtctcacaaaactcgagcgatctcga

SEQ ID NO: 174432 - DNA, 75 bp, Artificial Sequence
  Synthetic
ctggaagcgcgtctcttgtccgtgacagctatcctgaaagacacaaagaaaaaaaaaacccagcctcaggcgtag

SEQ ID NO: 174433 - DNA, 75 bp, Artificial Sequence
  Synthetic
gaaagctcgccaaggtctcgcgtaaaagaacagatgtgaacttcagatgtaccaaccaaataatacgggttccgc

SEQ ID NO: 174434 - DNA, 75 bp, Artificial Sequence
  Synthetic
aagaacagatgtgaacttcagatgtaccaaccaaataatacgggttccgctataaaaagtgcacctctattcccg

SEQ ID NO: 174435 - DNA, 75 bp, Artificial Sequence
  Synthetic
ttgtatcataccttgcatgttaaccggatcccgtggatcttacacacatacacacacacacaaacttggtgaggt

SEQ ID NO: 174436 - DNA, 75 bp, Artificial Sequence
  Synthetic
cacacacacacaaacttggtgaggtaaacacagagatctcactaactcataatcccctacacgcttaccaccacc

SEQ ID NO: 174437 - DNA, 75 bp, Artificial Sequence
  Synthetic
caatagtctatcttctttttctttccattcacagccaatgtgcagtactcgtgggtccacaacaacgaaagagac

SEQ ID NO: 174438 - DNA, 75 bp, Artificial Sequence
  Synthetic
ccttagagacacaccaaatacaaccacaaccaaaaaaaaaacagaaaacaacacaaagccaatgagtgcagaaat

SEQ ID NO: 174439 - DNA, 75 bp, Artificial Sequence
  Synthetic
acaaccaaaaaaaaaacagaaaacaacacaaagccaatgagtgcagaaatgctccgcgctgttcagctccagcca

SEQ ID NO: 174440 - DNA, 75 bp, Artificial Sequence
  Synthetic
agacgccggggacattcctcatctcccacttcccctccactcgaaggagagcccagtcccaagagactccaatcg

SEQ ID NO: 174441 - DNA, 75 bp, Artificial Sequence
  Synthetic
gcagacctaaacccagagctaaaacatggagcgaagctttatcccaccggtccttcctcaacatttacgcgtggc

SEQ ID NO: 174442 - DNA, 75 bp, Artificial Sequence
  Synthetic
atggagcgaagctttatcccaccggtccttcctcaacatttacgcgtggctgtctttgagtcgagggtctccgcg

SEQ ID NO: 174443 - DNA, 75 bp, Artificial Sequence
  Synthetic
cacagaggagaactcgtagcattgccatggccgcctaactggagcctggaacttcaccacgatccctatcgagac

SEQ ID NO: 174444 - DNA, 75 bp, Artificial Sequence
  Synthetic
catggccgcctaactggagcctggaacttcaccacgatccctatcgagacgccagagcacaaaccgtttggagtc

SEQ ID NO: 174445 - DNA, 75 bp, Artificial Sequence
  Synthetic
cgtgacagctcgcacggtgcgggactgcggtgagtgtaagcagtgtgacacattgttatcgcaattgtcttaccc

SEQ ID NO: 174446 - DNA, 75 bp, Artificial Sequence
  Synthetic
tgcggtgagtgtaagcagtgtgacacattgttatcgcaattgtcttacccgattaactttttattaatgtattaa

SEQ ID NO: 174447 - DNA, 75 bp, Artificial Sequence
  Synthetic
tgtgttttttgttgttatctacatcccggcagccctcgacacgcatatgtacgtgtgctgcggacgcggagaaaa

SEQ ID NO: 174448 - DNA, 75 bp, Artificial Sequence
  Synthetic
ccggcagccctcgacacgcatatgtacgtgtgctgcggacgcggagaaaagttgcagcccgtcggatacgtacgc

SEQ ID NO: 174449 - DNA, 75 bp, Artificial Sequence
  Synthetic
actcgttacgcgtcctcctcatagccagggacggagcaatgtatgtgcatcacatgagaacggcgcgactgtgcc

SEQ ID NO: 174450 - DNA, 75 bp, Artificial Sequence
  Synthetic
cgcgcgacgagggctgcagcgagaatccgaggtttatgaagatgatgtttccttgccagaccgtcgagtaggttc

SEQ ID NO: 174451 - DNA, 75 bp, Artificial Sequence
  Synthetic
tccgaggtttatgaagatgatgtttccttgccagaccgtcgagtaggttcggcaacggccattcacctgtttgac

SEQ ID NO: 174452 - DNA, 75 bp, Artificial Sequence
  Synthetic
ccttgccagaccgtcgagtaggttcggcaacggccattcacctgtttgacgtaattacccaggcagccgatgtcc

SEQ ID NO: 174453 - DNA, 75 bp, Artificial Sequence
  Synthetic
gtgtcagactcacaccggcgtcagctgccaactgtggtatacagaccacgatccccacaccgtcgctggggcggc

SEQ ID NO: 174454 - DNA, 75 bp, Artificial Sequence
  Synthetic
tgccaactgtggtatacagaccacgatccccacaccgtcgctggggcggcacgcttcacactgacggtcgcacgg

SEQ ID NO: 174455 - DNA, 75 bp, Artificial Sequence
  Synthetic
cacgacgcaaactgctgcagcacctacatccggaccacccacttgggctgtggctgttgtgtgccgtgctcacgt

SEQ ID NO: 174456 - DNA, 75 bp, Artificial Sequence
  Synthetic
acatccggaccacccacttgggctgtggctgttgtgtgccgtgctcacgtacgatgcaaaagagacgaatcgcgc

SEQ ID NO: 174457 - DNA, 75 bp, Artificial Sequence
  Synthetic
gaaaccgtgtgggtgatagttactggcaggggtgccattctaggattctggccagagagcgccaaaatgtgcaga

SEQ ID NO: 174458 - DNA, 75 bp, Artificial Sequence
  Synthetic
gcaggggtgccattctaggattctggccagagagcgccaaaatgtgcagattggcctcgtctatgaaaggactct

SEQ ID NO: 174459 - DNA, 75 bp, Artificial Sequence
  Synthetic
aggtcactggacatacgcagcacccggccggcatagagcgggagaggcctggcctttgtgtgcacactaccaatc

SEQ ID NO: 174460 - DNA, 75 bp, Artificial Sequence
  Synthetic
ggcctttgtgtgcacactaccaatctcctagatagaacaaaattaaaaagattaaaaaaaaaagaaaaaaagtac

SEQ ID NO: 174461 - DNA, 75 bp, Artificial Sequence
  Synthetic
aaaatcaccttcctcgttgccactagagggagtaccgaaagtgtaggcaagaaggccacgctgtaaatgactgtc

SEQ ID NO: 174462 - DNA, 75 bp, Artificial Sequence
  Synthetic
gagggagtaccgaaagtgtaggcaagaaggccacgctgtaaatgactgtcagcgtttggcgctgaaaacattgct

SEQ ID NO: 174463 - DNA, 75 bp, Artificial Sequence
  Synthetic
cgtgattaagattcctttcgttttcaaagtgtgcccgggaggcagacatgccctttctcgtgagacattatgaga

SEQ ID NO: 174464 - DNA, 75 bp, Artificial Sequence
  Synthetic
aaagtgtgcccgggaggcagacatgccctttctcgtgagacattatgagatttgcctgccagagaaccacgtgac

SEQ ID NO: 174465 - DNA, 75 bp, Artificial Sequence
  Synthetic
gtgccctctaggcatgaatgctctttagcgttagccatgaggctagcgtgatcctgtatagtacataagtttcta

SEQ ID NO: 174466 - DNA, 75 bp, Artificial Sequence
  Synthetic
tagcgttagccatgaggctagcgtgatcctgtatagtacataagtttctaagaatatgtttttaacaataatcat

SEQ ID NO: 174467 - DNA, 75 bp, Artificial Sequence
  Synthetic
aattctctgtaaatgaaggcaaattaaacaggatacagacagttgtggcagtggtccgtttcgtctttctgtgtt

SEQ ID NO: 174468 - DNA, 75 bp, Artificial Sequence
  Synthetic
aaacaggatacagacagttgtggcagtggtccgtttcgtctttctgtgttttccttacgcggctgacgaggtaaa

SEQ ID NO: 174469 - DNA, 75 bp, Artificial Sequence
  Synthetic
tgccaccgtagttagcggtggcatactaaaaactccgatagatgcagaacaataacaccgaaaaccacgctgtgg

SEQ ID NO: 174470 - DNA, 75 bp, Artificial Sequence
  Synthetic
ctaaaaactccgatagatgcagaacaataacaccgaaaaccacgctgtggaaccagaccacactttataaacaaa

SEQ ID NO: 174471 - DNA, 75 bp, Artificial Sequence
  Synthetic
ctaaaaataaggcaatgatacacctgactttccattggaaacctgccgtaaccctgaccacaaatcccatgctaa

SEQ ID NO: 174472 - DNA, 75 bp, Artificial Sequence
  Synthetic
gactttccattggaaacctgccgtaaccctgaccacaaatcccatgctaaatcccctgaaacactgccaaacgtc

SEQ ID NO: 174473 - DNA, 75 bp, Artificial Sequence
  Synthetic
ccgcagcaagcttaaactgaggtcacacacgactttaattacggcaacgcacagctgtaagctgcaggaaagata

SEQ ID NO: 174474 - DNA, 75 bp, Artificial Sequence
  Synthetic
aatcaagcgaggttgtagacgttacctacaatgaactacacctctaagcataacctgtcgggcacagtgagacac

SEQ ID NO: 174475 - DNA, 75 bp, Artificial Sequence
  Synthetic
ctacaatgaactacacctctaagcataacctgtcgggcacagtgagacacgcagccgtaaattcaaaactcaacc

SEQ ID NO: 174476 - DNA, 75 bp, Artificial Sequence
  Synthetic
taacctgtcgggcacagtgagacacgcagccgtaaattcaaaactcaacccaaaccgaagtctaagtctcaccct

SEQ ID NO: 174477 - DNA, 75 bp, Artificial Sequence
  Synthetic
taatcctagtccgtaaccgtaaccccaatcctagcccttagccctaaccctagccctaaccctagctctaacctt

SEQ ID NO: 174478 - DNA, 75 bp, Artificial Sequence
  Synthetic
ctaggctgcggccctaaccctagccctaaccctaaccctaatcctaatcctagccctaaccctagggctgcggcc

SEQ ID NO: 174479 - DNA, 75 bp, Artificial Sequence
  Synthetic
cggccctaaccctaaccctaactctagggctgcggccctaaccctaaccctaaccctaaccctagggctgcggcc

SEQ ID NO: 174480 - DNA, 75 bp, Artificial Sequence
  Synthetic
gagaaagacgctgccaaaccgcagctgcagcatgaaggctgagtgcacaattttggctttagtcccataaaggcg

SEQ ID NO: 174481 - DNA, 75 bp, Artificial Sequence
  Synthetic
cagcgcggcgcacagagcgaaggcagcggctttcagactgtttgccaagcgcagtctgcatcttaccaatgatga

SEQ ID NO: 174482 - DNA, 75 bp, Artificial Sequence
  Synthetic
gcggctttcagactgtttgccaagcgcagtctgcatcttaccaatgatgatcgcaagcaagaaaaatgttctttc

SEQ ID NO: 174483 - DNA, 75 bp, Artificial Sequence
  Synthetic
tgtggtcatcactaagttttcaagcttttggcaaggcatgaaaaataacattactattggactgtttatacttat

SEQ ID NO: 174484 - DNA, 75 bp, Artificial Sequence
  Synthetic
ttactattggactgtttatacttatcttcaaatgttcactcacagcagcgaaggggacactagaaaacactccca

SEQ ID NO: 174485 - DNA, 75 bp, Artificial Sequence
  Synthetic
cttcaaatgttcactcacagcagcgaaggggacactagaaaacactcccaagtagaactacgaggcggaacagca

SEQ ID NO: 174486 - DNA, 75 bp, Artificial Sequence
  Synthetic
tttattttctgaaatcatttaatagcatacaagtacggcctctccgaatcgaagctaatctgagagcaaagacaa

SEQ ID NO: 174487 - DNA, 75 bp, Artificial Sequence
  Synthetic
aaaaccccccgcttaaaaaagaatttcataattccgcagctcttccgaagccccccgagaacaacacagatcgct

SEQ ID NO: 174488 - DNA, 75 bp, Artificial Sequence
  Synthetic
tcataattccgcagctcttccgaagccccccgagaacaacacagatcgctaagggtgtctggactgagctcagta

SEQ ID NO: 174489 - DNA, 75 bp, Artificial Sequence
  Synthetic
gacataaactatattctcgtggtaattgaactaccggaacgtggatgcaagtgacgggtaactgcatggcccaag

SEQ ID NO: 174490 - DNA, 75 bp, Artificial Sequence
  Synthetic
cgtttctatcaggaaagcgatagtttttaaagagtctcctggcgcccatggccaaaaaaaccctaaaactacaag

SEQ ID NO: 174491 - DNA, 75 bp, Artificial Sequence
  Synthetic
aacatccagagcgtagacagcacccaagcgatccataagaacccgttgctttcgaagaagaccacgaccgaggca

SEQ ID NO: 174492 - DNA, 75 bp, Artificial Sequence
  Synthetic
aagcgatccataagaacccgttgctttcgaagaagaccacgaccgaggcatcttccgacaaactttccgataacc

SEQ ID NO: 174493 - DNA, 75 bp, Artificial Sequence
  Synthetic
acctccaccgctctccatggtcctccgggacggaaaattcgaacagcacgcctttaggccacggaagaggcacaa

SEQ ID NO: 174494 - DNA, 75 bp, Artificial Sequence
  Synthetic
cgggacggaaaattcgaacagcacgcctttaggccacggaagaggcacaagagccttgtcgaaagcaacagcgaa

SEQ ID NO: 174495 - DNA, 75 bp, Artificial Sequence
  Synthetic
atagggccgaagaaaaaaccccccgaaacgatggactcgaaaaaagcgtacacagggtcaaatctgcgcagacca

SEQ ID NO: 174496 - DNA, 75 bp, Artificial Sequence
  Synthetic
aaacgatggactcgaaaaaagcgtacacagggtcaaatctgcgcagaccacgcttccagagaccataaggggtgt

SEQ ID NO: 174497 - DNA, 75 bp, Artificial Sequence
  Synthetic
cacggaacggttaaatgcataaaattcaccccgatctccaataagcatcaaagcagataaatcagaatagagcac

SEQ ID NO: 174498 - DNA, 75 bp, Artificial Sequence
  Synthetic
tcaccccgatctccaataagcatcaaagcagataaatcagaatagagcaccagaccgatgacccaaacatccaca

SEQ ID NO: 174499 - DNA, 75 bp, Artificial Sequence
  Synthetic
ttaacttgcagacttcgtcttccgaaatgccaagcatctccgaagaggcaaacctcaactcagcgccggaaggcc

SEQ ID NO: 174500 - DNA, 75 bp, Artificial Sequence
  Synthetic
aatgccaagcatctccgaagaggcaaacctcaactcagcgccggaaggccacacgagaggaagtcgatggtgagc

SEQ ID NO: 174501 - DNA, 75 bp, Artificial Sequence
  Synthetic
tctccgaaagatacggtttccgcagcgaagctctgcaaaaacgtggtccagtagacctccggaacaggtgattca

SEQ ID NO: 174502 - DNA, 75 bp, Artificial Sequence
  Synthetic
cgaagctctgcaaaaacgtggtccagtagacctccggaacaggtgattcaactgtattcgattccagattaaaca

SEQ ID NO: 174503 - DNA, 75 bp, Artificial Sequence
  Synthetic
agccgtttccacaccggaatccaaaagcggagaatctgacatactagcaacatgcaaatgatcagagaaaaaaaa

SEQ ID NO: 174504 - DNA, 75 bp, Artificial Sequence
  Synthetic
caatcaaactcatactctaaagcacgaacgctgtttattaattaccatgtcaatttcaaaacccaccagcaaaca

SEQ ID NO: 174505 - DNA, 75 bp, Artificial Sequence
  Synthetic
acttagcaacgaaaaatctgggttccaacatcaggaaacgctgcccgctcatctgctcttgcagccaagaagaga

SEQ ID NO: 174506 - DNA, 75 bp, Artificial Sequence
  Synthetic
ttttcagataaaagcgcgacgaaaaatgacacaatggtttctggcaccatttgggctgagccgcgtaaaaagtgt

SEQ ID NO: 174507 - DNA, 75 bp, Artificial Sequence
  Synthetic
atgacacaatggtttctggcaccatttgggctgagccgcgtaaaaagtgtgatgtttatagaagttacgcacacc

SEQ ID NO: 174508 - DNA, 75 bp, Artificial Sequence
  Synthetic
ttgggctgagccgcgtaaaaagtgtgatgtttatagaagttacgcacaccgacaaacctaaaaacctgaaaactc

SEQ ID NO: 174509 - DNA, 75 bp, Artificial Sequence
  Synthetic
cgggatcgttatcattaaacccataaatttttcccgagcagtcagcgtaaagggaaattctagctccgtctgaaa

SEQ ID NO: 174510 - DNA, 75 bp, Artificial Sequence
  Synthetic
aatttttcccgagcagtcagcgtaaagggaaattctagctccgtctgaaaaacatttcagtccgaagctcgcaaa

SEQ ID NO: 174511 - DNA, 75 bp, Artificial Sequence
  Synthetic
tttatctccgggtcagaaacaaaatgaaaactgtctttcctgtgatgaaacaggatattctctctcgccggccat

SEQ ID NO: 174512 - DNA, 75 bp, Artificial Sequence
  Synthetic
gaaaactgtctttcctgtgatgaaacaggatattctctctcgccggccatcgcaactcaaatttttcaccaagat

SEQ ID NO: 174513 - DNA, 75 bp, Artificial Sequence
  Synthetic
agcgcatgttgtgatagcttcaatctctggatctgatacctcaaattgcagacacttacacaaaacgtatgcgta

SEQ ID NO: 174514 - DNA, 75 bp, Artificial Sequence
  Synthetic
tctggatctgatacctcaaattgcagacacttacacaaaacgtatgcgtacagacatcttttgagacctttcctc

SEQ ID NO: 174515 - DNA, 75 bp, Artificial Sequence
  Synthetic
cgcgacatagttgatcaggaaataacgttgtatgtgcataaacgcggccaactttcccaagtaagataaccacat

SEQ ID NO: 174516 - DNA, 75 bp, Artificial Sequence
  Synthetic
cgttgtatgtgcataaacgcggccaactttcccaagtaagataaccacatcatcagtctcatactcaagttcgta

SEQ ID NO: 174517 - DNA, 75 bp, Artificial Sequence
  Synthetic
taaccaagaacagtaagttcttcaggacaacacaccaacgcggcgtactttttgagcttatcttcctcatatccc

SEQ ID NO: 174518 - DNA, 75 bp, Artificial Sequence
  Synthetic
gacaacacaccaacgcggcgtactttttgagcttatcttcctcatatccctccacaccataagtcaaaacaagtt

SEQ ID NO: 174519 - DNA, 75 bp, Artificial Sequence
  Synthetic
caccctcaaatgcggattcagaaacaaaaacatttttagactattaaaatttgtataaacacgtagaaaatccac

SEQ ID NO: 174520 - DNA, 75 bp, Artificial Sequence
  Synthetic
aaaaacatttttagactattaaaatttgtataaacacgtagaaaatccacgagtttagccttagcagattcaaag

SEQ ID NO: 174521 - DNA, 75 bp, Artificial Sequence
  Synthetic
ataaaaacgttttctcaacgttggcaaccttcaaatcctttttcccgtcaacatgagcaacatattttcgtataa

SEQ ID NO: 174522 - DNA, 75 bp, Artificial Sequence
  Synthetic
aaccttcaaatcctttttcccgtcaacatgagcaacatattttcgtataaacgaattttccttttttaaatcttt

SEQ ID NO: 174523 - DNA, 75 bp, Artificial Sequence
  Synthetic
tcaaaattgaagtcagaccccaaatctgccatacttaaatcgtacctagcgtattaataatctttgtgcaccggt

SEQ ID NO: 174524 - DNA, 75 bp, Artificial Sequence
  Synthetic
ctgccatacttaaatcgtacctagcgtattaataatctttgtgcaccggtttcgcaaaagggcagaaagccaacc

SEQ ID NO: 174525 - DNA, 75 bp, Artificial Sequence
  Synthetic
ggtaaatccgcggtgctgagactctttaaaaagccttttcctcaccgaaactctcctttgtcgcatcctgtgttc

SEQ ID NO: 174526 - DNA, 75 bp, Artificial Sequence
  Synthetic
ttaaaaagccttttcctcaccgaaactctcctttgtcgcatcctgtgttcaaagatcctaacctcaaaagaacct

SEQ ID NO: 174527 - DNA, 75 bp, Artificial Sequence
  Synthetic
cgtttggaaacaaaccactccaaagatgcgtcccatataaattgcaatcttgacaccgaaaaaaacgcactggat

SEQ ID NO: 174528 - DNA, 75 bp, Artificial Sequence
  Synthetic
atgcgtcccatataaattgcaatcttgacaccgaaaaaaacgcactggattgtccatgtagtgcagctttaaagg

SEQ ID NO: 174529 - DNA, 75 bp, Artificial Sequence
  Synthetic
tgccttaactcccgagctaagtgtaaaagaaagcacgaacaagttaaagctaccttcttttgacacaagtgctct

SEQ ID NO: 174530 - DNA, 75 bp, Artificial Sequence
  Synthetic
aaagaaagcacgaacaagttaaagctaccttcttttgacacaagtgctctaggagagctctcactctatgattct

SEQ ID NO: 174531 - DNA, 75 bp, Artificial Sequence
  Synthetic
agaagccacttcaagaaaagcggaacagtgccgaggaatggacatcacattgtgactgctaaagtgactacctaa

SEQ ID NO: 174532 - DNA, 75 bp, Artificial Sequence
  Synthetic
cagtgccgaggaatggacatcacattgtgactgctaaagtgactacctaaaactgctaacttcctacaaacgttt

SEQ ID NO: 174533 - DNA, 75 bp, Artificial Sequence
  Synthetic
ttatttctaaaaagactaaagactgcgcgaaaaaacgcgctattttgtccaaatcacgagagatgcgttctctta

SEQ ID NO: 174534 - DNA, 75 bp, Artificial Sequence
  Synthetic
cgcgaaaaaacgcgctattttgtccaaatcacgagagatgcgttctcttactctgcgcgccaggaaaagacataa

SEQ ID NO: 174535 - DNA, 75 bp, Artificial Sequence
  Synthetic
atgtttctttctagatgactattccctaaaatttcatcatgtagaattggcaatgttttcgattccattgctttc

SEQ ID NO: 174536 - DNA, 75 bp, Artificial Sequence
  Synthetic
ctaaaatttcatcatgtagaattggcaatgttttcgattccattgctttcagtattaactccgcgccgagatctt

SEQ ID NO: 174537 - DNA, 75 bp, Artificial Sequence
  Synthetic
agcttcatcattagttaaatgtaattgctggagaatcaagtcctgtggactaaagtcctgtatatcggacaaatg

SEQ ID NO: 174538 - DNA, 75 bp, Artificial Sequence
  Synthetic
aaaaaacgagaaaatagcgccttgcgacattccccgcaactacaaagattagatacaacaaagtgataattcatc

SEQ ID NO: 174539 - DNA, 75 bp, Artificial Sequence
  Synthetic
ctaagaaattttttaataggagattggaaggcgctacgacttcaccagctatttccttcggatttggaagtaact

SEQ ID NO: 174540 - DNA, 75 bp, Artificial Sequence
  Synthetic
ggaaggcgctacgacttcaccagctatttccttcggatttggaagtaactcaaacaaactcaacaatatatttga

SEQ ID NO: 174541 - DNA, 75 bp, Artificial Sequence
  Synthetic
aattgtaaaaacaatgaatctaagagctccattaaacgattaaagtgagacgaaagagtgtcgcgcttttctcca

SEQ ID NO: 174542 - DNA, 75 bp, Artificial Sequence
  Synthetic
gctccattaaacgattaaagtgagacgaaagagtgtcgcgcttttctccagctacaaaatattccgctattgtaa

SEQ ID NO: 174543 - DNA, 75 bp, Artificial Sequence
  Synthetic
cagaactcgataaaacggagaagtgcactcttcaaaccttagactttgaagaaacgcgagaaaaccgtctaaagt

SEQ ID NO: 174544 - DNA, 75 bp, Artificial Sequence
  Synthetic
cactcttcaaaccttagactttgaagaaacgcgagaaaaccgtctaaagtcattgttgccttgtccctcctttta

SEQ ID NO: 174545 - DNA, 75 bp, Artificial Sequence
  Synthetic
aaacagcccatagtagactgtcatcgtaaaattttaagcctcgagtttggaacaaatcttctgaagtgagatgac

SEQ ID NO: 174546 - DNA, 75 bp, Artificial Sequence
  Synthetic
cgctatccgcaatcatctcctctgtcagctcattcaagttgacgtctaactcgcatgagttaaatgccgtccatg

SEQ ID NO: 174547 - DNA, 75 bp, Artificial Sequence
  Synthetic
atacgtaatgcgattccttagcggccctttacaaacatcataatcgattaaatccattacgcaaatccttgtcaa

SEQ ID NO: 174548 - DNA, 75 bp, Artificial Sequence
  Synthetic
cctttacaaacatcataatcgattaaatccattacgcaaatccttgtcaaaaatgtttattcatttccatcacta

SEQ ID NO: 174549 - DNA, 75 bp, Artificial Sequence
  Synthetic
tttctacattggcaaagtaacacaagtcattctgaatcttgtcaagaccccccagcttataccctacagctctta

SEQ ID NO: 174550 - DNA, 75 bp, Artificial Sequence
  Synthetic
gtcattctgaatcttgtcaagaccccccagcttataccctacagctcttacatctttttctggactggtctggaa

SEQ ID NO: 174551 - DNA, 75 bp, Artificial Sequence
  Synthetic
tatttgagaccactgaaaaaaagtgccattgctccattaatgttttttgtgttacttaaatattcagcttcgatg

SEQ ID NO: 174552 - DNA, 75 bp, Artificial Sequence
  Synthetic
ccattgctccattaatgttttttgtgttacttaaatattcagcttcgatgttcacgatcgatctctccagcacat

SEQ ID NO: 174553 - DNA, 75 bp, Artificial Sequence
  Synthetic
cactatgaagaaacctggtgctagattatttgcagcaaccaagtccgtgtgcttcgcaggctgcctttggatgta

SEQ ID NO: 174554 - DNA, 75 bp, Artificial Sequence
  Synthetic
atgaagtttgtttcatcatagtttttgtaatacggaatttcaaagctcatctttatcacttctaagcagttgaaa

SEQ ID NO: 174555 - DNA, 75 bp, Artificial Sequence
  Synthetic
ttctgacaatatctttaacctgcttcaacatattgaaataaacgatattgttcatacaacccttactgcccagtt

SEQ ID NO: 174556 - DNA, 75 bp, Artificial Sequence
  Synthetic
caacatattgaaataaacgatattgttcatacaacccttactgcccagtttcatttcacattccatgctagactc

SEQ ID NO: 174557 - DNA, 75 bp, Artificial Sequence
  Synthetic
acatcataatacattttcagttcagtaaacaaaacactgttaagagtttgaattatgaaaagcaaaaacacaatg

SEQ ID NO: 174558 - DNA, 75 bp, Artificial Sequence
  Synthetic
taaacaaaacactgttaagagtttgaattatgaaaagcaaaaacacaatgttactaagaatattcaacagatttc

SEQ ID NO: 174559 - DNA, 75 bp, Artificial Sequence
  Synthetic
aaccgagataggaaacctggaatgttcaatctgcccctcaataaaacttaaacacaaatctttggctacaaacat

SEQ ID NO: 174560 - DNA, 75 bp, Artificial Sequence
  Synthetic
tcaatctgcccctcaataaaacttaaacacaaatctttggctacaaacatagaaagattagaatatttctcagat

SEQ ID NO: 174561 - DNA, 75 bp, Artificial Sequence
  Synthetic
tcttacccaaagctggaaagaaatgtaatttgacagagccaggattctttttcattgtgcctacatttttaaacc

SEQ ID NO: 174562 - DNA, 75 bp, Artificial Sequence
  Synthetic
taatttgacagagccaggattctttttcattgtgcctacatttttaaacctgaaaaaattgtatcgacattcttc

SEQ ID NO: 174563 - DNA, 75 bp, Artificial Sequence
  Synthetic
tcaagtaagtacaactgaaaacgatcaaaaaaatcgcgtctgaagaatgattctgttttgttttgcatttctgtc

SEQ ID NO: 174564 - DNA, 75 bp, Artificial Sequence
  Synthetic
caaaaaaatcgcgtctgaagaatgattctgttttgttttgcatttctgtcttaaaagattcgctccaaaatgcac

SEQ ID NO: 174565 - DNA, 75 bp, Artificial Sequence
  Synthetic
agattctttactcaattccttcaattttccatctagtttaaaaaataacatagaaaggtactcacataggtagcg

SEQ ID NO: 174566 - DNA, 75 bp, Artificial Sequence
  Synthetic
tttccatctagtttaaaaaataacatagaaaggtactcacataggtagcgacaccagtatccaattccaggctta

SEQ ID NO: 174567 - DNA, 75 bp, Artificial Sequence
  Synthetic
cagaatagaaccctacagctgcaagtttagtaatgcactgccatttggggtcaaaatcttccataaattttaaat

SEQ ID NO: 174568 - DNA, 75 bp, Artificial Sequence
  Synthetic
cgcgcaactgcaaaagaaatttatcagcccttgtgaaagttgatggatacttgaacatttcgtactcatagtcta

SEQ ID NO: 174569 - DNA, 75 bp, Artificial Sequence
  Synthetic
tgaacataatcttagcccttttattccaaagcgtccagcagctgatgcttgaaggccgttgattagtctggattc

SEQ ID NO: 174570 - DNA, 75 bp, Artificial Sequence
  Synthetic
ccaaagcgtccagcagctgatgcttgaaggccgttgattagtctggattctgtcaccggaacaatgtacttcagt

SEQ ID NO: 174571 - DNA, 75 bp, Artificial Sequence
  Synthetic
ttggatgtagaaactttgtaacactttgaacaagaggattactgatttcagatgagtgcactgcaaacagaatac

SEQ ID NO: 174572 - DNA, 75 bp, Artificial Sequence
  Synthetic
ttgaacaagaggattactgatttcagatgagtgcactgcaaacagaatacttggcatgttcttcaataatctgaa

SEQ ID NO: 174573 - DNA, 75 bp, Artificial Sequence
  Synthetic
aagagtattgtgtagagaataccgaaaagaagaactttgatctttacatacctatcacaccttggatacatatgc

SEQ ID NO: 174574 - DNA, 75 bp, Artificial Sequence
  Synthetic
aaagaagaactttgatctttacatacctatcacaccttggatacatatgccgtggtttcttccgaagaatcggag

SEQ ID NO: 174575 - DNA, 75 bp, Artificial Sequence
  Synthetic
attttccgcctcactttcactcacataaatcaaactgtcatcatgccagttcagggcatatctttctttgtataa

SEQ ID NO: 174576 - DNA, 75 bp, Artificial Sequence
  Synthetic
taaatcaaactgtcatcatgccagttcagggcatatctttctttgtataagagttcttcaaaccctcgcctgata

SEQ ID NO: 174577 - DNA, 75 bp, Artificial Sequence
  Synthetic
tgttgatcttgttatcacaatacacataaatgtgaaaattgggacctagtaggatgacagctctacaatttggct

SEQ ID NO: 174578 - DNA, 75 bp, Artificial Sequence
  Synthetic
ataaatgtgaaaattgggacctagtaggatgacagctctacaatttggctctacctgacatctcgcgcaagttcc

SEQ ID NO: 174579 - DNA, 75 bp, Artificial Sequence
  Synthetic
attttttcgagaataccagaacctgtgatgtaatggatgtcattcgaagaacagaaagacaaatcaaaattttga

SEQ ID NO: 174580 - DNA, 75 bp, Artificial Sequence
  Synthetic
tgatgtaatggatgtcattcgaagaacagaaagacaaatcaaaattttgaaaagcatcgatacgaattttttgac

SEQ ID NO: 174581 - DNA, 75 bp, Artificial Sequence
  Synthetic
taaggctggaatatttttttgtaagagtacgaactcctcaccgctgcatttggtttctccgtaccacagtctgtc

SEQ ID NO: 174582 - DNA, 75 bp, Artificial Sequence
  Synthetic
tggtttctccgtaccacagtctgtctagctcaatatctaattcaatccttgcaaaaggtgggaaatttctcagcc

SEQ ID NO: 174583 - DNA, 75 bp, Artificial Sequence
  Synthetic
ttccgctatgatgtacaattcatctgtgaccgtatctaatgcaagcatcttatttgatgagcagtacatcacaaa

SEQ ID NO: 174584 - DNA, 75 bp, Artificial Sequence
  Synthetic
gtgaccgtatctaatgcaagcatcttatttgatgagcagtacatcacaaatggatcaaagtccgggtccggttct

SEQ ID NO: 174585 - DNA, 75 bp, Artificial Sequence
  Synthetic
cagcgcaaagaaattcgtctgctcctaccaaattactccaatcataagtgatgacactacgtctacatttgaaat

SEQ ID NO: 174586 - DNA, 75 bp, Artificial Sequence
  Synthetic
taccaaattactccaatcataagtgatgacactacgtctacatttgaaatgataaaattcgccaaaaataagcac

SEQ ID NO: 174587 - DNA, 75 bp, Artificial Sequence
  Synthetic
cactttataccattgcgaactatctccatgccttctccatatgaagacagcagcaactcaacggcaaaatcaaaa

SEQ ID NO: 174588 - DNA, 75 bp, Artificial Sequence
  Synthetic
ccatgccttctccatatgaagacagcagcaactcaacggcaaaatcaaaagacggtaaatccggagtcggttcaa

SEQ ID NO: 174589 - DNA, 75 bp, Artificial Sequence
  Synthetic
aatttctgcaaaattaacttgtgattagtacttccgtcactttcagaaaaattaaaaaccataaaaagtactgtt

SEQ ID NO: 174590 - DNA, 75 bp, Artificial Sequence
  Synthetic
tagtacttccgtcactttcagaaaaattaaaaaccataaaaagtactgttacttacttagataccaggagtactg

SEQ ID NO: 174591 - DNA, 75 bp, Artificial Sequence
  Synthetic
gataatcttccaaatctggcagtgacttttccaattttatcataaccaaaatctccacaatatctcgcgaagccg

SEQ ID NO: 174592 - DNA, 75 bp, Artificial Sequence
  Synthetic
cttttccaattttatcataaccaaaatctccacaatatctcgcgaagccgatccttgcaaaagtcagtaaacaat

SEQ ID NO: 174593 - DNA, 75 bp, Artificial Sequence
  Synthetic
aatccaatcataataataaattgctcctgtttctccaatgcatagaattggtctcaaaccatagtcttcggctga

SEQ ID NO: 174594 - DNA, 75 bp, Artificial Sequence
  Synthetic
cctgtttctccaatgcatagaattggtctcaaaccatagtcttcggctgaaatatttaaaaaacctaaaacaact

SEQ ID NO: 174595 - DNA, 75 bp, Artificial Sequence
  Synthetic
cttcaaatcttttttggtctgaggtgccacagtgtatgtttttcctgtcttgcaggattaacgctgtaaagattg

SEQ ID NO: 174596 - DNA, 75 bp, Artificial Sequence
  Synthetic
gccacagtgtatgtttttcctgtcttgcaggattaacgctgtaaagattggagtttccaaacgaagttttaaacc

SEQ ID NO: 174597 - DNA, 75 bp, Artificial Sequence
  Synthetic
atctctgctaacgttttacaccttgccaattcatctaattcggagagcattgaaatataatttctcctcaaagct

SEQ ID NO: 174598 - DNA, 75 bp, Artificial Sequence
  Synthetic
ccaattcatctaattcggagagcattgaaatataatttctcctcaaagcttttagtgccaaagctgttttcctgt

SEQ ID NO: 174599 - DNA, 75 bp, Artificial Sequence
  Synthetic
aagtggttcctgtaataatcctaagtctttaagagtctccaatttttcaaactttggaccatcataataaaagcg

SEQ ID NO: 174600 - DNA, 75 bp, Artificial Sequence
  Synthetic
tctttaagagtctccaatttttcaaactttggaccatcataataaaagcgagtataaacaggttctgagcaagtg

SEQ ID NO: 174601 - DNA, 75 bp, Artificial Sequence
  Synthetic
atctaacaaatttgtcaaagtcttcagctatgtaatacaaaacatcatcctccaaatcgtgacaaaaaattcgac

SEQ ID NO: 174602 - DNA, 75 bp, Artificial Sequence
  Synthetic
agctatgtaatacaaaacatcatcctccaaatcgtgacaaaaaattcgactcgattttcccacaaaaattggcac

SEQ ID NO: 174603 - DNA, 75 bp, Artificial Sequence
  Synthetic
ccaatcaagcacaaattttccttaaatccttggtaatggtcattcagttctgccaattgttgttctgagtaacca

SEQ ID NO: 174604 - DNA, 75 bp, Artificial Sequence
  Synthetic
atccttggtaatggtcattcagttctgccaattgttgttctgagtaaccagcaacgtcaactggctgtgcaagcc

SEQ ID NO: 174605 - DNA, 75 bp, Artificial Sequence
  Synthetic
caaagacaagcattcatttcgatgtcgttcagtaagaaggcgaattccagggaaatcagtaaaacgacataaatt

SEQ ID NO: 174606 - DNA, 75 bp, Artificial Sequence
  Synthetic
cgttcagtaagaaggcgaattccagggaaatcagtaaaacgacataaattcttcaattcccttaacaatccatca

SEQ ID NO: 174607 - DNA, 75 bp, Artificial Sequence
  Synthetic
ttttatattgttctgccatcgtctcaaaatttttcattgaagtgaatgtggtaagaagtttgtattctcatccat

SEQ ID NO: 174608 - DNA, 75 bp, Artificial Sequence
  Synthetic
aaaatttttcattgaagtgaatgtggtaagaagtttgtattctcatccatttctcaaaaactcaaccagataaat

SEQ ID NO: 174609 - DNA, 75 bp, Artificial Sequence
  Synthetic
gaaataaattttaaagctttgcagattttttatttcccattacaggaaacattagagtgattaaaaccataagcc

SEQ ID NO: 174610 - DNA, 75 bp, Artificial Sequence
  Synthetic
tgtcgaaagtaggaatcggatttttaccttttttaaagatcgatttttagaacattcacggtaacaatacaaaac

SEQ ID NO: 174611 - DNA, 75 bp, Artificial Sequence
  Synthetic
tcagaatctgccactgaaaggaaaatcccttttcgccctaagtaactacacttaaaaatggctatagcagaaagc

SEQ ID NO: 174612 - DNA, 75 bp, Artificial Sequence
  Synthetic
tcccttttcgccctaagtaactacacttaaaaatggctatagcagaaagcggagcgttcgaaataaatgtcaatc

SEQ ID NO: 174613 - DNA, 75 bp, Artificial Sequence
  Synthetic
aaaaaatcctataatctacatgcgtagacatctctctttttatgtggagttattaaaatttatcattcatcaata

SEQ ID NO: 174614 - DNA, 75 bp, Artificial Sequence
  Synthetic
agacatctctctttttatgtggagttattaaaatttatcattcatcaatatgagcaatgttttttaccaccgaaa

SEQ ID NO: 174615 - DNA, 75 bp, Artificial Sequence
  Synthetic
taatcgaactaaatactttaattatcgatctgaatcaacaaattacatcgaaacagcagatctatagttggacga

SEQ ID NO: 174616 - DNA, 75 bp, Artificial Sequence
  Synthetic
aaacagcagatctatagttggacgagcattactttgccaaaaatattttcgactaaagaattatattttattgtc

SEQ ID NO: 174617 - DNA, 75 bp, Artificial Sequence
  Synthetic
ctctcaatccagctgttactaaaggaggatggttatctgggagttttagctttccattgagtttaagttgtgcat

SEQ ID NO: 174618 - DNA, 75 bp, Artificial Sequence
  Synthetic
aggatggttatctgggagttttagctttccattgagtttaagttgtgcatacgccctcactggcgtatcttcaac

SEQ ID NO: 174619 - DNA, 75 bp, Artificial Sequence
  Synthetic
tataaattcccaatgacttacgtagacttttcgacacttcgaacatacgaggtaacaagtgaatatggatcaatc

SEQ ID NO: 174620 - DNA, 75 bp, Artificial Sequence
  Synthetic
acttttcgacacttcgaacatacgaggtaacaagtgaatatggatcaatccaaattataaaacagcggaattttt

SEQ ID NO: 174621 - DNA, 75 bp, Artificial Sequence
  Synthetic
gtcatggaaaagtcagagggataacaagaattttatcctgaaagcaatgttcgttggaaactggttagggataca

SEQ ID NO: 174622 - DNA, 75 bp, Artificial Sequence
  Synthetic
ctttttaataacacacggttttctattcaggattttgaattctccattaacatacaaaatataaaccttactagg

SEQ ID NO: 174623 - DNA, 75 bp, Artificial Sequence
  Synthetic
ccacggtttcttgtgatcagatgccaccaaacttgtctccagagaatctcccaaactatctagttattcagttcg

SEQ ID NO: 174624 - DNA, 75 bp, Artificial Sequence
  Synthetic
accaaacttgtctccagagaatctcccaaactatctagttattcagttcgaattggtttcaactctcgcaaatcc

SEQ ID NO: 174625 - DNA, 75 bp, Artificial Sequence
  Synthetic
cccaaattgtttttcacaggagatattctgaacagcgctataaatttacaacatagtcctaatcattatgagctt

SEQ ID NO: 174626 - DNA, 75 bp, Artificial Sequence
  Synthetic
ttctgaacagcgctataaatttacaacatagtcctaatcattatgagcttacagtgtacgcaccacataatttac

SEQ ID NO: 174627 - DNA, 75 bp, Artificial Sequence
  Synthetic
agtaacattaccaattcagttttcatccagaaatgatagacagatgttggtgtcaagctatcctaatgaaggcta

SEQ ID NO: 174628 - DNA, 75 bp, Artificial Sequence
  Synthetic
tccagaaatgatagacagatgttggtgtcaagctatcctaatgaaggctactttgaagtacaaatgtgcccatgg

SEQ ID NO: 174629 - DNA, 75 bp, Artificial Sequence
  Synthetic
ttattaaatctttttcaaaaaatctagtgctaccgcaaggcacccctattgcaattctcttatatatggaaaaaa

SEQ ID NO: 174630 - DNA, 75 bp, Artificial Sequence
  Synthetic
agtgctaccgcaaggcacccctattgcaattctcttatatatggaaaaaatgacaacaggaaaaaattctttacg

SEQ ID NO: 174631 - DNA, 75 bp, Artificial Sequence
  Synthetic
gacattacccgaataggaaacgtaaaccttccaaaagaaaatttcttacattataatagctaatctttattcaac

SEQ ID NO: 174632 - DNA, 75 bp, Artificial Sequence
  Synthetic
gagtgtgttaaatgcgatactagtttattaactatatcatcatctttttgaacagaattttcaagatcgattaaa

SEQ ID NO: 174633 - DNA, 75 bp, Artificial Sequence
  Synthetic
aaaagaggtgccgatatttgtccatcagcagcagtatttgcgttctggaattgttgccatagaatccttatattt

SEQ ID NO: 174634 - DNA, 75 bp, Artificial Sequence
  Synthetic
tgctagcaccgaaaatggtattttgcgtctctttgcctgttaaaagtgaacctgaatcaaaatcctggatttcag

SEQ ID NO: 174635 - DNA, 75 bp, Artificial Sequence
  Synthetic
ttgttgccatagaatccttatatttactttggcaaattttaaactcagaaagcatttttggaaagagaactggga

SEQ ID NO: 174636 - DNA, 75 bp, Artificial Sequence
  Synthetic
cgtctctttgcctgttaaaagtgaacctgaatcaaaatcctggatttcagcatttggtaaaaaaaatggagaccg

SEQ ID NO: 174637 - DNA, 75 bp, Artificial Sequence
  Synthetic
ctaaaattttgaaataaaggatctctctttctggagttcagtaaattcttcaggttgttgtcattgaaagtcgca

SEQ ID NO: 174638 - DNA, 75 bp, Artificial Sequence
  Synthetic
tctttctggagttcagtaaattcttcaggttgttgtcattgaaagtcgcaatgttagaaacatctgtttttttcg

SEQ ID NO: 174639 - DNA, 75 bp, Artificial Sequence
  Synthetic
aaactatgtcgtccccacatatttagccaataatgaaagtactatttccactttatttccggggttaatcagcat

SEQ ID NO: 174640 - DNA, 75 bp, Artificial Sequence
  Synthetic
ctttatttccggggttaatcagcattgtagttaacgaaagtgttcgtttaggctgggatcataatcaaaatactt

SEQ ID NO: 174641 - DNA, 75 bp, Artificial Sequence
  Synthetic
tcgctcttctaaactaattgtatccgtaaaatccgttaataatttcttaactttttcacctagtcctgattcaaa

SEQ ID NO: 174642 - DNA, 75 bp, Artificial Sequence
  Synthetic
gtaaaatccgttaataatttcttaactttttcacctagtcctgattcaaaaagttctttttgaagaagatcgttc

SEQ ID NO: 174643 - DNA, 75 bp, Artificial Sequence
  Synthetic
aactcggagtccacttcacatctttgactaattgattttttttagctgaagaagcactctctttttccttcattg

SEQ ID NO: 174644 - DNA, 75 bp, Artificial Sequence
  Synthetic
caatgacatttcattatgctcatcgtcaaaactttgtaagttctcgtggacaatttcttttctgcgtttttctga

SEQ ID NO: 174645 - DNA, 75 bp, Artificial Sequence
  Synthetic
ttttgtttaattgttttgattcgttctcgtagctccaaaattttctgcaagtcattggtcgagtttttagacagt

SEQ ID NO: 174646 - DNA, 75 bp, Artificial Sequence
  Synthetic
ctcgtagctccaaaattttctgcaagtcattggtcgagtttttagacagttgatcgcgtgattgcactccgtttt

SEQ ID NO: 174647 - DNA, 75 bp, Artificial Sequence
  Synthetic
aaaaaaggtagagtgataatcaattttatttttgggtagctgaactacgttaacttttggtgagctaacaatgtc

SEQ ID NO: 174648 - DNA, 75 bp, Artificial Sequence
  Synthetic
ttatttttgggtagctgaactacgttaacttttggtgagctaacaatgtctattactttgtttgagttgtgtaga

SEQ ID NO: 174649 - DNA, 75 bp, Artificial Sequence
  Synthetic
cttggttaataccgtctggtgccacagcaatttcattgaattggtttactttgtcctctggtctgtgcatagttt

SEQ ID NO: 174650 - DNA, 75 bp, Artificial Sequence
  Synthetic
agcaatttcattgaattggtttactttgtcctctggtctgtgcatagtttgatcagttaaatcaagtatttcagt

SEQ ID NO: 174651 - DNA, 75 bp, Artificial Sequence
  Synthetic
gaattgtttatagacgtggaatttcttggctcgtccaatatcatggaatccttttttaccgaggataacaaccca

SEQ ID NO: 174652 - DNA, 75 bp, Artificial Sequence
  Synthetic
tcttcagagcctacaaataaatctttggatagcgtgttgttactccgttgttcagtttttataaatggttctgga

SEQ ID NO: 174653 - DNA, 75 bp, Artificial Sequence
  Synthetic
ttttagaactactctcaaattgattgcttaaagacgatttcgacaaatctgttaaaactttgaatgtctgaatcg

SEQ ID NO: 174654 - DNA, 75 bp, Artificial Sequence
  Synthetic
gcttaaagacgatttcgacaaatctgttaaaactttgaatgtctgaatcggttcaggagtaaattttacacgatc

SEQ ID NO: 174655 - DNA, 75 bp, Artificial Sequence
  Synthetic
gcatgtaactcaagactttttgttataacatcaaagtcttcggttaaaattttaaaaaaagaagttactctatga

SEQ ID NO: 174656 - DNA, 75 bp, Artificial Sequence
  Synthetic
taacatcaaagtcttcggttaaaattttaaaaaaagaagttactctatgactagttaatggcaaacttaaaattt

SEQ ID NO: 174657 - DNA, 75 bp, Artificial Sequence
  Synthetic
tttgttgttttcaatcgcctttaaaattgcatttttcttttcattaatggtatttaatgcgagtttctccatgtt

SEQ ID NO: 174658 - DNA, 75 bp, Artificial Sequence
  Synthetic
attgcatttttcttttcattaatggtatttaatgcgagtttctccatgttcatccaggatccatgtaatgtaatt

SEQ ID NO: 174659 - DNA, 75 bp, Artificial Sequence
  Synthetic
gattgatgttagtaacatagtagccattttcattccacggatcaactatttggtaaattgtgaaagaaagcatat

SEQ ID NO: 174660 - DNA, 75 bp, Artificial Sequence
  Synthetic
attttcattccacggatcaactatttggtaaattgtgaaagaaagcatattgttttttgccttttgtaaattctc

SEQ ID NO: 174661 - DNA, 75 bp, Artificial Sequence
  Synthetic
gtaagattgacgtaatcggctgcgtgtgtcacagtgccccaacgaagaaaactgcccagtttaagcaaatctttt

SEQ ID NO: 174662 - DNA, 75 bp, Artificial Sequence
  Synthetic
gtgtcacagtgccccaacgaagaaaactgcccagtttaagcaaatcttttgctacgtttttaaattctgtttcaa

SEQ ID NO: 174663 - DNA, 75 bp, Artificial Sequence
  Synthetic
actagaataatcagtaatcatctgtctttgctctaagtaatctttcagaattttttgcacctttagtatttcttg

SEQ ID NO: 174664 - DNA, 75 bp, Artificial Sequence
  Synthetic
ctttgctctaagtaatctttcagaattttttgcacctttagtatttcttgccaaacttcctcatagtctggtttc

SEQ ID NO: 174665 - DNA, 75 bp, Artificial Sequence
  Synthetic
aaatccaaagaatcaaattgttgtaaagtgtttttacattgttaatggaatttccagttttaacgatacattgac

SEQ ID NO: 174666 - DNA, 75 bp, Artificial Sequence
  Synthetic
aagtgtttttacattgttaatggaatttccagttttaacgatacattgactcaaaatccatggattttcgcgaat

SEQ ID NO: 174667 - DNA, 75 bp, Artificial Sequence
  Synthetic
ttttcaaaaaatcgagataaaaaacactttgcttcatccgaaatccaagcaaagggtaaatgtgacattttcatg

SEQ ID NO: 174668 - DNA, 75 bp, Artificial Sequence
  Synthetic
actttgcttcatccgaaatccaagcaaagggtaaatgtgacattttcatgactcgttttttctgttgagcattat

SEQ ID NO: 174669 - DNA, 75 bp, Artificial Sequence
  Synthetic
aatagtctctattttctctttgattagatacatgcgctgccgacatggacactctaattgatttccaaaaaatcc

SEQ ID NO: 174670 - DNA, 75 bp, Artificial Sequence
  Synthetic
agatacatgcgctgccgacatggacactctaattgatttccaaaaaatcctggtatgataatctaatgttatgat

SEQ ID NO: 174671 - DNA, 75 bp, Artificial Sequence
  Synthetic
acctttgcatttttaatcatcttgcaaaactttttttcacagcatgatgaagagtacaagtacaattatacgtgt

SEQ ID NO: 174672 - DNA, 75 bp, Artificial Sequence
  Synthetic
aaaactttttttcacagcatgatgaagagtacaagtacaattatacgtgtattacgccaacagtacggaaagccc

SEQ ID NO: 174673 - DNA, 75 bp, Artificial Sequence
  Synthetic
atcaattccggaaatggtttgaatattccattgaatataaaccacaatgaaaatgccgttataggcacagtctct

SEQ ID NO: 174674 - DNA, 75 bp, Artificial Sequence
  Synthetic
aattatgctaacgctgatacttcctgttagtactgttgtcatatgcactctgctaatctactacaaatggacaaa

SEQ ID NO: 174675 - DNA, 75 bp, Artificial Sequence
  Synthetic
gttagtactgttgtcatatgcactctgctaatctactacaaatggacaaaacagacaattacttctccatatctt

SEQ ID NO: 174676 - DNA, 75 bp, Artificial Sequence
  Synthetic
tctttaagtgatttacagcacggtttgttcacggttgcccgtgttcaatcaaaggaattccttacaataattaag

SEQ ID NO: 174677 - DNA, 75 bp, Artificial Sequence
  Synthetic
tacattcattgactgtgttacttctcacattgaaccgagaagctctcacaaaccttaatcaggctttgtgtcaat

SEQ ID NO: 174678 - DNA, 75 bp, Artificial Sequence
  Synthetic
cacattgaaccgagaagctctcacaaaccttaatcaggctttgtgtcaatgtgtgctttttgtatacagtgcgtc

SEQ ID NO: 174679 - DNA, 75 bp, Artificial Sequence
  Synthetic
gcagtaatatccacaatacgctatcgaaccctgcaaagaaggacattaaacgacaaaaacaataatcatattaaa

SEQ ID NO: 174680 - DNA, 75 bp, Artificial Sequence
  Synthetic
gaaccctgcaaagaaggacattaaacgacaaaaacaataatcatattaaaaggaacgttggaattttatttctgt

SEQ ID NO: 174681 - DNA, 75 bp, Artificial Sequence
  Synthetic
agtattatatgttcaagtggaaaagaaaaaaggcaattatggaaaatgtaatatacacatctcaacgcaaaaagc

SEQ ID NO: 174682 - DNA, 75 bp, Artificial Sequence
  Synthetic
aaaaaaggcaattatggaaaatgtaatatacacatctcaacgcaaaaagcatatgacttgtttataggaattaaa

SEQ ID NO: 174683 - DNA, 75 bp, Artificial Sequence
  Synthetic
tttttccaactgtcattttcagctatttttatgtgatttttggtaagaccttgcgtgccttgacccaaagtaaac

SEQ ID NO: 174684 - DNA, 75 bp, Artificial Sequence
  Synthetic
tttttatgtgatttttggtaagaccttgcgtgccttgacccaaagtaaacataacaaaactctgtcattcattag

SEQ ID NO: 174685 - DNA, 75 bp, Artificial Sequence
  Synthetic
attcaaataccaaatctcctagtaatgtctgtggaaattttttttttgtatatagcaaatacttcctgcttaggc

SEQ ID NO: 174686 - DNA, 75 bp, Artificial Sequence
  Synthetic
tgtctgtggaaattttttttttgtatatagcaaatacttcctgcttaggcaccatacaaagagaaattgtgcaaa

SEQ ID NO: 174687 - DNA, 75 bp, Artificial Sequence
  Synthetic
acactgcttgtctaatccgctagtatatgcattcactagaacagatttccgattacgattttacgatttcattaa

SEQ ID NO: 174688 - DNA, 75 bp, Artificial Sequence
  Synthetic
tatgcattcactagaacagatttccgattacgattttacgatttcattaaatgtaatttgtgtaattcatcttta

SEQ ID NO: 174689 - DNA, 75 bp, Artificial Sequence
  Synthetic
taaaaaattgaacagtgaagcttgcttaaaactttgaaaattttttgtgattttaaataaaatttaaaatcaatt

SEQ ID NO: 174690 - DNA, 75 bp, Artificial Sequence
  Synthetic
ttaaaactttgaaaattttttgtgattttaaataaaatttaaaatcaatttatcctaagcttttcaggctatgac

SEQ ID NO: 174691 - DNA, 75 bp, Artificial Sequence
  Synthetic
agactaattacagctaacgatccagtacttgcatcgaattttacaatgcagcctacttttaaaatagccgataag

SEQ ID NO: 174692 - DNA, 75 bp, Artificial Sequence
  Synthetic
tacttgcatcgaattttacaatgcagcctacttttaaaatagccgataagaaagttgtactcagagatcataatt

SEQ ID NO: 174693 - DNA, 75 bp, Artificial Sequence
  Synthetic
atcaaggtctttcatgcattgcattcgatgtcaggaaaaaattgaaaagaagacatccgatagcattagagcata

SEQ ID NO: 174694 - DNA, 75 bp, Artificial Sequence
  Synthetic
cgatgtcaggaaaaaattgaaaagaagacatccgatagcattagagcatattccattaagccagatttcatgttt

SEQ ID NO: 174695 - DNA, 75 bp, Artificial Sequence
  Synthetic
cgtcaccatttttataacaatatttaaagtagctgaattgtacgttctgaaacagtctgaacggatccgctgaac

SEQ ID NO: 174696 - DNA, 75 bp, Artificial Sequence
  Synthetic
aaagtagctgaattgtacgttctgaaacagtctgaacggatccgctgaacgcagacacaatggaacagcaaaaag

SEQ ID NO: 174697 - DNA, 75 bp, Artificial Sequence
  Synthetic
tgacgaaaactgcaactttgtgcctgaaatattacctcgtatacatactaaatttcttaaagatgtcttaattgc

SEQ ID NO: 174698 - DNA, 75 bp, Artificial Sequence
  Synthetic
gaaatattacctcgtatacatactaaatttcttaaagatgtcttaattgccgattcctacaactctgttagttgg

SEQ ID NO: 174699 - DNA, 75 bp, Artificial Sequence
  Synthetic
ttcaaacgcttgaacaaattatggttcttataacaaagttcaagttttctcgctcgcgtgattttttattcccag

SEQ ID NO: 174700 - DNA, 75 bp, Artificial Sequence
  Synthetic
tcttataacaaagttcaagttttctcgctcgcgtgattttttattcccagtaattcgattagctgttcatatcaa

SEQ ID NO: 174701 - DNA, 75 bp, Artificial Sequence
  Synthetic
ctgaaaaccatgatagaaattatgaaaagcttgtttaacaccgaagaggctatgcgacgattcgatgaagcattg

SEQ ID NO: 174702 - DNA, 75 bp, Artificial Sequence
  Synthetic
aaagcttgtttaacaccgaagaggctatgcgacgattcgatgaagcattgatgattctattttctaatgagcaaa

SEQ ID NO: 174703 - DNA, 75 bp, Artificial Sequence
  Synthetic
tttatcgatgcatgagaatggtcttccagattcaaaatttatgaatgctctaaaaatgatttacagagctggaaa

SEQ ID NO: 174704 - DNA, 75 bp, Artificial Sequence
  Synthetic
ccagattcaaaatttatgaatgctctaaaaatgatttacagagctggaaattcttttgataatcaaccagacaat

SEQ ID NO: 174705 - DNA, 75 bp, Artificial Sequence
  Synthetic
taaaaatctacaactacctaattaaaatacctaagtacacactaaaagctggagttgatttatataatgaaaata

SEQ ID NO: 174706 - DNA, 75 bp, Artificial Sequence
  Synthetic
aatacctaagtacacactaaaagctggagttgatttatataatgaaaatataaaagatctttcgattggaatcca

SEQ ID NO: 174707 - DNA, 75 bp, Artificial Sequence
  Synthetic
tctcgtaatgatttttcattgaaagctatttataatgacgtgttatttctagtttctgcatggaatatgatcatc

SEQ ID NO: 174708 - DNA, 75 bp, Artificial Sequence
  Synthetic
ctatttataatgacgtgttatttctagtttctgcatggaatatgatcatcaactataaaaaagaacaaagaagac

SEQ ID NO: 174709 - DNA, 75 bp, Artificial Sequence
  Synthetic
aaactctttaatggagaatgttgtgcttgcagcctttcagttaccagatttaaaagaaatgacacttgatttaag

SEQ ID NO: 174710 - DNA, 75 bp, Artificial Sequence
  Synthetic
cttgcagcctttcagttaccagatttaaaagaaatgacacttgatttaagcgctttgattgccaacatgaatctt

SEQ ID NO: 174711 - DNA, 75 bp, Artificial Sequence
  Synthetic
cccattttaaactaattatcaacaaattttttgaaatcggaatttttgtcacgaaatcatatatttgtattttgc

SEQ ID NO: 174712 - DNA, 75 bp, Artificial Sequence
  Synthetic
ttcgtttgaaaacgttttaagttcaaacagacatgcggaagatgtgactttcatactaacatcttccaaggaatc

SEQ ID NO: 174713 - DNA, 75 bp, Artificial Sequence
  Synthetic
aacagacatgcggaagatgtgactttcatactaacatcttccaaggaatctgatgatgaatatgatgaagataaa

SEQ ID NO: 174714 - DNA, 75 bp, Artificial Sequence
  Synthetic
tcatactaacatcttccaaggaatctgatgatgaatatgatgaagataaacctccacgacaagtagatccagaca

SEQ ID NO: 174715 - DNA, 75 bp, Artificial Sequence
  Synthetic
agatttttttaatgtgaaaccggaaaacgccttttcagaaatcgcattaatgccaatttcacatgacaaaattat

SEQ ID NO: 174716 - DNA, 75 bp, Artificial Sequence
  Synthetic
aacgccttttcagaaatcgcattaatgccaatttcacatgacaaaattatagatgtcaacaactcaaacatacaa

SEQ ID NO: 174717 - DNA, 75 bp, Artificial Sequence
  Synthetic
caaatttatttgtgtatagcgcaatagctcaaaaatatgatttgcctttaaaagaatacgtagagcgcttaaacg

SEQ ID NO: 174718 - DNA, 75 bp, Artificial Sequence
  Synthetic
aaagaatacgtagagcgcttaaacgtctacaatcctgatctatcatctggaaactctacacccgcgcggaattct

SEQ ID NO: 174719 - DNA, 75 bp, Artificial Sequence
  Synthetic
taaatatatccagaccaggaagcactacaccctctgggaactctgcaagatatgggaataacacacctagaagta

SEQ ID NO: 174720 - DNA, 75 bp, Artificial Sequence
  Synthetic
tacaccctctgggaactctgcaagatatgggaataacacacctagaagtataactccggttttagagatttcaag

SEQ ID NO: 174721 - DNA, 75 bp, Artificial Sequence
  Synthetic
aattctgaaatctatgagaatagaacatccccaacgttccgtgtttctaggagtgcaactccaatagaaagaagt

SEQ ID NO: 174722 - DNA, 75 bp, Artificial Sequence
  Synthetic
catccccaacgttccgtgtttctaggagtgcaactccaatagaaagaagttcgagatctgctagtataatttctg

SEQ ID NO: 174723 - DNA, 75 bp, Artificial Sequence
  Synthetic
tgaccaagaacgtttgagcaccaattcgcctatttccataaatggtaatactccaagacagcaaagccatgggga

SEQ ID NO: 174724 - DNA, 75 bp, Artificial Sequence
  Synthetic
tcgcctatttccataaatggtaatactccaagacagcaaagccatggggacaatgaaatacaaactatagattcc

SEQ ID NO: 174725 - DNA, 75 bp, Artificial Sequence
  Synthetic
cacaatcaccccaatccatctattcaatttctagctatgtttcaacagacgatcaacttctacattcaccgacaa

SEQ ID NO: 174726 - DNA, 75 bp, Artificial Sequence
  Synthetic
aatttctagctatgtttcaacagacgatcaacttctacattcaccgacaaatagcccatttaatctttttgactc

SEQ ID NO: 174727 - DNA, 75 bp, Artificial Sequence
  Synthetic
gaataattaattgttttttatttagctaattcattgtatgacaacacaagggcaattgtttgattaatttccacg

SEQ ID NO: 174728 - DNA, 75 bp, Artificial Sequence
  Synthetic
ctaattcattgtatgacaacacaagggcaattgtttgattaatttccacgttttttagcttttgaataatctcaa

SEQ ID NO: 174729 - DNA, 75 bp, Artificial Sequence
  Synthetic
tcgttctatgtatgaaaaaaacattatcgcgttttcatgctcatcgtctccaagcctcagatgactttcttctag

SEQ ID NO: 174730 - DNA, 75 bp, Artificial Sequence
  Synthetic
gatcttttacagaagaacatttattatttttaaaaatgatttttcttaccgcataaatcatgtttaagaaaagtt

SEQ ID NO: 174731 - DNA, 75 bp, Artificial Sequence
  Synthetic
atttttaaaaatgatttttcttaccgcataaatcatgtttaagaaaagttgcttttcatgctttgttgtcatcat

SEQ ID NO: 174732 - DNA, 75 bp, Artificial Sequence
  Synthetic
gcataaatcatgtttaagaaaagttgcttttcatgctttgttgtcatcatatacaataatgctgtgattttcctg

SEQ ID NO: 174733 - DNA, 75 bp, Artificial Sequence
  Synthetic
taaaattttgaaactcgtttgtgtagaaataatagaggtggactcaccgttttacaggtatgtgtgtgaattgag

SEQ ID NO: 174734 - DNA, 75 bp, Artificial Sequence
  Synthetic
gaaataatagaggtggactcaccgttttacaggtatgtgtgtgaattgagcgacgatataacaatcctcagtttt

SEQ ID NO: 174735 - DNA, 75 bp, Artificial Sequence
  Synthetic
ttgatttcttgccatctcttaataataaacaaagcttcaatcactacagactttgtcacagttgtggttaatgtt

SEQ ID NO: 174736 - DNA, 75 bp, Artificial Sequence
  Synthetic
taaacaaagcttcaatcactacagactttgtcacagttgtggttaatgttaatccagaaaaaataaatctatatg

SEQ ID NO: 174737 - DNA, 75 bp, Artificial Sequence
  Synthetic
atattttatatagattgtctccactttagatataatattagataacgtcatcaatatctgtagtggacacagctc

SEQ ID NO: 174738 - DNA, 75 bp, Artificial Sequence
  Synthetic
ttagatataatattagataacgtcatcaatatctgtagtggacacagctcgcgaaattcctgtagtcgttgtctt

SEQ ID NO: 174739 - DNA, 75 bp, Artificial Sequence
  Synthetic
aagagtctaccctcgtagaagaacactaactaaatgaatttttttaggcgaacgcttaaaaaactcttttactgg

SEQ ID NO: 174740 - DNA, 75 bp, Artificial Sequence
  Synthetic
ctaactaaatgaatttttttaggcgaacgcttaaaaaactcttttactggcacaccgcctataaaaacccccaaa

SEQ ID NO: 174741 - DNA, 75 bp, Artificial Sequence
  Synthetic
accaaaaaaagattaaccgttattagaaagtgttcgtttttaacgatttttattggcacattttgaccgggttaa

SEQ ID NO: 174742 - DNA, 75 bp, Artificial Sequence
  Synthetic
gaaagtgttcgtttttaacgatttttattggcacattttgaccgggttaaatttcgtcttcatcagatgtatcca

SEQ ID NO: 174743 - DNA, 75 bp, Artificial Sequence
  Synthetic
tatagctaatccggcagcgtgtgggcaggtcggataaatttcatgagtaattgttaaattccttggaaaaaattt

SEQ ID NO: 174744 - DNA, 75 bp, Artificial Sequence
  Synthetic
caggtcggataaatttcatgagtaattgttaaattccttggaaaaaatttgtatgtgcgatatgttctaactatc

SEQ ID NO: 174745 - DNA, 75 bp, Artificial Sequence
  Synthetic
tttctgcaattttgacacagggaccgatcccggttccaattgcgtcaataccataaataaaaccttttaaatcca

SEQ ID NO: 174746 - DNA, 75 bp, Artificial Sequence
  Synthetic
gatcccggttccaattgcgtcaataccataaataaaaccttttaaatccatcattaaaaataaacttttaggaaa

SEQ ID NO: 174747 - DNA, 75 bp, Artificial Sequence
  Synthetic
atgatatgtccatagtatggcatattgtcataaacgtcagctagaaaattccattctgtgcgattagggaattct

SEQ ID NO: 174748 - DNA, 75 bp, Artificial Sequence
  Synthetic
tgtcataaacgtcagctagaaaattccattctgtgcgattagggaattcttcttttctggttagaaacaaaacta

SEQ ID NO: 174749 - DNA, 75 bp, Artificial Sequence
  Synthetic
caaacgaagagtgtacactttcccactgttagccgctattatttcagcaaacttcacaagattatactgtgcatg

SEQ ID NO: 174750 - DNA, 75 bp, Artificial Sequence
  Synthetic
ctgttagccgctattatttcagcaaacttcacaagattatactgtgcatgaatgagactttgcaaaacgtgatcg

SEQ ID NO: 174751 - DNA, 75 bp, Artificial Sequence
  Synthetic
tatcttgataaatcggatcaaaacggtgcaacccgaaataagcaaagcgctctgttgattcagcaagcaaatata

SEQ ID NO: 174752 - DNA, 75 bp, Artificial Sequence
  Synthetic
gtgcaacccgaaataagcaaagcgctctgttgattcagcaagcaaatataaattttctttttcgaagtccaaagc

SEQ ID NO: 174753 - DNA, 75 bp, Artificial Sequence
  Synthetic
agaatgatggttttagcagctgctgttgttacgtcgtttttagcactcagaaaaccgatgacttgtaacctttca

SEQ ID NO: 174754 - DNA, 75 bp, Artificial Sequence
  Synthetic
ttgttacgtcgtttttagcactcagaaaaccgatgacttgtaacctttcattgcaacataggagatagcaaccta

SEQ ID NO: 174755 - DNA, 75 bp, Artificial Sequence
  Synthetic
catcatgacacattggaaatgttttgactgcttttgcaacttacataggtcttgcagctcggtttcactagtagt

SEQ ID NO: 174756 - DNA, 75 bp, Artificial Sequence
  Synthetic
gactgcttttgcaacttacataggtcttgcagctcggtttcactagtagttctgaaaggcatatcccgcaaaggc

SEQ ID NO: 174757 - DNA, 75 bp, Artificial Sequence
  Synthetic
gccatcttatgaagatttcacacccactattttgagtaacgaagtcactaagagaatcgcgataaaaggcttgtt

SEQ ID NO: 174758 - DNA, 75 bp, Artificial Sequence
  Synthetic
actattttgagtaacgaagtcactaagagaatcgcgataaaaggcttgtttaacaaggcttaaatttgcgagtgc

SEQ ID NO: 174759 - DNA, 75 bp, Artificial Sequence
  Synthetic
ctttcggccatgttgaagcacactctaagcttatgaaaacagcagttgtgactaggtttttatatattactgaag

SEQ ID NO: 174760 - DNA, 75 bp, Artificial Sequence
  Synthetic
taagcttatgaaaacagcagttgtgactaggtttttatatattactgaagcatgacgtcgctttatgcttaagct

SEQ ID NO: 174761 - DNA, 75 bp, Artificial Sequence
  Synthetic
tcttaaacaagtctgtttacaatagggatttccttttcctgtaaatgctgcctgatactagaaatcatgtccgtg

SEQ ID NO: 174762 - DNA, 75 bp, Artificial Sequence
  Synthetic
ggatttccttttcctgtaaatgctgcctgatactagaaatcatgtccgtgaattccagtatggaaatctgggaaa

SEQ ID NO: 174763 - DNA, 75 bp, Artificial Sequence
  Synthetic
cctacttttccatgcagcatcattaacgccgaatcgaatatacacattttcagagctgcagttgacatactaaaa

SEQ ID NO: 174764 - DNA, 75 bp, Artificial Sequence
  Synthetic
acgccgaatcgaatatacacattttcagagctgcagttgacatactaaaatatggctattaagatcaccgtatgt

SEQ ID NO: 174765 - DNA, 75 bp, Artificial Sequence
  Synthetic
acgaacttggaaacattacttttaatatggaatacaaagacaggagagtcgctgtgacatcgagttatattcggg

SEQ ID NO: 174766 - DNA, 75 bp, Artificial Sequence
  Synthetic
tatggaatacaaagacaggagagtcgctgtgacatcgagttatattcgggtacattttgtttttaatcagcgtta

SEQ ID NO: 174767 - DNA, 75 bp, Artificial Sequence
  Synthetic
tttaatacaaaatgcggaagaaaaagcttacacttacctcttctttatattgagtaaaaatggaccgcgggggga

SEQ ID NO: 174768 - DNA, 75 bp, Artificial Sequence
  Synthetic
gcttacacttacctcttctttatattgagtaaaaatggaccgcggggggaacagattttaacagttctagattac

SEQ ID NO: 174769 - DNA, 75 bp, Artificial Sequence
  Synthetic
cagtgaccattgcacactcaaaaaaaaattattttctttcaggttctctcagatataagaaagatgattatgacg

SEQ ID NO: 174770 - DNA, 75 bp, Artificial Sequence
  Synthetic
aaattattttctttcaggttctctcagatataagaaagatgattatgacgttattcaaaaacaaaaaggtaagcg

SEQ ID NO: 174771 - DNA, 75 bp, Artificial Sequence
  Synthetic
attgtttgttaaacatgtagaaactcacaatgttttctctatgatccagcaaagacttgcaaagacagaaattga

SEQ ID NO: 174772 - DNA, 75 bp, Artificial Sequence
  Synthetic
cacaatgttttctctatgatccagcaaagacttgcaaagacagaaattgaaatgagcctgacagtcacgtaaaag

SEQ ID NO: 174773 - DNA, 75 bp, Artificial Sequence
  Synthetic
atcgagaataaatcaaccaacattcttgtcaactttgcgccgatttactatcgacaaacagaaaaacaaaaaaag

SEQ ID NO: 174774 - DNA, 75 bp, Artificial Sequence
  Synthetic
ttgtcaactttgcgccgatttactatcgacaaacagaaaaacaaaaaaagtaccattgctgatccgccgacaaga

SEQ ID NO: 174775 - DNA, 75 bp, Artificial Sequence
  Synthetic
gggtttgatcgaggaagctttcgtaatcattcaagaagatgacatttttacctccatatgaagcgctgagatctt

SEQ ID NO: 174776 - DNA, 75 bp, Artificial Sequence
  Synthetic
atcattcaagaagatgacatttttacctccatatgaagcgctgagatcttccaattctttgtacttgtaccaatc

SEQ ID NO: 174777 - DNA, 75 bp, Artificial Sequence
  Synthetic
cgcaaaaatcttttataaatagtttcattgcgtactattgtaaagtttggatttaagactttcctttgatatatt

SEQ ID NO: 174778 - DNA, 75 bp, Artificial Sequence
  Synthetic
cattgcgtactattgtaaagtttggatttaagactttcctttgatatatttcatcagataaatgaggacatatca

SEQ ID NO: 174779 - DNA, 75 bp, Artificial Sequence
  Synthetic
aaatttttgatttagaatttcaagtgttttgtttttatcttttccgacgcttctccacttaactgcaactatgcc

SEQ ID NO: 174780 - DNA, 75 bp, Artificial Sequence
  Synthetic
gttttgtttttatcttttccgacgcttctccacttaactgcaactatgccagatcttagctgcaaaagaaacttt

SEQ ID NO: 174781 - DNA, 75 bp, Artificial Sequence
  Synthetic
aaccacccgaattatgaccttctaaccaacattcaagtgtactgttagcccgagaagcaaagtgccattttttgg

SEQ ID NO: 174782 - DNA, 75 bp, Artificial Sequence
  Synthetic
ccaacattcaagtgtactgttagcccgagaagcaaagtgccattttttggcaattagtgctcttaacataactcc

SEQ ID NO: 174783 - DNA, 75 bp, Artificial Sequence
  Synthetic
ctcaaataggttaatttatgagatgttgtagtaagatttactagactcatttcgcgaaatccttcagtttttaaa

SEQ ID NO: 174784 - DNA, 75 bp, Artificial Sequence
  Synthetic
ttgtagtaagatttactagactcatttcgcgaaatccttcagtttttaaagacaaagaaatcagaaaagctgttc

SEQ ID NO: 174785 - DNA, 75 bp, Artificial Sequence
  Synthetic
tattagcatttcattaacataacacgtggtgacacaaacagcttctaatttattatctagaaatattatattctg

SEQ ID NO: 174786 - DNA, 75 bp, Artificial Sequence
  Synthetic
gtggtgacacaaacagcttctaatttattatctagaaatattatattctggtgacatttcaaatttgacatgagt

SEQ ID NO: 174787 - DNA, 75 bp, Artificial Sequence
  Synthetic
caaaaaacatcatctcttttcccatggtcctttataaagacttcacaatttcttcaagaaagtccacggtacttc

SEQ ID NO: 174788 - DNA, 75 bp, Artificial Sequence
  Synthetic
actattgatgaacattgcagcatttttccaatgcattgccatacataccccgaagaaatttttcctttgaaaaga

SEQ ID NO: 174789 - DNA, 75 bp, Artificial Sequence
  Synthetic
ttccaatgcattgccatacataccccgaagaaatttttcctttgaaaagatactctagatgtgaaaattgtgttg

SEQ ID NO: 174790 - DNA, 75 bp, Artificial Sequence
  Synthetic
cgaagaaatttttcctttgaaaagatactctagatgtgaaaattgtgttgaagaaagaagttccgtcttagtgga

SEQ ID NO: 174791 - DNA, 75 bp, Artificial Sequence
  Synthetic
agtttttgaatggttgatattctgctatcttgttctttccccctttaaatggccataaaaaagaaattatcagtt

SEQ ID NO: 174792 - DNA, 75 bp, Artificial Sequence
  Synthetic
tatcttgttctttccccctttaaatggccataaaaaagaaattatcagttaaagacagcgaaaaatttaaaataa

SEQ ID NO: 174793 - DNA, 75 bp, Artificial Sequence
  Synthetic
ggtaaattgttcgaaattcaccgggaaacccgaagttgaagtgtgttccaagtttttcagtggcgagtttgctat

SEQ ID NO: 174794 - DNA, 75 bp, Artificial Sequence
  Synthetic
aaacccgaagttgaagtgtgttccaagtttttcagtggcgagtttgctatttcttcataggtttccaatgagaag

SEQ ID NO: 174795 - DNA, 75 bp, Artificial Sequence
  Synthetic
aaggtgctgtctctgtctcgttagctgtgtttacctctttatagggatacatttccgctgtggtttgcggtttgt

SEQ ID NO: 174796 - DNA, 75 bp, Artificial Sequence
  Synthetic
tgtgtttacctctttatagggatacatttccgctgtggtttgcggtttgtaacaccgttctttaaaaaaaatgtc

SEQ ID NO: 174797 - DNA, 75 bp, Artificial Sequence
  Synthetic
gtaaaatgtccgagtcccgtttgcgtagatctggacactaaaattgtcacaccaggtgtatgacacattttgtaa

SEQ ID NO: 174798 - DNA, 75 bp, Artificial Sequence
  Synthetic
tagatctggacactaaaattgtcacaccaggtgtatgacacattttgtaaatcttgcaattatttggaagattgt

SEQ ID NO: 174799 - DNA, 75 bp, Artificial Sequence
  Synthetic
atacattttttctgcctgtgtctctctatcattcgaaagcttgtgaccaggaagaactctttgaaatcgcgcagg

SEQ ID NO: 174800 - DNA, 75 bp, Artificial Sequence
  Synthetic
ctatcattcgaaagcttgtgaccaggaagaactctttgaaatcgcgcaggtagttttccactaatattgattgtt

SEQ ID NO: 174801 - DNA, 75 bp, Artificial Sequence
  Synthetic
tgataaatctttcatggcattcatctctcgacatcttctttgacatgccatgtgtaattgcattttgacagctaa

SEQ ID NO: 174802 - DNA, 75 bp, Artificial Sequence
  Synthetic
tctcgacatcttctttgacatgccatgtgtaattgcattttgacagctaaattccaatttcgtggtccagaaatc

SEQ ID NO: 174803 - DNA, 75 bp, Artificial Sequence
  Synthetic
atcacaccatcttcataagcaaacacatgctgagacaaggacagtaaaaaaactatttgtcttcgcggcgtccca

SEQ ID NO: 174804 - DNA, 75 bp, Artificial Sequence
  Synthetic
catgctgagacaaggacagtaaaaaaactatttgtcttcgcggcgtcccagaagctgacacccattcttcggcaa

SEQ ID NO: 174805 - DNA, 75 bp, Artificial Sequence
  Synthetic
atcttgttatttgtcagtgctggtagaaagcagaaataaaaaattttgcttaaaacaatcgtttcaaaagatggt

SEQ ID NO: 174806 - DNA, 75 bp, Artificial Sequence
  Synthetic
aaatggataaaatccgatgttaactaaacgtttaagtctcctttctggaagaatgtcagtcatatcacaaattcg

SEQ ID NO: 174807 - DNA, 75 bp, Artificial Sequence
  Synthetic
aaacgtttaagtctcctttctggaagaatgtcagtcatatcacaaattcgaatattgatacacattatgtgttga

SEQ ID NO: 174808 - DNA, 75 bp, Artificial Sequence
  Synthetic
cttgaactgttttttcaaaaaactttaaatctttcgaagctgcaattaatttttctttgcagcgcagcatcgtcg

SEQ ID NO: 174809 - DNA, 75 bp, Artificial Sequence
  Synthetic
taaatctttcgaagctgcaattaatttttctttgcagcgcagcatcgtcgttaagccacattccttagacataat

SEQ ID NO: 174810 - DNA, 75 bp, Artificial Sequence
  Synthetic
tttaagcgtatatattcaaccccccggatatgggcgtggaaattaataaaaacacttcaaaaagcaaacttttta

SEQ ID NO: 174811 - DNA, 75 bp, Artificial Sequence
  Synthetic
ggatatgggcgtggaaattaataaaaacacttcaaaaagcaaactttttattgaaactcattaatgacacatgaa

SEQ ID NO: 174812 - DNA, 75 bp, Artificial Sequence
  Synthetic
tctggagaatccttagacaggcagtctgaatctgaaatttccattttttcagttgcacacaaattttccacagat

SEQ ID NO: 174813 - DNA, 75 bp, Artificial Sequence
  Synthetic
ctgaatctgaaatttccattttttcagttgcacacaaattttccacagatatataatcacagggatcaatttcca

SEQ ID NO: 174814 - DNA, 75 bp, Artificial Sequence
  Synthetic
atcaaggtccttacgcttattaagaacagccataacatgcagccaaatttcaaaaaacatttttttaacagtgat

SEQ ID NO: 174815 - DNA, 75 bp, Artificial Sequence
  Synthetic
acagccataacatgcagccaaatttcaaaaaacatttttttaacagtgattatagaaaaaataaaggcaagtata

SEQ ID NO: 174816 - DNA, 75 bp, Artificial Sequence
  Synthetic
cttcaaagtaattcccgtgtttgtaagttttgtgaaacaaattttgaaaatattcatctgaattattaaattcaa

SEQ ID NO: 174817 - DNA, 75 bp, Artificial Sequence
  Synthetic
agttttgtgaaacaaattttgaaaatattcatctgaattattaaattcaaggacgttaaaagagtaattacattt

SEQ ID NO: 174818 - DNA, 75 bp, Artificial Sequence
  Synthetic
ttagcggactccgtgttaatagatttaaaaaaaaagtagaattttttcccttttaagatgtccgatgccaaatat

SEQ ID NO: 174819 - DNA, 75 bp, Artificial Sequence
  Synthetic
taaaaaaaaagtagaattttttcccttttaagatgtccgatgccaaatattcttctgtcaaatcatcaggaacca

SEQ ID NO: 174820 - DNA, 75 bp, Artificial Sequence
  Synthetic
actcaatcccagtggactataaagctgcgccgaacacgttatgttagatccacgttttgtgatggacaccacagg

SEQ ID NO: 174821 - DNA, 75 bp, Artificial Sequence
  Synthetic
tgcgccgaacacgttatgttagatccacgttttgtgatggacaccacaggtggccgatatccatcttgaccgaag

SEQ ID NO: 174822 - DNA, 75 bp, Artificial Sequence
  Synthetic
gttgtttaacacaaaactgctgcacataaaatttgagaataagtaataattcaacattagcatacatgttttcgt

SEQ ID NO: 174823 - DNA, 75 bp, Artificial Sequence
  Synthetic
ataaaatttgagaataagtaataattcaacattagcatacatgttttcgtcaaaaccactgctagaaaaatccaa

SEQ ID NO: 174824 - DNA, 75 bp, Artificial Sequence
  Synthetic
ttatgaacttttaacaaataatgacttttcaaaacggtgtcaatttcacaaatgaattcagcgttaaaattgtgg

SEQ ID NO: 174825 - DNA, 75 bp, Artificial Sequence
  Synthetic
ttttcaaaacggtgtcaatttcacaaatgaattcagcgttaaaattgtggtgataatgaacactgcgattcctat

SEQ ID NO: 174826 - DNA, 75 bp, Artificial Sequence
  Synthetic
gctgtttaatgtagattcgtccttgttggtagaaaagacgtaagacaaagcattaaatttcgttggaaaatctgt

SEQ ID NO: 174827 - DNA, 75 bp, Artificial Sequence
  Synthetic
ttggtagaaaagacgtaagacaaagcattaaatttcgttggaaaatctgtgaggaaagacgaaatactagtattg

SEQ ID NO: 174828 - DNA, 75 bp, Artificial Sequence
  Synthetic
ccagttcatagttatccatcatcaattcatatttctcaagatgttctttattgattattgacattgtcaacttat

SEQ ID NO: 174829 - DNA, 75 bp, Artificial Sequence
  Synthetic
ttcatatttctcaagatgttctttattgattattgacattgtcaacttatgtgccacatatttggtaaaatgtac

SEQ ID NO: 174830 - DNA, 75 bp, Artificial Sequence
  Synthetic
atttgtgaaatgtgttgcgatagggcattggacaaaatctgaatcgtattaggagttccgagtaaaacgccgtta

SEQ ID NO: 174831 - DNA, 75 bp, Artificial Sequence
  Synthetic
ttcacaaacattgctgtttgagagattcttttttaggtaacggttcttgtccaaacatcaagtttgttagattga

SEQ ID NO: 174832 - DNA, 75 bp, Artificial Sequence
  Synthetic
ttcttttttaggtaacggttcttgtccaaacatcaagtttgttagattgattattttctctgatactggttcttt

SEQ ID NO: 174833 - DNA, 75 bp, Artificial Sequence
  Synthetic
agaactttctgaacaccgtctaaacaggaaactcctaataaaactaccgctgtaacaaatgcaaggaataatata

SEQ ID NO: 174834 - DNA, 75 bp, Artificial Sequence
  Synthetic
aggaaactcctaataaaactaccgctgtaacaaatgcaaggaataatatagcaatcaatgtgtagcaaagcatgt

SEQ ID NO: 174835 - DNA, 75 bp, Artificial Sequence
  Synthetic
ttcactatctaatagatccaaatccacatcaggtaatgttacctgtatttgtgttcctgtgttcttattcgtaca

SEQ ID NO: 174836 - DNA, 75 bp, Artificial Sequence
  Synthetic
acatcaggtaatgttacctgtatttgtgttcctgtgttcttattcgtacaggtacaaacatatgtggtcatttct

SEQ ID NO: 174837 - DNA, 75 bp, Artificial Sequence
  Synthetic
gcacatcactaccatacaaaggagtaaaagcacccgtagagttgaaaccaactcttttccactcttctccaaacg

SEQ ID NO: 174838 - DNA, 75 bp, Artificial Sequence
  Synthetic
aaaagcacccgtagagttgaaaccaactcttttccactcttctccaaacggactttttatcttttgcagaacttc

SEQ ID NO: 174839 - DNA, 75 bp, Artificial Sequence
  Synthetic
catcctgtatatttacaaactgctacctttacaccattctgtctaaatttcgaaaatgaacaatctatgttatta

SEQ ID NO: 174840 - DNA, 75 bp, Artificial Sequence
  Synthetic
cctttacaccattctgtctaaatttcgaaaatgaacaatctatgttattagttctatatcgttgttcatttcttt

SEQ ID NO: 174841 - DNA, 75 bp, Artificial Sequence
  Synthetic
cttaaatgtagcttcgaatgttttcgcgagtgataggtactttctttgccaaaaaaaaagttgattgaagtcatt

SEQ ID NO: 174842 - DNA, 75 bp, Artificial Sequence
  Synthetic
gcgagtgataggtactttctttgccaaaaaaaaagttgattgaagtcattttcacaagaattgatcagaaagttt

SEQ ID NO: 174843 - DNA, 75 bp, Artificial Sequence
  Synthetic
ttcgataagtgaagggatcatcttcacctaaatagtttttaatcgctacccacgtgctgtttcttttattttgca

SEQ ID NO: 174844 - DNA, 75 bp, Artificial Sequence
  Synthetic
acctaaatagtttttaatcgctacccacgtgctgtttcttttattttgcaagtagaatgtggtttcaagaattct

SEQ ID NO: 174845 - DNA, 75 bp, Artificial Sequence
  Synthetic
cgtctcagacggataaaacttttaaagggtgaacagataatttgaatatgaatgtaagactcgacatcaagacag

SEQ ID NO: 174846 - DNA, 75 bp, Artificial Sequence
  Synthetic
agggtgaacagataatttgaatatgaatgtaagactcgacatcaagacagagtttatcatatcgcttcatcagtc

SEQ ID NO: 174847 - DNA, 75 bp, Artificial Sequence
  Synthetic
caaaaaatgatttagtgtagaaaatacttgataacagttgaaagccaaatatttgccaaaatcggtttcaatttg

SEQ ID NO: 174848 - DNA, 75 bp, Artificial Sequence
  Synthetic
acttgataacagttgaaagccaaatatttgccaaaatcggtttcaatttgcgtttcgctgttgccaaaaaagaaa

SEQ ID NO: 174849 - DNA, 75 bp, Artificial Sequence
  Synthetic
cagagtgtctgattttatcgtctgaacattgtttgctcaaagatatgtcgaacaatagcaaatcatccactgtag

SEQ ID NO: 174850 - DNA, 75 bp, Artificial Sequence
  Synthetic
acattgtttgctcaaagatatgtcgaacaatagcaaatcatccactgtagcattcacatcaaaatccacaactgc

SEQ ID NO: 174851 - DNA, 75 bp, Artificial Sequence
  Synthetic
tctccataaatcacaggaacgcaaaacagcaagatagtccacatgttgaattagaaaagagtgatgagaaagaaa

SEQ ID NO: 174852 - DNA, 75 bp, Artificial Sequence
  Synthetic
acagcaagatagtccacatgttgaattagaaaagagtgatgagaaagaaagcttttatttcttaatatatatttg

SEQ ID NO: 174853 - DNA, 75 bp, Artificial Sequence
  Synthetic
attttacggtgataaacgttaggggttccgcaaaaatgtgtgcattgatctttctgtgatgacacagtggttagc

SEQ ID NO: 174854 - DNA, 75 bp, Artificial Sequence
  Synthetic
ttccgcaaaaatgtgtgcattgatctttctgtgatgacacagtggttagcaaagcacatctaacataataagtct

SEQ ID NO: 174855 - DNA, 75 bp, Artificial Sequence
  Synthetic
aacaggataagacatttgtgctggtctgattcctaattacatgagctgtatttacgccagaattttgtttatttc

SEQ ID NO: 174856 - DNA, 75 bp, Artificial Sequence
  Synthetic
ctgattcctaattacatgagctgtatttacgccagaattttgtttatttcctttaattaccctcaaaaaatgaaa

SEQ ID NO: 174857 - DNA, 75 bp, Artificial Sequence
  Synthetic
gaaacgctttcaacggagatcatgcgttgatggtagataaaacacaacaaggagaactttgcccaaaaaaacatt

SEQ ID NO: 174858 - DNA, 75 bp, Artificial Sequence
  Synthetic
gttgatggtagataaaacacaacaaggagaactttgcccaaaaaaacatttattaatcccagacaccaataaagg

SEQ ID NO: 174859 - DNA, 75 bp, Artificial Sequence
  Synthetic
tttcttagaatggttgcgtttggggtttttaattagtaaaactaacaacgctaacgctacaataccaataaaact

SEQ ID NO: 174860 - DNA, 75 bp, Artificial Sequence
  Synthetic
tttttaattagtaaaactaacaacgctaacgctacaataccaataaaactaactgctgcaattaaaatcacaagg

SEQ ID NO: 174861 - DNA, 75 bp, Artificial Sequence
  Synthetic
tattcaaaagttgaggttttgtcagttctggagttgaaattgtcagtgtgaaaaattcagatgcattcccactgt

SEQ ID NO: 174862 - DNA, 75 bp, Artificial Sequence
  Synthetic
ttctggagttgaaattgtcagtgtgaaaaattcagatgcattcccactgttttcatgattagtagtactgccact

SEQ ID NO: 174863 - DNA, 75 bp, Artificial Sequence
  Synthetic
tttaaggatgtagattcgacattctctttagttgttgcgatagtcgtaggtatactcatagacacagacattaaa

SEQ ID NO: 174864 - DNA, 75 bp, Artificial Sequence
  Synthetic
ctttagttgttgcgatagtcgtaggtatactcatagacacagacattaaatcgctcgtactctctgtatctgatg

SEQ ID NO: 174865 - DNA, 75 bp, Artificial Sequence
  Synthetic
agttcttgacatttccagagtgggcgtactagaaacagtactcatgttaacaaaggtaaccatttctaaaaaaaa

SEQ ID NO: 174866 - DNA, 75 bp, Artificial Sequence
  Synthetic
gtactagaaacagtactcatgttaacaaaggtaaccatttctaaaaaaaataaaattccaaataacattttaaac

SEQ ID NO: 174867 - DNA, 75 bp, Artificial Sequence
  Synthetic
ttaatattgtacgtgtgccgactaaattactgtttttaagcaacgcaaaaaagtgctggaatcggtgtaaaattc

SEQ ID NO: 174868 - DNA, 75 bp, Artificial Sequence
  Synthetic
attactgtttttaagcaacgcaaaaaagtgctggaatcggtgtaaaattcagggcttcgtacccccatatcgaac

SEQ ID NO: 174869 - DNA, 75 bp, Artificial Sequence
  Synthetic
agacataagataaccgatattatgagacatgccagtattataaaagtccctcttcggcgcacatttttgatttca

SEQ ID NO: 174870 - DNA, 75 bp, Artificial Sequence
  Synthetic
gacatgccagtattataaaagtccctcttcggcgcacatttttgatttcagaactagaagttgaatttattgttc

SEQ ID NO: 174871 - DNA, 75 bp, Artificial Sequence
  Synthetic
aaaaacggaatgatcgtggaacatttgcaacattacatcattataagaaggtggcggtgtctcatgagtcatctt

SEQ ID NO: 174872 - DNA, 75 bp, Artificial Sequence
  Synthetic
tgcaacattacatcattataagaaggtggcggtgtctcatgagtcatcttctagggatatttagagcacctgata

SEQ ID NO: 174873 - DNA, 75 bp, Artificial Sequence
  Synthetic
aaggacttatataatcatgatatgcaatgcaagccaaaataaacagaacaaacaaataataaatccctttccaac

SEQ ID NO: 174874 - DNA, 75 bp, Artificial Sequence
  Synthetic
aatgcaagccaaaataaacagaacaaacaaataataaatccctttccaacaatcttcataggtctctgggaaaaa

SEQ ID NO: 174875 - DNA, 75 bp, Artificial Sequence
  Synthetic
tgcagaattattttttctaccaacacttttccatagtaatggttgtttaaatatgttcctttttttccttttaca

SEQ ID NO: 174876 - DNA, 75 bp, Artificial Sequence
  Synthetic
cttttccatagtaatggttgtttaaatatgttcctttttttccttttacaagtatttccccatggacagttgatc

SEQ ID NO: 174877 - DNA, 75 bp, Artificial Sequence
  Synthetic
ttctaacatcgtttgttctttcaaaccaatacccatgtagtcgacgattttcattaaatcgtaaacaaccgattt

SEQ ID NO: 174878 - DNA, 75 bp, Artificial Sequence
  Synthetic
ccaatacccatgtagtcgacgattttcattaaatcgtaaacaaccgattttcaaaaattcagttatgttatgtgc

SEQ ID NO: 174879 - DNA, 75 bp, Artificial Sequence
  Synthetic
acaccaaaaattttcccattcacatcgaatattatcacaagttcaaaccacttcccaaaaacgttgtgttttaca

SEQ ID NO: 174880 - DNA, 75 bp, Artificial Sequence
  Synthetic
cgaatattatcacaagttcaaaccacttcccaaaaacgttgtgttttacacaaaaaagaacatctacaatgttgc

SEQ ID NO: 174881 - DNA, 75 bp, Artificial Sequence
  Synthetic
aaggtcttgatcagtataaggtgtcatgggaagtctgcaaaatcgtgtgtatgttttataaggactacttttcaa

SEQ ID NO: 174882 - DNA, 75 bp, Artificial Sequence
  Synthetic
atgggaagtctgcaaaatcgtgtgtatgttttataaggactacttttcaatataaaacaaacgtttatattttca

SEQ ID NO: 174883 - DNA, 75 bp, Artificial Sequence
  Synthetic
aagatttgctatgctccacgattttgctaccagtttcaaagtccacgataaaatcacacaattcgtagatggggt

SEQ ID NO: 174884 - DNA, 75 bp, Artificial Sequence
  Synthetic
gctaccagtttcaaagtccacgataaaatcacacaattcgtagatggggtagaaaaacttcaatcctactaaaaa

SEQ ID NO: 174885 - DNA, 75 bp, Artificial Sequence
  Synthetic
tagtaaagacttttgtcaaaaaaaccattgtagacatacaaatgccctctgtcaccttgtaaaagaattggtcct

SEQ ID NO: 174886 - DNA, 75 bp, Artificial Sequence
  Synthetic
cattgtagacatacaaatgccctctgtcaccttgtaaaagaattggtcctctgcaagttgattttttaacatgat

SEQ ID NO: 174887 - DNA, 75 bp, Artificial Sequence
  Synthetic
tttttcacaacacaagtaagtgtttcgaatttcttcgatgtcttcctttgaaatttctgggattgtttctaatga

SEQ ID NO: 174888 - DNA, 75 bp, Artificial Sequence
  Synthetic
cgaatttcttcgatgtcttcctttgaaatttctgggattgtttctaatgagtgaaatgtaactcgccattcttct

SEQ ID NO: 174889 - DNA, 75 bp, Artificial Sequence
  Synthetic
cttccttacttaagatgaattcttcgagaagagtaagtttattgacacagcacaaattcgctaagaaatccatgc

SEQ ID NO: 174890 - DNA, 75 bp, Artificial Sequence
  Synthetic
gagaagagtaagtttattgacacagcacaaattcgctaagaaatccatgcttcagttttaaaattacccaagaaa

SEQ ID NO: 174891 - DNA, 75 bp, Artificial Sequence
  Synthetic
ttttttatttagcacatttagaagctgcaaattttctttagaaaaaaattacaaagcaagctgaacaataaaaaa

SEQ ID NO: 174892 - DNA, 75 bp, Artificial Sequence
  Synthetic
tgcaaattttctttagaaaaaaattacaaagcaagctgaacaataaaaaaggttcaacaaatcgcctgtaaaaat

SEQ ID NO: 174893 - DNA, 75 bp, Artificial Sequence
  Synthetic
atttgagcaaatagagcgctataacctaagccaagaaagaactcaaacaacaatgaaaagaaacaatgttctgtt

SEQ ID NO: 174894 - DNA, 75 bp, Artificial Sequence
  Synthetic
ctaagccaagaaagaactcaaacaacaatgaaaagaaacaatgttctgttattacccctgctaacaaacacagaa

SEQ ID NO: 174895 - DNA, 75 bp, Artificial Sequence
  Synthetic
tttagtgataaacaaattactatgtaagactgccaagaaaaataaatgctggcaactttttcttggtaaatacaa

SEQ ID NO: 174896 - DNA, 75 bp, Artificial Sequence
  Synthetic
aagactgccaagaaaaataaatgctggcaactttttcttggtaaatacaattttccaaaccaaaccagcagcgtt

SEQ ID NO: 174897 - DNA, 75 bp, Artificial Sequence
  Synthetic
caataacatcttttatagccatttggtacgggccattcggtttatagatcggtttgtatcgctgaagacacatgg

SEQ ID NO: 174898 - DNA, 75 bp, Artificial Sequence
  Synthetic
gtacgggccattcggtttatagatcggtttgtatcgctgaagacacatggcaaactgatgagagttaaccagaaa

SEQ ID NO: 174899 - DNA, 75 bp, Artificial Sequence
  Synthetic
atcagaaacactgtaacaagcaatctgtaatgaaccaaatctgatatttttaacacaatggcaattagggtgccg

SEQ ID NO: 174900 - DNA, 75 bp, Artificial Sequence
  Synthetic
gaaatattagcatgcatctacagactatggctctcaagcggatttcagaaaaaaataaaaacgagcagattacca

SEQ ID NO: 174901 - DNA, 75 bp, Artificial Sequence
  Synthetic
cacgagtaatgataaagttataattttgagatcgttgaaaggacaatagttaaacaaattcacccgacggtaagt

SEQ ID NO: 174902 - DNA, 75 bp, Artificial Sequence
  Synthetic
ttgagatcgttgaaaggacaatagttaaacaaattcacccgacggtaagtcaatagcaaacctccgctaaaaagg

SEQ ID NO: 174903 - DNA, 75 bp, Artificial Sequence
  Synthetic
gcgttttctttatcataagatggaaacagctttctcccggaattacattccctaaaacaaggcccatagaaaaac

SEQ ID NO: 174904 - DNA, 75 bp, Artificial Sequence
  Synthetic
cttttcgaatttggggtatagtcaaaatgtgcagaatcgtcactttcgctgtcctctttctcattaaaaaaattt

SEQ ID NO: 174905 - DNA, 75 bp, Artificial Sequence
  Synthetic
aatgtgcagaatcgtcactttcgctgtcctctttctcattaaaaaaatttgttcctgtgccaccatttttagtgg

SEQ ID NO: 174906 - DNA, 75 bp, Artificial Sequence
  Synthetic
gtcctctttctcattaaaaaaatttgttcctgtgccaccatttttagtgggcaccatgtaacttgtaattttgtg

SEQ ID NO: 174907 - DNA, 75 bp, Artificial Sequence
  Synthetic
ttatttccttcctccaccttgtgatttttctctcctttttcctctgtttttgcttgacgttcaaattttgggtcg

SEQ ID NO: 174908 - DNA, 75 bp, Artificial Sequence
  Synthetic
ttttctctcctttttcctctgtttttgcttgacgttcaaattttgggtcgtctttaacctgctcttgacttaaat

SEQ ID NO: 174909 - DNA, 75 bp, Artificial Sequence
  Synthetic
tttagcgattaaaaataatttgtattctttgccagctattgctctaagactacacgaagactttaaaactgcaca

SEQ ID NO: 174910 - DNA, 75 bp, Artificial Sequence
  Synthetic
tctttgccagctattgctctaagactacacgaagactttaaaactgcacaagtactaaatgcttgctgtagattt

SEQ ID NO: 174911 - DNA, 75 bp, Artificial Sequence
  Synthetic
attttgcgtcgtgaaacacaactttcccgctatgagcaaattctatttcgtttaagtcggttagaaattttatac

SEQ ID NO: 174912 - DNA, 75 bp, Artificial Sequence
  Synthetic
cccgctatgagcaaattctatttcgtttaagtcggttagaaattttatacttggcgggttaacttgcacaactat

SEQ ID NO: 174913 - DNA, 75 bp, Artificial Sequence
  Synthetic
ttactgcgtttgttctttgtgaccggagcaagccattttaaaatctccgttacagttgaatggtccaagtctatt

SEQ ID NO: 174914 - DNA, 75 bp, Artificial Sequence
  Synthetic
gagcaagccattttaaaatctccgttacagttgaatggtccaagtctattcgaagtgcagattttccgctttctc

SEQ ID NO: 174915 - DNA, 75 bp, Artificial Sequence
  Synthetic
aggaatagatgcttgtgcacaaatatctgatgccgtgactaaaaaccgcgtatagagatcgctatcatgttgaat

SEQ ID NO: 174916 - DNA, 75 bp, Artificial Sequence
  Synthetic
tctgatgccgtgactaaaaaccgcgtatagagatcgctatcatgttgaatatacagtttagtgacatcaggattt

SEQ ID NO: 174917 - DNA, 75 bp, Artificial Sequence
  Synthetic
ataatggaacaaagttatttatcgttttagtcgaaaaatgatctgtatcggttatatataaacattctgcatgaa

SEQ ID NO: 174918 - DNA, 75 bp, Artificial Sequence
  Synthetic
tttagtcgaaaaatgatctgtatcggttatatataaacattctgcatgaataatcagctttaaaaccaaatggtt

SEQ ID NO: 174919 - DNA, 75 bp, Artificial Sequence
  Synthetic
ggttgaggagtaaaagtaactgtagtattttctcgcaaaagctttgcaaaagctcttagaggcttattgattgtt

SEQ ID NO: 174920 - DNA, 75 bp, Artificial Sequence
  Synthetic
tattttctcgcaaaagctttgcaaaagctcttagaggcttattgattgttttccaagttttcatgtgaaaagcca

SEQ ID NO: 174921 - DNA, 75 bp, Artificial Sequence
  Synthetic
atgttcgcgatgatctcggtgactatggtgttctctgttgctacgatccatgctgcaccaaaaatagatattaac

SEQ ID NO: 174922 - DNA, 75 bp, Artificial Sequence
  Synthetic
tggtgttctctgttgctacgatccatgctgcaccaaaaatagatattaacaggaagagttgtatgagaatactaa

SEQ ID NO: 174923 - DNA, 75 bp, Artificial Sequence
  Synthetic
tatatactgtgtttttttggcgccaaatttttattacatcactgaaatacatgcatagtactcatcaccacacca

SEQ ID NO: 174924 - DNA, 75 bp, Artificial Sequence
  Synthetic
aatttttattacatcactgaaatacatgcatagtactcatcaccacaccatcagaaaaaccactcagcaaatcaa

SEQ ID NO: 174925 - DNA, 75 bp, Artificial Sequence
  Synthetic
acacttttgatttttatacacagcttgataaattcctgttttaaacccattttgatacaaacatactaaaatgtc

SEQ ID NO: 174926 - DNA, 75 bp, Artificial Sequence
  Synthetic
tgataaattcctgttttaaacccattttgatacaaacatactaaaatgtccctcatattttctgtcttatttatg

SEQ ID NO: 174927 - DNA, 75 bp, Artificial Sequence
  Synthetic
ctgtaaacggcaacgcaccgacgtacatatttagcatttcattcacagaatagtcaaaagcattgagaaaaattg

SEQ ID NO: 174928 - DNA, 75 bp, Artificial Sequence
  Synthetic
catatttagcatttcattcacagaatagtcaaaagcattgagaaaaattgtcatttcctgcatttcttcttcgga

SEQ ID NO: 174929 - DNA, 75 bp, Artificial Sequence
  Synthetic
acatcataatttacagagcttaagtactctaaatggtttttaaatctgtttaagaacaggccattgtacactggt

SEQ ID NO: 174930 - DNA, 75 bp, Artificial Sequence
  Synthetic
actctaaatggtttttaaatctgtttaagaacaggccattgtacactggtatgtataatgtctgtaattcagtag

SEQ ID NO: 174931 - DNA, 75 bp, Artificial Sequence
  Synthetic
aacaggattaggatgcaaaacttttatactagatcgctttaaaatcttatttccctctatgggacaaaaagattg

SEQ ID NO: 174932 - DNA, 75 bp, Artificial Sequence
  Synthetic
atactagatcgctttaaaatcttatttccctctatgggacaaaaagattgtgagcaatttaacaaatcgaactct

SEQ ID NO: 174933 - DNA, 75 bp, Artificial Sequence
  Synthetic
aggttagatttctaagcccatatttttttatgtcgcttcttaaattcgtccataaaacatttggtaatgtatatt

SEQ ID NO: 174934 - DNA, 75 bp, Artificial Sequence
  Synthetic
ttttatgtcgcttcttaaattcgtccataaaacatttggtaatgtatattcaacattatcatacaaatcgcagtg

SEQ ID NO: 174935 - DNA, 75 bp, Artificial Sequence
  Synthetic
ctttgaaaaaaactgcaaggttccgctccttttttgcaacaattcatacttgttctaacactagaatagtaaatg

SEQ ID NO: 174936 - DNA, 75 bp, Artificial Sequence
  Synthetic
ctccttttttgcaacaattcatacttgttctaacactagaatagtaaatgttctcgcatactattcgatataatt

SEQ ID NO: 174937 - DNA, 75 bp, Artificial Sequence
  Synthetic
cagattcattgacattaatgctgaatgtaatccagtaacacagatagccaagcttcttgcattgactattccatc

SEQ ID NO: 174938 - DNA, 75 bp, Artificial Sequence
  Synthetic
tgtaatccagtaacacagatagccaagcttcttgcattgactattccatccattaaaaaatccctattttccaaa

SEQ ID NO: 174939 - DNA, 75 bp, Artificial Sequence
  Synthetic
tcaaaactaactcagtcactgtttttctcattttctttaaattgaaaattttatctctataatgaaacatatcta

SEQ ID NO: 174940 - DNA, 75 bp, Artificial Sequence
  Synthetic
tctcattttctttaaattgaaaattttatctctataatgaaacatatctatgttagtatgggacttttgttcttc

SEQ ID NO: 174941 - DNA, 75 bp, Artificial Sequence
  Synthetic
agatttaaggcaattctgaaagctgtattcaggccatattcaaaaggaattacatccatagaatttccaagacag

SEQ ID NO: 174942 - DNA, 75 bp, Artificial Sequence
  Synthetic
tattcaggccatattcaaaaggaattacatccatagaatttccaagacagtaggaagctatttgaggtaacatgg

SEQ ID NO: 174943 - DNA, 75 bp, Artificial Sequence
  Synthetic
gatgaatcccatctgtcctctgcgtaggcagcgacaaatattatccagcaacgtttcagttttgattctggcatg

SEQ ID NO: 174944 - DNA, 75 bp, Artificial Sequence
  Synthetic
aggcagcgacaaatattatccagcaacgtttcagttttgattctggcatgttcagcggtgcgttcacattcaaga

SEQ ID NO: 174945 - DNA, 75 bp, Artificial Sequence
  Synthetic
catataaccctaaattaattgccagagctttgtggaaaactgaccaataagaattttcagttttcagccgttcca

SEQ ID NO: 174946 - DNA, 75 bp, Artificial Sequence
  Synthetic
agctttgtggaaaactgaccaataagaattttcagttttcagccgttccataaaaatttctggcagtattagaca

SEQ ID NO: 174947 - DNA, 75 bp, Artificial Sequence
  Synthetic
aaaatttcacagaagtccagccacattaataatgacaggtgccaaatttcaagataaattgttagaccagttgtt

SEQ ID NO: 174948 - DNA, 75 bp, Artificial Sequence
  Synthetic
ttaataatgacaggtgccaaatttcaagataaattgttagaccagttgttttatttgtgtccttctctacaattt

SEQ ID NO: 174949 - DNA, 75 bp, Artificial Sequence
  Synthetic
aagagactctgcctcgtagtgataacgagtcagatttacactaacatatgatccatttaacatcgcaggcaagaa

SEQ ID NO: 174950 - DNA, 75 bp, Artificial Sequence
  Synthetic
cgagtcagatttacactaacatatgatccatttaacatcgcaggcaagaaaaaaccactgttaatgtccaaaaaa

SEQ ID NO: 174951 - DNA, 75 bp, Artificial Sequence
  Synthetic
tatgaaagacagtgtcaaaaacactctttttttcagacactaaacccaaattactcatacaaggaaaaggtaaca

SEQ ID NO: 174952 - DNA, 75 bp, Artificial Sequence
  Synthetic
ctttttttcagacactaaacccaaattactcatacaaggaaaaggtaacatacaaactctcttatacaataaaat

SEQ ID NO: 174953 - DNA, 75 bp, Artificial Sequence
  Synthetic
ttgtgactaacaaaacttttttgtaaatattcgattttttttatttgactggccaatgtcacactgattcttaga

SEQ ID NO: 174954 - DNA, 75 bp, Artificial Sequence
  Synthetic
aatattcgattttttttatttgactggccaatgtcacactgattcttagaaaaatcgttgggatgttttcttcga

SEQ ID NO: 174955 - DNA, 75 bp, Artificial Sequence
  Synthetic
atcgagaaatctcgatgcagctaatactcctggtgaaaacttcgctctccagacatggatagctgcttgcaagat

SEQ ID NO: 174956 - DNA, 75 bp, Artificial Sequence
  Synthetic
actcctggtgaaaacttcgctctccagacatggatagctgcttgcaagattttttcaagttctactttggagtca

SEQ ID NO: 174957 - DNA, 75 bp, Artificial Sequence
  Synthetic
gtaaaatattttcactttctaaaataagtgagatggaatcaaattccgaagcagagtttgttttgagatagaact

SEQ ID NO: 174958 - DNA, 75 bp, Artificial Sequence
  Synthetic
aagtgagatggaatcaaattccgaagcagagtttgttttgagatagaactggcctaacaaacgatcaacgtgcgg

SEQ ID NO: 174959 - DNA, 75 bp, Artificial Sequence
  Synthetic
gaaattatggcatcacgtaagcaccacatatctaagcccgaatttaagcgccggagaatttttgaaatttcatat

SEQ ID NO: 174960 - DNA, 75 bp, Artificial Sequence
  Synthetic
acatatctaagcccgaatttaagcgccggagaatttttgaaatttcatataactgcttataaagaagagttttgt

SEQ ID NO: 174961 - DNA, 75 bp, Artificial Sequence
  Synthetic
ttttttgttatattcatcatgacaaagacatttcctcaagagacccatgtttttatttatggaaactttattgtt

SEQ ID NO: 174962 - DNA, 75 bp, Artificial Sequence
  Synthetic
agacatttcctcaagagacccatgtttttatttatggaaactttattgttaggatccataatcacaagaaaattt

SEQ ID NO: 174963 - DNA, 75 bp, Artificial Sequence
  Synthetic
gtctttgagtcttataatggttaatgagataccctgtaagtctaaaattcctgattttatgttttgggttttaca

SEQ ID NO: 174964 - DNA, 75 bp, Artificial Sequence
  Synthetic
gagataccctgtaagtctaaaattcctgattttatgttttgggttttacaatgaccaattcgttgaaggcttcca

SEQ ID NO: 174965 - DNA, 75 bp, Artificial Sequence
  Synthetic
tgatcaaatagttcataaacataaatcgttctttggaaaacttgtttcttaataaatctatcaatacttcttcat

SEQ ID NO: 174966 - DNA, 75 bp, Artificial Sequence
  Synthetic
tcgttctttggaaaacttgtttcttaataaatctatcaatacttcttcatgtgtcagctcagataaaacaatgta

SEQ ID NO: 174967 - DNA, 75 bp, Artificial Sequence
  Synthetic
gcttgcctatagatataacagaggtaaatgtactgaattgcattttgtcttggttcccagtcaggttccaataat

SEQ ID NO: 174968 - DNA, 75 bp, Artificial Sequence
  Synthetic
aaatgtactgaattgcattttgtcttggttcccagtcaggttccaataataaatctttcaatatgaccaatccat

SEQ ID NO: 174969 - DNA, 75 bp, Artificial Sequence
  Synthetic
tacatgaccttgcattacacaggatattagacaattagtcccttgagagatataattagttactccaaacaaaga

SEQ ID NO: 174970 - DNA, 75 bp, Artificial Sequence
  Synthetic
attagacaattagtcccttgagagatataattagttactccaaacaaagacaccttttcttctaagtaagaacaa

SEQ ID NO: 174971 - DNA, 75 bp, Artificial Sequence
  Synthetic
caactaatgaagttttatacagattagctaaagaagtcctcgtgcagaaagacacattgaaggcattcatggcta

SEQ ID NO: 174972 - DNA, 75 bp, Artificial Sequence
  Synthetic
agctaaagaagtcctcgtgcagaaagacacattgaaggcattcatggctaaaaacaatacactaatcaacaaaaa

SEQ ID NO: 174973 - DNA, 75 bp, Artificial Sequence
  Synthetic
agtctgaacataagcattcctaaatggtctcgttcaggtcctaaaagttcgcaaggagtaaaacttcgcgaaagc

SEQ ID NO: 174974 - DNA, 75 bp, Artificial Sequence
  Synthetic
ggtctcgttcaggtcctaaaagttcgcaaggagtaaaacttcgcgaaagcacacactctttgggaacaccaaaag

SEQ ID NO: 174975 - DNA, 75 bp, Artificial Sequence
  Synthetic
ctcattttcaatgagattatttaaggaagtttcatcaattgtctgatgtttccttttttgaagcatttccattgt

SEQ ID NO: 174976 - DNA, 75 bp, Artificial Sequence
  Synthetic
gaagtttcatcaattgtctgatgtttccttttttgaagcatttccattgttcgcaagcgaaatggattgtacaaa

SEQ ID NO: 174977 - DNA, 75 bp, Artificial Sequence
  Synthetic
ttacttaaaacagatgtgtccgataatacattcttaactataacagcgaaaattgaaattttttctcttgcggct

SEQ ID NO: 174978 - DNA, 75 bp, Artificial Sequence
  Synthetic
atacattcttaactataacagcgaaaattgaaattttttctcttgcggctgaaagtatcacagcagataagatat

SEQ ID NO: 174979 - DNA, 75 bp, Artificial Sequence
  Synthetic
acacaattatcatttcaactttattaaaaatcatatggtgttttatatattaaattatagtactctaggatttgc

SEQ ID NO: 174980 - DNA, 75 bp, Artificial Sequence
  Synthetic
aaaaatcatatggtgttttatatattaaattatagtactctaggatttgccaaaagattttcaatagctgaaaca

SEQ ID NO: 174981 - DNA, 75 bp, Artificial Sequence
  Synthetic
acagaacattccaatcaacgtctaaattacaaaacttaaataatgcagaagtcctttatcaatttgaaaaactta

SEQ ID NO: 174982 - DNA, 75 bp, Artificial Sequence
  Synthetic
attacaaaacttaaataatgcagaagtcctttatcaatttgaaaaacttattgaatccattcaagtattcaaggc

SEQ ID NO: 174983 - DNA, 75 bp, Artificial Sequence
  Synthetic
cttctacgtcaagaaacaatgatctatgacaaacccacagaaaaatcagttaaatatgtcattattcagcaaaat

SEQ ID NO: 174984 - DNA, 75 bp, Artificial Sequence
  Synthetic
atgacaaacccacagaaaaatcagttaaatatgtcattattcagcaaaatttgataaaaattaataacttaattc

SEQ ID NO: 174985 - DNA, 75 bp, Artificial Sequence
  Synthetic
tagactcatagcggagctgatagatgaattatatcaaaaagtttataggtggtttatgcaaattttcacatacga

SEQ ID NO: 174986 - DNA, 75 bp, Artificial Sequence
  Synthetic
gaattatatcaaaaagtttataggtggtttatgcaaattttcacatacgacgatattattttccccaatgacaat

SEQ ID NO: 174987 - DNA, 75 bp, Artificial Sequence
  Synthetic
atttctgctatacatattacacggcatctaatcagcatttattatcactttttgaacagacaattgacaatcaaa

SEQ ID NO: 174988 - DNA, 75 bp, Artificial Sequence
  Synthetic
atctaatcagcatttattatcactttttgaacagacaattgacaatcaaatttttatcgacccttctccatactt

SEQ ID NO: 174989 - DNA, 75 bp, Artificial Sequence
  Synthetic
gaattacaatttatgagcacatttagcttaaagatattttcaaaaaatatttcagcgaaaaacgaagatctatat

SEQ ID NO: 174990 - DNA, 75 bp, Artificial Sequence
  Synthetic
gcttaaagatattttcaaaaaatatttcagcgaaaaacgaagatctatatatttatccacttttaaaaacaaact

SEQ ID NO: 174991 - DNA, 75 bp, Artificial Sequence
  Synthetic
agaaaatatttttttccatcatggatttatataccacatcttgcatagaacaaatatcacaccaactgaagaaaa

SEQ ID NO: 174992 - DNA, 75 bp, Artificial Sequence
  Synthetic
tttatataccacatcttgcatagaacaaatatcacaccaactgaagaaaaaaaattaggaaaaataaatggattc

SEQ ID NO: 174993 - DNA, 75 bp, Artificial Sequence
  Synthetic
caaacaacagttaccataactcaaatcttgccaggttctaaggaagcaataattttcccagtttacgatataggc

SEQ ID NO: 174994 - DNA, 75 bp, Artificial Sequence
  Synthetic
taattaaaaagaataacttacaaatcactttcccggagttgcttgataaaatctatcatttgcatagaataggct

SEQ ID NO: 174995 - DNA, 75 bp, Artificial Sequence
  Synthetic
cactttcccggagttgcttgataaaatctatcatttgcatagaataggcttgaatatcgaaacggcacaaatttt

SEQ ID NO: 174996 - DNA, 75 bp, Artificial Sequence
  Synthetic
ccagcgacgacaaataataagttgcagacatttttcacgaatttttcaataataattttttcggcatatattttt

SEQ ID NO: 174997 - DNA, 75 bp, Artificial Sequence
  Synthetic
agacatttttcacgaatttttcaataataattttttcggcatatattttttttctatgtattgagttattcagcc

SEQ ID NO: 174998 - DNA, 75 bp, Artificial Sequence
  Synthetic
aaaacttatcctcgagaaacaaaaatccatcatactaattctcggtgaacagttctctttcatttggaaagaggt

SEQ ID NO: 174999 - DNA, 75 bp, Artificial Sequence
  Synthetic
agtagcacagttacagaaacctatttcaaattttattctaaaggtgccgatgactacgaaaaagattttctttat

SEQ ID NO: 175000 - DNA, 75 bp, Artificial Sequence
  Synthetic
aattgtttttcccattaacttattcaatgacaacgccacagaaatataccgacaagcatgtatcaagtacagttt

SEQ ID NO: 175001 - DNA, 75 bp, Artificial Sequence
  Synthetic
aatgacaacgccacagaaatataccgacaagcatgtatcaagtacagttttgaaaaatttatgtgatacagcata

SEQ ID NO: 175002 - DNA, 75 bp, Artificial Sequence
  Synthetic
gaaagtctattaccatatattactcacccagagttcaaattcatttttattacacattacgtcagaccttctttg

SEQ ID NO: 175003 - DNA, 75 bp, Artificial Sequence
  Synthetic
acccagagttcaaattcatttttattacacattacgtcagaccttctttgtcattaatcacaaacttaacctttg

SEQ ID NO: 175004 - DNA, 75 bp, Artificial Sequence
  Synthetic
actaatactaatattcgcgtgtaaactgctaatgccatcaaattatcttttatcacattacttattattgttaca

SEQ ID NO: 175005 - DNA, 75 bp, Artificial Sequence
  Synthetic
ctgctaatgccatcaaattatcttttatcacattacttattattgttacacgctttcacactacaaattttcaaa

SEQ ID NO: 175006 - DNA, 75 bp, Artificial Sequence
  Synthetic
tacatgcaattactcaaaaaatttttgacaatattaattctctgacccaaactatttttattccaaaaacaaatt

SEQ ID NO: 175007 - DNA, 75 bp, Artificial Sequence
  Synthetic
tgacaatattaattctctgacccaaactatttttattccaaaaacaaattttttagtcagccttttattaacagc

SEQ ID NO: 175008 - DNA, 75 bp, Artificial Sequence
  Synthetic
gtgaatccttggatacaaaaaacaatcagtgaaaatatagcccttcttaaagaatacatcgatttcacaaagaaa

SEQ ID NO: 175009 - DNA, 75 bp, Artificial Sequence
  Synthetic
tcagtgaaaatatagcccttcttaaagaatacatcgatttcacaaagaaatgttcaagtactttggcaactacgt

SEQ ID NO: 175010 - DNA, 75 bp, Artificial Sequence
  Synthetic
agtaaatatgtattttgggaaaaacaaggttggaagtacttcactatcagctttttatagaacttgctctaagct

SEQ ID NO: 175011 - DNA, 75 bp, Artificial Sequence
  Synthetic
aattgaggaatctaaactgtttaaagataggcttcaagaaatcaaagtttcaaaaacattgtttatagagatgct

SEQ ID NO: 175012 - DNA, 75 bp, Artificial Sequence
  Synthetic
aaatttaaggatttagtctcaaatcaaactttgcaaaattttataattattgttgaaagaatctcctctcatgca

SEQ ID NO: 175013 - DNA, 75 bp, Artificial Sequence
  Synthetic
aaactttgcaaaattttataattattgttgaaagaatctcctctcatgcaaatacaacatatcaagatgttctca

SEQ ID NO: 175014 - DNA, 75 bp, Artificial Sequence
  Synthetic
aaacatgcaacttatccaatcttttaaaaacatcgtgtatgtcattgatgttctgaatactaaaaacatctttaa

SEQ ID NO: 175015 - DNA, 75 bp, Artificial Sequence
  Synthetic
aaaaacatcgtgtatgtcattgatgttctgaatactaaaaacatctttaacttttctctcgcatcacaattaatt

SEQ ID NO: 175016 - DNA, 75 bp, Artificial Sequence
  Synthetic
aggacacctataatcaattaaatgtgcaagatgattttgtcactgtattaaagtcacatctaaataatctgtttg

SEQ ID NO: 175017 - DNA, 75 bp, Artificial Sequence
  Synthetic
gcaagatgattttgtcactgtattaaagtcacatctaaataatctgtttgaaaagcagaagcctacaattaatat

SEQ ID NO: 175018 - DNA, 75 bp, Artificial Sequence
  Synthetic
atacccgacataaaacagattccattcttggatgtttttgatgaaagatatagactaataccacaaattgaaaag

SEQ ID NO: 175019 - DNA, 75 bp, Artificial Sequence
  Synthetic
tatctgcattggtacattgcatatagtgaagctgcgcaggctgatttggtcgagcctttactcttaaaacttggt

SEQ ID NO: 175020 - DNA, 75 bp, Artificial Sequence
  Synthetic
caaatcaaaacgatcctaaatacggaccaagagccggaaagcaatgtatgtcaaattgtttttctttcttgcata

SEQ ID NO: 175021 - DNA, 75 bp, Artificial Sequence
  Synthetic
accaagagccggaaagcaatgtatgtcaaattgtttttctttcttgcatacagtttatttgaacggaataaacaa

SEQ ID NO: 175022 - DNA, 75 bp, Artificial Sequence
  Synthetic
ataatcatggaaaatggagcattattggataatatcagtacaacgacattgaaactcgaaactggcaatatccca

SEQ ID NO: 175023 - DNA, 75 bp, Artificial Sequence
  Synthetic
tggataatatcagtacaacgacattgaaactcgaaactggcaatatcccagaatatcgatttttcacagaaatcc

SEQ ID NO: 175024 - DNA, 75 bp, Artificial Sequence
  Synthetic
cgaaacaatacatgaattatctagaccctttaatggtaccttagaatcacaacatatagataatgaagtttatct

SEQ ID NO: 175025 - DNA, 75 bp, Artificial Sequence
  Synthetic
ccctttaatggtaccttagaatcacaacatatagataatgaagtttatcttggactgttagactttctattgtat

SEQ ID NO: 175026 - DNA, 75 bp, Artificial Sequence
  Synthetic
ttgtcatcactataggggtaatggcacgagctatatttatagttgatgaattgttttacctttttgattcacatg

SEQ ID NO: 175027 - DNA, 75 bp, Artificial Sequence
  Synthetic
acgagctatatttatagttgatgaattgttttacctttttgattcacatgcatcagacacagaaaactctgcagc

SEQ ID NO: 175028 - DNA, 75 bp, Artificial Sequence
  Synthetic
gaattatatgctctattggccatagagaatgttgcggaattttactatgatgcagttttttcatatttcattgaa

SEQ ID NO: 175029 - DNA, 75 bp, Artificial Sequence
  Synthetic
acgactgatttatctcttgaagacggagatgcaacaattttaattttaaagacttacaaagatccagatatagct

SEQ ID NO: 175030 - DNA, 75 bp, Artificial Sequence
  Synthetic
tgtattcatctacatcctcaacaaagacagcggaaacaaacactttaatttcaaaacaatcaccaagcaaacgca

SEQ ID NO: 175031 - DNA, 75 bp, Artificial Sequence
  Synthetic
gacagcggaaacaaacactttaatttcaaaacaatcaccaagcaaacgcaaacaagaaaaaaccagtctaaattc

SEQ ID NO: 175032 - DNA, 75 bp, Artificial Sequence
  Synthetic
cagggctcatcactcaaatactataacaatgaagtagatttagtaccaagtttttatgagcttagacctcaattt

SEQ ID NO: 175033 - DNA, 75 bp, Artificial Sequence
  Synthetic
acaatgaagtagatttagtaccaagtttttatgagcttagacctcaatttaacaatattttatttgagctttcta

SEQ ID NO: 175034 - DNA, 75 bp, Artificial Sequence
  Synthetic
aaattggaccctttacatacagaaatttgcaacaaagtctacacagccatttacaaaaccttttatatggaatag

SEQ ID NO: 175035 - DNA, 75 bp, Artificial Sequence
  Synthetic
tttgcaacaaagtctacacagccatttacaaaaccttttatatggaatagggtattccatctattttctcaagtg

SEQ ID NO: 175036 - DNA, 75 bp, Artificial Sequence
  Synthetic
acgatcattgggatgagacacaacagcaaaaacaattcttcacacatttcttgccgttcaaagaattttctgagg

SEQ ID NO: 175037 - DNA, 75 bp, Artificial Sequence
  Synthetic
ccgagaaaataatcttgatctaatattgctttataaaaactatctttcgaaaactactgcattcaaaaaccttga

SEQ ID NO: 175038 - DNA, 75 bp, Artificial Sequence
  Synthetic
ttgctttataaaaactatctttcgaaaactactgcattcaaaaaccttgaaagaattttattaacgaagtttagc

SEQ ID NO: 175039 - DNA, 75 bp, Artificial Sequence
  Synthetic
aaactactgcattcaaaaaccttgaaagaattttattaacgaagtttagcgccattgtcagtccggtgcatgaaa

SEQ ID NO: 175040 - DNA, 75 bp, Artificial Sequence
  Synthetic
gctaactaacttaatacaaaaactagtcaaacatcccgaggataccaatgctttcatcaatgactacgtgttaaa

SEQ ID NO: 175041 - DNA, 75 bp, Artificial Sequence
  Synthetic
gtcaaacatcccgaggataccaatgctttcatcaatgactacgtgttaaaaaaccccttaaatcatttcatttgt

SEQ ID NO: 175042 - DNA, 75 bp, Artificial Sequence
  Synthetic
tcgctctactactgaataaaaaaagaatgagtatgctaaaagatgtggaaatcgaaaagaatggttttgttcaac

SEQ ID NO: 175043 - DNA, 75 bp, Artificial Sequence
  Synthetic
aatgagtatgctaaaagatgtggaaatcgaaaagaatggttttgttcaactccaagcattcatcgagaacatagg

SEQ ID NO: 175044 - DNA, 75 bp, Artificial Sequence
  Synthetic
ccggaaaatgcacgcaaagtgaatgttgaagaagtctcagaaaaagacatcccaacattatccacagataaagtt

SEQ ID NO: 175045 - DNA, 75 bp, Artificial Sequence
  Synthetic
cccaacattatccacagataaagtttccatacccaatgaaagtatgttcacatcaaataaaaaacacagcataga

SEQ ID NO: 175046 - DNA, 75 bp, Artificial Sequence
  Synthetic
gccattttgagtacaatggggcaaagattaactagaattattcaagaaaattataataacatcgctgcaggtttt

SEQ ID NO: 175047 - DNA, 75 bp, Artificial Sequence
  Synthetic
gattaactagaattattcaagaaaattataataacatcgctgcaggttttctgccggtgaacgatcttaataatc

SEQ ID NO: 175048 - DNA, 75 bp, Artificial Sequence
  Synthetic
ttttgatgtctatagcatcaccattaacggatttgtggtggaaaacgaattgataaaaaatattgaacaaattta

SEQ ID NO: 175049 - DNA, 75 bp, Artificial Sequence
  Synthetic
aacggatttgtggtggaaaacgaattgataaaaaatattgaacaaatttacgacaatacgcaatatctgagattt

SEQ ID NO: 175050 - DNA, 75 bp, Artificial Sequence
  Synthetic
atttgacaccgtttactatatctgtccgcaaaatgttcctggatttttttctatcacaaaaaactctgatagata

SEQ ID NO: 175051 - DNA, 75 bp, Artificial Sequence
  Synthetic
ccgcaaaatgttcctggatttttttctatcacaaaaaactctgatagatagagctgaagaaattatagagaacct

SEQ ID NO: 175052 - DNA, 75 bp, Artificial Sequence
  Synthetic
ggaaaacaaaaacttgccacaaagaatatgctcagagaacaattagaacagttgaatgctatggatgtggatgat

SEQ ID NO: 175053 - DNA, 75 bp, Artificial Sequence
  Synthetic
atatgctcagagaacaattagaacagttgaatgctatggatgtggatgatacaataaatctgaaaacagacacat

SEQ ID NO: 175054 - DNA, 75 bp, Artificial Sequence
  Synthetic
ccaagaattacgcatgatacaagacttcattttacaactctccattcacaatattccaagcattaactttgtgaa

SEQ ID NO: 175055 - DNA, 75 bp, Artificial Sequence
  Synthetic
ttcattttacaactctccattcacaatattccaagcattaactttgtgaaatctttgaaattacatattatttta

SEQ ID NO: 175056 - DNA, 75 bp, Artificial Sequence
  Synthetic
ctctacaagaaaaagtccagaatattctatatttttattttcaagatctagttaacgagatacctgctcaagaaa

SEQ ID NO: 175057 - DNA, 75 bp, Artificial Sequence
  Synthetic
tctatatttttattttcaagatctagttaacgagatacctgctcaagaaaatgttttgtcaacaatgttatttat

SEQ ID NO: 175058 - DNA, 75 bp, Artificial Sequence
  Synthetic
agaatacatctactagaaaccggatatatttccagacatattgtaaaaaaatggctaaacatgaaatcattgcaa

SEQ ID NO: 175059 - DNA, 75 bp, Artificial Sequence
  Synthetic
atatttccagacatattgtaaaaaaatggctaaacatgaaatcattgcaagatgctgaggatttaattcgattta

SEQ ID NO: 175060 - DNA, 75 bp, Artificial Sequence
  Synthetic
aaaatttgaacatcagccatttggaaaagaaattcaaaaactaattgaaaaaatacacttgttctataagcaaaa

SEQ ID NO: 175061 - DNA, 75 bp, Artificial Sequence
  Synthetic
aaagaaattcaaaaactaattgaaaaaatacacttgttctataagcaaaaagtaatcgagtatcaggaagatgtc

SEQ ID NO: 175062 - DNA, 75 bp, Artificial Sequence
  Synthetic
ttttaacttcaccctctgaattatctcaatttttagcttcagctcccactcaacgtatcatacaaaaacacaaaa

SEQ ID NO: 175063 - DNA, 75 bp, Artificial Sequence
  Synthetic
tcaatttttagcttcagctcccactcaacgtatcatacaaaaacacaaaaataatttagatcagaaacttttaat

SEQ ID NO: 175064 - DNA, 75 bp, Artificial Sequence
  Synthetic
gcaatggaagatgacaaaaaaagagttgcctgttctaaaattaatctggaacgacacctgaatgatttactgctc

SEQ ID NO: 175065 - DNA, 75 bp, Artificial Sequence
  Synthetic
ttgcctgttctaaaattaatctggaacgacacctgaatgatttactgctcttattgaaagacagacaatttgctt

SEQ ID NO: 175066 - DNA, 75 bp, Artificial Sequence
  Synthetic
gtgcgaaaatatatttaaaacgataccagatgataacctaattattcaattttcacatgctctgctttcagtttt

SEQ ID NO: 175067 - DNA, 75 bp, Artificial Sequence
  Synthetic
ccagatgataacctaattattcaattttcacatgctctgctttcagttttacttgacattgaaaaggatttaaaa

SEQ ID NO: 175068 - DNA, 75 bp, Artificial Sequence
  Synthetic
aaatactaataaataggcccctcgaaaccagtagattattagtgtttaaagacgcttatggtaatctgaaagagt

SEQ ID NO: 175069 - DNA, 75 bp, Artificial Sequence
  Synthetic
aaccagtagattattagtgtttaaagacgcttatggtaatctgaaagagtttttaaacgccttaaaacaatcact

SEQ ID NO: 175070 - DNA, 75 bp, Artificial Sequence
  Synthetic
aaggctgattttcttatccaaattttagattttacctataaatttagacataagacaaataaaggtaaacttcta

SEQ ID NO: 175071 - DNA, 75 bp, Artificial Sequence
  Synthetic
tagattttacctataaatttagacataagacaaataaaggtaaacttctacattccatttataatgaggatttca

SEQ ID NO: 175072 - DNA, 75 bp, Artificial Sequence
  Synthetic
gttaagaaaaaaagcaacagatgcaaaagagtcgttaactaaactttttaaagcatccgaacaaaagatcgagct

SEQ ID NO: 175073 - DNA, 75 bp, Artificial Sequence
  Synthetic
aaagagtcgttaactaaactttttaaagcatccgaacaaaagatcgagctgtcgcgtacgattccgttaaaggaa

SEQ ID NO: 175074 - DNA, 75 bp, Artificial Sequence
  Synthetic
atttccaaggttatggcaacgtagtttttcgagaaagtgcttttaaacgcgcaatagaggtagaaataaaaaatt

SEQ ID NO: 175075 - DNA, 75 bp, Artificial Sequence
  Synthetic
gcaatagaggtagaaataaaaaattacgaaatgaaattaaacgatctaataaaacactttaattcacacttaaaa

SEQ ID NO: 175076 - DNA, 75 bp, Artificial Sequence
  Synthetic
ttaatctatcttttgataacaaatggaaagattttgtctccaagtcaaaaatatctttcccaccagaactgacaa

SEQ ID NO: 175077 - DNA, 75 bp, Artificial Sequence
  Synthetic
taagttcacaagagttgatcaaggatcccattaaagttataactgaaactctaaacaaagcctcaaacgatttag

SEQ ID NO: 175078 - DNA, 75 bp, Artificial Sequence
  Synthetic
gaagtggttaatagtttttgtcaaagaactgaataccttttttgtagctacaatgtcagaatttggagaagttat

SEQ ID NO: 175079 - DNA, 75 bp, Artificial Sequence
  Synthetic
gaactgaataccttttttgtagctacaatgtcagaatttggagaagttatcccctttgactataaacatttcaga

SEQ ID NO: 175080 - DNA, 75 bp, Artificial Sequence
  Synthetic
agtacatagagattgaaaataaaataatctgcaacgaaattatcgaaaatactgacaatatagaaaaactctcaa

SEQ ID NO: 175081 - DNA, 75 bp, Artificial Sequence
  Synthetic
aatctgcaacgaaattatcgaaaatactgacaatatagaaaaactctcaaccttgataaaacaaatagatccaaa

SEQ ID NO: 175082 - DNA, 75 bp, Artificial Sequence
  Synthetic
tttcaggattatctgagcaaaattctaacagctgaaacgaaccagcaacaaacacgctataaagaacagttaaaa

SEQ ID NO: 175083 - DNA, 75 bp, Artificial Sequence
  Synthetic
taacagctgaaacgaaccagcaacaaacacgctataaagaacagttaaaaaaacagtactttgaccttttagata

SEQ ID NO: 175084 - DNA, 75 bp, Artificial Sequence
  Synthetic
cgattttaaccatcaacaaaatttaattttaaaactgaaagacaaattcaaaactcttagaacagacactgtatt

SEQ ID NO: 175085 - DNA, 75 bp, Artificial Sequence
  Synthetic
attttaaaactgaaagacaaattcaaaactcttagaacagacactgtatttgaaagatttccaaatttagatgat

SEQ ID NO: 175086 - DNA, 75 bp, Artificial Sequence
  Synthetic
agaactttttgcaggcacttgaggctttaagccatttcgtgcaggcagcacaaaattttctacaaaacgttttaa

SEQ ID NO: 175087 - DNA, 75 bp, Artificial Sequence
  Synthetic
tttaagccatttcgtgcaggcagcacaaaattttctacaaaacgttttaacagagcaagcggatttatttccaca

SEQ ID NO: 175088 - DNA, 75 bp, Artificial Sequence
  Synthetic
tccaccgtcaaaacaattccaaaatcagatataaatttacgtatgaaaatacacacaccccaaactttttttcag

SEQ ID NO: 175089 - DNA, 75 bp, Artificial Sequence
  Synthetic
cagatataaatttacgtatgaaaatacacacaccccaaactttttttcaggttgattcagtttttaatacacagt

SEQ ID NO: 175090 - DNA, 75 bp, Artificial Sequence
  Synthetic
agtccaattttacaatgttttccacaatattgttttcaagttttttgctctaaattataagaaaattatcgtacc

SEQ ID NO: 175091 - DNA, 75 bp, Artificial Sequence
  Synthetic
aatattgttttcaagttttttgctctaaattataagaaaattatcgtacctgataaagtgctgaacttagtatca

SEQ ID NO: 175092 - DNA, 75 bp, Artificial Sequence
  Synthetic
taaaaagcattctgagtgttgtaaaaagcttttggaaagagattataaatttcgatttaacttcttatttccaag

SEQ ID NO: 175093 - DNA, 75 bp, Artificial Sequence
  Synthetic
aagcttttggaaagagattataaatttcgatttaacttcttatttccaagggaaagcagaatttacttttcaaaa

SEQ ID NO: 175094 - DNA, 75 bp, Artificial Sequence
  Synthetic
atatttatttacattattactcaggcctggtcagtcacatctgatgaaacacagcattcgtttgaactgccacta

SEQ ID NO: 175095 - DNA, 75 bp, Artificial Sequence
  Synthetic
cctggtcagtcacatctgatgaaacacagcattcgtttgaactgccactagaaaaattttctcttttaattatag

SEQ ID NO: 175096 - DNA, 75 bp, Artificial Sequence
  Synthetic
ttctctgcagtgtccagtggacctagctattaattctctaatacccttattggaaaagaaaaaatatttcactgc

SEQ ID NO: 175097 - DNA, 75 bp, Artificial Sequence
  Synthetic
gctattaattctctaatacccttattggaaaagaaaaaatatttcactgcatttaccatctctgacaatccaccc

SEQ ID NO: 175098 - DNA, 75 bp, Artificial Sequence
  Synthetic
ttgtgtgtttggatttgaacacctggagtgaaataacattagaaaaatacacttttaaaaagaacagtttgatgc

SEQ ID NO: 175099 - DNA, 75 bp, Artificial Sequence
  Synthetic
gagtgaaataacattagaaaaatacacttttaaaaagaacagtttgatgcagttatgtatgggcaaagagaaatt

SEQ ID NO: 175100 - DNA, 75 bp, Artificial Sequence
  Synthetic
gttcttcctcaaaattttttgaattacatttggattcaatacaaaccttcgtgctgtgctcaggattcattccaa

SEQ ID NO: 175101 - DNA, 75 bp, Artificial Sequence
  Synthetic
acatttggattcaatacaaaccttcgtgctgtgctcaggattcattccaacaactcattcaagatttatgtttcg

SEQ ID NO: 175102 - DNA, 75 bp, Artificial Sequence
  Synthetic
gcccatttcattaaatctccaagaaccaaatgcattaaaacatggtgaaagaatcctttcgaaattcgtgctgga

SEQ ID NO: 175103 - DNA, 75 bp, Artificial Sequence
  Synthetic
ccaaatgcattaaaacatggtgaaagaatcctttcgaaattcgtgctggaaaaaaatgcaaacacttctcttttt

SEQ ID NO: 175104 - DNA, 75 bp, Artificial Sequence
  Synthetic
tattagattatctattattttcatacttaaccgcaactgaaatgactttttcatattatgtggattccatcaaaa

SEQ ID NO: 175105 - DNA, 75 bp, Artificial Sequence
  Synthetic
cttaaccgcaactgaaatgactttttcatattatgtggattccatcaaaaattttcttcttacgatccgacattt

SEQ ID NO: 175106 - DNA, 75 bp, Artificial Sequence
  Synthetic
tttagaacgatattgcaatctcgaaatttcgatctaaaatatcttttaacacaatcatggacacaaaatgtttta

SEQ ID NO: 175107 - DNA, 75 bp, Artificial Sequence
  Synthetic
atttcgatctaaaatatcttttaacacaatcatggacacaaaatgttttagaacagtccatctttcacgtgcaac

SEQ ID NO: 175108 - DNA, 75 bp, Artificial Sequence
  Synthetic
acaaccacaactaagtctgaagaaaattccactggttttgtttaacggtgacaacgaagtcgtgtcaacttatgt

SEQ ID NO: 175109 - DNA, 75 bp, Artificial Sequence
  Synthetic
attccactggttttgtttaacggtgacaacgaagtcgtgtcaacttatgtgccccctgaacaagcaagccagaca

SEQ ID NO: 175110 - DNA, 75 bp, Artificial Sequence
  Synthetic
ttttcccaaatcctgtgcaagagtatagtagcaaaaatgtgattctttttacgaactatccaaaaaacaccaaat

SEQ ID NO: 175111 - DNA, 75 bp, Artificial Sequence
  Synthetic
tagtagcaaaaatgtgattctttttacgaactatccaaaaaacaccaaatttttatttaactctcctccacctaa

SEQ ID NO: 175112 - DNA, 75 bp, Artificial Sequence
  Synthetic
ccagacactaccgatgacataaacacggaaacattatcaagtcccacgattcaaagaatccctatcaaaggactt

SEQ ID NO: 175113 - DNA, 75 bp, Artificial Sequence
  Synthetic
cggaaacattatcaagtcccacgattcaaagaatccctatcaaaggacttgtacccaaagaaaacgaaattgtct

SEQ ID NO: 175114 - DNA, 75 bp, Artificial Sequence
  Synthetic
cacagactctaaagagacaaaaacgcatttaatagacaccttcaatatattgtctcaaacaaagggtgaaatcaa

SEQ ID NO: 175115 - DNA, 75 bp, Artificial Sequence
  Synthetic
catttaatagacaccttcaatatattgtctcaaacaaagggtgaaatcaaaacattttctacagattttgatcaa

SEQ ID NO: 175116 - DNA, 75 bp, Artificial Sequence
  Synthetic
acttttaagatgattcgctaactttgctatttaatctatgcaaagcaagcatgcgtaaaaaatcaagtctgaagg

SEQ ID NO: 175117 - DNA, 75 bp, Artificial Sequence
  Synthetic
gctatttaatctatgcaaagcaagcatgcgtaaaaaatcaagtctgaaggctgctttttcaatgtttccggtatt

SEQ ID NO: 175118 - DNA, 75 bp, Artificial Sequence
  Synthetic
gtccctgtgacagggtgtgaacccatagaagaatgcaagcctagaatattcgtaaacatttgttgctttttcttt

SEQ ID NO: 175119 - DNA, 75 bp, Artificial Sequence
  Synthetic
tagaagaatgcaagcctagaatattcgtaaacatttgttgctttttcttttcttcttctttttttgaactgttgc

SEQ ID NO: 175120 - DNA, 75 bp, Artificial Sequence
  Synthetic
gatttcatcaccacgtgtcgcagccatgttgcgtgcacttagctaattgagaaattttacagcctgtacaaattt

SEQ ID NO: 175121 - DNA, 75 bp, Artificial Sequence
  Synthetic
atgttgcgtgcacttagctaattgagaaattttacagcctgtacaaatttctccacagtcctctagatcaagaca

SEQ ID NO: 175122 - DNA, 75 bp, Artificial Sequence
  Synthetic
tcttggcattgaaattctgtggagtgagaaattagtttcaacagtttatttatcgttagattctgcagatggatc

SEQ ID NO: 175123 - DNA, 75 bp, Artificial Sequence
  Synthetic
gagaaattagtttcaacagtttatttatcgttagattctgcagatggatcatagagtaacaagttctgcaagaac

SEQ ID NO: 175124 - DNA, 75 bp, Artificial Sequence
  Synthetic
actatcgtttaaaatagtgcaagcggaattagttccaattatagctttccatgatacactttttacttgaatgcc

SEQ ID NO: 175125 - DNA, 75 bp, Artificial Sequence
  Synthetic
gaattagttccaattatagctttccatgatacactttttacttgaatgcctgaaacactatattcatacaattca

SEQ ID NO: 175126 - DNA, 75 bp, Artificial Sequence
  Synthetic
gcccgccacataatgaacaataaagcaaatctgtgtgcatactgtaaataatatttttttcctgtctatctcgat

SEQ ID NO: 175127 - DNA, 75 bp, Artificial Sequence
  Synthetic
caaatctgtgtgcatactgtaaataatatttttttcctgtctatctcgataataaaacatcgagcttaaagaaaa

SEQ ID NO: 175128 - DNA, 75 bp, Artificial Sequence
  Synthetic
ttgccggaatttaaacaatgtccacatttagaacatatcacagtgagataactatcaattttagcatatctgaga

SEQ ID NO: 175129 - DNA, 75 bp, Artificial Sequence
  Synthetic
atttagaacatatcacagtgagataactatcaattttagcatatctgagacactttgttttgcaaaaacataata

SEQ ID NO: 175130 - DNA, 75 bp, Artificial Sequence
  Synthetic
taagcttcttttcaagactgtcgtcaaagcaaaagttagaatttttggaagttgatgtttttcttgtttgttcaa

SEQ ID NO: 175131 - DNA, 75 bp, Artificial Sequence
  Synthetic
aaagcaaaagttagaatttttggaagttgatgtttttcttgtttgttcaaaacaatcggcaccaagttattattt

SEQ ID NO: 175132 - DNA, 75 bp, Artificial Sequence
  Synthetic
aactgtaacaataattttctatcatggccatggccatagcaaagataaaatttccacatggaactgttaaagaac

SEQ ID NO: 175133 - DNA, 75 bp, Artificial Sequence
  Synthetic
caggttgcttgctctatgagcgtatcgcagtgtgatgtcattacattgttcaaagttacgtaaacaaaagagttt

SEQ ID NO: 175134 - DNA, 75 bp, Artificial Sequence
  Synthetic
cgcagtgtgatgtcattacattgttcaaagttacgtaaacaaaagagtttcatacaaggaatattacaatgagtt

SEQ ID NO: 175135 - DNA, 75 bp, Artificial Sequence
  Synthetic
caaagttacgtaaacaaaagagtttcatacaaggaatattacaatgagttgaaattggcaacattaactgttgct

SEQ ID NO: 175136 - DNA, 75 bp, Artificial Sequence
  Synthetic
aaaagacacaaacgacggtatttccaacaactgatttaacttatgtattgggtattgtttgaatctctccacaat

SEQ ID NO: 175137 - DNA, 75 bp, Artificial Sequence
  Synthetic
aacaactgatttaacttatgtattgggtattgtttgaatctctccacaatttgtttccaagtaagacgttgaatt

SEQ ID NO: 175138 - DNA, 75 bp, Artificial Sequence
  Synthetic
ccttgcattgcctgtacaaaaaatacaaatatgccaaaagcaaaaagaaattttttgtcatcatcattttattaa

SEQ ID NO: 175139 - DNA, 75 bp, Artificial Sequence
  Synthetic
caaatatgccaaaagcaaaaagaaattttttgtcatcatcattttattaaaaatagctttaatctgatttcttga

SEQ ID NO: 175140 - DNA, 75 bp, Artificial Sequence
  Synthetic
tttaaaaacttccggtagaaattatcagttaaatctttactcaaaaactttttattcgttacgaacatcgataat

SEQ ID NO: 175141 - DNA, 75 bp, Artificial Sequence
  Synthetic
cagttaaatctttactcaaaaactttttattcgttacgaacatcgataatacgcaattttcagatttgctgacat

SEQ ID NO: 175142 - DNA, 75 bp, Artificial Sequence
  Synthetic
actgtacgaaccatgtttacacagcggagaaatcagccgacaaagcaaattccttaaagatgacatagcatacaa

SEQ ID NO: 175143 - DNA, 75 bp, Artificial Sequence
  Synthetic
ggagaaatcagccgacaaagcaaattccttaaagatgacatagcatacaattagtaaggcggcaaccaaaaaacc

SEQ ID NO: 175144 - DNA, 75 bp, Artificial Sequence
  Synthetic
aaaataggaacagtaactgggaatactgctgcgtcttttgtgtttcccatgtaatttatactcctgaatgatgtc

SEQ ID NO: 175145 - DNA, 75 bp, Artificial Sequence
  Synthetic
ctgctgcgtcttttgtgtttcccatgtaatttatactcctgaatgatgtcatctctcctactgacttcaactgta

SEQ ID NO: 175146 - DNA, 75 bp, Artificial Sequence
  Synthetic
tgcagctctatgtttctctaaatcttggcgctctaaaaattttttctttaagattatcgctttaagaagagcgat

SEQ ID NO: 175147 - DNA, 75 bp, Artificial Sequence
  Synthetic
tggcgctctaaaaattttttctttaagattatcgctttaagaagagcgatatactcagattcactctcgggacca

SEQ ID NO: 175148 - DNA, 75 bp, Artificial Sequence
  Synthetic
ccgcatctcggtttcgtctaataatgcactttgtcagtacaccacttgaagaaggtttaatagcttcaatgtcat

SEQ ID NO: 175149 - DNA, 75 bp, Artificial Sequence
  Synthetic
gcactttgtcagtacaccacttgaagaaggtttaatagcttcaatgtcattcaaacacacagataaacactcatt

SEQ ID NO: 175150 - DNA, 75 bp, Artificial Sequence
  Synthetic
acaatgttctgactttcttgttttatgggagcgtggagataacaagacatggaaacagcacctcccgtattttta

SEQ ID NO: 175151 - DNA, 75 bp, Artificial Sequence
  Synthetic
tgggagcgtggagataacaagacatggaaacagcacctcccgtatttttaaaaataaatctcgcttcttgttttg

SEQ ID NO: 175152 - DNA, 75 bp, Artificial Sequence
  Synthetic
atattccaggctatatgcaaaatccaattttaaaagtatatcacataaaggaaatttaggatttttagaaaataa

SEQ ID NO: 175153 - DNA, 75 bp, Artificial Sequence
  Synthetic
aattttaaaagtatatcacataaaggaaatttaggatttttagaaaataaatttttatctgtgacacgaaagtct

SEQ ID NO: 175154 - DNA, 75 bp, Artificial Sequence
  Synthetic
acgtggaaagaattaattcatcgtacatcttttctttcaacatgtttattttctctttaaaaatttctgcagttg

SEQ ID NO: 175155 - DNA, 75 bp, Artificial Sequence
  Synthetic
catcttttctttcaacatgtttattttctctttaaaaatttctgcagttgtatattatgtatttaaatattcctg

SEQ ID NO: 175156 - DNA, 75 bp, Artificial Sequence
  Synthetic
aacagtttcgataaaattgaagtgagtagtttgattttttttttgataatctccgagtgactgcattgatttgct

SEQ ID NO: 175157 - DNA, 75 bp, Artificial Sequence
  Synthetic
gtagtttgattttttttttgataatctccgagtgactgcattgatttgctctgtgatgtaaatattttaaatagg

SEQ ID NO: 175158 - DNA, 75 bp, Artificial Sequence
  Synthetic
aaaatgtagtcgggcatctaatgaaggcagcattatatcgtacagttttggtaacatagggagaaaagctatttc

SEQ ID NO: 175159 - DNA, 75 bp, Artificial Sequence
  Synthetic
ggcagcattatatcgtacagttttggtaacatagggagaaaagctatttcaatttcaactcgggaagataattgt

SEQ ID NO: 175160 - DNA, 75 bp, Artificial Sequence
  Synthetic
tggcattgtcgttagacatggcttataagggatggaactccgattccttttctatgaactcagaactttttaatg

SEQ ID NO: 175161 - DNA, 75 bp, Artificial Sequence
  Synthetic
taagggatggaactccgattccttttctatgaactcagaactttttaatgaaattcttttatatgcacacttaga

SEQ ID NO: 175162 - DNA, 75 bp, Artificial Sequence
  Synthetic
cttaacacaaatcccaatacacttgaaaatgaaattaactccgttgaaaaaactttaaatattgaagaactgaaa

SEQ ID NO: 175163 - DNA, 75 bp, Artificial Sequence
  Synthetic
aaaatgaaattaactccgttgaaaaaactttaaatattgaagaactgaaaaaaattacaactgctttaaatattg

SEQ ID NO: 175164 - DNA, 75 bp, Artificial Sequence
  Synthetic
tataaacatctgtttacgacatgaaaccgataaaatgtggatctatgactatgctcttttgtgttacaaatgtaa

SEQ ID NO: 175165 - DNA, 75 bp, Artificial Sequence
  Synthetic
accgataaaatgtggatctatgactatgctcttttgtgttacaaatgtaatgctgcacctagaactcccttggct

SEQ ID NO: 175166 - DNA, 75 bp, Artificial Sequence
  Synthetic
tgcagttgattcaaaagcatttcttaaacataaatttcgatgggttatttttaaacaacattttgtcaatactcg

SEQ ID NO: 175167 - DNA, 75 bp, Artificial Sequence
  Synthetic
aaacataaatttcgatgggttatttttaaacaacattttgtcaatactcgattttcatgtacactttttcataaa

SEQ ID NO: 175168 - DNA, 75 bp, Artificial Sequence
  Synthetic
gatctattacataatgaaaacataaccttatatcacatggccatattaaaatcacttctattggaagacgaatct

SEQ ID NO: 175169 - DNA, 75 bp, Artificial Sequence
  Synthetic
ccttatatcacatggccatattaaaatcacttctattggaagacgaatctataccaaatataagaataaagaaat

SEQ ID NO: 175170 - DNA, 75 bp, Artificial Sequence
  Synthetic
aaaacagcatggaaatgctatccttgaaaaacaaactcttccacttaacacgcattttacacatttaatttttta

SEQ ID NO: 175171 - DNA, 75 bp, Artificial Sequence
  Synthetic
gaaaaacaaactcttccacttaacacgcattttacacatttaattttttatatgtgggctgggacaaacatattc

SEQ ID NO: 175172 - DNA, 75 bp, Artificial Sequence
  Synthetic
ccatcaagaaacgccaaattttaaaagccatttactctactaaaaatgagctcaattgttctgcgggaccaatcc

SEQ ID NO: 175173 - DNA, 75 bp, Artificial Sequence
  Synthetic
agccatttactctactaaaaatgagctcaattgttctgcgggaccaatcctactatctcaaataccgatctccat

SEQ ID NO: 175174 - DNA, 75 bp, Artificial Sequence
  Synthetic
tgcttattatgtgaactaatgacatcttctcagaaaaatttcgacttgctacagttcatctacaccagtgtcatt

SEQ ID NO: 175175 - DNA, 75 bp, Artificial Sequence
  Synthetic
cttctcagaaaaatttcgacttgctacagttcatctacaccagtgtcattaattactgtcaaaataatttgaaga

SEQ ID NO: 175176 - DNA, 75 bp, Artificial Sequence
  Synthetic
cgcaaatcttttagatttagctagaatatatactaacgttaaaaccacatcagattgctcaaaaattgtattagc

SEQ ID NO: 175177 - DNA, 75 bp, Artificial Sequence
  Synthetic
atatatactaacgttaaaaccacatcagattgctcaaaaattgtattagccaatgaacaagaattttcaaactct

SEQ ID NO: 175178 - DNA, 75 bp, Artificial Sequence
  Synthetic
ttttaattctaaagcaggttggacctgtgggattatacaaacatttcttttgtgatccactgtgcatagcaaaca

SEQ ID NO: 175179 - DNA, 75 bp, Artificial Sequence
  Synthetic
tgtgggattatacaaacatttcttttgtgatccactgtgcatagcaaacattaagacaataaaaccccatatttt

SEQ ID NO: 175180 - DNA, 75 bp, Artificial Sequence
  Synthetic
ctacaagacttcaaagttgcaatttgttatcagaatgagtatttaaacagtgttgaaaaacatgtttggttagcc

SEQ ID NO: 175181 - DNA, 75 bp, Artificial Sequence
  Synthetic
gttatcagaatgagtatttaaacagtgttgaaaaacatgtttggttagccattcatttttttaaagcatttcagg

SEQ ID NO: 175182 - DNA, 75 bp, Artificial Sequence
  Synthetic
aacgcttatatctgatttcttaaaggatttcacacagctcttagcagatcaaaactttgaaattgtcgatcctac

SEQ ID NO: 175183 - DNA, 75 bp, Artificial Sequence
  Synthetic
gatttcacacagctcttagcagatcaaaactttgaaattgtcgatcctacatttaccattcattattacgtttag

SEQ ID NO: 175184 - DNA, 75 bp, Artificial Sequence
  Synthetic
ctgagacgagcatctagcttgttaaagaaaagcaaaccttacaacaaagaaaaaactaacttatctttatctttg

SEQ ID NO: 175185 - DNA, 75 bp, Artificial Sequence
  Synthetic
agaaaagcaaaccttacaacaaagaaaaaactaacttatctttatctttgtcacttaaagaactccattcggttt

SEQ ID NO: 175186 - DNA, 75 bp, Artificial Sequence
  Synthetic
gaaatttctaaatatgatgaaacttccaataaccggtaaagaacctatcaaaattccattcgatctaagtctaca

SEQ ID NO: 175187 - DNA, 75 bp, Artificial Sequence
  Synthetic
ccaataaccggtaaagaacctatcaaaattccattcgatctaagtctacatcatcaacatacgtgcttagactta

SEQ ID NO: 175188 - DNA, 75 bp, Artificial Sequence
  Synthetic
caaaaagtgcatgtgttaattgtggtacaacaaacattccaacagcttcagatgctatggtggcatatatgaatc

SEQ ID NO: 175189 - DNA, 75 bp, Artificial Sequence
  Synthetic
tacaacaaacattccaacagcttcagatgctatggtggcatatatgaatcaaatttcaaacgtaatgcaaaatag

SEQ ID NO: 175190 - DNA, 75 bp, Artificial Sequence
  Synthetic
aaggttgaactgattcgtatgtcagccaagcaaccaacgctttttcaaattttttatattctttcaagcatagca

SEQ ID NO: 175191 - DNA, 75 bp, Artificial Sequence
  Synthetic
aaaataacgagaaattaaatatgtatgttgttttccaaacaagaactcttcatattccttgcgaatgtatcaatc

SEQ ID NO: 175192 - DNA, 75 bp, Artificial Sequence
  Synthetic
cactgtacttttagacatcttacacgacagcattgtactacatgttctttgtaaaactattgagactagcaatat

SEQ ID NO: 175193 - DNA, 75 bp, Artificial Sequence
  Synthetic
gacagcattgtactacatgttctttgtaaaactattgagactagcaatattcaaattgatattaatgttcttcag

SEQ ID NO: 175194 - DNA, 75 bp, Artificial Sequence
  Synthetic
ccgatgaaataggtgacaagttcgaaaagctgaaacacattctaccgtttatttaaaacagatcacagaacatct

SEQ ID NO: 175195 - DNA, 75 bp, Artificial Sequence
  Synthetic
aaagctgaaacacattctaccgtttatttaaaacagatcacagaacatctgtcaggtcacaaaagctttgatcta

SEQ ID NO: 175196 - DNA, 75 bp, Artificial Sequence
  Synthetic
aagtaaaaacttttctttcttaatgcccgttttcggaaatattggagagatagcatttgttacagctttcattat

SEQ ID NO: 175197 - DNA, 75 bp, Artificial Sequence
  Synthetic
cccgttttcggaaatattggagagatagcatttgttacagctttcattatttgttcaaaatatttatctgcattg

SEQ ID NO: 175198 - DNA, 75 bp, Artificial Sequence
  Synthetic
atgctggatcttctgctaactcataattatgaaatgttttttttacggtttctgtgggtgcaattaaaatgtaca

SEQ ID NO: 175199 - DNA, 75 bp, Artificial Sequence
  Synthetic
attatgaaatgttttttttacggtttctgtgggtgcaattaaaatgtacataactctatctcctatgtttggcaa

SEQ ID NO: 175200 - DNA, 75 bp, Artificial Sequence
  Synthetic
ttaacaacagccaaatgtggtaaatttgcttgcttgtaggcagaaatgtcttttgataagactgaagacaaaacc

SEQ ID NO: 175201 - DNA, 75 bp, Artificial Sequence
  Synthetic
ttgcttgcttgtaggcagaaatgtcttttgataagactgaagacaaaaccaaacttttaatgttaaccctgttta

SEQ ID NO: 175202 - DNA, 75 bp, Artificial Sequence
  Synthetic
caactttttaattattttttggataccatcgggaactccattttcatagatttcttgtattgtcatattagagag

SEQ ID NO: 175203 - DNA, 75 bp, Artificial Sequence
  Synthetic
ccatcgggaactccattttcatagatttcttgtattgtcatattagagagcttttcagcagacttttgtacatcg

SEQ ID NO: 175204 - DNA, 75 bp, Artificial Sequence
  Synthetic
tgtctttaactaccactttaacaaaatcgcaagaagtcttgcgaactaactccacacctttaaaaacaagcgttg

SEQ ID NO: 175205 - DNA, 75 bp, Artificial Sequence
  Synthetic
atcgcaagaagtcttgcgaactaactccacacctttaaaaacaagcgttgcatcatctaactttccaatgtaacg

SEQ ID NO: 175206 - DNA, 75 bp, Artificial Sequence
  Synthetic
aataggatcttttcaaattctaatttgataggatgtttaaataacgtgtttgttatgtggcttgcaatagaagga

SEQ ID NO: 175207 - DNA, 75 bp, Artificial Sequence
  Synthetic
tgataggatgtttaaataacgtgtttgttatgtggcttgcaatagaaggagctattcttttcaaagctttgggac

SEQ ID NO: 175208 - DNA, 75 bp, Artificial Sequence
  Synthetic
actgtcagtatcaccataaatcacctctattccaaatgtccctgaaaaatcaccgcgtgtcaatccaaatttctc

SEQ ID NO: 175209 - DNA, 75 bp, Artificial Sequence
  Synthetic
tctattccaaatgtccctgaaaaatcaccgcgtgtcaatccaaatttctcaatgaaaaaagtgtccgaatacatg

SEQ ID NO: 175210 - DNA, 75 bp, Artificial Sequence
  Synthetic
tacaaagcatttcacgcccaagacatgtgacagaagctgctattgccacacatggaagtaagctatgtgttgccc

SEQ ID NO: 175211 - DNA, 75 bp, Artificial Sequence
  Synthetic
tgtgacagaagctgctattgccacacatggaagtaagctatgtgttgccccggtgactccgtagactgaattaca

SEQ ID NO: 175212 - DNA, 75 bp, Artificial Sequence
  Synthetic
ttatctaaaagcatttccatcacggggttgttacacattttcatctgcatttttacttcttttcttttatccagc

SEQ ID NO: 175213 - DNA, 75 bp, Artificial Sequence
  Synthetic
ggttgttacacattttcatctgcatttttacttcttttcttttatccagccattttttcaataaactcgctaaaa

SEQ ID NO: 175214 - DNA, 75 bp, Artificial Sequence
  Synthetic
aaacctgtgcgttacaggtccaacatgcacagtgagaatgtcatctgcatgtaaaccaattactgcattttcatc

SEQ ID NO: 175215 - DNA, 75 bp, Artificial Sequence
  Synthetic
tgcacagtgagaatgtcatctgcatgtaaaccaattactgcattttcatcaacaaccagggtactataacacaga

SEQ ID NO: 175216 - DNA, 75 bp, Artificial Sequence
  Synthetic
acaaactttggaaatcaaaaactactgttggagtagcataataacctattttcggttctaaaactgtagcacctt

SEQ ID NO: 175217 - DNA, 75 bp, Artificial Sequence
  Synthetic
tgttggagtagcataataacctattttcggttctaaaactgtagcacctttatagcccacattttctttgccttt

SEQ ID NO: 175218 - DNA, 75 bp, Artificial Sequence
  Synthetic
aaaatcatatttaaatttttagcttcgtgtaaaatgcatgggaaaatttttttttgttgtccctcaaatacggcg

SEQ ID NO: 175219 - DNA, 75 bp, Artificial Sequence
  Synthetic
cgtgtaaaatgcatgggaaaatttttttttgttgtccctcaaatacggcgcaacgaatagtaatataagcgagac

SEQ ID NO: 175220 - DNA, 75 bp, Artificial Sequence
  Synthetic
ataattaatctttgtaaaaagctgaacaaccaatagagaatcttgtatacaatatctgccaaccacagctctacc

SEQ ID NO: 175221 - DNA, 75 bp, Artificial Sequence
  Synthetic
aatatctgccaaccacagctctacctttggaaccatcaataaattttttaggaatttccttgtaagagagatttt

SEQ ID NO: 175222 - DNA, 75 bp, Artificial Sequence
  Synthetic
ggctatagtgtctaatttataattctgagctgagattttagatgaatacacattatacatgtcgaagcataaaat

SEQ ID NO: 175223 - DNA, 75 bp, Artificial Sequence
  Synthetic
tccacgttttagtttcgaaaaaccccctatctcgaaattatatattttttccattctcgtacataaatactttaa

SEQ ID NO: 175224 - DNA, 75 bp, Artificial Sequence
  Synthetic
gtaaggatttctggtgatttacattttaaaaaaaggaaaaaagcatatagaagttcaaattctgatgcaaactca

SEQ ID NO: 175225 - DNA, 75 bp, Artificial Sequence
  Synthetic
cgcaagtgcccaaagtaaacaaatgtttactttggtaatttccttcagaatcaaaatcgatgaccgaaattaatg

SEQ ID NO: 175226 - DNA, 75 bp, Artificial Sequence
  Synthetic
tggaaagtttccattttggcttagacattcaatatcaaaagaacaacaatcatataatggccaagaatcttcctt

SEQ ID NO: 175227 - DNA, 75 bp, Artificial Sequence
  Synthetic
cattcaatatcaaaagaacaacaatcatataatggccaagaatcttcctttaacaaaaataaatctgacacatga

SEQ ID NO: 175228 - DNA, 75 bp, Artificial Sequence
  Synthetic
tgctttttgcaaattcttgaatagatagataattaatttggtaccaaccaaagctttttaagttgttatcaatga

SEQ ID NO: 175229 - DNA, 75 bp, Artificial Sequence
  Synthetic
tagataattaatttggtaccaaccaaagctttttaagttgttatcaatgaagaaacgattgagaatctcaacttc

SEQ ID NO: 175230 - DNA, 75 bp, Artificial Sequence
  Synthetic
tttagtaaaatttttccaattcgattactgatataaaagtttgaaaatgataatttaaataaatttttgataggt

SEQ ID NO: 175231 - DNA, 75 bp, Artificial Sequence
  Synthetic
atttagttacagattcaatagaaaatgagcatgacatttttatttcagaactattcagaagtgaacagattctag

SEQ ID NO: 175232 - DNA, 75 bp, Artificial Sequence
  Synthetic
tgagcatgacatttttatttcagaactattcagaagtgaacagattctagaattcagctcttttttacattgata

SEQ ID NO: 175233 - DNA, 75 bp, Artificial Sequence
  Synthetic
ctattcagaagtgaacagattctagaattcagctcttttttacattgatattcacagtagaaataactattttgt

SEQ ID NO: 175234 - DNA, 75 bp, Artificial Sequence
  Synthetic
taccacattctgtttttccaaaaagttttatgacattaccagatggaataacgaaatgtctatattggaaaggga

SEQ ID NO: 175235 - DNA, 75 bp, Artificial Sequence
  Synthetic
ttttatgacattaccagatggaataacgaaatgtctatattggaaagggatgttttctatagaatcagtaaataa

SEQ ID NO: 175236 - DNA, 75 bp, Artificial Sequence
  Synthetic
tgaaattttaaaggcgcacgcaattctttttcggctacttgagaaagcgatggccatgtcatatcatttttgaga

SEQ ID NO: 175237 - DNA, 75 bp, Artificial Sequence
  Synthetic
ctttttcggctacttgagaaagcgatggccatgtcatatcatttttgagaatgtattgcttatcttgatagaaca

SEQ ID NO: 175238 - DNA, 75 bp, Artificial Sequence
  Synthetic
cttcattaagccgggtgctccatcgtgcattataccgcgcggaaaaatccggagaaaagtagattttgttttttt

SEQ ID NO: 175239 - DNA, 75 bp, Artificial Sequence
  Synthetic
tgcattataccgcgcggaaaaatccggagaaaagtagattttgtttttttcttagttcgtacattctctagatac

SEQ ID NO: 175240 - DNA, 75 bp, Artificial Sequence
  Synthetic
tcacagttcttctgttgaaagtttctgatagcccctgtattgaatcctttcaagtaggcttggtctctgtgattt

SEQ ID NO: 175241 - DNA, 75 bp, Artificial Sequence
  Synthetic
tgatagcccctgtattgaatcctttcaagtaggcttggtctctgtgatttttttgcctcagcgatttccgctttt

SEQ ID NO: 175242 - DNA, 75 bp, Artificial Sequence
  Synthetic
tagctttcaacatttttaaagcttccacttgtgaatattcattagtgtgtgttatgtcatcaccttgcggttctg

SEQ ID NO: 175243 - DNA, 75 bp, Artificial Sequence
  Synthetic
gttatgtcatcaccttgcggttctgtgtctttgttagtttttaaataaggcggagatgaatctaaaggttctttc

SEQ ID NO: 175244 - DNA, 75 bp, Artificial Sequence
  Synthetic
cttgaagtaccgaatttgttgattttgatgtataaggaaataaaatatcaatcggtgtttgtgctaatcgtttat

SEQ ID NO: 175245 - DNA, 75 bp, Artificial Sequence
  Synthetic
tgatgtataaggaaataaaatatcaatcggtgtttgtgctaatcgtttatgtcttaaaaataagaaaataactaa

SEQ ID NO: 175246 - DNA, 75 bp, Artificial Sequence
  Synthetic
atagttagtgctccaccaaatggatttttaagaaaagagaaaactccattcaccacatctcccaaagcaccagcc

SEQ ID NO: 175247 - DNA, 75 bp, Artificial Sequence
  Synthetic
ttttaagaaaagagaaaactccattcaccacatctcccaaagcaccagccgttacacccagcacagcccccaaac

SEQ ID NO: 175248 - DNA, 75 bp, Artificial Sequence
  Synthetic
gaaaaatgtgtcaatccctcctatatatgttggagtaacagttgcaatttttgtttctatatggtgtagcgcact

SEQ ID NO: 175249 - DNA, 75 bp, Artificial Sequence
  Synthetic
tatgttggagtaacagttgcaatttttgtttctatatggtgtagcgcacttttgtaagaattgtattctctaaga

SEQ ID NO: 175250 - DNA, 75 bp, Artificial Sequence
  Synthetic
ctttgctcagttcatcttttgtatacaattccaataatgtaaaatctgcattttctaaaggatctatgtttaagt

SEQ ID NO: 175251 - DNA, 75 bp, Artificial Sequence
  Synthetic
caattccaataatgtaaaatctgcattttctaaaggatctatgtttaagtcaacaaacgcatctaaagcttctat

SEQ ID NO: 175252 - DNA, 75 bp, Artificial Sequence
  Synthetic
tacgtatagtctttaaaaatatgagcgaatttaccagacaaaaaaattttcgtgttagattgttcacattcttct

SEQ ID NO: 175253 - DNA, 75 bp, Artificial Sequence
  Synthetic
cgaatttaccagacaaaaaaattttcgtgttagattgttcacattcttctgttctgtgatttcccagtaatatct

SEQ ID NO: 175254 - DNA, 75 bp, Artificial Sequence
  Synthetic
ataagtttccttcgaagaatttgcaaatgaatatgttaacaatggccgagaataacatcttagagcatcgtaact

SEQ ID NO: 175255 - DNA, 75 bp, Artificial Sequence
  Synthetic
aatgaatatgttaacaatggccgagaataacatcttagagcatcgtaacttgaatcttttgtcaatctcatactt

SEQ ID NO: 175256 - DNA, 75 bp, Artificial Sequence
  Synthetic
tgacttcaatgcactttgagactgctaatacatcaccaattaatttagcggacatgggtttaccgtacactgctg

SEQ ID NO: 175257 - DNA, 75 bp, Artificial Sequence
  Synthetic
gacatgggtttaccgtacactgctgaaatgattccagaaggacttattttactaagctcgtgcaacactgtgata

SEQ ID NO: 175258 - DNA, 75 bp, Artificial Sequence
  Synthetic
cttcagcaagcttacctagtgctgtgttaatgtaatctttcagagtgtcgtataggtattgtagttgaacatata

SEQ ID NO: 175259 - DNA, 75 bp, Artificial Sequence
  Synthetic
cctcttcctcctttttctagaagcattagaaaaattttccaaaaccgttaatttccgttgtattaacggttgcca

SEQ ID NO: 175260 - DNA, 75 bp, Artificial Sequence
  Synthetic
ttagaaaaattttccaaaaccgttaatttccgttgtattaacggttgccaaatcagaattaaatctccctcagtt

SEQ ID NO: 175261 - DNA, 75 bp, Artificial Sequence
  Synthetic
atttccgttgtattaacggttgccaaatcagaattaaatctccctcagttttaaaaatttcataactaccatttt

SEQ ID NO: 175262 - DNA, 75 bp, Artificial Sequence
  Synthetic
ttggtaaatctcatccaaaattgaagtataattgctgttaatacaattatattttgaatcagaaagcgtataatt

SEQ ID NO: 175263 - DNA, 75 bp, Artificial Sequence
  Synthetic
gtataattgctgttaatacaattatattttgaatcagaaagcgtataattactttttcctgtgacaaaagaagca

SEQ ID NO: 175264 - DNA, 75 bp, Artificial Sequence
  Synthetic
aactgttagcattttctgcccgtaaagcgtgtgggattgtcatccaatgctttaacaaacaaatggaagactctt

SEQ ID NO: 175265 - DNA, 75 bp, Artificial Sequence
  Synthetic
agcgtgtgggattgtcatccaatgctttaacaaacaaatggaagactcttcattctgcacttcccatgaaaaaat

SEQ ID NO: 175266 - DNA, 75 bp, Artificial Sequence
  Synthetic
attttagttaacgtcacaaaatttccttttgatccatcatcaaacgttttcagcatagtataattatttctaaac

SEQ ID NO: 175267 - DNA, 75 bp, Artificial Sequence
  Synthetic
cttttgatccatcatcaaacgttttcagcatagtataattatttctaaacaaaattttttccgttggttcattaa

SEQ ID NO: 175268 - DNA, 75 bp, Artificial Sequence
  Synthetic
aaacggtgacccttccacggtttcccctgttgataaagcaaaaaaatcaaaaggatatttagtctttgcaatgca

SEQ ID NO: 175269 - DNA, 75 bp, Artificial Sequence
  Synthetic
cctgttgataaagcaaaaaaatcaaaaggatatttagtctttgcaatgcagtctgtaactatgcaatttatcgat

SEQ ID NO: 175270 - DNA, 75 bp, Artificial Sequence
  Synthetic
gaccatttcttaaaaatggttctttagtagttatatatcttctgacagtatcagatttaaaatttaacggaatca

SEQ ID NO: 175271 - DNA, 75 bp, Artificial Sequence
  Synthetic
tcagatttaaaatttaacggaatcaaatccaacgttttattcacatattcatctttatgatatgcaacatactcc

SEQ ID NO: 175272 - DNA, 75 bp, Artificial Sequence
  Synthetic
tagaggacaaacaacgcgcctcggtgtttaccatgtgcacttcttcaattggcattggcaaagttgtaacagttc

SEQ ID NO: 175273 - DNA, 75 bp, Artificial Sequence
  Synthetic
gtttaccatgtgcacttcttcaattggcattggcaaagttgtaacagttcgatctaagaaatacacagtgccaac

SEQ ID NO: 175274 - DNA, 75 bp, Artificial Sequence
  Synthetic
agttcttttttaaaagttctgacagaaaacgtgtgtgcttcaatctttgttttgtaaattatcaaaataccttcg

SEQ ID NO: 175275 - DNA, 75 bp, Artificial Sequence
  Synthetic
aaaacgtgtgtgcttcaatctttgttttgtaaattatcaaaataccttcggtagttttaatgttagagccgtaag

SEQ ID NO: 175276 - DNA, 75 bp, Artificial Sequence
  Synthetic
acgcactaaatctgtcccggtggcaattgaacaaattcgaaatggtaaatgctgattgtgtccagtcatgacaaa

SEQ ID NO: 175277 - DNA, 75 bp, Artificial Sequence
  Synthetic
attgaacaaattcgaaatggtaaatgctgattgtgtccagtcatgacaaagtcagcttctgtttgtagagatagc

SEQ ID NO: 175278 - DNA, 75 bp, Artificial Sequence
  Synthetic
tcaggaatagaattttcattttgtctacatagatctaacagatttggagccggtatatgggaaacttgcttagtt

SEQ ID NO: 175279 - DNA, 75 bp, Artificial Sequence
  Synthetic
tgtgaaatttgaacaggatcgcattgagtctttaaatcgaaatacaataaagagtacaaatcattaaattttgtc

SEQ ID NO: 175280 - DNA, 75 bp, Artificial Sequence
  Synthetic
aaggagaaccactatcaaaagttaaaagtattttttcgacagtttctgtctcttcgccaaacttgacgattgata

SEQ ID NO: 175281 - DNA, 75 bp, Artificial Sequence
  Synthetic
aagtattttttcgacagtttctgtctcttcgccaaacttgacgattgataattgttttccaaatacatcattata

SEQ ID NO: 175282 - DNA, 75 bp, Artificial Sequence
  Synthetic
ctgataaaattccacatttgtctttgcatatcgttgatattatgcaaaccatcaaaattgaaaaatttattatat

SEQ ID NO: 175283 - DNA, 75 bp, Artificial Sequence
  Synthetic
gcatatcgttgatattatgcaaaccatcaaaattgaaaaatttattatatgtacacagcatccaattttccgggt

SEQ ID NO: 175284 - DNA, 75 bp, Artificial Sequence
  Synthetic
cagatcttctttcatatgtggtaaaaaatctgcaacatcgcaagcatacgccatggatatgttgctggacaatgg

SEQ ID NO: 175285 - DNA, 75 bp, Artificial Sequence
  Synthetic
aaatctgcaacatcgcaagcatacgccatggatatgttgctggacaatggaaaagaagcggtgtgataattcgac

SEQ ID NO: 175286 - DNA, 75 bp, Artificial Sequence
  Synthetic
tttcttgacttaaattaggtaaaagttcctgaggcaatttttttgaaagtagattgtttttaatgtataagtgat

SEQ ID NO: 175287 - DNA, 75 bp, Artificial Sequence
  Synthetic
ttcctgaggcaatttttttgaaagtagattgtttttaatgtataagtgatcatcataagtaaatggatcagcaga

SEQ ID NO: 175288 - DNA, 75 bp, Artificial Sequence
  Synthetic
ctatttgcaaatgcgttcatcattttcgaaagactttcgaaaatgtgatttcctaggatattaatattcattaac

SEQ ID NO: 175289 - DNA, 75 bp, Artificial Sequence
  Synthetic
tcgaaagactttcgaaaatgtgatttcctaggatattaatattcattaacttatttattaatgcttcttgctctt

SEQ ID NO: 175290 - DNA, 75 bp, Artificial Sequence
  Synthetic
acccgattcggaaattttttggtaataagctttttttctaatgtgaatctcttgttgtaaattgtgatcttgtgt

SEQ ID NO: 175291 - DNA, 75 bp, Artificial Sequence
  Synthetic
taagctttttttctaatgtgaatctcttgttgtaaattgtgatcttgtgtcattgaatgcgttacgtattttttt

SEQ ID NO: 175292 - DNA, 75 bp, Artificial Sequence
  Synthetic
caagttcatttaataaagtttttattttagtttgtatttcatcttcctctgccagctttgtaaaaaccggatctt

SEQ ID NO: 175293 - DNA, 75 bp, Artificial Sequence
  Synthetic
tttagtttgtatttcatcttcctctgccagctttgtaaaaaccggatcttcttctaagttttttatactaacatt

SEQ ID NO: 175294 - DNA, 75 bp, Artificial Sequence
  Synthetic
ggggaaataaatctcgatccgatgtataatttgtcatcatttgtaacattttcttcgttaaaattgaaaacatct

SEQ ID NO: 175295 - DNA, 75 bp, Artificial Sequence
  Synthetic
ataatttgtcatcatttgtaacattttcttcgttaaaattgaaaacatcttgaatagtttcaccatataaaaact

SEQ ID NO: 175296 - DNA, 75 bp, Artificial Sequence
  Synthetic
ataaagtgaatgacaaagatttagttgatttagagttattgaagctttttgaataacagattctgaaattttaga

SEQ ID NO: 175297 - DNA, 75 bp, Artificial Sequence
  Synthetic
tgatttagagttattgaagctttttgaataacagattctgaaattttagaccaataggtgaattcactcaacgaa

SEQ ID NO: 175298 - DNA, 75 bp, Artificial Sequence
  Synthetic
aaaggtcaaagttgattaaagtgttttcagcttcttgtaaatgtggaggttttgaatatagttgctgttgaaaaa

SEQ ID NO: 175299 - DNA, 75 bp, Artificial Sequence
  Synthetic
ttcagcttcttgtaaatgtggaggttttgaatatagttgctgttgaaaaatatttgtgattttcgccatatactc

SEQ ID NO: 175300 - DNA, 75 bp, Artificial Sequence
  Synthetic
gaaaaatccaaatctttctcaatgatgtcaacgtttttttctaaattggataccatatgtgtttcagttagatga

SEQ ID NO: 175301 - DNA, 75 bp, Artificial Sequence
  Synthetic
tgtcaacgtttttttctaaattggataccatatgtgtttcagttagatgattacaaaatttgccagctagtcttt

SEQ ID NO: 175302 - DNA, 75 bp, Artificial Sequence
  Synthetic
cactaaagataattcttcataacattttaaacatgtagtagtttcagaaaaaacttctggcttcatcactacgca

SEQ ID NO: 175303 - DNA, 75 bp, Artificial Sequence
  Synthetic
tttaaacatgtagtagtttcagaaaaaacttctggcttcatcactacgcaaacgccacacaaaattgttagaaat

SEQ ID NO: 175304 - DNA, 75 bp, Artificial Sequence
  Synthetic
tgccatccagtggtgaaattaagccaaaaatacaattcatcttacataaaagtttttcaatatcattgatcgtag

SEQ ID NO: 175305 - DNA, 75 bp, Artificial Sequence
  Synthetic
attattaagagccaagtccaattttaagtgttgcttgcattcattgagttggaatatattttcaaaatatttttg

SEQ ID NO: 175306 - DNA, 75 bp, Artificial Sequence
  Synthetic
tgaattgaagcatcgagtaataagacttgattatacatagcttttaataaaatctgtaaataaatggttacagga

SEQ ID NO: 175307 - DNA, 75 bp, Artificial Sequence
  Synthetic
cttgattatacatagcttttaataaaatctgtaaataaatggttacaggagatgcacaattaaaattttgatgac

SEQ ID NO: 175308 - DNA, 75 bp, Artificial Sequence
  Synthetic
caaatgaattattacaacaccgtttttcctgaaatttgtcatatctggaataagtgtgacagggtcacaaaatcg

SEQ ID NO: 175309 - DNA, 75 bp, Artificial Sequence
  Synthetic
tcttttctagtcagttcagtatgtggcactgttcctctgagaaatctgttaattgctatggcagttttctgttca

SEQ ID NO: 175310 - DNA, 75 bp, Artificial Sequence
  Synthetic
ttcctgaaatttgtcatatctggaataagtgtgacagggtcacaaaatcgtaagcactctaattctaaagcacat

SEQ ID NO: 175311 - DNA, 75 bp, Artificial Sequence
  Synthetic
acaatgattgcaaagaattcatttttacaatctagctttttttaaggagggttcctcattttcatgctcagtctc

SEQ ID NO: 175312 - DNA, 75 bp, Artificial Sequence
  Synthetic
tacaatctagctttttttaaggagggttcctcattttcatgctcagtctcttcacattttaatataccaaaacct

SEQ ID NO: 175313 - DNA, 75 bp, Artificial Sequence
  Synthetic
ctgaaaaatcatagatggcagcactatcttctacttgttcttcaaaaactgacaataaagttgaaagagaaaaat

SEQ ID NO: 175314 - DNA, 75 bp, Artificial Sequence
  Synthetic
atcttctacttgttcttcaaaaactgacaataaagttgaaagagaaaaatcatgtacatttaaatccgttaaatg

SEQ ID NO: 175315 - DNA, 75 bp, Artificial Sequence
  Synthetic
gctagaggctctctaccatccacgtagaataacatatcatccatagtaggcttactatctctatctttcatcact

SEQ ID NO: 175316 - DNA, 75 bp, Artificial Sequence
  Synthetic
agaataacatatcatccatagtaggcttactatctctatctttcatcacttcagctaatatgagtagttctggat

SEQ ID NO: 175317 - DNA, 75 bp, Artificial Sequence
  Synthetic
aatgttgagcacctttcctcgaattacttccacatcataaacaatggcttctctcttaactttcttcacaataat

SEQ ID NO: 175318 - DNA, 75 bp, Artificial Sequence
  Synthetic
acttccacatcataaacaatggcttctctcttaactttcttcacaataatgtcacacagttttgtagcaatcaca

SEQ ID NO: 175319 - DNA, 75 bp, Artificial Sequence
  Synthetic
cttgcaagccggaggaaggagggtttaaattgcgatctacaccacttccagctatccaacctaactgaccaaagt

SEQ ID NO: 175320 - DNA, 75 bp, Artificial Sequence
  Synthetic
taaattgcgatctacaccacttccagctatccaacctaactgaccaaagtggaaataatctctactagcaacact

SEQ ID NO: 175321 - DNA, 75 bp, Artificial Sequence
  Synthetic
aaggtaataatagatcttcctgtgaaaatgctcccaaaatttggttcttttgttaatgatgcagtcataggttct

SEQ ID NO: 175322 - DNA, 75 bp, Artificial Sequence
  Synthetic
aaatgctcccaaaatttggttcttttgttaatgatgcagtcataggttctttaagtccattccctaccaactttt

SEQ ID NO: 175323 - DNA, 75 bp, Artificial Sequence
  Synthetic
agaagaaaatgttggatgttctttaagaaaaactgggaataacatagggttttgaggaactagtttagaagttaa

SEQ ID NO: 175324 - DNA, 75 bp, Artificial Sequence
  Synthetic
tattatgaaagtaatactcgataaaggatagtaagcattctggttgaatatctaacaaatctatttcatcatatg

SEQ ID NO: 175325 - DNA, 75 bp, Artificial Sequence
  Synthetic
gatgaaagaacgcatgtcttcaacattacctatatctatggtttttggcatgttattaagcaaaatacgctgcca

SEQ ID NO: 175326 - DNA, 75 bp, Artificial Sequence
  Synthetic
ttacctatatctatggtttttggcatgttattaagcaaaatacgctgccaaaattctaggcaggatatttttaaa

SEQ ID NO: 175327 - DNA, 75 bp, Artificial Sequence
  Synthetic
taaacagcaaaaatgataagcaaccagaaagtgggttctttttctgtttgacctttttgaaaaaaggattatttt

SEQ ID NO: 175328 - DNA, 75 bp, Artificial Sequence
  Synthetic
agaaagtgggttctttttctgtttgacctttttgaaaaaaggattattttgtgtgtttttgtttggcttattgaa

SEQ ID NO: 175329 - DNA, 75 bp, Artificial Sequence
  Synthetic
ttcaaacattgcatggaaaggcgacagagtttagcttggatagaggttttagcatatttacccgatttaaacaaa

SEQ ID NO: 175330 - DNA, 75 bp, Artificial Sequence
  Synthetic
agagtttagcttggatagaggttttagcatatttacccgatttaaacaaattgaaatcaatgtattgttccatgt

SEQ ID NO: 175331 - DNA, 75 bp, Artificial Sequence
  Synthetic
tttcatattcaaaaaaccttttttaaaatgactgttgtaaaatgctccgtagagagattggtattgttgcattaa

SEQ ID NO: 175332 - DNA, 75 bp, Artificial Sequence
  Synthetic
aaatgactgttgtaaaatgctccgtagagagattggtattgttgcattaaccatttagaaattaagtttccagta

SEQ ID NO: 175333 - DNA, 75 bp, Artificial Sequence
  Synthetic
taccgattattaaagccaagttctgtaaaacaattagtataactttgtaatacgtgaaaacaaagaatggagaaa

SEQ ID NO: 175334 - DNA, 75 bp, Artificial Sequence
  Synthetic
tttgatttttgtgttttttttttaaaatgtggacccacccattcaaaaataaggcgtttggggtaaagcaaatgt

SEQ ID NO: 175335 - DNA, 75 bp, Artificial Sequence
  Synthetic
taaaacaattagtataactttgtaatacgtgaaaacaaagaatggagaaaaagccaaagacagaggtgtcgtatc

SEQ ID NO: 175336 - DNA, 75 bp, Artificial Sequence
  Synthetic
tcgatttgttctctggatgtctgcgtttttctcatttctgaaatacattttgaaactgcttcctcaatgcattga

SEQ ID NO: 175337 - DNA, 75 bp, Artificial Sequence
  Synthetic
tttttctcatttctgaaatacattttgaaactgcttcctcaatgcattgaattaaatcattaatcatattcacaa

SEQ ID NO: 175338 - DNA, 75 bp, Artificial Sequence
  Synthetic
attgtcttccccagttattgcatcaatcaaattatttttcttacaataatcgtgaatcattcctaagaatttgaa

SEQ ID NO: 175339 - DNA, 75 bp, Artificial Sequence
  Synthetic
atcaaattatttttcttacaataatcgtgaatcattcctaagaatttgaatctatctaaggaaggtgtggtttga

SEQ ID NO: 175340 - DNA, 75 bp, Artificial Sequence
  Synthetic
cattaactccctttttcccaaaagaacctagaacatctacatctgcataaaaacgagaaaacattgtcataacaa

SEQ ID NO: 175341 - DNA, 75 bp, Artificial Sequence
  Synthetic
acctagaacatctacatctgcataaaaacgagaaaacattgtcataacaataggttcttttttagtcgttttaga

SEQ ID NO: 175342 - DNA, 75 bp, Artificial Sequence
  Synthetic
ctgatcaatgctgttccgatacacgaatggcaacacttaccttcacaaaactcacagagattagaggaacaattt

SEQ ID NO: 175343 - DNA, 75 bp, Artificial Sequence
  Synthetic
aatggcaacacttaccttcacaaaactcacagagattagaggaacaatttacgatgtggttatatatttcagaat

SEQ ID NO: 175344 - DNA, 75 bp, Artificial Sequence
  Synthetic
cattctgttcaaattccatattatatgcgataagatttgtggacatgtcgcacatgcgtaagctagatgaaaagc

SEQ ID NO: 175345 - DNA, 75 bp, Artificial Sequence
  Synthetic
tgcgataagatttgtggacatgtcgcacatgcgtaagctagatgaaaagcggaaaatttatcttctttacaaggt

SEQ ID NO: 175346 - DNA, 75 bp, Artificial Sequence
  Synthetic
tggcatcgttataaaaatcttcgttaagagatgacaaggaattacaaaactggattgaacgcagtaatgtttctt

SEQ ID NO: 175347 - DNA, 75 bp, Artificial Sequence
  Synthetic
aagagatgacaaggaattacaaaactggattgaacgcagtaatgtttcttgagtgatcgcagagttaaaagcttg

SEQ ID NO: 175348 - DNA, 75 bp, Artificial Sequence
  Synthetic
ttgttactgtaaagtatcgaattcgcagcaaagactaaagcagctacatggctagatagatggagcctcaatttt

SEQ ID NO: 175349 - DNA, 75 bp, Artificial Sequence
  Synthetic
cagcaaagactaaagcagctacatggctagatagatggagcctcaattttttcagttccacgattttctcttcgt

SEQ ID NO: 175350 - DNA, 75 bp, Artificial Sequence
  Synthetic
ccactctgaaaaattcatgatttgattattttcataaatagaatcaagatactctgctgtgtaactgaaggttag

SEQ ID NO: 175351 - DNA, 75 bp, Artificial Sequence
  Synthetic
ttattttcataaatagaatcaagatactctgctgtgtaactgaaggttagttccgtgattacagcgtccactaac

SEQ ID NO: 175352 - DNA, 75 bp, Artificial Sequence
  Synthetic
atagtttttgaccaggaataccgtgatatgttttattcggtgcaagcttgacagtttgttcagtatcttggataa

SEQ ID NO: 175353 - DNA, 75 bp, Artificial Sequence
  Synthetic
atatgttttattcggtgcaagcttgacagtttgttcagtatcttggataaattgtttcagaccggctttaatcaa

SEQ ID NO: 175354 - DNA, 75 bp, Artificial Sequence
  Synthetic
gtcattccccatgatgtaaagattaagtagaacaatacttcgctgatctgaggcgcataaaagccgttttcttga

SEQ ID NO: 175355 - DNA, 75 bp, Artificial Sequence
  Synthetic
agtagaacaatacttcgctgatctgaggcgcataaaagccgttttcttgaatgaattcagtgcaagtatcgatgc

SEQ ID NO: 175356 - DNA, 75 bp, Artificial Sequence
  Synthetic
ggtagccgaatataacggaatttttattgccaagcattcaccaacctggacttgaatctgctcttctacacatgg

SEQ ID NO: 175357 - DNA, 75 bp, Artificial Sequence
  Synthetic
tctttgaaaccattcccaacaactatatgacatagaacgtcatctgcatttcttccaacactttcacagatcttt

SEQ ID NO: 175358 - DNA, 75 bp, Artificial Sequence
  Synthetic
cgttaacgacaaattcttgtagattgaatttttctcttgtttgtttgcacaatttatcaagatttccatggtctt

SEQ ID NO: 175359 - DNA, 75 bp, Artificial Sequence
  Synthetic
gaatttttctcttgtttgtttgcacaatttatcaagatttccatggtcttctgcttcttttaaaaaaacatctgt

SEQ ID NO: 175360 - DNA, 75 bp, Artificial Sequence
  Synthetic
ataaacgatgtgattttggtaatgactgttccgccgtaattaataatgggtgttttaacggttgggaagaagtca

SEQ ID NO: 175361 - DNA, 75 bp, Artificial Sequence
  Synthetic
ctgttccgccgtaattaataatgggtgttttaacggttgggaagaagtcattttcaaccgttagattaagtaaca

SEQ ID NO: 175362 - DNA, 75 bp, Artificial Sequence
  Synthetic
tttttccattaacgataatgtagtcagaatttctattaatttttgttctttcggcagaatgtacagccatgctgc

SEQ ID NO: 175363 - DNA, 75 bp, Artificial Sequence
  Synthetic
agaatttctattaatttttgttctttcggcagaatgtacagccatgctgcggtacatattggggccgaaacaaca

SEQ ID NO: 175364 - DNA, 75 bp, Artificial Sequence
  Synthetic
tgctatttcatctgtggtttgagaaatgatctgttccatgtgttgattttctatgctgtgtacatgttcaacttc

SEQ ID NO: 175365 - DNA, 75 bp, Artificial Sequence
  Synthetic
aaacatgaagaccccagtttctgcaaggggtgtttctgctaaaccttatatattttagttgacgtaacaaaactt

SEQ ID NO: 175366 - DNA, 75 bp, Artificial Sequence
  Synthetic
aggggtgtttctgctaaaccttatatattttagttgacgtaacaaaacttagcgtcatcatacaacggaaattaa

SEQ ID NO: 175367 - DNA, 75 bp, Artificial Sequence
  Synthetic
cggagaactaaaaacgatatactgactcggatttgatagtttatgcaaattagcgtccacctcactcgtaatagt

SEQ ID NO: 175368 - DNA, 75 bp, Artificial Sequence
  Synthetic
ctcggatttgatagtttatgcaaattagcgtccacctcactcgtaatagtatttatttttcatggtttttaaaat

SEQ ID NO: 175369 - DNA, 75 bp, Artificial Sequence
  Synthetic
gaaccctcccacttccgcaaagtaagcaacgaccaatcagaagtttgcattgcaagtatttaatttgttgcagca

SEQ ID NO: 175370 - DNA, 75 bp, Artificial Sequence
  Synthetic
gagatgctacatattgggaaattaatccgaatcatcagaatcagtgtcattaatgtcggtctcacaagtttctac

SEQ ID NO: 175371 - DNA, 75 bp, Artificial Sequence
  Synthetic
tccgaatcatcagaatcagtgtcattaatgtcggtctcacaagtttctacatcttcataatctaaatccagttcc

SEQ ID NO: 175372 - DNA, 75 bp, Artificial Sequence
  Synthetic
taatgtcggtctcacaagtttctacatcttcataatctaaatccagttccatttcattatcagagttttcctctc

SEQ ID NO: 175373 - DNA, 75 bp, Artificial Sequence
  Synthetic
tttcatagaagtatcattttcaataaatacaaagcgagtttcatcttcctgtagagtcgtgtttgtttcaaaatc

SEQ ID NO: 175374 - DNA, 75 bp, Artificial Sequence
  Synthetic
aatacaaagcgagtttcatcttcctgtagagtcgtgtttgtttcaaaatctatagaatcaacttctttactccag

SEQ ID NO: 175375 - DNA, 75 bp, Artificial Sequence
  Synthetic
gctcatttgttttctgtcctttattcgttttatccgcagtaagaagctttttacatttggcttgctttttggttt

SEQ ID NO: 175376 - DNA, 75 bp, Artificial Sequence
  Synthetic
cgttttatccgcagtaagaagctttttacatttggcttgctttttggtttgtaaattcaattggacggtttgctt

SEQ ID NO: 175377 - DNA, 75 bp, Artificial Sequence
  Synthetic
gacggagttgtagaacatgcaacattaaagctgttgtactcttcaggcatgttaggatgcagaccaaactccaca

SEQ ID NO: 175378 - DNA, 75 bp, Artificial Sequence
  Synthetic
gttaggatgcagaccaaactccacaaattctttgggaagataggtacagaaatataagcttggtttccaaggtga

SEQ ID NO: 175379 - DNA, 75 bp, Artificial Sequence
  Synthetic
caaccgatgtcatcacattgatgattgttaaattggtctccgactaatctggaaatcatgccacattgatattgt

SEQ ID NO: 175380 - DNA, 75 bp, Artificial Sequence
  Synthetic
tgttaaattggtctccgactaatctggaaatcatgccacattgatattgttcacttacacgatcttggtcaaaat

SEQ ID NO: 175381 - DNA, 75 bp, Artificial Sequence
  Synthetic
ttgaagaatacgttcctttatttgacgtaaaatccttgcaaaagttactataaatgataaagcttgctgtgctgg

SEQ ID NO: 175382 - DNA, 75 bp, Artificial Sequence
  Synthetic
cgtaaaatccttgcaaaagttactataaatgataaagcttgctgtgctggatattgaaaagatccaggagtctgt

SEQ ID NO: 175383 - DNA, 75 bp, Artificial Sequence
  Synthetic
gcatatcacggtcatataccggttttccacaaagttgtctgaaaatacggtattctatgtcaccatgtccattgt

SEQ ID NO: 175384 - DNA, 75 bp, Artificial Sequence
  Synthetic
tccacaaagttgtctgaaaatacggtattctatgtcaccatgtccattgtcattaaaaacacaacaaagttttgc

SEQ ID NO: 175385 - DNA, 75 bp, Artificial Sequence
  Synthetic
aacttcattatggtaatagtatacataaacagatcttgagggtcaataggtaagttgtgcacaaaatgatattta

SEQ ID NO: 175386 - DNA, 75 bp, Artificial Sequence
  Synthetic
taaacagatcttgagggtcaataggtaagttgtgcacaaaatgatatttatagtaaatgcaagcttcctcaataa

SEQ ID NO: 175387 - DNA, 75 bp, Artificial Sequence
  Synthetic
agaattcgtcaatgaaaaaactcggtctccgagtatctgttgatgttgttctctattgagggagtttaagcagtt

SEQ ID NO: 175388 - DNA, 75 bp, Artificial Sequence
  Synthetic
tctccgagtatctgttgatgttgttctctattgagggagtttaagcagttcttatatcgtagtaacaagtctgtt

SEQ ID NO: 175389 - DNA, 75 bp, Artificial Sequence
  Synthetic
agattttttcatgattccggggaaatcgatctcgaatcctatgagctggatctcgtgcttcaccggaatacttgc

SEQ ID NO: 175390 - DNA, 75 bp, Artificial Sequence
  Synthetic
tcgatctcgaatcctatgagctggatctcgtgcttcaccggaatacttgcgtaaaccaagggcttccgcggtgta

SEQ ID NO: 175391 - DNA, 75 bp, Artificial Sequence
  Synthetic
aaattggcgaaaaaagtcaatgcatgcgtctgtgcacgcttttcttcctgcttttcttcaatgatgagtttcagc

SEQ ID NO: 175392 - DNA, 75 bp, Artificial Sequence
  Synthetic
gcgtctgtgcacgcttttcttcctgcttttcttcaatgatgagtttcagctgttctagttctctgagactcaaag

SEQ ID NO: 175393 - DNA, 75 bp, Artificial Sequence
  Synthetic
cttaataggaatgatgcgtctgtgaaattgtttcgtaaagcggctgacatacttgttagcaggtttatgaacaag

SEQ ID NO: 175394 - DNA, 75 bp, Artificial Sequence
  Synthetic
aattgtttcgtaaagcggctgacatacttgttagcaggtttatgaacaagagttcgtttaatggttttcaaacca

SEQ ID NO: 175395 - DNA, 75 bp, Artificial Sequence
  Synthetic
ttttaaccccgcgtggatacatgtttctgtcgaaaatgagaaccttgttcataaacggccttttatattattttt

SEQ ID NO: 175396 - DNA, 75 bp, Artificial Sequence
  Synthetic
tctgtcgaaaatgagaaccttgttcataaacggccttttatattatttttgtctcgtgtagcggtgacgcctctg

SEQ ID NO: 175397 - DNA, 75 bp, Artificial Sequence
  Synthetic
acatataaagctagacacgaattaaggtgcgtctaaaattttatttacaaaacacaaataaataacataaaaatg

SEQ ID NO: 175398 - DNA, 75 bp, Artificial Sequence
  Synthetic
ggtgcgtctaaaattttatttacaaaacacaaataaataacataaaaatgtcacatattcaaagaatctaaaacg

SEQ ID NO: 175399 - DNA, 75 bp, Artificial Sequence
  Synthetic
tagatttacatttcgtagtaaaacatttgctccataatattatcaaaatgcgattgttatctaccttaaattcta

SEQ ID NO: 175400 - DNA, 75 bp, Artificial Sequence
  Synthetic
tttgctccataatattatcaaaatgcgattgttatctaccttaaattctaagtacactaagacattttcacggtt

SEQ ID NO: 175401 - DNA, 75 bp, Artificial Sequence
  Synthetic
ctgaaatcacttagttttccgttttgcaatttttttagttgtatatttttgtgatcaatttttagaaaagttaca

SEQ ID NO: 175402 - DNA, 75 bp, Artificial Sequence
  Synthetic
gcaatttttttagttgtatatttttgtgatcaatttttagaaaagttacatgttgaaattgtgtagctgttcgtg

SEQ ID NO: 175403 - DNA, 75 bp, Artificial Sequence
  Synthetic
taacatttgtggccaggcaattgaacgagtaaaagtcattaacaaatcatcacgggaaagacaacttgtttccga

SEQ ID NO: 175404 - DNA, 75 bp, Artificial Sequence
  Synthetic
cgagtaaaagtcattaacaaatcatcacgggaaagacaacttgtttccgaaaaaccattgacatgtaaatatttc

SEQ ID NO: 175405 - DNA, 75 bp, Artificial Sequence
  Synthetic
gttttctgtgatacagttgcttagtcctagaatctataaaagaaaactctgttggacaggccttatcaaaaatgc

SEQ ID NO: 175406 - DNA, 75 bp, Artificial Sequence
  Synthetic
cctagaatctataaaagaaaactctgttggacaggccttatcaaaaatgctgtagattatctctgtaatggtttg

SEQ ID NO: 175407 - DNA, 75 bp, Artificial Sequence
  Synthetic
tgtgggtatatgtacatattacataatatatgctagtaaatgattacatgcactagcatatatttgcacatacta

SEQ ID NO: 175408 - DNA, 75 bp, Artificial Sequence
  Synthetic
ttattgagatctagttgcatgctaacgaaatcttgaaaattctttttcattttttccgggacaataaaaataggc

SEQ ID NO: 175409 - DNA, 75 bp, Artificial Sequence
  Synthetic
tattctcttcgtcaactttatacatgaaacctaaccgtaaacaacgtcccgtattatagattcctgtatcaaaac

SEQ ID NO: 175410 - DNA, 75 bp, Artificial Sequence
  Synthetic
aagaatctgcattaaatcgtggtttagacacattaaatgattgaatattttagaaagttgttttaatggctcact

SEQ ID NO: 175411 - DNA, 75 bp, Artificial Sequence
  Synthetic
agacacattaaatgattgaatattttagaaagttgttttaatggctcacttccaattattgcagtaccttgaggg

SEQ ID NO: 175412 - DNA, 75 bp, Artificial Sequence
  Synthetic
ttttttttttgcaaacacaaaaagctgtttcaacttcattgtaacatacattgtggttcaggggattctccggat

SEQ ID NO: 175413 - DNA, 75 bp, Artificial Sequence
  Synthetic
tgtttcaacttcattgtaacatacattgtggttcaggggattctccggattactacaggtagttttgaaaaaaaa

SEQ ID NO: 175414 - DNA, 75 bp, Artificial Sequence
  Synthetic
aacggaaatattttttgccatgcattgatcagcacattccgcatcaatttacacatagagaaaaataacgattcc

SEQ ID NO: 175415 - DNA, 75 bp, Artificial Sequence
  Synthetic
tgatcagcacattccgcatcaatttacacatagagaaaaataacgattccgttattatagctgaatcctgtaatg

SEQ ID NO: 175416 - DNA, 75 bp, Artificial Sequence
  Synthetic
tgtaaccggaaggtattcattaaagatttcatgcctggttacgtaaaactgtttttctatttcgtcgcttaaaaa

SEQ ID NO: 175417 - DNA, 75 bp, Artificial Sequence
  Synthetic
atttcatgcctggttacgtaaaactgtttttctatttcgtcgcttaaaaaggtcgtgtcctgcaaccaaaatgta

SEQ ID NO: 175418 - DNA, 75 bp, Artificial Sequence
  Synthetic
actcattgggtaaaaattgcataacctggtcgaaacccatatttttgtaccaactttctgcacttccaaaacaat

SEQ ID NO: 175419 - DNA, 75 bp, Artificial Sequence
  Synthetic
ctggtcgaaacccatatttttgtaccaactttctgcacttccaaaacaataaagatttttgtaagacatttgaac

SEQ ID NO: 175420 - DNA, 75 bp, Artificial Sequence
  Synthetic
aattggtcatgtagatattgtctccttgtaacaggtttaccatctatcaaaatagatttattagatgccaaaatt

SEQ ID NO: 175421 - DNA, 75 bp, Artificial Sequence
  Synthetic
ttgtaacaggtttaccatctatcaaaatagatttattagatgccaaaatttttaaaaatccttgtaagcctaatt

SEQ ID NO: 175422 - DNA, 75 bp, Artificial Sequence
  Synthetic
gtgtttattgcatttgttaaccatctttgaaatttggtctgaatttattacaagcatgatatttctattactgtt

SEQ ID NO: 175423 - DNA, 75 bp, Artificial Sequence
  Synthetic
tttgaaatttggtctgaatttattacaagcatgatatttctattactgtttatgtcataaacgtactgttgcatt

SEQ ID NO: 175424 - DNA, 75 bp, Artificial Sequence
  Synthetic
ttatttctacataattttgaaaataactgtcttcgttaaagtactgtttcatgattgaaatgagatccgagtgta

SEQ ID NO: 175425 - DNA, 75 bp, Artificial Sequence
  Synthetic
actgtcttcgttaaagtactgtttcatgattgaaatgagatccgagtgtaaagaatttcctaggatgtacatatt

SEQ ID NO: 175426 - DNA, 75 bp, Artificial Sequence
  Synthetic
ctggtaggatcataagatgtcagttgactatacttgatgaatttatttttttctaatgctgtactgtaagcaatg

SEQ ID NO: 175427 - DNA, 75 bp, Artificial Sequence
  Synthetic
gactatacttgatgaatttatttttttctaatgctgtactgtaagcaatgtagatatagtggactcgaaaactgt

SEQ ID NO: 175428 - DNA, 75 bp, Artificial Sequence
  Synthetic
aatatctatttgcttatcaagataaagaaattcttttcgatctcttatgtttttttgttttgcatattcagaaaa

SEQ ID NO: 175429 - DNA, 75 bp, Artificial Sequence
  Synthetic
agaaattcttttcgatctcttatgtttttttgttttgcatattcagaaaaactaacaaattttttccgatagtta

SEQ ID NO: 175430 - DNA, 75 bp, Artificial Sequence
  Synthetic
cagacatggaggaataagtaaataccatatctcctaatttatcagtgaaacactgaacataattcttagttgttg

SEQ ID NO: 175431 - DNA, 75 bp, Artificial Sequence
  Synthetic
catatctcctaatttatcagtgaaacactgaacataattcttagttgttgctatggtgcttttctgctcttcaaa

SEQ ID NO: 175432 - DNA, 75 bp, Artificial Sequence
  Synthetic
agcattccttctgtttgaccgtatgttgataaaaaccaaaacggtgacgtgggtaagagatacttatttgttaga

SEQ ID NO: 175433 - DNA, 75 bp, Artificial Sequence
  Synthetic
ttgataaaaaccaaaacggtgacgtgggtaagagatacttatttgttagatgtttaatgattatagtcttgcaaa

SEQ ID NO: 175434 - DNA, 75 bp, Artificial Sequence
  Synthetic
attttcacttccttctggaacatgagaaagtaaaaaatctttatacagattttctgtttcttccgtatttaaaca

SEQ ID NO: 175435 - DNA, 75 bp, Artificial Sequence
  Synthetic
gaaagtaaaaaatctttatacagattttctgtttcttccgtatttaaacagtgaataatatcctcagacttaatg

SEQ ID NO: 175436 - DNA, 75 bp, Artificial Sequence
  Synthetic
tgaaattcaaagattctgcgtcgcaaacaaataccgtctcaattcttttggaaaacttgcatttctgtgtctgca

SEQ ID NO: 175437 - DNA, 75 bp, Artificial Sequence
  Synthetic
aacaaataccgtctcaattcttttggaaaacttgcatttctgtgtctgcatacaaaaatatacattttttgatgg

SEQ ID NO: 175438 - DNA, 75 bp, Artificial Sequence
  Synthetic
attaaatgttcactagggttcttacataagatatttactatcacgtgcgcggggtcatattccgttgcaaacaca

SEQ ID NO: 175439 - DNA, 75 bp, Artificial Sequence
  Synthetic
ataagatatttactatcacgtgcgcggggtcatattccgttgcaaacacagtaatagtcattgtgaatgtctttc

SEQ ID NO: 175440 - DNA, 75 bp, Artificial Sequence
  Synthetic
ataagacaataggaatcatgggaaattgctttgtaaaaaaaatctcttctgacatcttcaactctaactaccaga

SEQ ID NO: 175441 - DNA, 75 bp, Artificial Sequence
  Synthetic
ttgctttgtaaaaaaaatctcttctgacatcttcaactctaactaccagatgctctattctgagctctcagagca

SEQ ID NO: 175442 - DNA, 75 bp, Artificial Sequence
  Synthetic
acaaaatatacagattttggaattttaaaaaccgatattctcaactatgaaagagactccgaaacattcaaaact

SEQ ID NO: 175443 - DNA, 75 bp, Artificial Sequence
  Synthetic
taaaaaccgatattctcaactatgaaagagactccgaaacattcaaaactttgttgcaagtgttacctatctata

SEQ ID NO: 175444 - DNA, 75 bp, Artificial Sequence
  Synthetic
gattgaacgctgtttaaataattgtccccctcacgttaaagatgcattgattattgaaatcatgaaagctaagaa

SEQ ID NO: 175445 - DNA, 75 bp, Artificial Sequence
  Synthetic
ccccctcacgttaaagatgcattgattattgaaatcatgaaagctaagaaaattttagagactctggatgttgtg

SEQ ID NO: 175446 - DNA, 75 bp, Artificial Sequence
  Synthetic
ttacaatttgcagtgacaatgtgaatcaattgctcaataaattttcaatagaccaaacaacattatgtgacatgg

SEQ ID NO: 175447 - DNA, 75 bp, Artificial Sequence
  Synthetic
tcaattgctcaataaattttcaatagaccaaacaacattatgtgacatggaaaaaataaatactttaattgactt

SEQ ID NO: 175448 - DNA, 75 bp, Artificial Sequence
  Synthetic
ttgacagagatcgatcctttgttacatcaagaaacaggcctgtatcaagcgctgcctaatgcagttacggatcca

SEQ ID NO: 175449 - DNA, 75 bp, Artificial Sequence
  Synthetic
atcaagaaacaggcctgtatcaagcgctgcctaatgcagttacggatccaccaagcgaacagagagccgcaacta

SEQ ID NO: 175450 - DNA, 75 bp, Artificial Sequence
  Synthetic
ataaaattttattccgtgctgtactgaaaccaaagcatcgatgttttatctaacactgcaagctgattcaacact

SEQ ID NO: 175451 - DNA, 75 bp, Artificial Sequence
  Synthetic
gaaaccaaagcatcgatgttttatctaacactgcaagctgattcaacactcgattaggtaatagctttaaaataa

SEQ ID NO: 175452 - DNA, 75 bp, Artificial Sequence
  Synthetic
tgcaatacaaattcctgcttgcacaaagatcctctgagaagtgggattaaaaatctttacacttggagttgtgtt

SEQ ID NO: 175453 - DNA, 75 bp, Artificial Sequence
  Synthetic
aagatcctctgagaagtgggattaaaaatctttacacttggagttgtgttctttaaccagatattagtttcaacc

SEQ ID NO: 175454 - DNA, 75 bp, Artificial Sequence
  Synthetic
tgtttgctattattaaagctttcaattcatcaggacaatcaaacatgtaatcaaaattttggattgtgtaattat

SEQ ID NO: 175455 - DNA, 75 bp, Artificial Sequence
  Synthetic
ttcatcaggacaatcaaacatgtaatcaaaattttggattgtgtaattattggattctacatagaaatctttatt

SEQ ID NO: 175456 - DNA, 75 bp, Artificial Sequence
  Synthetic
tttggagaaggaaaattataagtttcccagggttccggtatatagcatggaaggatgttaatcactaattctata

SEQ ID NO: 175457 - DNA, 75 bp, Artificial Sequence
  Synthetic
cccagggttccggtatatagcatggaaggatgttaatcactaattctatatcaccaggtaacaacattactgatt

SEQ ID NO: 175458 - DNA, 75 bp, Artificial Sequence
  Synthetic
ggagataacgttttctgttgtgatgagttctgttacacattcgcagagagtgtcgttaactgttccagtcaaaat

SEQ ID NO: 175459 - DNA, 75 bp, Artificial Sequence
  Synthetic
agttctgttacacattcgcagagagtgtcgttaactgttccagtcaaaatcccaaaaagtccgtcgggaatgttt

SEQ ID NO: 175460 - DNA, 75 bp, Artificial Sequence
  Synthetic
gtacttgttcacaaggcacccatataagttctctatttacgagtacaattttatttgtatttagaattacatcca

SEQ ID NO: 175461 - DNA, 75 bp, Artificial Sequence
  Synthetic
aagttctctatttacgagtacaattttatttgtatttagaattacatccatccgacttttctcaaaatgatttat

SEQ ID NO: 175462 - DNA, 75 bp, Artificial Sequence
  Synthetic
ggaacattttcaaaaccaaatctgctagatctgtttcttggaaaggtgagatatttcttttcattgtccatatgt

SEQ ID NO: 175463 - DNA, 75 bp, Artificial Sequence
  Synthetic
tagatctgtttcttggaaaggtgagatatttcttttcattgtccatatgttctgcaaagaactcatcgtaaattt

SEQ ID NO: 175464 - DNA, 75 bp, Artificial Sequence
  Synthetic
ttgaggaattccaagtaaagaaaatggtcgttgataaaccgtcaattcagtgttcacatattcatttaattgctt

SEQ ID NO: 175465 - DNA, 75 bp, Artificial Sequence
  Synthetic
ggtcgttgataaaccgtcaattcagtgttcacatattcatttaattgctttgcatcgattttaggccatgtaaga

SEQ ID NO: 175466 - DNA, 75 bp, Artificial Sequence
  Synthetic
tccagatatcatccacatccgttacagtaaacaggaaaaagtgcaagtatctggacataggcaatttgttaagtg

SEQ ID NO: 175467 - DNA, 75 bp, Artificial Sequence
  Synthetic
agtaaacaggaaaaagtgcaagtatctggacataggcaatttgttaagtgtaattgtttcagagattttttcaga

SEQ ID NO: 175468 - DNA, 75 bp, Artificial Sequence
  Synthetic
cttctggagggtagactttgcattttcgttgaagccttcggatgattaggaaaaatgactctatacaagattgtt

SEQ ID NO: 175469 - DNA, 75 bp, Artificial Sequence
  Synthetic
tcgttgaagccttcggatgattaggaaaaatgactctatacaagattgtttccaagccaattatattgctggcat

SEQ ID NO: 175470 - DNA, 75 bp, Artificial Sequence
  Synthetic
aaatgaagtcgacggggaggagctgttttataagcctacttgtcattcagatacatatgaaattattttaaaaaa

SEQ ID NO: 175471 - DNA, 75 bp, Artificial Sequence
  Synthetic
ttttataagcctacttgtcattcagatacatatgaaattattttaaaaaaattttcttctatttggatattggtc

SEQ ID NO: 175472 - DNA, 75 bp, Artificial Sequence
  Synthetic
tttcattatttttaaagtattggtgttttaagactctcgccaaagaaactgtaaaagggtattaaatctatatga

SEQ ID NO: 175473 - DNA, 75 bp, Artificial Sequence
  Synthetic
ttttaagactctcgccaaagaaactgtaaaagggtattaaatctatatgaagaatgtatgaaaatgccctcagaa

SEQ ID NO: 175474 - DNA, 75 bp, Artificial Sequence
  Synthetic
catatttgaacataaatattctaagccaaatatttttctcgtgattagtctgcgttacttctgtcaccacactca

SEQ ID NO: 175475 - DNA, 75 bp, Artificial Sequence
  Synthetic
ccaaatatttttctcgtgattagtctgcgttacttctgtcaccacactcatatttttcatggtatttgttagaat

SEQ ID NO: 175476 - DNA, 75 bp, Artificial Sequence
  Synthetic
cacgtcatgctgtatgttgaagttgaacaatggtgtgtctgtggttgaatttgttacgaacgcttaatagaaatt

SEQ ID NO: 175477 - DNA, 75 bp, Artificial Sequence
  Synthetic
aacaatggtgtgtctgtggttgaatttgttacgaacgcttaatagaaattattgtacatttttctattagtatga

SEQ ID NO: 175478 - DNA, 75 bp, Artificial Sequence
  Synthetic
ttctgttttgagtgttaattaaagttgcattgaaaagaatggcggttgtactgtaatttctcaaatcaaagtttt

SEQ ID NO: 175479 - DNA, 75 bp, Artificial Sequence
  Synthetic
tgcattgaaaagaatggcggttgtactgtaatttctcaaatcaaagttttaaagtatgctttgtcacggagatac

SEQ ID NO: 175480 - DNA, 75 bp, Artificial Sequence
  Synthetic
tgttttgctgatttatgtgcttgtgttactatggtttgtcgtgaaaaaggtcgtaggaaatgatgaagtctgttg

SEQ ID NO: 175481 - DNA, 75 bp, Artificial Sequence
  Synthetic
ttactatggtttgtcgtgaaaaaggtcgtaggaaatgatgaagtctgttgtgaagcttgcatgcttgaggtgcct

SEQ ID NO: 175482 - DNA, 75 bp, Artificial Sequence
  Synthetic
gttcggaagtaacagcgttcggaattgctgtaggcttagtaactttggtcttattttctaagaacatcaagttcc

SEQ ID NO: 175483 - DNA, 75 bp, Artificial Sequence
  Synthetic
tgctgtaggcttagtaactttggtcttattttctaagaacatcaagttccccttaaaactttgtattggtgacat

SEQ ID NO: 175484 - DNA, 75 bp, Artificial Sequence
  Synthetic
gtaacaccaaatggtgttgacacattccgcgtgttcacagaattatagaaaaattttgaaatagaattcttgcaa

SEQ ID NO: 175485 - DNA, 75 bp, Artificial Sequence
  Synthetic
tccgcgtgttcacagaattatagaaaaattttgaaatagaattcttgcaatctgttcgattgtaaacaaagtagt

SEQ ID NO: 175486 - DNA, 75 bp, Artificial Sequence
  Synthetic
ttgctcagaattttcgcgtgaaaataattgagcttcagtatggttttggagatcttggaaaatggtttcaatctt

SEQ ID NO: 175487 - DNA, 75 bp, Artificial Sequence
  Synthetic
aattgagcttcagtatggttttggagatcttggaaaatggtttcaatcttgttttggctaaagttaattttaaac

SEQ ID NO: 175488 - DNA, 75 bp, Artificial Sequence
  Synthetic
gtattttattgacacaagagtcatccatcgttttgaatgctagtgtagcaaaaactaaatacaaaaaggaaatat

SEQ ID NO: 175489 - DNA, 75 bp, Artificial Sequence
  Synthetic
catcgttttgaatgctagtgtagcaaaaactaaatacaaaaaggaaatattatctaagtaaacgtgacgttttct

SEQ ID NO: 175490 - DNA, 75 bp, Artificial Sequence
  Synthetic
tgtaatgtccatcgcggaaaattatctagatagagcatatttattttagaaaggcaaatattctttttctgggat

SEQ ID NO: 175491 - DNA, 75 bp, Artificial Sequence
  Synthetic
ctagatagagcatatttattttagaaaggcaaatattctttttctgggatagacggaatgaccaaaataaaatct

SEQ ID NO: 175492 - DNA, 75 bp, Artificial Sequence
  Synthetic
tatgtcgcaactctgaatatatgttttttcaaaagactcataatgaaattttgcgaatttcggccacatggaaaa

SEQ ID NO: 175493 - DNA, 75 bp, Artificial Sequence
  Synthetic
ttttcaaaagactcataatgaaattttgcgaatttcggccacatggaaaaattcgttaaatttacaaacgagatt

SEQ ID NO: 175494 - DNA, 75 bp, Artificial Sequence
  Synthetic
gagtccatatgatcagataactataaaaaagaaaagaaatcaacgtgaacactagcattgaatacattttgtttt

SEQ ID NO: 175495 - DNA, 75 bp, Artificial Sequence
  Synthetic
aaaaagaaaagaaatcaacgtgaacactagcattgaatacattttgtttttcataaatgtgaattatttaggaac

SEQ ID NO: 175496 - DNA, 75 bp, Artificial Sequence
  Synthetic
atttttttaaccaggatcatgattgcaaaatgtaccttgtgttggacagtatttgttcacgcgctaatcatttta

SEQ ID NO: 175497 - DNA, 75 bp, Artificial Sequence
  Synthetic
caaaatgtaccttgtgttggacagtatttgttcacgcgctaatcattttaatgatacttttattaattcttcgtt

SEQ ID NO: 175498 - DNA, 75 bp, Artificial Sequence
  Synthetic
ttggtcgcaatcacaactagcttttacttgtctgaataaaagtttatctcatgttccagcataatatcaaaacaa

SEQ ID NO: 175499 - DNA, 75 bp, Artificial Sequence
  Synthetic
acttgtctgaataaaagtttatctcatgttccagcataatatcaaaacaatctaaatacatgataaataccaaac

SEQ ID NO: 175500 - DNA, 75 bp, Artificial Sequence
  Synthetic
acagaagaactaacatgattgaaacttgacttgattttagatctaatgcggtaatttcgaaaacagagccatttc

SEQ ID NO: 175501 - DNA, 75 bp, Artificial Sequence
  Synthetic
ttgacttgattttagatctaatgcggtaatttcgaaaacagagccatttcttaaaaacaataaataatgtgttcg

SEQ ID NO: 175502 - DNA, 75 bp, Artificial Sequence
  Synthetic
tccggatctattaattttaatagttgcttgtcatccattatgtatacaaattggataattccgtctatgtcgtca

SEQ ID NO: 175503 - DNA, 75 bp, Artificial Sequence
  Synthetic
gcttgtcatccattatgtatacaaattggataattccgtctatgtcgtcatattccacaaccaagctttcacaaa

SEQ ID NO: 175504 - DNA, 75 bp, Artificial Sequence
  Synthetic
atagattggttttatatttttcaccgaatatttataattagtaggtgtgcaggtagagtttaagggaacaacagt

SEQ ID NO: 175505 - DNA, 75 bp, Artificial Sequence
  Synthetic
gaatatttataattagtaggtgtgcaggtagagtttaagggaacaacagtgataataattgtagtgcttatgaca

SEQ ID NO: 175506 - DNA, 75 bp, Artificial Sequence
  Synthetic
cggctaaaatatattttgaagagatggtgtaagtaatatttggtaatgtgaggaaggcagcttgttcatttgaaa

SEQ ID NO: 175507 - DNA, 75 bp, Artificial Sequence
  Synthetic
ggtgtaagtaatatttggtaatgtgaggaaggcagcttgttcatttgaaacacaggaaatgcttttaaacatatc

SEQ ID NO: 175508 - DNA, 75 bp, Artificial Sequence
  Synthetic
agtgtgttcatcaccttgtttgtgtatgcgtctaggtttttataggataaaatgttgttgacaactctttgagtt

SEQ ID NO: 175509 - DNA, 75 bp, Artificial Sequence
  Synthetic
atgcgtctaggtttttataggataaaatgttgttgacaactctttgagttaaatctttgcgcgtggctgttgcac

SEQ ID NO: 175510 - DNA, 75 bp, Artificial Sequence
  Synthetic
catgacattatcaagcatatgtgtccaaaaatacatttccaaaggattgcacagacttgcgagcaaaacatgaat

SEQ ID NO: 175511 - DNA, 75 bp, Artificial Sequence
  Synthetic
caaaaatacatttccaaaggattgcacagacttgcgagcaaaacatgaatctttcgcttgatcttttcttggaag

SEQ ID NO: 175512 - DNA, 75 bp, Artificial Sequence
  Synthetic
gtaaaaacaaatttgcacgttccggttgggttaaatttgtaaacaatttatgtttttcatataatgtttcaatat

SEQ ID NO: 175513 - DNA, 75 bp, Artificial Sequence
  Synthetic
ttgggttaaatttgtaaacaatttatgtttttcatataatgtttcaatattgttttctatttctttccatttgtt

SEQ ID NO: 175514 - DNA, 75 bp, Artificial Sequence
  Synthetic
tctgctaaagataaaaatgctagcttagcagagataggaattgtcagatcagatgtaatataagaataatctact

SEQ ID NO: 175515 - DNA, 75 bp, Artificial Sequence
  Synthetic
tagcagagataggaattgtcagatcagatgtaatataagaataatctactaactggaaattctgaagtttttcca

SEQ ID NO: 175516 - DNA, 75 bp, Artificial Sequence
  Synthetic
agtcattttgaagcacttttctaaaaacctacccatcgtaatgatgctttggtgagtattaaggatttccaacag

SEQ ID NO: 175517 - DNA, 75 bp, Artificial Sequence
  Synthetic
aacctacccatcgtaatgatgctttggtgagtattaaggatttccaacagagggaggagtccatctcctcgagta

SEQ ID NO: 175518 - DNA, 75 bp, Artificial Sequence
  Synthetic
ataaaaacattaaatggaatgtgtctttgttaactggttttccgcaaaatccctccatgatataaacagttgcta

SEQ ID NO: 175519 - DNA, 75 bp, Artificial Sequence
  Synthetic
tttgttaactggttttccgcaaaatccctccatgatataaacagttgctaacttattgaatttggctattaaaaa

SEQ ID NO: 175520 - DNA, 75 bp, Artificial Sequence
  Synthetic
atatcatccagaaagtctattttgagaaacggataaaatctttcaattgttgttttttttgtaattaacaggaga

SEQ ID NO: 175521 - DNA, 75 bp, Artificial Sequence
  Synthetic
gaaacggataaaatctttcaattgttgttttttttgtaattaacaggagatcgtctgagacagtctgtctatata

SEQ ID NO: 175522 - DNA, 75 bp, Artificial Sequence
  Synthetic
actgcggttgccttctcagcaggttttacgggttctcacccgtttaggcaggaaagaccccaaccacataaccca

SEQ ID NO: 175523 - DNA, 75 bp, Artificial Sequence
  Synthetic
tttaaaaaaaatacgactaacatttccaaagataaaaacgacatcatccattcctgtttccactgaaattataaa

SEQ ID NO: 175524 - DNA, 75 bp, Artificial Sequence
  Synthetic
ccaaagataaaaacgacatcatccattcctgtttccactgaaattataaaaaacgatggtgtcaaagctagcatg

SEQ ID NO: 175525 - DNA, 75 bp, Artificial Sequence
  Synthetic
gtctcataacacatctttctgttattgggaatagataatcagtcaagccatttgaaagtgtgcaaatgtattggt

SEQ ID NO: 175526 - DNA, 75 bp, Artificial Sequence
  Synthetic
tttgaaagtgtgcaaatgtattggttgtaatagagtttgcgaatttccgaaacatttgcaaagtagacatccttt

SEQ ID NO: 175527 - DNA, 75 bp, Artificial Sequence
  Synthetic
acataacccactgacatttaaacccgtgaaaacaacaggaactgcggttgccttctcagcaggttttatgggttc

SEQ ID NO: 175528 - DNA, 75 bp, Artificial Sequence
  Synthetic
ctgtaatcgtttttgtatgcgaaacaggtttgatatttgtctgaaatttttgtgcatagattttcacagctttct

SEQ ID NO: 175529 - DNA, 75 bp, Artificial Sequence
  Synthetic
aggtttgatatttgtctgaaatttttgtgcatagattttcacagctttctctgttgatgggttaaaaaaacgtgt

SEQ ID NO: 175530 - DNA, 75 bp, Artificial Sequence
  Synthetic
gattcatcgaaattcacagaatcaaataaattcgagacaaaagtatatccgaataagcatttgggaatctgataa

SEQ ID NO: 175531 - DNA, 75 bp, Artificial Sequence
  Synthetic
ataaattcgagacaaaagtatatccgaataagcatttgggaatctgataaacccgagtttcgttataatcatgga

SEQ ID NO: 175532 - DNA, 75 bp, Artificial Sequence
  Synthetic
gaccccaaccacataacccactgacatttaaacccgtgaaaacaacaggaactgcggttgccttctcagcaggtt

SEQ ID NO: 175533 - DNA, 75 bp, Artificial Sequence
  Synthetic
aataatagtttgatttgttttttcatttacgcaaattgaagaattgagtatattccagtgtttccatccatttat

SEQ ID NO: 175534 - DNA, 75 bp, Artificial Sequence
  Synthetic
tgacacgatgagaagtagactatttatgtaaaaatacattttctccaatttagagcctggaagataaacgggaag

SEQ ID NO: 175535 - DNA, 75 bp, Artificial Sequence
  Synthetic
ttacatattaaatacataacgggataggaatcatagagatattttgggtaatatgtctttagaatacttgccccc

SEQ ID NO: 175536 - DNA, 75 bp, Artificial Sequence
  Synthetic
aggaatcatagagatattttgggtaatatgtctttagaatacttgccccctgttagaagacgtattggtcaatat

SEQ ID NO: 175537 - DNA, 75 bp, Artificial Sequence
  Synthetic
ttctgttgttaaaatccaattttgaaaaattaaatttttttttgggcaatctttttccagaagaactgcatgatt

SEQ ID NO: 175538 - DNA, 75 bp, Artificial Sequence
  Synthetic
aaaattaaatttttttttgggcaatctttttccagaagaactgcatgattcaaaaatacatgtatattttgaagt

SEQ ID NO: 175539 - DNA, 75 bp, Artificial Sequence
  Synthetic
tgacatttaaacccgtgaaaacaacaggaactgcggttgccttctcagcaggttttatgggttctcacccgttta

SEQ ID NO: 175540 - DNA, 75 bp, Artificial Sequence
  Synthetic
tgcattattgtttttaggcattttggtgagaaattattaaaaactttccattgttatttttttgaattcaaaact

SEQ ID NO: 175541 - DNA, 75 bp, Artificial Sequence
  Synthetic
gtgagaaattattaaaaactttccattgttatttttttgaattcaaaactacttttgccaaatcaaatctgtttt

SEQ ID NO: 175542 - DNA, 75 bp, Artificial Sequence
  Synthetic
aattcaatatttacagggactaaggcaactacgacaagcaacagattatctacagcaatttgtcatcaaaaatga

SEQ ID NO: 175543 - DNA, 75 bp, Artificial Sequence
  Synthetic
caactacgacaagcaacagattatctacagcaatttgtcatcaaaaatgaaagcttatgtaaggtaaaccctgta

SEQ ID NO: 175544 - DNA, 75 bp, Artificial Sequence
  Synthetic
taaaattggactttgtgaaaactttcatagctaaagaattgcaactgtcttccacgtttctttgcaaccttttta

SEQ ID NO: 175545 - DNA, 75 bp, Artificial Sequence
  Synthetic
catagctaaagaattgcaactgtcttccacgtttctttgcaacctttttacgaaatatcaaaatgacacagttaa

SEQ ID NO: 175546 - DNA, 75 bp, Artificial Sequence
  Synthetic
accaattttcgaagggcatgtcagaaatactctaatttgtaccgaggaagatatgcaacaactccaaaacttggg

SEQ ID NO: 175547 - DNA, 75 bp, Artificial Sequence
  Synthetic
aatactctaatttgtaccgaggaagatatgcaacaactccaaaacttgggaattcgaaaacttcgaaaagaaaaa

SEQ ID NO: 175548 - DNA, 75 bp, Artificial Sequence
  Synthetic
taaaaaacttgttaaaaactgaacttgatgttttgcaagcacatgtacagacagaatgccagaaattaaatacaa

SEQ ID NO: 175549 - DNA, 75 bp, Artificial Sequence
  Synthetic
agatttactaaatgtagtgtaaaatatcaaaaaaatttaaaattaatttattctgaagtttaacattttttaaat

SEQ ID NO: 175550 - DNA, 75 bp, Artificial Sequence
  Synthetic
acagaatgccagaaattaaatacaaatttaagagacattgaaaatgcattgcttttagaaaatcaaaaaataatt

SEQ ID NO: 175551 - DNA, 75 bp, Artificial Sequence
  Synthetic
tggaagagtctctccaggctaaaactgtcacgcaagtcacaattacacaaattgatcctgctattcatttcacgg

SEQ ID NO: 175552 - DNA, 75 bp, Artificial Sequence
  Synthetic
tgtcacgcaagtcacaattacacaaattgatcctgctattcatttcacggaaaatttccgacctgagatgataaa

SEQ ID NO: 175553 - DNA, 75 bp, Artificial Sequence
  Synthetic
tggagctatacgtttggagcttggttttacaaattaaagcgagctttctttaccgattctaaattaaaaagaatg

SEQ ID NO: 175554 - DNA, 75 bp, Artificial Sequence
  Synthetic
tttacaaattaaagcgagctttctttaccgattctaaattaaaaagaatgctaaagttaacatatgttgattctc

SEQ ID NO: 175555 - DNA, 75 bp, Artificial Sequence
  Synthetic
tatttcaattaatgcattggaacaaattactatttatcctatgcatgataatttagtgtccgatttagaagctgg

SEQ ID NO: 175556 - DNA, 75 bp, Artificial Sequence
  Synthetic
attactatttatcctatgcatgataatttagtgtccgatttagaagctggtttgtgtctactgactgcttttttt

SEQ ID NO: 175557 - DNA, 75 bp, Artificial Sequence
  Synthetic
ccgaaaatattaaattcgtggatgtcattcaaaatttgtctcaaatttttagatatctaaacaccgaaattttag

SEQ ID NO: 175558 - DNA, 75 bp, Artificial Sequence
  Synthetic
cattcaaaatttgtctcaaatttttagatatctaaacaccgaaattttagctacgaaaaacgcgtcaccacagga

SEQ ID NO: 175559 - DNA, 75 bp, Artificial Sequence
  Synthetic
gacaaaatgaaatattttattccgttgtgtaaagggaggcattatgcaataaatacattcagtaatcatatctta

SEQ ID NO: 175560 - DNA, 75 bp, Artificial Sequence
  Synthetic
tgtgtaaagggaggcattatgcaataaatacattcagtaatcatatcttaattaaaatttttataaaaaaaggtg

SEQ ID NO: 175561 - DNA, 75 bp, Artificial Sequence
  Synthetic
aatgtcgaaaggacatgttgtaatagaatcgaagttgacaggcacgttaacagatgataaattattatattggac

SEQ ID NO: 175562 - DNA, 75 bp, Artificial Sequence
  Synthetic
aattgttgccatagaatccttatatttactttggcaaattctaaactcagaaagcatttttggaaagagaactgg

SEQ ID NO: 175563 - DNA, 75 bp, Artificial Sequence
  Synthetic
ccccatgtaaatgcagaagatgttacagaaacagaattttcttctgtcaatatccagaattttgagtttctcatg

SEQ ID NO: 175564 - DNA, 75 bp, Artificial Sequence
  Synthetic
cactttatttccggggttaatcagcatcgtagttaacgaaagtgttcgtttaggctgggatcataatcaaaatac

SEQ ID NO: 175565 - DNA, 75 bp, Artificial Sequence
  Synthetic
agccaaacaaaagacaatccgtttgttgaatatatccgttcacaattagaagaaacggcagaacttgcggtactc

SEQ ID NO: 175566 - DNA, 75 bp, Artificial Sequence
  Synthetic
agaaacggcagaacttgcggtactcgagaaacatgataaaattctttttcattttgaaaatggcttgaatgtgac

SEQ ID NO: 175567 - DNA, 75 bp, Artificial Sequence
  Synthetic
aggttgttcgctatggcatcctcattatttaatgtggctgatttgtatgatttcttgtattttttggtattaggt

SEQ ID NO: 175568 - DNA, 75 bp, Artificial Sequence
  Synthetic
tatttaatgtggctgatttgtatgatttcttgtattttttggtattaggttttattccagtagcaactgttattt

SEQ ID NO: 175569 - DNA, 75 bp, Artificial Sequence
  Synthetic
tgttttggatataaatacgcgtggaagtgttaaggagcttcattttaaaaaagacacctttcttaagcttttgta

SEQ ID NO: 175570 - DNA, 75 bp, Artificial Sequence
  Synthetic
agtgttaaggagcttcattttaaaaaagacacctttcttaagcttttgtaaacatgaaaaatatcgatttaacaa

SEQ ID NO: 175571 - DNA, 75 bp, Artificial Sequence
  Synthetic
tgaatatctgttttttttctcgtttttctttctttgtctgctggtaataatagtggtgaaatttaataacagcac

SEQ ID NO: 175572 - DNA, 75 bp, Artificial Sequence
  Synthetic
ttctttctttgtctgctggtaataatagtggtgaaatttaataacagcaccgttggtcgagaatacacatttagt

SEQ ID NO: 175573 - DNA, 75 bp, Artificial Sequence
  Synthetic
ttttattgttaccggttaaaatgggaatgttaaccaaaatgtgggatgtatccaccgattactgtataatcttaa

SEQ ID NO: 175574 - DNA, 75 bp, Artificial Sequence
  Synthetic
aatgttaaccaaaatgtgggatgtatccaccgattactgtataatcttaatgtttctgagtgatttttcatttat

SEQ ID NO: 175575 - DNA, 75 bp, Artificial Sequence
  Synthetic
ttggcactggaacgtatcaacaatttttctttttctgagattaaggtaaacgaaactaaaattctaaaacaaatg

SEQ ID NO: 175576 - DNA, 75 bp, Artificial Sequence
  Synthetic
tttctttttctgagattaaggtaaacgaaactaaaattctaaaacaaatgtctttcccaattatctgggttactt

SEQ ID NO: 175577 - DNA, 75 bp, Artificial Sequence
  Synthetic
aatgaaatataagaaatcgcaaatgaatttagaagatgattactgtttattggctattgaacgctctgcagaaga

SEQ ID NO: 175578 - DNA, 75 bp, Artificial Sequence
  Synthetic
aatttagaagatgattactgtttattggctattgaacgctctgcagaagaagcctggatcttattaatgtatacc

SEQ ID NO: 175579 - DNA, 75 bp, Artificial Sequence
  Synthetic
ttttctacgtgttaaataagcgatttctctttttagaaagagacctgaactcaattgttacacatttaagcttgt

SEQ ID NO: 175580 - DNA, 75 bp, Artificial Sequence
  Synthetic
tctctttttagaaagagacctgaactcaattgttacacatttaagcttgtttttattttttggtgctttatgctt

SEQ ID NO: 175581 - DNA, 75 bp, Artificial Sequence
  Synthetic
ttcaactgcaatcgattgttttacggtctgcatgaattgctcattgtttgtttagagctaaaaattttttatgtt

SEQ ID NO: 175582 - DNA, 75 bp, Artificial Sequence
  Synthetic
gtctgcatgaattgctcattgtttgtttagagctaaaaattttttatgttcccactatgacatatataataagct

SEQ ID NO: 175583 - DNA, 75 bp, Artificial Sequence
  Synthetic
agcttttttttgtaaatgttttaaaccttgtttcttgatgccttcgttaagaaaattgcaacaacctacaaaatc

SEQ ID NO: 175584 - DNA, 75 bp, Artificial Sequence
  Synthetic
ccttgtttcttgatgccttcgttaagaaaattgcaacaacctacaaaatctacacagttttaaaattgtagaggt

SEQ ID NO: 175585 - DNA, 75 bp, Artificial Sequence
  Synthetic
tacactctgttacttttgcttctttctccactatgccacaaaaaactttgaaatcattctgaataaaagtaaata

SEQ ID NO: 175586 - DNA, 75 bp, Artificial Sequence
  Synthetic
ctccactatgccacaaaaaactttgaaatcattctgaataaaagtaaataatccattcctgtgttctggtttctg

SEQ ID NO: 175587 - DNA, 75 bp, Artificial Sequence
  Synthetic
ttgatcttgtcaaaaaaaattaaataaccaaaccacagatgcttacaaatttttcggataaaaggttcatatact

SEQ ID NO: 175588 - DNA, 75 bp, Artificial Sequence
  Synthetic
aaccaaaccacagatgcttacaaatttttcggataaaaggttcatatacttcttgcccccagaacttgttgaaat

SEQ ID NO: 175589 - DNA, 75 bp, Artificial Sequence
  Synthetic
attgtagatggcaccaatagaaaacattatattcccatcgtgaataatttcagctggaattgtaattgaaagacc

SEQ ID NO: 175590 - DNA, 75 bp, Artificial Sequence
  Synthetic
attatattcccatcgtgaataatttcagctggaattgtaattgaaagaccaaattcatccaaaaagaaactttct

SEQ ID NO: 175591 - DNA, 75 bp, Artificial Sequence
  Synthetic
gatgtaattttttcgagagctgagctgcattttcttcactgaagatatgtttaaggatttctgatccagatcttt

SEQ ID NO: 175592 - DNA, 75 bp, Artificial Sequence
  Synthetic
tgcattttcttcactgaagatatgtttaaggatttctgatccagatctttgtttaatcatgcaaaagatcttaaa

SEQ ID NO: 175593 - DNA, 75 bp, Artificial Sequence
  Synthetic
ttcagaaccactaaatcactcactccgatattgtgcaaagtctctctcaacagtaagatttggatgccgtgagaa

SEQ ID NO: 175594 - DNA, 75 bp, Artificial Sequence
  Synthetic
cagtaagatttggatgccgtgagaaaacattagggtacacacattctggatgatcaaaatctcttcttgttttag

SEQ ID NO: 175595 - DNA, 75 bp, Artificial Sequence
  Synthetic
aatttcttagtgatatgtaatattaaattggaggttgagttgttcgagattatgtattgacctacttgtgtcatc

SEQ ID NO: 175596 - DNA, 75 bp, Artificial Sequence
  Synthetic
aattggaggttgagttgttcgagattatgtattgacctacttgtgtcatcgtaataatggaaactgtgctagtgg

SEQ ID NO: 175597 - DNA, 75 bp, Artificial Sequence
  Synthetic
taatgatataaatgataacttttatctgccaaggaggacgatacaagaagaaatcaattccggaaatggtttgaa

SEQ ID NO: 175598 - DNA, 75 bp, Artificial Sequence
  Synthetic
cttctttaagtgtttacagcacggtttgtttcgttgcccgtgttcaatcaaaggaattccttacaataattaaga

SEQ ID NO: 175599 - DNA, 75 bp, Artificial Sequence
  Synthetic
aaccaacacggaagaaaaaactctgccaccagatcccgaaatagagtgtttaaattcaattttcccaggtttgtc

SEQ ID NO: 175600 - DNA, 75 bp, Artificial Sequence
  Synthetic
ccaccagatcccgaaatagagtgtttaaattcaattttcccaggtttgtcattatcgaacagggttggtggcaat

SEQ ID NO: 175601 - DNA, 75 bp, Artificial Sequence
  Synthetic
tctctatctgtggcgttggtcgtcgacctggaacaatagctatttttggacgaaatttaaattggattctggata

SEQ ID NO: 175602 - DNA, 75 bp, Artificial Sequence
  Synthetic
acctggaacaatagctatttttggacgaaatttaaattggattctggatagattttcttctattacagaagcgga

SEQ ID NO: 175603 - DNA, 75 bp, Artificial Sequence
  Synthetic
caaagctgtgttcagttttttgccgaggaacaatttaaagtggatttatatgatctgctagcggatagtttagac

SEQ ID NO: 175604 - DNA, 75 bp, Artificial Sequence
  Synthetic
aggaacaatttaaagtggatttatatgatctgctagcggatagtttagacacttcgtacataaaagtacgttttc

SEQ ID NO: 175605 - DNA, 75 bp, Artificial Sequence
  Synthetic
tagtggaatttcaaaatctacttatattaaagcgagtgaaaatttaacggctaacaaccatactattaacgtgaa

SEQ ID NO: 175606 - DNA, 75 bp, Artificial Sequence
  Synthetic
attaaagcgagtgaaaatttaacggctaacaaccatactattaacgtgaattcaaaagtcacaaaggagacagaa

SEQ ID NO: 175607 - DNA, 75 bp, Artificial Sequence
  Synthetic
attgcgcagtccatgcaccagatttgataagtacgatttgctcgacaacgcacacaacgcatcacgacctagtca

SEQ ID NO: 175608 - DNA, 75 bp, Artificial Sequence
  Synthetic
gataagtacgatttgctcgacaacgcacacaacgcatcacgacctagtcagaatgaatggctcagctactggcaa

SEQ ID NO: 175609 - DNA, 75 bp, Artificial Sequence
  Synthetic
ttttccgaatgtgtttttttaccgaaagatacattttgctccttactgaatgctacagctggggcccaaaataaa

SEQ ID NO: 175610 - DNA, 75 bp, Artificial Sequence
  Synthetic
tgctacagctggggcccaaaataaaaacgtaacgccagctgctccgatatttaaaactgatgaatatataactcc

SEQ ID NO: 175611 - DNA, 75 bp, Artificial Sequence
  Synthetic
gattatggaaatagaatgaattatcacataccacctccatattggtatccctctatgcctggatttaattataaa

SEQ ID NO: 175612 - DNA, 75 bp, Artificial Sequence
  Synthetic
acataccacctccatattggtatccctctatgcctggatttaattataaatcttatcgtggttcccaaaaacggt

SEQ ID NO: 175613 - DNA, 75 bp, Artificial Sequence
  Synthetic
aatgagctttccaggagatcctgactatacgacaaagaaaaagaagcggtatagagaagatgacgatcgtgaact

SEQ ID NO: 175614 - DNA, 75 bp, Artificial Sequence
  Synthetic
tatacgacaaagaaaaagaagcggtatagagaagatgacgatcgtgaactcactaaagacaaaaatgatattaaa

SEQ ID NO: 175615 - DNA, 75 bp, Artificial Sequence
  Synthetic
tgcgtcatgaaatttcagcgctaaagtatattcggtctcagtctcctcagagacagcattgtacagcggtagata

SEQ ID NO: 175616 - DNA, 75 bp, Artificial Sequence
  Synthetic
gtatattcggtctcagtctcctcagagacagcattgtacagcggtagatacaatgccaacgattgaagaaaaaaa

SEQ ID NO: 175617 - DNA, 75 bp, Artificial Sequence
  Synthetic
gtaaatgcctcgctaactccaggtcaagacaggaatcaaaatttgatgcaaagtgatcaatctttattgagtttg

SEQ ID NO: 175618 - DNA, 75 bp, Artificial Sequence
  Synthetic
aagtgatcaatctttattgagtttgaacaaaaaattgtttgtagaagctttgaataaaatggacaattgaataca

SEQ ID NO: 175619 - DNA, 75 bp, Artificial Sequence
  Synthetic
cactgggacaaggaaccgtttgcagcccaatgttgccttctaaaacagttaatgtgtgtggtaaggcagtgattg

SEQ ID NO: 175620 - DNA, 75 bp, Artificial Sequence
  Synthetic
cccaatgttgccttctaaaacagttaatgtgtgtggtaaggcagtgattggtagaaatgtgcgaaggttgtctgt

SEQ ID NO: 175621 - DNA, 75 bp, Artificial Sequence
  Synthetic
aggtgttccttagctatgtttaaatgaagagaatttagattaatagatacgttagttgcagctgtgatatttggt

SEQ ID NO: 175622 - DNA, 75 bp, Artificial Sequence
  Synthetic
gaagagaatttagattaatagatacgttagttgcagctgtgatatttggtactgtagatagtacaggactatcag

SEQ ID NO: 175623 - DNA, 75 bp, Artificial Sequence
  Synthetic
gacacttatttgattattttgattggaaatcaaaattctgcttgtctctgtccagccaaaatctatatttgattg

SEQ ID NO: 175624 - DNA, 75 bp, Artificial Sequence
  Synthetic
gaaatcaaaattctgcttgtctctgtccagccaaaatctatatttgattgatcgtgtgttactatttgactgggt

SEQ ID NO: 175625 - DNA, 75 bp, Artificial Sequence
  Synthetic
gagaataatcaatacggcagttttttttgtaggctctcatggttacttgaagatgagttctctctttccaagtga

SEQ ID NO: 175626 - DNA, 75 bp, Artificial Sequence
  Synthetic
tttgtaggctctcatggttacttgaagatgagttctctctttccaagtgaaagtgtttaatgaaatcccgtttat

SEQ ID NO: 175627 - DNA, 75 bp, Artificial Sequence
  Synthetic
aatttctgtttagaatcaaaaaatgttggaaatgtacatgagaaggggtcagtggtattcgaattaatgtttttt

SEQ ID NO: 175628 - DNA, 75 bp, Artificial Sequence
  Synthetic
ttggaaatgtacatgagaaggggtcagtggtattcgaattaatgttttttgtagaacctacggttatgcatgtgc

SEQ ID NO: 175629 - DNA, 75 bp, Artificial Sequence
  Synthetic
atttctttccatcacaatgtgaggaatggtttggataaaatttacttggaaaaagatgtcgctaggaaaattatc

SEQ ID NO: 175630 - DNA, 75 bp, Artificial Sequence
  Synthetic
atggtttggataaaatttacttggaaaaagatgtcgctaggaaaattatcaggatttaaaagataattgttttca

SEQ ID NO: 175631 - DNA, 75 bp, Artificial Sequence
  Synthetic
tttcatgcagcattatttgcttaaaataaacatttctgctggatataaattccacttttgcactgttaaaaattt

SEQ ID NO: 175632 - DNA, 75 bp, Artificial Sequence
  Synthetic
ataaacatttctgctggatataaattccacttttgcactgttaaaaatttgatctggtggagttgtttgtaaatc

SEQ ID NO: 175633 - DNA, 75 bp, Artificial Sequence
  Synthetic
taatgcgttggttcttcgtgttgtaattctgtccagcgtattctcttaatatgggctcttaatttagtttgagat

SEQ ID NO: 175634 - DNA, 75 bp, Artificial Sequence
  Synthetic
attctgtccagcgtattctcttaatatgggctcttaatttagtttgagatccataaagaataaattgagcacggc

SEQ ID NO: 175635 - DNA, 75 bp, Artificial Sequence
  Synthetic
ctccatgcgctcaactatttggacaggaagtgataccaaattaatgctaggaagaaaaaaggcaaaaagattaat

SEQ ID NO: 175636 - DNA, 75 bp, Artificial Sequence
  Synthetic
ggaagtgataccaaattaatgctaggaagaaaaaaggcaaaaagattaataattaaaggaaattgttttaaatct

SEQ ID NO: 175637 - DNA, 75 bp, Artificial Sequence
  Synthetic
cagccaaggttacattgccacaatctcttagatcgatatacgtaaagtaggctgctgtaaagcttccttcatctc

SEQ ID NO: 175638 - DNA, 75 bp, Artificial Sequence
  Synthetic
tcttagatcgatatacgtaaagtaggctgctgtaaagcttccttcatctctgcacatacacacaaatgttgattg

SEQ ID NO: 175639 - DNA, 75 bp, Artificial Sequence
  Synthetic
cttaagcatcttatttcacgaggttttaaaaggattggtgctgtcaattttagttgtagaaaatatgaagaccag

SEQ ID NO: 175640 - DNA, 75 bp, Artificial Sequence
  Synthetic
ttaaaaggattggtgctgtcaattttagttgtagaaaatatgaagaccagaccacataacaggattccattctta

SEQ ID NO: 175641 - DNA, 75 bp, Artificial Sequence
  Synthetic
tacttaaatagttgatattacaattgcatacgtttgaagcggggtgttatgttcatagagttatgtctaatgttt

SEQ ID NO: 175642 - DNA, 75 bp, Artificial Sequence
  Synthetic
gcatacgtttgaagcggggtgttatgttcatagagttatgtctaatgttttctgtctcttgtatttgttcgtagg

SEQ ID NO: 175643 - DNA, 75 bp, Artificial Sequence
  Synthetic
caaaattgggagagagtctgaaaaaaaatcgttccctaaaaagttaattcgaaatgaattgaaagcggcttcaac

SEQ ID NO: 175644 - DNA, 75 bp, Artificial Sequence
  Synthetic
aaatcgttccctaaaaagttaattcgaaatgaattgaaagcggcttcaacttttgatttgcaatctgcgtgtgct

SEQ ID NO: 175645 - DNA, 75 bp, Artificial Sequence
  Synthetic
gttctctactgataaagtagacatgaccaattatatcatgctccgttacaaatgtctcatttcggcagtacacgt

SEQ ID NO: 175646 - DNA, 75 bp, Artificial Sequence
  Synthetic
accaattatatcatgctccgttacaaatgtctcatttcggcagtacacgtaaattctaaaagtctcacgcggttg

SEQ ID NO: 175647 - DNA, 75 bp, Artificial Sequence
  Synthetic
ttagatttctttggaatgaatagccctacagcagcaggattctcaaaggttcctcgtaaattgatttgtgtgatg

SEQ ID NO: 175648 - DNA, 75 bp, Artificial Sequence
  Synthetic
cagggaaataaatttccattgttttgaattcttcagaaatattgaaatacggcatgcaaatgttaagtgcaactg

SEQ ID NO: 175649 - DNA, 75 bp, Artificial Sequence
  Synthetic
taagcgtaaagaacactcatccacacagaaacgtgaattcattactttaagataccgtagaaagacaaataacac

SEQ ID NO: 175650 - DNA, 75 bp, Artificial Sequence
  Synthetic
cagaaacgtgaattcattactttaagataccgtagaaagacaaataacaccggtgatcgatattcaatcttgtac

SEQ ID NO: 175651 - DNA, 75 bp, Artificial Sequence
  Synthetic
accctaaccctaaccctaaccctaaccctaaccctaaccctaaccctaagtctaaccctaaccctaagtctaacc

SEQ ID NO: 175652 - DNA, 75 bp, Artificial Sequence
  Synthetic
tttccacgttgcagattggcgttgcgctcgcgaaaaaaacattccaatatttgcagtatgttgtattgaaggtga

SEQ ID NO: 175653 - DNA, 75 bp, Artificial Sequence
  Synthetic
ttgatcattggagtttttcagtaaaggttgaaattcattcttttcccaagtaattttagttactgtggcatttac

SEQ ID NO: 175654 - DNA, 75 bp, Artificial Sequence
  Synthetic
ggttgaaattcattcttttcccaagtaattttagttactgtggcatttacgatcagatcaccatttttcacagaa

SEQ ID NO: 175655 - DNA, 75 bp, Artificial Sequence
  Synthetic
taattttagttactgtggcatttacgatcagatcaccatttttcacagaatataaaattataggagttgttccta

SEQ ID NO: 175656 - DNA, 75 bp, Artificial Sequence
  Synthetic
accctaaccctaaccctaagtctaaccctaaccctaaccctaaccctaaccctaaccctaagtctaaccctaacc

SEQ ID NO: 175657 - DNA, 75 bp, Artificial Sequence
  Synthetic
atgaaatctaagaggatccatattttctttaaagtaacaattatcttgtatcagcagggatgacgtaatgttaaa

SEQ ID NO: 175658 - DNA, 75 bp, Artificial Sequence
  Synthetic
tctttaaagtaacaattatcttgtatcagcagggatgacgtaatgttaaaaattggcagggcaaaaatattgaca

SEQ ID NO: 175659 - DNA, 75 bp, Artificial Sequence
  Synthetic
aaacattaattttgatcacttttttgttttttagaacgtgacccaccaaagttacgcattctgcattgttttcag

SEQ ID NO: 175660 - DNA, 75 bp, Artificial Sequence
  Synthetic
gttttttagaacgtgacccaccaaagttacgcattctgcattgttttcagttccatcggtaattagcaacagtac

SEQ ID NO: 175661 - DNA, 75 bp, Artificial Sequence
  Synthetic
gtaatctctgcgggagaaaaattgagttctggctgcaaatcattaaaatccacagtaaactgaattaattgcgat

SEQ ID NO: 175662 - DNA, 75 bp, Artificial Sequence
  Synthetic
gttctggctgcaaatcattaaaatccacagtaaactgaattaattgcgataattcagagactggtgttgaattca

SEQ ID NO: 175663 - DNA, 75 bp, Artificial Sequence
  Synthetic
caaatgattcttaattgttttcacacgttttatagaatctagcaagcttctaaggctttttaaaaccgcaatcta

SEQ ID NO: 175664 - DNA, 75 bp, Artificial Sequence
  Synthetic
tatttgatccagattgcaatttttttttacgagcgctccaaccttttcttaagattaaatctggcaaatcagaga

SEQ ID NO: 175665 - DNA, 75 bp, Artificial Sequence
  Synthetic
cagtgcgtcagattctggatcttctgagttaagctcaatttcagcagcaaaactatccgtatagttgggatcaaa

SEQ ID NO: 175666 - DNA, 75 bp, Artificial Sequence
  Synthetic
gagttaagctcaatttcagcagcaaaactatccgtatagttgggatcaaatttagttcgtaaaatatgcgttggg

SEQ ID NO: 175667 - DNA, 75 bp, Artificial Sequence
  Synthetic
catttgtagtcactctctgcgatctatcactagtcacttttgtggtaaaacttgtagtgggagaccagaaagaag

SEQ ID NO: 175668 - DNA, 75 bp, Artificial Sequence
  Synthetic
atcactagtcacttttgtggtaaaacttgtagtgggagaccagaaagaagcaatagactgcactttggaatttgg

SEQ ID NO: 175669 - DNA, 75 bp, Artificial Sequence
  Synthetic
ttaaaattataaaaagtgcctttaaaatgaagttttttagtttcgccctcatcgaaaagcatcgtgtcttggaaa

SEQ ID NO: 175670 - DNA, 75 bp, Artificial Sequence
  Synthetic
aatgaagttttttagtttcgccctcatcgaaaagcatcgtgtcttggaaaaaaacgtcaatttttcttttatcgc

SEQ ID NO: 175671 - DNA, 75 bp, Artificial Sequence
  Synthetic
cacagttagagaaatttcgtttgggattatttcgttgacaaaaccaagtttaagcatgcaatcgtttggaaccat

SEQ ID NO: 175672 - DNA, 75 bp, Artificial Sequence
  Synthetic
attatttcgttgacaaaaccaagtttaagcatgcaatcgtttggaaccatatacgtgttatttttagttacctct

SEQ ID NO: 175673 - DNA, 75 bp, Artificial Sequence
  Synthetic
gtagaggaggagaaaagatcattttaagtacggaaactgttgggtctgaaatagaaaacactttgcacgttggaa

SEQ ID NO: 175674 - DNA, 75 bp, Artificial Sequence
  Synthetic
aagtacggaaactgttgggtctgaaatagaaaacactttgcacgttggaaaatctgaaccactccgaacatcgtg

SEQ ID NO: 175675 - DNA, 75 bp, Artificial Sequence
  Synthetic
ttaacagagcagactgtacatagagttgttaatggatggccaggtgttctttcaatcgaacgttgataagtactt

SEQ ID NO: 175676 - DNA, 75 bp, Artificial Sequence
  Synthetic
ttgttaatggatggccaggtgttctttcaatcgaacgttgataagtacttagtttccattcaatgttaaacatcg

SEQ ID NO: 175677 - DNA, 75 bp, Artificial Sequence
  Synthetic
tggggtttgcgtcactatgaccttttcgtttttgaatcttatcagactaggaaaaactcccatctgctcttgttc

SEQ ID NO: 175678 - DNA, 75 bp, Artificial Sequence
  Synthetic
tcgtttttgaatcttatcagactaggaaaaactcccatctgctcttgttctttaacatcatggtttgggatgatg

SEQ ID NO: 175679 - DNA, 75 bp, Artificial Sequence
  Synthetic
acggaaatccaaaaaacaagacttttgatggataaatgtgtctattcagattttttaaatgtagttttagttgtt

SEQ ID NO: 175680 - DNA, 75 bp, Artificial Sequence
  Synthetic
tgatggataaatgtgtctattcagattttttaaatgtagttttagttgttgttcttccattaaaggacgagcaga

SEQ ID NO: 175681 - DNA, 75 bp, Artificial Sequence
  Synthetic
tttatttcagcgctcaaaagtaaaactggttcagtttttgattggacatactcgtcaaataataatgtaacatta

SEQ ID NO: 175682 - DNA, 75 bp, Artificial Sequence
  Synthetic
ctggttcagtttttgattggacatactcgtcaaataataatgtaacattatctttaccctggaattcttctttgt

SEQ ID NO: 175683 - DNA, 75 bp, Artificial Sequence
  Synthetic
taagatatcagaagttgcgagagacatggagctgaaataaaatctgttacaacagacactatttcaaagaacttt

SEQ ID NO: 175684 - DNA, 75 bp, Artificial Sequence
  Synthetic
aagcctaaccccaaccctaaccctaaccctagctctaagtctaaccccaaccctaaccctaaccctagctctaag

SEQ ID NO: 175685 - DNA, 75 bp, Artificial Sequence
  Synthetic
atggagctgaaataaaatctgttacaacagacactatttcaaagaactttttattcactctttaaatatacaagt

SEQ ID NO: 175686 - DNA, 75 bp, Artificial Sequence
  Synthetic
tcagccacaatgaaaaacgttttttcttgtgtaagggaattgatttggttaatcatggtgaaaaccgttttaatt

SEQ ID NO: 175687 - DNA, 75 bp, Artificial Sequence
  Synthetic
cttgtgtaagggaattgatttggttaatcatggtgaaaaccgttttaattttctgtaattctgttttaatttcag

SEQ ID NO: 175688 - DNA, 75 bp, Artificial Sequence
  Synthetic
agaaaaatttttttttgctaggagttcttgacatttaatcaataacatagactgatcttctaaagataatctttc

SEQ ID NO: 175689 - DNA, 75 bp, Artificial Sequence
  Synthetic
tcttgacatttaatcaataacatagactgatcttctaaagataatctttctatatatgtttgaactatatcagga

SEQ ID NO: 175690 - DNA, 75 bp, Artificial Sequence
  Synthetic
aaatgcatgctgttttcatggaaaacgtggacttacaatcattgataacatctggtaacttaattgttacatctc

SEQ ID NO: 175691 - DNA, 75 bp, Artificial Sequence
  Synthetic
cgtggacttacaatcattgataacatctggtaacttaattgttacatctctgtactgcaaagtgcgcagctcatc

SEQ ID NO: 175692 - DNA, 75 bp, Artificial Sequence
  Synthetic
tttctatgtatggaaaggaggctgatgcaaagcattcgcacgtttatttccgttgcgacgtctgtagggatcagt

SEQ ID NO: 175693 - DNA, 75 bp, Artificial Sequence
  Synthetic
cgttgcgacgtctgtagggatcagtaatggcagaatcagctcccagttaggtaagacaagtaattgttgcgaagg

SEQ ID NO: 175694 - DNA, 75 bp, Artificial Sequence
  Synthetic
aattgatctcccttttccagaggaaatggtccggtatttttgatttcatactggtgtccaatttttggacgtatt

SEQ ID NO: 175695 - DNA, 75 bp, Artificial Sequence
  Synthetic
atggtccggtatttttgatttcatactggtgtccaatttttggacgtattaatattaattggtttccttctactt

SEQ ID NO: 175696 - DNA, 75 bp, Artificial Sequence
  Synthetic
ttttaagatatcccttatttgaatataatcggtggttgtagataagaccgtgtaaagtcctaaatttgtgttgcc

SEQ ID NO: 175697 - DNA, 75 bp, Artificial Sequence
  Synthetic
taatcggtggttgtagataagaccgtgtaaagtcctaaatttgtgttgccaattaaatgacggtgcgacggtatt

SEQ ID NO: 175698 - DNA, 75 bp, Artificial Sequence
  Synthetic
ataaagttccaatgtcagaaagagtaagcttttgatcaaaagtacagtagattgaatccatttctatagcaggga

SEQ ID NO: 175699 - DNA, 75 bp, Artificial Sequence
  Synthetic
aagcttttgatcaaaagtacagtagattgaatccatttctatagcagggactcaataatattttgtaacggaata

SEQ ID NO: 175700 - DNA, 75 bp, Artificial Sequence
  Synthetic
aatgcgtttcacttaactgtgtcattccgttcttagatcgactctctaatagagcttggttagaggagcaatgga

SEQ ID NO: 175701 - DNA, 75 bp, Artificial Sequence
  Synthetic
tccgttcttagatcgactctctaatagagcttggttagaggagcaatggattggaaacgcaatttgtaaaaactg

SEQ ID NO: 175702 - DNA, 75 bp, Artificial Sequence
  Synthetic
gttccttcggaacaagaatactgaatatcagtgtcgctgtccaggcatgttttagtttttatggaataatcactg

SEQ ID NO: 175703 - DNA, 75 bp, Artificial Sequence
  Synthetic
tatcagtgtcgctgtccaggcatgttttagtttttatggaataatcactgataagtttaaacataaacttatttg

SEQ ID NO: 175704 - DNA, 75 bp, Artificial Sequence
  Synthetic
aaagactgcgttaggactgtaactttttggattatatcctaattgatctctgtgatttatattatataagacatc

SEQ ID NO: 175705 - DNA, 75 bp, Artificial Sequence
  Synthetic
tgtgatttatattatataagacatcagataaagatccttcttgagatgcccaaggatttgttgttgccacaaaag

SEQ ID NO: 175706 - DNA, 75 bp, Artificial Sequence
  Synthetic
atacaaagattttctagcttctgactcattatggggatcgacacccatcatacacgaagcccttcctctaggatt

SEQ ID NO: 175707 - DNA, 75 bp, Artificial Sequence
  Synthetic
tcattatggggatcgacacccatcatacacgaagcccttcctctaggatttttaggtgttttatagaaattaata

SEQ ID NO: 175708 - DNA, 75 bp, Artificial Sequence
  Synthetic
cctcgcagattgcttgttggccatgtaaaagtattgattgtgattgcttatttatcttaccgaaagaaaggatgt

SEQ ID NO: 175709 - DNA, 75 bp, Artificial Sequence
  Synthetic
taaaagtattgattgtgattgcttatttatcttaccgaaagaaaggatgtttaaagcatcggtttcggaaggatt

SEQ ID NO: 175710 - DNA, 75 bp, Artificial Sequence
  Synthetic
ctaacccaactatttacagtagggttggtgtatgcgtgcattggaaagaccgaaaatagatcttgcactttactt

SEQ ID NO: 175711 - DNA, 75 bp, Artificial Sequence
  Synthetic
tggtgtatgcgtgcattggaaagaccgaaaatagatcttgcactttacttcccatatcagtttttacccttttca

SEQ ID NO: 175712 - DNA, 75 bp, Artificial Sequence
  Synthetic
aaatcctaatcccatatcaagaaaacttatatgctgcgtaaggttatatgtggttgagatgtcttttacttctgt

SEQ ID NO: 175713 - DNA, 75 bp, Artificial Sequence
  Synthetic
cttatatgctgcgtaaggttatatgtggttgagatgtcttttacttctgtagataccgttgggtcatcaatcatt

SEQ ID NO: 175714 - DNA, 75 bp, Artificial Sequence
  Synthetic
acagtaagcaattaatgtcgaaacaatctgttcttactaaagtcgcagcgaaaccaggatgaattttttgtctgc

SEQ ID NO: 175715 - DNA, 75 bp, Artificial Sequence
  Synthetic
atctgttcttactaaagtcgcagcgaaaccaggatgaattttttgtctgctttgaagaatgatagctattggaga

SEQ ID NO: 175716 - DNA, 75 bp, Artificial Sequence
  Synthetic
gtcatgatacttagcaatgaatttgaacaacaagaagcatagacaaagaacggtgttctttgccaattatggaat

SEQ ID NO: 175717 - DNA, 75 bp, Artificial Sequence
  Synthetic
aacaacaagaagcatagacaaagaacggtgttctttgccaattatggaattcatgagataatgcttgtggtagag

SEQ ID NO: 175718 - DNA, 75 bp, Artificial Sequence
  Synthetic
gtggggaaatatgtttagataggtttgtacttcaatattcattaagccacaaataatagggtctgagaaaaaacg

SEQ ID NO: 175719 - DNA, 75 bp, Artificial Sequence
  Synthetic
tgtacttcaatattcattaagccacaaataatagggtctgagaaaaaacgattaaaaggaattggcttgaaatac

SEQ ID NO: 175720 - DNA, 75 bp, Artificial Sequence
  Synthetic
ctaaacacagtccattatataaaacatgttgtagagatttgaagtttgaagaactaccatgtctttgagaaggat

SEQ ID NO: 175721 - DNA, 75 bp, Artificial Sequence
  Synthetic
atgttgtagagatttgaagtttgaagaactaccatgtctttgagaaggatctaaagaagattcaatttccaaaat

SEQ ID NO: 175722 - DNA, 75 bp, Artificial Sequence
  Synthetic
atagatttaaagagttgtttaccaatgcaagataaatctgtgagtgcatgtgagggaccaacagcttcagttatc

SEQ ID NO: 175723 - DNA, 75 bp, Artificial Sequence
  Synthetic
tgcaagataaatctgtgagtgcatgtgagggaccaacagcttcagttatcaattcaatcaatacattgttcgtaa

SEQ ID NO: 175724 - DNA, 75 bp, Artificial Sequence
  Synthetic
aactcgagcgatctcgacgcataatgccacgacaacaataagaataccgcgccttcccagttacctgctggaagc

SEQ ID NO: 175725 - DNA, 75 bp, Artificial Sequence
  Synthetic
aggtaatataaagggttctgtgtagaagaaatctagaatgaaagatttcacatcaaaacctgcaccacacatctt

SEQ ID NO: 175726 - DNA, 75 bp, Artificial Sequence
  Synthetic
catcaaaacctgcaccacacatcttgttatttgtcagtgctggtagaaagcagaaataaaaaattttgcttaaaa

SEQ ID NO: 175727 - DNA, 75 bp, Artificial Sequence
  Synthetic
gttatttgtcagtgctggtagaaagcagaaataaaaaattttgcttaaaacaattgtttcaaaagatggtctatc

SEQ ID NO: 175728 - DNA, 75 bp, Artificial Sequence
  Synthetic
tccaataaattcattctattcaggtcagatacttcatagtttcttaatttcactgtattttgggtaaggggagtg

SEQ ID NO: 175729 - DNA, 75 bp, Artificial Sequence
  Synthetic
cagatacttcatagtttcttaatttcactgtattttgggtaaggggagtgttaccagctgtgattattgcatttg

SEQ ID NO: 175730 - DNA, 75 bp, Artificial Sequence
  Synthetic
aaatggagggaatagacgattatcaaacaaagcgttcacaaatccaaccaatggttccccacacagttgctcatt

SEQ ID NO: 175731 - DNA, 75 bp, Artificial Sequence
  Synthetic
aacaaagcgttcacaaatccaaccaatggttccccacacagttgctcattaaagtttgaaatagaaattgtcctt

SEQ ID NO: 175732 - DNA, 75 bp, Artificial Sequence
  Synthetic
tatttttgtaatgtgtataagcaattcctggaattgactcatctccaagataggttgtaattaaccaaatcattt

SEQ ID NO: 175733 - DNA, 75 bp, Artificial Sequence
  Synthetic
tcctggaattgactcatctccaagataggttgtaattaaccaaatcatttcaaaattattgcaaaacaataatat

SEQ ID NO: 175734 - DNA, 75 bp, Artificial Sequence
  Synthetic
atacattggctgacaacgtctttaagaatctgaaacgctgtcttattaccatggatgagaagttctatgatatat

SEQ ID NO: 175735 - DNA, 75 bp, Artificial Sequence
  Synthetic
gaatctgaaacgctgtcttattaccatggatgagaagttctatgatatatgctagttcgggataagctgtgttag

SEQ ID NO: 175736 - DNA, 75 bp, Artificial Sequence
  Synthetic
ggtgtagtcataatttaaattatttgtcttggcttgttcgatcatttgattggtcctagcttcatgaaaagatga

SEQ ID NO: 175737 - DNA, 75 bp, Artificial Sequence
  Synthetic
cctaacaaaattcttggtgaacacaaaacatcagttgatctgtttttttgaatataggtgaaatcaaaaaatgga

SEQ ID NO: 175738 - DNA, 75 bp, Artificial Sequence
  Synthetic
aaacatcagttgatctgtttttttgaatataggtgaaatcaaaaaatggatgtagctctgtctttaaagtaaaat

SEQ ID NO: 175739 - DNA, 75 bp, Artificial Sequence
  Synthetic
aatataggtgaaatcaaaaaatggatgtagctctgtctttaaagtaaaattttcagatttatagaaatcttctgt

SEQ ID NO: 175740 - DNA, 75 bp, Artificial Sequence
  Synthetic
gtcgtcttaggtatttcttttttcatttcatataagttgtataaatttgataaaaaggtgcttggaggttctcta

SEQ ID NO: 175741 - DNA, 75 bp, Artificial Sequence
  Synthetic
taaaagattcccccgtaggttttgcagcatttttaaaaattcgctctgagacactacaatcaaaaataattggat

SEQ ID NO: 175742 - DNA, 75 bp, Artificial Sequence
  Synthetic
atagtctattctctgcaaaagcttatccttattatagaaatagatagatgtgggtagattgttttccattgtatc

SEQ ID NO: 175743 - DNA, 75 bp, Artificial Sequence
  Synthetic
tccttattatagaaatagatagatgtgggtagattgttttccattgtatcatttagtttaagcctgctatccata

SEQ ID NO: 175744 - DNA, 75 bp, Artificial Sequence
  Synthetic
tgtataagcccattgggaaaaaaaacgtcaattccaatttttgttccaaaggatcctcaatgttagtgtttttat

SEQ ID NO: 175745 - DNA, 75 bp, Artificial Sequence
  Synthetic
cgtcaattccaatttttgttccaaaggatcctcaatgttagtgtttttatacactttctttaaatgatctaagac

SEQ ID NO: 175746 - DNA, 75 bp, Artificial Sequence
  Synthetic
atgtttgtctttagatcagcatgttgagtttggttttcaaagatttcagattttttgttttggtcttgtgtttca

SEQ ID NO: 175747 - DNA, 75 bp, Artificial Sequence
  Synthetic
gagtttggttttcaaagatttcagattttttgttttggtcttgtgtttcagtcgcaacgtttttggtataatttg

SEQ ID NO: 175748 - DNA, 75 bp, Artificial Sequence
  Synthetic
tgctattgcagtaacagcattttctttccccataacaaatgtgccataagaaacaggtacagacattgtcatttg

SEQ ID NO: 175749 - DNA, 75 bp, Artificial Sequence
  Synthetic
tgaaatgtgttgcgatagggcgttggacaaaatctgaatcgtattaggagttccgagtaaaacgccgttaatagg

SEQ ID NO: 175750 - DNA, 75 bp, Artificial Sequence
  Synthetic
ttggtgttatttaaaatgctttcagtggttgaatcaaccatttcacacagatatctgtatataaagcttacatta

SEQ ID NO: 175751 - DNA, 75 bp, Artificial Sequence
  Synthetic
tggttgaatcaaccatttcacacagatatctgtatataaagcttacattagaagttctgttcaaaaaaaataagg

SEQ ID NO: 175752 - DNA, 75 bp, Artificial Sequence
  Synthetic
ttgaaacatattgcttcgctgtactttagaaagaatctgtttactgttgactttgttttctaacatggttttcag

SEQ ID NO: 175753 - DNA, 75 bp, Artificial Sequence
  Synthetic
ttagaaagaatctgtttactgttgactttgttttctaacatggttttcaggataaactgtggcggtgccttctta

SEQ ID NO: 175754 - DNA, 75 bp, Artificial Sequence
  Synthetic
atagagcgggagaggcctggcctttgtgtgcacactaccaatctcctagatagaacaaaattaaaaagattaaaa

SEQ ID NO: 175755 - DNA, 75 bp, Artificial Sequence
  Synthetic
ttaaccctcgttgtaacgaatcagcagaattcttcagcgatcgtaacaccgtatgaatcgcattgatgttgagca

SEQ ID NO: 175756 - DNA, 75 bp, Artificial Sequence
  Synthetic
agaattcttcagcgatcgtaacaccgtatgaatcgcattgatgttgagcatttgatctaaaattgtgtttttaaa

SEQ ID NO: 175757 - DNA, 75 bp, Artificial Sequence
  Synthetic
gcagcacttaattcaaacgatatattgataggatgcttttctgaatacttggtaaccagtacggttgtttcttta

SEQ ID NO: 175758 - DNA, 75 bp, Artificial Sequence
  Synthetic
tgataggatgcttttctgaatacttggtaaccagtacggttgtttctttaggcgcagttacgtcgtttcctgtag

SEQ ID NO: 175759 - DNA, 75 bp, Artificial Sequence
  Synthetic
cagaatttttcccagtgacattttgtctaggtcgttgaaacggataacatttgcagcaaccgctatggacgtatg

SEQ ID NO: 175760 - DNA, 75 bp, Artificial Sequence
  Synthetic
tctaggtcgttgaaacggataacatttgcagcaaccgctatggacgtatgaaaaaaatctatccattcagtccga

SEQ ID NO: 175761 - DNA, 75 bp, Artificial Sequence
  Synthetic
cgaaacttatgttataacgatcagagtcgtcaccgtaatacaatcttaagttttcaaaaagttgttcagcagttt

SEQ ID NO: 175762 - DNA, 75 bp, Artificial Sequence
  Synthetic
gtcgtcaccgtaatacaatcttaagttttcaaaaagttgttcagcagtttgtgttctgatatcatcaaacacgtt

SEQ ID NO: 175763 - DNA, 75 bp, Artificial Sequence
  Synthetic
atttcagctgtgcgccaattttccatggttagtaataatgatagactcaatatctgaagaaactttaatagtaaa

SEQ ID NO: 175764 - DNA, 75 bp, Artificial Sequence
  Synthetic
tggttagtaataatgatagactcaatatctgaagaaactttaatagtaaagagctacaccgttaatcactgtgct

SEQ ID NO: 175765 - DNA, 75 bp, Artificial Sequence
  Synthetic
cctatgatttaaccgcagaagtggccaaaaatgaagacgtgcgattagcgcgacaagttcaaatttcattagaga

SEQ ID NO: 175766 - DNA, 75 bp, Artificial Sequence
  Synthetic
caaaaatgaagacgtgcgattagcgcgacaagttcaaatttcattagagaaaatagatgaagttatagaatcaat

SEQ ID NO: 175767 - DNA, 75 bp, Artificial Sequence
  Synthetic
gaaaatgtaaaagatcaggcaaagtttgctttgtgtcgtttactgcttggtcctgtgagtattccgtgctactgc

SEQ ID NO: 175768 - DNA, 75 bp, Artificial Sequence
  Synthetic
ttgctttgtgtcgtttactgcttggtcctgtgagtattccgtgctactgcgaagaatgggatgtcaatttttatc

SEQ ID NO: 175769 - DNA, 75 bp, Artificial Sequence
  Synthetic
aggcccggttctatatatctataaaaatgcttctcaatgctgtgaaagcacatatcgtttttctatcatgactaa

SEQ ID NO: 175770 - DNA, 75 bp, Artificial Sequence
  Synthetic
aatgcttctcaatgctgtgaaagcacatatcgtttttctatcatgactaattatcattccactcacatctttaga

SEQ ID NO: 175771 - DNA, 75 bp, Artificial Sequence
  Synthetic
atagtcatctatcaaatatcttatgtacttgttcgaacgtaacaggtgataaatatactgcaacaatctttccaa

SEQ ID NO: 175772 - DNA, 75 bp, Artificial Sequence
  Synthetic
tacttgttcgaacgtaacaggtgataaatatactgcaacaatctttccaaacaatgcttcaatttacttggaata

SEQ ID NO: 175773 - DNA, 75 bp, Artificial Sequence
  Synthetic
tgcaagcatctgtctatcattgatattgagcaatgtactaatgaattgatagcttttcttggtccaaagacttct

SEQ ID NO: 175774 - DNA, 75 bp, Artificial Sequence
  Synthetic
caaaggattataattcactataaactgttattcgggtttcgatctaaaccaatgaatttcactgtttctttgtta

SEQ ID NO: 175775 - DNA, 75 bp, Artificial Sequence
  Synthetic
aaaaactctactattccgttagtaagcacaacagtacaacagcagattttttcaatgtcattaccgctaaatttg

SEQ ID NO: 175776 - DNA, 75 bp, Artificial Sequence
  Synthetic
gcacaacagtacaacagcagattttttcaatgtcattaccgctaaatttgcagaggacaaatattttgttctacg

SEQ ID NO: 175777 - DNA, 75 bp, Artificial Sequence
  Synthetic
actcctggtattcaaagtttttgttcattgaaattcaaactccagaccttatatctaaatttgaaaattatgaaa

SEQ ID NO: 175778 - DNA, 75 bp, Artificial Sequence
  Synthetic
cattgaaattcaaactccagaccttatatctaaatttgaaaattatgaaaaacacaaaattatccatttctaata

SEQ ID NO: 175779 - DNA, 75 bp, Artificial Sequence
  Synthetic
tacactggatgaaaagcaacttgtttggagaaatttattgttaatttactatggttacaatttaaaagacaatgt

SEQ ID NO: 175780 - DNA, 75 bp, Artificial Sequence
  Synthetic
aaaacaaacacaagaagagagtttgttgtcgatgcattacatacgaatattggaaagattgtctctaaaaagttt

SEQ ID NO: 175781 - DNA, 75 bp, Artificial Sequence
  Synthetic
tttgaaattccgagttaccaagagaaaactttgcagtttattccaggtggaaatgatttcgcagaaatcacatcg

SEQ ID NO: 175782 - DNA, 75 bp, Artificial Sequence
  Synthetic
aaactttgcagtttattccaggtggaaatgatttcgcagaaatcacatcggtcacgcatggagaaacaactgtga

SEQ ID NO: 175783 - DNA, 75 bp, Artificial Sequence
  Synthetic
gaatgtgaaagctgctctttcaggagaaatacactgtgttttacatcgtattcctaaaagcatgacacatagttt

SEQ ID NO: 175784 - DNA, 75 bp, Artificial Sequence
  Synthetic
gaaatacactgtgttttacatcgtattcctaaaagcatgacacatagttttgtgatgtataagcgcacttttaaa

SEQ ID NO: 175785 - DNA, 75 bp, Artificial Sequence
  Synthetic
tcatttcaaatgatgatttcaccacaagttcattgaacattaacattcgaggtccctactgtgattttttatatg

SEQ ID NO: 175786 - DNA, 75 bp, Artificial Sequence
  Synthetic
aagttcattgaacattaacattcgaggtccctactgtgattttttatatgcattgggtgtgtatagattacatgt

SEQ ID NO: 175787 - DNA, 75 bp, Artificial Sequence
  Synthetic
gcttttgtttgtaacagtaataattcgatggatttgcatgggctagaaaatcaaggaattgtgcgaaagcgtaaa

SEQ ID NO: 175788 - DNA, 75 bp, Artificial Sequence
  Synthetic
cgatggatttgcatgggctagaaaatcaaggaattgtgcgaaagcgtaaaaagaaggtttactggataactaatt

SEQ ID NO: 175789 - DNA, 75 bp, Artificial Sequence
  Synthetic
aaaagttaatgttggttggtttaaagcgggaacaggcataatacccaaggtttctggaacagacttaaaaaatgt

SEQ ID NO: 175790 - DNA, 75 bp, Artificial Sequence
  Synthetic
gcgggaacaggcataatacccaaggtttctggaacagacttaaaaaatgttcttttgaaagaactcataagcatc

SEQ ID NO: 175791 - DNA, 75 bp, Artificial Sequence
  Synthetic
atatggatttacatgctttgttaactcttttagagaaacgaaatatgcatcaggttccatttcttattaaacaat

SEQ ID NO: 175792 - DNA, 75 bp, Artificial Sequence
  Synthetic
tcttttagagaaacgaaatatgcatcaggttccatttcttattaaacaattttttatgtttcttcgtttaggtct

SEQ ID NO: 175793 - DNA, 75 bp, Artificial Sequence
  Synthetic
gaaagaaaggtccatcacattatgctattcttaatacaaaagggttttttcgatttttcgaagaattcagttgcc

SEQ ID NO: 175794 - DNA, 75 bp, Artificial Sequence
  Synthetic
tattcttaatacaaaagggttttttcgatttttcgaagaattcagttgccaacagtaaaattaaacatgcatgcg

SEQ ID NO: 175795 - DNA, 75 bp, Artificial Sequence
  Synthetic
caatgtgccaaaaattctgtctaagcagaaaaaaatgaaactggatcatttgggtcgaaacgcaaacgctttaac

SEQ ID NO: 175796 - DNA, 75 bp, Artificial Sequence
  Synthetic
cagaaaaaaatgaaactggatcatttgggtcgaaacgcaaacgctttaaccgttttacgttttattgtagaaaat

SEQ ID NO: 175797 - DNA, 75 bp, Artificial Sequence
  Synthetic
ttcgcaaacttttgaagtatttagctactacatcttttaatgctcatgttcaaactgaaagtaatcgtttactca

SEQ ID NO: 175798 - DNA, 75 bp, Artificial Sequence
  Synthetic
tactacatcttttaatgctcatgttcaaactgaaagtaatcgtttactcaacttgatgcacaatgacagcaaaac

SEQ ID NO: 175799 - DNA, 75 bp, Artificial Sequence
  Synthetic
tacactttacgttaacaatgagacagcaactgtgcatgaaatcttgaattccgatttaagtgaactgttacagtt

SEQ ID NO: 175800 - DNA, 75 bp, Artificial Sequence
  Synthetic
gcaactgtgcatgaaatcttgaattccgatttaagtgaactgttacagttaaagacggaatttgtatctatgaca

SEQ ID NO: 175801 - DNA, 75 bp, Artificial Sequence
  Synthetic
gtataaatcagaatatttccagcatcacgatatattggcatgcttacagtgaagtaatttatgctttaactggaa

SEQ ID NO: 175802 - DNA, 75 bp, Artificial Sequence
  Synthetic
cacgatatattggcatgcttacagtgaagtaatttatgctttaactggaattatacactgtgaaaagatttctat

SEQ ID NO: 175803 - DNA, 75 bp, Artificial Sequence
  Synthetic
aataacattttgtatgaaaagcccaaactgtttttacttcgagaaaatttagcaccaactgaattaaggtggaaa

SEQ ID NO: 175804 - DNA, 75 bp, Artificial Sequence
  Synthetic
aactgtttttacttcgagaaaatttagcaccaactgaattaaggtggaaatctttaataaaaacaaagactataa

SEQ ID NO: 175805 - DNA, 75 bp, Artificial Sequence
  Synthetic
tgagatttttcccaaaatagcacacaagccgtcaatccttttagagattgaagaagcaccccgatttaaggaaat

SEQ ID NO: 175806 - DNA, 75 bp, Artificial Sequence
  Synthetic
aagccgtcaatccttttagagattgaagaagcaccccgatttaaggaaatggtgtcatgtatttggaagttagtt

SEQ ID NO: 175807 - DNA, 75 bp, Artificial Sequence
  Synthetic
aaagcgagaatgatattgtcaaaacatgcaaaaagcttgctgaatcacaaagatatactttgacaaatggtactg

SEQ ID NO: 175808 - DNA, 75 bp, Artificial Sequence
  Synthetic
atgcaaaaagcttgctgaatcacaaagatatactttgacaaatggtactgtgttgcaaaattttatattagtcca

SEQ ID NO: 175809 - DNA, 75 bp, Artificial Sequence
  Synthetic
gttaatttttgggaggaaatgaatggaaaattacgtcaacggccagaactaatgtcaaaatcattcactggccat

SEQ ID NO: 175810 - DNA, 75 bp, Artificial Sequence
  Synthetic
gaaaattacgtcaacggccagaactaatgtcaaaatcattcactggccatgaggaatgtttctataattgttatt

SEQ ID NO: 175811 - DNA, 75 bp, Artificial Sequence
  Synthetic
ttatagttacaaaactttattgccagaaattgtagacaataccagatccattcatgtagtagtgaaagcatatta

SEQ ID NO: 175812 - DNA, 75 bp, Artificial Sequence
  Synthetic
gaaattgtagacaataccagatccattcatgtagtagtgaaagcatattattcagagcacatagatgtttcttac

SEQ ID NO: 175813 - DNA, 75 bp, Artificial Sequence
  Synthetic
tgatgaacttattctctcagtatttaaattttacagatttattgccatatataaataagcacattaaaattgatg

SEQ ID NO: 175814 - DNA, 75 bp, Artificial Sequence
  Synthetic
aaattttacagatttattgccatatataaataagcacattaaaattgatgtttcagcatctaagcaagatatgat

SEQ ID NO: 175815 - DNA, 75 bp, Artificial Sequence
  Synthetic
ctttagatttctttaaatgaagtttgtttaccttcatggcacatataaatagccattataatagaaattaaaagg

SEQ ID NO: 175816 - DNA, 75 bp, Artificial Sequence
  Synthetic
gtttaccttcatggcacatataaatagccattataatagaaattaaaaggtcatctgaacaggtttgttttttgg

SEQ ID NO: 175817 - DNA, 75 bp, Artificial Sequence
  Synthetic
attaatttggtgaagattcttaatttgttcaatcacatactctattgggtcatacgttatttttattgtaaagga

SEQ ID NO: 175818 - DNA, 75 bp, Artificial Sequence
  Synthetic
tgttcaatcacatactctattgggtcatacgttatttttattgtaaaggaaattagttcttgtgacgctttaatg

SEQ ID NO: 175819 - DNA, 75 bp, Artificial Sequence
  Synthetic
aatattctacggctaatctcttttctctccccagtaaataaaatggttgtgcaatttggctctgatctaaagtat

SEQ ID NO: 175820 - DNA, 75 bp, Artificial Sequence
  Synthetic
tctccccagtaaataaaatggttgtgcaatttggctctgatctaaagtatggaaaaatgttatgtgcttatatct

SEQ ID NO: 175821 - DNA, 75 bp, Artificial Sequence
  Synthetic
atgcatgcaattttcaccgccgatgattgattggaattaccctcgataataattttgagctcagtaaaaaaaggg

SEQ ID NO: 175822 - DNA, 75 bp, Artificial Sequence
  Synthetic
attgattggaattaccctcgataataattttgagctcagtaaaaaaagggtgtaattctaaaacagctagtatca

SEQ ID NO: 175823 - DNA, 75 bp, Artificial Sequence
  Synthetic
agcatcggagtttgatagtaaactttctagaaaatagtgctccattccatatattatatattgatcaccatatgt

SEQ ID NO: 175824 - DNA, 75 bp, Artificial Sequence
  Synthetic
tctagaaaatagtgctccattccatatattatatattgatcaccatatgttccgatcgctgctacccctgttcca

SEQ ID NO: 175825 - DNA, 75 bp, Artificial Sequence
  Synthetic
ctggatcaatatatatgtagagctctttgcctaagaatggaattatctgtttgctaattgtgctatatcggaaaa

SEQ ID NO: 175826 - DNA, 75 bp, Artificial Sequence
  Synthetic
tttgcctaagaatggaattatctgtttgctaattgtgctatatcggaaaaggtcgaattcaatgagtccttgctc

SEQ ID NO: 175827 - DNA, 75 bp, Artificial Sequence
  Synthetic
ttgcagagagaaccacccattatttcgtgtttgaaagcaccttctaaaaataggtcggcggtttttttgacgtca

SEQ ID NO: 175828 - DNA, 75 bp, Artificial Sequence
  Synthetic
cgtgtttgaaagcaccttctaaaaataggtcggcggtttttttgacgtcagcgttgatgctgataaatttcggtt

SEQ ID NO: 175829 - DNA, 75 bp, Artificial Sequence
  Synthetic
tgttgcatttcctctgtcatttagtatgtgcacatgatcttcacaaacataagatactacagttaacatttcaaa

SEQ ID NO: 175830 - DNA, 75 bp, Artificial Sequence
  Synthetic
atgtgcacatgatcttcacaaacataagatactacagttaacatttcaaagggggaattgcttagttttgtcaag

SEQ ID NO: 175831 - DNA, 75 bp, Artificial Sequence
  Synthetic
ttgtggatgatataaaaataattttagtcgaagattgtggcagaaatccaagaattgtgctaaacgcgtcttttt

SEQ ID NO: 175832 - DNA, 75 bp, Artificial Sequence
  Synthetic
agtcgaagattgtggcagaaatccaagaattgtgctaaacgcgtcttttttgataaaatggctttcatcaacgat

SEQ ID NO: 175833 - DNA, 75 bp, Artificial Sequence
  Synthetic
atactctgagaagaaaatgaacggagttttaaacgatataaagactgagtttttatgtaatactaaaacagatct

SEQ ID NO: 175834 - DNA, 75 bp, Artificial Sequence
  Synthetic
gttttaaacgatataaagactgagtttttatgtaatactaaaacagatcttttaacgttgatacaaaaaatttgt

SEQ ID NO: 175835 - DNA, 75 bp, Artificial Sequence
  Synthetic
cggtagaatcttttcctaaaaaaaccgagttggttgcggtgatgtatgatacgctcgcggtggaaatttttaacg

SEQ ID NO: 175836 - DNA, 75 bp, Artificial Sequence
  Synthetic
cgagttggttgcggtgatgtatgatacgctcgcggtggaaatttttaacgatcttttaaaatataatgaacaaaa

SEQ ID NO: 175837 - DNA, 75 bp, Artificial Sequence
  Synthetic
gtcaatcacagttgcttgtgaaggagaatgttcgcaaatgtacaatttgcataatcctctgacatttgaaatggg

SEQ ID NO: 175838 - DNA, 75 bp, Artificial Sequence
  Synthetic
gaatgttcgcaaatgtacaatttgcataatcctctgacatttgaaatgggtttgggaaacatctttatatgtgtt

SEQ ID NO: 175839 - DNA, 75 bp, Artificial Sequence
  Synthetic
atatgctagaagactgcaacctgataaatactcatgaaggatgcgtgtgttcaaaaaccgggcttttttataacg

SEQ ID NO: 175840 - DNA, 75 bp, Artificial Sequence
  Synthetic
aaatactcatgaaggatgcgtgtgttcaaaaaccgggcttttttataacggatggatgccagcctattcacatac

SEQ ID NO: 175841 - DNA, 75 bp, Artificial Sequence
  Synthetic
aatatggagaccgttaatgtagttgtagtgctgttatcatacgtttacagttttttaatacaaaataaagccagg

SEQ ID NO: 175842 - DNA, 75 bp, Artificial Sequence
  Synthetic
tagtgctgttatcatacgtttacagttttttaatacaaaataaagccaggtattcaaacattattcgcgacatta

SEQ ID NO: 175843 - DNA, 75 bp, Artificial Sequence
  Synthetic
agtagaaaatgctgttttttgtacatttaataaggtgtttaagaactccaccttgaataagttacctcttactac

SEQ ID NO: 175844 - DNA, 75 bp, Artificial Sequence
  Synthetic
tttaataaggtgtttaagaactccaccttgaataagttacctcttactactgtcagtcaactttttgttcagtta

SEQ ID NO: 175845 - DNA, 75 bp, Artificial Sequence
  Synthetic
ctatttacgataataatgtcattcgtgttagtagaagaaagagggaggataacatacttaaaaaaatgaggattg

SEQ ID NO: 175846 - DNA, 75 bp, Artificial Sequence
  Synthetic
tgttagtagaagaaagagggaggataacatacttaaaaaaatgaggattgaatatggaaatgcacttgctctgtg

SEQ ID NO: 175847 - DNA, 75 bp, Artificial Sequence
  Synthetic
taatattttaccggtacatttatgtattttactggatgatgttatacataaagagaaagtaaaagctatagaagg

SEQ ID NO: 175848 - DNA, 75 bp, Artificial Sequence
  Synthetic
attttactggatgatgttatacataaagagaaagtaaaagctatagaagggatcttttttcagtgtgtatttttt

SEQ ID NO: 175849 - DNA, 75 bp, Artificial Sequence
  Synthetic
ggacaaaaataaagtttacttatgtgttacatgatcttgtaatttctcaaatctttaagaatgcctgtattaaag

SEQ ID NO: 175850 - DNA, 75 bp, Artificial Sequence
  Synthetic
gttacatgatcttgtaatttctcaaatctttaagaatgcctgtattaaagaagtaatacatggggcattaattct

SEQ ID NO: 175851 - DNA, 75 bp, Artificial Sequence
  Synthetic
ctacattttgatacagatattttaattctaaaaattatttacccacattttttgcacgatgatattgtcataaaa

SEQ ID NO: 175852 - DNA, 75 bp, Artificial Sequence
  Synthetic
ttctaaaaattatttacccacattttttgcacgatgatattgtcataaaattatcggaaattttgtctggagcac

SEQ ID NO: 175853 - DNA, 75 bp, Artificial Sequence
  Synthetic
aaaacaagaggtggaaaaaccttttttccatattcctgcaaaacttggagatctcacaaaggaagaccctatttc

SEQ ID NO: 175854 - DNA, 75 bp, Artificial Sequence
  Synthetic
ttccatattcctgcaaaacttggagatctcacaaaggaagaccctatttcgttcaaccatcatggtccgttagaa

SEQ ID NO: 175855 - DNA, 75 bp, Artificial Sequence
  Synthetic
aacaatctgcgaacgttaggcatagtcatccaatatcaaggcctgaaaaagcgaacgtaacctttctaagtgatt

SEQ ID NO: 175856 - DNA, 75 bp, Artificial Sequence
  Synthetic
tcatccaatatcaaggcctgaaaaagcgaacgtaacctttctaagtgattcgtggtacagccaaaatctaaagtg

SEQ ID NO: 175857 - DNA, 75 bp, Artificial Sequence
  Synthetic
agacatgtgcttgtcattttttggtatgagttatcgaaagggatacaaatgcaaattaaaaatattcaaattcct

SEQ ID NO: 175858 - DNA, 75 bp, Artificial Sequence
  Synthetic
atgagttatcgaaagggatacaaatgcaaattaaaaatattcaaattcctcctgaaaatttgttttcatcaataa

SEQ ID NO: 175859 - DNA, 75 bp, Artificial Sequence
  Synthetic
atatctagacgagattgctgaaagaacttttcgatgtattactactaacatggaaattcagaatagacatcttcc

SEQ ID NO: 175860 - DNA, 75 bp, Artificial Sequence
  Synthetic
tggaaattcagaatagacatcttccacaaaaatttaatagtcattttcaaatagagtttaattgtactcacttaa

SEQ ID NO: 175861 - DNA, 75 bp, Artificial Sequence
  Synthetic
tttttggattttgtctttagatagaaatagttgtgttttaaaagctatggccagtcattttcttcataaaaaaaa

SEQ ID NO: 175862 - DNA, 75 bp, Artificial Sequence
  Synthetic
ccagtcattttcttcataaaaaaaaagggagaagctcacttagttcgaatgaattttgggctgacttaattgatt

SEQ ID NO: 175863 - DNA, 75 bp, Artificial Sequence
  Synthetic
agagaaagtacggtggcaattaaattctgaaacgagcttatactccacattcagaaaaaatcaaaacatttcatg

SEQ ID NO: 175864 - DNA, 75 bp, Artificial Sequence
  Synthetic
tctgaaacgagcttatactccacattcagaaaaaatcaaaacatttcatgggaattacagcctaattgttatgca

SEQ ID NO: 175865 - DNA, 75 bp, Artificial Sequence
  Synthetic
tgtattgggtattacccggggggttctgcgtgtctggaacttttaaattaaaagagaacgatgaatttttcttcg

SEQ ID NO: 175866 - DNA, 75 bp, Artificial Sequence
  Synthetic
ctgcgtgtctggaacttttaaattaaaagagaacgatgaatttttcttcgattggcaatttgggatgtcttagga

SEQ ID NO: 175867 - DNA, 75 bp, Artificial Sequence
  Synthetic
gttttcggtgtgtaaaaaaaagttgtaccacgaatatcgttgtgtggcaacatcttctcctgttttcgctgttga

SEQ ID NO: 175868 - DNA, 75 bp, Artificial Sequence
  Synthetic
taccacgaatatcgttgtgtggcaacatcttctcctgttttcgctgttgataaatttaaagattgcttgcactgt

SEQ ID NO: 175869 - DNA, 75 bp, Artificial Sequence
  Synthetic
tggattttgtttttagcttggccataaacggaatacatgccggacagtttgcaacaaattccattaaactaaaaa

SEQ ID NO: 175870 - DNA, 75 bp, Artificial Sequence
  Synthetic
aaacggaatacatgccggacagtttgcaacaaattccattaaactaaaaaaaattataataacaaacgatttggt

SEQ ID NO: 175871 - DNA, 75 bp, Artificial Sequence
  Synthetic
ttaacggtaacggatttacatttcattccaaaatacaatagtgaacatgtgctgaatgtgcgacctattacgcca

SEQ ID NO: 175872 - DNA, 75 bp, Artificial Sequence
  Synthetic
ttgttagttatgacgaagctaaacttttaactgttaaaggacctggagaaaataaattaattcctttgggttgtg

SEQ ID NO: 175873 - DNA, 75 bp, Artificial Sequence
  Synthetic
acgttattatgtgtacacttttgtcctggtgtacgatttatatctggcttgctttgaaaaaaacactttgccatc

SEQ ID NO: 175874 - DNA, 75 bp, Artificial Sequence
  Synthetic
ctggtgtacgatttatatctggcttgctttgaaaaaaacactttgccatcattatctaaagtagtttttgatatg

SEQ ID NO: 175875 - DNA, 75 bp, Artificial Sequence
  Synthetic
ttttttgtaaggatcatagtaaacacgtagaacaaactggcaaaaccgttggatgcactgataatcaagaaacat

SEQ ID NO: 175876 - DNA, 75 bp, Artificial Sequence
  Synthetic
cgtagaacaaactggcaaaaccgttggatgcactgataatcaagaaacatgtttttgttacaccccatgcaagaa

SEQ ID NO: 175877 - DNA, 75 bp, Artificial Sequence
  Synthetic
gatctgtcttcattattatgtgatcaagagctcgatttacttgatctaatttaccctgaaaagcccactagtctt

SEQ ID NO: 175878 - DNA, 75 bp, Artificial Sequence
  Synthetic
aagagctcgatttacttgatctaatttaccctgaaaagcccactagtctttcaactgatataaatgcttacgtac

SEQ ID NO: 175879 - DNA, 75 bp, Artificial Sequence
  Synthetic
cgttttaaggaatacaaactggatattaattcgtcttgacccagcaattagcagattaatactcctttcctgtcc

SEQ ID NO: 175880 - DNA, 75 bp, Artificial Sequence
  Synthetic
ttaattcgtcttgacccagcaattagcagattaatactcctttcctgtccagtctgtaaacgcatagtaagtagg

SEQ ID NO: 175881 - DNA, 75 bp, Artificial Sequence
  Synthetic
gtgttgtaacaactagcaaacagtgctgtactttttattgtttcgtgttcgatagtaatcacattatcttgacag

SEQ ID NO: 175882 - DNA, 75 bp, Artificial Sequence
  Synthetic
ctgtactttttattgtttcgtgttcgatagtaatcacattatcttgacaggtgatattcttttgcgggaaaaaac

SEQ ID NO: 175883 - DNA, 75 bp, Artificial Sequence
  Synthetic
cataacaaagtgcgaaacgtgtttttgatgtgcaacataaccaatgctgattccttctaaattctttaataaaaa

SEQ ID NO: 175884 - DNA, 75 bp, Artificial Sequence
  Synthetic
tgatgtgcaacataaccaatgctgattccttctaaattctttaataaaaaacaaataactggtatcatgaaccat

SEQ ID NO: 175885 - DNA, 75 bp, Artificial Sequence
  Synthetic
gaaaaacactagctttctgtttaagtatgtttacgctgctttcgtttataaactctatgtcaaatttatatttta

SEQ ID NO: 175886 - DNA, 75 bp, Artificial Sequence
  Synthetic
tatgtttacgctgctttcgtttataaactctatgtcaaatttatattttaagtaatcaaggacatgattggccag

SEQ ID NO: 175887 - DNA, 75 bp, Artificial Sequence
  Synthetic
aaaaaaattatgtgtataagaatgctcttttgaaatggctctagtttaattctttcctttttattggtgttctca

SEQ ID NO: 175888 - DNA, 75 bp, Artificial Sequence
  Synthetic
aatcttgaataaatttttcgatctgtaaaaacatgggatttctgtaaaaacttgtttgtagctctagatgttttt

SEQ ID NO: 175889 - DNA, 75 bp, Artificial Sequence
  Synthetic
tatgattgcagtaaatttgagctttgacaaagcgcagttcaaggggtcgcatattgcaattttagattttacgtg

SEQ ID NO: 175890 - DNA, 75 bp, Artificial Sequence
  Synthetic
gacaaagcgcagttcaaggggtcgcatattgcaattttagattttacgtgccgttggcgatcacaaaagagatat

SEQ ID NO: 175891 - DNA, 75 bp, Artificial Sequence
  Synthetic
catgtgtaaagccaagttctggagttaatataataaatcgtttttggcaaaatatcgcgctgtttggaaaagttg

SEQ ID NO: 175892 - DNA, 75 bp, Artificial Sequence
  Synthetic
taatataataaatcgtttttggcaaaatatcgcgctgtttggaaaagttgaagaaatctttacgtcctgttcatg

SEQ ID NO: 175893 - DNA, 75 bp, Artificial Sequence
  Synthetic
ttctgaattgcatctatatcgcatgatcgcaacatggacacagatattgctctagctgcaatttataaagaaacg

SEQ ID NO: 175894 - DNA, 75 bp, Artificial Sequence
  Synthetic
atcgcaacatggacacagatattgctctagctgcaatttataaagaaacgactaaattaaatgaaaaggatgcta

SEQ ID NO: 175895 - DNA, 75 bp, Artificial Sequence
  Synthetic
cgcactaactgtgtgtaaagcaaccgctcctaatacacgtctaaaactcgttgaaacaccaactaataacttctt

SEQ ID NO: 175896 - DNA, 75 bp, Artificial Sequence
  Synthetic
gctcctaatacacgtctaaaactcgttgaaacaccaactaataacttcttactagtaacaaatgttgttccatca

SEQ ID NO: 175897 - DNA, 75 bp, Artificial Sequence
  Synthetic
caaatcttaatattgatgcagcgttggaaaaactggcgtcttcctttaatacagcggtacctgtaaaatcatcca

SEQ ID NO: 175898 - DNA, 75 bp, Artificial Sequence
  Synthetic
ggaaaaactggcgtcttcctttaatacagcggtacctgtaaaatcatccaaaaagtatttgttgcaaaatgtgag

SEQ ID NO: 175899 - DNA, 75 bp, Artificial Sequence
  Synthetic
ctaactggatcatatatcatctatacgaaaaaacacatcgaggtggcgtttctgttagataagtctgattttgtt

SEQ ID NO: 175900 - DNA, 75 bp, Artificial Sequence
  Synthetic
cgaaaaaacacatcgaggtggcgtttctgttagataagtctgattttgttcaggatattttacgttatgctgaaa

SEQ ID NO: 175901 - DNA, 75 bp, Artificial Sequence
  Synthetic
tgtacgtgatttagaatgtttgttatggttagctttttgtggtcctatgagttattgtcaggctgataattgttt

SEQ ID NO: 175902 - DNA, 75 bp, Artificial Sequence
  Synthetic
tggttagctttttgtggtcctatgagttattgtcaggctgataattgttttggactaaataaggcggggtataac

SEQ ID NO: 175903 - DNA, 75 bp, Artificial Sequence
  Synthetic
catgcatgtatgaaagaaatatgaaccttagtgtattttttgggttattgcaaatttatgtgttctctttgtata

SEQ ID NO: 175904 - DNA, 75 bp, Artificial Sequence
  Synthetic
ccttagtgtattttttgggttattgcaaatttatgtgttctctttgtatagagattttagtgtcgaaaattcaaa

SEQ ID NO: 175905 - DNA, 75 bp, Artificial Sequence
  Synthetic
attaagttggttctgtcagatttacgggccaaagaaagaatttgtgaggaagagataggaaattttccattggcg

SEQ ID NO: 175906 - DNA, 75 bp, Artificial Sequence
  Synthetic
gggccaaagaaagaatttgtgaggaagagataggaaattttccattggcggctcaaatatgcctgttttgtgcat

SEQ ID NO: 175907 - DNA, 75 bp, Artificial Sequence
  Synthetic
ggaatatgccgcaaacaatctaagtatgagtgtgttcagtccaataatattaaaggactgtacatttatgcaaac

SEQ ID NO: 175908 - DNA, 75 bp, Artificial Sequence
  Synthetic
taaaggactgtacatttatgcaaacaacagttaccataactcaaatcttgccaggttctaaggaagcaataattt

SEQ ID NO: 175909 - DNA, 75 bp, Artificial Sequence
  Synthetic
aacagttaccataactcaaatcttgccaggttctaaggaagcaataatttttccagtttacgatataggcaaatt

SEQ ID NO: 175910 - DNA, 75 bp, Artificial Sequence
  Synthetic
aacggtgtacttttgaaactataatgtcactgcatgaattaataaaacaaactatgtccaaaaatttagaaaaaa

SEQ ID NO: 175911 - DNA, 75 bp, Artificial Sequence
  Synthetic
gtcactgcatgaattaataaaacaaactatgtccaaaaatttagaaaaaaaacattatgagttgttaaaattaaa

SEQ ID NO: 175912 - DNA, 75 bp, Artificial Sequence
  Synthetic
gttcgacagcaaattcacgctctcaatcaaaatcttgtatcagaaaatctcgaacagtcccagataattacttct

SEQ ID NO: 175913 - DNA, 75 bp, Artificial Sequence
  Synthetic
atcaaaatcttgtatcagaaaatctcgaacagtcccagataattacttctttgacaaaaatgttaaaggatcaaa

SEQ ID NO: 175914 - DNA, 75 bp, Artificial Sequence
  Synthetic
aaatgctgctcagctagaatgtgtagatttggatgacattttggatacggcagcggaagtgaaatccgtcaccga

SEQ ID NO: 175915 - DNA, 75 bp, Artificial Sequence
  Synthetic
gatttggatgacattttggatacggcagcggaagtgaaatccgtcaccgacaatataaaagaaactttactggcc

SEQ ID NO: 175916 - DNA, 75 bp, Artificial Sequence
  Synthetic
gcagcttaagacaccccaaaatcaaaaaacacgtccaagaaatatgcttcctaaaaaaaaaggaaaagaacttaa

SEQ ID NO: 175917 - DNA, 75 bp, Artificial Sequence
  Synthetic
aaaacacgtccaagaaatatgcttcctaaaaaaaaaggaaaagaacttaaaaaaaggccttgtaaagtaaaacgt

SEQ ID NO: 175918 - DNA, 75 bp, Artificial Sequence
  Synthetic
gacctaacaaaaaaatacctctggcttcagacgtggataacgaattggaaaaaaaacggggctcgatgatacgaa

SEQ ID NO: 175919 - DNA, 75 bp, Artificial Sequence
  Synthetic
ttcagacgtggataacgaattggaaaaaaaacggggctcgatgatacgaaaacggtctgagacggacttatgtcc

SEQ ID NO: 175920 - DNA, 75 bp, Artificial Sequence
  Synthetic
tgtcatgaatctttgactgtatctccaaagtttgaacgagatggattgagtgcatgcacggaatttgagaatttt

SEQ ID NO: 175921 - DNA, 75 bp, Artificial Sequence
  Synthetic
caaagtttgaacgagatggattgagtgcatgcacggaatttgagaattttatggatacaaggaaaatcgtgttaa

SEQ ID NO: 175922 - DNA, 75 bp, Artificial Sequence
  Synthetic
tttaagtgcacattaccccgttttatgtaatcttggaatttttgagcgtattcattcaccctttttgttttcaat

SEQ ID NO: 175923 - DNA, 75 bp, Artificial Sequence
  Synthetic
tgtaatcttggaatttttgagcgtattcattcaccctttttgttttcaatacacattgatactcagtcattttca

SEQ ID NO: 175924 - DNA, 75 bp, Artificial Sequence
  Synthetic
gttcctgttctcagttttgcgagccagaaaaaaacatggcacggattttaggaagcggatcatatggaatggtat

SEQ ID NO: 175925 - DNA, 75 bp, Artificial Sequence
  Synthetic
agaaaaaaacatggcacggattttaggaagcggatcatatggaatggtatatgatttgaacaatgttgcaattaa

SEQ ID NO: 175926 - DNA, 75 bp, Artificial Sequence
  Synthetic
atttcttcttatgtgtctggagtagttcgtgcaaaagccggagctcaattaacctcacgcgaatgcgtgtttaaa

SEQ ID NO: 175927 - DNA, 75 bp, Artificial Sequence
  Synthetic
ttcgtgcaaaagccggagctcaattaacctcacgcgaatgcgtgtttaaaagtcttttgatatgtaattctgtct

SEQ ID NO: 175928 - DNA, 75 bp, Artificial Sequence
  Synthetic
caaaacttatgatacagatttatataaatttacagactggaaattggaaaacgttgaaaattattactctatttt

SEQ ID NO: 175929 - DNA, 75 bp, Artificial Sequence
  Synthetic
aaatttacagactggaaattggaaaacgttgaaaattattactctattttttgcaaccttgcagaagctgttcgt

SEQ ID NO: 175930 - DNA, 75 bp, Artificial Sequence
  Synthetic
accattgtgatatttcactagcaaatattttgatacaccacaaggaaggtattattttggaggctgtgttagctg

SEQ ID NO: 175931 - DNA, 75 bp, Artificial Sequence
  Synthetic
tattttgatacaccacaaggaaggtattattttggaggctgtgttagctgattacagtttagctgaagtacaccc

SEQ ID NO: 175932 - DNA, 75 bp, Artificial Sequence
  Synthetic
ctaagacaatttgatcataggatccagattgtgcctaaaagttataataaattgtgtgacatgtttaatccaggt

SEQ ID NO: 175933 - DNA, 75 bp, Artificial Sequence
  Synthetic
agattgtgcctaaaagttataataaattgtgtgacatgtttaatccaggtttcagacccatgatagctcacaaaa

SEQ ID NO: 175934 - DNA, 75 bp, Artificial Sequence
  Synthetic
atttgatggtaagggcaatccagtgagacattgtaatctagatctttgtgcactagcgcaagtatttttattatg

SEQ ID NO: 175935 - DNA, 75 bp, Artificial Sequence
  Synthetic
agacattgtaatctagatctttgtgcactagcgcaagtatttttattatgtgtcatcagaatgttggatgaacgc

SEQ ID NO: 175936 - DNA, 75 bp, Artificial Sequence
  Synthetic
atgaaaatcgattgttcacgtactcaaatgaagcttgtactttgaatccaatcaaataccctttagaatataaag

SEQ ID NO: 175937 - DNA, 75 bp, Artificial Sequence
  Synthetic
aaatgaagcttgtactttgaatccaatcaaataccctttagaatataaagatgcttgttgcaaagttttagctga

SEQ ID NO: 175938 - DNA, 75 bp, Artificial Sequence
  Synthetic
ttttatcgtgaggtggtggatatgtttgaaaacttgtatgactttctgcacgcaagtggtgatttaagcgtaaga

SEQ ID NO: 175939 - DNA, 75 bp, Artificial Sequence
  Synthetic
ttgaaaacttgtatgactttctgcacgcaagtggtgatttaagcgtaagagatttactcgaggaaacatatgtaa

SEQ ID NO: 175940 - DNA, 75 bp, Artificial Sequence
  Synthetic
accaatcaggtataggcacgcccaattacaaagacacgaaattggtcaaatacttttaaatgatctgcaacaatt

SEQ ID NO: 175941 - DNA, 75 bp, Artificial Sequence
  Synthetic
ttacaaagacacgaaattggtcaaatacttttaaatgatctgcaacaattgctttccattataactatttcagat

SEQ ID NO: 175942 - DNA, 75 bp, Artificial Sequence
  Synthetic
ttcgggtgtaacatggcaatagattacgcacaaatttcttgtaatttggcttctattatagaagaggactcggtc

SEQ ID NO: 175943 - DNA, 75 bp, Artificial Sequence
  Synthetic
acgcacaaatttcttgtaatttggcttctattatagaagaggactcggtctttttatttctaatagacaaattaa

SEQ ID NO: 175944 - DNA, 75 bp, Artificial Sequence
  Synthetic
aatttcatttaattttatccgtctgtgttatacttattatatcttaataaagtttaattctcgcttcaaagatac

SEQ ID NO: 175945 - DNA, 75 bp, Artificial Sequence
  Synthetic
tgttatacttattatatcttaataaagtttaattctcgcttcaaagataccttcttagccagatcgttcattgat

SEQ ID NO: 175946 - DNA, 75 bp, Artificial Sequence
  Synthetic
ttatcgatgagaatgttgagctatctgatttatatagcaatatttatgtccgcttacaagatgcgagtccaaaag

SEQ ID NO: 175947 - DNA, 75 bp, Artificial Sequence
  Synthetic
tgatttatatagcaatatttatgtccgcttacaagatgcgagtccaaaagttgttaagaatctatttaaaatatt

SEQ ID NO: 175948 - DNA, 75 bp, Artificial Sequence
  Synthetic
acaaatccactctggcacgctatgcgaaaaaattgcatcacggcaactaaaatttatgacatctatatctctaaa

SEQ ID NO: 175949 - DNA, 75 bp, Artificial Sequence
  Synthetic
gaaaaaattgcatcacggcaactaaaatttatgacatctatatctctaaatctttttcgggtatacaggagcatt

SEQ ID NO: 175950 - DNA, 75 bp, Artificial Sequence
  Synthetic
tggaattaaacatgaacgcatcatagaacacctgttaaagacattctttgtgaaaaagccctggatatctaaaac

SEQ ID NO: 175951 - DNA, 75 bp, Artificial Sequence
  Synthetic
gaacacctgttaaagacattctttgtgaaaaagccctggatatctaaaacacttggtttattattagatccttca

SEQ ID NO: 175952 - DNA, 75 bp, Artificial Sequence
  Synthetic
attcttattatggaatctcttttaatgacaacaacctgatagaagtaggggataaagttgttatatttgaattga

SEQ ID NO: 175953 - DNA, 75 bp, Artificial Sequence
  Synthetic
tgacaacaacctgatagaagtaggggataaagttgttatatttgaattgaaatttagatataaatatctgagaga

SEQ ID NO: 175954 - DNA, 75 bp, Artificial Sequence
  Synthetic
ctgttacaaaatccgtcagaaattgctttagctaaattcatcttatcacatccaataccagctatagagtataga

SEQ ID NO: 175955 - DNA, 75 bp, Artificial Sequence
  Synthetic
ctttagctaaattcatcttatcacatccaataccagctatagagtatagagaaaatggaaagatgccctcggcaa

SEQ ID NO: 175956 - DNA, 75 bp, Artificial Sequence
  Synthetic
tctatacgattctggtaaaaaacgtcgtgcttgcttgactcccaaaaatttgacgttcgacattacacgactaat

SEQ ID NO: 175957 - DNA, 75 bp, Artificial Sequence
  Synthetic
cgtgcttgcttgactcccaaaaatttgacgttcgacattacacgactaattcccatgaacgaaaaaaatgtgtca

SEQ ID NO: 175958 - DNA, 75 bp, Artificial Sequence
  Synthetic
aagactgtatattaaacacattggttgcataccaaaaagctatttttactattgatgcttttataaatcctaggc

SEQ ID NO: 175959 - DNA, 75 bp, Artificial Sequence
  Synthetic
tgcataccaaaaagctatttttactattgatgcttttataaatcctaggcatagatattattttcagagtatttt

SEQ ID NO: 175960 - DNA, 75 bp, Artificial Sequence
  Synthetic
tatatacaggatcacgataatccagaaaatattgaaaaagagaatttaccctcggtttatattgtatctgccata

SEQ ID NO: 175961 - DNA, 75 bp, Artificial Sequence
  Synthetic
aaaatattgaaaaagagaatttaccctcggtttatattgtatctgccatatttcgaaaaagagaagacgacgaaa

SEQ ID NO: 175962 - DNA, 75 bp, Artificial Sequence
  Synthetic
cacagaatatttagaagaagaaatccctttaattttattgattactccaattactattgacgctgaatttacttc

SEQ ID NO: 175963 - DNA, 75 bp, Artificial Sequence
  Synthetic
cctttaattttattgattactccaattactattgacgctgaatttacttcacgagtaatcaaagatatatgctgt

SEQ ID NO: 175964 - DNA, 75 bp, Artificial Sequence
  Synthetic
agacaaatttaaaaatatgggctcaaagtgctgtaagacaatacatggcggcatcttcagcaaggccgaagacac

SEQ ID NO: 175965 - DNA, 75 bp, Artificial Sequence
  Synthetic
aagtgctgtaagacaatacatggcggcatcttcagcaaggccgaagacaccttagtagactataaaggaaaatat

SEQ ID NO: 175966 - DNA, 75 bp, Artificial Sequence
  Synthetic
ctttaagtgatactgaatctgaagaagagttgcaactagagaagccacttctaaataaacaagattctagcgttt

SEQ ID NO: 175967 - DNA, 75 bp, Artificial Sequence
  Synthetic
agagttgcaactagagaagccacttctaaataaacaagattctagcgtttcgttaacccagaagaaacttgaaaa

SEQ ID NO: 175968 - DNA, 75 bp, Artificial Sequence
  Synthetic
taaaaaccctttattcatttgcttcttctaatacatctaggtcttccactgttgtaggtaatttcttataattat

SEQ ID NO: 175969 - DNA, 75 bp, Artificial Sequence
  Synthetic
ttctaatacatctaggtcttccactgttgtaggtaatttcttataattatgatgtttccgcataaaaaatctaat

SEQ ID NO: 175970 - DNA, 75 bp, Artificial Sequence
  Synthetic
caaactatggtgatcacagctagattgactatgaatttgacagtccattccgttttaaatagtgaatcatatttt

SEQ ID NO: 175971 - DNA, 75 bp, Artificial Sequence
  Synthetic
tgactatgaatttgacagtccattccgttttaaatagtgaatcatattttagtattgggtaggttaagcctagga

SEQ ID NO: 175972 - DNA, 75 bp, Artificial Sequence
  Synthetic
accaaattgaaccttaacatactgatgtaaaattaattcaatcaccaaagagtatacaaaagacataacaaaaaa

SEQ ID NO: 175973 - DNA, 75 bp, Artificial Sequence
  Synthetic
tgtaaaattaattcaatcaccaaagagtatacaaaagacataacaaaaaaggtgttgatagatgcgaaagccact

SEQ ID NO: 175974 - DNA, 75 bp, Artificial Sequence
  Synthetic
tacctaaacctagacaaatcgtaattgcaaacaccatactggaaaaacccaacattagttctatcatattgatta

SEQ ID NO: 175975 - DNA, 75 bp, Artificial Sequence
  Synthetic
tttgagttttgggtggatccgtttcaatacgaagaaagatctttcagaggattgatactgtgttatcatagtcaa

SEQ ID NO: 175976 - DNA, 75 bp, Artificial Sequence
  Synthetic
aacaggcaatacgtaaaagctgcgagggtgactagtcgaaaagaaagacaggtgacaaagaactgatatgtatcc

SEQ ID NO: 175977 - DNA, 75 bp, Artificial Sequence
  Synthetic
gggtgactagtcgaaaagaaagacaggtgacaaagaactgatatgtatccatagttaaaacaaattggaaacacg

SEQ ID NO: 175978 - DNA, 75 bp, Artificial Sequence
  Synthetic
atcccttgtagattgattgatgttgggagttttttcggaagagaatacttttacgcaacaaactatatagtatac

SEQ ID NO: 175979 - DNA, 75 bp, Artificial Sequence
  Synthetic
ggagttttttcggaagagaatacttttacgcaacaaactatatagtatactaagatgaagaaaaagcagatatcc

SEQ ID NO: 175980 - DNA, 75 bp, Artificial Sequence
  Synthetic
ggataggatttaggtagagttgtggcgttaggctgcggatgtcattccgtatagagaggttgatggctttcatat

SEQ ID NO: 175981 - DNA, 75 bp, Artificial Sequence
  Synthetic
cgttaggctgcggatgtcattccgtatagagaggttgatggctttcatatcattgatttcataatatgcgcatgg

SEQ ID NO: 175982 - DNA, 75 bp, Artificial Sequence
  Synthetic
gccactaaatgcactgtgacgttgacatacgttaaacaagcacagattatacttaagacccaaattctcatatta

SEQ ID NO: 175983 - DNA, 75 bp, Artificial Sequence
  Synthetic
catacgttaaacaagcacagattatacttaagacccaaattctcatattaatcacatctactctgctcaatgcca

SEQ ID NO: 175984 - DNA, 75 bp, Artificial Sequence
  Synthetic
tcagcttcaaaatgatcaattatttttggaatggtttggacaaaatttgttggattgccactttgcacaaaacgt

SEQ ID NO: 175985 - DNA, 75 bp, Artificial Sequence
  Synthetic
ttggaatggtttggacaaaatttgttggattgccactttgcacaaaacgtttcagtgtatttgcaagatgcttca

SEQ ID NO: 175986 - DNA, 75 bp, Artificial Sequence
  Synthetic
aacaaataaaaattataagagctccaatgggttctggcaaaacctctgcattgatagaattcttgaaaactgttt

SEQ ID NO: 175987 - DNA, 75 bp, Artificial Sequence
  Synthetic
aatgggttctggcaaaacctctgcattgatagaattcttgaaaactgtttcatatattgattctgtccttgttat

SEQ ID NO: 175988 - DNA, 75 bp, Artificial Sequence
  Synthetic
gaacttttaaatagattcaagaagaatgatttgaacgatttctatctgtacagcgaaattaaagagcgtcaaatc

SEQ ID NO: 175989 - DNA, 75 bp, Artificial Sequence
  Synthetic
atgatttgaacgatttctatctgtacagcgaaattaaagagcgtcaaatcaacaagaacaaactgataattcaag

SEQ ID NO: 175990 - DNA, 75 bp, Artificial Sequence
  Synthetic
gaattatcatgttttaatactagatgaaataatgtctattataaaacagttctattcaaaaaccatgactaaagt

SEQ ID NO: 175991 - DNA, 75 bp, Artificial Sequence
  Synthetic
gaaataatgtctattataaaacagttctattcaaaaaccatgactaaagtcaaggaagtagatgctaagctttta

SEQ ID NO: 175992 - DNA, 75 bp, Artificial Sequence
  Synthetic
tcgtagctatggatgcaacagtcaatcgttatgtggtggattttttctctctctgtatgccgcattttaagtctg

SEQ ID NO: 175993 - DNA, 75 bp, Artificial Sequence
  Synthetic
tcgttatgtggtggattttttctctctctgtatgccgcattttaagtctgcattgatcataaatacgtttgtaag

SEQ ID NO: 175994 - DNA, 75 bp, Artificial Sequence
  Synthetic
tatttttgtccaacttttatagatgggaatcttgcattttatggaattctaaaacaaaaattaggcttaggaaaa

SEQ ID NO: 175995 - DNA, 75 bp, Artificial Sequence
  Synthetic
ggaatcttgcattttatggaattctaaaacaaaaattaggcttaggaaaaaacatttgcttattttgtagcacag

SEQ ID NO: 175996 - DNA, 75 bp, Artificial Sequence
  Synthetic
attgttaaaaactgatttcccggataaaaaaattttgcttttaacttctaagcagggcaaatgtcattctgtcga

SEQ ID NO: 175997 - DNA, 75 bp, Artificial Sequence
  Synthetic
aaaaaaattttgcttttaacttctaagcagggcaaatgtcattctgtcgagagttggataaactataatattgtt

SEQ ID NO: 175998 - DNA, 75 bp, Artificial Sequence
  Synthetic
ggctcagttttgactttctacatttttcagctatgtttgtttacattcatttggtaaaaggtggccctgatatgg

SEQ ID NO: 175999 - DNA, 75 bp, Artificial Sequence
  Synthetic
ttcagctatgtttgtttacattcatttggtaaaaggtggccctgatatggtttcggtttttcaatcaatgggtag

SEQ ID NO: 176000 - DNA, 75 bp, Artificial Sequence
  Synthetic
atttttatttatttgaatcctgcattaattcaggtgcctctttctgtatcccctatttcgattccacaatgctat

SEQ ID NO: 176001 - DNA, 75 bp, Artificial Sequence
  Synthetic
taattcaggtgcctctttctgtatcccctatttcgattccacaatgctatgattggacactttttgaaaagtcaa

SEQ ID NO: 176002 - DNA, 75 bp, Artificial Sequence
  Synthetic
taataaaaaatgtctcagtgcacaaaactacttgtctaattccatgataaaacaattttttagaattaggcatta

SEQ ID NO: 176003 - DNA, 75 bp, Artificial Sequence
  Synthetic
aactacttgtctaattccatgataaaacaattttttagaattaggcattatattgaaaaaactacgctattaaat

SEQ ID NO: 176004 - DNA, 75 bp, Artificial Sequence
  Synthetic
gtcttttattggatagtaattcaattaaagttcacatcgatggagacgtctttcctatagctaaagaaaaattct

SEQ ID NO: 176005 - DNA, 75 bp, Artificial Sequence
  Synthetic
acgcatttacaaaaatgttggttcaaggttgccatttttttgaaaagaagaaaacagactttgtagaaaatacta

SEQ ID NO: 176006 - DNA, 75 bp, Artificial Sequence
  Synthetic
tacaaatattactgttaacggagaattctatgaacttggaaatttccaagttcataaagattacattgttaattt

SEQ ID NO: 176007 - DNA, 75 bp, Artificial Sequence
  Synthetic
ttctatgaacttggaaatttccaagttcataaagattacattgttaatttaaataatttccagaatttatttttg

SEQ ID NO: 176008 - DNA, 75 bp, Artificial Sequence
  Synthetic
ttgaagagattatgcttactttaaaatctgaaattaggaggtttgtttttataaatgctttgctacaaaaatatg

SEQ ID NO: 176009 - DNA, 75 bp, Artificial Sequence
  Synthetic
atctgaaattaggaggtttgtttttataaatgctttgctacaaaaatatgttgccaccggtatcgatgtggaaaa

SEQ ID NO: 176010 - DNA, 75 bp, Artificial Sequence
  Synthetic
atcaaaacatttactctacctgaaaactatatatgtagcaagttttatttattaagtgatatttcaggcgtacat

SEQ ID NO: 176011 - DNA, 75 bp, Artificial Sequence
  Synthetic
actatatatgtagcaagttttatttattaagtgatatttcaggcgtacatgaatgtggtatgttgatggatgtag

SEQ ID NO: 176012 - DNA, 75 bp, Artificial Sequence
  Synthetic
ggatttaaatttacagtcctgtacagatacgcaaactgacatctcagaagatgctatcttactttgcgctgcaag

SEQ ID NO: 176013 - DNA, 75 bp, Artificial Sequence
  Synthetic
gatacgcaaactgacatctcagaagatgctatcttactttgcgctgcaagaagatcatctgaaatccttaggatt

SEQ ID NO: 176014 - DNA, 75 bp, Artificial Sequence
  Synthetic
tgcaattatttgaaaaatacaacagttatacgttatatttgttcaataggttaaagggaatgcaattaaatacct

SEQ ID NO: 176015 - DNA, 75 bp, Artificial Sequence
  Synthetic
tgtttcaataataaggatgtttttcaaatgtgcctttaatatgaatctggttaagagtaaacccagatatatcgt

SEQ ID NO: 176016 - DNA, 75 bp, Artificial Sequence
  Synthetic
aaatgtgcctttaatatgaatctggttaagagtaaacccagatatatcgttgggaagccatttagaagtctaacg

SEQ ID NO: 176017 - DNA, 75 bp, Artificial Sequence
  Synthetic
ttaagagtaaacccagatatatcgttgggaagccatttagaagtctaacgaaaagggaaatagaaactttacttg

SEQ ID NO: 176018 - DNA, 75 bp, Artificial Sequence
  Synthetic
tctgaaaacctacaaagagttacgtaaggctctgacagaagcttcaaaaaaaagacaaagaaaaaaaatttataa

SEQ ID NO: 176019 - DNA, 75 bp, Artificial Sequence
  Synthetic
aaggctctgacagaagcttcaaaaaaaagacaaagaaaaaaaatttataaattactaggtcacaatataagttct

SEQ ID NO: 176020 - DNA, 75 bp, Artificial Sequence
  Synthetic
tccagcatgcagatgcggggatgtgtttgtcatctgggtgtctattgcgttcataacgattggaaaaataaacaa

SEQ ID NO: 176021 - DNA, 75 bp, Artificial Sequence
  Synthetic
tttgtcatctgggtgtctattgcgttcataacgattggaaaaataaacaatatagagtaccaatttatcaatgcc

SEQ ID NO: 176022 - DNA, 75 bp, Artificial Sequence
  Synthetic
cttgcatacttttttggttattggaaatgagatttctgaaaatctccttgataagatttccatttcaaaagaaaa

SEQ ID NO: 176023 - DNA, 75 bp, Artificial Sequence
  Synthetic
aatgagatttctgaaaatctccttgataagatttccatttcaaaagaaaaaatctttatgtgggatttgaatgaa

SEQ ID NO: 176024 - DNA, 75 bp, Artificial Sequence
  Synthetic
cagagtcaatctgtgaactgatgtttggcaacaaacaaataattcaaaaactatccagaacatttattttcttaa

SEQ ID NO: 176025 - DNA, 75 bp, Artificial Sequence
  Synthetic
tggcaacaaacaaataattcaaaaactatccagaacatttattttcttaacaattattttaaattctaatatgta

SEQ ID NO: 176026 - DNA, 75 bp, Artificial Sequence
  Synthetic
agtaatgcggttttgtacatgccagacttaagaccaatgataataagatgtgttggaaactattcgaaaatatct

SEQ ID NO: 176027 - DNA, 75 bp, Artificial Sequence
  Synthetic
acttaagaccaatgataataagatgtgttggaaactattcgaaaatatcttctgaactattgtcagattcagact

SEQ ID NO: 176028 - DNA, 75 bp, Artificial Sequence
  Synthetic
atttgattatcacgtcacaaacttttgtttctcattaaatgtcaatggtaaaaaagtactgttttctagtacaga

SEQ ID NO: 176029 - DNA, 75 bp, Artificial Sequence
  Synthetic
tgtttctcattaaatgtcaatggtaaaaaagtactgttttctagtacagagtcttcagaaagtattttagaaaaa

SEQ ID NO: 176030 - DNA, 75 bp, Artificial Sequence
  Synthetic
catataaattggcagaagaacaattcttaatggtgacacctaaaaacttttttaccgtcttatttgatgaggaca

SEQ ID NO: 176031 - DNA, 75 bp, Artificial Sequence
  Synthetic
cttaatggtgacacctaaaaacttttttaccgtcttatttgatgaggacatgtgtctacttttgctgcaaacagt

SEQ ID NO: 176032 - DNA, 75 bp, Artificial Sequence
  Synthetic
tttcgaaataagttagttgtgaaacaagttcatgattacattggtccagatttgtggccgcaaggacatgagagg

SEQ ID NO: 176033 - DNA, 75 bp, Artificial Sequence
  Synthetic
tttgtggccgcaaggacatgagagggcagtttattttgtagggtttcctaatatgtggtttttatcgatttacga

SEQ ID NO: 176034 - DNA, 75 bp, Artificial Sequence
  Synthetic
aaaaatatttgcaatagaattttactttactgtggcctgccagatagtctaggaccagatggttgccagagtgtt

SEQ ID NO: 176035 - DNA, 75 bp, Artificial Sequence
  Synthetic
tttactgtggcctgccagatagtctaggaccagatggttgccagagtgttccaagtacgcagtgtgtggatgaat

SEQ ID NO: 176036 - DNA, 75 bp, Artificial Sequence
  Synthetic
attacaatatttgaaatataatagtttggttgttacaatggaaacagtagaaaattctgagaatgtgtattattt

SEQ ID NO: 176037 - DNA, 75 bp, Artificial Sequence
  Synthetic
ttggttgttacaatggaaacagtagaaaattctgagaatgtgtattatttttttggagagcaggatctgtttatt

SEQ ID NO: 176038 - DNA, 75 bp, Artificial Sequence
  Synthetic
ctttgttggaactatatgttcctaaaagttttctcccagattttagcgatgcttatataaaaagtgaaatcttat

SEQ ID NO: 176039 - DNA, 75 bp, Artificial Sequence
  Synthetic
aagttttctcccagattttagcgatgcttatataaaaagtgaaatcttattgaaatttatatctcgacttcacaa

SEQ ID NO: 176040 - DNA, 75 bp, Artificial Sequence
  Synthetic
atcgtaaaaaaaatcacagagtttttgagatgttttttaaacgcgtgtcgattaatggatcttaattggatgttt

SEQ ID NO: 176041 - DNA, 75 bp, Artificial Sequence
  Synthetic
tgagatgttttttaaacgcgtgtcgattaatggatcttaattggatgtttattagaaacatgcatattgtgtatt

SEQ ID NO: 176042 - DNA, 75 bp, Artificial Sequence
  Synthetic
tgtagtacttcctctgttaaaaacgtctgtggaaagttgttggaaaaaaattctcaattcttcaagaactccagt

SEQ ID NO: 176043 - DNA, 75 bp, Artificial Sequence
  Synthetic
tctgtggaaagttgttggaaaaaaattctcaattcttcaagaactccagtagtgaacataaattacatccctggt

SEQ ID NO: 176044 - DNA, 75 bp, Artificial Sequence
  Synthetic
gctttttgacaagcggagacatcaatagtgaagattctcattggactatcacagctagcaagtgtttatataatt

SEQ ID NO: 176045 - DNA, 75 bp, Artificial Sequence
  Synthetic
tagtgaagattctcattggactatcacagctagcaagtgtttatataattgtttaggggcaagtcagattacagt

SEQ ID NO: 176046 - DNA, 75 bp, Artificial Sequence
  Synthetic
ttccagcagatggttagcgtttttctaagtcacagatacgaaaataaatattggatcgaatattttgagcccaac

SEQ ID NO: 176047 - DNA, 75 bp, Artificial Sequence
  Synthetic
taagtcacagatacgaaaataaatattggatcgaatattttgagcccaacaactattttctagagacacacgaag

SEQ ID NO: 176048 - DNA, 75 bp, Artificial Sequence
  Synthetic
agctgtctggacaacagaaaacaaactaataagacaatctgttggttatccattaacggataaaatagattttat

SEQ ID NO: 176049 - DNA, 75 bp, Artificial Sequence
  Synthetic
ctaataagacaatctgttggttatccattaacggataaaatagattttattcattacatccaggttgtgatagaa

SEQ ID NO: 176050 - DNA, 75 bp, Artificial Sequence
  Synthetic
aatatagtcaacaagagtatgcagaaactgttagattaggaagtaagatcatctctgatcatttacatttgttta

SEQ ID NO: 176051 - DNA, 75 bp, Artificial Sequence
  Synthetic
aactgttagattaggaagtaagatcatctctgatcatttacatttgtttaatgtaaactagttttttctatttct

SEQ ID NO: 176052 - DNA, 75 bp, Artificial Sequence
  Synthetic
catcgcatatagcgctttttaaaaaatctattaaatatttagagtcgtcttgcaaacgtctcgtgtttagtgata

SEQ ID NO: 176053 - DNA, 75 bp, Artificial Sequence
  Synthetic
atctattaaatatttagagtcgtcttgcaaacgtctcgtgtttagtgatagagtacatgtgtcgtcattgtcgtg

SEQ ID NO: 176054 - DNA, 75 bp, Artificial Sequence
  Synthetic
tgtatatttgctgtttttgactcataatagagctgaataatgggtggaactttatccagtacgtcttgctgtttg

SEQ ID NO: 176055 - DNA, 75 bp, Artificial Sequence
  Synthetic
aatagagctgaataatgggtggaactttatccagtacgtcttgctgtttgtcatcgtaaaaaatgtatcttaaaa

SEQ ID NO: 176056 - DNA, 75 bp, Artificial Sequence
  Synthetic
ggctagaagtttagagactggcagagttacactgatttttttaataatatctcgtaatttaagtagtgtctgccc

SEQ ID NO: 176057 - DNA, 75 bp, Artificial Sequence
  Synthetic
gttacactgatttttttaataatatctcgtaatttaagtagtgtctgcccttttattggtagattttctagagca

SEQ ID NO: 176058 - DNA, 75 bp, Artificial Sequence
  Synthetic
ccgtgtcttcctttaaaatcaaataaatgattcttcgtttacattgagttttactcagccgaatctcttctagcg

SEQ ID NO: 176059 - DNA, 75 bp, Artificial Sequence
  Synthetic
aatgattcttcgtttacattgagttttactcagccgaatctcttctagcgtatcttcggaatcaagaagaataat

SEQ ID NO: 176060 - DNA, 75 bp, Artificial Sequence
  Synthetic
gttttctcacatatgcttttataggatttgccatttacaattgtgccatcttccaaatgaaaccatacatcatca

SEQ ID NO: 176061 - DNA, 75 bp, Artificial Sequence
  Synthetic
atttgccatttacaattgtgccatcttccaaatgaaaccatacatcatcatttccaaccgaaatatcaattaaag

SEQ ID NO: 176062 - DNA, 75 bp, Artificial Sequence
  Synthetic
ggcgtgtttgtttagttcacagatattccggacgcttgatatattgaatatgtctagagtttcgaatccttttaa

SEQ ID NO: 176063 - DNA, 75 bp, Artificial Sequence
  Synthetic
ttccggacgcttgatatattgaatatgtctagagtttcgaatccttttaagcttgctggcaacgtcatcttgcgg

SEQ ID NO: 176064 - DNA, 75 bp, Artificial Sequence
  Synthetic
gatcctaaatcaggtgtcaaagtcaaatcactttgtttctgagtatgtattaaatgcgaaagctcgttaatctgc

SEQ ID NO: 176065 - DNA, 75 bp, Artificial Sequence
  Synthetic
taaatgcgaaagctcgttaatctgccgtatatagattaatcttaaataatgcttaattttacagtttgagtacac

SEQ ID NO: 176066 - DNA, 75 bp, Artificial Sequence
  Synthetic
aggaacagaaactcttctgggagcagttcaaaatgtcttaattttagaacatgtttcatgaagggtataagaagc

SEQ ID NO: 176067 - DNA, 75 bp, Artificial Sequence
  Synthetic
gttcaaaatgtcttaattttagaacatgtttcatgaagggtataagaagcaattctagcgtgtaatttgaatatg

SEQ ID NO: 176068 - DNA, 75 bp, Artificial Sequence
  Synthetic
gttgacattttttcgtagacggaatgtccttgtgtattcagtttcccataattgatcaatttttttgtctgcgta

SEQ ID NO: 176069 - DNA, 75 bp, Artificial Sequence
  Synthetic
gtccttgtgtattcagtttcccataattgatcaatttttttgtctgcgtattcaatatctggaatatattgtgaa

SEQ ID NO: 176070 - DNA, 75 bp, Artificial Sequence
  Synthetic
tgtcgtctattgatacactagtgaatgggagactttgaactttgttcagagctttagcgagagacaagctttcaa

SEQ ID NO: 176071 - DNA, 75 bp, Artificial Sequence
  Synthetic
tgggagactttgaactttgttcagagctttagcgagagacaagctttcaatatctgaatctaaagtaaagtcatg

SEQ ID NO: 176072 - DNA, 75 bp, Artificial Sequence
  Synthetic
aatgaatgcatgtctttaatcttattttcaaatagccgatttgcagttttcagtgtttcgatttcgtccagttgt

SEQ ID NO: 176073 - DNA, 75 bp, Artificial Sequence
  Synthetic
ttatgatttgttttttgaagatatctctaatatcgcgatcattattgtcctgcccacgacgttgcaaatttcctt

SEQ ID NO: 176074 - DNA, 75 bp, Artificial Sequence
  Synthetic
aattatagacggcgtgatgtcttgtaaaaaaccctcaatactatctgttattccaattttagatttactatcgga

SEQ ID NO: 176075 - DNA, 75 bp, Artificial Sequence
  Synthetic
aaaaaaccctcaatactatctgttattccaattttagatttactatcggacaagtttaatagaaactttataaga

SEQ ID NO: 176076 - DNA, 75 bp, Artificial Sequence
  Synthetic
cctctctttctataagttctagaatttttttgttatcaacactgttctttgatgtagttaaaactttaattggaa

SEQ ID NO: 176077 - DNA, 75 bp, Artificial Sequence
  Synthetic
ttttttgttatcaacactgttctttgatgtagttaaaactttaattggaaaagtattcagcaattgacacatttt

SEQ ID NO: 176078 - DNA, 75 bp, Artificial Sequence
  Synthetic
ttattcaattctgagtataagtgagctaggggtgttgtaaacagcaattgattatttatgaaatatggtgcactg

SEQ ID NO: 176079 - DNA, 75 bp, Artificial Sequence
  Synthetic
attatttatgaaatatggtgcactgtaaacaaagtactctagttccttgttattggagagacaggttatattgcc

SEQ ID NO: 176080 - DNA, 75 bp, Artificial Sequence
  Synthetic
atgttggtgaaatcggcaatagatgttgaggagatctgtgttaaaatgtgcagtagaaagttctgtttgtttcgt

SEQ ID NO: 176081 - DNA, 75 bp, Artificial Sequence
  Synthetic
ttgaggagatctgtgttaaaatgtgcagtagaaagttctgtttgtttcgtatgatttcttgaatcaatctagagg

SEQ ID NO: 176082 - DNA, 75 bp, Artificial Sequence
  Synthetic
cgtaaccttgttttttggtaatgtgacaattggtgttattccaatcgtacaaatccaatcaatgtatttattata

SEQ ID NO: 176083 - DNA, 75 bp, Artificial Sequence
  Synthetic
atgtagtttatcgtttgcaaaatgccttccaggattacctgtttgattgcataataccagatattaaaatattct

SEQ ID NO: 176084 - DNA, 75 bp, Artificial Sequence
  Synthetic
acggaaatgctttcagatgacgttgccattcagcattgatctgctggatggatatactattcaagagagtgtgtg

SEQ ID NO: 176085 - DNA, 75 bp, Artificial Sequence
  Synthetic
ccattcagcattgatctgctggatggatatactattcaagagagtgtgtgacagtgtgtaaaacatttgcttctt

SEQ ID NO: 176086 - DNA, 75 bp, Artificial Sequence
  Synthetic
ctgtgtatagattgtcccttaaagaattcttttttaccgtgtagcatttctataaattttatagtcttaatagaa

SEQ ID NO: 176087 - DNA, 75 bp, Artificial Sequence
  Synthetic
attcttttttaccgtgtagcatttctataaattttatagtcttaatagaaggaaataaaatgtcattgtcttcat

SEQ ID NO: 176088 - DNA, 75 bp, Artificial Sequence
  Synthetic
attccttttaaacatgtcatctgctgctaaggtggagttgattgttgagaaagttgcagctttagctgatgcctg

SEQ ID NO: 176089 - DNA, 75 bp, Artificial Sequence
  Synthetic
gctaaggtggagttgattgttgagaaagttgcagctttagctgatgcctgtttagagacgccgttaccaactgac

SEQ ID NO: 176090 - DNA, 75 bp, Artificial Sequence
  Synthetic
aattagaatttaatagcaattttgaagaaattcattctataggtgatgaagaatttgctcaaccgttgccatttt

SEQ ID NO: 176091 - DNA, 75 bp, Artificial Sequence
  Synthetic
agaaattcattctataggtgatgaagaatttgctcaaccgttgccatttttaccttttagagtattattaataac

SEQ ID NO: 176092 - DNA, 75 bp, Artificial Sequence
  Synthetic
agcagcattcaaaccttagcagctaatagtgattgtcttataactgctaccacttccattgctgctcaaaatctt

SEQ ID NO: 176093 - DNA, 75 bp, Artificial Sequence
  Synthetic
atagtgattgtcttataactgctaccacttccattgctgctcaaaatcttagtggtttattgaacagaaccaaat

SEQ ID NO: 176094 - DNA, 75 bp, Artificial Sequence
  Synthetic
aacatttggttttaatagttcacatgtatctatgaatgaaagaattagttgttcagtaacaactttagattcgat

SEQ ID NO: 176095 - DNA, 75 bp, Artificial Sequence
  Synthetic
tgcggatcagcaaaaacatgatttatctacatattggaacgtcatcgcagatatagcggaaagagctttgaatgc

SEQ ID NO: 176096 - DNA, 75 bp, Artificial Sequence
  Synthetic
cctgatctatgtgaaagcagtgtgattgtgattgatgaagcaggagtgatcttaaggcacattttgcatacagtt

SEQ ID NO: 176097 - DNA, 75 bp, Artificial Sequence
  Synthetic
ttgtgattgatgaagcaggagtgatcttaaggcacattttgcatacagttgtctttttttattggttttataacg

SEQ ID NO: 176098 - DNA, 75 bp, Artificial Sequence
  Synthetic
aaatagagttattccttgtattgtatgtgttggatctcctacacaaagtggggctttaatttcatcgtttaatcc

SEQ ID NO: 176099 - DNA, 75 bp, Artificial Sequence
  Synthetic
tgtgttggatctcctacacaaagtggggctttaatttcatcgtttaatccgttaacacaaaataaagacgtaaag

SEQ ID NO: 176100 - DNA, 75 bp, Artificial Sequence
  Synthetic
taatatgtgacgacattctatcaaattactgtaaaatatcagaaaattgggtgatttttgttaataataaacgat

SEQ ID NO: 176101 - DNA, 75 bp, Artificial Sequence
  Synthetic
ttactgtaaaatatcagaaaattgggtgatttttgttaataataaacgatgcactgatgtggaattcggcgaatt

SEQ ID NO: 176102 - DNA, 75 bp, Artificial Sequence
  Synthetic
ccattgaaacctgaattgattgagtatgttgataggtttgttagaccggcaacttatattagaaatcctacaaac

SEQ ID NO: 176103 - DNA, 75 bp, Artificial Sequence
  Synthetic
atgttgataggtttgttagaccggcaacttatattagaaatcctacaaacgaaattggaatgacgcgtttatttt

SEQ ID NO: 176104 - DNA, 75 bp, Artificial Sequence
  Synthetic
ttttaaagttttacatgagcaggtcgaactgacaaataaagataatctttttacttttcctgtttatttcataat

SEQ ID NO: 176105 - DNA, 75 bp, Artificial Sequence
  Synthetic
gaactgacaaataaagataatctttttacttttcctgtttatttcataattcagaataaagcatttgaagattac

SEQ ID NO: 176106 - DNA, 75 bp, Artificial Sequence
  Synthetic
tagagattgaaccatggtttaaaactaatttacacagattaaatacttattcccaattcgctgatcaagatttgt

SEQ ID NO: 176107 - DNA, 75 bp, Artificial Sequence
  Synthetic
taatttacacagattaaatacttattcccaattcgctgatcaagatttgtctaagaccatacaaatcgaagaaat

SEQ ID NO: 176108 - DNA, 75 bp, Artificial Sequence
  Synthetic
gaaactttgataacgtgtcatttgaaacatataaaacatagttctattggcgttacttccagaacaaaatcttca

SEQ ID NO: 176109 - DNA, 75 bp, Artificial Sequence
  Synthetic
aacatataaaacatagttctattggcgttacttccagaacaaaatcttcaactgttgggttttcagggacatatg

SEQ ID NO: 176110 - DNA, 75 bp, Artificial Sequence
  Synthetic
tgatttatttattgaaaaaacagcatgcgaatatagcgtgcacgcctattccttcttgacaggtttaatgtatgg

SEQ ID NO: 176111 - DNA, 75 bp, Artificial Sequence
  Synthetic
tgcgaatatagcgtgcacgcctattccttcttgacaggtttaatgtatgggggtatgtattctttctgtttatcc

SEQ ID NO: 176112 - DNA, 75 bp, Artificial Sequence
  Synthetic
cagaaataagaaagatcaaattgcccaatattgattttctacaaacaatgacagctgaagtttctttgcaaacct

SEQ ID NO: 176113 - DNA, 75 bp, Artificial Sequence
  Synthetic
caatattgattttctacaaacaatgacagctgaagtttctttgcaaaccttcgatgaatcagacgaatactatga

SEQ ID NO: 176114 - DNA, 75 bp, Artificial Sequence
  Synthetic
gaaatgttagcttcggatccgtgcccagatcctttttttttaaagtacaagcaacttccattaacgaatgttcta

SEQ ID NO: 176115 - DNA, 75 bp, Artificial Sequence
  Synthetic
cagatcctttttttttaaagtacaagcaacttccattaacgaatgttctaacatttgaagaaatcagttaccttt

SEQ ID NO: 176116 - DNA, 75 bp, Artificial Sequence
  Synthetic
ttctagatttgcaattctacaaaggcacagtaaagaaatgttcggcaagagtaatttaatcacatataataggaa

SEQ ID NO: 176117 - DNA, 75 bp, Artificial Sequence
  Synthetic
cacagtaaagaaatgttcggcaagagtaatttaatcacatataataggaataatgtttcgagcaaaagatgtggg

SEQ ID NO: 176118 - DNA, 75 bp, Artificial Sequence
  Synthetic
tctacggcatgttaacatatgctgtgcctgctaataattatactttggaaggatatacttatgataatgtgattt

SEQ ID NO: 176119 - DNA, 75 bp, Artificial Sequence
  Synthetic
gcctgctaataattatactttggaaggatatacttatgataatgtgattttcttagggacggataaaatgcttcc

SEQ ID NO: 176120 - DNA, 75 bp, Artificial Sequence
  Synthetic
cccaaaattgttatcaaggatgaaatgggctttatttcgatcttagacaacaatgtatcaaaacttactgacact

SEQ ID NO: 176121 - DNA, 75 bp, Artificial Sequence
  Synthetic
tgggctttatttcgatcttagacaacaatgtatcaaaacttactgacactgtcaatggtaacagttttcatatct

SEQ ID NO: 176122 - DNA, 75 bp, Artificial Sequence
  Synthetic
ttctaaagttgcaatgactgtgacaaaaagtcaaggcttatctatacaaagggttgccttagattttggaaatga

SEQ ID NO: 176123 - DNA, 75 bp, Artificial Sequence
  Synthetic
aaaagtcaaggcttatctatacaaagggttgccttagattttggaaatgatcctaaaaatttaaagttgagttct

SEQ ID NO: 176124 - DNA, 75 bp, Artificial Sequence
  Synthetic
ttgatccaaataatttaattatgaatctgaaccctttacggttgaactatgaaaatgataatattattgcttcac

SEQ ID NO: 176125 - DNA, 75 bp, Artificial Sequence
  Synthetic
tctgaaccctttacggttgaactatgaaaatgataatattattgcttcacatattgtaaaggccttaaaaaataa

SEQ ID NO: 176126 - DNA, 75 bp, Artificial Sequence
  Synthetic
ccagagtttgtgttgattgacgtatttttttaaactaagttgaaattaagtttttcatgtatcgatgtgcttttt

SEQ ID NO: 176127 - DNA, 75 bp, Artificial Sequence
  Synthetic
ttttttaaactaagttgaaattaagtttttcatgtatcgatgtgcttttttctggtatgtttttaatggttggca

SEQ ID NO: 176128 - DNA, 75 bp, Artificial Sequence
  Synthetic
atgatttggtatacactattttattgcgaaaatgataaatactctgggtccggaagttgaggcttttagaaatct

SEQ ID NO: 176129 - DNA, 75 bp, Artificial Sequence
  Synthetic
gcgaaaatgataaatactctgggtccggaagttgaggcttttagaaatctttcatcttctgaatctgcaaagaaa

SEQ ID NO: 176130 - DNA, 75 bp, Artificial Sequence
  Synthetic
ctagataaagtaggtaaaaaataaatataaacaaaatttaccgtctgcgtagttatttgttccagttgaatgagg

SEQ ID NO: 176131 - DNA, 75 bp, Artificial Sequence
  Synthetic
tataaacaaaatttaccgtctgcgtagttatttgttccagttgaatgaggactgcagtattcttatgccaggttt

SEQ ID NO: 176132 - DNA, 75 bp, Artificial Sequence
  Synthetic
gggaaaaacttttccggagtatacaaatgtactccggattgcgcaggcgtgtttattctacatttaaaattgatg

SEQ ID NO: 176133 - DNA, 75 bp, Artificial Sequence
  Synthetic
aatgtactccggattgcgcaggcgtgtttattctacatttaaaattgatggcagttagcggtgtcaggtggtatg

SEQ ID NO: 176134 - DNA, 75 bp, Artificial Sequence
  Synthetic
gaaatcaactaaagttccttttccacacactactgaaggttgtatgaatatcacaattcacaattttataacaat

SEQ ID NO: 176135 - DNA, 75 bp, Artificial Sequence
  Synthetic
cacactactgaaggttgtatgaatatcacaattcacaattttataacaatctagagttgctttttaaggtatgga

SEQ ID NO: 176136 - DNA, 75 bp, Artificial Sequence
  Synthetic
gctgataattgtacattcagaaagctaaaactacttattcttaatatctatgacttaaccttaaaaatctatgac

SEQ ID NO: 176137 - DNA, 75 bp, Artificial Sequence
  Synthetic
taaaactacttattcttaatatctatgacttaaccttaaaaatctatgacaaaacctattgattattcttaacag

SEQ ID NO: 176138 - DNA, 75 bp, Artificial Sequence
  Synthetic
actattcttaaaaactatgattttaccccattccccacccccacccccacccttcttgattatatcccggacccc

SEQ ID NO: 176139 - DNA, 75 bp, Artificial Sequence
  Synthetic
ccccattccccacccccacccccacccttcttgattatatcccggaccccactaaatggattgtctttgtattat

SEQ ID NO: 176140 - DNA, 75 bp, Artificial Sequence
  Synthetic
gaaacatagtacaagggctaactcttaatggttacaagtatgcagctcaaaatcgtaatggttctgatctttctt

SEQ ID NO: 176141 - DNA, 75 bp, Artificial Sequence
  Synthetic
taatggttacaagtatgcagctcaaaatcgtaatggttctgatctttcttgtacatgttcaagttttcggcggtt

SEQ ID NO: 176142 - DNA, 75 bp, Artificial Sequence
  Synthetic
ttttagattcaaaacatcacttatctccacagatcatttccaagcaattgtacagaaagatagaatgtcaatgag

SEQ ID NO: 176143 - DNA, 75 bp, Artificial Sequence
  Synthetic
tccacagatcatttccaagcaattgtacagaaagatagaatgtcaatgagaacagccgttctcattgtcttcaca

SEQ ID NO: 176144 - DNA, 75 bp, Artificial Sequence
  Synthetic
tagccgtaaatggctactgtggtttacattataaatgagaacagccgttcccatagttttaaaatgaggtttaaa

SEQ ID NO: 176145 - DNA, 75 bp, Artificial Sequence
  Synthetic
acattataaatgagaacagccgttcccatagttttaaaatgaggtttaaaacatacagtagccattacatggtta

SEQ ID NO: 176146 - DNA, 75 bp, Artificial Sequence
  Synthetic
atcgcaatccacaatacacagtcccgttgttcaaaaagttatgcagttggcggtcttaatcaggtatgagatggt

SEQ ID NO: 176147 - DNA, 75 bp, Artificial Sequence
  Synthetic
gttgttcaaaaagttatgcagttggcggtcttaatcaggtatgagatggtatggcaatacacgttgtaaaaattc

SEQ ID NO: 176148 - DNA, 75 bp, Artificial Sequence
  Synthetic
gttgtaggatatcctgtagtttttgatggttttttggttgatgacttacacaagatcaaaagttactggtaatcc

SEQ ID NO: 176149 - DNA, 75 bp, Artificial Sequence
  Synthetic
atggttttttggttgatgacttacacaagatcaaaagttactggtaatccttagtgttagatcttacatgatatg

SEQ ID NO: 176150 - DNA, 75 bp, Artificial Sequence
  Synthetic
gaagggataacccatatcaaacaagaaaagttaaagagaagaaactatgagatgggagaacctataacaaataca

SEQ ID NO: 176151 - DNA, 75 bp, Artificial Sequence
  Synthetic
aaaagttaaagagaagaaactatgagatgggagaacctataacaaatacacttttaagattggggtgggtgaaca

SEQ ID NO: 176152 - DNA, 75 bp, Artificial Sequence
  Synthetic
gtgaccgacagttacattccttcataaaaactaacgtgatagcaaaaaaaatatacataaataaagaagatggct

SEQ ID NO: 176153 - DNA, 75 bp, Artificial Sequence
  Synthetic
aaaaactaacgtgatagcaaaaaaaatatacataaataaagaagatggcttttcaagtgataatggcagtctaga

SEQ ID NO: 176154 - DNA, 75 bp, Artificial Sequence
  Synthetic
tcagtccatatacaacttttcctattacctcgtctaaaaaaggcaacctaaaactggctgttttacctgggatga

SEQ ID NO: 176155 - DNA, 75 bp, Artificial Sequence
  Synthetic
tacctcgtctaaaaaaggcaacctaaaactggctgttttacctgggatgatttaaatatagaataaacattcacc

SEQ ID NO: 176156 - DNA, 75 bp, Artificial Sequence
  Synthetic
agtagtgttgactgcattgtctccgtgtatcttgatccaatagagctttatctaataaatacaaaaaaggaaaaa

SEQ ID NO: 176157 - DNA, 75 bp, Artificial Sequence
  Synthetic
tgtatcttgatccaatagagctttatctaataaatacaaaaaaggaaaaatccgtatattccataacttgttaag

SEQ ID NO: 176158 - DNA, 75 bp, Artificial Sequence
  Synthetic
atatatcgtttagatgttatacaaaagtttatcgttttaactaatcattgtctattttcagacatcgatacagag

SEQ ID NO: 176159 - DNA, 75 bp, Artificial Sequence
  Synthetic
agtttatcgttttaactaatcattgtctattttcagacatcgatacagagtttgatatttacgagtttttcgaaa

SEQ ID NO: 176160 - DNA, 75 bp, Artificial Sequence
  Synthetic
cgctgtcttaacagttcatgtagatcgcgggctttataaacaaatgctttccagttttccacgccctgggggata

SEQ ID NO: 176161 - DNA, 75 bp, Artificial Sequence
  Synthetic
cgcgggctttataaacaaatgctttccagttttccacgccctgggggatatgacgcaatttccttcatccgtgaa

SEQ ID NO: 176162 - DNA, 75 bp, Artificial Sequence
  Synthetic
cggaagtaaaccgttattttttctcgaacggtaaaatacaaaaacggtttatgcgaaacaatttcaggcaaatat

SEQ ID NO: 176163 - DNA, 75 bp, Artificial Sequence
  Synthetic
gaacggtaaaatacaaaaacggtttatgcgaaacaatttcaggcaaatatcattgcgactttttaaaaacgattt

SEQ ID NO: 176164 - DNA, 75 bp, Artificial Sequence
  Synthetic
cattccggaaatcaattttcatgtcagaaagcataaaagggagatgcttttgtgtcaggaagcaactttatcagt

SEQ ID NO: 176165 - DNA, 75 bp, Artificial Sequence
  Synthetic
agaaagcataaaagggagatgcttttgtgtcaggaagcaactttatcagtcaagaactgtgaagtacattccttg

SEQ ID NO: 176166 - DNA, 75 bp, Artificial Sequence
  Synthetic
aagtgagtttttcagtgagtggaagcaggtaagtataaaatttccctattctatttcaacctgtactcgactctg

SEQ ID NO: 176167 - DNA, 75 bp, Artificial Sequence
  Synthetic
caggtaagtataaaatttccctattctatttcaacctgtactcgactctgaatacgttatttcttttattgacag

SEQ ID NO: 176168 - DNA, 75 bp, Artificial Sequence
  Synthetic
ggaacgtttgaatctgtaacccaggcttatcagcagatcattagtcatactttacagctgagacgatatgaattt

SEQ ID NO: 176169 - DNA, 75 bp, Artificial Sequence
  Synthetic
cttatcagcagatcattagtcatactttacagctgagacgatatgaatttgaaactgggtgcatgattatgtttt

SEQ ID NO: 176170 - DNA, 75 bp, Artificial Sequence
  Synthetic
gctctctaatggttggatttcaatgatttcatggacttcagaaaccgatacggccggctcattgacattggatat

SEQ ID NO: 176171 - DNA, 75 bp, Artificial Sequence
  Synthetic
atttcatggacttcagaaaccgatacggccggctcattgacattggatatttgtactgagggagggcagtgcaaa

SEQ ID NO: 176172 - DNA, 75 bp, Artificial Sequence
  Synthetic
tatgttctaaaaacatcacttcaatttctcagaaaaacgagggaaaggaaaaagttttgacgatttgtcatgaca

SEQ ID NO: 176173 - DNA, 75 bp, Artificial Sequence
  Synthetic
ttctcagaaaaacgagggaaaggaaaaagttttgacgatttgtcatgacaatggaaaattgcatttaacttatat

SEQ ID NO: 176174 - DNA, 75 bp, Artificial Sequence
  Synthetic
tgtgatatcaaagaccaaaaactggagaaactgtttgaaaaagaacatgcagaacgaaaaaagcaagatgatgat

SEQ ID NO: 176175 - DNA, 75 bp, Artificial Sequence
  Synthetic
agaaactgtttgaaaaagaacatgcagaacgaaaaaagcaagatgatgattataaaaaaaaagctcttaaacaaa

SEQ ID NO: 176176 - DNA, 75 bp, Artificial Sequence
  Synthetic
aattttggaagactgtgataaaaaagatgaaaaaaaaagaatggatgacaccgaaaaaagaaaactacaagagga

SEQ ID NO: 176177 - DNA, 75 bp, Artificial Sequence
  Synthetic
gatgaaaaaaaaagaatggatgacaccgaaaaaagaaaactacaagaggaccgtcgaaacgaaaaacaagaccta

SEQ ID NO: 176178 - DNA, 75 bp, Artificial Sequence
  Synthetic
aaagaaaattagaagatgaccgtcgaaacgaaaaacaagacctcgaaggttagttgccttttttctaaatcacta

SEQ ID NO: 176179 - DNA, 75 bp, Artificial Sequence
  Synthetic
aaacgaaaaacaagacctcgaaggttagttgccttttttctaaatcactagtcctaaatatgacttgttgaattt

SEQ ID NO: 176180 - DNA, 75 bp, Artificial Sequence
  Synthetic
aacatgttttcttagatgcatccaaagaaaaaaggatgaaagtgcatcacgaaaaacgtcatgcggaagaacaag

SEQ ID NO: 176181 - DNA, 75 bp, Artificial Sequence
  Synthetic
agaaaaaaggatgaaagtgcatcacgaaaaacgtcatgcggaagaacaagcaaacgaagaggttgcttcttcgag

SEQ ID NO: 176182 - DNA, 75 bp, Artificial Sequence
  Synthetic
ggtgcgttatcgcccactatttctattgatcttcaggaatatcaagaatttgaggattttgacaagcgcatttgt

SEQ ID NO: 176183 - DNA, 75 bp, Artificial Sequence
  Synthetic
ttgatcttcaggaatatcaagaatttgaggattttgacaagcgcatttgtgggcaggtgggtggagttttgggtt

SEQ ID NO: 176184 - DNA, 75 bp, Artificial Sequence
  Synthetic
ttatgtggttaaagatgtttctttcttttaggggaagaatcaagacgctgtatgcaagaaagtccaaagtgatga

SEQ ID NO: 176185 - DNA, 75 bp, Artificial Sequence
  Synthetic
ttttaggggaagaatcaagacgctgtatgcaagaaagtccaaagtgatgaaagtttttgtataaataaaccgtta

SEQ ID NO: 176186 - DNA, 75 bp, Artificial Sequence
  Synthetic
aaattactcatgaagctgtacaacagtcactgttacaatcgcggggaaaaaatgaggataataaaaaagatgtta

SEQ ID NO: 176187 - DNA, 75 bp, Artificial Sequence
  Synthetic
gtcactgttacaatcgcggggaaaaaatgaggataataaaaaagatgttacccaaaatgtaaaattcgctgatga

SEQ ID NO: 176188 - DNA, 75 bp, Artificial Sequence
  Synthetic
aaatgtacttctaaaactaagcatattgaagatcaacaaatacagtttggggcacaaaatagatttgttcctata

SEQ ID NO: 176189 - DNA, 75 bp, Artificial Sequence
  Synthetic
ttgaagatcaacaaatacagtttggggcacaaaatagatttgttcctatatgtgaaataaaaccatttattgatg

SEQ ID NO: 176190 - DNA, 75 bp, Artificial Sequence
  Synthetic
aggtagaaggagtactcgtggaagaagaaactcaaactccgctagattttcggcctctacttttgaacaaccaat

SEQ ID NO: 176191 - DNA, 75 bp, Artificial Sequence
  Synthetic
agaaactcaaactccgctagattttcggcctctacttttgaacaaccaattgaaacttctgagatgctgacggtt

SEQ ID NO: 176192 - DNA, 75 bp, Artificial Sequence
  Synthetic
ggggaaggccaagaggcagaggcagatccagaaacatgtcaatgagacaaactccaagagaagttgaagacatgt

SEQ ID NO: 176193 - DNA, 75 bp, Artificial Sequence
  Synthetic
atccagaaacatgtcaatgagacaaactccaagagaagttgaagacatgttaccgattgttttggacagtgacag

SEQ ID NO: 176194 - DNA, 75 bp, Artificial Sequence
  Synthetic
gaagatttattggcgtcttccatattacagactttataaatcgtttgttatgttccaatcaattggacatttgtt

SEQ ID NO: 176195 - DNA, 75 bp, Artificial Sequence
  Synthetic
tacagactttataaatcgtttgttatgttccaatcaattggacatttgttgtggatttgtaaatatttatttgct

SEQ ID NO: 176196 - DNA, 75 bp, Artificial Sequence
  Synthetic
aaggtgtttttgatccttttgttctcggagatggatgtgcacattccaaaatcaagtgtttctttgaatctatta

SEQ ID NO: 176197 - DNA, 75 bp, Artificial Sequence
  Synthetic
cggagatggatgtgcacattccaaaatcaagtgtttctttgaatctattaaagacacgagtttgcgagcctgtga

SEQ ID NO: 176198 - DNA, 75 bp, Artificial Sequence
  Synthetic
tgcattttttctgatagttggttaataattcggttgctcaaaacttgccatccaatcgcttcatgggacattggt

SEQ ID NO: 176199 - DNA, 75 bp, Artificial Sequence
  Synthetic
taattcggttgctcaaaacttgccatccaatcgcttcatgggacattggtactccccttataactgtgaaaacag

SEQ ID NO: 176200 - DNA, 75 bp, Artificial Sequence
  Synthetic
acaccaagattttaaagatccgtgggctggagctttaaaattctctattgttctttcaagttctgcaaaaatggt

SEQ ID NO: 176201 - DNA, 75 bp, Artificial Sequence
  Synthetic
gctggagctttaaaattctctattgttctttcaagttctgcaaaaatggtttttaaagaattcggaggggaacat

SEQ ID NO: 176202 - DNA, 75 bp, Artificial Sequence
  Synthetic
cgtgacctctaccatcgggataaggatcttggcccactattatcaccttaatctcttcaggcgaacataaataac

SEQ ID NO: 176203 - DNA, 75 bp, Artificial Sequence
  Synthetic
atcttggcccactattatcaccttaatctcttcaggcgaacataaataactccagctgtgtacattctgaggatc

SEQ ID NO: 176204 - DNA, 75 bp, Artificial Sequence
  Synthetic
tcacgctgaaccaatttgtatacattttgtaattgtacaatgtcagaatctgataagtttaaaaacttaagccac

SEQ ID NO: 176205 - DNA, 75 bp, Artificial Sequence
  Synthetic
tttgtaattgtacaatgtcagaatctgataagtttaaaaacttaagccacttcacattgatttgaaacgtttcat

SEQ ID NO: 176206 - DNA, 75 bp, Artificial Sequence
  Synthetic
tgagttgtcatctgaaatgttttccagcatccactgtagtaatgccattattgaatgggagaagcagtgttcatg

SEQ ID NO: 176207 - DNA, 75 bp, Artificial Sequence
  Synthetic
agcatccactgtagtaatgccattattgaatgggagaagcagtgttcatgggctttttattaatgttgcctgaac

SEQ ID NO: 176208 - DNA, 75 bp, Artificial Sequence
  Synthetic
ataaagcatgcgtcagtaagttctaatgagcaaattcgaaaactcgcttcggaatggaagcacttcattatattt

SEQ ID NO: 176209 - DNA, 75 bp, Artificial Sequence
  Synthetic
atgagcaaattcgaaaactcgcttcggaatggaagcacttcattatatttttccatttcttgaattaacgggaaa

SEQ ID NO: 176210 - DNA, 75 bp, Artificial Sequence
  Synthetic
atctcaaacaatttaacaaagcatcaaaaacattaattccatggtgatcaattctcacaattctctgtgtgcgag

SEQ ID NO: 176211 - DNA, 75 bp, Artificial Sequence
  Synthetic
aaaaacattaattccatggtgatcaattctcacaattctctgtgtgcgagtctcttcattttcaaggtaaatcaa

SEQ ID NO: 176212 - DNA, 75 bp, Artificial Sequence
  Synthetic
tttgatggtatattgaattcaaatccgattatattttctacaaagatgttgcccgtgaatttgagtttttcataa

SEQ ID NO: 176213 - DNA, 75 bp, Artificial Sequence
  Synthetic
cgattatattttctacaaagatgttgcccgtgaatttgagtttttcataagagtatgatttacacacattatctc

SEQ ID NO: 176214 - DNA, 75 bp, Artificial Sequence
  Synthetic
aagacatctttcaaagttatttaaaaagccaagccagttgtgccctgattctgaatctttaattaaggaaagtaa

SEQ ID NO: 176215 - DNA, 75 bp, Artificial Sequence
  Synthetic
aagccaagccagttgtgccctgattctgaatctttaattaaggaaagtaaggtgtgtagttgattaggattatta

SEQ ID NO: 176216 - DNA, 75 bp, Artificial Sequence
  Synthetic
aatcttcatcaattaaaacttgatctctccttgagatatagggagtatgatataataagcgagaaattatatccg

SEQ ID NO: 176217 - DNA, 75 bp, Artificial Sequence
  Synthetic
aggttccagaagcgacagagtttttgattgggtacaatttagaatgtttttgatacattcttgttctaaattaga

SEQ ID NO: 176218 - DNA, 75 bp, Artificial Sequence
  Synthetic
gattgggtacaatttagaatgtttttgatacattcttgttctaaattagaataataagagttattaaataaagca

SEQ ID NO: 176219 - DNA, 75 bp, Artificial Sequence
  Synthetic
tgatacattcttgttctaaattagaataataagagttattaaataaagcatatatttggtttagaatggagataa

SEQ ID NO: 176220 - DNA, 75 bp, Artificial Sequence
  Synthetic
catgttccataaagttgtatacaaaacaccaggaacttaaatatggaagacacatttaaatggaatctaataatt

SEQ ID NO: 176221 - DNA, 75 bp, Artificial Sequence
  Synthetic
cacatttaaatggaatctaataatttacataccgtttttgaagtgagctttctaattatttcgtgattatagaaa

SEQ ID NO: 176222 - DNA, 75 bp, Artificial Sequence
  Synthetic
gaaacagaaaatctggaattcttaacagtaggttttccttacctgtattagtagaagttgtatttttagaagtcg

SEQ ID NO: 176223 - DNA, 75 bp, Artificial Sequence
  Synthetic
cagtaggttttccttacctgtattagtagaagttgtatttttagaagtcgaatctgagtcaagatctatagaaaa

SEQ ID NO: 176224 - DNA, 75 bp, Artificial Sequence
  Synthetic
ttaagcaataaatatataacgtaattcgagtcaatcagagtacataagttttaaaatatactatgtctttaatag

SEQ ID NO: 176225 - DNA, 75 bp, Artificial Sequence
  Synthetic
tcgagtcaatcagagtacataagttttaaaatatactatgtctttaatagtttaccataatcgtcccagtagatg

SEQ ID NO: 176226 - DNA, 75 bp, Artificial Sequence
  Synthetic
ttaaatgctctttaagtaataaaggttgtgttaactttgagacatttagtaaaatgtcagcagggtaacgaattg

SEQ ID NO: 176227 - DNA, 75 bp, Artificial Sequence
  Synthetic
ttgtgttaactttgagacatttagtaaaatgtcagcagggtaacgaattgaaaattggacacagagatgagcagc

SEQ ID NO: 176228 - DNA, 75 bp, Artificial Sequence
  Synthetic
gcatttatgtacagagagtagacaccactatttttcctgtgtttgctgttgacattcacaggcatcatagcttct

SEQ ID NO: 176229 - DNA, 75 bp, Artificial Sequence
  Synthetic
tttctagtcagttcagtatgtggtactgttcctctgagaaatctgttaattgctatggcagttttctgttcatgg

SEQ ID NO: 176230 - DNA, 75 bp, Artificial Sequence
  Synthetic
cgcctttgttaacaatcagattagctatttccatcaatttttcgtgaagtgagtttacaagtaatccgttacgtg

SEQ ID NO: 176231 - DNA, 75 bp, Artificial Sequence
  Synthetic
tatttccatcaatttttcgtgaagtgagtttacaagtaatccgttacgtgaataaacttgaatttgaactacagt

SEQ ID NO: 176232 - DNA, 75 bp, Artificial Sequence
  Synthetic
taaacttccgataagaaatttttcggcgaacataaaccgcatggatgcataaaatcacaattaaaatctgtataa

SEQ ID NO: 176233 - DNA, 75 bp, Artificial Sequence
  Synthetic
gcgaacataaaccgcatggatgcataaaatcacaattaaaatctgtataattttttatttcaggagagtggatag

SEQ ID NO: 176234 - DNA, 75 bp, Artificial Sequence
  Synthetic
aacaatacccttagattttgttgcaaagtttgtcgttgagagattttcttttacagccttaaatatttttctcaa

SEQ ID NO: 176235 - DNA, 75 bp, Artificial Sequence
  Synthetic
aagtttgtcgttgagagattttcttttacagccttaaatatttttctcaatttagaatgtttatagatggcattc

SEQ ID NO: 176236 - DNA, 75 bp, Artificial Sequence
  Synthetic
tttctgattttgaaatgtttatttcagaatttattttttcaggaattgtacattttatggctttttcattaaacg

SEQ ID NO: 176237 - DNA, 75 bp, Artificial Sequence
  Synthetic
agaatttattttttcaggaattgtacattttatggctttttcattaaacggtaacgtttttgaaaaacagttaca

SEQ ID NO: 176238 - DNA, 75 bp, Artificial Sequence
  Synthetic
cacatgcagcttttagaagtgagtttacctttggccttacaaacagttttacgttttttgcccctcatattcaag

SEQ ID NO: 176239 - DNA, 75 bp, Artificial Sequence
  Synthetic
tacctttggccttacaaacagttttacgttttttgcccctcatattcaagtactgaagctttcaaaattttcaat

SEQ ID NO: 176240 - DNA, 75 bp, Artificial Sequence
  Synthetic
aagggttgaagctattataacgaaaagcaggacactggagattattaaaattatccacgccaaatcgttgttaat

SEQ ID NO: 176241 - DNA, 75 bp, Artificial Sequence
  Synthetic
agcaggacactggagattattaaaattatccacgccaaatcgttgttaattaactctgactgtttaagagaatca

SEQ ID NO: 176242 - DNA, 75 bp, Artificial Sequence
  Synthetic
ggttttcaaatggttgaataatcgaggtaacattctcgtctatctctccgccgtaagacagacaagtgatcggtt

SEQ ID NO: 176243 - DNA, 75 bp, Artificial Sequence
  Synthetic
ggtaacattctcgtctatctctccgccgtaagacagacaagtgatcggtttgccaaagaacgtattgctgccttg

SEQ ID NO: 176244 - DNA, 75 bp, Artificial Sequence
  Synthetic
gttgtctgcgagccgttgtaattttcacgcactgttggactgtcctgtctatatatcttatctaaaaataaaatg

SEQ ID NO: 176245 - DNA, 75 bp, Artificial Sequence
  Synthetic
cacgcactgttggactgtcctgtctatatatcttatctaaaaataaaatggctactaatggctttggatacgacg

SEQ ID NO: 176246 - DNA, 75 bp, Artificial Sequence
  Synthetic
attttgcagatggcgatagtacaaagcaattattggcttcattgaaagatgcacacaactcatagtagacaatcg

SEQ ID NO: 176247 - DNA, 75 bp, Artificial Sequence
  Synthetic
gcaattattggcttcattgaaagatgcacacaactcatagtagacaatcgagtcttggcgaagaatgcacatgtt

SEQ ID NO: 176248 - DNA, 75 bp, Artificial Sequence
  Synthetic
gagatttaaatttcagcaatgctgtgatattgttagcattgaagtaaataatgctttctttgtcacgatgtttaa

SEQ ID NO: 176249 - DNA, 75 bp, Artificial Sequence
  Synthetic
gatattgttagcattgaagtaaataatgctttctttgtcacgatgtttaaattcatgaactattttttcactcat

SEQ ID NO: 176250 - DNA, 75 bp, Artificial Sequence
  Synthetic
gtatgatttaatatcagttcgtaatgtttaaaccatattacagagctgagatttttagttgtatcaacagtacac

SEQ ID NO: 176251 - DNA, 75 bp, Artificial Sequence
  Synthetic
gtttaaaccatattacagagctgagatttttagttgtatcaacagtacactgaaatacaattgtgtttcctagtt

SEQ ID NO: 176252 - DNA, 75 bp, Artificial Sequence
  Synthetic
taatgcatatatgattacagaaaatccaatcatctttatgaaaattgcacctaagaaaggcattgtgtgaaattg

SEQ ID NO: 176253 - DNA, 75 bp, Artificial Sequence
  Synthetic
tctgattttggatttttctgcatctatattatctggacacaccctaaaaaaccactattttttctcttttacttt

SEQ ID NO: 176254 - DNA, 75 bp, Artificial Sequence
  Synthetic
gatttttgtggttttttttttaaatgtggacccacccattcaaaaataaggcgtttggggtaaagcaaatgtaat

SEQ ID NO: 176255 - DNA, 75 bp, Artificial Sequence
  Synthetic
caaagtgctgtgtattttgaaagaaaatctctacttacaggattatagatggaaatcggattatccccatcggtg

SEQ ID NO: 176256 - DNA, 75 bp, Artificial Sequence
  Synthetic
aatctctacttacaggattatagatggaaatcggattatccccatcggtgatagagcttaatcgcagaacaattt

SEQ ID NO: 176257 - DNA, 75 bp, Artificial Sequence
  Synthetic
gttacagattttagctgccatgaaaaaatctattggtgttgcagcgtatattataattgttttgagatctgaatg

SEQ ID NO: 176258 - DNA, 75 bp, Artificial Sequence
  Synthetic
aaatctattggtgttgcagcgtatattataattgttttgagatctgaatgtcttgtatacagagtatgtgcacta

SEQ ID NO: 176259 - DNA, 75 bp, Artificial Sequence
  Synthetic
gcggtccttttttttgtaattcgatgaaattctttatggaatctttgtcataatatcgcgggggggcgtggttca

SEQ ID NO: 176260 - DNA, 75 bp, Artificial Sequence
  Synthetic
gaaattctttatggaatctttgtcataatatcgcgggggggcgtggttcattttaaagggttcagacatggtgat

SEQ ID NO: 176261 - DNA, 75 bp, Artificial Sequence
  Synthetic
tgcatggcttttatgtcttcggcaacagtttttgacctggtaaaatatattataagcgcaccggatttagagctt

SEQ ID NO: 176262 - DNA, 75 bp, Artificial Sequence
  Synthetic
cagtttttgacctggtaaaatatattataagcgcaccggatttagagcttccattgcagcacaaagcataaaccg

SEQ ID NO: 176263 - DNA, 75 bp, Artificial Sequence
  Synthetic
cggtttttttggaatttgtttatattcaaaagcgcggattgtttttcgaaacagtttttcaaaatctttagtggg

SEQ ID NO: 176264 - DNA, 75 bp, Artificial Sequence
  Synthetic
tcaaaagcgcggattgtttttcgaaacagtttttcaaaatctttagtgggaacacgaccacgttgtactttaaat

SEQ ID NO: 176265 - DNA, 75 bp, Artificial Sequence
  Synthetic
attttacatactccctgtaggataaatcattatcagatagttctgagtcagatttttgggtaccagatatccgct

SEQ ID NO: 176266 - DNA, 75 bp, Artificial Sequence
  Synthetic
atcattatcagatagttctgagtcagatttttgggtaccagatatccgctttttgtagaaaagctgcatgcttga

SEQ ID NO: 176267 - DNA, 75 bp, Artificial Sequence
  Synthetic
ctcgcatttctgcgtttatttttaaaaaatttattagtacttttcttttgttcatactcattcggaatacttttg

SEQ ID NO: 176268 - DNA, 75 bp, Artificial Sequence
  Synthetic
aaaatttattagtacttttcttttgttcatactcattcggaatacttttggccccatgagtaaaatctatatcta

SEQ ID NO: 176269 - DNA, 75 bp, Artificial Sequence
  Synthetic
agaagaccacgaatgattagaacagcttctttccgatctttttttgcaatctgattcagaagacctgcttctact

SEQ ID NO: 176270 - DNA, 75 bp, Artificial Sequence
  Synthetic
cttctttccgatctttttttgcaatctgattcagaagacctgcttctacttcttagagtttctgaattcttattt

SEQ ID NO: 176271 - DNA, 75 bp, Artificial Sequence
  Synthetic
aaatactgtgttctgaatttgatctagatatagatatcaaatgtttgcattgtgtttccgactgagaatcttgtt

SEQ ID NO: 176272 - DNA, 75 bp, Artificial Sequence
  Synthetic
agatatagatatcaaatgtttgcattgtgtttccgactgagaatcttgtttattgttagaacacactttacatgt

SEQ ID NO: 176273 - DNA, 75 bp, Artificial Sequence
  Synthetic
ctcgatgtatcagagctgcttctagatctgtgtttttggcgatgtcttgttttagtactttctgaacatgattct

SEQ ID NO: 176274 - DNA, 75 bp, Artificial Sequence
  Synthetic
atctgtgtttttggcgatgtcttgttttagtactttctgaacatgattctgactcagtgtttctgtgttcgtgcc

SEQ ID NO: 176275 - DNA, 75 bp, Artificial Sequence
  Synthetic
ttgggattgtaaatctgaattggtatccgattctgactctgtgctcggtggtctctttttccttatgtgagggcg

SEQ ID NO: 176276 - DNA, 75 bp, Artificial Sequence
  Synthetic
tccgattctgactctgtgctcggtggtctctttttccttatgtgagggcgaaatcttggattatacaaatgttca

SEQ ID NO: 176277 - DNA, 75 bp, Artificial Sequence
  Synthetic
attcaacatgtttatacaaatttagctcttttccacacctgaattcaaattctgacatatcaactttgctaacaa

SEQ ID NO: 176278 - DNA, 75 bp, Artificial Sequence
  Synthetic
ctcttttccacacctgaattcaaattctgacatatcaactttgctaacaaaatcacactgtctattgccattaga

SEQ ID NO: 176279 - DNA, 75 bp, Artificial Sequence
  Synthetic
tttaactctgtagaggaacaactatttctacttaatacagaatttttagaagatgctgagctagatgacttacaa

SEQ ID NO: 176280 - DNA, 75 bp, Artificial Sequence
  Synthetic
ttctacttaatacagaatttttagaagatgctgagctagatgacttacaactgcatttactgcttgaactgctgc

SEQ ID NO: 176281 - DNA, 75 bp, Artificial Sequence
  Synthetic
gtcactggatgaacttcgtgtagattttggactcatagatctatcacttataggaaacttttttgtttcagagga

SEQ ID NO: 176282 - DNA, 75 bp, Artificial Sequence
  Synthetic
gttctgtgtgcattgtaattcattatcaaagaattcaaatagcccattctctgtgtctgatttagctaaaaattc

SEQ ID NO: 176283 - DNA, 75 bp, Artificial Sequence
  Synthetic
gactgtgaataatcatttactggtgatttatattgtccttcctcagtactacttgaatcagatcgtgtcctttgt

SEQ ID NO: 176284 - DNA, 75 bp, Artificial Sequence
  Synthetic
ctgttgtatttgatttttcagattctacagggggattatcgatagaaggtatattacatggtgctgtgactttcc

SEQ ID NO: 176285 - DNA, 75 bp, Artificial Sequence
  Synthetic
tattttggaattaacagtagtttttgcttgtctaggtctacctacacgatatgaattttttcctgtacattttgt

SEQ ID NO: 176286 - DNA, 75 bp, Artificial Sequence
  Synthetic
gcttgtctaggtctacctacacgatatgaattttttcctgtacattttgtatcagagaaaacagtactagaatta

SEQ ID NO: 176287 - DNA, 75 bp, Artificial Sequence
  Synthetic
agcgtgaagattgcttaatgaattctatatcagaagcagaaatgtctttgtcatttttttctaggagtcttttaa

SEQ ID NO: 176288 - DNA, 75 bp, Artificial Sequence
  Synthetic
tatatcagaagcagaaatgtctttgtcatttttttctaggagtcttttaaaattaatcaacttagttggagctcg

SEQ ID NO: 176289 - DNA, 75 bp, Artificial Sequence
  Synthetic
ttaggagttaatggcagtggagaaagcattggttctagttttgataattttctgagattttctatagcttcatct

SEQ ID NO: 176290 - DNA, 75 bp, Artificial Sequence
  Synthetic
gcattggttctagttttgataattttctgagattttctatagcttcatctggtgatttgtcctttttctttaagt

SEQ ID NO: 176291 - DNA, 75 bp, Artificial Sequence
  Synthetic
acaatgcttagaatctgtagtcgatgtgatttgtttttcttttgatgtactaggtcttgttctagctttcataaa

SEQ ID NO: 176292 - DNA, 75 bp, Artificial Sequence
  Synthetic
gtgatttgtttttcttttgatgtactaggtcttgttctagctttcataaaagtcttttcctgtgaagacttgtta

SEQ ID NO: 176293 - DNA, 75 bp, Artificial Sequence
  Synthetic
tcgaagatagactgtctttagccaggggaactatatcagcattataaattcttttaattagatccatcttatgag

SEQ ID NO: 176294 - DNA, 75 bp, Artificial Sequence
  Synthetic
gggaactatatcagcattataaattcttttaattagatccatcttatgagaacttggaatatatgacaagcttac

SEQ ID NO: 176295 - DNA, 75 bp, Artificial Sequence
  Synthetic
tctttgtctgtctttttcctggcaggtttttccaaattgttcacgtttgagattaatttggtttccttgtgattt

SEQ ID NO: 176296 - DNA, 75 bp, Artificial Sequence
  Synthetic
gtttttccaaattgttcacgtttgagattaatttggtttccttgtgatttgtctgaattggtgtattttgactgt

SEQ ID NO: 176297 - DNA, 75 bp, Artificial Sequence
  Synthetic
acctgatgaaatacattctttttgaaggttttgactatctgtgatcatagagctgcttggaatttgtgaaaaagc

SEQ ID NO: 176298 - DNA, 75 bp, Artificial Sequence
  Synthetic
aggttttgactatctgtgatcatagagctgcttggaatttgtgaaaaagccatgctgtaatctctgctttgaaag

SEQ ID NO: 176299 - DNA, 75 bp, Artificial Sequence
  Synthetic
aattgtctctgtaaggattatgtctaaaatctgaattgtatgagtcatatgactgatctcgttgcatatattccg

SEQ ID NO: 176300 - DNA, 75 bp, Artificial Sequence
  Synthetic
aaaatctgaattgtatgagtcatatgactgatctcgttgcatatattccggaaaggtaaattcatttctgttgga

SEQ ID NO: 176301 - DNA, 75 bp, Artificial Sequence
  Synthetic
cgtccacgtctgttgtaaggtctgtgaaaatgtttaccataatgattttggtattttgagttagggttacaataa

SEQ ID NO: 176302 - DNA, 75 bp, Artificial Sequence
  Synthetic
gaaaatgtttaccataatgattttggtattttgagttagggttacaataatttctactgtcatattttcctctgt

SEQ ID NO: 176303 - DNA, 75 bp, Artificial Sequence
  Synthetic
tcgataggttgtatcgaacgaattgtgacaaagttctctatttttatagtccaaattgttaaaaatatcaactga

SEQ ID NO: 176304 - DNA, 75 bp, Artificial Sequence
  Synthetic
tgacaaagttctctatttttatagtccaaattgttaaaaatatcaactgaagattggggttgatatggtaaagag

SEQ ID NO: 176305 - DNA, 75 bp, Artificial Sequence
  Synthetic
gataattataatacaatgattgcagtccttgatgtggcaattctgatgcaaatcgaaattgtccagtttcagttg

SEQ ID NO: 176306 - DNA, 75 bp, Artificial Sequence
  Synthetic
tccttgatgtggcaattctgatgcaaatcgaaattgtccagtttcagttgtatttggagaagattcagaagtaaa

SEQ ID NO: 176307 - DNA, 75 bp, Artificial Sequence
  Synthetic
gcacgtcgcggatcttgaagagtttttgatgtgactatttcttggttgttaaaatttgaataagttatttcattt

SEQ ID NO: 176308 - DNA, 75 bp, Artificial Sequence
  Synthetic
ttgatgtgactatttcttggttgttaaaatttgaataagttatttcattttctggttttgtatgatcgtgaattt

SEQ ID NO: 176309 - DNA, 75 bp, Artificial Sequence
  Synthetic
ggcttcacgaaccacgtcagctgtagtgctcatgggtgcatgcaatggtcttttttctgaaaatgaaaaataaaa

SEQ ID NO: 176310 - DNA, 75 bp, Artificial Sequence
  Synthetic
gtgctcatgggtgcatgcaatggtcttttttctgaaaatgaaaaataaaaattgtttattttaaaatgttattaa

SEQ ID NO: 176311 - DNA, 75 bp, Artificial Sequence
  Synthetic
atacctttaaatagagtggaaatgtacttttaattgtctagaaaatataacgcaatatgttagttaaaaatgtaa

SEQ ID NO: 176312 - DNA, 75 bp, Artificial Sequence
  Synthetic
acttttaattgtctagaaaatataacgcaatatgttagttaaaaatgtaacttgttagattgatatttcatgggc

SEQ ID NO: 176313 - DNA, 75 bp, Artificial Sequence
  Synthetic
tgtgtacaaatttgtgacaataaatattaaagtggaaacattccaaatgtagcaatttacatgtaaacggatatg

SEQ ID NO: 176314 - DNA, 75 bp, Artificial Sequence
  Synthetic
attaaagtggaaacattccaaatgtagcaatttacatgtaaacggatatgtaaatgtaataaagatgtgtatggt

SEQ ID NO: 176315 - DNA, 75 bp, Artificial Sequence
  Synthetic
catgcagttattaattgtaatggatgtacaaatgttgatacatgtttgtgtctgttgctgtgtatatgagtttat

SEQ ID NO: 176316 - DNA, 75 bp, Artificial Sequence
  Synthetic
gtacaaatgttgatacatgtttgtgtctgttgctgtgtatatgagtttatgttaaatgtttatgtaaatattata

SEQ ID NO: 176317 - DNA, 75 bp, Artificial Sequence
  Synthetic
gttgataagcagatgttagtatgtattagtatcaatggattgtagtatgctactgcatgctattaaacaagtaga

SEQ ID NO: 176318 - DNA, 75 bp, Artificial Sequence
  Synthetic
ttagtatcaatggattgtagtatgctactgcatgctattaaacaagtagagtgtttacttgtattagattatatt

SEQ ID NO: 176319 - DNA, 75 bp, Artificial Sequence
  Synthetic
tagttgcatacatttttcatgtaacaacacatatgtgttcatgtacatattacataatatatgctagtaaatgat

SEQ ID NO: 176320 - DNA, 75 bp, Artificial Sequence
  Synthetic
tacataatatatgctagtaaatgattacatgcactagtaaatatttgcacatgctaatacataacagtacatgtt

SEQ ID NO: 176321 - DNA, 75 bp, Artificial Sequence
  Synthetic
tacatgcactagtaaatatttgcacatgctaatacataacagtacatgttaataacttttgatctatgccgctac

SEQ ID NO: 176322 - DNA, 75 bp, Artificial Sequence
  Synthetic
atgctaatacataacagtacatgttaataacttttgatctatgccgctacatgttagtacatgctatactgataa

SEQ ID NO: 176323 - DNA, 75 bp, Artificial Sequence
  Synthetic
tctgtaaggtcatgtgtattctatgaatgagtatataaatgggtatgttaatatatgttagtatggttgcaagta

SEQ ID NO: 176324 - DNA, 75 bp, Artificial Sequence
  Synthetic
aatgagtatataaatgggtatgttaatatatgttagtatggttgcaagtaaagatatgttaatgtgtattagtaa

SEQ ID NO: 176325 - DNA, 75 bp, Artificial Sequence
  Synthetic
aattttcaaagaaatgatatagaaatttctaaacatgttattgtggaaaatgtagatcttgtgatctattataat

SEQ ID NO: 176326 - DNA, 75 bp, Artificial Sequence
  Synthetic
tttctaaacatgttattgtggaaaatgtagatcttgtgatctattataataatataaacataaattaaattttta

SEQ ID NO: 176327 - DNA, 75 bp, Artificial Sequence
  Synthetic
tttttcttggggggcatactttttatatgattttatatgtacggaaatatatgtacgtagaataaagaataaaat

SEQ ID NO: 176328 - DNA, 75 bp, Artificial Sequence
  Synthetic
tatgattttatatgtacggaaatatatgtacgtagaataaagaataaaatacttgaaatcaaaccctgttataag

SEQ ID NO: 176329 - DNA, 75 bp, Artificial Sequence
  Synthetic
ataaattttgataatttatgaagatggcataaatgttgaaaatattcatgtgtttgttataagaatttcaatgtt

SEQ ID NO: 176330 - DNA, 75 bp, Artificial Sequence
  Synthetic
ggcataaatgttgaaaatattcatgtgtttgttataagaatttcaatgttactaaaataaaaccaatcactaatt

SEQ ID NO: 176331 - DNA, 75 bp, Artificial Sequence
  Synthetic
ttgtatatattcaaattaaaatttaaaacttatgttttaatcatgtgaaatacagatgtatgaatatgtagcatg

SEQ ID NO: 176332 - DNA, 75 bp, Artificial Sequence
  Synthetic
aaacttatgttttaatcatgtgaaatacagatgtatgaatatgtagcatggaaacttcaaaaatataaatcatat

SEQ ID NO: 176333 - DNA, 75 bp, Artificial Sequence
  Synthetic
agatttacatatttaaatattacataataaaaattttaatatttaaataaaaatatgtattataaatatgttatt

SEQ ID NO: 176334 - DNA, 75 bp, Artificial Sequence
  Synthetic
aataaaaattttaatatttaaataaaaatatgtattataaatatgttatttactagtacagctttataaattaaa

SEQ ID NO: 176335 - DNA, 75 bp, Artificial Sequence
  Synthetic
actaatgaaatgtgcttctatgagttaattgtaaatgtcaattttgtgattttaatatttttctaaataatgaga

SEQ ID NO: 176336 - DNA, 75 bp, Artificial Sequence
  Synthetic
taattgtaaatgtcaattttgtgattttaatatttttctaaataatgagattcaatgttgttaattagatgtgtg

SEQ ID NO: 176337 - DNA, 75 bp, Artificial Sequence
  Synthetic
caaaaatttgtatatatttaaaaatatgttaatcagcatagccttatttataatgattaattttaaattctatgt

SEQ ID NO: 176338 - DNA, 75 bp, Artificial Sequence
  Synthetic
atgttaatcagcatagccttatttataatgattaattttaaattctatgtaattaaatcttatggacaaaataaa

SEQ ID NO: 176339 - DNA, 75 bp, Artificial Sequence
  Synthetic
ataaatgcagtttagaactgatacaattttttttttcaaaaggggtacatacttaaaagattttttacagtggtt

SEQ ID NO: 176340 - DNA, 75 bp, Artificial Sequence
  Synthetic
attttttttttcaaaaggggtacatacttaaaagattttttacagtggttataaaagtattagaaaaggaattaa

SEQ ID NO: 176341 - DNA, 75 bp, Artificial Sequence
  Synthetic
tgcttatggaactataatatatcaaagcaatttatttatgaaaattccaagtctatgaaagtaaagatacccatt

SEQ ID NO: 176342 - DNA, 75 bp, Artificial Sequence
  Synthetic
agcaatttatttatgaaaattccaagtctatgaaagtaaagatacccattcaagtgaaaggctattatagttagg

SEQ ID NO: 176343 - DNA, 75 bp, Artificial Sequence
  Synthetic
tattcaatgtatttttttttaagctatgaaagtaaagatacctattcaagtgaaaggctattatagttaggaggg

SEQ ID NO: 176344 - DNA, 75 bp, Artificial Sequence
  Synthetic
atgaaagtaaagatacctattcaagtgaaaggctattatagttaggagggctagcaatataagaaaacttatatt

SEQ ID NO: 176345 - DNA, 75 bp, Artificial Sequence
  Synthetic
aaatttgataggtctaaaacattttatttataagaaaaaaatgaaaaattttatttcatagatacaataacacag

SEQ ID NO: 176346 - DNA, 75 bp, Artificial Sequence
  Synthetic
atttataagaaaaaaatgaaaaattttatttcatagatacaataacacagatgaaagttacatttataatgtatc

SEQ ID NO: 176347 - DNA, 75 bp, Artificial Sequence
  Synthetic
cagtaagttaaactaatatgtaaaatatttaagtaaaaaaagtataaaaaacttaaggtttatttaaaagtccat

SEQ ID NO: 176348 - DNA, 75 bp, Artificial Sequence
  Synthetic
tatttaagtaaaaaaagtataaaaaacttaaggtttatttaaaagtccatattttataaaagttaatgaaaaaga

SEQ ID NO: 176349 - DNA, 75 bp, Artificial Sequence
  Synthetic
tccatatgcaaaaactacaatttcaacaaaaggaaaagtgatgtttaatagatttgagcattttccaaaaatgga

SEQ ID NO: 176350 - DNA, 75 bp, Artificial Sequence
  Synthetic
acaaaaggaaaagtgatgtttaatagatttgagcattttccaaaaatggatcatatccctgtggataaccttcaa

SEQ ID NO: 176351 - DNA, 75 bp, Artificial Sequence
  Synthetic
atctgtgttttctttcccataattttgagtgtcaacactctgttctaaaataaatgagttcatctcacttacatt

SEQ ID NO: 176352 - DNA, 75 bp, Artificial Sequence
  Synthetic
tgagtgtcaacactctgttctaaaataaatgagttcatctcacttacatttttatttgcatatctcttttttaat

SEQ ID NO: 176353 - DNA, 75 bp, Artificial Sequence
  Synthetic
ttttaatcatttctgtgatttccataaaattatccatgataatatttgttaccatggttttagtctctgaaatgc

SEQ ID NO: 176354 - DNA, 75 bp, Artificial Sequence
  Synthetic
aaaattatccatgataatatttgttaccatggttttagtctctgaaatgctgtcaacctcaataaaattttcttg

SEQ ID NO: 176355 - DNA, 75 bp, Artificial Sequence
  Synthetic
ttttcccgcctatattcttcatcattacttcttattggaataaaatgattattaaaacaataacttgcttgtttg

SEQ ID NO: 176356 - DNA, 75 bp, Artificial Sequence
  Synthetic
tacttcttattggaataaaatgattattaaaacaataacttgcttgtttggtcagttctttattttcatcttttt

SEQ ID NO: 176357 - DNA, 75 bp, Artificial Sequence
  Synthetic
tttatgagtcttacgtaaaaaccacaggcagttttttttaggaacaattttaactctgacacctcttgtcacccc

SEQ ID NO: 176358 - DNA, 75 bp, Artificial Sequence
  Synthetic
aggcagttttttttaggaacaattttaactctgacacctcttgtcaccccccgtatggatctgataggaattgtg

SEQ ID NO: 176359 - DNA, 75 bp, Artificial Sequence
  Synthetic
tttcacagttatcagaattgttaattagttttgatctgtaaggaatagaatctgtagacatctctgtattaaaat

SEQ ID NO: 176360 - DNA, 75 bp, Artificial Sequence
  Synthetic
tagttttgatctgtaaggaatagaatctgtagacatctctgtattaaaattactcatgttttcattgtctgtatc

SEQ ID NO: 176361 - DNA, 75 bp, Artificial Sequence
  Synthetic
ttgcagccctctttaacaattagtttttttttttttgctttgctagttttcaacttgctttcactttttctcttt

SEQ ID NO: 176362 - DNA, 75 bp, Artificial Sequence
  Synthetic
tttttttttttgctttgctagttttcaacttgctttcactttttctctttaattgtttttttttaacagcactga

SEQ ID NO: 176363 - DNA, 75 bp, Artificial Sequence
  Synthetic
actgaaggatgttagactgacactactgaatgtagaatttgtatcagtgctggagctctcactttcatatatggt

SEQ ID NO: 176364 - DNA, 75 bp, Artificial Sequence
  Synthetic
ctgaatgtagaatttgtatcagtgctggagctctcactttcatatatggttgatttatctgtatcataaccatat

SEQ ID NO: 176365 - DNA, 75 bp, Artificial Sequence
  Synthetic
ttgtattatctgtatctctactgttattattggaattctgctccaataaaatcaatccttcagcggccacttttt

SEQ ID NO: 176366 - DNA, 75 bp, Artificial Sequence
  Synthetic
attattggaattctgctccaataaaatcaatccttcagcggccactttttccacatcactttctgtgtcaacatc

SEQ ID NO: 176367 - DNA, 75 bp, Artificial Sequence
  Synthetic
ttagttgaaatatcctttttcttatctctgatgtaaaaggtttcattaggaaatttatctggaataattaaatct

SEQ ID NO: 176368 - DNA, 75 bp, Artificial Sequence
  Synthetic
ctctgatgtaaaaggtttcattaggaaatttatctggaataattaaatcttttccatctttatatttgttttcat

SEQ ID NO: 176369 - DNA, 75 bp, Artificial Sequence
  Synthetic
attggaggttttattgccctgactaacactctgtttatttttaatcatttcttcttgccctgataaagacttatc

SEQ ID NO: 176370 - DNA, 75 bp, Artificial Sequence
  Synthetic
cttcttgccctgataaagacttatctgttttaattttaacatctgttttgtcttcagacagattgtgacctttgt

SEQ ID NO: 176371 - DNA, 75 bp, Artificial Sequence
  Synthetic
catggtaaaaagttcaaagtactgttctttatcttgggtgtccttattaaatattgacctttccatgagtattcc

SEQ ID NO: 176372 - DNA, 75 bp, Artificial Sequence
  Synthetic
tctttatcttgggtgtccttattaaatattgacctttccatgagtattccagctgggctatttgtttttttatct

SEQ ID NO: 176373 - DNA, 75 bp, Artificial Sequence
  Synthetic
catttgaaaatgtcaaagagttattgacgcaaatttcctcagttactgacctttccatgagtattccagcttggt

SEQ ID NO: 176374 - DNA, 75 bp, Artificial Sequence
  Synthetic
aaaggttgtatgaggaaattcatttgaaaagttcaaagagttcttatcttgataagtttcctcatttcttttaag

SEQ ID NO: 176375 - DNA, 75 bp, Artificial Sequence
  Synthetic
tcattgttcttactgactttctgtttgtttttaatagtctttctctgtcctgttagaatttgatctgctttagta

SEQ ID NO: 176376 - DNA, 75 bp, Artificial Sequence
  Synthetic
tgtttttaatagtctttctctgtcctgttagaatttgatctgctttagtatccctgcagcttttcatagtagcct

SEQ ID NO: 176377 - DNA, 75 bp, Artificial Sequence
  Synthetic
tgcttcggaaagccccgtctcattttttatagcattcacttcagaatttttctcaactgagattataggattatc

SEQ ID NO: 176378 - DNA, 75 bp, Artificial Sequence
  Synthetic
tttatagcattcacttcagaatttttctcaactgagattataggattatcagataagaatctgcaaatagtattc

SEQ ID NO: 176379 - DNA, 75 bp, Artificial Sequence
  Synthetic
cttcagaaacatttacctcactttcttcagtactcattccaggatttgtttcagctggatacatgagacagtcag

SEQ ID NO: 176380 - DNA, 75 bp, Artificial Sequence
  Synthetic
ttcagtactcattccaggatttgtttcagctggatacatgagacagtcaggtgagtcttttgaaacaaccttttt

SEQ ID NO: 176381 - DNA, 75 bp, Artificial Sequence
  Synthetic
tcaaagaaatctaatttatattctctggtacaaacttcaggattttttccagttgtgtttttagagtgtgattca

SEQ ID NO: 176382 - DNA, 75 bp, Artificial Sequence
  Synthetic
tggtacaaacttcaggattttttccagttgtgtttttagagtgtgattcatctgatgcttgtgaaacagccagag

SEQ ID NO: 176383 - DNA, 75 bp, Artificial Sequence
  Synthetic
tgaaaaatttgattgaacattgtactgttcagactttgaaacacactgtgtaggactgacattctgatgtacact

SEQ ID NO: 176384 - DNA, 75 bp, Artificial Sequence
  Synthetic
tgttcagactttgaaacacactgtgtaggactgacattctgatgtacactttggtaggattgttcagatgtttca

SEQ ID NO: 176385 - DNA, 75 bp, Artificial Sequence
  Synthetic
aatcattaaaatcttcaatttctggtggagtcgagtcagaattatataagtgtgactcaagcaaagtggaagagt

SEQ ID NO: 176386 - DNA, 75 bp, Artificial Sequence
  Synthetic
tggagtcgagtcagaattatataagtgtgactcaagcaaagtggaagagtgatgtccatttcctgtgacatatcc

SEQ ID NO: 176387 - DNA, 75 bp, Artificial Sequence
  Synthetic
actgtaacttctcctgtgacatcatatagcttttctatttgatcacaagcatcattaatcatatgcataagtgtg

SEQ ID NO: 176388 - DNA, 75 bp, Artificial Sequence
  Synthetic
atagcttttctatttgatcacaagcatcattaatcatatgcataagtgtgatcttaaattcttttctatttgccc

SEQ ID NO: 176389 - DNA, 75 bp, Artificial Sequence
  Synthetic
agagcatattacaatacactgcagtacagcagctcctaggttttttgctgcctctattaaatttatacaattgaa

SEQ ID NO: 176390 - DNA, 75 bp, Artificial Sequence
  Synthetic
acagcagctcctaggttttttgctgcctctattaaatttatacaattgaaatgtattttaaggaatgtttcgtca

SEQ ID NO: 176391 - DNA, 75 bp, Artificial Sequence
  Synthetic
tctgtttgattgcaaagtctttcatagtttgagctattctgctgtttttttcaattatttcaaatttacattcca

SEQ ID NO: 176392 - DNA, 75 bp, Artificial Sequence
  Synthetic
agtttgagctattctgctgtttttttcaattatttcaaatttacattccaacaaatcttttttaatcttatttgt

SEQ ID NO: 176393 - DNA, 75 bp, Artificial Sequence
  Synthetic
atgtttatatctgttatgtctctgttttttcccatcattaataacattgttgcacatctgttaagtttctcatta

SEQ ID NO: 176394 - DNA, 75 bp, Artificial Sequence
  Synthetic
tttttcccatcattaataacattgttgcacatctgttaagtttctcattactgcttataaagttgcccatactta

SEQ ID NO: 176395 - DNA, 75 bp, Artificial Sequence
  Synthetic
ttctctatccatattatttctcaaatctgataaatattctctacaatctgcaatcacttttttaacaatttcatc

SEQ ID NO: 176396 - DNA, 75 bp, Artificial Sequence
  Synthetic
tctgataaatattctctacaatctgcaatcacttttttaacaatttcatcaaatttatcacaggcatatacagtg

SEQ ID NO: 176397 - DNA, 75 bp, Artificial Sequence
  Synthetic
attctaattgttctccagataagatatcttcataaaaagatataaatccagaggaagcaccactaattaaattaa

SEQ ID NO: 176398 - DNA, 75 bp, Artificial Sequence
  Synthetic
atcttcataaaaagatataaatccagaggaagcaccactaattaaattaacatttagcatctgagataattgttc

SEQ ID NO: 176399 - DNA, 75 bp, Artificial Sequence
  Synthetic
ctgtcattcgttaaaattccagcgtggttaattaaacaatcttcaatgtctgctttttcctgatccatggcagca

SEQ ID NO: 176400 - DNA, 75 bp, Artificial Sequence
  Synthetic
ggttaattaaacaatcttcaatgtctgctttttcctgatccatggcagcattcacggatttaagaataccttgga

SEQ ID NO: 176401 - DNA, 75 bp, Artificial Sequence
  Synthetic
aatttaaagaaaaaagtctaaatatgaaatctgtacacatatatcatattttatatgtaagaaaatgaaaaaaaa

SEQ ID NO: 176402 - DNA, 75 bp, Artificial Sequence
  Synthetic
gaaatctgtacacatatatcatattttatatgtaagaaaatgaaaaaaaaatacctgctgccagtttaatatccg

SEQ ID NO: 176403 - DNA, 75 bp, Artificial Sequence
  Synthetic
ggaataggaagcatttgccgttgcaatatcattagatgatattgagtcaaggaaatcaaaagaatccaattcttg

SEQ ID NO: 176404 - DNA, 75 bp, Artificial Sequence
  Synthetic
atatcattagatgatattgagtcaaggaaatcaaaagaatccaattcttggaagagagtattatcaaaggaaggg

SEQ ID NO: 176405 - DNA, 75 bp, Artificial Sequence
  Synthetic
tgtctctgatggtctcttccacggtggtatctgggtgatatctgtaataaaatttataaattttattacagagaa

SEQ ID NO: 176406 - DNA, 75 bp, Artificial Sequence
  Synthetic
ggtatctgggtgatatctgtaataaaatttataaattttattacagagaaattaaatctgtcttttttgtattaa

SEQ ID NO: 176407 - DNA, 75 bp, Artificial Sequence
  Synthetic
tgtctttcgtcattcgatgccatggtttcagatggttgtccaacaatcaacataggtgaagtagctccacttctt

SEQ ID NO: 176408 - DNA, 75 bp, Artificial Sequence
  Synthetic
tttcagatggttgtccaacaatcaacataggtgaagtagctccacttctttccatagttttatctgtatgtttag

SEQ ID NO: 176409 - DNA, 75 bp, Artificial Sequence
  Synthetic
agaaatattaaccccattccaaactcaatataaggccagcctaaaaatactttcaagcagagttttaaaactctg

SEQ ID NO: 176410 - DNA, 75 bp, Artificial Sequence
  Synthetic
caatataaggccagcctaaaaatactttcaagcagagttttaaaactctgcttgaaaaaaatgtatactctggaa

SEQ ID NO: 176411 - DNA, 75 bp, Artificial Sequence
  Synthetic
aacttacttattggatcattttggcaatattatttgtttttttaataataactggatctgtattaattgtaattg

SEQ ID NO: 176412 - DNA, 75 bp, Artificial Sequence
  Synthetic
aatattatttgtttttttaataataactggatctgtattaattgtaattgaaactctgtcaattcaaagaacgac

SEQ ID NO: 176413 - DNA, 75 bp, Artificial Sequence
  Synthetic
agtactgttgttccagaattaacatctaattctccaggtttgttcagctataaaatgtcattgtttaaaaaaaaa

SEQ ID NO: 176414 - DNA, 75 bp, Artificial Sequence
  Synthetic
ctaattctccaggtttgttcagctataaaatgtcattgtttaaaaaaaaagtttgtaactctgttaatatgaata

SEQ ID NO: 176415 - DNA, 75 bp, Artificial Sequence
  Synthetic
tgacaaatttttctgcaagttctaaaccaactcttagcagtaaacaacccggatggatacaggcactaactacag

SEQ ID NO: 176416 - DNA, 75 bp, Artificial Sequence
  Synthetic
accaactcttagcagtaaacaacccggatggatacaggcactaactacagcttttggaattttaacactgttttc

SEQ ID NO: 176417 - DNA, 75 bp, Artificial Sequence
  Synthetic
aatttttggctaactgagaaaaatgacaaaactgcaaatccaacagaatactactcagaagacatattagattat

SEQ ID NO: 176418 - DNA, 75 bp, Artificial Sequence
  Synthetic
acaaaactgcaaatccaacagaatactactcagaagacatattagattatacaaatccaagttttacagaaattg

SEQ ID NO: 176419 - DNA, 75 bp, Artificial Sequence
  Synthetic
ttgcttcagaaataacaaaattgtaagtaaatttacttgattttcttacactatgagatatttaatggttttaaa

SEQ ID NO: 176420 - DNA, 75 bp, Artificial Sequence
  Synthetic
agtaaatttacttgattttcttacactatgagatatttaatggttttaaaatagaaaatgtcagagtttaaagta

SEQ ID NO: 176421 - DNA, 75 bp, Artificial Sequence
  Synthetic
aaatgtgtcttacaactagaaaataactttaaattattattagtattgtaataatttaaaattattaatattagt

SEQ ID NO: 176422 - DNA, 75 bp, Artificial Sequence
  Synthetic
actttaaattattattagtattgtaataatttaaaattattaatattagtattgtaataatttaaaattaataat

SEQ ID NO: 176423 - DNA, 75 bp, Artificial Sequence
  Synthetic
atataaaaaaaataaatttaaaatttatattaaatgattttaaatttacttaccagatggcagcgatatattgga

SEQ ID NO: 176424 - DNA, 75 bp, Artificial Sequence
  Synthetic
tatattaaatgattttaaatttacttaccagatggcagcgatatattggaaattctgtgtagcagaactgtatct

SEQ ID NO: 176425 - DNA, 75 bp, Artificial Sequence
  Synthetic
aaatagttgatctgtcttcttattatatacattttgaagcggatgtgatgcacaggaaaatgacgttaatatatc

SEQ ID NO: 176426 - DNA, 75 bp, Artificial Sequence
  Synthetic
tataatactaaaaaaattagggtttaaccttatttgtacatgtatttttttaaaatattatttttccaataaaaa

SEQ ID NO: 176427 - DNA, 75 bp, Artificial Sequence
  Synthetic
aaccttatttgtacatgtatttttttaaaatattatttttccaataaaaaccacaatggatttatattttacgta

SEQ ID NO: 176428 - DNA, 75 bp, Artificial Sequence
  Synthetic
taaaatattatttttccaataaaaaccacaatggatttatattttacgtaaacatgatttttgcggttattttat

SEQ ID NO: 176429 - DNA, 75 bp, Artificial Sequence
  Synthetic
aacaacaggaattgcggttgtcttctcagcaagttctacacattcccactcgctttaggcaggaaagaccccaac

SEQ ID NO: 176430 - DNA, 75 bp, Artificial Sequence
  Synthetic
ccgtttaggcaggaaagaccccaaccacataacccactgacatttaaacccgtgaaaacaacaggaactgcggtt

SEQ ID NO: 176431 - DNA, 75 bp, Artificial Sequence
  Synthetic
aaacccgtgaaaacaacaggaactgcggttgccttctcagcaggttttatgggttctcacccgtttaggcaggaa

SEQ ID NO: 176432 - DNA, 75 bp, Artificial Sequence
  Synthetic
aaacaacaggaactgcggttgacttctcagcaggttttatgggttctcacccgtttaggtaggaaagacccagac

SEQ ID NO: 176433 - DNA, 75 bp, Artificial Sequence
  Synthetic
ctcagcaggttttatgggttctcacccgtttaggtaggaaagacccagaccgcataacccactaacattttaata

SEQ ID NO: 176434 - DNA, 75 bp, Artificial Sequence
  Synthetic
tgtgaaaataaacaggaactgcggttatagtttcagtacattctagagattacatcctgctaaggcgaaaaacac

SEQ ID NO: 176435 - DNA, 75 bp, Artificial Sequence
  Synthetic
tatagtttcagtacattctagagattacatcctgctaaggcgaaaaacactttaaccgcaaaagccactgatttt

SEQ ID NO: 176436 - DNA, 75 bp, Artificial Sequence
  Synthetic
cacagaaacgtcaggaaaaaaacgttgttttataattatgtccataaaacatgcaacataatccaaaccggccaa

SEQ ID NO: 176437 - DNA, 75 bp, Artificial Sequence
  Synthetic
tgttttataattatgtccataaaacatgcaacataatccaaaccggccaatgatttttctgcttaaatgtaattt

SEQ ID NO: 176438 - DNA, 75 bp, Artificial Sequence
  Synthetic
ttatagccacgcctacgcagcaatgtatataagcagacaccgtcatttcgcagttagtctgctggaaagcttgtg

SEQ ID NO: 176439 - DNA, 75 bp, Artificial Sequence
  Synthetic
tatataagcagacaccgtcatttcgcagttagtctgctggaaagcttgtgaagactacataaaggtaaaaatttg

SEQ ID NO: 176440 - DNA, 75 bp, Artificial Sequence
  Synthetic
acattattttagtttaaaaaatccaaaattcttaatagaaatttattgtgaaatttaaaagattttgtaaatatg

SEQ ID NO: 176441 - DNA, 75 bp, Artificial Sequence
  Synthetic
gtaaaatatcaaaaaaatttaaaattaatttattctgaagtttaacattttttaaatatgtatttaattattact

SEQ ID NO: 176442 - DNA, 75 bp, Artificial Sequence
  Synthetic
gatacattgcgtaggtttggaaatgtgtttcgaaaattgctgtaaaaattattgactcttttttaaatttataga

SEQ ID NO: 176443 - DNA, 75 bp, Artificial Sequence
  Synthetic
tgtttcgaaaattgctgtaaaaattattgactcttttttaaatttatagaacattggatgtaattgcacattcct

SEQ ID NO: 176444 - DNA, 75 bp, Artificial Sequence
  Synthetic
gtaagtcaatttatatgtattgattttaaatggcctccaataaatatttttagccagtttaatgtaaaacaaagc

SEQ ID NO: 176445 - DNA, 75 bp, Artificial Sequence
  Synthetic
ttaaatggcctccaataaatatttttagccagtttaatgtaaaacaaagcataaagtttatgtagttttaaaatg

SEQ ID NO: 176446 - DNA, 75 bp, Artificial Sequence
  Synthetic
taaagacagtatctattaagaatttaaatgcagttctatggctttaaaaatttgtacgttttatttgaaaagttt

SEQ ID NO: 176447 - DNA, 75 bp, Artificial Sequence
  Synthetic
aaatgcagttctatggctttaaaaatttgtacgttttatttgaaaagtttgctctatttgaaatcaaatgtttta

SEQ ID NO: 176448 - DNA, 75 bp, Artificial Sequence
  Synthetic
gaaatatgtttcatttataataggtatttttctgtttctaaaaatagatgataaaagtcactagatagaaaatat

SEQ ID NO: 176449 - DNA, 75 bp, Artificial Sequence
  Synthetic
atttttctgtttctaaaaatagatgataaaagtcactagatagaaaatatcttataaattgttatttagtagaat

SEQ ID NO: 176450 - DNA, 75 bp, Artificial Sequence
  Synthetic
acaaagtacatgactttagaaagccaactaaatgcattattatttaaaaattacagaatcaacgagtaatgtcac

SEQ ID NO: 176451 - DNA, 75 bp, Artificial Sequence
  Synthetic
aactaaatgcattattatttaaaaattacagaatcaacgagtaatgtcactatagttttttaaagtaacttttaa

SEQ ID NO: 176452 - DNA, 75 bp, Artificial Sequence
  Synthetic
agaaggatggagagtggggatagtttcggaaataatcaccaagtctcatcgaattcagatgcttttcaattccgg

SEQ ID NO: 176453 - DNA, 75 bp, Artificial Sequence
  Synthetic
tcggaaataatcaccaagtctcatcgaattcagatgcttttcaattccggcaatattcaacaactgtagatactt

SEQ ID NO: 176454 - DNA, 75 bp, Artificial Sequence
  Synthetic
aaattgcatgcttaatgaacaaactcatttagaaacggtactagtttatcctgtttacaacatgtcttcccagca

SEQ ID NO: 176455 - DNA, 75 bp, Artificial Sequence
  Synthetic
catttagaaacggtactagtttatcctgtttacaacatgtcttcccagcaaacagtggagagaaatctctatgcc

SEQ ID NO: 176456 - DNA, 75 bp, Artificial Sequence
  Synthetic
tgagttattgtagacaagatagtttgcaaggaaaccaaggaacatattttccaacatatcagggatttcactcaa

SEQ ID NO: 176457 - DNA, 75 bp, Artificial Sequence
  Synthetic
gaattttaattttggcaccaatgtcatcaggcctataccatttagaaatgagggagtagacgcatcaacatccaa

SEQ ID NO: 176458 - DNA, 75 bp, Artificial Sequence
  Synthetic
acaacgatgcaaatacagtttagtcagccatctgcttttcaaacttattctttaatgaatggaaattttagtgaa

SEQ ID NO: 176459 - DNA, 75 bp, Artificial Sequence
  Synthetic
agccatctgcttttcaaacttattctttaatgaatggaaattttagtgaaaatggttatggatacaatactaaga

SEQ ID NO: 176460 - DNA, 75 bp, Artificial Sequence
  Synthetic
tgttgagcaagagtctgtagactcaaaatatccaaacaaagaagttagtatctcttatcaaagaaatgaacatta

SEQ ID NO: 176461 - DNA, 75 bp, Artificial Sequence
  Synthetic
aaatatccaaacaaagaagttagtatctcttatcaaagaaatgaacattatgatgagaatctcccgacgagagag

SEQ ID NO: 176462 - DNA, 75 bp, Artificial Sequence
  Synthetic
atcaaagttctgtgttacagcacacctttgcgaatgtccaaagcattatttcacagcaaagtccatatcagttga

SEQ ID NO: 176463 - DNA, 75 bp, Artificial Sequence
  Synthetic
ctttgcgaatgtccaaagcattatttcacagcaaagtccatatcagttgattggaaaagaaaacagctttaacaa

SEQ ID NO: 176464 - DNA, 75 bp, Artificial Sequence
  Synthetic
agtgattgtcaatctaacggggggcctaaaattggcctagacacagatcaatctgttttttcagatgaagtgact

SEQ ID NO: 176465 - DNA, 75 bp, Artificial Sequence
  Synthetic
ctaaaattggcctagacacagatcaatctgttttttcagatgaagtgactggggcgtgtgtagaaaatgttcatt

SEQ ID NO: 176466 - DNA, 75 bp, Artificial Sequence
  Synthetic
tgtaaataacatatcacttgatgtacaaactgaatttcctgtgactgagaatcctcttgtaggagaaagtcaggc

SEQ ID NO: 176467 - DNA, 75 bp, Artificial Sequence
  Synthetic
caaactgaatttcctgtgactgagaatcctcttgtaggagaaagtcaggctacaaagaacaaggatgtggacagt

SEQ ID NO: 176468 - DNA, 75 bp, Artificial Sequence
  Synthetic
aatatcgtctattgaaacgcaatattacaccgaccatgggtaatattaaacatttaaattttagttgcaagatat

SEQ ID NO: 176469 - DNA, 75 bp, Artificial Sequence
  Synthetic
tacaccgaccatgggtaatattaaacatttaaattttagttgcaagatatctaccgaagaagaaaggaaaacatt

SEQ ID NO: 176470 - DNA, 75 bp, Artificial Sequence
  Synthetic
aaaataagggatgatataaaaaacactaaaatttcttcaaaagtggattttattcaatctgaagcttctacatca

SEQ ID NO: 176471 - DNA, 75 bp, Artificial Sequence
  Synthetic
ctaaaatttcttcaaaagtggattttattcaatctgaagcttctacatcattggacatttgtaaaaatacattca

SEQ ID NO: 176472 - DNA, 75 bp, Artificial Sequence
  Synthetic
ggacactgatatccttgcagacaacccattagtgatatgtgaaaatgaactgatttgtgataacaatgaggaaaa

SEQ ID NO: 176473 - DNA, 75 bp, Artificial Sequence
  Synthetic
ccattagtgatatgtgaaaatgaactgatttgtgataacaatgaggaaaacatcaagtttccgcctaacgttgaa

SEQ ID NO: 176474 - DNA, 75 bp, Artificial Sequence
  Synthetic
ttaaacgcagctttccagaaatctgtccagagcattttaaaaaaagaagatttataaatggtgatgtgatttatg

SEQ ID NO: 176475 - DNA, 75 bp, Artificial Sequence
  Synthetic
tccagagcattttaaaaaaagaagatttataaatggtgatgtgatttatgaagatttaaattctgtttataaagt

SEQ ID NO: 176476 - DNA, 75 bp, Artificial Sequence
  Synthetic
gatgtgcgtttcggagaagtggattatcaaacctcttcggctcagacaaaaatttccaaccaccagttagcgttg

SEQ ID NO: 176477 - DNA, 75 bp, Artificial Sequence
  Synthetic
atcaaacctcttcggctcagacaaaaatttccaaccaccagttagcgttgttgccaacaaattatcagcacatga

SEQ ID NO: 176478 - DNA, 75 bp, Artificial Sequence
  Synthetic
gcgggattatcacaatgacagtgctcaaattatttacaattgctcatttcaacgacagggaaaaaggcttcttgc

SEQ ID NO: 176479 - DNA, 75 bp, Artificial Sequence
  Synthetic
caaattatttacaattgctcatttcaacgacagggaaaaaggcttcttgctgatattccatatagaccttggtta

SEQ ID NO: 176480 - DNA, 75 bp, Artificial Sequence
  Synthetic
atggaaaaagatttgtcaaaacagtccctagaccagccagtgtttttatttttggaagatgtcgaaaaaaaatgc

SEQ ID NO: 176481 - DNA, 75 bp, Artificial Sequence
  Synthetic
ccctagaccagccagtgtttttatttttggaagatgtcgaaaaaaaatgctgagggaaagcgttaaatcttttat

SEQ ID NO: 176482 - DNA, 75 bp, Artificial Sequence
  Synthetic
aaagaaagtctagaagcatatgtacttagaaattgtaacaagtttttagatttgagttggccgatacgacacaag

SEQ ID NO: 176483 - DNA, 75 bp, Artificial Sequence
  Synthetic
ttagaaattgtaacaagtttttagatttgagttggccgatacgacacaagatctatattatgcctgatgtgagta

SEQ ID NO: 176484 - DNA, 75 bp, Artificial Sequence
  Synthetic
gaatttatttcccgtaccggaaggctggatggtaactctaggttttgtaggaacagaagaaccggtgaccaaaat

SEQ ID NO: 176485 - DNA, 75 bp, Artificial Sequence
  Synthetic
tggatggtaactctaggttttgtaggaacagaagaaccggtgaccaaaatttataacattgctgtattgttatgt

SEQ ID NO: 176486 - DNA, 75 bp, Artificial Sequence
  Synthetic
agaatgataaagtggaacctgaactttatttagctgcttcgaatctcaatgaacttatagaggatggactggcac

SEQ ID NO: 176487 - DNA, 75 bp, Artificial Sequence
  Synthetic
ttatttagctgcttcgaatctcaatgaacttatagaggatggactggcacgctgtgattgtatttacgagaaaag

SEQ ID NO: 176488 - DNA, 75 bp, Artificial Sequence
  Synthetic
gaaggaaaattaagacagtttatggacaattttggctcactgcaaagtgtgctagcctacagaaagtatttacat

SEQ ID NO: 176489 - DNA, 75 bp, Artificial Sequence
  Synthetic
acaattttggctcactgcaaagtgtgctagcctacagaaagtatttacatggttttctgtgggcttttaatggca

SEQ ID NO: 176490 - DNA, 75 bp, Artificial Sequence
  Synthetic
gttccatacttgtgtacctggggttcataatgcccttcccttagatgctgtgattaaacatgaaaataatccctt

SEQ ID NO: 176491 - DNA, 75 bp, Artificial Sequence
  Synthetic
cataatgcccttcccttagatgctgtgattaaacatgaaaataatcccttgtatttcattggatatgtaaccacc

SEQ ID NO: 176492 - DNA, 75 bp, Artificial Sequence
  Synthetic
ctaatgttttcatcgcggtagatggaaatttaagcatttatggctatcatcttatatctcaaaaaacttggtttc

SEQ ID NO: 176493 - DNA, 75 bp, Artificial Sequence
  Synthetic
aaatttaagcatttatggctatcatcttatatctcaaaaaacttggtttctagcaaaaacattttcaacttttct

SEQ ID NO: 176494 - DNA, 75 bp, Artificial Sequence
  Synthetic
tatgattatgagattccacttaaaattcatttaggagatagtgcagattcatttctgtcttgttttaaaaatgcc

SEQ ID NO: 176495 - DNA, 75 bp, Artificial Sequence
  Synthetic
tacttagaaagcaatttcctaaaccttagattgttaaaacttggataaccaaactatattgaattatgtatatct

SEQ ID NO: 176496 - DNA, 75 bp, Artificial Sequence
  Synthetic
aacatttttgaagcttaaataaagagtgttttcaaatatctctgttttgtctctttacagaggacttgaaaaatt

SEQ ID NO: 176497 - DNA, 75 bp, Artificial Sequence
  Synthetic
gtgttttcaaatatctctgttttgtctctttacagaggacttgaaaaattttttactgtctttagaacttgcgaa

SEQ ID NO: 176498 - DNA, 75 bp, Artificial Sequence
  Synthetic
taacgcatctccacagtggtgcaggtcgcttcgtaaatataatcaaaaaattcttctacttctagtagttttggt

SEQ ID NO: 176499 - DNA, 75 bp, Artificial Sequence
  Synthetic
gtcggatcttcattggcgccataatttgaattaattctagcagcttttattccttcccaactaaaagagaaaatg

SEQ ID NO: 176500 - DNA, 75 bp, Artificial Sequence
  Synthetic
gcattccttggaaaaatgatgctcacctgaaggctttgtttaaatcaatccacggtggcattggttgagtctttg

SEQ ID NO: 176501 - DNA, 75 bp, Artificial Sequence
  Synthetic
cctgaaggctttgtttaaatcaatccacggtggcattggttgagtctttgtaggtttgttgttaggcgtaggttt

SEQ ID NO: 176502 - DNA, 75 bp, Artificial Sequence
  Synthetic
gtatatataggagtgcagtatgtaatacctccggcctgatatatgctgcgaacgagaaattaagaaatgagtttg

SEQ ID NO: 176503 - DNA, 75 bp, Artificial Sequence
  Synthetic
tacctccggcctgatatatgctgcgaacgagaaattaagaaatgagtttgtttctaagacgaaaagtattgtccc

SEQ ID NO: 176504 - DNA, 75 bp, Artificial Sequence
  Synthetic
gtcgtcacatgtcagttctatcacatcaccgtctgtaaatcgcaagtattcatcacagcaggattctagtttagg

SEQ ID NO: 176505 - DNA, 75 bp, Artificial Sequence
  Synthetic
tcaccgtctgtaaatcgcaagtattcatcacagcaggattctagtttaggtaattgaagttcgctagctagaatt

SEQ ID NO: 176506 - DNA, 75 bp, Artificial Sequence
  Synthetic
ttaatctatatatgcacatcatggacgcattttatggcttcgagctatacactcttttgttttattcatttcttt

SEQ ID NO: 176507 - DNA, 75 bp, Artificial Sequence
  Synthetic
cgcattttatggcttcgagctatacactcttttgttttattcatttctttaatactttgtattttatagaaacta

SEQ ID NO: 176508 - DNA, 75 bp, Artificial Sequence
  Synthetic
ttattaaccacccataacattttgtaacttttcggatacagtattgttaaaggcttgagttatatttccactgtt

SEQ ID NO: 176509 - DNA, 75 bp, Artificial Sequence
  Synthetic
aacttttcggatacagtattgttaaaggcttgagttatatttccactgttacacagttgagcatttaaagatttg

SEQ ID NO: 176510 - DNA, 75 bp, Artificial Sequence
  Synthetic
ggtcatctttttttaagaaagtcaataacagcgtatcaatagtgagtagtcttccgttgtcaaactctgtttttg

SEQ ID NO: 176511 - DNA, 75 bp, Artificial Sequence
  Synthetic
taacagcgtatcaatagtgagtagtcttccgttgtcaaactctgtttttgcactgtcggttttaattttaattga

SEQ ID NO: 176512 - DNA, 75 bp, Artificial Sequence
  Synthetic
agttttcttgttagattcttatcccccccccccccgacaggagagttttcaaattaccaaggtccgaaatcttta

SEQ ID NO: 176513 - DNA, 75 bp, Artificial Sequence
  Synthetic
ccccccccccgacaggagagttttcaaattaccaaggtccgaaatctttagatggtgttagtagtacatcgtatt

SEQ ID NO: 176514 - DNA, 75 bp, Artificial Sequence
  Synthetic
tggaaagtcttgccacatagcacttacgatggctggatcgaattctctaggatgaagaagcgaaaattagattat

SEQ ID NO: 176515 - DNA, 75 bp, Artificial Sequence
  Synthetic
acgatggctggatcgaattctctaggatgaagaagcgaaaattagattatatctagttttgctttctaagttaat

SEQ ID NO: 176516 - DNA, 75 bp, Artificial Sequence
  Synthetic
aacgactgtcggtgcggatgtggaaacatgtcttgtacagtcttttgtccaatagtgtcgaataagcgttctatt

SEQ ID NO: 176517 - DNA, 75 bp, Artificial Sequence
  Synthetic
acatgtcttgtacagtcttttgtccaatagtgtcgaataagcgttctatttctagtagtgctattggaaaaagac

SEQ ID NO: 176518 - DNA, 75 bp, Artificial Sequence
  Synthetic
tctctccagtttttaaatttcgagtaataaaagacacttgcttttcttacattacggtggtgacgtagtttcgtg

SEQ ID NO: 176519 - DNA, 75 bp, Artificial Sequence
  Synthetic
aataaaagacacttgcttttcttacattacggtggtgacgtagtttcgtgcagttgtatcgtttttaggcgagca

SEQ ID NO: 176520 - DNA, 75 bp, Artificial Sequence
  Synthetic
aatctaaaaaaaaaaatattgtcaactcaacctttttgtcattttgttgattgcatgtatgtgcggttttcctct

SEQ ID NO: 176521 - DNA, 75 bp, Artificial Sequence
  Synthetic
ctcaacctttttgtcattttgttgattgcatgtatgtgcggttttcctcttttttagtgtgcttgttaatatgag

SEQ ID NO: 176522 - DNA, 75 bp, Artificial Sequence
  Synthetic
tgtagtgtttgttaagcacctttcgtccgtgggtatctgtctaataatgtctatgtctctccagggttcgatggt

SEQ ID NO: 176523 - DNA, 75 bp, Artificial Sequence
  Synthetic
tccgtgggtatctgtctaataatgtctatgtctctccagggttcgatggttgtctctgtccagggatgttctgac

SEQ ID NO: 176524 - DNA, 75 bp, Artificial Sequence
  Synthetic
ctcgacttttgttcttatccgggcaacaagcgtcatacaatggtttttctgaagtcatgttcactttaggtatgt

SEQ ID NO: 176525 - DNA, 75 bp, Artificial Sequence
  Synthetic
acaagcgtcatacaatggtttttctgaagtcatgttcactttaggtatgttaaaatcttcttctttccattgtga

SEQ ID NO: 176526 - DNA, 75 bp, Artificial Sequence
  Synthetic
tagcccttgttgtcttttcggacgattgccagtgatatttgtgtccgaaaggctattccgctgtagctacgcatc

SEQ ID NO: 176527 - DNA, 75 bp, Artificial Sequence
  Synthetic
ttgccagtgatatttgtgtccgaaaggctattccgctgtagctacgcatctttttaaaatctgcgcgtatctgta

SEQ ID NO: 176528 - DNA, 75 bp, Artificial Sequence
  Synthetic
attcaaattcttggagaaaaaaataactatagatagtacctttttttgcttaccattgagcagacgactgggtgt

SEQ ID NO: 176529 - DNA, 75 bp, Artificial Sequence
  Synthetic
actatagatagtacctttttttgcttaccattgagcagacgactgggtgtattgctcacgtctttcccaacggtg

SEQ ID NO: 176530 - DNA, 75 bp, Artificial Sequence
  Synthetic
gtcaaaatgtttgcggtgttcattcttttcacatacaacaaactgttttgtttacttccgaatcctccattaagt

SEQ ID NO: 176531 - DNA, 75 bp, Artificial Sequence
  Synthetic
ttttcacatacaacaaactgttttgtttacttccgaatcctccattaagtagagaatagtgtaagcctgtagtta

SEQ ID NO: 176532 - DNA, 75 bp, Artificial Sequence
  Synthetic
actcataattttttctcttaatccgcgcactcccaatgagttctcttttagtggaatgcagagtgttgtttctaa

SEQ ID NO: 176533 - DNA, 75 bp, Artificial Sequence
  Synthetic
cgcactcccaatgagttctcttttagtggaatgcagagtgttgtttctaataatataacccttagaagaattaaa

SEQ ID NO: 176534 - DNA, 75 bp, Artificial Sequence
  Synthetic
aaagctcttcaaagtcgtcatattgtagaaatcagtgtaaccatttttacttactgtgcttcgtctggccattca

SEQ ID NO: 176535 - DNA, 75 bp, Artificial Sequence
  Synthetic
tagaaatcagtgtaaccatttttacttactgtgcttcgtctggccattcacattcgcaggaaaacgatgtacatc

SEQ ID NO: 176536 - DNA, 75 bp, Artificial Sequence
  Synthetic
ttcctcggaacttagaccaatatatctagtagagcttgcgttgtgcatgttttcatttattaagttttcgattat

SEQ ID NO: 176537 - DNA, 75 bp, Artificial Sequence
  Synthetic
tttcatttattaagttttcgattatatcttctagagttattgccgtgcgtgctttttcaagtgggaccgtattgg

SEQ ID NO: 176538 - DNA, 75 bp, Artificial Sequence
  Synthetic
aattatataatgcagttgcaccattatctgcgaagagattttttttgcagcgtctttatgtgcaggcttattccc

SEQ ID NO: 176539 - DNA, 75 bp, Artificial Sequence
  Synthetic
ctaaccctagctctaagcctaaccccagccctaaccctaaccctagctctaagcctaaccccaaccctaacccta

SEQ ID NO: 176540 - DNA, 75 bp, Artificial Sequence
  Synthetic
aaaaaaaaacaatccacatactctagaacaaactgtacccaaaaataagtccgtgtgcaaaactgggaaaaaaaa

SEQ ID NO: 176541 - DNA, 75 bp, Artificial Sequence
  Synthetic
ctaagcctaaccctaaccgtagctctaagtttaaccctaaccctaaccctaaccatgaccctgaccctaacccta

SEQ ID NO: 176542 - DNA, 75 bp, Artificial Sequence
  Synthetic
cactggcagccaatgtcttgtaatgccttcaaggcactttttctgcgagccgcgcgcagcactcagtgaaaaaca

SEQ ID NO: 176543 - DNA, 75 bp, Artificial Sequence
  Synthetic
ccccccgtttcgtatttcaaatcctaaataacccccggggggtaaaaaaagggggggagctaaccctaaccctag

SEQ ID NO: 176544 - DNA, 75 bp, Artificial Sequence
  Synthetic
aaataacccccggggggtaaaaaaagggggggagctaaccctaaccctagctctaaccctaaccctaaccctagc

SEQ ID NO: 176545 - DNA, 75 bp, Artificial Sequence
  Synthetic
ctaaccctgaccctaaccctaagtctaaccctgaccctaaccctaaccctaaccctagctctaaccctaacccta

SEQ ID NO: 176546 - DNA, 75 bp, Artificial Sequence
  Synthetic
gctctaaccctaaccctaaccctaaccctagccctaaccctaaccctaaccctaaccctaaccctaaccctaacc

SEQ ID NO: 176547 - DNA, 75 bp, Artificial Sequence
  Synthetic
cctaaccctaaccctaaccctaaccctaaccctaaccctaaccctaggtctaaccctaaccctaaccctaagtct

SEQ ID NO: 176548 - DNA, 75 bp, Artificial Sequence
  Synthetic
taaccctaaccctaaccctaagtctaaccctaaccctaagtctaaccctaaccctaaccctaaccctaaccctaa

SEQ ID NO: 176549 - DNA, 75 bp, Artificial Sequence
  Synthetic
ctaaccctaaccctaaccctaaccctaagtctaaccctaaccctaagtctaaccctaactctaagtctaacccta

SEQ ID NO: 176550 - DNA, 75 bp, Artificial Sequence
  Synthetic
taaccctaaccctaaccctaaccctaaccctaaccctaaccctaaccctaaccctaaccctaaccctaaccctaa

SEQ ID NO: 176551 - DNA, 75 bp, Artificial Sequence
  Synthetic
ctaaccctaaccctaaccctaaccctaaccctaaccctaagtctaaccctaaccctaagtctaaccctaacccta

SEQ ID NO: 176552 - DNA, 75 bp, Artificial Sequence
  Synthetic
ccccaaccctaaccctaaccctagctctaagcctaaccccaaccctaaccctaaccctagctctaagcctaaccc

SEQ ID NO: 176553 - DNA, 75 bp, Artificial Sequence
  Synthetic
ctagctctaagtctaaccccaaccctaaccctaaccctagctctaagtttcaccccaaccctaaccctaacccta

SEQ ID NO: 176554 - DNA, 75 bp, Artificial Sequence
  Synthetic
gctctaagtttcaccccaaccctaaccctaaccctagctctaagcctaaccccaaccctaaccctaaccctagct

SEQ ID NO: 176555 - DNA, 75 bp, Artificial Sequence
  Synthetic
cctaaccctaaccctagctctaagtctaaccccaaccctaaccctaaccctagctctaagtctaaccccaaccct

SEQ ID NO: 176556 - DNA, 75 bp, Artificial Sequence
  Synthetic
ccctagctctaagcctaaccccaaccctaaccctaaccctagctctaagtttcaccccaaccctaaccctaaccc

SEQ ID NO: 176557 - DNA, 75 bp, Artificial Sequence
  Synthetic
ctaaccctagctctaaacctaaccccagccctaaccctaaccctaaccctagctctaagtctaaccccaacccta

SEQ ID NO: 176558 - DNA, 75 bp, Artificial Sequence
  Synthetic
aaccctaaccctaaccctagctctaagtctaaccccaaccctaaccctaaccctagctctaagcctaaccccaac

SEQ ID NO: 176559 - DNA, 75 bp, Artificial Sequence
  Synthetic
gctctaagtctaacccaaaccctaaccctaaccctagctctaagtttcaccccaaccccaaccctaaccctagct

SEQ ID NO: 176560 - DNA, 75 bp, Artificial Sequence
  Synthetic
ccctaaccctagctctaagtttcaccccaaccccaaccctaaccctagctctaagtctaacccaaaccctaaccc

SEQ ID NO: 176561 - DNA, 75 bp, Artificial Sequence
  Synthetic
aaccctaaccctagctctcagtctaaccccagccctaaccctaaccctagctctcactgtcaccctaacactagc

SEQ ID NO: 176562 - DNA, 75 bp, Artificial Sequence
  Synthetic
ctctcactgtcaccctaacactagctccaggtcatctgttctagatcctatccatatctgccctgactcctggtt

SEQ ID NO: 176563 - DNA, 75 bp, Artificial Sequence
  Synthetic
aagcgcgtctgttgtccgtgacagctatcctgaaagacacaaagaaaaaaaaaacccagcctcaggcgtagcagc

SEQ ID NO: 176564 - DNA, 75 bp, Artificial Sequence
  Synthetic
acacacacaaacttggtgaggtaaacacagaaatctcactaactcataatcccctacacgcttaccaccacctaa

SEQ ID NO: 176565 - DNA, 75 bp, Artificial Sequence
  Synthetic
ctttgtgtgcacactaccaatctcctagatagaacaaaattaaaaagattaaaaaaaaaaagaaaaaaagtacaa

SEQ ID NO: 176566 - DNA, 75 bp, Artificial Sequence
  Synthetic
gctctaagtttaaccctaaccctaaccctaaccatgaccctgaccctaaccctagggctgcggccctaaccctag

SEQ ID NO: 176567 - DNA, 75 bp, Artificial Sequence
  Synthetic
cctagccctaaccctagggctgcggccctaaccctagccctaaccctaaccctagccctagggctgcggccctaa

SEQ ID NO: 176568 - DNA, 75 bp, Artificial Sequence
  Synthetic
ccctaaccctagccctaaccctaaccctagccctagggctgcggccctaaacctaaccctaaccctagagctgcg

SEQ ID NO: 176569 - DNA, 75 bp, Artificial Sequence
  Synthetic
ggccctaaccctaaccctagggctgcggcccgaaccctagccctaaccctaaccctagccctagggctgcggccc

SEQ ID NO: 176570 - DNA, 75 bp, Artificial Sequence
  Synthetic
agccctagggctgcggccctaaccctaaccctagccctagggctgcggccctaaacctaaccctagccctagggc

SEQ ID NO: 176571 - DNA, 75 bp, Artificial Sequence
  Synthetic
ccctaaccctagggctgcggccctaaccctaaccctagggctgcggcccgaaccctaaccctaaccctaacccta

SEQ ID NO: 176572 - DNA, 75 bp, Artificial Sequence
  Synthetic
aatgttcactcacagcagcgaaggggacactagaaaacactcccaactagaactacgaggcggaacagcaatgga

SEQ ID NO: 176573 - DNA, 75 bp, Artificial Sequence
  Synthetic
cccccgcttaaaaaagaatttcataattccgcagctcttccgaagccccccgaaaacaacacagatcgctaaggg

SEQ ID NO: 176574 - DNA, 75 bp, Artificial Sequence
  Synthetic
attccgcagctcttccgaagccccccgaaaacaacacagatcgctaagggtgtctggactgagctcagtatcccg

SEQ ID NO: 176575 - DNA, 75 bp, Artificial Sequence
  Synthetic
ccgatctccaataagcatcaaagcagataaatcagaatagagcaccagaccgatgacccaaacttccacaaaagg

SEQ ID NO: 176576 - DNA, 75 bp, Artificial Sequence
  Synthetic
tttaaagtcttggtggaagaatttgctttatttccatttttttgcttaatgcttttttgatcttgtggaggcaat

SEQ ID NO: 176577 - DNA, 75 bp, Artificial Sequence
  Synthetic
gacatttcattatgctcgtcatcaaaactttgtaagttctcgtggacaatttcttttctgcgtttttctgaagga

SEQ ID NO: 176578 - DNA, 75 bp, Artificial Sequence
  Synthetic
ctgatttatctcttgaagacggagatgcaacaattttgattttaaagacttacaaagatccagatatagctctta

SEQ ID NO: 176579 - DNA, 75 bp, Artificial Sequence
  Synthetic
attttttaccaatcatgtttgaaaataacgagaaattaaatatgtatgttgttttccaaacaagaactcttcata

SEQ ID NO: 176580 - DNA, 75 bp, Artificial Sequence
  Synthetic
taacgagaaattaaatatgtatgttgttttccaaacaagaactcttcatatcccttgcgaatgtatcaatcagat

SEQ ID NO: 176581 - DNA, 75 bp, Artificial Sequence
  Synthetic
tcaaaaacttcttatgctgttcgtagggaacgatgacagaaaactttccacgttttagtttcgaaaaacccccta

SEQ ID NO: 176582 - DNA, 75 bp, Artificial Sequence
  Synthetic
cgttttagtttcgaaaaaccccctatctcaaaattatatattttttccattctcgtacataaatactttaaatcg

SEQ ID NO: 176583 - DNA, 75 bp, Artificial Sequence
  Synthetic
tgaataccccttcgatttgctcgcaagtgcccaaagtaaacaaatgtttactttggtaatttccttcagaatcaa

SEQ ID NO: 176584 - DNA, 75 bp, Artificial Sequence
  Synthetic
agtgcccaaagtaaacaaatgtttactttggtaatttccttcagaatcaaaatcgatgaccgaaatttgaatgat

SEQ ID NO: 176585 - DNA, 75 bp, Artificial Sequence
  Synthetic
tactaattttgaaaggcggggttctgccaggcatagtctttttttgtggcggcccttgtgtaaacctgtctttca

SEQ ID NO: 176586 - DNA, 75 bp, Artificial Sequence
  Synthetic
ggcccttgtgtaaacctgtctttcagaccttgttggacatcccgtacaatcaagatgttcctgtatgttgtttgc

SEQ ID NO: 176587 - DNA, 75 bp, Artificial Sequence
  Synthetic
ttggcaagacactggcaagtaacaaatacagacacacgcaaaaacatctgcgtaacgctctcgtataccgggttg

SEQ ID NO: 176588 - DNA, 75 bp, Artificial Sequence
  Synthetic
gaccttgttggacatcccgtacaatcaagatgttcctgtatgttgtttgcagtctggcggtttgctttcgaggac

SEQ ID NO: 176589 - DNA, 75 bp, Artificial Sequence
  Synthetic
atacagacacacgcaaaaacatctgcgtaacgctctcgtataccgggttgggtccctcggtcctgagcacgtacg

SEQ ID NO: 176590 - DNA, 75 bp, Artificial Sequence
  Synthetic
tcaacgccttacacgttgacctgtccgtctaatacatccttgccaacatcctggtattgcaacgatactcggctt

SEQ ID NO: 176591 - DNA, 75 bp, Artificial Sequence
  Synthetic
tacgcactggactgtttgtatttgcaaagcaaatcctctagtgcatctgcatgctttttgataaagtcataaacc

SEQ ID NO: 176592 - DNA, 75 bp, Artificial Sequence
  Synthetic
aaagcaaatcctctagtgcatctgcatgctttttgataaagtcataaaccggagaagatagcgtgttagcgaacg

SEQ ID NO: 176593 - DNA, 75 bp, Artificial Sequence
  Synthetic
ctgttgacacccttatctgcaattttagttgtgtgggacaatctgggcatcgatacagcctttggattacatggt

SEQ ID NO: 176594 - DNA, 75 bp, Artificial Sequence
  Synthetic
tgccacaggcgcccggccatggcgttcgcgcgaacatcccagcccaccgttgtctttactgagtcaacgagcgat

SEQ ID NO: 176595 - DNA, 75 bp, Artificial Sequence
  Synthetic
tcgcgcgaacatcccagcccaccgttgtctttactgagtcaacgagcgattgcgcacacacgtgaaaatctagac

SEQ ID NO: 176596 - DNA, 75 bp, Artificial Sequence
  Synthetic
acttgtggtcagcatgttactttgtattgttctacctctggaaataatgttaccgtttggcatctaccaaacgga

SEQ ID NO: 176597 - DNA, 75 bp, Artificial Sequence
  Synthetic
attgttctacctctggaaataatgttaccgtttggcatctaccaaacggacaaaatgaaaccgtgtcacaaacta

SEQ ID NO: 176598 - DNA, 75 bp, Artificial Sequence
  Synthetic
gtcacctctcgctttacagacgacatggcttctacagaaaaatctgccaagggccggcagcggcaaaaaaatcag

SEQ ID NO: 176599 - DNA, 75 bp, Artificial Sequence
  Synthetic
tggcttctacagaaaaatctgccaagggccggcagcggcaaaaaaatcagagaacacgagaagtgggaaagatgc

SEQ ID NO: 176600 - DNA, 75 bp, Artificial Sequence
  Synthetic
tctaacgggctgtcgtctcgcctgtcaaatcgtctatgtttttcggcgcgttgtgccaatataactccagaaact

SEQ ID NO: 176601 - DNA, 75 bp, Artificial Sequence
  Synthetic
ttcccagtttgcacacggcgccaaaaaacatcttgtttatatacagctcgtatctcatttgaatatatctcgtcc

SEQ ID NO: 176602 - DNA, 75 bp, Artificial Sequence
  Synthetic
catactgtatctgtcagcagtactacaggctttagaacatttgcaaccgcacctactctatttgtaatgaaagaa

SEQ ID NO: 176603 - DNA, 75 bp, Artificial Sequence
  Synthetic
aaacatcttgtttatatacagctcgtatctcatttgaatatatctcgtccgaatgacgtcggtataataatcctt

SEQ ID NO: 176604 - DNA, 75 bp, Artificial Sequence
  Synthetic
gcgacatcgccggctgattgttcacacgaacataaatcacacaagcataaatagtaacgcgcgcgcggacggggt

SEQ ID NO: 176605 - DNA, 75 bp, Artificial Sequence
  Synthetic
acgaacataaatcacacaagcataaatagtaacgcgcgcgcggacggggtcacggcgacccgtaaacggagatga

SEQ ID NO: 176606 - DNA, 75 bp, Artificial Sequence
  Synthetic
catggggagggtcacgcgcgagcccaactcctttaacggcagaggtcaccttagtcacgaaggtgctgtgaacac

SEQ ID NO: 176607 - DNA, 75 bp, Artificial Sequence
  Synthetic
taacataattgtaatgtgttttatgtttatagctacaaatgttttatgcaaaatacattttatgaggtcggatac

SEQ ID NO: 176608 - DNA, 75 bp, Artificial Sequence
  Synthetic
tttatagctacaaatgttttatgcaaaatacattttatgaggtcggatacttattaaaagcattgtcttaagtac

SEQ ID NO: 176609 - DNA, 75 bp, Artificial Sequence
  Synthetic
aactcctttaacggcagaggtcaccttagtcacgaaggtgctgtgaacaccctgtaccagaggtcccacgggcgc

SEQ ID NO: 176610 - DNA, 75 bp, Artificial Sequence
  Synthetic
tcaaatcagcaattccagtctgatttccgtaccacagggatgccaccttgtgagtctgaggcgccacgtcggcat

SEQ ID NO: 176611 - DNA, 75 bp, Artificial Sequence
  Synthetic
acaaacactgtggattttatggacatttaccatggtcattggccaggacaatgaaaagtgttcccaaaaaacctt

SEQ ID NO: 176612 - DNA, 75 bp, Artificial Sequence
  Synthetic
tttaccatggtcattggccaggacaatgaaaagtgttcccaaaaaaccttaattggatatagacttaaaatgtct

SEQ ID NO: 176613 - DNA, 75 bp, Artificial Sequence
  Synthetic
tccgtaccacagggatgccaccttgtgagtctgaggcgccacgtcggcatctgcgcctgaaagtttaaacaggga

SEQ ID NO: 176614 - DNA, 75 bp, Artificial Sequence
  Synthetic
agcaaaaaagatatgttccggggggctcgtgtgcattaagggtctgcgaatacacgagaaaatctccgtaggtgg

SEQ ID NO: 176615 - DNA, 75 bp, Artificial Sequence
  Synthetic
tggatacactacttatgcccgcaatataacagcaacatgtttacaaggtgggacgtggtctgaaccaacggcaac

SEQ ID NO: 176616 - DNA, 75 bp, Artificial Sequence
  Synthetic
ataacagcaacatgtttacaaggtgggacgtggtctgaaccaacggcaacatgtaacaaaaagtcctgtccaaac

SEQ ID NO: 176617 - DNA, 75 bp, Artificial Sequence
  Synthetic
ctcgtgtgcattaagggtctgcgaatacacgagaaaatctccgtaggtgggctgattaaacggcaggtgccacat

SEQ ID NO: 176618 - DNA, 75 bp, Artificial Sequence
  Synthetic
agagaacatcgcgcagccctctagcaaatcctggtccgttcgttaaggacaccttgtgcgtgggcgggggtagaa

SEQ ID NO: 176619 - DNA, 75 bp, Artificial Sequence
  Synthetic
cttaaaatatggggcaaacatttcatatgtttgtaatgaaggatattttttggttggtcgagaatacgtgcgata

SEQ ID NO: 176620 - DNA, 75 bp, Artificial Sequence
  Synthetic
tatgtttgtaatgaaggatattttttggttggtcgagaatacgtgcgatattgtatgattggagcatctggccaa

SEQ ID NO: 176621 - DNA, 75 bp, Artificial Sequence
  Synthetic
aaatcctggtccgttcgttaaggacaccttgtgcgtgggcgggggtagaaggttcaacatctgccgccccagccg

SEQ ID NO: 176622 - DNA, 75 bp, Artificial Sequence
  Synthetic
tccgcagggtaacgcaaggacttctgcgtgccggagaccgcttcctgcaacaaactaaaattttaatggagtttc

SEQ ID NO: 176623 - DNA, 75 bp, Artificial Sequence
  Synthetic
accgaaaatcgaaaatggagattttaagcctgataaagattattatgagtataatgatgcagttcattttgaatg

SEQ ID NO: 176624 - DNA, 75 bp, Artificial Sequence
  Synthetic
aagcctgataaagattattatgagtataatgatgcagttcattttgaatgtaatgaaggatatactctagttgga

SEQ ID NO: 176625 - DNA, 75 bp, Artificial Sequence
  Synthetic
gcgtgccggagaccgcttcctgcaacaaactaaaattttaatggagtttcagttacgcggcgtgcccgtcaagtc

SEQ ID NO: 176626 - DNA, 75 bp, Artificial Sequence
  Synthetic
tgaacaacaccctagctcgtttcgtgtgcgatcatgcggtgttcgctcttgtgcgcggcgcgtactatatcgggg

SEQ ID NO: 176627 - DNA, 75 bp, Artificial Sequence
  Synthetic
aacctgtgaactcgcaggctgtaaatttccatcggtgactcatggttatccaatccaaggtttttctcttactta

SEQ ID NO: 176628 - DNA, 75 bp, Artificial Sequence
  Synthetic
gtgcgatcatgcggtgttcgctcttgtgcgcggcgcgtactatatcggggatgtgacgccggagcggatcggtga

SEQ ID NO: 176629 - DNA, 75 bp, Artificial Sequence
  Synthetic
gcatgcaatgatggatttgttctcagaggatcccccacaattacgtgtaacgttactgaatgggacccaccactt

SEQ ID NO: 176630 - DNA, 75 bp, Artificial Sequence
  Synthetic
cagacagttctatatcgggtcaaaccaaacccgtaccggaaccccttaacaatgcgtatctccttaacagtctga

SEQ ID NO: 176631 - DNA, 75 bp, Artificial Sequence
  Synthetic
caaacccgtaccggaaccccttaacaatgcgtatctccttaacagtctgacagcctatacggaccgcgtcattga

SEQ ID NO: 176632 - DNA, 75 bp, Artificial Sequence
  Synthetic
acgtttgcatccaacacccaatgaaaaaccaaatggtaatgtctttcaacgctcaaactatacagaacctccaac

SEQ ID NO: 176633 - DNA, 75 bp, Artificial Sequence
  Synthetic
aaaccaaatggtaatgtctttcaacgctcaaactatacagaacctccaacaaagcctgaagacacccatacagca

SEQ ID NO: 176634 - DNA, 75 bp, Artificial Sequence
  Synthetic
tcgtatgcgtggaacaactctggcacgcgtgctttcgtcgctactgggcgacgatctctccgacttattggatgg

SEQ ID NO: 176635 - DNA, 75 bp, Artificial Sequence
  Synthetic
cgcgtgctttcgtcgctactgggcgacgatctctccgacttattggatggcgcaatacgagccacccccaacccc

SEQ ID NO: 176636 - DNA, 75 bp, Artificial Sequence
  Synthetic
cgaaggttttaatgagactaccacatctaatacaattacaaaacaattagaggatgagaaaactacatcccagcc

SEQ ID NO: 176637 - DNA, 75 bp, Artificial Sequence
  Synthetic
aggatgagaaaactacatcccagccaaatacacatattacatctgccttaacatccatgaaagcgaaaggtaact

SEQ ID NO: 176638 - DNA, 75 bp, Artificial Sequence
  Synthetic
taccgccagggtttgcgacacaaaatcaactcgcgcgcgatctggtaacgggccatcacgagctatttgtcccca

SEQ ID NO: 176639 - DNA, 75 bp, Artificial Sequence
  Synthetic
tcaactcgcgcgcgatctggtaacgggccatcacgagctatttgtccccacctcgctgtccacagaatccagtaa

SEQ ID NO: 176640 - DNA, 75 bp, Artificial Sequence
  Synthetic
acttcccaagatgatgctacgccttcaatacctagtgtacagacacccaattataatactaacgcaccgacacgt

SEQ ID NO: 176641 - DNA, 75 bp, Artificial Sequence
  Synthetic
ccaacaacaaggtggtcgcagacaacacgcccatgctggcgttcagtgatctcgagttaaccacgctgcgacctg

SEQ ID NO: 176642 - DNA, 75 bp, Artificial Sequence
  Synthetic
cacgcccatgctggcgttcagtgatctcgagttaaccacgctgcgacctgagtatctcttcttatacgactttat

SEQ ID NO: 176643 - DNA, 75 bp, Artificial Sequence
  Synthetic
acactaacgtctctccatattgaagaaggcccatccaattctactacttcagaaaaggccactgcctctactctc

SEQ ID NO: 176644 - DNA, 75 bp, Artificial Sequence
  Synthetic
taacaacgttcataacgcgcggaatcgactttgtaacagagttagttcagtatctggaaacactaacgcgacacc

SEQ ID NO: 176645 - DNA, 75 bp, Artificial Sequence
  Synthetic
caaaacaacacagttgccatccactaataaacctacaaacagtcaagccaagagttccactaagccacgcgttga

SEQ ID NO: 176646 - DNA, 75 bp, Artificial Sequence
  Synthetic
aataaacctacaaacagtcaagccaagagttccactaagccacgcgttgagacacacaataaaacaaccagtaat

SEQ ID NO: 176647 - DNA, 75 bp, Artificial Sequence
  Synthetic
cgactttgtaacagagttagttcagtatctggaaacactaacgcgacaccatatacacatggaacaccgtcagat

SEQ ID NO: 176648 - DNA, 75 bp, Artificial Sequence
  Synthetic
gtgccaccctgaaaaccatgctatttactgtgcctaagacgtttctcaacaatgtgccctccctgcccgtgttca

SEQ ID NO: 176649 - DNA, 75 bp, Artificial Sequence
  Synthetic
accaacactccctcccattttcaggccaccggcgtctaaaaatcgctatctggaaaagcaactagttattggact

SEQ ID NO: 176650 - DNA, 75 bp, Artificial Sequence
  Synthetic
ccaccggcgtctaaaaatcgctatctggaaaagcaactagttattggactactaaccgctgtcgccctaacgtgt

SEQ ID NO: 176651 - DNA, 75 bp, Artificial Sequence
  Synthetic
tactgtgcctaagacgtttctcaacaatgtgccctccctgcccgtgttcattacactcgtgtctcgacttgtcac

SEQ ID NO: 176652 - DNA, 75 bp, Artificial Sequence
  Synthetic
tagcccgtctcaagattagagcgattttagagggcgcaaccttggaacacggcgactcagaattccatgaggcga

SEQ ID NO: 176653 - DNA, 75 bp, Artificial Sequence
  Synthetic
tccagtgttagacagggctatgattgcttctccacgctgtccaccttaacacttcccaataacaaatccggtatg

SEQ ID NO: 176654 - DNA, 75 bp, Artificial Sequence
  Synthetic
tttagagggcgcaaccttggaacacggcgactcagaattccatgaggcgacagaagctcctgcgtggaacttggc

SEQ ID NO: 176655 - DNA, 75 bp, Artificial Sequence
  Synthetic
cctaaaaaatgtgcatgtggtatgtattgtactaaagataccgaccaatacaagacaactaatattaaccatagt

SEQ ID NO: 176656 - DNA, 75 bp, Artificial Sequence
  Synthetic
gtacgcaccaagcgcttttgtccaacctcctgcggtcaatctatgagatctacatcaaggctacatggggcgagg

SEQ ID NO: 176657 - DNA, 75 bp, Artificial Sequence
  Synthetic
cctcctgcggtcaatctatgagatctacatcaaggctacatggggcgaggtacagttggaccccccggcggcccc

SEQ ID NO: 176658 - DNA, 75 bp, Artificial Sequence
  Synthetic
ggcgtttccatatgaggccaagtgcattggctattttaggggcggtgaccacgcactatagtgcgcggtgtggca

SEQ ID NO: 176659 - DNA, 75 bp, Artificial Sequence
  Synthetic
attggctattttaggggcggtgaccacgcactatagtgcgcggtgtggcagaaaattcacaccgtatataaacaa

SEQ ID NO: 176660 - DNA, 75 bp, Artificial Sequence
  Synthetic
ttcaagagtactgccgccatatccgcgttggagacgtcgtccacgacgatcgcatggtgcgtagtccactcttcg

SEQ ID NO: 176661 - DNA, 75 bp, Artificial Sequence
  Synthetic
cgttggagacgtcgtccacgacgatcgcatggtgcgtagtccactcttcgctcaggagtttatacgatatcattt

SEQ ID NO: 176662 - DNA, 75 bp, Artificial Sequence
  Synthetic
ttttgttgtcttggccaatcgtgtctccatggcgctaaagggaccacaaaccctcgaggaaaatattgggtctgc

SEQ ID NO: 176663 - DNA, 75 bp, Artificial Sequence
  Synthetic
tccatggcgctaaagggaccacaaaccctcgaggaaaatattgggtctgcggcccccactggtccctgcgggtac

SEQ ID NO: 176664 - DNA, 75 bp, Artificial Sequence
  Synthetic
ccctcttcaaactgcgatggctaattgtattcgcatcggagtcgagtcccggcctagatcccttacgtagatctc

SEQ ID NO: 176665 - DNA, 75 bp, Artificial Sequence
  Synthetic
tgtattcgcatcggagtcgagtcccggcctagatcccttacgtagatctctggcacgcgcgtacttccacattat

SEQ ID NO: 176666 - DNA, 75 bp, Artificial Sequence
  Synthetic
gggcaatggctacccggaggcaaaagtattttcactacctcttttgcacgggctcacagtggaatccgatttccc

SEQ ID NO: 176667 - DNA, 75 bp, Artificial Sequence
  Synthetic
actgtgtactggagagcgtgaatcttatcacaccatattttccaggcgtgacgtgcccccaggagtttcttcagg

SEQ ID NO: 176668 - DNA, 75 bp, Artificial Sequence
  Synthetic
tatcacaccatattttccaggcgtgacgtgcccccaggagtttcttcaggccatgtacgtttttcattttcaccc

SEQ ID NO: 176669 - DNA, 75 bp, Artificial Sequence
  Synthetic
aaaatcgatgcaaccacagcttctgtgaaattaacttcataccacagggaggccatcgtctttcataatactcac

SEQ ID NO: 176670 - DNA, 75 bp, Artificial Sequence
  Synthetic
ggccatcgtctttcataatactcacttatttcagccaatctttcaaggaaagggactggaaaagttatgtcgaga

SEQ ID NO: 176671 - DNA, 75 bp, Artificial Sequence
  Synthetic
ttatttcagccaatctttcaaggaaagggactggaaaagttatgtcgagagagccgagagctgtttggattttca

SEQ ID NO: 176672 - DNA, 75 bp, Artificial Sequence
  Synthetic
ggtcaacacttccggacctcacgaaagttgtcgccttgggagacaaattacgccgcgtacgttgggaatatgata

SEQ ID NO: 176673 - DNA, 75 bp, Artificial Sequence
  Synthetic
agttgtcgccttgggagacaaattacgccgcgtacgttgggaatatgataacacaacagaaagcatacttgtacc

SEQ ID NO: 176674 - DNA, 75 bp, Artificial Sequence
  Synthetic
ccctcagctaccctgcgcgaatgagatttttatggcggtcatagttacagagggattcaaggagagactgtacgg

SEQ ID NO: 176675 - DNA, 75 bp, Artificial Sequence
  Synthetic
atttttatggcggtcatagttacagagggattcaaggagagactgtacggcggcaaactggtgcccgtgccctct

SEQ ID NO: 176676 - DNA, 75 bp, Artificial Sequence
  Synthetic
ctacgattcaacttctggaaagagccaccaaagaaacacttctcaccacaacaaaggccgcggagcgcctgtccc

SEQ ID NO: 176677 - DNA, 75 bp, Artificial Sequence
  Synthetic
caccaaagaaacacttctcaccacaacaaaggccgcggagcgcctgtccctggctcatgggcgcctgctgcggac

SEQ ID NO: 176678 - DNA, 75 bp, Artificial Sequence
  Synthetic
gtatgacgaggatctgtttggtccaagtcgcgcccaagaactatgtaggttttacaaccccgatatcagtagata

SEQ ID NO: 176679 - DNA, 75 bp, Artificial Sequence
  Synthetic
agtcgcgcccaagaactatgtaggttttacaaccccgatatcagtagatacctacatgactccatattcactgga

SEQ ID NO: 176680 - DNA, 75 bp, Artificial Sequence
  Synthetic
cgtcggcacccatagtggcgcttcgtgagaagtacactgccctttttggtcttctcaatcgcctcactgccgcgg

SEQ ID NO: 176681 - DNA, 75 bp, Artificial Sequence
  Synthetic
tgagaagtacactgccctttttggtcttctcaatcgcctcactgccgcggttgtgaactgcagcgcgtacaccct

SEQ ID NO: 176682 - DNA, 75 bp, Artificial Sequence
  Synthetic
agaaaggcaatttgtgcacgaccaatacaagataccaaagctggtccaagccaaggacttcccccagtgtgcttc

SEQ ID NO: 176683 - DNA, 75 bp, Artificial Sequence
  Synthetic
tacaagataccaaagctggtccaagccaaggacttcccccagtgtgcttccaggggaaccgacgggtctacccta

SEQ ID NO: 176684 - DNA, 75 bp, Artificial Sequence
  Synthetic
tggtacggcaacttttagaattcgacgagagcaaagacactacggaaggctttctgcagagcctgacacagccgg

SEQ ID NO: 176685 - DNA, 75 bp, Artificial Sequence
  Synthetic
cgagagcaaagacactacggaaggctttctgcagagcctgacacagccggtcatctgtggtgcccaatccagacg

SEQ ID NO: 176686 - DNA, 75 bp, Artificial Sequence
  Synthetic
ctttattgagggaccccaggatagctgcgaggttctaaattatgacacgtggcccatctttgaaaactgcgagac

SEQ ID NO: 176687 - DNA, 75 bp, Artificial Sequence
  Synthetic
tgcgaggttctaaattatgacacgtggcccatctttgaaaactgcgagacgccagatgcccgccttcgtgcacta

SEQ ID NO: 176688 - DNA, 75 bp, Artificial Sequence
  Synthetic
ctatatccgggttatttcaagagagccccgaccgcatgcgtccatctattaaactctcgtattcgggacgatacg

SEQ ID NO: 176689 - DNA, 75 bp, Artificial Sequence
  Synthetic
ccccgaccgcatgcgtccatctattaaactctcgtattcgggacgatacgacgttacaaaggtatctatagactg

SEQ ID NO: 176690 - DNA, 75 bp, Artificial Sequence
  Synthetic
ggccaactctgtgctctacctgaccagagtggcaaagctgcctcagaagaatcagagaggagacgccaacatgta

SEQ ID NO: 176691 - DNA, 75 bp, Artificial Sequence
  Synthetic
agagtggcaaagctgcctcagaagaatcagagaggagacgccaacatgtacaactcattctacctacagcatggc

SEQ ID NO: 176692 - DNA, 75 bp, Artificial Sequence
  Synthetic
ttttctatctaactgtagaaactctcaagaggctgtttacagactgaccaccatggcacaaccgccgcctctgcg

SEQ ID NO: 176693 - DNA, 75 bp, Artificial Sequence
  Synthetic
caagaggctgtttacagactgaccaccatggcacaaccgccgcctctgcgcatggagggcgtggcttccacgcac

SEQ ID NO: 176694 - DNA, 75 bp, Artificial Sequence
  Synthetic
caagggcgtgccagtgtctgcactggatgggtcatcttacaccctccagcacctggcctacgcgtcctctttctc

SEQ ID NO: 176695 - DNA, 75 bp, Artificial Sequence
  Synthetic
gatgggtcatcttacaccctccagcacctggcctacgcgtcctctttctccccacatctcctggcaaggatgtgt

SEQ ID NO: 176696 - DNA, 75 bp, Artificial Sequence
  Synthetic
ctgcgtcatgtatctcgcatcttgctattacaatcgggaaactcccctcctggacaccccaagtctagatgacat

SEQ ID NO: 176697 - DNA, 75 bp, Artificial Sequence
  Synthetic
tattacaatcgggaaactcccctcctggacaccccaagtctagatgacattctagaaaaaggcagtcggctagat

SEQ ID NO: 176698 - DNA, 75 bp, Artificial Sequence
  Synthetic
caatgtggtggactacgtgggcaccgcggcacctagtcaaatgtgtgacctgtgtcaggggcaatgtccagctgt

SEQ ID NO: 176699 - DNA, 75 bp, Artificial Sequence
  Synthetic
gcggcacctagtcaaatgtgtgacctgtgtcaggggcaatgtccagctgtatgcatcaacacgctgttttacagg

SEQ ID NO: 176700 - DNA, 75 bp, Artificial Sequence
  Synthetic
ccatcacattcccagctaccttcgcacagatgcctggaccacgaagatatttcaatctgccgagttctttggact

SEQ ID NO: 176701 - DNA, 75 bp, Artificial Sequence
  Synthetic
acagatgcctggaccacgaagatatttcaatctgccgagttctttggactcctgggccaggaggccgccatcagg

SEQ ID NO: 176702 - DNA, 75 bp, Artificial Sequence
  Synthetic
tgtgatcacgggcacagcgggaacgtacaatgacctagagattctcggaaactttgccaccttcagggagagaga

SEQ ID NO: 176703 - DNA, 75 bp, Artificial Sequence
  Synthetic
tacaatgacctagagattctcggaaactttgccaccttcagggagagagaggaggaggggaatcctgtggaagat

SEQ ID NO: 176704 - DNA, 75 bp, Artificial Sequence
  Synthetic
aacggttcaatactttgtcgtgatctgtcaggcgaagtccagggctattctgataaaagacaaagcatttttcat

SEQ ID NO: 176705 - DNA, 75 bp, Artificial Sequence
  Synthetic
tgtcaggcgaagtccagggctattctgataaaagacaaagcatttttcatgttcgatccccattgtattccacac

SEQ ID NO: 176706 - DNA, 75 bp, Artificial Sequence
  Synthetic
agcgtccatgggcatctcggagggcggcgatgccctaagaaccctcattgtggacatccccagcttcgtcaaagt

SEQ ID NO: 176707 - DNA, 75 bp, Artificial Sequence
  Synthetic
ggcgatgccctaagaaccctcattgtggacatccccagcttcgtcaaagtgttcaaggggatagacagcacggta

SEQ ID NO: 176708 - DNA, 75 bp, Artificial Sequence
  Synthetic
cctctcatatatcgccacaccagacacagaatacactgggtgttttttgtatttccttccaaacgattatgtcag

SEQ ID NO: 176709 - DNA, 75 bp, Artificial Sequence
  Synthetic
acagaatacactgggtgttttttgtatttccttccaaacgattatgtcagcccagagcattacattactaatcac

SEQ ID NO: 176710 - DNA, 75 bp, Artificial Sequence
  Synthetic
cttcagagagaacatcaaatccgtccatcacatccttcagtttgcatgcaacgtatactggcaggcgccgtgccc

SEQ ID NO: 176711 - DNA, 75 bp, Artificial Sequence
  Synthetic
catcacatccttcagtttgcatgcaacgtatactggcaggcgccgtgcccggtttttctgaccctttactacaag

SEQ ID NO: 176712 - DNA, 75 bp, Artificial Sequence
  Synthetic
gacgggcgtggaagctgcatcaattaccgagattgacagtcctcccgggtcgcccacgagaccggacacacacac

SEQ ID NO: 176713 - DNA, 75 bp, Artificial Sequence
  Synthetic
accgagattgacagtcctcccgggtcgcccacgagaccggacacacacacgacctcaggagatacgcacgaagac

SEQ ID NO: 176714 - DNA, 75 bp, Artificial Sequence
  Synthetic
cgagcaggacaacccggccgtgggaattgtaccatccgagtggcttaaaatgcactttcagacaatgtggaccaa

SEQ ID NO: 176715 - DNA, 75 bp, Artificial Sequence
  Synthetic
attgtaccatccgagtggcttaaaatgcactttcagacaatgtggaccaacttcaagggtgcctgcttcgacaaa

SEQ ID NO: 176716 - DNA, 75 bp, Artificial Sequence
  Synthetic
tggaaccccgcgccccagacggaaaaatcgcggtactcccccgtcaccagaaccgcccggtatcaaccagacaca

SEQ ID NO: 176717 - DNA, 75 bp, Artificial Sequence
  Synthetic
aatcgcggtactcccccgtcaccagaaccgcccggtatcaaccagacacacaatcgtccagatgcgtctcatcgg

SEQ ID NO: 176718 - DNA, 75 bp, Artificial Sequence
  Synthetic
tgacctctttgacaccgacgctgccataggagggatgtttgcacccgctcggatgcaggtcaggatagccagagc

SEQ ID NO: 176719 - DNA, 75 bp, Artificial Sequence
  Synthetic
ataggagggatgtttgcacccgctcggatgcaggtcaggatagccagagcaatgctcatggttccaaaaaccata

SEQ ID NO: 176720 - DNA, 75 bp, Artificial Sequence
  Synthetic
cggtgtcgaagctgacgtgcccaacgatacaactcaacacgcgaatgaaatttcggaaacaacgcgctccagtga

SEQ ID NO: 176721 - DNA, 75 bp, Artificial Sequence
  Synthetic
gatacaactcaacacgcgaatgaaatttcggaaacaacgcgctccagtgaagcgggtgaaaacgaggccccgccc

SEQ ID NO: 176722 - DNA, 75 bp, Artificial Sequence
  Synthetic
ccaggcaggttttatgaagccggccagccaaagggattcatacatcgtcggaggaccctacatgaaattcctaaa

SEQ ID NO: 176723 - DNA, 75 bp, Artificial Sequence
  Synthetic
agccaaagggattcatacatcgtcggaggaccctacatgaaattcctaaacgccctgcacaaaacactttttcct

SEQ ID NO: 176724 - DNA, 75 bp, Artificial Sequence
  Synthetic
tgcaccaggggcagatgtgttattggcagacctggccgcggcgcgcggccaaaaacgcaaaatatcagaaattac

SEQ ID NO: 176725 - DNA, 75 bp, Artificial Sequence
  Synthetic
gcagacctggccgcggcgcgcggccaaaaacgcaaaatatcagaaattacagaccaggacgacacagaccccaga

SEQ ID NO: 176726 - DNA, 75 bp, Artificial Sequence
  Synthetic
aaaaaatcccatactaccaggtgtctcgggggaacacctaacggagttatgtaattatgtaaaggcaagtagcca

SEQ ID NO: 176727 - DNA, 75 bp, Artificial Sequence
  Synthetic
atggatcgatgaccccccggaacccctatatccccctacggaaacgccatcgtttgacgtcactatagatgttag

SEQ ID NO: 176728 - DNA, 75 bp, Artificial Sequence
  Synthetic
ctatatccccctacggaaacgccatcgtttgacgtcactatagatgttagcacatccgctctaacgcccgatgag

SEQ ID NO: 176729 - DNA, 75 bp, Artificial Sequence
  Synthetic
acacagttttatgcaactactctctcttgcctttcgccagtgactcagctggttccggccgaggagtacccccac

SEQ ID NO: 176730 - DNA, 75 bp, Artificial Sequence
  Synthetic
cgagttcatacggttctctgaagcgacaccggaggccctgagtacggccgttgtcaagcttgacatagggccact

SEQ ID NO: 176731 - DNA, 75 bp, Artificial Sequence
  Synthetic
acaccggaggccctgagtacggccgttgtcaagcttgacatagggccactcgatgctctcataaaaaacctaaat

SEQ ID NO: 176732 - DNA, 75 bp, Artificial Sequence
  Synthetic
cgccggcaggtctgtaaccattgtacagtcaacactgaagcaagctgtttccaccaacggacgactccggcctat

SEQ ID NO: 176733 - DNA, 75 bp, Artificial Sequence
  Synthetic
cagtcaacactgaagcaagctgtttccaccaacggacgactccggcctatcattaccgtgccactggtggtcaac

SEQ ID NO: 176734 - DNA, 75 bp, Artificial Sequence
  Synthetic
gcgtcctttccgcgagagcgcagccctacgtgacatggataggctcttaacacacgtgatactggaacacggtcc

SEQ ID NO: 176735 - DNA, 75 bp, Artificial Sequence
  Synthetic
ctacgtgacatggataggctcttaacacacgtgatactggaacacggtccgatctcgagcgcgctaaccgccggc

SEQ ID NO: 176736 - DNA, 75 bp, Artificial Sequence
  Synthetic
gggatacttctcggggagaggggtggacagaaatctcaggccagaaagcgtcccctttaaaaagaataatgtcag

SEQ ID NO: 176737 - DNA, 75 bp, Artificial Sequence
  Synthetic
gacagaaatctcaggccagaaagcgtcccctttaaaaagaataatgtcagctctatgctaagaaaacgccacgtg

SEQ ID NO: 176738 - DNA, 75 bp, Artificial Sequence
  Synthetic
gctaggcattcccgtcgcggacgctaaacgggtgttaaaagctgaattgacgatcccgagtctatgcaacctagt

SEQ ID NO: 176739 - DNA, 75 bp, Artificial Sequence
  Synthetic
aaacgggtgttaaaagctgaattgacgatcccgagtctatgcaacctagtacaagaacaacaaattacgtccccc

SEQ ID NO: 176740 - DNA, 75 bp, Artificial Sequence
  Synthetic
ctctggggaattcgaggcagaagcggttaagagaagtgtgcagaatgtcctggaagacagagataacccaaacct

SEQ ID NO: 176741 - DNA, 75 bp, Artificial Sequence
  Synthetic
gttaagagaagtgtgcagaatgtcctggaagacagagataacccaaacctgccgaagacagttgtattagagttg

SEQ ID NO: 176742 - DNA, 75 bp, Artificial Sequence
  Synthetic
gcacccaaaaaccacgccaaattttcgaacaatcattcagcagatcaacacggaaggaataaaaatcgcctctat

SEQ ID NO: 176743 - DNA, 75 bp, Artificial Sequence
  Synthetic
cgaacaatcattcagcagatcaacacggaaggaataaaaatcgcctctatggaagaggagacatctacggtgacc

SEQ ID NO: 176744 - DNA, 75 bp, Artificial Sequence
  Synthetic
ttactacctgggcccttatgccgtacttggggacgaggtcctgtcattactgagcacagtgggccaggcgggggt

SEQ ID NO: 176745 - DNA, 75 bp, Artificial Sequence
  Synthetic
cttggggacgaggtcctgtcattactgagcacagtgggccaggcgggggtgccatggacggccgagggtgtggcc

SEQ ID NO: 176746 - DNA, 75 bp, Artificial Sequence
  Synthetic
ttccaatgaagatatacagactatcatggaaggcatccggcgcctaagagacgagatcaaaaaaagaaacgccca

SEQ ID NO: 176747 - DNA, 75 bp, Artificial Sequence
  Synthetic
atggaaggcatccggcgcctaagagacgagatcaaaaaaagaaacgcccaaatccaagacgaggagggtagattt

SEQ ID NO: 176748 - DNA, 75 bp, Artificial Sequence
  Synthetic
agaagagccttgccttatccaaggacagtcggtagtggaggagctttttccgtccccgggcgtcccaagcctgac

SEQ ID NO: 176749 - DNA, 75 bp, Artificial Sequence
  Synthetic
cagtcggtagtggaggagctttttccgtccccgggcgtcccaagcctgacagtgggtaaaaaacgaaaaatcgca

SEQ ID NO: 176750 - DNA, 75 bp, Artificial Sequence
  Synthetic
ccaagcatttgagattctcccggacaaaaaactcagaatcgttgtggaacacctgacgctggccgaagcgagaat

SEQ ID NO: 176751 - DNA, 75 bp, Artificial Sequence
  Synthetic
aaaaaactcagaatcgttgtggaacacctgacgctggccgaagcgagaattaccacccaacttgtagaaggttta

SEQ ID NO: 176752 - DNA, 75 bp, Artificial Sequence
  Synthetic
aggaactggcggcggtctatgccgatgtgtcagccctagccatggacctctgtcttcttagttacgcagacccgg

SEQ ID NO: 176753 - DNA, 75 bp, Artificial Sequence
  Synthetic
tgtgtcagccctagccatggacctctgtcttcttagttacgcagacccggcaacactggacactaaaagtctggc

SEQ ID NO: 176754 - DNA, 75 bp, Artificial Sequence
  Synthetic
tccaaacataagtcaggtgttgggcagcttaggcaacacactaaaaacaattaaacacgttgcagaaagattaca

SEQ ID NO: 176755 - DNA, 75 bp, Artificial Sequence
  Synthetic
agcttaggcaacacactaaaaacaattaaacacgttgcagaaagattacagacgaatacggcagccctcgatcct

SEQ ID NO: 176756 - DNA, 75 bp, Artificial Sequence
  Synthetic
tcagacgacaaaacgcacacgaatgctcaggtctgtcactagaattggagcaccttttggaaaacgtggctgatg

SEQ ID NO: 176757 - DNA, 75 bp, Artificial Sequence
  Synthetic
gctagactggccccatccgcccaccgagccgatacagcctctagaaatcttacaaatactcagaaaaaaaataac

SEQ ID NO: 176758 - DNA, 75 bp, Artificial Sequence
  Synthetic
gagccgatacagcctctagaaatcttacaaatactcagaaaaaaaataacccaagcagaggctcgcgtacagagc

SEQ ID NO: 176759 - DNA, 75 bp, Artificial Sequence
  Synthetic
tagcagaaaactgtctccagaagagcatttttccctcctgcatttggacataacatgcaacaagcaccggagcgt

SEQ ID NO: 176760 - DNA, 75 bp, Artificial Sequence
  Synthetic
taggtttaatttttacggaaattgggccttggagttaaagctgtcactaataaacgacgttgaaattttctttaa

SEQ ID NO: 176761 - DNA, 75 bp, Artificial Sequence
  Synthetic
tataacagatccttctagtgcacaataccgcacacagtccgtgtctatccctgtattggaaaactacatacaaaa

SEQ ID NO: 176762 - DNA, 75 bp, Artificial Sequence
  Synthetic
gccttggagttaaagctgtcactaataaacgacgttgaaattttctttaaacgtcttagtagcgttttttattgt

SEQ ID NO: 176763 - DNA, 75 bp, Artificial Sequence
  Synthetic
taccgcacacagtccgtgtctatccctgtattggaaaactacatacaaaatgccggggtcttactgggacatgaa

SEQ ID NO: 176764 - DNA, 75 bp, Artificial Sequence
  Synthetic
tgggaagctgaggggtatctcacccgtacctgggccggacctatatgtctcaaatctgccctgcctagaatgcct

SEQ ID NO: 176765 - DNA, 75 bp, Artificial Sequence
  Synthetic
ctccgaaacgttcctcacaatgactctgcacgacacaagcctggccaatgtaataactaatgccgccaaaatcgg

SEQ ID NO: 176766 - DNA, 75 bp, Artificial Sequence
  Synthetic
gtacctgggccggacctatatgtctcaaatctgccctgcctagaatgccttcaggaagtgtgtctgactcccaac

SEQ ID NO: 176767 - DNA, 75 bp, Artificial Sequence
  Synthetic
ctgcacgacacaagcctggccaatgtaataactaatgccgccaaaatcggcgaggcgtttgcggccaaccccgca

SEQ ID NO: 176768 - DNA, 75 bp, Artificial Sequence
  Synthetic
atgtacccccgcatgcggtgagcctgtccggggcctctttgagaacgagctaaaacagctcgggcttcaaacccc

SEQ ID NO: 176769 - DNA, 75 bp, Artificial Sequence
  Synthetic
cgtcatccgggaggccctagacgctctcgagaggcgagaccccgcggctcttccacaaggtaccacgctagccat

SEQ ID NO: 176770 - DNA, 75 bp, Artificial Sequence
  Synthetic
gtccggggcctctttgagaacgagctaaaacagctcgggcttcaaacccctgagtccatacctactaccccctgt

SEQ ID NO: 176771 - DNA, 75 bp, Artificial Sequence
  Synthetic
ctcgagaggcgagaccccgcggctcttccacaaggtaccacgctagccatggaaacactgctggattatggatca

SEQ ID NO: 176772 - DNA, 75 bp, Artificial Sequence
  Synthetic
ggtaggagatcaccacattttcggagaggtgaccagatctgtcctggaaatctcaaacctgatctattggagctc

SEQ ID NO: 176773 - DNA, 75 bp, Artificial Sequence
  Synthetic
ccaggcgaccgttagagagggagacaaggaccggtggaacacagccatagctagcctgacccaacttaaatcaac

SEQ ID NO: 176774 - DNA, 75 bp, Artificial Sequence
  Synthetic
tctcaaacctgatctattggagctctggccactcggatgccacctgcgacggagacagagactgctctcacctgg

SEQ ID NO: 176775 - DNA, 75 bp, Artificial Sequence
  Synthetic
aaggaccggtggaacacagccatagctagcctgacccaacttaaatcaacactggccgccgcggcgatggaggcc

SEQ ID NO: 176776 - DNA, 75 bp, Artificial Sequence
  Synthetic
gccggatgcttgggcgaacgcggcacgcccaaacacttttttgactgctttcgcccagactccctagaaaccctt

SEQ ID NO: 176777 - DNA, 75 bp, Artificial Sequence
  Synthetic
gcaaaaaaaccaaacccgtctactggaggagtcatggaaaaataaagttctggcgtttgtgccgaggtcggccga

SEQ ID NO: 176778 - DNA, 75 bp, Artificial Sequence
  Synthetic
cgcccaaacacttttttgactgctttcgcccagactccctagaaacccttttctgtggtggtctttttagctccg

SEQ ID NO: 176779 - DNA, 75 bp, Artificial Sequence
  Synthetic
gaggagtcatggaaaaataaagttctggcgtttgtgccgaggtcggccgacgaggcgctcgattttctaaaaggg

SEQ ID NO: 176780 - DNA, 75 bp, Artificial Sequence
  Synthetic
caacaggtaaactacactactgcactgcaaaaacagaacgagttttacgtccgactcagcaaactgctggcagct

SEQ ID NO: 176781 - DNA, 75 bp, Artificial Sequence
  Synthetic
gcatggcctacacctggaaactccgacccaggacgccacggtagccatggaatacagcccaacccccctacccaa

SEQ ID NO: 176782 - DNA, 75 bp, Artificial Sequence
  Synthetic
tgcaaaaacagaacgagttttacgtccgactcagcaaactgctggcagctggtcagctaaatttgggcaaatgtt

SEQ ID NO: 176783 - DNA, 75 bp, Artificial Sequence
  Synthetic
acccaggacgccacggtagccatggaatacagcccaacccccctacccaacacgaaagagatcgacaaggcgact

SEQ ID NO: 176784 - DNA, 75 bp, Artificial Sequence
  Synthetic
aaaccagaggaagtgctgagggatgcaaaacaccggcaagaactataccttcagaaagtggcacgcgacggtttt

SEQ ID NO: 176785 - DNA, 75 bp, Artificial Sequence
  Synthetic
ctacacgttccacaccatccattcgacagattgggaggcccttgcggcggaatatcagcggcctggttccgcact

SEQ ID NO: 176786 - DNA, 75 bp, Artificial Sequence
  Synthetic
acagattgggaggcccttgcggcggaatatcagcggcctggttccgcactacctagcacggtcggagcggttctc

SEQ ID NO: 176787 - DNA, 75 bp, Artificial Sequence
  Synthetic
aaaaaactctctgattgtataagacaccagggccacatcctgtctcagaccctgggtctaagactgtgggggtct

SEQ ID NO: 176788 - DNA, 75 bp, Artificial Sequence
  Synthetic
acgtcttcgctccttcctgccggacgcggcaccgttccagccaccatcgttcgactggctgacgccctatcagaa

SEQ ID NO: 176789 - DNA, 75 bp, Artificial Sequence
  Synthetic
gcggcaccgttccagccaccatcgttcgactggctgacgccctatcagaaccacgttagctttttcctgcgtatc

SEQ ID NO: 176790 - DNA, 75 bp, Artificial Sequence
  Synthetic
acagttcatatccctcccctggcaggacctgacggtcgactgtccaacgcggtttgaaaattctaaatatatcaa

SEQ ID NO: 176791 - DNA, 75 bp, Artificial Sequence
  Synthetic
gacctgacggtcgactgtccaacgcggtttgaaaattctaaatatatcaaaaattctctgtactgccagcgtctg

SEQ ID NO: 176792 - DNA, 75 bp, Artificial Sequence
  Synthetic
ccagcacgtgatacacgccctcaatgccaccgatctccagcaggccacggcgggcacgcacctggaaaacgcagc

SEQ ID NO: 176793 - DNA, 75 bp, Artificial Sequence
  Synthetic
gccaccgatctccagcaggccacggcgggcacgcacctggaaaacgcagccagagagtacgaaggcctggccgcc

SEQ ID NO: 176794 - DNA, 75 bp, Artificial Sequence
  Synthetic
gggcccgctgtcaaagcgacatactttatttcccagtcctccaaatgtgacgctggctcagtgcttcgaggctgc

SEQ ID NO: 176795 - DNA, 75 bp, Artificial Sequence
  Synthetic
ttatttcccagtcctccaaatgtgacgctggctcagtgcttcgaggctgcgggcatgcttccccatcaaaagatg

SEQ ID NO: 176796 - DNA, 75 bp, Artificial Sequence
  Synthetic
agcggactacatagatgccattcacagcgcggcagtggtggtaactcccgagagacccacgctggtcgtcccgaa

SEQ ID NO: 176797 - DNA, 75 bp, Artificial Sequence
  Synthetic
agcgcggcagtggtggtaactcccgagagacccacgctggtcgtcccgaaaacgtacattcctagcgcgcgaatt

SEQ ID NO: 176798 - DNA, 75 bp, Artificial Sequence
  Synthetic
gcccaacttcaaccagttctatagctttgagaatcaagacataaaccatctgcaaaagagagcttgggaatatat

SEQ ID NO: 176799 - DNA, 75 bp, Artificial Sequence
  Synthetic
tgcaaaagagagcttgggaatatatcagagagctggtattatcggtttctctgtacaacagaacttgggagaggg

SEQ ID NO: 176800 - DNA, 75 bp, Artificial Sequence
  Synthetic
ggacgccagatgcctcgcacagcaaagggcggccttcgaggacatagacagagaaatccgggcagccgaggcgca

SEQ ID NO: 176801 - DNA, 75 bp, Artificial Sequence
  Synthetic
agggcggccttcgaggacatagacagagaaatccgggcagccgaggcgcaacggaaagccggcagagaagagagt

SEQ ID NO: 176802 - DNA, 75 bp, Artificial Sequence
  Synthetic
aaacccgcaggactcacaacggggctgtacctaacatttgagacatctgcgcccttggtgttggtggataaaaaa

SEQ ID NO: 176803 - DNA, 75 bp, Artificial Sequence
  Synthetic
tgtacctaacatttgagacatctgcgcccttggtgttggtggataaaaaatatggctggatatttaaagacctgt

SEQ ID NO: 176804 - DNA, 75 bp, Artificial Sequence
  Synthetic
ggccatctcggggcgtccgctgaatccgcaagccccgaccggcttcctggagagcatcgttcacgaggacgtcct

SEQ ID NO: 176805 - DNA, 75 bp, Artificial Sequence
  Synthetic
ccgcaagccccgaccggcttcctggagagcatcgttcacgaggacgtcctgggtcgcgaaacatacgaggttgcg

SEQ ID NO: 176806 - DNA, 75 bp, Artificial Sequence
  Synthetic
gtctagattggccaccctggggactgtcatcctgttggtctgcttttgcgcaggcgcggcgcactcgaggggtga

SEQ ID NO: 176807 - DNA, 75 bp, Artificial Sequence
  Synthetic
tgccgtcctggatgaacaacaaaaactgcaaaggttaacggaagaagccacaaaacagcgccacatagtagaagc

SEQ ID NO: 176808 - DNA, 75 bp, Artificial Sequence
  Synthetic
ctgcaaaggttaacggaagaagccacaaaacagcgccacatagtagaagcttgtttggcgctggaagacgccgca

SEQ ID NO: 176809 - DNA, 75 bp, Artificial Sequence
  Synthetic
cccccaccaaacctggtgaggaagcatctggtcctaagagtgtggacttttaccagttcagagtgtgtagtgcat

SEQ ID NO: 176810 - DNA, 75 bp, Artificial Sequence
  Synthetic
gtcccaccgcgtcgtcggcgggaaagccacggtcgatggctggaaatcaaaacttgaggaaattcgctcattggt

SEQ ID NO: 176811 - DNA, 75 bp, Artificial Sequence
  Synthetic
accaaagacaagtaccaccaagaaggaattttactggtgtacaaaaaaaacatagtgcctcatatctttaaggtg

SEQ ID NO: 176812 - DNA, 75 bp, Artificial Sequence
  Synthetic
gaattttactggtgtacaaaaaaaacatagtgcctcatatctttaaggtgcggcgctataggaaaattgccacct

SEQ ID NO: 176813 - DNA, 75 bp, Artificial Sequence
  Synthetic
gccacggtcgatggctggaaatcaaaacttgaggaaattcgctcattggtaaaagccgcggagcaaaccagcgtt

SEQ ID NO: 176814 - DNA, 75 bp, Artificial Sequence
  Synthetic
gacggcggagctcacggaactgtatcagcgctgtcaagaaacactgggaaaccttaaaagcgacaccgccaaagc

SEQ ID NO: 176815 - DNA, 75 bp, Artificial Sequence
  Synthetic
gaactcccgagacccgtgccactctatgagataagccacatggacagcacctatcagtgctttagttccatgaag

SEQ ID NO: 176816 - DNA, 75 bp, Artificial Sequence
  Synthetic
atgagataagccacatggacagcacctatcagtgctttagttccatgaaggtaaatgtcaacggggtagaaaaca

SEQ ID NO: 176817 - DNA, 75 bp, Artificial Sequence
  Synthetic
cagcgctgtcaagaaacactgggaaaccttaaaagcgacaccgccaaagcaccaatggtaaccctccgtgagaag

SEQ ID NO: 176818 - DNA, 75 bp, Artificial Sequence
  Synthetic
ctttgtgtctacacaacccgccatcttttctgcctttccactgacgcgagaagtcgttggtgacctgccgccaaa

SEQ ID NO: 176819 - DNA, 75 bp, Artificial Sequence
  Synthetic
gaggggcttacggataacattcaaaggtactttagccagccggtcatctacgcggaacccggctggtttcccggc

SEQ ID NO: 176820 - DNA, 75 bp, Artificial Sequence
  Synthetic
ttttctgcctttccactgacgcgagaagtcgttggtgacctgccgccaaatccgctaccattcgagacagcgggg

SEQ ID NO: 176821 - DNA, 75 bp, Artificial Sequence
  Synthetic
attgcgagatagtggacatgatagccaggtctgctgaaccatacaattactttgtcacgtcactgggtgacacgg

SEQ ID NO: 176822 - DNA, 75 bp, Artificial Sequence
  Synthetic
atggatccttaccacgcccatctttgatcccgactctccagccgctattccagaggggggtcgagaacccccgct

SEQ ID NO: 176823 - DNA, 75 bp, Artificial Sequence
  Synthetic
gatcccgactctccagccgctattccagaggggggtcgagaacccccgctgcatcgacaactgatcttcttaaat

SEQ ID NO: 176824 - DNA, 75 bp, Artificial Sequence
  Synthetic
tagatgtacgtgttggtgatgctcacaacaaaagcccaaatccctcctttatacccagctttaaatactttattg

SEQ ID NO: 176825 - DNA, 75 bp, Artificial Sequence
  Synthetic
agcaacaaaaatggccttagcgtccaagtagttctcaaccacactgtggtcacgtactctgacagaggaaccagt

SEQ ID NO: 176826 - DNA, 75 bp, Artificial Sequence
  Synthetic
aagtagttctcaaccacactgtggtcacgtactctgacagaggaaccagtcccactccccaaaacaggatctttg

SEQ ID NO: 176827 - DNA, 75 bp, Artificial Sequence
  Synthetic
cacggtgggtttgccaggtaccgcggcggcacgccgcggtgcggaagcggcctcgtggtttctaaaccaatggga

SEQ ID NO: 176828 - DNA, 75 bp, Artificial Sequence
  Synthetic
gcggcacgccgcggtgcggaagcggcctcgtggtttctaaaccaatgggaggacgtgtcacgcctccttccagag

SEQ ID NO: 176829 - DNA, 75 bp, Artificial Sequence
  Synthetic
gccgtgtgtccgctggcactgtggaaaaccttcccgcgctccatccagactacccacgaggacagcttccacttt

SEQ ID NO: 176830 - DNA, 75 bp, Artificial Sequence
  Synthetic
aaaccttcccgcgctccatccagactacccacgaggacagcttccactttgtggccaacgagatcacggccacct

SEQ ID NO: 176831 - DNA, 75 bp, Artificial Sequence
  Synthetic
gaatcggttcctagccatgtgcgtgttcacatatctgatttacgcggcaagcccgacggtatcggtgccatcgtc

SEQ ID NO: 176832 - DNA, 75 bp, Artificial Sequence
  Synthetic
ttcacatatctgatttacgcggcaagcccgacggtatcggtgccatcgtcggacgagataccgatagacgccttt

SEQ ID NO: 176833 - DNA, 75 bp, Artificial Sequence
  Synthetic
ctgacctcggatatcaacaccacgctaaacgccagcaaggccaaactggcgagcactcacgtccctaacgggacg

SEQ ID NO: 176834 - DNA, 75 bp, Artificial Sequence
  Synthetic
taaacgccagcaaggccaaactggcgagcactcacgtccctaacgggacggtccagtacttccacacaacaggcg

SEQ ID NO: 176835 - DNA, 75 bp, Artificial Sequence
  Synthetic
tatctggcccacgtgggtttcagccgtgctaaaggaggggtcgtacgcagaagcgcttcaagtctgcacgttcac

SEQ ID NO: 176836 - DNA, 75 bp, Artificial Sequence
  Synthetic
gtgctaaaggaggggtcgtacgcagaagcgcttcaagtctgcacgttcactctggcccccctgttgcgggccgtt

SEQ ID NO: 176837 - DNA, 75 bp, Artificial Sequence
  Synthetic
cagggcgacagcgggaaccccacgtcatcgccgcccccctccgcatcccccatgaccacctctgccagccgcaga

SEQ ID NO: 176838 - DNA, 75 bp, Artificial Sequence
  Synthetic
catcgccgcccccctccgcatcccccatgaccacctctgccagccgcagaaagagacggtcagccagtaccgctg

SEQ ID NO: 176839 - DNA, 75 bp, Artificial Sequence
  Synthetic
gcgcctacaaaactacggagctccagaagcctttccgttttttccagacgaatggcaaacgatcgatgttcggga

SEQ ID NO: 176840 - DNA, 75 bp, Artificial Sequence
  Synthetic
gaagcctttccgttttttccagacgaatggcaaacgatcgatgttcgggaccagttgtggcagcgcaaagaattc

SEQ ID NO: 176841 - DNA, 75 bp, Artificial Sequence
  Synthetic
tttgcctacgacaaactgcgggatggcattaatcaggtgttagaagaactctccagggcatggtgtcgcgagcag

SEQ ID NO: 176842 - DNA, 75 bp, Artificial Sequence
  Synthetic
gcattaatcaggtgttagaagaactctccagggcatggtgtcgcgagcaggtcagggacaacctaatgtggtacg

SEQ ID NO: 176843 - DNA, 75 bp, Artificial Sequence
  Synthetic
gtgggccttgacgcaccttcacccggcatccgtagagcacctatgggcttcactgcgcccgctgaacgtgtcagc

SEQ ID NO: 176844 - DNA, 75 bp, Artificial Sequence
  Synthetic
gcatccgtagagcacctatgggcttcactgcgcccgctgaacgtgtcagcttccgacacgccagtaacgctactc

SEQ ID NO: 176845 - DNA, 75 bp, Artificial Sequence
  Synthetic
cctgtatccgccaagttcgtaggagacgccatttccgtgaccgagtgcattaacgtggaccagagctccgtaaac

SEQ ID NO: 176846 - DNA, 75 bp, Artificial Sequence
  Synthetic
acgccatttccgtgaccgagtgcattaacgtggaccagagctccgtaaacatccacaagagcctcagaaccaata

SEQ ID NO: 176847 - DNA, 75 bp, Artificial Sequence
  Synthetic
agaggccaaggaaaacgaacctccatatcagtacggtcgccccagcgggagcatgctcacgatgcgtactccgga

SEQ ID NO: 176848 - DNA, 75 bp, Artificial Sequence
  Synthetic
tatcagtacggtcgccccagcgggagcatgctcacgatgcgtactccggataggctgccacgtcacgacgggcca

SEQ ID NO: 176849 - DNA, 75 bp, Artificial Sequence
  Synthetic
agttccaacctattcaccggccagctgggcgcgcgcaatgagataatactgaccaacaaccaggtggaaacctgc

SEQ ID NO: 176850 - DNA, 75 bp, Artificial Sequence
  Synthetic
tgggcgcgcgcaatgagataatactgaccaacaaccaggtggaaacctgcaaagacacctgcgaacactacttca

SEQ ID NO: 176851 - DNA, 75 bp, Artificial Sequence
  Synthetic
tctgcgaatattcgtcaccgcttctacccatcgtatttccaaaacacgaggaggattcctgctacttacaccggt

SEQ ID NO: 176852 - DNA, 75 bp, Artificial Sequence
  Synthetic
acccatcgtatttccaaaacacgaggaggattcctgctacttacaccggttcttgattgtagtcttgacagcgaa

SEQ ID NO: 176853 - DNA, 75 bp, Artificial Sequence
  Synthetic
ataaacaccactgacatatccaccctgaacacttttatcgccctgaatctatcctttattcaaaacatagacttc

SEQ ID NO: 176854 - DNA, 75 bp, Artificial Sequence
  Synthetic
tgaacacttttatcgccctgaatctatcctttattcaaaacatagacttcaaggccatcgagctgtacagcagtg

SEQ ID NO: 176855 - DNA, 75 bp, Artificial Sequence
  Synthetic
tacgcagcgagggattcatacaacggaggagctccaaatcttcgccagacaagcggcatggctccgtcacgcctt

SEQ ID NO: 176856 - DNA, 75 bp, Artificial Sequence
  Synthetic
gaggagctccaaatcttcgccagacaagcggcatggctccgtcacgccttcgcctcgagtcccagcgacgcgcgc

SEQ ID NO: 176857 - DNA, 75 bp, Artificial Sequence
  Synthetic
gagtacaactactacacacatcgtctcgcgggtttgcgcgaggatctggacaacaccatagatatgaacaaggag

SEQ ID NO: 176858 - DNA, 75 bp, Artificial Sequence
  Synthetic
tcgcgggtttgcgcgaggatctggacaacaccatagatatgaacaaggagcgcttcgtaagggacttgtcggaga

SEQ ID NO: 176859 - DNA, 75 bp, Artificial Sequence
  Synthetic
cgccacatatgtccctcgtgtaacttcctcgccagacaatcgccctttctacctgattccaggaaaaccaacggg

SEQ ID NO: 176860 - DNA, 75 bp, Artificial Sequence
  Synthetic
tcctcgccagacaatcgccctttctacctgattccaggaaaaccaacgggcaggtggcccgaaattctggctctt

SEQ ID NO: 176861 - DNA, 75 bp, Artificial Sequence
  Synthetic
agcgtggtcactctatgtggctcattggttaccggattcataaattttattaaacaccccctaggtggcatgctg

SEQ ID NO: 176862 - DNA, 75 bp, Artificial Sequence
  Synthetic
tggttaccggattcataaattttattaaacaccccctaggtggcatgctgatgatcattatcgttatagcaatca

SEQ ID NO: 176863 - DNA, 75 bp, Artificial Sequence
  Synthetic
ttttgcgcgcctaacggagagtcagcgaagagcgacctccgccgacgtgtttgccgcggtacctcgtaacatcgg

SEQ ID NO: 176864 - DNA, 75 bp, Artificial Sequence
  Synthetic
cgaagagcgacctccgccgacgtgtttgccgcggtacctcgtaacatcggcgctccgccggaagcgtcgccaccc

SEQ ID NO: 176865 - DNA, 75 bp, Artificial Sequence
  Synthetic
ccggtgaagatgatctaccccgacgtagatcgcagggcacctcctagcggcggagccccaacacgggaggaaatc

SEQ ID NO: 176866 - DNA, 75 bp, Artificial Sequence
  Synthetic
tagatcgcagggcacctcctagcggcggagccccaacacgggaggaaatcaaaaacatcctgctgggaatgcacc

SEQ ID NO: 176867 - DNA, 75 bp, Artificial Sequence
  Synthetic
caagcgccgccactccagaacgccagctctaactaccgtaaacgccgggcaattcctgccaccggcgaatctggc

SEQ ID NO: 176868 - DNA, 75 bp, Artificial Sequence
  Synthetic
gctctaactaccgtaaacgccgggcaattcctgccaccggcgaatctggccggcgcgcttgaacatcgggcagtt

SEQ ID NO: 176869 - DNA, 75 bp, Artificial Sequence
  Synthetic
ccctcggtgtttcagcgtaccgcaaacggccttcgtcagcgtctgagaggatataaacctctgactcaatcgcta

SEQ ID NO: 176870 - DNA, 75 bp, Artificial Sequence
  Synthetic
gactctggttaaaaaagtccaaaacggtacattgcacccgacgccacgcatacgtcccccgtccccaataaggac

SEQ ID NO: 176871 - DNA, 75 bp, Artificial Sequence
  Synthetic
gacatcagtccggaaacgggggagtgacagtggattcgaggttattgtttgatgtaaatttaggaaacacggccc

SEQ ID NO: 176872 - DNA, 75 bp, Artificial Sequence
  Synthetic
ggtacattgcacccgacgccacgcatacgtcccccgtccccaataaggacacctgatgtaacccccccattgcgc

SEQ ID NO: 176873 - DNA, 75 bp, Artificial Sequence
  Synthetic
ggcccttttgtttaagagggactggagcgcgctgtcgtccacggtaatctcgccgaccgccaaggccagcattgt

SEQ ID NO: 176874 - DNA, 75 bp, Artificial Sequence
  Synthetic
cacagacacaaattaccgtccgcagatcatggattttttcaatccatttatcgacccaactcgcggaggcccgag

SEQ ID NO: 176875 - DNA, 75 bp, Artificial Sequence
  Synthetic
acagaatttggacactgcaccgctcacgcccaccaacagaccttcaagcacgacaaccgaaacccaaccgaagct

SEQ ID NO: 176876 - DNA, 75 bp, Artificial Sequence
  Synthetic
atcatggattttttcaatccatttatcgacccaactcgcggaggcccgagaaacactgtgaggcaacccacgccg

SEQ ID NO: 176877 - DNA, 75 bp, Artificial Sequence
  Synthetic
acgcccaccaacagaccttcaagcacgacaaccgaaacccaaccgaagctcaacggcagtaaaaaaagaaccccc

SEQ ID NO: 176878 - DNA, 75 bp, Artificial Sequence
  Synthetic
ggcctgtttccaaaccccggggcgacccggcgtggttgccgtggacaccacatttccacccacctacttccaggg

SEQ ID NO: 176879 - DNA, 75 bp, Artificial Sequence
  Synthetic
aactcccattagcccgtcatcggaatacgtcgcctactccgatgagggcttaaccgtggattcaaagagtcccga

SEQ ID NO: 176880 - DNA, 75 bp, Artificial Sequence
  Synthetic
cccggcgtggttgccgtggacaccacatttccacccacctacttccagggccccaagcggggagaagtattcgcg

SEQ ID NO: 176881 - DNA, 75 bp, Artificial Sequence
  Synthetic
tacgtcgcctactccgatgagggcttaaccgtggattcaaagagtcccgatagagaagcccaagagaacgagtcg

SEQ ID NO: 176882 - DNA, 75 bp, Artificial Sequence
  Synthetic
tcctatgtcgcacctcatattccacgtatacgacatcgtggagaccacctacacggccgaccgctgcgaggacgt

SEQ ID NO: 176883 - DNA, 75 bp, Artificial Sequence
  Synthetic
actgccgacgctaccaaaaacaggccgcgaactatccgcggaacagagaccacaacctctaaaatcctggccggc

SEQ ID NO: 176884 - DNA, 75 bp, Artificial Sequence
  Synthetic
gtatacgacatcgtggagaccacctacacggccgaccgctgcgaggacgtgccatttagcttccagactgatatc

SEQ ID NO: 176885 - DNA, 75 bp, Artificial Sequence
  Synthetic
cgcgaactatccgcggaacagagaccacaacctctaaaatcctggccggcaccacgcatcatcgtccgtcccgcc

SEQ ID NO: 176886 - DNA, 75 bp, Artificial Sequence
  Synthetic
cagtgtctgcgtgaacgttttcaggcagcgctgctacttctacacactagcaccccagggggtaaacctgaccca

SEQ ID NO: 176887 - DNA, 75 bp, Artificial Sequence
  Synthetic
catacccctgccacagagctctccagaagcatcccctcccgattctccaacctcgccccggtggcaggaaatacc

SEQ ID NO: 176888 - DNA, 75 bp, Artificial Sequence
  Synthetic
cagcgctgctacttctacacactagcaccccagggggtaaacctgacccacgtcctccagcaggccctccaggct

SEQ ID NO: 176889 - DNA, 75 bp, Artificial Sequence
  Synthetic
gaagcatcccctcccgattctccaacctcgccccggtggcaggaaatacccacgccgctggcattgtcacaaagc

SEQ ID NO: 176890 - DNA, 75 bp, Artificial Sequence
  Synthetic
aatcttgcgcgcgtacgacacacaacaatatgctgtgcaaaaaataaccctgtcatccagtccgatgatgcgaac

SEQ ID NO: 176891 - DNA, 75 bp, Artificial Sequence
  Synthetic
cgctaccaacccagacgtgctcggggaaccatccgtccgccgcctaacaagcacagaatcctggacgcccctcgt

SEQ ID NO: 176892 - DNA, 75 bp, Artificial Sequence
  Synthetic
gaaccatccgtccgccgcctaacaagcacagaatcctggacgcccctcgtccccccggctttacaccacgccgac

SEQ ID NO: 176893 - DNA, 75 bp, Artificial Sequence
  Synthetic
gcttagcgaccgcctaacaacctgtgggtgcgaggtgtttgagtccaatgtggacgccattaggcgcttcgtgct

SEQ ID NO: 176894 - DNA, 75 bp, Artificial Sequence
  Synthetic
gcgggtcgcggcattggccacctcgctagcgcaaaccgtcactcgaataaaagcatggtatctataacaaaacac

SEQ ID NO: 176895 - DNA, 75 bp, Artificial Sequence
  Synthetic
ctagcgcaaaccgtcactcgaataaaagcatggtatctataacaaaacacaatttattttctttttgcagtgaga

SEQ ID NO: 176896 - DNA, 75 bp, Artificial Sequence
  Synthetic
cccgcacccaggccagagactcttggacggaactggagtttgactgcagctgggaggacctaaagtttatcccgg

SEQ ID NO: 176897 - DNA, 75 bp, Artificial Sequence
  Synthetic
gacggaactggagtttgactgcagctgggaggacctaaagtttatcccggagaggacggagtggcccccatacac

SEQ ID NO: 176898 - DNA, 75 bp, Artificial Sequence
  Synthetic
ctggggggtggcggatgcgggcgcagaggacacgtgactaccagcagacgtcagggtagttataatctctgcatt

SEQ ID NO: 176899 - DNA, 75 bp, Artificial Sequence
  Synthetic
gaggacacgtgactaccagcagacgtcagggtagttataatctctgcattagatccctttacgctcgctgcggta

SEQ ID NO: 176900 - DNA, 75 bp, Artificial Sequence
  Synthetic
cgactcaagacgaggacatgattatacaaatctcgtgtgttttacacacagtcggcaacgataaaccgtacaccc

SEQ ID NO: 176901 - DNA, 75 bp, Artificial Sequence
  Synthetic
cacggggggcgtgacctgggcacccgagtcgagggaggcaggcgcgcccgccagcgaagagagccccagccccgg

SEQ ID NO: 176902 - DNA, 75 bp, Artificial Sequence
  Synthetic
cgacccccttcctggggtggaggtctttgagtttccttcggagtacgacatgctggccgccttcctcagcatgct

SEQ ID NO: 176903 - DNA, 75 bp, Artificial Sequence
  Synthetic
tgctggccgccttcctcagcatgctccgcgattacaatgtggagtttataacggggtacaacatagcaaactttg

SEQ ID NO: 176904 - DNA, 75 bp, Artificial Sequence
  Synthetic
ccgcgattacaatgtggagtttataacggggtacaacatagcaaactttgaccttccatacatcatagcccgggc

SEQ ID NO: 176905 - DNA, 75 bp, Artificial Sequence
  Synthetic
gagtcgagggaggcaggcgcgcccgccagcgaagagagccccagccccggaccgcgacccgctcggtctggcagc

SEQ ID NO: 176906 - DNA, 75 bp, Artificial Sequence
  Synthetic
ctgtctcagatatgcctcatagtgatgatgggcgatgagaaacaccaggtagttacgcttctgcgttagatactg

SEQ ID NO: 176907 - DNA, 75 bp, Artificial Sequence
  Synthetic
tgatgggcgatgagaaacaccaggtagttacgcttctgcgttagatactgggcatcggacatgctgccctggtct

SEQ ID NO: 176908 - DNA, 75 bp, Artificial Sequence
  Synthetic
ggtccgtgtttgaggtccaccaacccagaggcggttccgatgggggcaacttcatgaggtcccagtcaaaggtca

SEQ ID NO: 176909 - DNA, 75 bp, Artificial Sequence
  Synthetic
cagaggcggttccgatgggggcaacttcatgaggtcccagtcaaaggtcaaaatatcggggatcgtccccataga

SEQ ID NO: 176910 - DNA, 75 bp, Artificial Sequence
  Synthetic
acgttcctgcaccagtgggtccctgacacgaaacccagccatgatgagaaatatccttttcaccgtgcacacttc

SEQ ID NO: 176911 - DNA, 75 bp, Artificial Sequence
  Synthetic
acacgaaacccagccatgatgagaaatatccttttcaccgtgcacacttcgcacacagaaactcgctcaacgctg

SEQ ID NO: 176912 - DNA, 75 bp, Artificial Sequence
  Synthetic
acacagtggctaagcaatgcctcggtcgacaaaaagatgacatctcatacaaggacatacccccgctttttaaat

SEQ ID NO: 176913 - DNA, 75 bp, Artificial Sequence
  Synthetic
tcgcattcgggagccccaagacagggcacggcgaaactgatattctgctctaaatccgaaatggccagggctgca

SEQ ID NO: 176914 - DNA, 75 bp, Artificial Sequence
  Synthetic
gcacggcgaaactgatattctgctctaaatccgaaatggccagggctgcattgttggcgagcacagcgcggagca

SEQ ID NO: 176915 - DNA, 75 bp, Artificial Sequence
  Synthetic
ggaaatagccaagctggccaagatccccacccgtagggtactgacggacggccaacagatcagggtattttcctg

SEQ ID NO: 176916 - DNA, 75 bp, Artificial Sequence
  Synthetic
cgcatgtgctcgctgccacagtaggaacaatagaccctgccggtggttccgcagacagaaaactgcttttctttt

SEQ ID NO: 176917 - DNA, 75 bp, Artificial Sequence
  Synthetic
ggttacattctccccgtcccaaaaggagacgcggttagcgggtatcagggggccactgtaataagcccctctccg

SEQ ID NO: 176918 - DNA, 75 bp, Artificial Sequence
  Synthetic
aacaatagaccctgccggtggttccgcagacagaaaactgcttttctttttggtctcgactgaagaagacgttag

SEQ ID NO: 176919 - DNA, 75 bp, Artificial Sequence
  Synthetic
ggccactgtaataagcccctctccgggattctatgacgaccccgtactcgtggtggattttgccagcttgtaccc

SEQ ID NO: 176920 - DNA, 75 bp, Artificial Sequence
  Synthetic
ggattctatgacgaccccgtactcgtggtggattttgccagcttgtaccccagtatcatccaagcgcacaacttg

SEQ ID NO: 176921 - DNA, 75 bp, Artificial Sequence
  Synthetic
tgtccacattccaagcataccaccgccctagcacacgttggcagcttggccctcgcagcagccgcaacgctatcg

SEQ ID NO: 176922 - DNA, 75 bp, Artificial Sequence
  Synthetic
ccctagcacacgttggcagcttggccctcgcagcagccgcaacgctatcggaaaccatgggcagggatacgcagg

SEQ ID NO: 176923 - DNA, 75 bp, Artificial Sequence
  Synthetic
ctccccggacgactacgaaacctttgtcctcagcggaggtccggtccactttgtaaaaaaacacaaaagggagtc

SEQ ID NO: 176924 - DNA, 75 bp, Artificial Sequence
  Synthetic
gtcctcagcggaggtccggtccactttgtaaaaaaacacaaaagggagtcccttcttgccaagcttctgacggta

SEQ ID NO: 176925 - DNA, 75 bp, Artificial Sequence
  Synthetic
tcctgggccccggactccgtgacaggtaacaccacgcgcggtgtatgcgcgagacacgcgaagccgagcgccaaa

SEQ ID NO: 176926 - DNA, 75 bp, Artificial Sequence
  Synthetic
gtaacaccacgcgcggtgtatgcgcgagacacgcgaagccgagcgccaaaagcatggcgtcaaacggtcggccgc

SEQ ID NO: 176927 - DNA, 75 bp, Artificial Sequence
  Synthetic
ccccgcactgaaaactattctagacaaacaacaactggccatcaaggttacctgcaacgccgtttacggcttcac

SEQ ID NO: 176928 - DNA, 75 bp, Artificial Sequence
  Synthetic
aaacaacaactggccatcaaggttacctgcaacgccgtttacggcttcacgggcgttgcctctggcatactgcct

SEQ ID NO: 176929 - DNA, 75 bp, Artificial Sequence
  Synthetic
gccgcgccagccggcgtcgacaccacggtaccgcgcgcgctaggagcaggaacctctaggcccccccgctgcaaa

SEQ ID NO: 176930 - DNA, 75 bp, Artificial Sequence
  Synthetic
cggtaccgcgcgcgctaggagcaggaacctctaggcccccccgctgcaaagatgtcccgtgccaccgtttgcgca

SEQ ID NO: 176931 - DNA, 75 bp, Artificial Sequence
  Synthetic
gagatctcaggcctttgtagaggccatctcgccggaacgcctagcgggtctcctgcggaggccagtagacgtctc

SEQ ID NO: 176932 - DNA, 75 bp, Artificial Sequence
  Synthetic
atctcgccggaacgcctagcgggtctcctgcggaggccagtagacgtctcacccgacgcccgattcaaggtcata

SEQ ID NO: 176933 - DNA, 75 bp, Artificial Sequence
  Synthetic
cgcacagagagccccacaaagcgagagagttgagcgcatgccttaacaaacggcatagagagatactttaaccac

SEQ ID NO: 176934 - DNA, 75 bp, Artificial Sequence
  Synthetic
agagttgagcgcatgccttaacaaacggcatagagagatactttaaccacacgtatctggggggtaaccgcaggc

SEQ ID NO: 176935 - DNA, 75 bp, Artificial Sequence
  Synthetic
cagcgtgtcagacttcgcggaggagctagcgtcaatcaccaccaacacgctgtttcgtagccccatcaagctgga

SEQ ID NO: 176936 - DNA, 75 bp, Artificial Sequence
  Synthetic
ctagcgtcaatcaccaccaacacgctgtttcgtagccccatcaagctggaggctgaaaagatcttcaagtgcctt

SEQ ID NO: 176937 - DNA, 75 bp, Artificial Sequence
  Synthetic
acgtaagcgctcagtaagcgctgcccagaatacagcaacgcggttttagcgggaacgtcgtcttcgcggcccagc

SEQ ID NO: 176938 - DNA, 75 bp, Artificial Sequence
  Synthetic
cagaatacagcaacgcggttttagcgggaacgtcgtcttcgcggcccagcaagcagacaattgcctgtcccaacg

SEQ ID NO: 176939 - DNA, 75 bp, Artificial Sequence
  Synthetic
tctgatgaagggcgtagacctcattaggaaaacagcctgtcgttttgtccaggaaaagagcagtcaggtcctgga

SEQ ID NO: 176940 - DNA, 75 bp, Artificial Sequence
  Synthetic
aggaaaacagcctgtcgttttgtccaggaaaagagcagtcaggtcctggacctcatactgcgggagccgagcgtc

SEQ ID NO: 176941 - DNA, 75 bp, Artificial Sequence
  Synthetic
ggggacccaaacaccaaaaatccaaggtactcttccgggggcgctccagagtcgccctcgaatacaccatatgac

SEQ ID NO: 176942 - DNA, 75 bp, Artificial Sequence
  Synthetic
ggtactcttccgggggcgctccagagtcgccctcgaatacaccatatgacgttaggtgggacggatccaaacgca

SEQ ID NO: 176943 - DNA, 75 bp, Artificial Sequence
  Synthetic
ggaagggctcccagaggggttcgtcaagataattcaagtgctcaacgcgagccaccgggaactgtgcgaacgcag

SEQ ID NO: 176944 - DNA, 75 bp, Artificial Sequence
  Synthetic
cgtaccagtagacaaactgacgtttaccaccgagctaagccgcccgctggcggactacaagacgcaaaacctccc

SEQ ID NO: 176945 - DNA, 75 bp, Artificial Sequence
  Synthetic
gcaggcctccgaaaagcaggcccgcgattccagccgcacgcggtagcaggcgcccaacggcgggtgtcccgagga

SEQ ID NO: 176946 - DNA, 75 bp, Artificial Sequence
  Synthetic
gattccagccgcacgcggtagcaggcgcccaacggcgggtgtcccgaggacaaagtccgcggcgctatccgggac

SEQ ID NO: 176947 - DNA, 75 bp, Artificial Sequence
  Synthetic
agatacacgacagaatcccctacgtgttcgtcgacgccccaggtagcctgcgctccgagctggcagagcaccccg

SEQ ID NO: 176948 - DNA, 75 bp, Artificial Sequence
  Synthetic
caccaacgtctgctgctggactagccagagacgagacagtgtccagcagggatcgcagccttttgtgactcttgg

SEQ ID NO: 176949 - DNA, 75 bp, Artificial Sequence
  Synthetic
cagagacgagacagtgtccagcagggatcgcagccttttgtgactcttgggcgtgaccacaagaaactgtaacac

SEQ ID NO: 176950 - DNA, 75 bp, Artificial Sequence
  Synthetic
agtacgtcaagcagcacggactgcgcgtggcggtggacctgtacttcgacaagctggtacacgcggtagccaaca

SEQ ID NO: 176951 - DNA, 75 bp, Artificial Sequence
  Synthetic
cgttgagattatgcgaaaatacaagccccgccttaaactttgtgaaatcgtcctcgcccaacacgacggaggcgt

SEQ ID NO: 176952 - DNA, 75 bp, Artificial Sequence
  Synthetic
tataactttttagacattcccgtgacttttcccacgccctagtgactcagacgcggaaacagcgcctagaaagtt

SEQ ID NO: 176953 - DNA, 75 bp, Artificial Sequence
  Synthetic
cttttcccacgccctagtgactcagacgcggaaacagcgcctagaaagtttcctcttgcgctatgtgggacaact

SEQ ID NO: 176954 - DNA, 75 bp, Artificial Sequence
  Synthetic
ccccgccttaaactttgtgaaatcgtcctcgcccaacacgacggaggcgttctttgcgaggtgtacgtcggaatc

SEQ ID NO: 176955 - DNA, 75 bp, Artificial Sequence
  Synthetic
cgaaacacttgagtgtggttgtcagcccgttgttagaaatcacaaaacacggggtacgcgcgtagcgcaggtccc

SEQ ID NO: 176956 - DNA, 75 bp, Artificial Sequence
  Synthetic
aaaaaaataatgcagacagaggcaacgttcatcctaggtgactgggagataacggtgtctaactgccggtttact

SEQ ID NO: 176957 - DNA, 75 bp, Artificial Sequence
  Synthetic
cgttcatcctaggtgactgggagataacggtgtctaactgccggtttacttgcagcagcctaacatgtggccccc

SEQ ID NO: 176958 - DNA, 75 bp, Artificial Sequence
  Synthetic
cccgttgttagaaatcacaaaacacggggtacgcgcgtagcgcaggtcccggaggatatgaagccagaatttgta

SEQ ID NO: 176959 - DNA, 75 bp, Artificial Sequence
  Synthetic
cggcagccgatgcgcctttggcgtaaacgggcgccccgtcgtagcacctttccagctctaccggctgcccgggtt

SEQ ID NO: 176960 - DNA, 75 bp, Artificial Sequence
  Synthetic
gatcgactaatacgtgaccatgccatctttgggctagtgccaaatattgaggatctgttaacccatgggtcatgc

SEQ ID NO: 176961 - DNA, 75 bp, Artificial Sequence
  Synthetic
tctttgggctagtgccaaatattgaggatctgttaacccatgggtcatgcgtcgccgtagtggccgacgcaaacg

SEQ ID NO: 176962 - DNA, 75 bp, Artificial Sequence
  Synthetic
aacgggcgccccgtcgtagcacctttccagctctaccggctgcccgggttgcccgaggtaggcggataccacgcg

SEQ ID NO: 176963 - DNA, 75 bp, Artificial Sequence
  Synthetic
gcacgctcctgaacctcggaataaacggaatccgcgctaacgatcttgcagataactcgccgaactgtctccact

SEQ ID NO: 176964 - DNA, 75 bp, Artificial Sequence
  Synthetic
ttttcagaacccatcggcatttgggtacgcggccctccgccgcaaacgcgcaaggaagctattaagttctgcata

SEQ ID NO: 176965 - DNA, 75 bp, Artificial Sequence
  Synthetic
tacgcggccctccgccgcaaacgcgcaaggaagctattaagttctgcatattttttgtcagtcccctgcccccgc

SEQ ID NO: 176966 - DNA, 75 bp, Artificial Sequence
  Synthetic
cggaatccgcgctaacgatcttgcagataactcgccgaactgtctccactttgccgtccagaacaatggagtgct

SEQ ID NO: 176967 - DNA, 75 bp, Artificial Sequence
  Synthetic
caataattaagagcgttcagtctggcatagatcgtgggaaacatcagttgcagatcctcaggaagtagttgttca

SEQ ID NO: 176968 - DNA, 75 bp, Artificial Sequence
  Synthetic
gaggaacccgaaacactacactccgccgaggcacccctaccgtcgcgcgagacgctggtaactggacagctgcga

SEQ ID NO: 176969 - DNA, 75 bp, Artificial Sequence
  Synthetic
ccgaggcacccctaccgtcgcgcgagacgctggtaactggacagctgcgatccacctcgccacgaacgtatacgg

SEQ ID NO: 176970 - DNA, 75 bp, Artificial Sequence
  Synthetic
catagatcgtgggaaacatcagttgcagatcctcaggaagtagttgttcaaagtcagggccctcgacagacgcca

SEQ ID NO: 176971 - DNA, 75 bp, Artificial Sequence
  Synthetic
gttcaaatattttacaccacgatccacgccgctcccgtcgtacttgaccgtcccggcgttctaacaagcggcgcg

SEQ ID NO: 176972 - DNA, 75 bp, Artificial Sequence
  Synthetic
gagtccatggggtgtgaaaacgtggaaggtgaccccgagccattgacacccaagtacttgacgttcacgcagacg

SEQ ID NO: 176973 - DNA, 75 bp, Artificial Sequence
  Synthetic
acgccgctcccgtcgtacttgaccgtcccggcgttctaacaagcggcgcgcgccggaacaatgttcgtgccatgg

SEQ ID NO: 176974 - DNA, 75 bp, Artificial Sequence
  Synthetic
caagtacttgacgttcacgcagacgggagaacgactttacaaagtaaccgttcacaacacccattcgacagcatg

SEQ ID NO: 176975 - DNA, 75 bp, Artificial Sequence
  Synthetic
cgcttcgttcctaccggacagacccgaggagagcctgggagaccctctaatgactcaaacacacgaatcacttca

SEQ ID NO: 176976 - DNA, 75 bp, Artificial Sequence
  Synthetic
gaggagagcctgggagaccctctaatgactcaaacacacgaatcacttcagccgtcctcttcctgcagaatatgc

SEQ ID NO: 176977 - DNA, 75 bp, Artificial Sequence
  Synthetic
agcttgtcatgggtcaggcttcacccctcataacaacccctctgggagccagggtattcgcagtctatccagact

SEQ ID NO: 176978 - DNA, 75 bp, Artificial Sequence
  Synthetic
cgaagactacgcatgcgtctgcttgtgctgcctctacgcgcccaactgctggacagcgaccgtcgccgtcgccgc

SEQ ID NO: 176979 - DNA, 75 bp, Artificial Sequence
  Synthetic
ctgttcgagcagcatggtgccaacgccggagaatgcgcctttgtcatcatggggctcgcccgtgaaacaaagttt

SEQ ID NO: 176980 - DNA, 75 bp, Artificial Sequence
  Synthetic
tgctgcctctacgcgcccaactgctggacagcgaccgtcgccgtcgccgcagacctctgtgagctcctggtgcgc

SEQ ID NO: 176981 - DNA, 75 bp, Artificial Sequence
  Synthetic
attcaacccacagacacatcctctgaccattcaacgggacacaatagtgggcgtggcaatggcttgctatatcca

SEQ ID NO: 176982 - DNA, 75 bp, Artificial Sequence
  Synthetic
tcttggggtcgatctacagctacatttttttatacagaagtgtttcaggacaacaccgccagaaaaactcatcgg

SEQ ID NO: 176983 - DNA, 75 bp, Artificial Sequence
  Synthetic
ttttttatacagaagtgtttcaggacaacaccgccagaaaaactcatcggcgcgtcaaacttacagttcattaaa

SEQ ID NO: 176984 - DNA, 75 bp, Artificial Sequence
  Synthetic
ctttaaaacatcctggccaagaacagacagggaagagcctcccacaaacacaccatgttgcaacgcgacagaagt

SEQ ID NO: 176985 - DNA, 75 bp, Artificial Sequence
  Synthetic
gtctgtacaccaccttgccacgtagcgattagggccgaccgccacgaggaacccatgcaatcgtgactgtccgag

SEQ ID NO: 176986 - DNA, 75 bp, Artificial Sequence
  Synthetic
cgattagggccgaccgccacgaggaacccatgcaatcgtgactgtccgagcacatatggcgcaggagtcagagca

SEQ ID NO: 176987 - DNA, 75 bp, Artificial Sequence
  Synthetic
gacagggaagagcctcccacaaacacaccatgttgcaacgcgacagaagttctaaccgcggggcagcggcgcctc

SEQ ID NO: 176988 - DNA, 75 bp, Artificial Sequence
  Synthetic
caatctactgcgactgtttttgcgaacctggcccgaagcggcgggaatccacgacgagaatagcctattggagcc

SEQ ID NO: 176989 - DNA, 75 bp, Artificial Sequence
  Synthetic
gcgagcccgtatgggattccgtcattcaccctagccacatcgtcatctctaatcgagtacccctcttactaagag

SEQ ID NO: 176990 - DNA, 75 bp, Artificial Sequence
  Synthetic
tcaccctagccacatcgtcatctctaatcgagtacccctcttactaagagaacagaacatatgtctcccttcgtg

SEQ ID NO: 176991 - DNA, 75 bp, Artificial Sequence
  Synthetic
tctcttctctaccgtgaatcgcaccttaaacacaacaccagaccgccaccaggtggcacccaacatccattatgg

SEQ ID NO: 176992 - DNA, 75 bp, Artificial Sequence
  Synthetic
acctggcccgaagcggcgggaatccacgacgagaatagcctattggagcctttggatgccgctagctttgaccac

SEQ ID NO: 176993 - DNA, 75 bp, Artificial Sequence
  Synthetic
gtgtctcctccacccaaccctgggtttacgatacaaaaacggcacatcctccgtgtgtatactatgcgagtgtct

SEQ ID NO: 176994 - DNA, 75 bp, Artificial Sequence
  Synthetic
acaacacgcaccgcaagcagcaaacggagacctacactgcattctacgcttttggggaccaaaataacaaggtta

SEQ ID NO: 176995 - DNA, 75 bp, Artificial Sequence
  Synthetic
ggagacctacactgcattctacgcttttggggaccaaaataacaaggttaggatcttgcccactgttgtggaaag

SEQ ID NO: 176996 - DNA, 75 bp, Artificial Sequence
  Synthetic
ttacgatacaaaaacggcacatcctccgtgtgtatactatgcgagtgtctggcggcccatccagaggcccccgct

SEQ ID NO: 176997 - DNA, 75 bp, Artificial Sequence
  Synthetic
aaagcttgtcgatcgcatcgctttcgtcctcgagggtccgaacgccctaccgtatgtgtcggatccccttctccg

SEQ ID NO: 176998 - DNA, 75 bp, Artificial Sequence
  Synthetic
tcgccgtgggagggctcaaaataataatacttgctctcaccctggtgcatgcccaaggagtgtacctgcgttgcg

SEQ ID NO: 176999 - DNA, 75 bp, Artificial Sequence
  Synthetic
gtcctcgagggtccgaacgccctaccgtatgtgtcggatccccttctccgatgcgttctgctgcacagagacccc

SEQ ID NO: 177000 - DNA, 75 bp, Artificial Sequence
  Synthetic
cgcaccggctattgttcagcgtgaggtgctgagcagcgggtttgagccgcagtttaccgtaactggcattccagt

SEQ ID NO: 177001 - DNA, 75 bp, Artificial Sequence
  Synthetic
caaagcggtttgcgaacgcatcctgtttaacacgccgtctgaaccagagtataaaaagcttcgagccctggtagc

SEQ ID NO: 177002 - DNA, 75 bp, Artificial Sequence
  Synthetic
tttaacacgccgtctgaaccagagtataaaaagcttcgagccctggtagcctcagggcacctactggacaccaat

SEQ ID NO: 177003 - DNA, 75 bp, Artificial Sequence
  Synthetic
gccggctggcaaagccgtttgcacgcctgtccgcggagacgactgaggagtgtcgcgtcaggtctatccgcctcg

SEQ ID NO: 177004 - DNA, 75 bp, Artificial Sequence
  Synthetic
cctgcaacactgtcgggttggcaaaaccaccgcctgcgagataattagagaactggcggggcagctgcgaaagca

SEQ ID NO: 177005 - DNA, 75 bp, Artificial Sequence
  Synthetic
accaccgcctgcgagataattagagaactggcggggcagctgcgaaagcacggtctcgacctcacgcatccagcc

SEQ ID NO: 177006 - DNA, 75 bp, Artificial Sequence
  Synthetic
gactgcgcctgcgcaggaaacgcccgtctgggggctcgtgaccacgagcttcagccttacccccaccgcaccgct

SEQ ID NO: 177007 - DNA, 75 bp, Artificial Sequence
  Synthetic
tcagccttacccccaccgcaccgctggcctttgatcgtaacccgtacaatcacgagacatttgcctgtaacgcca

SEQ ID NO: 177008 - DNA, 75 bp, Artificial Sequence
  Synthetic
ggcctttgatcgtaacccgtacaatcacgagacatttgcctgtaacgccaggcactacatcccagtaatctacag

SEQ ID NO: 177009 - DNA, 75 bp, Artificial Sequence
  Synthetic
gagcgctcgcaggtcgtctgccgtttcggtgcacatgccccccgaccgaagacgggcatcgcacgcttcgaaaat

SEQ ID NO: 177010 - DNA, 75 bp, Artificial Sequence
  Synthetic
tcggtgcacatgccccccgaccgaagacgggcatcgcacgcttcgaaaatgtctctcggcaagcgccgccaccat

SEQ ID NO: 177011 - DNA, 75 bp, Artificial Sequence
  Synthetic
acaacagctacacgtcctccctgccatgcaaagtcacagccatcgtgtcaaaccactgctgtaactgtgacatat

SEQ ID NO: 177012 - DNA, 75 bp, Artificial Sequence
  Synthetic
atgcaaagtcacagccatcgtgtcaaaccactgctgtaactgtgacatatttttagaggactcggaatggcgccc

SEQ ID NO: 177013 - DNA, 75 bp, Artificial Sequence
  Synthetic
gtttttctcggtactcgctaatcgtcacgagctgggcatggacttccttagagagatggacacgccaatttgcac

SEQ ID NO: 177014 - DNA, 75 bp, Artificial Sequence
  Synthetic
cacgagctgggcatggacttccttagagagatggacacgccaatttgcaccaacaagtccgtgatgctccccctg

SEQ ID NO: 177015 - DNA, 75 bp, Artificial Sequence
  Synthetic
tattggagccggacacacacattggaaacgccctcttcatcatcgcacccaaggcccgaggtttacgcagactga

SEQ ID NO: 177016 - DNA, 75 bp, Artificial Sequence
  Synthetic
aaacgccctcttcatcatcgcacccaaggcccgaggtttacgcagactgactcgcttaaccacaaaaaccattga

SEQ ID NO: 177017 - DNA, 75 bp, Artificial Sequence
  Synthetic
ccactcatcaaacatgggatttcagtgcgtactgtgttcccccagcgataaagcggcggtggcgagggcatcggg

SEQ ID NO: 177018 - DNA, 75 bp, Artificial Sequence
  Synthetic
tgcgtactgtgttcccccagcgataaagcggcggtggcgagggcatcgggtctcggcggagacacattaaaagcc

SEQ ID NO: 177019 - DNA, 75 bp, Artificial Sequence
  Synthetic
aaatgtatgttgccaccggacgcagttaggtgtccggttcccacccacacatttgtctttattgctttcaaataa

SEQ ID NO: 177020 - DNA, 75 bp, Artificial Sequence
  Synthetic
agtggtgcaacacaagactttttacctctctctgctgagccactcaatggacgtcgtacgcctaagttttctgca

SEQ ID NO: 177021 - DNA, 75 bp, Artificial Sequence
  Synthetic
atttgtctttattgctttcaaataaaacggtgttctctcaacctcctacgggctcactagtattgtgttcccata

SEQ ID NO: 177022 - DNA, 75 bp, Artificial Sequence
  Synthetic
ctctctctgctgagccactcaatggacgtcgtacgcctaagttttctgcagcccggcctgctgtacgcccacctg

SEQ ID NO: 177023 - DNA, 75 bp, Artificial Sequence
  Synthetic
ataacacacacaaagacatagtgactgtagacagttaatctttattgtctagacacgcaaagtatattagtgtta

SEQ ID NO: 177024 - DNA, 75 bp, Artificial Sequence
  Synthetic
caatatgctgaccctctttctgatttttaaaacgagagaactacatctcggcgagacgactttgcgcctgctcat

SEQ ID NO: 177025 - DNA, 75 bp, Artificial Sequence
  Synthetic
tgtagacagttaatctttattgtctagacacgcaaagtatattagtgttataagaaattttatgtcacgtcgctc

SEQ ID NO: 177026 - DNA, 75 bp, Artificial Sequence
  Synthetic
tttaaaacgagagaactacatctcggcgagacgactttgcgcctgctcatggacaacctgcccaactacagggtg

SEQ ID NO: 177027 - DNA, 75 bp, Artificial Sequence
  Synthetic
cgcaccgcttgacctgcaaacttttccattgcactcagaacataaaacgaagcaaagtgtctcacccaatactta

SEQ ID NO: 177028 - DNA, 75 bp, Artificial Sequence
  Synthetic
cagagatactgaagccatgaccgtgccggtgcataccatctgtgaggcggttgccgccctggactgcacagacga

SEQ ID NO: 177029 - DNA, 75 bp, Artificial Sequence
  Synthetic
ccggtgcataccatctgtgaggcggttgccgccctggactgcacagacgagctacgagacgacattcaaaagggc

SEQ ID NO: 177030 - DNA, 75 bp, Artificial Sequence
  Synthetic
gtgcgtcttagtcagcttattgagctcttcctgtatgtcccatcctaaggtcttcgtcagaagctccatgacgtc

SEQ ID NO: 177031 - DNA, 75 bp, Artificial Sequence
  Synthetic
tcttcctgtatgtcccatcctaaggtcttcgtcagaagctccatgacgtccacgtttatcactgattttccaaac

SEQ ID NO: 177032 - DNA, 75 bp, Artificial Sequence
  Synthetic
gcgacaaataaattatgtttaaatcagacatatttattatgtatattgtggatttatttgccacacagagagcgg

SEQ ID NO: 177033 - DNA, 75 bp, Artificial Sequence
  Synthetic
agacatatttattatgtatattgtggatttatttgccacacagagagcggcaaggggggatcggggccgaatgcg

SEQ ID NO: 177034 - DNA, 75 bp, Artificial Sequence
  Synthetic
gggcggacgccgcggtcggaaacactatgcgttaacttagactgcgcagtgttaccgaccaggcacccgcctgca

SEQ ID NO: 177035 - DNA, 75 bp, Artificial Sequence
  Synthetic
cagatgaaaaatagcagcgggctctagaatacccttgcagatgccggtacggtaacagaggtcgcggaagcattc

SEQ ID NO: 177036 - DNA, 75 bp, Artificial Sequence
  Synthetic
tatgcgttaacttagactgcgcagtgttaccgaccaggcacccgcctgcaaccagggcaatagctaagacgtcgg

SEQ ID NO: 177037 - DNA, 75 bp, Artificial Sequence
  Synthetic
agtctctgaatgagaagatccttttcaaactcgggggcgtccggcaacttgccccgcgttccagataccagcagt

SEQ ID NO: 177038 - DNA, 75 bp, Artificial Sequence
  Synthetic
gtctccgaatgcgcacgcgtcgtaccagcttaacacgacgacgtcgaccgcgctggggtttgtttagcgggtttg

SEQ ID NO: 177039 - DNA, 75 bp, Artificial Sequence
  Synthetic
cagcttaacacgacgacgtcgaccgcgctggggtttgtttagcgggtttgtgctctgcgtgtttctgtcgccgcc

SEQ ID NO: 177040 - DNA, 75 bp, Artificial Sequence
  Synthetic
acttgaaccagcgcatggctgctaacgcggcatacactagccggtggtgcccgagcgggagttacgaagtctcac

SEQ ID NO: 177041 - DNA, 75 bp, Artificial Sequence
  Synthetic
aggtcgccgatgcggcgagtggcggcgtgggtgacccctcgcccagtggccttatacgcggggtttctatgtagt

SEQ ID NO: 177042 - DNA, 75 bp, Artificial Sequence
  Synthetic
cgtgggtgacccctcgcccagtggccttatacgcggggtttctatgtagtgaaacgatggtagcttatgctgtgc

SEQ ID NO: 177043 - DNA, 75 bp, Artificial Sequence
  Synthetic
tccgaactctgagtcacttttatgtaggtctcaaacatgtaaaagataccacgttcttgaaaaaccctctcttgc

SEQ ID NO: 177044 - DNA, 75 bp, Artificial Sequence
  Synthetic
gggccgcaggactccgcgccgcaggggccccgtcagtgaggcctcggggacctgaaaggggggacagcatcgtgt

SEQ ID NO: 177045 - DNA, 75 bp, Artificial Sequence
  Synthetic
catacgcagccaagctatcatgcgagagaaacacgtcacaggcaaagtcatgtaaaacccgggttaaaaatagcc

SEQ ID NO: 177046 - DNA, 75 bp, Artificial Sequence
  Synthetic
ggccccgtcagtgaggcctcggggacctgaaaggggggacagcatcgtgtaacacgggctcgccttaagcggact

SEQ ID NO: 177047 - DNA, 75 bp, Artificial Sequence
  Synthetic
aggctatgaaatcatgaatggtaactgtctggacaccaatcttccgcggggtggcggcagtgcgacgcaagtatc

SEQ ID NO: 177048 - DNA, 75 bp, Artificial Sequence
  Synthetic
atgacccaaaccttgtcaatttgctgtgctagctctgggcttctcgccaacccaagcgcggcatcgagcgaactc

SEQ ID NO: 177049 - DNA, 75 bp, Artificial Sequence
  Synthetic
gtcgcgtgggcattcgcacgatccgcggaagcgtcttttgaggcgagtcatttggtacaacgtagtcgctcggag

SEQ ID NO: 177050 - DNA, 75 bp, Artificial Sequence
  Synthetic
cccaagcgcggcatcgagcgaactcgccaaaaagtgagcaccagggggcggggtttctaacgtgcgacttagaac

SEQ ID NO: 177051 - DNA, 75 bp, Artificial Sequence
  Synthetic
cggaagcgtcttttgaggcgagtcatttggtacaacgtagtcgctcggaggttcaggatcgtgtccaccgcacgc

SEQ ID NO: 177052 - DNA, 75 bp, Artificial Sequence
  Synthetic
atgtgcgccgccccataacaaccatgttttgttttccaggggcacagtcggtagtcagctgtcgaaaacgcctca

SEQ ID NO: 177053 - DNA, 75 bp, Artificial Sequence
  Synthetic
cgggcacaatccaggatggccaaatttggtgcgaagttatactggctgaatgtagagaacccgacaaacgtttaa

SEQ ID NO: 177054 - DNA, 75 bp, Artificial Sequence
  Synthetic
ttggtgcgaagttatactggctgaatgtagagaacccgacaaacgtttaacttggcttggggagctgggtgacgg

SEQ ID NO: 177055 - DNA, 75 bp, Artificial Sequence
  Synthetic
cgggtggctgaactggacctgcggagacaatggtggtgtaggacgggtgtgggggggggaccaagcaaaattgcc

SEQ ID NO: 177056 - DNA, 75 bp, Artificial Sequence
  Synthetic
agggtataggtaaacaccaccaaccacacagtgtgctcttatatacttttaatgaaacataagggcagacgaaac

SEQ ID NO: 177057 - DNA, 75 bp, Artificial Sequence
  Synthetic
gacaatggtggtgtaggacgggtgtgggggggggaccaagcaaaattgcctggccggtttagggtgagcttacct

SEQ ID NO: 177058 - DNA, 75 bp, Artificial Sequence
  Synthetic
aaccctgtggaaggatatcaactagagaggagggtccagccttattatggcaggagacactataagccccatcgc

SEQ ID NO: 177059 - DNA, 75 bp, Artificial Sequence
  Synthetic
ctaaaagaaatgacaaaacagtatgggaggaaaccatatatagatgaagggcattgtgggatatgggatggttaa

SEQ ID NO: 177060 - DNA, 75 bp, Artificial Sequence
  Synthetic
ggaggaaaccatatatagatgaagggcattgtgggatatgggatggttaacttaccacaaataggcgtaaccaaa

SEQ ID NO: 177061 - DNA, 75 bp, Artificial Sequence
  Synthetic
acagtaagtggccctataccgctcagcgcccaagttgttacagtcacacccaaccgcggttggctctacattgtc

SEQ ID NO: 177062 - DNA, 75 bp, Artificial Sequence
  Synthetic
gcgcccaagttgttacagtcacacccaaccgcggttggctctacattgtcatcacgtccatcattatgtgttggt

SEQ ID NO: 177063 - DNA, 75 bp, Artificial Sequence
  Synthetic
accacgcccacaaagatgttagatcttcttgcgtataccaactagacgagccgagatggggtcatagcagagaac

SEQ ID NO: 177064 - DNA, 75 bp, Artificial Sequence
  Synthetic
ttcttgcgtataccaactagacgagccgagatggggtcatagcagagaaccagctcagccagtctaattagaata

SEQ ID NO: 177065 - DNA, 75 bp, Artificial Sequence
  Synthetic
gcgatgcacaggagcgccatccgcggggccatcttggtcgcctggagctgcccccgcgggcccctcctcgtcctg

SEQ ID NO: 177066 - DNA, 75 bp, Artificial Sequence
  Synthetic
agggcattagcataaattagagcatgtaaattggagaccccgatataaccacacaaatcgcgggactccgaactt

SEQ ID NO: 177067 - DNA, 75 bp, Artificial Sequence
  Synthetic
gtaaattggagaccccgatataaccacacaaatcgcgggactccgaacttacatagcctaattactatgcaaatg

SEQ ID NO: 177068 - DNA, 75 bp, Artificial Sequence
  Synthetic
tttacagcagcgtatgcccgccccacgtggcgcatcatgtggaaaaacgcacccaacccaaaaacgacaaacaat

SEQ ID NO: 177069 - DNA, 75 bp, Artificial Sequence
  Synthetic
cggagtaacctagatatgtaaagtagatagttagtaaccttataccaactaacgccccgatgggttaacatatgc

SEQ ID NO: 177070 - DNA, 75 bp, Artificial Sequence
  Synthetic
gatagttagtaaccttataccaactaacgccccgatgggttaacatatgcaaattagacaaaggagctaaacaac

SEQ ID NO: 177071 - DNA, 75 bp, Artificial Sequence
  Synthetic
acgcggctgcagcgacgtgatctatctctgggtcatgaccgcccactatatatagccaaacccacgtcgcagcgg

SEQ ID NO: 177072 - DNA, 75 bp, Artificial Sequence
  Synthetic
cacttaattagcatacaggtattattacacctgctaaggaatagtagtgcagctaagatatgtaaattagaaaaa

SEQ ID NO: 177073 - DNA, 75 bp, Artificial Sequence
  Synthetic
tacacctgctaaggaatagtagtgcagctaagatatgtaaattagaaaaatcagctagaacaaccagcctgaata

SEQ ID NO: 177074 - DNA, 75 bp, Artificial Sequence
  Synthetic
agaccctcctggtaagtcagccgaggcaatagcgtcatttcgcgcaagggtcgccagaccacgcgcgtgttgtat

SEQ ID NO: 177075 - DNA, 75 bp, Artificial Sequence
  Synthetic
gcaatagcgtcatttcgcgcaagggtcgccagaccacgcgcgtgttgtatacgacgccacatatctgacaggccg

SEQ ID NO: 177076 - DNA, 75 bp, Artificial Sequence
  Synthetic
tatatctaattaaaatacaaactaaaatttctattgctttccgttataggatagtagttcagttaagatatgcaa

SEQ ID NO: 177077 - DNA, 75 bp, Artificial Sequence
  Synthetic
aatttctattgctttccgttataggatagtagttcagttaagatatgcaaattagataactcagctgagcatcta

SEQ ID NO: 177078 - DNA, 75 bp, Artificial Sequence
  Synthetic
tcgagctctcctgtgcatccacaggctctaaatctctcatttccgagctcctcgttgcaaatccagcagacagga

SEQ ID NO: 177079 - DNA, 75 bp, Artificial Sequence
  Synthetic
ctctaaatctctcatttccgagctcctcgttgcaaatccagcagacaggaacatcctcatcttccatatcctgag

SEQ ID NO: 177080 - DNA, 75 bp, Artificial Sequence
  Synthetic
tgaagcggagagggggtggtgcgagttggcagttgacgggtttgtaatagctggagtgctgaccacggcacagga

SEQ ID NO: 177081 - DNA, 75 bp, Artificial Sequence
  Synthetic
tatagaggacaccaaaacaaaacccgagcattctattggtaaagcgcctgggccaatgaaattactggtttcacc

SEQ ID NO: 177082 - DNA, 75 bp, Artificial Sequence
  Synthetic
gagcattctattggtaaagcgcctgggccaatgaaattactggtttcacctaaaatatccaattaacgctgtaac

SEQ ID NO: 177083 - DNA, 75 bp, Artificial Sequence
  Synthetic
ccagggcacgcgtccaggcaaccggggtccccctcgttggtctatacaattccatgactacctactggtaatgct

SEQ ID NO: 177084 - DNA, 75 bp, Artificial Sequence
  Synthetic
ggtccccctcgttggtctatacaattccatgactacctactggtaatgctacagccactcactgtacaagccggt

SEQ ID NO: 177085 - DNA, 75 bp, Artificial Sequence
  Synthetic
tggctaaaagtgttggccaataccgtgcgggcgttaattgattgacatgctctttccccaataggaatattttat

SEQ ID NO: 177086 - DNA, 75 bp, Artificial Sequence
  Synthetic
tgcgggcgttaattgattgacatgctctttccccaataggaatattttatgttttgtgattgacagctgctccga

SEQ ID NO: 177087 - DNA, 75 bp, Artificial Sequence
  Synthetic
cactccaaacacttatgtactttgtggctcggctttattgtaacagccaagaggggcgtttgtggctcagcttta

SEQ ID NO: 177088 - DNA, 75 bp, Artificial Sequence
  Synthetic
tggctatctcacaaaaagtcaccgattcatgtagacaacccgctcccacgaattcggtttttaaaaagccctcac

SEQ ID NO: 177089 - DNA, 75 bp, Artificial Sequence
  Synthetic
ttaagcgtttaagcctcattggccaggtgccatcacgttgcacaagagcggtcagcgtggcacgcagctacctct

SEQ ID NO: 177090 - DNA, 75 bp, Artificial Sequence
  Synthetic
ggtgccatcacgttgcacaagagcggtcagcgtggcacgcagctacctctctagcttgacgtcatcagttggcga

SEQ ID NO: 177091 - DNA, 75 bp, Artificial Sequence
  Synthetic
cacatgagcgggcatcctgtttccgccttgacgcccaccactctgaccgcacgctaaacatcgccctacctgcta

SEQ ID NO: 177092 - DNA, 75 bp, Artificial Sequence
  Synthetic
gggacgcggggcttcagcagatccgtgggttcttcctccaaggatccgctggcccggcgaccccaaggtgctata

SEQ ID NO: 177093 - DNA, 75 bp, Artificial Sequence
  Synthetic
tactgccatttccatacgaatggtaggatgcgggcagtagtccaccagtctaaaatcatcaggtgtaaactcttc

SEQ ID NO: 177094 - DNA, 75 bp, Artificial Sequence
  Synthetic
tgggttcttcctccaaggatccgctggcccggcgaccccaaggtgctatacgtttctgggagcacgtggtccaca

SEQ ID NO: 177095 - DNA, 75 bp, Artificial Sequence
  Synthetic
tgcgcgtcagctgcagccgtagtggctctatatgcgttttgtagatgtgggcatctcccaacgtgtgaataaact

SEQ ID NO: 177096 - DNA, 75 bp, Artificial Sequence
  Synthetic
gggaactgctgccggatagcatacaatgtgcgcttccgcccctctgaccttaacctaaattggcatataaatgca

SEQ ID NO: 177097 - DNA, 75 bp, Artificial Sequence
  Synthetic
ctctatatgcgttttgtagatgtgggcatctcccaacgtgtgaataaactccccgggtctaagaccagtaacatg

SEQ ID NO: 177098 - DNA, 75 bp, Artificial Sequence
  Synthetic
atgtgcgcttccgcccctctgaccttaacctaaattggcatataaatgcacgttatccacttatatctgtgagaa

SEQ ID NO: 177099 - DNA, 75 bp, Artificial Sequence
  Synthetic
ccaaacccatgtctcccgacctctgatacagctgacaggaaagctcaccgtcagctacataaaattgacataaca

SEQ ID NO: 177100 - DNA, 75 bp, Artificial Sequence
  Synthetic
gccgccagtggacactaataagtgtactgctgctctgtaaccgctgccgcgcgtgacacctaggcaccaccgacg

SEQ ID NO: 177101 - DNA, 75 bp, Artificial Sequence
  Synthetic
actgctgctctgtaaccgctgccgcgcgtgacacctaggcaccaccgacgatgatacacttcaggagtgccaaga

SEQ ID NO: 177102 - DNA, 75 bp, Artificial Sequence
  Synthetic
agtgacagggcggaagcgccatcaacgacaagtccgccgggttccacgcacacataatgattcttctatcgtgcg

SEQ ID NO: 177103 - DNA, 75 bp, Artificial Sequence
  Synthetic
agtaatggctaaccgcaggtcatcgtgatggtactcgcgcatgcgactgcagtcctgacaggcttgcatgtttcg

SEQ ID NO: 177104 - DNA, 75 bp, Artificial Sequence
  Synthetic
tgatggtactcgcgcatgcgactgcagtcctgacaggcttgcatgtttcgtgtctgcacgcaagcctgatcaggg

SEQ ID NO: 177105 - DNA, 75 bp, Artificial Sequence
  Synthetic
cctgtatagtcagcatccgcgtccacgtacgccgccccaaagtgcctccactggaaaccgtaaacaggtcccaaa

SEQ ID NO: 177106 - DNA, 75 bp, Artificial Sequence
  Synthetic
cgtacgccgccccaaagtgcctccactggaaaccgtaaacaggtcccaaatccccctcccttctgtgcgccaggc

SEQ ID NO: 177107 - DNA, 75 bp, Artificial Sequence
  Synthetic
cggcgcgtgcgccccatcccaccctaactacgtactctcggcgacttcggcccggagggagtttttgtagggcgt

SEQ ID NO: 177108 - DNA, 75 bp, Artificial Sequence
  Synthetic
aactacgtactctcggcgacttcggcccggagggagtttttgtagggcgtatctgcccgcgagcatacatacgca

SEQ ID NO: 177109 - DNA, 75 bp, Artificial Sequence
  Synthetic
cctgttcttgaaagctccctggagtcagtactccccttcagaaaccaaagcagctcttgcactacgcctcgccaa

SEQ ID NO: 177110 - DNA, 75 bp, Artificial Sequence
  Synthetic
cagtactccccttcagaaaccaaagcagctcttgcactacgcctcgccaaaacacccgctttgtggttagtaagg

SEQ ID NO: 177111 - DNA, 75 bp, Artificial Sequence
  Synthetic
ccttcctacccacctgttaaatttctcaagtatataccaagtgtagtggcccggtttctcaccagtgtcgcccac

SEQ ID NO: 177112 - DNA, 75 bp, Artificial Sequence
  Synthetic
tcaagtatataccaagtgtagtggcccggtttctcaccagtgtcgcccactgtaccacgccaacggactttccac

SEQ ID NO: 177113 - DNA, 75 bp, Artificial Sequence
  Synthetic
gtgcctatgccggtgcggtcgagtcgatcgctgccacggcacaaaatttccctcaactgcctgagatactgaagt

SEQ ID NO: 177114 - DNA, 75 bp, Artificial Sequence
  Synthetic
gatcgctgccacggcacaaaatttccctcaactgcctgagatactgaagttcctcgtggggcgtctcagccccag

SEQ ID NO: 177115 - DNA, 75 bp, Artificial Sequence
  Synthetic
cataccatagtaaaaataccaatgcgttataggtacggtactgcaggcaggtagtgtttattaggcttggtaata

SEQ ID NO: 177116 - DNA, 75 bp, Artificial Sequence
  Synthetic
gttataggtacggtactgcaggcaggtagtgtttattaggcttggtaatacaatcgtttagctggcgggggcgtc

SEQ ID NO: 177117 - DNA, 75 bp, Artificial Sequence
  Synthetic
acgccaggcttttgacagaagcgaaaccccctggcacggaataactttttggcgacatacaagcttaaaggtaca

SEQ ID NO: 177118 - DNA, 75 bp, Artificial Sequence
  Synthetic
accccctggcacggaataactttttggcgacatacaagcttaaaggtacaaacggaaacatgatagatcctggaa

SEQ ID NO: 177119 - DNA, 75 bp, Artificial Sequence
  Synthetic
gtgtctctggttctgtttcaagagtttgggaggtatttgtgggcgaccctggcctcgatgccggttcgcgagtct

SEQ ID NO: 177120 - DNA, 75 bp, Artificial Sequence
  Synthetic
ttgggaggtatttgtgggcgaccctggcctcgatgccggttcgcgagtctgcgattcggatgcagactggggcgc

SEQ ID NO: 177121 - DNA, 75 bp, Artificial Sequence
  Synthetic
gagacctacatgtatactcaggctcttctataaaccctccccaaaagtttataaaacaccgtacgtaatacacat

SEQ ID NO: 177122 - DNA, 75 bp, Artificial Sequence
  Synthetic
ttctataaaccctccccaaaagtttataaaacaccgtacgtaatacacattactcacagttcccacggtgacgcc

SEQ ID NO: 177123 - DNA, 75 bp, Artificial Sequence
  Synthetic
gcgacactggcgcgcgacacgtaggacacagcggcccagccaccggagatattctggaggcgccaggtcggacca

SEQ ID NO: 177124 - DNA, 75 bp, Artificial Sequence
  Synthetic
acacagcggcccagccaccggagatattctggaggcgccaggtcggaccaaggcggcgttggtgagggcctgtag

SEQ ID NO: 177125 - DNA, 75 bp, Artificial Sequence
  Synthetic
aaaagtgtgtgtctgacattcacatttatttttacaagacaattttgtgcagtagagttgtgccttccgacaccc

SEQ ID NO: 177126 - DNA, 75 bp, Artificial Sequence
  Synthetic
ttatttttacaagacaattttgtgcagtagagttgtgccttccgacaccccgcgccgttcgctgttctcctgtaa

SEQ ID NO: 177127 - DNA, 75 bp, Artificial Sequence
  Synthetic
cggggcccaagagatccaggcgctccatcatatgcacccagtgtaaaaaactaccggggacgtgacgggcaccaa

SEQ ID NO: 177128 - DNA, 75 bp, Artificial Sequence
  Synthetic
catcatatgcacccagtgtaaaaaactaccggggacgtgacgggcaccaagggcgtttcggctcagaaacacaag

SEQ ID NO: 177129 - DNA, 75 bp, Artificial Sequence
  Synthetic
cgctggccttagacttgtggacccaacatgggtatcgttagagatccgtcgcgtaaatgcgcagctggcaaagca

SEQ ID NO: 177130 - DNA, 75 bp, Artificial Sequence
  Synthetic
acatgggtatcgttagagatccgtcgcgtaaatgcgcagctggcaaagcattcttcagcgagcagtgactggtaa

SEQ ID NO: 177131 - DNA, 75 bp, Artificial Sequence
  Synthetic
gcctaaaggcgctaaaataactggcggtgtgctgcgtctggtgttccacgaacccgggttccaagaacagcagtc

SEQ ID NO: 177132 - DNA, 75 bp, Artificial Sequence
  Synthetic
ggtgtgctgcgtctggtgttccacgaacccgggttccaagaacagcagtctgcgcactagatctcgccgacctgc

SEQ ID NO: 177133 - DNA, 75 bp, Artificial Sequence
  Synthetic
ggcgaccacgctttgtcaaaaatatcacacccggcttgctgcacagttgggaggtggggtaccagctggacagaa

SEQ ID NO: 177134 - DNA, 75 bp, Artificial Sequence
  Synthetic
cacacccggcttgctgcacagttgggaggtggggtaccagctggacagaagcacctgtggtaatggtcttttctg

SEQ ID NO: 177135 - DNA, 75 bp, Artificial Sequence
  Synthetic
tgcgtgcaacaagagcgcccacaaactgaccaaccgtgggctggggtataaacataccacacaaaaataatacag

SEQ ID NO: 177136 - DNA, 75 bp, Artificial Sequence
  Synthetic
ctgaccaaccgtgggctggggtataaacataccacacaaaaataatacagcctcgcggttgtctagatcaaggta

SEQ ID NO: 177137 - DNA, 75 bp, Artificial Sequence
  Synthetic
ccccagattgcaaacaaagcaaggcagtcagcacagcgacgagcaggatgcccttggtgtccataactcccctcg

SEQ ID NO: 177138 - DNA, 75 bp, Artificial Sequence
  Synthetic
agtcagcacagcgacgagcaggatgcccttggtgtccataactcccctcgtgtgtcctcgtgtaaatgcgaaacg

SEQ ID NO: 177139 - DNA, 75 bp, Artificial Sequence
  Synthetic
acacttggaaacacaataactttaagatctagccgcggctggcggttcttcttcttcgcccaaaatatccaaagt

SEQ ID NO: 177140 - DNA, 75 bp, Artificial Sequence
  Synthetic
gatctagccgcggctggcggttcttcttcttcgcccaaaatatccaaagtcacggtggccagtatgcttgtaacc

SEQ ID NO: 177141 - DNA, 75 bp, Artificial Sequence
  Synthetic
acgtgatgtagtgctggttctacgacgcctacctgtaaactccaggatcctgggcttttattacgaaggccaaca

SEQ ID NO: 177142 - DNA, 75 bp, Artificial Sequence
  Synthetic
cgcctacctgtaaactccaggatcctgggcttttattacgaaggccaacaccccaaaaaatccacgcccccgtga

SEQ ID NO: 177143 - DNA, 75 bp, Artificial Sequence
  Synthetic
tagtctctgcaggatttcatccgatgttaaaccggacggcgtctccaaggtggaggcggctaaggcgcagcaagc

SEQ ID NO: 177144 - DNA, 75 bp, Artificial Sequence
  Synthetic
gttaaaccggacggcgtctccaaggtggaggcggctaaggcgcagcaagctgcgctcaggaccgaggcccgtaag

SEQ ID NO: 177145 - DNA, 75 bp, Artificial Sequence
  Synthetic
cctgccatgtaacctgcaaggtaaccagacaaacatctaggaagcgtaaatatccccaggtaggagaagtattgc

SEQ ID NO: 177146 - DNA, 75 bp, Artificial Sequence
  Synthetic
cagacaaacatctaggaagcgtaaatatccccaggtaggagaagtattgcatatgtcacagactcaacacacacg

SEQ ID NO: 177147 - DNA, 75 bp, Artificial Sequence
  Synthetic
ccggtgccacgcggaatactggtctggaaccgggtctaatctatataagagacaagccgtaacatccgtggctac

SEQ ID NO: 177148 - DNA, 75 bp, Artificial Sequence
  Synthetic
ggaaccgggtctaatctatataagagacaagccgtaacatccgtggctacaatggcctctgagcgccattttaaa

SEQ ID NO: 177149 - DNA, 75 bp, Artificial Sequence
  Synthetic
acgcgcttcgcgagaggtatctccgtgtgcttctccatcagaagacgcgtgcgccgcttcgcaggcgacccgcat

SEQ ID NO: 177150 - DNA, 75 bp, Artificial Sequence
  Synthetic
tgtgcttctccatcagaagacgcgtgcgccgcttcgcaggcgacccgcatactttccgccccgagtgcgttacaa

SEQ ID NO: 177151 - DNA, 75 bp, Artificial Sequence
  Synthetic
gtctgctgccagaaaacacagggcgctcacggaaatgggtcgccgatttctgattttggaggcaatgaggaggca

SEQ ID NO: 177152 - DNA, 75 bp, Artificial Sequence
  Synthetic
ctcacggaaatgggtcgccgatttctgattttggaggcaatgaggaggcacgcggctcccactttttgaaattca

SEQ ID NO: 177153 - DNA, 75 bp, Artificial Sequence
  Synthetic
catatcagcttatccggtggcaatctggcactggacagggaattctcgcaacaatccgaggccatgatggtggca

SEQ ID NO: 177154 - DNA, 75 bp, Artificial Sequence
  Synthetic
tggcactggacagggaattctcgcaacaatccgaggccatgatggtggcaggaccgctggccgcacatagctcaa

SEQ ID NO: 177155 - DNA, 75 bp, Artificial Sequence
  Synthetic
tagtgccagacaacccgaagataaactgtagtcgtcagccacacacaaaagccatgccccgaggcgggtgcgcat

SEQ ID NO: 177156 - DNA, 75 bp, Artificial Sequence
  Synthetic
ctgtagtcgtcagccacacacaaaagccatgccccgaggcgggtgcgcatatatgcgctaagttcccgctggatg

SEQ ID NO: 177157 - DNA, 75 bp, Artificial Sequence
  Synthetic
atgctccacatacagttctggcgccacaacgatgatgcgcaaaggggtgcattaccctaaatcccagcctagtta

SEQ ID NO: 177158 - DNA, 75 bp, Artificial Sequence
  Synthetic
acaacgatgatgcgcaaaggggtgcattaccctaaatcccagcctagttataaattattgaagcccaggcgacca

SEQ ID NO: 177159 - DNA, 75 bp, Artificial Sequence
  Synthetic
gtttgccaaaaccctgtcttcacagagcaccgcatcaagaatcccgtatttgctaccaagggtcgccatgaggct

SEQ ID NO: 177160 - DNA, 75 bp, Artificial Sequence
  Synthetic
agcaccgcatcaagaatcccgtatttgctaccaagggtcgccatgaggctagttgggcgagagttggcccgggga

SEQ ID NO: 177161 - DNA, 75 bp, Artificial Sequence
  Synthetic
ccaaatgtaacttatgtataacccaaaatattgcgcatcgataaggtttgccaaaacacccgaaagtacacacac

SEQ ID NO: 177162 - DNA, 75 bp, Artificial Sequence
  Synthetic
aaatattgcgcatcgataaggtttgccaaaacacccgaaagtacacacacaaaaaaacagcaacaagacgctcac

SEQ ID NO: 177163 - DNA, 75 bp, Artificial Sequence
  Synthetic
cgtctagattgtttcagccattgtctctatatccttggggttttatgtcgtgggaaccagcacctcctgtctctg

SEQ ID NO: 177164 - DNA, 75 bp, Artificial Sequence
  Synthetic
tctatatccttggggttttatgtcgtgggaaccagcacctcctgtctctgcgttctccatccggtaactagggcc

SEQ ID NO: 177165 - DNA, 75 bp, Artificial Sequence
  Synthetic
gggaaacaccaggggcggcggaggttgtcaatagtgtccagtatttcgttagacgcgggttcttggacccgatgt

SEQ ID NO: 177166 - DNA, 75 bp, Artificial Sequence
  Synthetic
gattaaaggatcatagttcccaggtttaatactccaagctatcccagaacaggaccccggcagaaccccgctaac

SEQ ID NO: 177167 - DNA, 75 bp, Artificial Sequence
  Synthetic
tctgtttcctgtgacgcgttagaatgtggcggtgacgtaggtgcagggggcggtaacgagcccaaatttaatggc

SEQ ID NO: 177168 - DNA, 75 bp, Artificial Sequence
  Synthetic
gtggcggtgacgtaggtgcagggggcggtaacgagcccaaatttaatggcatgctgtctttgaatttgaccctgg

SEQ ID NO: 177169 - DNA, 75 bp, Artificial Sequence
  Synthetic
gactgaaaaggtcatagagaggacaccggtcccatttcccacggtccaaaaatccagcgcgccccaccggctttc

SEQ ID NO: 177170 - DNA, 75 bp, Artificial Sequence
  Synthetic
cccaagatgaccttctgagctgtggccttagattgacagtaaacatagatacaatacatgtgcggtccaggcacg

SEQ ID NO: 177171 - DNA, 75 bp, Artificial Sequence
  Synthetic
aatccagcgcgccccaccggctttccgagaacttcggcaaagctaatttgcatgcgctaatccttttatgtgcat

SEQ ID NO: 177172 - DNA, 75 bp, Artificial Sequence
  Synthetic
ccttagattgacagtaaacatagatacaatacatgtgcggtccaggcacgccaggtctgccgggatggggtaggc

SEQ ID NO: 177173 - DNA, 75 bp, Artificial Sequence
  Synthetic
ggtgcacggggtcacctccaggtcacgccgctaggtgggaccgtgagcgactcgaaaaattataatttttggcca

SEQ ID NO: 177174 - DNA, 75 bp, Artificial Sequence
  Synthetic
ttctttagagggtacggtcggggtgtccaaaatatcgccgcgtgtctccagtgtcgatccggtcgatacatagtc

SEQ ID NO: 177175 - DNA, 75 bp, Artificial Sequence
  Synthetic
tccaaaatatcgccgcgtgtctccagtgtcgatccggtcgatacatagtcagcggtcccaagaatcggagataaa

SEQ ID NO: 177176 - DNA, 75 bp, Artificial Sequence
  Synthetic
ccctctcccattggtccgccggcccgtcaatcaaagttttccgagccgccattggcccattcggccgaccaatcc

SEQ ID NO: 177177 - DNA, 75 bp, Artificial Sequence
  Synthetic
ggcatcattgggctctgaaatctcgcgtggaacggaggacggccgccgttgcctcctggaacgcgcctaagacga

SEQ ID NO: 177178 - DNA, 75 bp, Artificial Sequence
  Synthetic
cgtggaacggaggacggccgccgttgcctcctggaacgcgcctaagacgaacaacgggccggggcccagagtcca

SEQ ID NO: 177179 - DNA, 75 bp, Artificial Sequence
  Synthetic
actggttcatttacttcagatggctcctgggtatttgcatctgcattatcggaatcttcgggttcctggggttct

SEQ ID NO: 177180 - DNA, 75 bp, Artificial Sequence
  Synthetic
cctgggtatttgcatctgcattatcggaatcttcgggttcctggggttctggttcttcctcatgctcgtcttcag

SEQ ID NO: 177181 - DNA, 75 bp, Artificial Sequence
  Synthetic
aatcctagcgcagctgagtcatcgcagcccctattccagtaggtatacccagctgggtaatccagtaggtatacc

SEQ ID NO: 177182 - DNA, 75 bp, Artificial Sequence
  Synthetic
agcccctattccagtaggtatacccagctgggtaatccagtaggtatacccaggtgggtgaacccagctgggtat

SEQ ID NO: 177183 - DNA, 75 bp, Artificial Sequence
  Synthetic
tctggctcttcttcgggctctggctcaggctcttcctcaggctctggctcaggctcaggctcttcctcgggctct

SEQ ID NO: 177184 - DNA, 75 bp, Artificial Sequence
  Synthetic
aggtggtatttccggaagcattaccaaataaggcaacctcagctgggaataccagcggactacccccaactgtat

SEQ ID NO: 177185 - DNA, 75 bp, Artificial Sequence
  Synthetic
aaataaggcaacctcagctgggaataccagcggactacccccaactgtattcaaccctcctttgttttccggaag

SEQ ID NO: 177186 - DNA, 75 bp, Artificial Sequence
  Synthetic
ctctggctcttcctcaggctctggctcaggctcttcctcaggctcaggctcaggctcttcttcaggctgaggctc

SEQ ID NO: 177187 - DNA, 75 bp, Artificial Sequence
  Synthetic
caggctcttcttcaggctgaggctcaggctcaggctcttcttcaggctcaggctcaggctctggctcttcctcag

SEQ ID NO: 177188 - DNA, 75 bp, Artificial Sequence
  Synthetic
gctctggctcaggctcttcctcaggctctggctcaggctcttcctcaggctctggctcaggctcttcctcaggct

SEQ ID NO: 177189 - DNA, 75 bp, Artificial Sequence
  Synthetic
tgagtcacgggcctggaatctcgcctctgggtggtttcggtagatgggggccgggaggatggggccccgcccacc

SEQ ID NO: 177190 - DNA, 75 bp, Artificial Sequence
  Synthetic
gccacacggtggcgctaacctttaatgatgtcccactcagtgagtttggccactcccaagcccacatgggcctac

SEQ ID NO: 177191 - DNA, 75 bp, Artificial Sequence
  Synthetic
gctggcgcgccccagaacatgggtggctaacgcctacatgggcagcttgtcctacggttacgcccatttgagacg

SEQ ID NO: 177192 - DNA, 75 bp, Artificial Sequence
  Synthetic
gctaacgcctacatgggcagcttgtcctacggttacgcccatttgagacgggttaaccaactgttacaccccttc

SEQ ID NO: 177193 - DNA, 75 bp, Artificial Sequence
  Synthetic
caggctcttcctctggctctggctcaggctccgtctcttcctctgaatctggctcttcctctggctcaggctcag

SEQ ID NO: 177194 - DNA, 75 bp, Artificial Sequence
  Synthetic
aggctccgtctcttcctctgaatctggctcttcctctggctcaggctcaggctctgacttaggctcttcctcagg

SEQ ID NO: 177195 - DNA, 75 bp, Artificial Sequence
  Synthetic
cgccaccctcccccggagggggatcccggcgcgccaccctcccccggagggggatcccggcgcgccaccctcccc

SEQ ID NO: 177196 - DNA, 75 bp, Artificial Sequence
  Synthetic
cttcctctggccctggctcaggctcttcctctggccctggttcaggctcttcctctggccctggttcaggctcag

SEQ ID NO: 177197 - DNA, 75 bp, Artificial Sequence
  Synthetic
ttcctctggccctggttcaggctcttcctctggccctggttcaggctcaggttctggctcaggctcttcctcagg

SEQ ID NO: 177198 - DNA, 75 bp, Artificial Sequence
  Synthetic
ccggcgcgccaccctcccccggagggggatcccggcgcgccaccctcccccggagggggatcccggcgcgccacc

SEQ ID NO: 177199 - DNA, 75 bp, Artificial Sequence
  Synthetic
tttcctcaggctcaggctctggctcttcttcaggctctggctcaggctcttcctctggctctggctcaggctccg

SEQ ID NO: 177200 - DNA, 75 bp, Artificial Sequence
  Synthetic
acctgttgccatgtatggcgatttgtatcagtcacaagcacacaacccctgctagtattaatggtgtttaaaacg

SEQ ID NO: 177201 - DNA, 75 bp, Artificial Sequence
  Synthetic
ttctacacgtacggcggaccgcatccgtcgcaagcacgcgcatataacccccaaatgcaccatgatgagaagcac

SEQ ID NO: 177202 - DNA, 75 bp, Artificial Sequence
  Synthetic
cgtcgcaagcacgcgcatataacccccaaatgcaccatgatgagaagcacagccacgcgtcaaaaaactttaaaa

SEQ ID NO: 177203 - DNA, 75 bp, Artificial Sequence
  Synthetic
ggctctggctcgggctctggctcaggctcttcctcgggctctggctcttgctcaggctctggcttaggctcaggc

SEQ ID NO: 177204 - DNA, 75 bp, Artificial Sequence
  Synthetic
gctcttcctcgggctctggctcttgctcaggctctggcttaggctcaggctcttcctcgggctctggctcgggct

SEQ ID NO: 177205 - DNA, 75 bp, Artificial Sequence
  Synthetic
cacgtcaccgtgttagtgtcacccactgtacacaaggcgtgtcgtatatgtagtataggtatttgatgaggcgga

SEQ ID NO: 177206 - DNA, 75 bp, Artificial Sequence
  Synthetic
ctgtacacaaggcgtgtcgtatatgtagtataggtatttgatgaggcggaagcatatcccgcttccagcgaacgg

SEQ ID NO: 177207 - DNA, 75 bp, Artificial Sequence
  Synthetic
tcctcgggctctggctctccctccgactctggctcgtcatcagactctacatccgatccttcctcgagcttggcc

SEQ ID NO: 177208 - DNA, 75 bp, Artificial Sequence
  Synthetic
actctggctcgtcatcagactctacatccgatccttcctcgagcttggcctctcgtgttaaaggtctgttgttat

SEQ ID NO: 177209 - DNA, 75 bp, Artificial Sequence
  Synthetic
cacattgtttagagagagtttttcttagtcaccattccatacttgggcagtattggcctacgatttgggcgacgt

SEQ ID NO: 177210 - DNA, 75 bp, Artificial Sequence
  Synthetic
tagtcaccattccatacttgggcagtattggcctacgatttgggcgacgtttcaggctggtctattctccgtcca

SEQ ID NO: 177211 - DNA, 75 bp, Artificial Sequence
  Synthetic
cgcaacagaatacctcgacgttcgtcggagctttcggatgacgaagatccaacagaaattggtgacagaccacct

SEQ ID NO: 177212 - DNA, 75 bp, Artificial Sequence
  Synthetic
cggagctttcggatgacgaagatccaacagaaattggtgacagaccacctaggttgtcgtcctcgctggaggatc

SEQ ID NO: 177213 - DNA, 75 bp, Artificial Sequence
  Synthetic
ttaccgagtaaaaggttccactcaccctcatttgtcgttgcacccatcccccctttgcttaatcacccgaaaact

SEQ ID NO: 177214 - DNA, 75 bp, Artificial Sequence
  Synthetic
gcacgcgggttgtttgaaagtcaacagctacttgtttttaatgaggacagatttgggcacaggccagagggtaaa

SEQ ID NO: 177215 - DNA, 75 bp, Artificial Sequence
  Synthetic
catggtaaataaaatccaccatcgggccctgttgggggggacaggaacatttctggcgaggagtccatgctcgga

SEQ ID NO: 177216 - DNA, 75 bp, Artificial Sequence
  Synthetic
gccctgttgggggggacaggaacatttctggcgaggagtccatgctcggagagccaggtagccatgtgggctttg

SEQ ID NO: 177217 - DNA, 75 bp, Artificial Sequence
  Synthetic
aacctgcacggtgcataacacccagggcgtcacgtcacatatctctgtgcacccaagtggttgttcaaccgttgt

SEQ ID NO: 177218 - DNA, 75 bp, Artificial Sequence
  Synthetic
cctgggtgccatgttgttggccacggggtgcctgggcgcaccgtgagggatggcccgggcgtgggagcgtcagga

SEQ ID NO: 177219 - DNA, 75 bp, Artificial Sequence
  Synthetic
ggcgtcacgtcacatatctctgtgcacccaagtggttgttcaaccgttgttttttggatgatttttccgcaccgg

SEQ ID NO: 177220 - DNA, 75 bp, Artificial Sequence
  Synthetic
gggtgcctgggcgcaccgtgagggatggcccgggcgtgggagcgtcaggatctgagggcgacgccaatggagccg

SEQ ID NO: 177221 - DNA, 75 bp, Artificial Sequence
  Synthetic
cacggtcgttcgggcccccgtccggctcgtctccggatgaaccgtcacgttctttgtctccagaggcgacgtctc

SEQ ID NO: 177222 - DNA, 75 bp, Artificial Sequence
  Synthetic
ggcgagccagagggcgaggccggcggggccgagggcgaggccggcggggccggcggggccggcggggccgagggc

SEQ ID NO: 177223 - DNA, 75 bp, Artificial Sequence
  Synthetic
gggccgagggcgaggccggcggggccggcggggccggcggggccgagggcgaggccgggggcgaggccggcgggg

SEQ ID NO: 177224 - DNA, 75 bp, Artificial Sequence
  Synthetic
ctcgtccgtcccgcccgcgggtccgacaaggaccgtcaattcgatgttatcttcgttcgcggttggccggcgcgg

SEQ ID NO: 177225 - DNA, 75 bp, Artificial Sequence
  Synthetic
gaggccgggggcaaggccgggggcgcggcagaggttgaggccagcggggccgatggtgaggccgggggcgcggca

SEQ ID NO: 177226 - DNA, 75 bp, Artificial Sequence
  Synthetic
cggcagaggttgaggccagcggggccgatggtgaggccgggggcgcggcagaggttgaggccgggggcgatgccg

SEQ ID NO: 177227 - DNA, 75 bp, Artificial Sequence
  Synthetic
ccctcacagtgccacttacgcggcatatgccgccaaatgcaaacacaataaatatttggtaaaacccaaagaagc

SEQ ID NO: 177228 - DNA, 75 bp, Artificial Sequence
  Synthetic
agagaaaaccgagcacggccccgggggagaatgttcccgcaggagcagttaggatgaccaggagcgtccaggtgc

SEQ ID NO: 177229 - DNA, 75 bp, Artificial Sequence
  Synthetic
ccttttcgccttttgcgagcttgacgcgcgccctgggcgcggtcatccggcggcaggcatctttttgtagacata

SEQ ID NO: 177230 - DNA, 75 bp, Artificial Sequence
  Synthetic
gcgcgccctgggcgcggtcatccggcggcaggcatctttttgtagacatatgtccctcttcggggtcgccggtgg

SEQ ID NO: 177231 - DNA, 75 bp, Artificial Sequence
  Synthetic
agttcaaaaatttcttggcgctccatctccggccacaggttaaggcgactacgccactgcgtgcgcgtgcggtat

SEQ ID NO: 177232 - DNA, 75 bp, Artificial Sequence
  Synthetic
tctccggccacaggttaaggcgactacgccactgcgtgcgcgtgcggtatataacgcgacacatttgacaggccg

SEQ ID NO: 177233 - DNA, 75 bp, Artificial Sequence
  Synthetic
tccctaatgggagagcgaacgtataaaattcgacgattggagaaattatacgcaagttgcgataccgtagatggc

SEQ ID NO: 177234 - DNA, 75 bp, Artificial Sequence
  Synthetic
aaattcgacgattggagaaattatacgcaagttgcgataccgtagatggccacacgagggcaccacaacccaaca

SEQ ID NO: 177235 - DNA, 75 bp, Artificial Sequence
  Synthetic
tccagctctccggtacaggcgcaggggtgtatgccctcgttccccacctcttccctacatatccagcagatgggt

SEQ ID NO: 177236 - DNA, 75 bp, Artificial Sequence
  Synthetic
ggtgtatgccctcgttccccacctcttccctacatatccagcagatgggtccctctacaccctcttctacgtcct

SEQ ID NO: 177237 - DNA, 75 bp, Artificial Sequence
  Synthetic
actcagtggcggggatccccgaaagcaatggccacggggggatagggtcccgaaagtgaacgcccttatgaggtt

SEQ ID NO: 177238 - DNA, 75 bp, Artificial Sequence
  Synthetic
caatggccacggggggatagggtcccgaaagtgaacgcccttatgaggttcgcggttcccaatttgccttccctg

SEQ ID NO: 177239 - DNA, 75 bp, Artificial Sequence
  Synthetic
ggtgagcagagtgcccagttagtctccgacccgccgtccgccctactgtcgctatcccgccttgacagatgtcta

SEQ ID NO: 177240 - DNA, 75 bp, Artificial Sequence
  Synthetic
taccctcacccggtaataggactagttcccacggagctttcggggaactcatggtatcttggaggtgtttccttg

SEQ ID NO: 177241 - DNA, 75 bp, Artificial Sequence
  Synthetic
ttcccacggagctttcggggaactcatggtatcttggaggtgtttccttgcctaccttataaaagggccgaccac

SEQ ID NO: 177242 - DNA, 75 bp, Artificial Sequence
  Synthetic
ccctggaaaactgtcacaacccaccctgctttagctctacatctgtatttttgtttacgcacaggatcaacgctt

SEQ ID NO: 177243 - DNA, 75 bp, Artificial Sequence
  Synthetic
ctgatgtttgagtttgccgggtatcacgtgggcaaagcctgactcatagtgactcggtagatgattggtcatgac

SEQ ID NO: 177244 - DNA, 75 bp, Artificial Sequence
  Synthetic
acgtgggcaaagcctgactcatagtgactcggtagatgattggtcatgacggatcctgtagtcatggcgacctgg

SEQ ID NO: 177245 - DNA, 75 bp, Artificial Sequence
  Synthetic
tggttagttctaggcagctccggacaagttgtccaaaacacggcgcgccccgcccttccttccctccggatccgc

SEQ ID NO: 177246 - DNA, 75 bp, Artificial Sequence
  Synthetic
aagttgtccaaaacacggcgcgccccgcccttccttccctccggatccgcccacaccggacctatgaaataaggg

SEQ ID NO: 177247 - DNA, 75 bp, Artificial Sequence
  Synthetic
cgcggtcctattgcactcagaatattggaaaatattttttgctcctttaaacaccatactgggtggccgcgtggg

SEQ ID NO: 177248 - DNA, 75 bp, Artificial Sequence
  Synthetic
tggaaaatattttttgctcctttaaacaccatactgggtggccgcgtggggtgccaactagctatatatattttt

SEQ ID NO: 177249 - DNA, 75 bp, Artificial Sequence
  Synthetic
aaacacctgagtggatcccccaccccccgcgtacgacaggcgtttctgtggtgcgcttctgggaaaaacgttttt

SEQ ID NO: 177250 - DNA, 75 bp, Artificial Sequence
  Synthetic
cccgcgtacgacaggcgtttctgtggtgcgcttctgggaaaaacgtttttcccccatttcttcctcgacaggtct

SEQ ID NO: 177251 - DNA, 75 bp, Artificial Sequence
  Synthetic
actgggtggctcagcctcacttacgtgtcagacccccaccgaggcagaggtgctaactgtcacctggcaaaagag

SEQ ID NO: 177252 - DNA, 75 bp, Artificial Sequence
  Synthetic
tgtcagacccccaccgaggcagaggtgctaactgtcacctggcaaaagagcggacgcgagagtcccgaaaacatg

SEQ ID NO: 177253 - DNA, 75 bp, Artificial Sequence
  Synthetic
gcgcacgatggcgttgtcgcctcgagcagttgggccgcagtgatatcttcaactttcgaccgtctaagctatggc

SEQ ID NO: 177254 - DNA, 75 bp, Artificial Sequence
  Synthetic
gcagttgggccgcagtgatatcttcaactttcgaccgtctaagctatggcaggcagccgctgcatcagctgccta

SEQ ID NO: 177255 - DNA, 75 bp, Artificial Sequence
  Synthetic
taaggcgaacattaccaccagtaacccgcacaactccacactcaccctctataacctcaccgcggccgatgaggg

SEQ ID NO: 177256 - DNA, 75 bp, Artificial Sequence
  Synthetic
ccgcacaactccacactcaccctctataacctcaccgcggccgatgaggggtgttacatttgcttgtttaacact

SEQ ID NO: 177257 - DNA, 75 bp, Artificial Sequence
  Synthetic
caaaataactccgggttttgggcacgctggggacgtgggataccactcttttagaatttggacgggcggtgggtg

SEQ ID NO: 177258 - DNA, 75 bp, Artificial Sequence
  Synthetic
gctggggacgtgggataccactcttttagaatttggacgggcggtgggtgctgctggaacccgtagcagcagcta

SEQ ID NO: 177259 - DNA, 75 bp, Artificial Sequence
  Synthetic
gcctggcggacgcatacaggtgcacacgctgtatgatggaattaatgtaacttgtctagccgtggggcgacccgc

SEQ ID NO: 177260 - DNA, 75 bp, Artificial Sequence
  Synthetic
acgctgtatgatggaattaatgtaacttgtctagccgtggggcgacccgccccgagtctatcatggacgggcccg

SEQ ID NO: 177261 - DNA, 75 bp, Artificial Sequence
  Synthetic
aaacgtggcaagcagtacgctaacgcagcataaaacgtggacgggggccatctggaggtgccaagttcgcaacag

SEQ ID NO: 177262 - DNA, 75 bp, Artificial Sequence
  Synthetic
cagcataaaacgtggacgggggccatctggaggtgccaagttcgcaacagtctaaagaaaaccgtaaaggctatt

SEQ ID NO: 177263 - DNA, 75 bp, Artificial Sequence
  Synthetic
tacactcgtgtggagcaccttatttttgcctaccgcgcgcgtcgatgcgttgttggacttccagtgtctaattaa

SEQ ID NO: 177264 - DNA, 75 bp, Artificial Sequence
  Synthetic
ttgcctaccgcgcgcgtcgatgcgttgttggacttccagtgtctaattaaatccgagggcctcacggtggccctg

SEQ ID NO: 177265 - DNA, 75 bp, Artificial Sequence
  Synthetic
tgattctggtctcacctgtttatttatagtggcgtatgctaaccgccagcttacatgcgggataagttggcctaa

SEQ ID NO: 177266 - DNA, 75 bp, Artificial Sequence
  Synthetic
atagtggcgtatgctaaccgccagcttacatgcgggataagttggcctaactcaccaaaaacgggttgcagacaa

SEQ ID NO: 177267 - DNA, 75 bp, Artificial Sequence
  Synthetic
tactgtaatctgtgcatttatcgccctaattgtcttttatggggtcgtgtgggcactctaccactttggctaatc

SEQ ID NO: 177268 - DNA, 75 bp, Artificial Sequence
  Synthetic
ctaattgtcttttatggggtcgtgtgggcactctaccactttggctaatcatccagaatagttgaaaacagagtt

SEQ ID NO: 177269 - DNA, 75 bp, Artificial Sequence
  Synthetic
gtggtttagtggacacttcccctttttctcctggccctgcccttaacctgttggttgcatagccagatgactgct

SEQ ID NO: 177270 - DNA, 75 bp, Artificial Sequence
  Synthetic
aagccgggtagtttcaggggtcatctggcgatcagtgtaccatattcccacgacccatcaacaccgctgcttgag

SEQ ID NO: 177271 - DNA, 75 bp, Artificial Sequence
  Synthetic
ttctcctggccctgcccttaacctgttggttgcatagccagatgactgctagtttatggtgcctgacgcctgggc

SEQ ID NO: 177272 - DNA, 75 bp, Artificial Sequence
  Synthetic
gcgtgtctctgtatgtgtcaccggagactgcatgtatcgtgcatatctgtattgtgcgcttgcgcggagacaaca

SEQ ID NO: 177273 - DNA, 75 bp, Artificial Sequence
  Synthetic
aagaagggataagatggccggcgtggattttacaatggacgcggatctgtggaactactcggactacgattttgc

SEQ ID NO: 177274 - DNA, 75 bp, Artificial Sequence
  Synthetic
gattttacaatggacgcggatctgtggaactactcggactacgattttgccaactactccgtgaatatcacgtgg

SEQ ID NO: 177275 - DNA, 75 bp, Artificial Sequence
  Synthetic
ccgtgggcgagccgaaataattatatatttttttggcacggttgtgagcaacgccatcgtgagttggttaatacc

SEQ ID NO: 177276 - DNA, 75 bp, Artificial Sequence
  Synthetic
ctctaaacgcatagtctttttttatttgtcaaccaaccagtcaatcacctgtcatcgccgctcagaagcacacgt

SEQ ID NO: 177277 - DNA, 75 bp, Artificial Sequence
  Synthetic
ctgcattctcggtcttatctttctcctaaacgtaattggaaacggtacagtcacatacatattttgccagcatat

SEQ ID NO: 177278 - DNA, 75 bp, Artificial Sequence
  Synthetic
ctaaacgtaattggaaacggtacagtcacatacatattttgccagcatatggccttggccaaagcggttgatgtg

SEQ ID NO: 177279 - DNA, 75 bp, Artificial Sequence
  Synthetic
acgagtccgacaatcacacacgtccgccagcgatttgcagcgcagctaaaatcgcgtggccgggttggtagaagc

SEQ ID NO: 177280 - DNA, 75 bp, Artificial Sequence
  Synthetic
gataacgctagccatgcattttctgcccacgctcacctctggaatcttgtgctggacggagctctttttttatga

SEQ ID NO: 177281 - DNA, 75 bp, Artificial Sequence
  Synthetic
cccacgctcacctctggaatcttgtgctggacggagctctttttttatgacctgtatttatatctagacatcttt

SEQ ID NO: 177282 - DNA, 75 bp, Artificial Sequence
  Synthetic
tttgttttggggttatctacatattatattccttatcccgactggttgcggaagtattcgcagcttggctactct

SEQ ID NO: 177283 - DNA, 75 bp, Artificial Sequence
  Synthetic
gaagtattcgcagcttggctactctgctcgattaccccgtgaataactgggcggggggtgacccaacatagtgat

SEQ ID NO: 177284 - DNA, 75 bp, Artificial Sequence
  Synthetic
cagctcttggcccaaaaatccccgatttgggtgcgttctcgccgccgcgtccctggtggtagcggctggactggc

SEQ ID NO: 177285 - DNA, 75 bp, Artificial Sequence
  Synthetic
tttgggtgcgttctcgccgccgcgtccctggtggtagcggctggactggcaggtaacgcctgtaggtatagaagc

SEQ ID NO: 177286 - DNA, 75 bp, Artificial Sequence
  Synthetic
catccgtattgtgtatatgtaatttggtttccatatttggtaggagtatggagttttcttatggattattaaggg

SEQ ID NO: 177287 - DNA, 75 bp, Artificial Sequence
  Synthetic
ggtttccatatttggtaggagtatggagttttcttatggattattaagggtcagcttgaaggatgatgttaatga

SEQ ID NO: 177288 - DNA, 75 bp, Artificial Sequence
  Synthetic
aaatgcgacactagagtggaaactacacgtgagaaccgtgggcgtggccgtcggattctgcctccccctctcact

SEQ ID NO: 177289 - DNA, 75 bp, Artificial Sequence
  Synthetic
gagttttcttatggattattaagggtcagcttgaaggatgatgttaatgacataaaggggcgtggcttccaaaaa

SEQ ID NO: 177290 - DNA, 75 bp, Artificial Sequence
  Synthetic
cacgtgagaaccgtgggcgtggccgtcggattctgcctccccctctcactactgattttattttatgccatgacc

SEQ ID NO: 177291 - DNA, 75 bp, Artificial Sequence
  Synthetic
agcttgagtcagtttagcactgggactgcccagtcaccttggctgccgcttcacctatggattttgtgctcgctg

SEQ ID NO: 177292 - DNA, 75 bp, Artificial Sequence
  Synthetic
tgtaatattttcggtggtctgcttgttttttatatgttgcatcccgtatcagatcctgaacctggtggacaccat

SEQ ID NO: 177293 - DNA, 75 bp, Artificial Sequence
  Synthetic
ctgcccagtcaccttggctgccgcttcacctatggattttgtgctcgctgcttgccttcttgccgcttctggttt

SEQ ID NO: 177294 - DNA, 75 bp, Artificial Sequence
  Synthetic
ttttttatatgttgcatcccgtatcagatcctgaacctggtggacaccatgcttagacggggtatgctgagtgac

SEQ ID NO: 177295 - DNA, 75 bp, Artificial Sequence
  Synthetic
ccatcctggctttcggctaggttttccgtcctacttttcccacattggcctgagagctgtagtacaaaaaacacc

SEQ ID NO: 177296 - DNA, 75 bp, Artificial Sequence
  Synthetic
cctgcaggcgctgtatagtgccaccgtgcctgtggtatactcatgcctgggttccctgtttaggaggagggtcta

SEQ ID NO: 177297 - DNA, 75 bp, Artificial Sequence
  Synthetic
ccgtcctacttttcccacattggcctgagagctgtagtacaaaaaacaccgcgcggtctggagctctccataagc

SEQ ID NO: 177298 - DNA, 75 bp, Artificial Sequence
  Synthetic
gtgcctgtggtatactcatgcctgggttccctgtttaggaggagggtctacgggatgtgttctaacatccgaaga

SEQ ID NO: 177299 - DNA, 75 bp, Artificial Sequence
  Synthetic
acagtcaccccttgcgggttattgcattggattcaatctccaggccagttgtagcccccttttatgatatgcgag

SEQ ID NO: 177300 - DNA, 75 bp, Artificial Sequence
  Synthetic
taaagaaggtagatctcatatagtggatgtgtcagcgtatttgctttattgtgcacatggttaaaataaacttat

SEQ ID NO: 177301 - DNA, 75 bp, Artificial Sequence
  Synthetic
attggattcaatctccaggccagttgtagcccccttttatgatatgcgaggatacttaacgtgtctgaatgtgga

SEQ ID NO: 177302 - DNA, 75 bp, Artificial Sequence
  Synthetic
gatgtgtcagcgtatttgctttattgtgcacatggttaaaataaacttataattagcacactacagggggtcgtg

SEQ ID NO: 177303 - DNA, 75 bp, Artificial Sequence
  Synthetic
cactacctatctgctcattcgttgtttcggttctgtgtttgtctgattcttagatagtgttgaggtaattctaga

SEQ ID NO: 177304 - DNA, 75 bp, Artificial Sequence
  Synthetic
cccacggggacgttgtcatgggcgttaggtccctcgggatgtactgccactgccacggatggaatgtcagcgccg

SEQ ID NO: 177305 - DNA, 75 bp, Artificial Sequence
  Synthetic
ttcggttctgtgtttgtctgattcttagatagtgttgaggtaattctagaaagcggattgagtgtaaatcgggcc

SEQ ID NO: 177306 - DNA, 75 bp, Artificial Sequence
  Synthetic
taggtccctcgggatgtactgccactgccacggatggaatgtcagcgccgggtccacaagcagagcagtgtgtcg

SEQ ID NO: 177307 - DNA, 75 bp, Artificial Sequence
  Synthetic
gaagcattttaaaatgcgttttagattgtatcaggctagtgctgtaatggtgtgtttatttttccagtgtaagca

SEQ ID NO: 177308 - DNA, 75 bp, Artificial Sequence
  Synthetic
tggggtagtgtcgggcgtagtggttctcgtctgcgctctgactgtgatatgccatggctatgttaccgcgctctc

SEQ ID NO: 177309 - DNA, 75 bp, Artificial Sequence
  Synthetic
ttgtatcaggctagtgctgtaatggtgtgtttatttttccagtgtaagcaagtcgatttgaatgacataggcgac

SEQ ID NO: 177310 - DNA, 75 bp, Artificial Sequence
  Synthetic
ctcgtctgcgctctgactgtgatatgccatggctatgttaccgcgctctctgaaaatatattcgagtgcatcgcg

SEQ ID NO: 177311 - DNA, 75 bp, Artificial Sequence
  Synthetic
actaaagtggtgtgcggcagctgggagcgctctttcaatgttaatgttttaatgtgtatgttgtgttggaagttc

SEQ ID NO: 177312 - DNA, 75 bp, Artificial Sequence
  Synthetic
tgccgcgaaggacacgcaggaaaatgcttctggtgttctgcggaatgtgcacattaagccaatggctgtcgtagg

SEQ ID NO: 177313 - DNA, 75 bp, Artificial Sequence
  Synthetic
agcgctctttcaatgttaatgttttaatgtgtatgttgtgttggaagttccaggctaatatttgatgttttgcta

SEQ ID NO: 177314 - DNA, 75 bp, Artificial Sequence
  Synthetic
gcttctggtgttctgcggaatgtgcacattaagccaatggctgtcgtaggtgccggacacgttcggctctaggtt

SEQ ID NO: 177315 - DNA, 75 bp, Artificial Sequence
  Synthetic
aacggtgttttggctgggtttttccttgttcgcaccggacacctccagtgaccagacggcaaggtttttatccca

SEQ ID NO: 177316 - DNA, 75 bp, Artificial Sequence
  Synthetic
cttggcgggcgatgaccccgagcgccgtgagaagctgaaagcccacctctccgcaacacacggaaaaggtgtcca

SEQ ID NO: 177317 - DNA, 75 bp, Artificial Sequence
  Synthetic
ttgttcgcaccggacacctccagtgaccagacggcaaggtttttatcccagtgtatattggaaaaacatgttata

SEQ ID NO: 177318 - DNA, 75 bp, Artificial Sequence
  Synthetic
cgtgagaagctgaaagcccacctctccgcaacacacggaaaaggtgtccagtctaccgaaaaacgccgccagcgt

SEQ ID NO: 177319 - DNA, 75 bp, Artificial Sequence
  Synthetic
tgacgtagctggcctggcagccggtcgtctgcgaggtgatgaggcccgagaagccattaagcgagaggccactct

SEQ ID NO: 177320 - DNA, 75 bp, Artificial Sequence
  Synthetic
cgtctgcgaggtgatgaggcccgagaagccattaagcgagaggccactcttgagttcctccaccgtcacgcacgc

SEQ ID NO: 177321 - DNA, 75 bp, Artificial Sequence
  Synthetic
ttgggatgggggtgtgggatgggggtgtgggatgggggtgtgggatgggggtgtgggatgggggtgtgggatggg

SEQ ID NO: 177322 - DNA, 75 bp, Artificial Sequence
  Synthetic
aactgccaggaatgaccaggctggctaccctgcgcggagctcttggacatgcgaagatgcgcaggcgattttgca

SEQ ID NO: 177323 - DNA, 75 bp, Artificial Sequence
  Synthetic
ggggtaaatgacaatggggcgcttggtgacacatttgccccaccgtcgcctgcccggaaccagcttggtgatgtg

SEQ ID NO: 177324 - DNA, 75 bp, Artificial Sequence
  Synthetic
gtgacacatttgccccaccgtcgcctgcccggaaccagcttggtgatgtgctgtctggctctcaggtgcacttta

SEQ ID NO: 177325 - DNA, 75 bp, Artificial Sequence
  Synthetic
taccctgcgcggagctcttggacatgcgaagatgcgcaggcgattttgcatgcacaactcctgcaggccaccgag

SEQ ID NO: 177326 - DNA, 75 bp, Artificial Sequence
  Synthetic
ccatgggaggggccgtgatcgcccacgtctcgtcggcaaacgcagtccaggaaacaagcagcgatgacagagttt

SEQ ID NO: 177327 - DNA, 75 bp, Artificial Sequence
  Synthetic
tggtgctgtgcgcgtgctatgtgccctggtgaccgtccacaatggacgaggacgttttgcctggagaggtgttgg

SEQ ID NO: 177328 - DNA, 75 bp, Artificial Sequence
  Synthetic
ctggtgaccgtccacaatggacgaggacgttttgcctggagaggtgttggccattgaagggatattcatggcctg

SEQ ID NO: 177329 - DNA, 75 bp, Artificial Sequence
  Synthetic
cgtctcgtcggcaaacgcagtccaggaaacaagcagcgatgacagagtttcttggaagatgcacgcgtcgttttg

SEQ ID NO: 177330 - DNA, 75 bp, Artificial Sequence
  Synthetic
cgtgagcaatgcagctgtaatcacgtgctgcagccaggactagggcaagcttctcttgtgggacctcgacaaggg

SEQ ID NO: 177331 - DNA, 75 bp, Artificial Sequence
  Synthetic
agctatacatcacaggcttaatgcgagacaaggagtctttattcgaggccatgttggctaatgtgagatttcaca

SEQ ID NO: 177332 - DNA, 75 bp, Artificial Sequence
  Synthetic
agacaaggagtctttattcgaggccatgttggctaatgtgagatttcacagcaccaccggtataaaccagcttgg

SEQ ID NO: 177333 - DNA, 75 bp, Artificial Sequence
  Synthetic
tgctgcagccaggactagggcaagcttctcttgtgggacctcgacaagggcccccggggtttctgacaccaatat

SEQ ID NO: 177334 - DNA, 75 bp, Artificial Sequence
  Synthetic
ccgccatggccatctcaatggcagctacgagaagccctccgtctccaatgtcgtgaccggaaacaacaagcctat

SEQ ID NO: 177335 - DNA, 75 bp, Artificial Sequence
  Synthetic
ccctggctatactgacctttggcagttttgtggcccagaagttatccaacgaacctcacctgcgagactttgctt

SEQ ID NO: 177336 - DNA, 75 bp, Artificial Sequence
  Synthetic
ttttgtggcccagaagttatccaacgaacctcacctgcgagactttgctttggccgttttacctgtatatgcgta

SEQ ID NO: 177337 - DNA, 75 bp, Artificial Sequence
  Synthetic
tacgagaagccctccgtctccaatgtcgtgaccggaaacaacaagcctatttgacatcagaaacttaatcaggta

SEQ ID NO: 177338 - DNA, 75 bp, Artificial Sequence
  Synthetic
atgccaggaacagatgctcgaaggtggaaccttccacagtgcagtgctgactgaccggcaggtaaaccaacgcgt

SEQ ID NO: 177339 - DNA, 75 bp, Artificial Sequence
  Synthetic
tgaaggcgtattgtacacaggtgcttaccagaagaaggggacggagaatgacagcgctattgggaagcattgcat

SEQ ID NO: 177340 - DNA, 75 bp, Artificial Sequence
  Synthetic
ggaaccttccacagtgcagtgctgactgaccggcaggtaaaccaacgcgttgccttgccgctttaggtctggggt

SEQ ID NO: 177341 - DNA, 75 bp, Artificial Sequence
  Synthetic
cgcgatgagcaggagataacgcgtaattcgaggtccccggaagagtagagggttgcatgttatacaaacaacata

SEQ ID NO: 177342 - DNA, 75 bp, Artificial Sequence
  Synthetic
aattaaactgcaccacctccaccgtctcctgccgttgggtgatctgcagcatcctctcagacagtggcaaagacg

SEQ ID NO: 177343 - DNA, 75 bp, Artificial Sequence
  Synthetic
ctcctgccgttgggtgatctgcagcatcctctcagacagtggcaaagacgttgagcctgacgtgaaggacaggcc

SEQ ID NO: 177344 - DNA, 75 bp, Artificial Sequence
  Synthetic
aggggagtagggtaggaagggtacgtctaatacgtaactgttcgctactgcttgttcaggagctcctcgcagaac

SEQ ID NO: 177345 - DNA, 75 bp, Artificial Sequence
  Synthetic
gagcttgtgcctgagatgactctgaactccaggtcacggcggcggcgaggacaatgtcctgcagttttgacaccg

SEQ ID NO: 177346 - DNA, 75 bp, Artificial Sequence
  Synthetic
actccaggtcacggcggcggcgaggacaatgtcctgcagttttgacaccgggctgaacataatgtttgtgatggc

SEQ ID NO: 177347 - DNA, 75 bp, Artificial Sequence
  Synthetic
tagagcgactgctggcttcaacgcggttcgatgtagggttcggcgtaggagcgtctttctccaccgccgcgcatg

SEQ ID NO: 177348 - DNA, 75 bp, Artificial Sequence
  Synthetic
acgcctgttctcccaaggccatggcctggccccgccatgccggctgaatgacgggagttgttggtaaggtcttaa

SEQ ID NO: 177349 - DNA, 75 bp, Artificial Sequence
  Synthetic
gcgggggtgggttcagcgggtggtgcgccaactaccgcgagtcctgtagagactggcgggtggctcacatgtggc

SEQ ID NO: 177350 - DNA, 75 bp, Artificial Sequence
  Synthetic
cgccaactaccgcgagtcctgtagagactggcgggtggctcacatgtggctgagcaaaaaggatgggcgccgctt

SEQ ID NO: 177351 - DNA, 75 bp, Artificial Sequence
  Synthetic
ctggccccgccatgccggctgaatgacgggagttgttggtaaggtcttaacccaaccttccacgtctctctggac

SEQ ID NO: 177352 - DNA, 75 bp, Artificial Sequence
  Synthetic
gggccacccgttcggccaacatagccgagtggagcaccaggtggtagtccgagaggggaagatctaaaggcccta

SEQ ID NO: 177353 - DNA, 75 bp, Artificial Sequence
  Synthetic
gttcctccgtgctccttcattgtcgggaattgacacggggccgctgaattggcgtggggcctgtagtgtggatct

SEQ ID NO: 177354 - DNA, 75 bp, Artificial Sequence
  Synthetic
ggaattgacacggggccgctgaattggcgtggggcctgtagtgtggatctactgcggctgctgctgcagaggagg

SEQ ID NO: 177355 - DNA, 75 bp, Artificial Sequence
  Synthetic
cgagtggagcaccaggtggtagtccgagaggggaagatctaaaggccctatgccagcctgctgggcaattaggcc

SEQ ID NO: 177356 - DNA, 75 bp, Artificial Sequence
  Synthetic
taggacaacgtagcatctgatggacgatggagctgatgttaaagaggctccaatctacagtgtctgcaatcacta

SEQ ID NO: 177357 - DNA, 75 bp, Artificial Sequence
  Synthetic
gactgtatttccgctatgttctttgacatggacaagatatccttgtgatacgccggctcctctcctggaaagagg

SEQ ID NO: 177358 - DNA, 75 bp, Artificial Sequence
  Synthetic
acatggacaagatatccttgtgatacgccggctcctctcctggaaagaggtgtccttcgtcgtcctctgcgccgc

SEQ ID NO: 177359 - DNA, 75 bp, Artificial Sequence
  Synthetic
gatggagctgatgttaaagaggctccaatctacagtgtctgcaatcactactccaagatggtccgatgatgtgga

SEQ ID NO: 177360 - DNA, 75 bp, Artificial Sequence
  Synthetic
gctgcagctctgacgtgtctccttcgcggggaaggtcatccacaattcgaatcccctgctgctcagtagttatgc

SEQ ID NO: 177361 - DNA, 75 bp, Artificial Sequence
  Synthetic
ggatcgtatgggttcttgtaagcgtagccgtatggtggcgctgggtttgaaacatacgaaggtaggtgatggtcg

SEQ ID NO: 177362 - DNA, 75 bp, Artificial Sequence
  Synthetic
agccgtatggtggcgctgggtttgaaacatacgaaggtaggtgatggtcggtggggaacatctggcccccacacc

SEQ ID NO: 177363 - DNA, 75 bp, Artificial Sequence
  Synthetic
gcggggaaggtcatccacaattcgaatcccctgctgctcagtagttatgcccaggattgaaaccggacagccaca

SEQ ID NO: 177364 - DNA, 75 bp, Artificial Sequence
  Synthetic
cctccgggccccaagactctgccaccaccgcaaacagtagagagctgtacacttgcagaaaatacctggacacgg

SEQ ID NO: 177365 - DNA, 75 bp, Artificial Sequence
  Synthetic
ttcattccatcgatgctgctttgtagcatgctcaggaaggcggatttggggatggatatgatatcctcttgacca

SEQ ID NO: 177366 - DNA, 75 bp, Artificial Sequence
  Synthetic
gcatgctcaggaaggcggatttggggatggatatgatatcctcttgaccagagctgttcatggctggtctgggtg

SEQ ID NO: 177367 - DNA, 75 bp, Artificial Sequence
  Synthetic
caccgcaaacagtagagagctgtacacttgcagaaaatacctggacacggtgtcttgtattgtctcaggactggc

SEQ ID NO: 177368 - DNA, 75 bp, Artificial Sequence
  Synthetic
ggaaaagtaggagtcccatgcgagccactactgctcgaagctggacttccacgattcctgggtcatgggacctat

SEQ ID NO: 177369 - DNA, 75 bp, Artificial Sequence
  Synthetic
gggctcaatatgctggccacacctctgtcagttttcaataggtcgaggcggtcccgtatgaagctggcatctata

SEQ ID NO: 177370 - DNA, 75 bp, Artificial Sequence
  Synthetic
tgtcagttttcaataggtcgaggcggtcccgtatgaagctggcatctatagcttttgccattaaggtctccaggg

SEQ ID NO: 177371 - DNA, 75 bp, Artificial Sequence
  Synthetic
cactactgctcgaagctggacttccacgattcctgggtcatgggacctattgaggctagagaataccggaccctc

SEQ ID NO: 177372 - DNA, 75 bp, Artificial Sequence
  Synthetic
ccgcgctgtcagtgtacaggcccgggtagctgtctggagtcgtggtgggatcaaagcggccgaaacagattacgt

SEQ ID NO: 177373 - DNA, 75 bp, Artificial Sequence
  Synthetic
tgctggaggatgtgggcgcgctccgacttagatactgatgagaatctggaaaccacccactcggcgtcgtgtccg

SEQ ID NO: 177374 - DNA, 75 bp, Artificial Sequence
  Synthetic
acttagatactgatgagaatctggaaaccacccactcggcgtcgtgtccgtacacggccactgtgccgcgtcggc

SEQ ID NO: 177375 - DNA, 75 bp, Artificial Sequence
  Synthetic
gtagctgtctggagtcgtggtgggatcaaagcggccgaaacagattacgtgttggttctggcgcattcgcctcaa

SEQ ID NO: 177376 - DNA, 75 bp, Artificial Sequence
  Synthetic
cgttgcccagcgcactgggtaccgtgtccacggtcttgaggaatccaccgagggtcggtacgccagcgccatgta

SEQ ID NO: 177377 - DNA, 75 bp, Artificial Sequence
  Synthetic
tgggataactcgcggggatgtatagacgataaagacagccccgggagccacgtgtggagtatctccaacagtggt

SEQ ID NO: 177378 - DNA, 75 bp, Artificial Sequence
  Synthetic
acgataaagacagccccgggagccacgtgtggagtatctccaacagtggttccttagggagatttttcacggggg

SEQ ID NO: 177379 - DNA, 75 bp, Artificial Sequence
  Synthetic
gtccacggtcttgaggaatccaccgagggtcggtacgccagcgccatgtagcaaagacgcgtgattcagacctcg

SEQ ID NO: 177380 - DNA, 75 bp, Artificial Sequence
  Synthetic
ttgttgcatacaagcccgttaaggcggcctgggtatggcctcctgggaataaagtgccatgaaacagaaggtcgc

SEQ ID NO: 177381 - DNA, 75 bp, Artificial Sequence
  Synthetic
gctggcgacgtgatggctccggtgcagaaaataccgtgggacacttgaaatagacccagtgtccagcccacttct

SEQ ID NO: 177382 - DNA, 75 bp, Artificial Sequence
  Synthetic
agaaaataccgtgggacacttgaaatagacccagtgtccagcccacttctgtctctggtaggtgttcgattgtta

SEQ ID NO: 177383 - DNA, 75 bp, Artificial Sequence
  Synthetic
ggcctgggtatggcctcctgggaataaagtgccatgaaacagaaggtcgctgagatcgcgaagaccgaggtgaaa

SEQ ID NO: 177384 - DNA, 75 bp, Artificial Sequence
  Synthetic
tgcagtgccatccccacatatctactgtacacgaatttgcgaccacaaagtatctggccaggttgtagttgtcgc

SEQ ID NO: 177385 - DNA, 75 bp, Artificial Sequence
  Synthetic
agatagagctcttgctccagcttggggcaggacacaacatctacaaaccctccgacgtacaggccctgtgccatg

SEQ ID NO: 177386 - DNA, 75 bp, Artificial Sequence
  Synthetic
tgtacacgaatttgcgaccacaaagtatctggccaggttgtagttgtcgcctgtcgaggcttggaccgcgaggga

SEQ ID NO: 177387 - DNA, 75 bp, Artificial Sequence
  Synthetic
agccgctgagcccggggcttaggaggctcatgtggcgctttttgcaaaataagaatttaaatacattccacgccc

SEQ ID NO: 177388 - DNA, 75 bp, Artificial Sequence
  Synthetic
gggcctgttgtggtggtgcgtcgtcaggtggactccctataggttctaagcccctatagggcaccatttctgtgt

SEQ ID NO: 177389 - DNA, 75 bp, Artificial Sequence
  Synthetic
aggtggactccctataggttctaagcccctatagggcaccatttctgtgtgggccgtgaatgcttggataaagtg

SEQ ID NO: 177390 - DNA, 75 bp, Artificial Sequence
  Synthetic
ctaaatgtgtacctgttaagggaggctactgccaatgccgggacctacgacgaggtggtcctgggacgcaaggtt

SEQ ID NO: 177391 - DNA, 75 bp, Artificial Sequence
  Synthetic
ctactgccaatgccgggacctacgacgaggtggtcctgggacgcaaggttcctgcggaggtgtggaagctcgtgt

SEQ ID NO: 177392 - DNA, 75 bp, Artificial Sequence
  Synthetic
ttccgatttcaaggcgttgcagagatgtcatacctagttctgccaggacagctgtcagttccatggagacagtcg

SEQ ID NO: 177393 - DNA, 75 bp, Artificial Sequence
  Synthetic
tgtcatacctagttctgccaggacagctgtcagttccatggagacagtcgtggggcgtcgcctgaggtccggtcc

SEQ ID NO: 177394 - DNA, 75 bp, Artificial Sequence
  Synthetic
gcataccgggacagcctctggatgcacttgaacgataaggtggggctcttgaggggcctggcgaattatctgttt

SEQ ID NO: 177395 - DNA, 75 bp, Artificial Sequence
  Synthetic
aagattgaggatagtcgaaatgcggacccatgagcgcaagcgtcagctgcatttcagcctcacgtctctctcttt

SEQ ID NO: 177396 - DNA, 75 bp, Artificial Sequence
  Synthetic
caccggctaggggtcacccacgacgttcgcatcgccccggaaaacctggtggacggaaactttttgtttaatctg

SEQ ID NO: 177397 - DNA, 75 bp, Artificial Sequence
  Synthetic
acccatgagcgcaagcgtcagctgcatttcagcctcacgtctctctctttccgccgaagaaacggccgggcttgg

SEQ ID NO: 177398 - DNA, 75 bp, Artificial Sequence
  Synthetic
cttttggggcagcgatgaacacgaacgctgggtgcgcttcttcgcccagaagcttttcatttgctacctgatagt

SEQ ID NO: 177399 - DNA, 75 bp, Artificial Sequence
  Synthetic
tcaggtggccttgcctacccgtatagaaggccacaaaagcctcctcgtcgggcgtaaggtcgccaggtagccaga

SEQ ID NO: 177400 - DNA, 75 bp, Artificial Sequence
  Synthetic
gaaggccacaaaagcctcctcgtcgggcgtaaggtcgccaggtagccagaatccctggacgctgcgcgccatggc

SEQ ID NO: 177401 - DNA, 75 bp, Artificial Sequence
  Synthetic
tctctgctagtttgggccagcgaaacgggctatcccggtccggtggaggcagtctgtcgcgacatccgctccatg

SEQ ID NO: 177402 - DNA, 75 bp, Artificial Sequence
  Synthetic
agtacctggcctaagtcacagagtgacagcggtggcacccggattgtagaggtctcgtgggagcaagcatttgca

SEQ ID NO: 177403 - DNA, 75 bp, Artificial Sequence
  Synthetic
acagcggtggcacccggattgtagaggtctcgtgggagcaagcatttgcattaaactataattgttgcctcaaat

SEQ ID NO: 177404 - DNA, 75 bp, Artificial Sequence
  Synthetic
agcgcagctggcctaccttggtgcgtttaacaacaacgcggtttaaacgaccgcgaggaccaccggcaggcagcc

SEQ ID NO: 177405 - DNA, 75 bp, Artificial Sequence
  Synthetic
ccgcgaggaccaccggcaggcagccaagaaccataaagtacgctctatcgtagtcatcgccgccgccaaactggg

SEQ ID NO: 177406 - DNA, 75 bp, Artificial Sequence
  Synthetic
ggaaaatagacatcctcgtatcctccgtcttcgcccggaccgcccatctgttcgtcacacgtcagtgcaccggat

SEQ ID NO: 177407 - DNA, 75 bp, Artificial Sequence
  Synthetic
cgtcttcgcccggaccgcccatctgttcgtcacacgtcagtgcaccggatatagtgttgcctagcagagcagacg

SEQ ID NO: 177408 - DNA, 75 bp, Artificial Sequence
  Synthetic
acgtccaggccctcttctgttgccaggcggagggctgttctcgcctggagcagcgccagtggatctcggaatgta

SEQ ID NO: 177409 - DNA, 75 bp, Artificial Sequence
  Synthetic
ggcggagggctgttctcgcctggagcagcgccagtggatctcggaatgtaagctgctggttcaggatttcgaata

SEQ ID NO: 177410 - DNA, 75 bp, Artificial Sequence
  Synthetic
attggtatacttgaaccaatggaggtttccaccgcggcggtagtgtatacaatgggagattcgggcgtgggtgta

SEQ ID NO: 177411 - DNA, 75 bp, Artificial Sequence
  Synthetic
tttccaccgcggcggtagtgtatacaatgggagattcgggcgtgggtgtagagcttacagtgtttctacttaaag

SEQ ID NO: 177412 - DNA, 75 bp, Artificial Sequence
  Synthetic
tgggacacggtcgatcgcgcctcgagggcggccagtattatgccagggaagatgaaggacacgggggcgtttgga

SEQ ID NO: 177413 - DNA, 75 bp, Artificial Sequence
  Synthetic
gaacgtgctatgggccaagttggagacgtgccatctcccgtaccgcgaccacttggagacatgaaattaatcctc

SEQ ID NO: 177414 - DNA, 75 bp, Artificial Sequence
  Synthetic
acgtgccatctcccgtaccgcgaccacttggagacatgaaattaatcctccttggagccttgtgtatgtggatga

SEQ ID NO: 177415 - DNA, 75 bp, Artificial Sequence
  Synthetic
gtgtaggtagctaagtacataggtatacaaaagtcagcagtgccaacttactaatgaggagagcgatgcaaacca

SEQ ID NO: 177416 - DNA, 75 bp, Artificial Sequence
  Synthetic
cctcgcgcgacttgcccaaactccagcaatccatacgcgaggataaacacctccagcgcaacaatccccgctcgc

SEQ ID NO: 177417 - DNA, 75 bp, Artificial Sequence
  Synthetic
gcaatccatacgcgaggataaacacctccagcgcaacaatccccgctcgcaggttccactggtatgcggaaaatg

SEQ ID NO: 177418 - DNA, 75 bp, Artificial Sequence
  Synthetic
tacaaaagtcagcagtgccaacttactaatgaggagagcgatgcaaaccaacgttgctaaagcaaccagcaccca

SEQ ID NO: 177419 - DNA, 75 bp, Artificial Sequence
  Synthetic
ctgtaacacaatgaaataaaaatttaggcaagttcaacactaaagtgacaaatgtatgatatatacccaaatact

SEQ ID NO: 177420 - DNA, 75 bp, Artificial Sequence
  Synthetic
atggcgggcgctgtccctggcgcgcccgtacccttgttgtggggaaataatccagccttagccatcattgcgtga

SEQ ID NO: 177421 - DNA, 75 bp, Artificial Sequence
  Synthetic
ccgtacccttgttgtggggaaataatccagccttagccatcattgcgtgaagcttgtggcgctggaagaaggctg

SEQ ID NO: 177422 - DNA, 75 bp, Artificial Sequence
  Synthetic
aggcaagttcaacactaaagtgacaaatgtatgatatatacccaaatacttacaaatgagggtgtgacatagtcc

SEQ ID NO: 177423 - DNA, 75 bp, Artificial Sequence
  Synthetic
gcagtacaatactcgccacaaacacatgttgggacgctacataaaatggcaggattgaaaggttagggcaagtgc

SEQ ID NO: 177424 - DNA, 75 bp, Artificial Sequence
  Synthetic
gggtttgagtatgtgaagctgaagtccccaggaccgctttcctgttttagctgagtgattagcaggtctagcttt

SEQ ID NO: 177425 - DNA, 75 bp, Artificial Sequence
  Synthetic
ccccaggaccgctttcctgttttagctgagtgattagcaggtctagcttttgaggcaggtctgctaacaggtcat

SEQ ID NO: 177426 - DNA, 75 bp, Artificial Sequence
  Synthetic
atgttgggacgctacataaaatggcaggattgaaaggttagggcaagtgcttacaaatgaacactgtgaaagaaa

SEQ ID NO: 177427 - DNA, 75 bp, Artificial Sequence
  Synthetic
gagtaatacaaaataatttcagccgaaataatatatataaataacaccaatccttgtaaaagaagatatgttgct

SEQ ID NO: 177428 - DNA, 75 bp, Artificial Sequence
  Synthetic
acgaggcaaagcgcggcctgggtgtccgtgagatgcctggcgtcggcgaaaaagtcagcggtggtcgaggcgacc

SEQ ID NO: 177429 - DNA, 75 bp, Artificial Sequence
  Synthetic
ccgtgagatgcctggcgtcggcgaaaaagtcagcggtggtcgaggcgaccgtcgtcagggtgtgagagatgagtt

SEQ ID NO: 177430 - DNA, 75 bp, Artificial Sequence
  Synthetic
aaataatatatataaataacaccaatccttgtaaaagaagatatgttgctacgcccttgccagtgtttttccatg

SEQ ID NO: 177431 - DNA, 75 bp, Artificial Sequence
  Synthetic
gttgttaacaaattgtatgaaagttattatggaattataaaaagtttatactcactaactccccataccaatgtt

SEQ ID NO: 177432 - DNA, 75 bp, Artificial Sequence
  Synthetic
aagacgcgccgctgcatggcgttgtccgtgaggctgatgaaccacggcccaaaggatggcaaccactgattctgg

SEQ ID NO: 177433 - DNA, 75 bp, Artificial Sequence
  Synthetic
ccgtgaggctgatgaaccacggcccaaaggatggcaaccactgattctggttcatgtacagggtgggcatgagct

SEQ ID NO: 177434 - DNA, 75 bp, Artificial Sequence
  Synthetic
attatggaattataaaaagtttatactcactaactccccataccaatgttaaaaattgtgatagccgctgctaga

SEQ ID NO: 177435 - DNA, 75 bp, Artificial Sequence
  Synthetic
cacaaggcctaagaaagaaaatatcacagtaagtatagtgtaggctagaacaaaactacataaatagcaaattac

SEQ ID NO: 177436 - DNA, 75 bp, Artificial Sequence
  Synthetic
gccacggtgaagttacggtggctggcctgcgggggggatgtcactaagggaggctcatgggaacggctttggggc

SEQ ID NO: 177437 - DNA, 75 bp, Artificial Sequence
  Synthetic
cctgcgggggggatgtcactaagggaggctcatgggaacggctttggggcatgtctatgttgtcagaccatgtca

SEQ ID NO: 177438 - DNA, 75 bp, Artificial Sequence
  Synthetic
acagtaagtatagtgtaggctagaacaaaactacataaatagcaaattacctacctatatacactgcatgggtgg

SEQ ID NO: 177439 - DNA, 75 bp, Artificial Sequence
  Synthetic
aacaagatgaaaaagctaaaagctacaattaacgcagcagaggacataggccattggttccacagggtaaaaaat

SEQ ID NO: 177440 - DNA, 75 bp, Artificial Sequence
  Synthetic
acgcgtgagtcatggacctgaacaagccggtccagctctagggaaagcaggtgtgcctttgtctttcgttctcga

SEQ ID NO: 177441 - DNA, 75 bp, Artificial Sequence
  Synthetic
gccggtccagctctagggaaagcaggtgtgcctttgtctttcgttctcgatttcgcacgagttggctgcgcagtc

SEQ ID NO: 177442 - DNA, 75 bp, Artificial Sequence
  Synthetic
caattaacgcagcagaggacataggccattggttccacagggtaaaaaatgtaaaaagtgagtacagcagaagaa

SEQ ID NO: 177443 - DNA, 75 bp, Artificial Sequence
  Synthetic
atgtaggttgtagccaggacgcctgtaagaaaaaatacacgcataagtataaaaacaaaatgggaaaaataaaaa

SEQ ID NO: 177444 - DNA, 75 bp, Artificial Sequence
  Synthetic
acgttttccgggtgtggggcccagaatcttcccgcctctgtccatcttcggttttttgggtaccttagataggac

SEQ ID NO: 177445 - DNA, 75 bp, Artificial Sequence
  Synthetic
atcttcccgcctctgtccatcttcggttttttgggtaccttagataggacctttctgatgtcagcattttctcta

SEQ ID NO: 177446 - DNA, 75 bp, Artificial Sequence
  Synthetic
taagaaaaaatacacgcataagtataaaaacaaaatgggaaaaataaaaaaaatgttaacataaacaagcatacc

SEQ ID NO: 177447 - DNA, 75 bp, Artificial Sequence
  Synthetic
cgttggcatgatgaatccaagtagttgtgagcagatatgcaactagaagaagaagaataaaaattatagaatccg

SEQ ID NO: 177448 - DNA, 75 bp, Artificial Sequence
  Synthetic
aaacgccccgggtgattcagagtatactgtctttagtgttttctgattcttaaatatcagcaggggcgtgatagt

SEQ ID NO: 177449 - DNA, 75 bp, Artificial Sequence
  Synthetic
actgtctttagtgttttctgattcttaaatatcagcaggggcgtgatagtccacgcctcggtacccggaggggcc

SEQ ID NO: 177450 - DNA, 75 bp, Artificial Sequence
  Synthetic
tgtgagcagatatgcaactagaagaagaagaataaaaattatagaatccgtatgatagcatacatgggaattaat

SEQ ID NO: 177451 - DNA, 75 bp, Artificial Sequence
  Synthetic
aggcctgtgagcattataaatgtataacgtatgtagaattccaacacaccacgttacgcatccaaacactaagaa

SEQ ID NO: 177452 - DNA, 75 bp, Artificial Sequence
  Synthetic
tcgctgtgacgttctcacggtgttggttgggatcagctggtgactcagacaagtcttgagctctacaacgtaaca

SEQ ID NO: 177453 - DNA, 75 bp, Artificial Sequence
  Synthetic
gttgggatcagctggtgactcagacaagtcttgagctctacaacgtaacatacgggctgatgcccacccgatacc

SEQ ID NO: 177454 - DNA, 75 bp, Artificial Sequence
  Synthetic
aacgtatgtagaattccaacacaccacgttacgcatccaaacactaagaaaggagaaagtatggggggcttcaaa

SEQ ID NO: 177455 - DNA, 75 bp, Artificial Sequence
  Synthetic
taaaaacaaaaaccatattgtccatatgtggccacgggttagtttccagttagccatggcaaaaggtaataaagg

SEQ ID NO: 177456 - DNA, 75 bp, Artificial Sequence
  Synthetic
tctgtggtgtccaaggggagggttctggggccggctacttagaaaccgccatagatcgggcagggtggagtactt

SEQ ID NO: 177457 - DNA, 75 bp, Artificial Sequence
  Synthetic
tggggccggctacttagaaaccgccatagatcgggcagggtggagtacttgaggagccggcggtaggtggccagg

SEQ ID NO: 177458 - DNA, 75 bp, Artificial Sequence
  Synthetic
atgtggccacgggttagtttccagttagccatggcaaaaggtaataaaggtagaaaatgtgagtgttaaacaaaa

SEQ ID NO: 177459 - DNA, 75 bp, Artificial Sequence
  Synthetic
ggaaatagaaatggccaaatttattttggaatgttcttggcattgtgtaaaaatgttctgggcgaaaggccataa

SEQ ID NO: 177460 - DNA, 75 bp, Artificial Sequence
  Synthetic
tttcttaacctcggcctcggttggacgtaccatggcagaaggcggttttggagcggactcggtggggcgcggcgg

SEQ ID NO: 177461 - DNA, 75 bp, Artificial Sequence
  Synthetic
cgtaccatggcagaaggcggttttggagcggactcggtggggcgcggcggagaaaaggcctctgtgactagggga

SEQ ID NO: 177462 - DNA, 75 bp, Artificial Sequence
  Synthetic
ttggaatgttcttggcattgtgtaaaaatgttctgggcgaaaggccataacatgagtcatggataaaatgcaaca

SEQ ID NO: 177463 - DNA, 75 bp, Artificial Sequence
  Synthetic
gaacccaggagtaggtggcttgaaaacctcgcttatctccctgcctagtaaccactaagccaacatagattatga

SEQ ID NO: 177464 - DNA, 75 bp, Artificial Sequence
  Synthetic
cagcacggatatggacgacctccctgaggagaggaaaccactaacgggaaagtctgtaaaaacctcgtacatata

SEQ ID NO: 177465 - DNA, 75 bp, Artificial Sequence
  Synthetic
gaggagaggaaaccactaacgggaaagtctgtaaaaacctcgtacatatacgacgtgcccaccgtcccgaccagc

SEQ ID NO: 177466 - DNA, 75 bp, Artificial Sequence
  Synthetic
agtgggtgagatgtgagggggggtgacagtccgcgggccccggcgcgggcgcgggcgagcactttcgctttgggc

SEQ ID NO: 177467 - DNA, 75 bp, Artificial Sequence
  Synthetic
ctaattttcaaaggcggggttctgccaggcatagtctttttttctggcggcccttgtgtaaacctgtctttcaga

SEQ ID NO: 177468 - DNA, 75 bp, Artificial Sequence
  Synthetic
tccgcccagacctctcatacggcacccttccgaaaaaggcagcatttttgccagtcggttgtcagcgactgacga

SEQ ID NO: 177469 - DNA, 75 bp, Artificial Sequence
  Synthetic
ccttccgaaaaaggcagcatttttgccagtcggttgtcagcgactgacgacgactcgggagactacgcgccaatg

SEQ ID NO: 177470 - DNA, 75 bp, Artificial Sequence
  Synthetic
gcctccaaatcacccacctccggcaactaggccggcagacgcgtcaatgggggacgtgggctgggcggatctgca

SEQ ID NO: 177471 - DNA, 75 bp, Artificial Sequence
  Synthetic
aacgccttacacgttgacctgtctgtctgatgcatccttgccaatatcctggtattgcaacgatactcggctttg

SEQ ID NO: 177472 - DNA, 75 bp, Artificial Sequence
  Synthetic
gttgacgccattacctgcaattttacttgtgtggaacaatctgggcatcgacagagcatttggattacatggaat

SEQ ID NO: 177473 - DNA, 75 bp, Artificial Sequence
  Synthetic
tgtaggtgaccgtctcagggacggcggctttgcctttagtcctaggggcgtgaaatctgccatagggcaaaacat

SEQ ID NO: 177474 - DNA, 75 bp, Artificial Sequence
  Synthetic
ccacgcagcttatggtaccggtgcacctcattagaacgcctgtgaccgtggactacaggaatgtttatttgcttt

SEQ ID NO: 177475 - DNA, 75 bp, Artificial Sequence
  Synthetic
cctcattagaacgcctgtgaccgtggactacaggaatgtttatttgctttacttagagggggtaatgggtgtggg

SEQ ID NO: 177476 - DNA, 75 bp, Artificial Sequence
  Synthetic
tcgtctcgcctgtcaaatcgtctatgtttttcggcgcgttgtgcccatataactccagaaactcatactgtatct

SEQ ID NO: 177477 - DNA, 75 bp, Artificial Sequence
  Synthetic
tgacaagttttcccgagcccatggtgtactggacgagggcatttacagattgttacaaggaaatttcccacctga

SEQ ID NO: 177478 - DNA, 75 bp, Artificial Sequence
  Synthetic
gtactggacgagggcatttacagattgttacaaggaaatttcccacctgatgaagtctggtaaggcgggagaccc

SEQ ID NO: 177479 - DNA, 75 bp, Artificial Sequence
  Synthetic
aagtgcatttttttgtatttatgacactcgtagctctaataggaaccatgtgtggtatcttaggaactattatct

SEQ ID NO: 177480 - DNA, 75 bp, Artificial Sequence
  Synthetic
tccggacgaacgccaccgctatcctgcgaatgatgcagccctggaacgttgggggtgggtctgggaggggcactc

SEQ ID NO: 177481 - DNA, 75 bp, Artificial Sequence
  Synthetic
gcgaatgatgcagccctggaacgttgggggtgggtctgggaggggcactcactggtgcgtctttgataggcatct

SEQ ID NO: 177482 - DNA, 75 bp, Artificial Sequence
  Synthetic
tatcttttgatcacttctttcaattactttccatctttagagccacagaaggcgacgtggtcgccattctcaccc

SEQ ID NO: 177483 - DNA, 75 bp, Artificial Sequence
  Synthetic
actttccatctttagagccacagaaggcgacgtggtcgccattctcaccctctccagcgccgagtcgttgcggcg

SEQ ID NO: 177484 - DNA, 75 bp, Artificial Sequence
  Synthetic
tcagagaattggcgtgggcttatcacgccgtgtactgttcatggatcatgttgcagtacatcactgtggagcaga

SEQ ID NO: 177485 - DNA, 75 bp, Artificial Sequence
  Synthetic
cgccgtgtactgttcatggatcatgttgcagtacatcactgtggagcagatggtacaactatgcgtacaaaccac

SEQ ID NO: 177486 - DNA, 75 bp, Artificial Sequence
  Synthetic
aaactttgaaaaaccttcacgagcagagcatgctacctatgatcaccggtgtactggatcccgtgagacatcatc

SEQ ID NO: 177487 - DNA, 75 bp, Artificial Sequence
  Synthetic
gagcatgctacctatgatcaccggtgtactggatcccgtgagacatcatcccgtcgtgatcgagctttgcttttg

SEQ ID NO: 177488 - DNA, 75 bp, Artificial Sequence
  Synthetic
agttccacgacgacgtatgcggcctgtggaccgaaatctacaggcagatcctgtccaatccggctattaaaccca

SEQ ID NO: 177489 - DNA, 75 bp, Artificial Sequence
  Synthetic
gtggaccgaaatctacaggcagatcctgtccaatccggctattaaacccagggccatcaactggccagcattaga

SEQ ID NO: 177490 - DNA, 75 bp, Artificial Sequence
  Synthetic
cttcttggcggcccttgcatgctggcgatgcatatcgttgacatgtggagccactggcgcgttgccgacaacggc

SEQ ID NO: 177491 - DNA, 75 bp, Artificial Sequence
  Synthetic
cgatgcatatcgttgacatgtggagccactggcgcgttgccgacaacggcgacgacaataacccgctccgccacg

SEQ ID NO: 177492 - DNA, 75 bp, Artificial Sequence
  Synthetic
cactagtttttttctaaattggcaaaatctgttgaatgtgatcacggagccggccctgacagagttgtggacctc

SEQ ID NO: 177493 - DNA, 75 bp, Artificial Sequence
  Synthetic
aatctgttgaatgtgatcacggagccggccctgacagagttgtggacctccgccgaagtcgccgaggacctcagg

SEQ ID NO: 177494 - DNA, 75 bp, Artificial Sequence
  Synthetic
gatctctggagacggccatcgctatacgtgcgaggtgccgacgtcgtcgcaaacttataacatcaccaagggctt

SEQ ID NO: 177495 - DNA, 75 bp, Artificial Sequence
  Synthetic
acgtgcgaggtgccgacgtcgtcgcaaacttataacatcaccaagggctttaactatagcgctctgcccgggcac

SEQ ID NO: 177496 - DNA, 75 bp, Artificial Sequence
  Synthetic
atcaaaatggtcgctattcgcgagggacaccccagagtatcgggtgttttacccaatgaatgtcatggccgtcaa

SEQ ID NO: 177497 - DNA, 75 bp, Artificial Sequence
  Synthetic
gacaccccagagtatcgggtgttttacccaatgaatgtcatggccgtcaagttttccatatccattggcaacaac

SEQ ID NO: 177498 - DNA, 75 bp, Artificial Sequence
  Synthetic
cacgctccacaacaggtccaaagaggctaacgagacggcgtcccatcttctgttcggtctcccggattcactgcc

SEQ ID NO: 177499 - DNA, 75 bp, Artificial Sequence
  Synthetic
gctaacgagacggcgtcccatcttctgttcggtctcccggattcactgccatctctgaagggccatgccacctat

SEQ ID NO: 177500 - DNA, 75 bp, Artificial Sequence
  Synthetic
gcctaaagattcttaccagacactccttacagagaattacactcgcatatttctgaacatgacggagtcgacgcc

SEQ ID NO: 177501 - DNA, 75 bp, Artificial Sequence
  Synthetic
cttacagagaattacactcgcatatttctgaacatgacggagtcgacgcccctcgagttcacgcggacgatccag

SEQ ID NO: 177502 - DNA, 75 bp, Artificial Sequence
  Synthetic
ggcgccggacatattcttggtgttgtttcagatgttggtggcacactttcttgttgcgcggggcattgccgagca

SEQ ID NO: 177503 - DNA, 75 bp, Artificial Sequence
  Synthetic
tttcagatgttggtggcacactttcttgttgcgcggggcattgccgagcaccgatttgtggaggtggactgcgtg

SEQ ID NO: 177504 - DNA, 75 bp, Artificial Sequence
  Synthetic
cggcacagcctatccctgtaatcgtggacagactgacatcgcgaccttttcgagaagccagcgctctacaggcta

SEQ ID NO: 177505 - DNA, 75 bp, Artificial Sequence
  Synthetic
catgcccacgttcaccactgtcgggtataaccacaccacccttggcgctgtggccgccacacaaatagctcgcgt

SEQ ID NO: 177506 - DNA, 75 bp, Artificial Sequence
  Synthetic
tataaccacaccacccttggcgctgtggccgccacacaaatagctcgcgtgtccgccacgaagttggccagtttg

SEQ ID NO: 177507 - DNA, 75 bp, Artificial Sequence
  Synthetic
tgatggcgccgtcccttcctccattctggagggcattgctatggtcgtcgaacatatgtataccgcctacactta

SEQ ID NO: 177508 - DNA, 75 bp, Artificial Sequence
  Synthetic
ctggagggcattgctatggtcgtcgaacatatgtataccgcctacacttatgtgtacacactcggcgatactgaa

SEQ ID NO: 177509 - DNA, 75 bp, Artificial Sequence
  Synthetic
caaagactccggagtatcagaaaagctactgagaacatatttgatgttcacatcaatgtgtaccaacatagagct

SEQ ID NO: 177510 - DNA, 75 bp, Artificial Sequence
  Synthetic
ctactgagaacatatttgatgttcacatcaatgtgtaccaacatagagctgggcgaaatgatcgcccgcttttcc

SEQ ID NO: 177511 - DNA, 75 bp, Artificial Sequence
  Synthetic
actaaggtacgatttgcatccagccaagttgcgcgccgaggcgccgcagtcgtccgctctgacgcggactgccgt

SEQ ID NO: 177512 - DNA, 75 bp, Artificial Sequence
  Synthetic
aagttgcgcgccgaggcgccgcagtcgtccgctctgacgcggactgccgttgccagaggaacatcgggattcgca

SEQ ID NO: 177513 - DNA, 75 bp, Artificial Sequence
  Synthetic
taactgttcaaagattacagccgacaagataatagctacggtacccttgcctcacgtcacgtatatcatcagttc

SEQ ID NO: 177514 - DNA, 75 bp, Artificial Sequence
  Synthetic
aagataatagctacggtacccttgcctcacgtcacgtatatcatcagttccgaagcactctcgaacgctgttgtc

SEQ ID NO: 177515 - DNA, 75 bp, Artificial Sequence
  Synthetic
caaacccgattgctccggctttaacttttctcagattgataggcacattcccatagtctacaacatcagcacacc

SEQ ID NO: 177516 - DNA, 75 bp, Artificial Sequence
  Synthetic
ttttctcagattgataggcacattcccatagtctacaacatcagcacaccaagaagaggttgccccctttgtgac

SEQ ID NO: 177517 - DNA, 75 bp, Artificial Sequence
  Synthetic
tgtcactaatgaaagggtgcagaccaacctctttttagataagtcacctttctttgataataacaacctacacat

SEQ ID NO: 177518 - DNA, 75 bp, Artificial Sequence
  Synthetic
aacctctttttagataagtcacctttctttgataataacaacctacacattcattatttgtggctgagggacaac

SEQ ID NO: 177519 - DNA, 75 bp, Artificial Sequence
  Synthetic
tttgtttctaattctctcttttattgggttctcgggggttatctactttctttacagactgttttccatccttta

SEQ ID NO: 177520 - DNA, 75 bp, Artificial Sequence
  Synthetic
gggttctcgggggttatctactttctttacagactgttttccatcctttattagacggtcaataaagcgtagatt

SEQ ID NO: 177521 - DNA, 75 bp, Artificial Sequence
  Synthetic
aaatccgagcacctcagaaagtggattgccgtcacatatcagttcgaccacccctgcacctagccatgcggcgct

SEQ ID NO: 177522 - DNA, 75 bp, Artificial Sequence
  Synthetic
ttgccgtcacatatcagttcgaccacccctgcacctagccatgcggcgctttgacggtctttggggctacacatc

SEQ ID NO: 177523 - DNA, 75 bp, Artificial Sequence
  Synthetic
ttggcgaatgggttccctaaacgggaaatcctctatggtattcaggcagaagaccgcgtcctccacccgacgttt

SEQ ID NO: 177524 - DNA, 75 bp, Artificial Sequence
  Synthetic
gggcaagttctgcgccgtacagcgatgagaaacacgacacgatgttttccagccccatgctgcgcagcaacacgt

SEQ ID NO: 177525 - DNA, 75 bp, Artificial Sequence
  Synthetic
gttcagttttagcttgggtagaaaagttatcgagttgttagcacgctccatgatggtaacggtgttgaagtcaca

SEQ ID NO: 177526 - DNA, 75 bp, Artificial Sequence
  Synthetic
gttatcgagttgttagcacgctccatgatggtaacggtgttgaagtcacagaccgggctttctccgagtctcggc

SEQ ID NO: 177527 - DNA, 75 bp, Artificial Sequence
  Synthetic
aagtgacacgatatcccgttcgcaaacctgtgcgatgttgtgtttcagtatagatctggtctgaccggcacgggg

SEQ ID NO: 177528 - DNA, 75 bp, Artificial Sequence
  Synthetic
acctgtgcgatgttgtgtttcagtatagatctggtctgaccggcacggggtgttatggggtgacgcggtaaaggc

SEQ ID NO: 177529 - DNA, 75 bp, Artificial Sequence
  Synthetic
acgcttgttcgcggcgtgtatggggacgcgacggcatcccgctggcagatctataatcttaaagttggtataaga

SEQ ID NO: 177530 - DNA, 75 bp, Artificial Sequence
  Synthetic
acgcgacggcatcccgctggcagatctataatcttaaagttggtataagactggtcgctcgttatggccagccgg

SEQ ID NO: 177531 - DNA, 75 bp, Artificial Sequence
  Synthetic
cttggagtgcaggtaaacgccaagagatgcggtctcttcgcctacgcacaagtggcttcttaacgcgtaggggtg

SEQ ID NO: 177532 - DNA, 75 bp, Artificial Sequence
  Synthetic
gatgcggtctcttcgcctacgcacaagtggcttcttaacgcgtaggggtgcggtgagagcatgatccgtagcaac

SEQ ID NO: 177533 - DNA, 75 bp, Artificial Sequence
  Synthetic
agtcccaaacttttcgaacaacagtggcatcgggacttcaggattagagactcccaccatggccgccaccgccgg

SEQ ID NO: 177534 - DNA, 75 bp, Artificial Sequence
  Synthetic
ggcatcgggacttcaggattagagactcccaccatggccgccaccgccggagaggtcaagacgtgaaacacgcgc

SEQ ID NO: 177535 - DNA, 75 bp, Artificial Sequence
  Synthetic
cggaactcgtaacatagcttagaccagcggacggacgcaacgtacgcggggatcggctggcggtgtctgctcgtt

SEQ ID NO: 177536 - DNA, 75 bp, Artificial Sequence
  Synthetic
agcggacggacgcaacgtacgcggggatcggctggcggtgtctgctcgttggacgcggccgttcggtggcgccag

SEQ ID NO: 177537 - DNA, 75 bp, Artificial Sequence
  Synthetic
ggcgaaccgatgacccgtggtggcgacgaacgaaatgaagtttgcattgcggcccaactcgtctagcctggtctt

SEQ ID NO: 177538 - DNA, 75 bp, Artificial Sequence
  Synthetic
acgaacgaaatgaagtttgcattgcggcccaactcgtctagcctggtcttcttgtttcgggcatagattttcggg

SEQ ID NO: 177539 - DNA, 75 bp, Artificial Sequence
  Synthetic
tcgagtcgctcgagagcgacatgcgcgccgcagaggcccagagaaaagcatcgcgcgaggaaacccagcgcaaaa

SEQ ID NO: 177540 - DNA, 75 bp, Artificial Sequence
  Synthetic
agtgtgactgattatcttctttgagaagtcaaacaggccccgggcggcggctcgcctaatgcaagccacgtcaag

SEQ ID NO: 177541 - DNA, 75 bp, Artificial Sequence
  Synthetic
aagtcaaacaggccccgggcggcggctcgcctaatgcaagccacgtcaagcctgagaaacgaacagcattccacc

SEQ ID NO: 177542 - DNA, 75 bp, Artificial Sequence
  Synthetic
gtgctcaagtagggagaatattctatttttgtttccgtcgatgcgcgcgtgctggtccgtgagaatgggcgccag

SEQ ID NO: 177543 - DNA, 75 bp, Artificial Sequence
  Synthetic
tttttgtttccgtcgatgcgcgcgtgctggtccgtgagaatgggcgccagctcgtggcgaatctgttccacaaga

SEQ ID NO: 177544 - DNA, 75 bp, Artificial Sequence
  Synthetic
cacgtttagcccatccttgctggagaccacagatggaaagtttgtggtccaaaatacgttttttcgccccattct

SEQ ID NO: 177545 - DNA, 75 bp, Artificial Sequence
  Synthetic
accacagatggaaagtttgtggtccaaaatacgttttttcgccccattctcaccatgtactggttttccagtccg

SEQ ID NO: 177546 - DNA, 75 bp, Artificial Sequence
  Synthetic
cctgattggcagaaagcatttcagcgtacccattgcgaagagaaagtgcagcatgtccccactgatgttgatgtt

SEQ ID NO: 177547 - DNA, 75 bp, Artificial Sequence
  Synthetic
gtacccattgcgaagagaaagtgcagcatgtccccactgatgttgatgtttattgcggtgccttgacacatgttg

SEQ ID NO: 177548 - DNA, 75 bp, Artificial Sequence
  Synthetic
tcgtataacaaaattgttggtcaatctggggatgtttaaaatagtcttttgcagggtgttaggaacgtggcagct

SEQ ID NO: 177549 - DNA, 75 bp, Artificial Sequence
  Synthetic
ctggggatgtttaaaatagtcttttgcagggtgttaggaacgtggcagcttatcttagtgttaatcaccatgttg

SEQ ID NO: 177550 - DNA, 75 bp, Artificial Sequence
  Synthetic
ttccagcatgtctgacactgtggagctgcccagagtccgcgcgtccgtggccgcgtatcgttggaagcacgcctg

SEQ ID NO: 177551 - DNA, 75 bp, Artificial Sequence
  Synthetic
ctgcccagagtccgcgcgtccgtggccgcgtatcgttggaagcacgcctgcaaatttcctttcatggctgctcgc

SEQ ID NO: 177552 - DNA, 75 bp, Artificial Sequence
  Synthetic
cggtgtctcgtgggtgcctaaaaagtttgcgcaggggtgcagtccgctgcacgagtggccgatgcagtctgccac

SEQ ID NO: 177553 - DNA, 75 bp, Artificial Sequence
  Synthetic
acgagtggccgatgcagtctgccactgccatacacatgacgagtctgtagatggccggtgtgcccggatacacta

SEQ ID NO: 177554 - DNA, 75 bp, Artificial Sequence
  Synthetic
ccggggtccttgcgttggatttttacgtgcagacgggacacgagctggtttagagccagctgaaagcccaccaga

SEQ ID NO: 177555 - DNA, 75 bp, Artificial Sequence
  Synthetic
cgtgcagacgggacacgagctggtttagagccagctgaaagcccaccagatcccgtccgttaaccttgacgtcct

SEQ ID NO: 177556 - DNA, 75 bp, Artificial Sequence
  Synthetic
acgttgtgagcgatggcacggcgcagcgagaccagctctccgtgccacccccacgtggccatgaagctgctgatg

SEQ ID NO: 177557 - DNA, 75 bp, Artificial Sequence
  Synthetic
gcgagaccagctctccgtgccacccccacgtggccatgaagctgctgatgttaaactttaaaaaatgtagctgtg

SEQ ID NO: 177558 - DNA, 75 bp, Artificial Sequence
  Synthetic
tccaggagtgcaaaataattttgatagattgtgggttgtagactatggggcaacaccgccagaaacgcatgaaaa

SEQ ID NO: 177559 - DNA, 75 bp, Artificial Sequence
  Synthetic
ggtacctgcacactatcctgaacatggctttgtaacatatggtgcacgttagtagcgcgggaagatacagcgagc

SEQ ID NO: 177560 - DNA, 75 bp, Artificial Sequence
  Synthetic
gatcccaccgcaggtaggtagttgtcggtgtctatctgtccgcgcgtaaacactccaccaccgtcaattattaaa

SEQ ID NO: 177561 - DNA, 75 bp, Artificial Sequence
  Synthetic
cggtgtctatctgtccgcgcgtaaacactccaccaccgtcaattattaaaccttcgccgctgtaccgtcgaccca

SEQ ID NO: 177562 - DNA, 75 bp, Artificial Sequence
  Synthetic
cccaggagtagtctgcgtatcgctctgcaggcgaaaaaggtgggctcgggctgcatcatcttatcaagaccttct

SEQ ID NO: 177563 - DNA, 75 bp, Artificial Sequence
  Synthetic
ctgcatcatcttatcaagaccttctaaggtcagctctgcctgcaggtgcgagttggtggccagacagcagaatat

SEQ ID NO: 177564 - DNA, 75 bp, Artificial Sequence
  Synthetic
tcgtcagggaggcgctcggtggcagtagtagggggccctcgagcgctgccatggaggcgaccttggagcaacgac

SEQ ID NO: 177565 - DNA, 75 bp, Artificial Sequence
  Synthetic
tagtagggggccctcgagcgctgccatggaggcgaccttggagcaacgacctttcccgtacctcgccacggaggc

SEQ ID NO: 177566 - DNA, 75 bp, Artificial Sequence
  Synthetic
gctttcagctattgctcggcaaggacgccagagaaggcagtgtccgtttcgaagcgctactgggcgtatatacca

SEQ ID NO: 177567 - DNA, 75 bp, Artificial Sequence
  Synthetic
cgccagagaaggcagtgtccgtttcgaagcgctactgggcgtatataccaatgtggtggagtttgttaagtttct

SEQ ID NO: 177568 - DNA, 75 bp, Artificial Sequence
  Synthetic
ggagaatgatagatggaaaaatacagtttaaaatttcaatgcccactattgcccacggagacgggaggaggccca

SEQ ID NO: 177569 - DNA, 75 bp, Artificial Sequence
  Synthetic
gtttaaaatttcaatgcccactattgcccacggagacgggaggaggcccaacaagcagagacagtatatcgtcat

SEQ ID NO: 177570 - DNA, 75 bp, Artificial Sequence
  Synthetic
ctccttcagagccaggtgagcgccacatggtctgacatcttctccagggttcccgagcgcctcgctcccaatgcg

SEQ ID NO: 177571 - DNA, 75 bp, Artificial Sequence
  Synthetic
cagacatcgagcttctcttcgccgagaaagagacgcccttggacttcacagagtacgcgggtgccatcaagacga

SEQ ID NO: 177572 - DNA, 75 bp, Artificial Sequence
  Synthetic
gaaagagacgcccttggacttcacagagtacgcgggtgccatcaagacgattacgtcggctttgcagtttggtat

SEQ ID NO: 177573 - DNA, 75 bp, Artificial Sequence
  Synthetic
ggcacgctccacccgtctttattttaaagacgctgggcgatcccgtctactctgagaggggcctcaaaaaggccg

SEQ ID NO: 177574 - DNA, 75 bp, Artificial Sequence
  Synthetic
aaagacgctgggcgatcccgtctactctgagaggggcctcaaaaaggccgtcaagtctgacatggtatccatgtt

SEQ ID NO: 177575 - DNA, 75 bp, Artificial Sequence
  Synthetic
tgacaagggggaagcagtatgtcctaaccatgctctccgacatgctggccgcggtgtgcgaggataccgtcttta

SEQ ID NO: 177576 - DNA, 75 bp, Artificial Sequence
  Synthetic
aaccatgctctccgacatgctggccgcggtgtgcgaggataccgtctttaagggtgtcagcacgtacaccacggc

SEQ ID NO: 177577 - DNA, 75 bp, Artificial Sequence
  Synthetic
gacggctgatgaacctgctggggcaagtggaaagtgccatgtccgggcccgcggcctacgccagctacgttgtca

SEQ ID NO: 177578 - DNA, 75 bp, Artificial Sequence
  Synthetic
gcggcctacgccagctacgttgtcaggggtgccaacctcgtcaccgccgttagctacggaagggcgatgagaaac

SEQ ID NO: 177579 - DNA, 75 bp, Artificial Sequence
  Synthetic
tgtggaaggtgacaaggccgctctggcggacggacacgacgagattcagagaacccgcatcgccgcctctctcgt

SEQ ID NO: 177580 - DNA, 75 bp, Artificial Sequence
  Synthetic
gcggacggacacgacgagattcagagaacccgcatcgccgcctctctcgtcaagataggggataagtttgtggcc

SEQ ID NO: 177581 - DNA, 75 bp, Artificial Sequence
  Synthetic
gaaccggcgcatccagtacacctatttcttccctgttggccttcaccttcccgtgccccgctactcgacatccgt

SEQ ID NO: 177582 - DNA, 75 bp, Artificial Sequence
  Synthetic
ccgtgccccgctactcgacatccgtctcagtcaggggcgtagaatccccggccatccagtcgaccgagacgtggg

SEQ ID NO: 177583 - DNA, 75 bp, Artificial Sequence
  Synthetic
aaaagcatatgccaccctcgaatgcacaaccccacccagtcagcccaggcactaaaccaagcttttcccgatccc

SEQ ID NO: 177584 - DNA, 75 bp, Artificial Sequence
  Synthetic
gacgggggacatgggtacggtctcaggtatgagcagacgccaaacatgaacctattcagaacgttccaccagtat

SEQ ID NO: 177585 - DNA, 75 bp, Artificial Sequence
  Synthetic
cgtaaccacggaggatctactgcacccaacctctcaccgtctcctcagattggaggtccaccccttctttgattt

SEQ ID NO: 177586 - DNA, 75 bp, Artificial Sequence
  Synthetic
ttttgtgcacccctgtcctggagcgagaggatcgtaccgcgccacccacagaacaatggttggaaatataccaca

SEQ ID NO: 177587 - DNA, 75 bp, Artificial Sequence
  Synthetic
ctgtgacgaatatgacacacgtcatagaccagctaactattgacgtcatacaggagacggcatttgaccccgcgt

SEQ ID NO: 177588 - DNA, 75 bp, Artificial Sequence
  Synthetic
agaccagctaactattgacgtcatacaggagacggcatttgaccccgcgtatcccctgttctgctatgtaatcga

SEQ ID NO: 177589 - DNA, 75 bp, Artificial Sequence
  Synthetic
ttgccctggtcattcaaacctactgggtcaactcgggaaaactggcgtttgtgaacagttatcacatggttagat

SEQ ID NO: 177590 - DNA, 75 bp, Artificial Sequence
  Synthetic
ggtcaactcgggaaaactggcgtttgtgaacagttatcacatggttagattcatctgtacgcatatggggaatgg

SEQ ID NO: 177591 - DNA, 75 bp, Artificial Sequence
  Synthetic
tcatcgcccttgagcaggcgcttctcaagctcgcgggacacgagacggtgggtcggacgccgatcacacatctgg

SEQ ID NO: 177592 - DNA, 75 bp, Artificial Sequence
  Synthetic
caagctcgcgggacacgagacggtgggtcggacgccgatcacacatctggtttcggctctcctcgacccgcatct

SEQ ID NO: 177593 - DNA, 75 bp, Artificial Sequence
  Synthetic
catccagacaacccataatcaagatcggggatcaaaactacgacaaccctcaaaatagggcgacattcatcaacc

SEQ ID NO: 177594 - DNA, 75 bp, Artificial Sequence
  Synthetic
caataaccttgttaacatttaccagacaagggtcaatgaggaccatgacgagagacacgtcctggacgtggcgcc

SEQ ID NO: 177595 - DNA, 75 bp, Artificial Sequence
  Synthetic
agagacacgtcctggacgtggcgcccctggacgagaatgactacaacccggtcctcgagaagctattctactatg

SEQ ID NO: 177596 - DNA, 75 bp, Artificial Sequence
  Synthetic
cctggacgagaatgactacaacccggtcctcgagaagctattctactatgttttaatgccggtgtgcagtaacgg

SEQ ID NO: 177597 - DNA, 75 bp, Artificial Sequence
  Synthetic
cttacaacggccccgtctttgcggacgtcgtgaacgcacaggatgatattctactgcacctggagaacggaacct

SEQ ID NO: 177598 - DNA, 75 bp, Artificial Sequence
  Synthetic
cgtcgtgaacgcacaggatgatattctactgcacctggagaacggaaccttgaaggacattctgcaggcaggcga

SEQ ID NO: 177599 - DNA, 75 bp, Artificial Sequence
  Synthetic
cgtgccctttcgtcacccaggccgctcgcgtgatcacaaagcgggacccggcccagagttttgccacgcacgaat

SEQ ID NO: 177600 - DNA, 75 bp, Artificial Sequence
  Synthetic
tcgcgtgatcacaaagcgggacccggcccagagttttgccacgcacgaatacgggaaggatgtggcgcagaccgt

SEQ ID NO: 177601 - DNA, 75 bp, Artificial Sequence
  Synthetic
cggcggagactatgttttatccggtaccctttaacaagctctacgctgacccgttggtggctgccacactgcatc

SEQ ID NO: 177602 - DNA, 75 bp, Artificial Sequence
  Synthetic
ccgttggtggctgccacactgcatccgctcctggcaaactatgtcaccaggctccccaaccagagaaacgcggtg

SEQ ID NO: 177603 - DNA, 75 bp, Artificial Sequence
  Synthetic
gtcgcccgtcgcggcgtatgccgcgtcttgtcaggccaccccgggcgccattagcgccatggtgagcatgcacca

SEQ ID NO: 177604 - DNA, 75 bp, Artificial Sequence
  Synthetic
tcttgtcaggccaccccgggcgccattagcgccatggtgagcatgcaccaaaaactatctgcccccagtttcatt

SEQ ID NO: 177605 - DNA, 75 bp, Artificial Sequence
  Synthetic
gacggacgaggttctagcagagcacatcctatactgctccagggcgtcgacatccatgtttgtgggcttgccttc

SEQ ID NO: 177606 - DNA, 75 bp, Artificial Sequence
  Synthetic
catccatgtttgtgggcttgccttcggtggtacggcgcgaggtacgttcggacgcggtgacttttgaaattaccc

SEQ ID NO: 177607 - DNA, 75 bp, Artificial Sequence
  Synthetic
ccggcccacgtggccgccataactacagacatgggagtacattgtcaggacctctttatgattttcccaggggac

SEQ ID NO: 177608 - DNA, 75 bp, Artificial Sequence
  Synthetic
cctctttatgattttcccaggggacgcgtatcaggaccgccagctgcatgactatatcaaaatgaaagcgggcgt

SEQ ID NO: 177609 - DNA, 75 bp, Artificial Sequence
  Synthetic
gggttcctcgctgcgagaacctgcccggtttgagtcatggtcagctggcaacctgcgagataattcccacgccgg

SEQ ID NO: 177610 - DNA, 75 bp, Artificial Sequence
  Synthetic
cggtttgagtcatggtcagctggcaacctgcgagataattcccacgccggtcacatctgacgttgcctatttcca

SEQ ID NO: 177611 - DNA, 75 bp, Artificial Sequence
  Synthetic
cttacagtaacgaaagcgcagagcgtttgctctacgaccattcaataccagaccccgcgtacgaatgccggtcca

SEQ ID NO: 177612 - DNA, 75 bp, Artificial Sequence
  Synthetic
tttgctctacgaccattcaataccagaccccgcgtacgaatgccggtccaccaacaacccgtgggcttcgcagcg

SEQ ID NO: 177613 - DNA, 75 bp, Artificial Sequence
  Synthetic
tgccgggcatgtacagtccttgtcggcagttcttccacaaggaagacattatgcggtacaatagggggttgtaca

SEQ ID NO: 177614 - DNA, 75 bp, Artificial Sequence
  Synthetic
tcaacggtacagacgtgtttttggaccagccttgccatatgctgcaggaggcctatcccacgctcgccgccagcc

SEQ ID NO: 177615 - DNA, 75 bp, Artificial Sequence
  Synthetic
gtcaaacaagcagacacacgccccagtacacatgggccagtatctcattgaagaggtggcgccgatgaagagact

SEQ ID NO: 177616 - DNA, 75 bp, Artificial Sequence
  Synthetic
aagaggtggcgccgatgaagagactattaaagctcggaaacaaggtggtgtattagctaacccttctagcgttgg

SEQ ID NO: 177617 - DNA, 75 bp, Artificial Sequence
  Synthetic
attaaagctcggaaacaaggtggtgtattagctaacccttctagcgttggctagtcatggcactcgacaagagta

SEQ ID NO: 177618 - DNA, 75 bp, Artificial Sequence
  Synthetic
cagtcaaaaatagggagcgtactgccgctcggagattgccaccgtttacaaaatatacaggcattgggcctgggg

SEQ ID NO: 177619 - DNA, 75 bp, Artificial Sequence
  Synthetic
cgctcggagattgccaccgtttacaaaatatacaggcattgggcctggggtgcgtatgctcacgtgagacatctc

SEQ ID NO: 177620 - DNA, 75 bp, Artificial Sequence
  Synthetic
ctggaggaggttcgcccggacagcctgcgcctaacgcggatggatccctctgacaaccttcagataaaaaacgta

SEQ ID NO: 177621 - DNA, 75 bp, Artificial Sequence
  Synthetic
tgcgcctaacgcggatggatccctctgacaaccttcagataaaaaacgtatatgcccccttttttcagtgggaca

SEQ ID NO: 177622 - DNA, 75 bp, Artificial Sequence
  Synthetic
accattgtgctcgaatccaacggatttgacctcgtgttccccatggtcgtgccgcagcaactggggcacgctatt

SEQ ID NO: 177623 - DNA, 75 bp, Artificial Sequence
  Synthetic
ttgacctcgtgttccccatggtcgtgccgcagcaactggggcacgctattctgcagcagctgttggtgtaccaca

SEQ ID NO: 177624 - DNA, 75 bp, Artificial Sequence
  Synthetic
cttgatctatataccaccaatgtgtcatttatggggcgcacatatcgtctggacgtagacaacacggatccacgt

SEQ ID NO: 177625 - DNA, 75 bp, Artificial Sequence
  Synthetic
catttatggggcgcacatatcgtctggacgtagacaacacggatccacgtactgccctgcgagtgcttgacgatc

SEQ ID NO: 177626 - DNA, 75 bp, Artificial Sequence
  Synthetic
cgtctgctcacggcgctcgtgcggcacgacaggcatcctctgacagaggtgtttgagggggtggtgccagatgag

SEQ ID NO: 177627 - DNA, 75 bp, Artificial Sequence
  Synthetic
acgacaggcatcctctgacagaggtgtttgagggggtggtgccagatgaggtgaccaggatagatctcgaccagt

SEQ ID NO: 177628 - DNA, 75 bp, Artificial Sequence
  Synthetic
cagagtctcagttctatatttaatcttggccccagactgcacgtgtatgcctactcggcagagactttggcggcc

SEQ ID NO: 177629 - DNA, 75 bp, Artificial Sequence
  Synthetic
ttggccccagactgcacgtgtatgcctactcggcagagactttggcggcctcctgttggtattccccacgctaac

SEQ ID NO: 177630 - DNA, 75 bp, Artificial Sequence
  Synthetic
caaggacggatgacggctccgtctgtgaagtctccctgcgtggaggtaggaaaaaaactaccgtctacctgccgg

SEQ ID NO: 177631 - DNA, 75 bp, Artificial Sequence
  Synthetic
tgaagtctccctgcgtggaggtaggaaaaaaactaccgtctacctgccggacactgaaccctgggtggtagagac

SEQ ID NO: 177632 - DNA, 75 bp, Artificial Sequence
  Synthetic
gaaagcttcatcgtggtgccctgccctcaaattctcacaacggcttgaggatggtgcttttttgttattgttact

SEQ ID NO: 177633 - DNA, 75 bp, Artificial Sequence
  Synthetic
ctcaaattctcacaacggcttgaggatggtgcttttttgttattgttacttgcaaaattgtgtgtacctagccct

SEQ ID NO: 177634 - DNA, 75 bp, Artificial Sequence
  Synthetic
ttgccgagcccgttgtggcacctgaggtgctcttcccacacccggctgagatgtctcgcggttgcgatgacgcga

SEQ ID NO: 177635 - DNA, 75 bp, Artificial Sequence
  Synthetic
ggtgctcttcccacacccggctgagatgtctcgcggttgcgatgacgcgattttctgtaaactgccctataccgt

SEQ ID NO: 177636 - DNA, 75 bp, Artificial Sequence
  Synthetic
agccggacggcaggcctacggattactccatggcccttagaagggcttttgcagttatggttaacacgtcatgtg

SEQ ID NO: 177637 - DNA, 75 bp, Artificial Sequence
  Synthetic
ctccatggcccttagaagggcttttgcagttatggttaacacgtcatgtgcaggagtgacattgtgccgcggaga

SEQ ID NO: 177638 - DNA, 75 bp, Artificial Sequence
  Synthetic
tgttttctgtgattatctatgccttagatcacaactgtcacccggaagcactgtctatcgcgagcggcatctttg

SEQ ID NO: 177639 - DNA, 75 bp, Artificial Sequence
  Synthetic
agatcacaactgtcacccggaagcactgtctatcgcgagcggcatctttgacgagcgtgactatggattattcat

SEQ ID NO: 177640 - DNA, 75 bp, Artificial Sequence
  Synthetic
aagatatctacaacgggacttacctagctcggcctggaaactgtgacccctggcccaatctatccacccctccct

SEQ ID NO: 177641 - DNA, 75 bp, Artificial Sequence
  Synthetic
agctcggcctggaaactgtgacccctggcccaatctatccacccctcccttgattctaaattttaaataaaggtg

SEQ ID NO: 177642 - DNA, 75 bp, Artificial Sequence
  Synthetic
accgctaagggattataccgggatttaaaaccgcccactgatttttttacgctaagagttgggtgcttggggggt

SEQ ID NO: 177643 - DNA, 75 bp, Artificial Sequence
  Synthetic
taaaaccgcccactgatttttttacgctaagagttgggtgcttggggggttttgcattgctctgttgtaaactat

SEQ ID NO: 177644 - DNA, 75 bp, Artificial Sequence
  Synthetic
ctcagttgagagtcagagaatacagtgctaatcagggtagatgagcatgacttccccgtctccagtcaccggagg

SEQ ID NO: 177645 - DNA, 75 bp, Artificial Sequence
  Synthetic
tgctaatcagggtagatgagcatgacttccccgtctccagtcaccggaggaatggtggacggctccgtcctggtg

SEQ ID NO: 177646 - DNA, 75 bp, Artificial Sequence
  Synthetic
cctagtcataggcgcctgcgtctactgctgcattcgcgtgttcctggcggctcgactgtggcgcgccaccccact

SEQ ID NO: 177647 - DNA, 75 bp, Artificial Sequence
  Synthetic
tgctgcattcgcgtgttcctggcggctcgactgtggcgcgccaccccactaggcagggccaccgtggcgtatcag

SEQ ID NO: 177648 - DNA, 75 bp, Artificial Sequence
  Synthetic
gggcatagctacccaggagccctaccgtacaatatacatgccagattagaacggggtgtgtgctataatggatgg

SEQ ID NO: 177649 - DNA, 75 bp, Artificial Sequence
  Synthetic
gcgctgtgcttttattgtggggatatgggcttgtacatgtgtctatcatcggtagccataaaatgggccatgaca

SEQ ID NO: 177650 - DNA, 75 bp, Artificial Sequence
  Synthetic
ggtagccataaaatgggccatgacaactgccacaagtaagtcgtccgacatgtgcttttgcttggcgctgtatga

SEQ ID NO: 177651 - DNA, 75 bp, Artificial Sequence
  Synthetic
actgccacaagtaagtcgtccgacatgtgcttttgcttggcgctgtatgactgccctccatccctaagcgggacg

SEQ ID NO: 177652 - DNA, 75 bp, Artificial Sequence
  Synthetic
tattttgatggtgttggacaccaccgtctggctggcgctcagggtgccggagttcagagcgtagatgaatgtctc

SEQ ID NO: 177653 - DNA, 75 bp, Artificial Sequence
  Synthetic
ccccagaatcttggctgctgttgccttcgaccgccgcgttcacgcgctcaattgtggggtggagcacagcgatcg

SEQ ID NO: 177654 - DNA, 75 bp, Artificial Sequence
  Synthetic
cgctatctcgtaagcagctgcgccagtgaggtcgcgcaggaagaaatgctccatgcccaatatgaggcttctggt

SEQ ID NO: 177655 - DNA, 75 bp, Artificial Sequence
  Synthetic
ccatgcccaatatgaggcttctggtgggagtctgagtactcgtgacaacggcgcccacgccagtaccggacgcct

SEQ ID NO: 177656 - DNA, 75 bp, Artificial Sequence
  Synthetic
gggagtctgagtactcgtgacaacggcgcccacgccagtaccggacgcctccgtgttgttcgtatacgcggggtc

SEQ ID NO: 177657 - DNA, 75 bp, Artificial Sequence
  Synthetic
tggtgtctacccgacacatgtcaaactgtgtcagcgctgcgtcacccaccacgcggtaaagcgtagcatttgacg

SEQ ID NO: 177658 - DNA, 75 bp, Artificial Sequence
  Synthetic
ctgtgtcagcgctgcgtcacccaccacgcggtaaagcgtagcatttgacgacgctgctccctcgcccattagttc

SEQ ID NO: 177659 - DNA, 75 bp, Artificial Sequence
  Synthetic
cgtcgatggtgatgtacgtcggaatgtgcagtctgtaacaaggacaggacactagtgcgtcttgcaggtggaaat

SEQ ID NO: 177660 - DNA, 75 bp, Artificial Sequence
  Synthetic
gtgcagtctgtaacaaggacaggacactagtgcgtcttgcaggtggaaatcttcgcggtggtccgcacacacgta

SEQ ID NO: 177661 - DNA, 75 bp, Artificial Sequence
  Synthetic
aactcgtggagcggtctgacgagttcacggatgatataaatatcagcttggcgtctttctgaagcatgaaaccca

SEQ ID NO: 177662 - DNA, 75 bp, Artificial Sequence
  Synthetic
cacggatgatataaatatcagcttggcgtctttctgaagcatgaaacccagaatagccggcagtgcatccttttt

SEQ ID NO: 177663 - DNA, 75 bp, Artificial Sequence
  Synthetic
tgctctgcagacacggaaagacacaaaagaggggctcataagcggctaacagtaaaggagaggaggcgaacagtg

SEQ ID NO: 177664 - DNA, 75 bp, Artificial Sequence
  Synthetic
aaagaggggctcataagcggctaacagtaaaggagaggaggcgaacagtgcgtggctcttgttcttgggaataaa

SEQ ID NO: 177665 - DNA, 75 bp, Artificial Sequence
  Synthetic
tggtgaatgagaaagattttgaggagtgtgaacaatttttcagtcaaccccttagggagcaagtggtcgcggggg

SEQ ID NO: 177666 - DNA, 75 bp, Artificial Sequence
  Synthetic
gtgtgaacaatttttcagtcaaccccttagggagcaagtggtcgcgggggtcagggcactcgacggcctcggtct

SEQ ID NO: 177667 - DNA, 75 bp, Artificial Sequence
  Synthetic
tggtgggcacggagtgctttgcgagggtgtgccgcctagacaccggtgcgaaatgaagagtgtggcgagtccctt

SEQ ID NO: 177668 - DNA, 75 bp, Artificial Sequence
  Synthetic
ggtgtgccgcctagacaccggtgcgaaatgaagagtgtggcgagtcccttatgtcagttccacggcgtgttttgc

SEQ ID NO: 177669 - DNA, 75 bp, Artificial Sequence
  Synthetic
cgaatgcgttctcctgcatacgccggagagcgtcatctgcgaactaacgggtaactgcatgctcggcaacattca

SEQ ID NO: 177670 - DNA, 75 bp, Artificial Sequence
  Synthetic
gagagcgtcatctgcgaactaacgggtaactgcatgctcggcaacattcaagagggccagtttttagggccggta

SEQ ID NO: 177671 - DNA, 75 bp, Artificial Sequence
  Synthetic
gctagcgtgtctgaaacgggacattgtgcggtatttgcagacatggccggacaccaccgtaatcgtgcaggaaat

SEQ ID NO: 177672 - DNA, 75 bp, Artificial Sequence
  Synthetic
gtgcggtatttgcagacatggccggacaccaccgtaatcgtgcaggaaatagccctgggggacggcgtcaccgac

SEQ ID NO: 177673 - DNA, 75 bp, Artificial Sequence
  Synthetic
gggggaggcccaaggcgggtacgccctggtctgtagcatgtatctgcacgttatcgtctccatctattcgacaaa

SEQ ID NO: 177674 - DNA, 75 bp, Artificial Sequence
  Synthetic
gccgggttcctggggtgcgccgcgccgggttcctggggtgcgccgcgccgggttcctggggtgcgccgcgccggg

SEQ ID NO: 177675 - DNA, 75 bp, Artificial Sequence
  Synthetic
ctggtctgtagcatgtatctgcacgttatcgtctccatctattcgacaaaaacggtgtacaacagtatgctattt

SEQ ID NO: 177676 - DNA, 75 bp, Artificial Sequence
  Synthetic
aaaatggatgcgcatgctatcaacgaaagatacgtaggtcctcgctgccaccgtttggcccacgtggtgctgcct

SEQ ID NO: 177677 - DNA, 75 bp, Artificial Sequence
  Synthetic
aaagatacgtaggtcctcgctgccaccgtttggcccacgtggtgctgcctaggacctttctgctgcatcacgcca

SEQ ID NO: 177678 - DNA, 75 bp, Artificial Sequence
  Synthetic
tcgccagggtcatcccgccggttggtggtgtgtgggaaacgtgtcctgccaggggaggaaaaccaacttgcgtct

SEQ ID NO: 177679 - DNA, 75 bp, Artificial Sequence
  Synthetic
tggtgtgtgggaaacgtgtcctgccaggggaggaaaaccaacttgcgtcttcaccttctggcttggcgcttagcc

SEQ ID NO: 177680 - DNA, 75 bp, Artificial Sequence
  Synthetic
ggttcctggggtgccaccgctcctcgatacgtgtaaatccaagagatccgtcctccgtgccgccgcgcgcgtaat

SEQ ID NO: 177681 - DNA, 75 bp, Artificial Sequence
  Synthetic
ctgcgcatttcctgccctggttctaatcttagtcttactgtcagatttctctatctatctctggtggtggctatg

SEQ ID NO: 177682 - DNA, 75 bp, Artificial Sequence
  Synthetic
ggggcgggacggaataatgcgcggagtccgaccgttgacggggtatcgccgccagagggcgccgtagcccaccct

SEQ ID NO: 177683 - DNA, 75 bp, Artificial Sequence
  Synthetic
ccgtggaccgttgcaggtcctgaccggccttctccgcgcagggtcagacggagaccgcgccactcaccacatggc

SEQ ID NO: 177684 - DNA, 75 bp, Artificial Sequence
  Synthetic
ggagaaagcctagacccgcctgtttcacagaaggggccagcgcgcacacgccacaggccaccccccgtgcgactg

SEQ ID NO: 177685 - DNA, 75 bp, Artificial Sequence
  Synthetic
ccacaggccaccccccgtgcgactgagcttcaaccccgtcaatgccgatgtacccgctacctggcgagacgccac

SEQ ID NO: 177686 - DNA, 75 bp, Artificial Sequence
  Synthetic
taacgtgtactcgggtgctccctactatgtgtgtgtttacgaacgcggtggccgtcaggaagacgactggctgcc

SEQ ID NO: 177687 - DNA, 75 bp, Artificial Sequence
  Synthetic
tgttcatggacgacttgttcattaacacgaagcagtgcgactttgtggacacgctagaggccgcctgtcgcacgc

SEQ ID NO: 177688 - DNA, 75 bp, Artificial Sequence
  Synthetic
acgctagaggccgcctgtcgcacgcaaggctacacgttgagacagcgcgtgcctgtcgccattcctcgcgacgcg

SEQ ID NO: 177689 - DNA, 75 bp, Artificial Sequence
  Synthetic
acgggggctggcttcggaggctagtgcctggataagagctgccacgtccccgccccttggccgccacgcctgctg

SEQ ID NO: 177690 - DNA, 75 bp, Artificial Sequence
  Synthetic
gcctggataagagctgccacgtccccgccccttggccgccacgcctgctggatggacgtgttaggattatgggaa

SEQ ID NO: 177691 - DNA, 75 bp, Artificial Sequence
  Synthetic
cacggacggtgactggttagagattttaaaacagcccgatgtgcaaaagacagtcagcgggagtcttgtggcatg

SEQ ID NO: 177692 - DNA, 75 bp, Artificial Sequence
  Synthetic
ttaaaacagcccgatgtgcaaaagacagtcagcgggagtcttgtggcatgcgtgatcgtcacacccgcattggaa

SEQ ID NO: 177693 - DNA, 75 bp, Artificial Sequence
  Synthetic
aatttttcgagtcgctcacggtcccacctagcggcgtgacctggaggtgaccccgtgcacccgggcgctctgaat

SEQ ID NO: 177694 - DNA, 75 bp, Artificial Sequence
  Synthetic
gtcgaaggaggatctggtgttcattcgaggccgctatggctagccggaggcgcaaacttcggaatttcctaaaca

SEQ ID NO: 177695 - DNA, 75 bp, Artificial Sequence
  Synthetic
cgaggccgctatggctagccggaggcgcaaacttcggaatttcctaaacaaggaatgcatatggactgttaaccc

SEQ ID NO: 177696 - DNA, 75 bp, Artificial Sequence
  Synthetic
aaaaagtgagcaccagggggcggggtttctaacgtgcgacttagaacccccgccaatggtcgacagcccgcggga

SEQ ID NO: 177697 - DNA, 75 bp, Artificial Sequence
  Synthetic
cggtgtatgaccctgagctggtaaccagctacgcactgagcgtgcctgcttacaatgtgtctgtggctatcttgc

SEQ ID NO: 177698 - DNA, 75 bp, Artificial Sequence
  Synthetic
ggctgtgggaattaacggagaaatgatcatgtacgtcgtaagccagtgtgtttctgtgcggcccgtcccggggcg

SEQ ID NO: 177699 - DNA, 75 bp, Artificial Sequence
  Synthetic
gactgagatttccctacattgctccgccgccgtcgcgcgaacacgtacctgacctgaccagacaagaattagttc

SEQ ID NO: 177700 - DNA, 75 bp, Artificial Sequence
  Synthetic
gccgccgtcgcgcgaacacgtacctgacctgaccagacaagaattagttcatacctcccaggtggtgcgccgcgg

SEQ ID NO: 177701 - DNA, 75 bp, Artificial Sequence
  Synthetic
ttgtttggctcgggggcggatcggtgtggctgctgttcttgggcgtggactacatggcgttctgtccgggtgtcg

SEQ ID NO: 177702 - DNA, 75 bp, Artificial Sequence
  Synthetic
gtggctgctgttcttgggcgtggactacatggcgttctgtccgggtgtcgacggaatgccgtcgttggcaagagt

SEQ ID NO: 177703 - DNA, 75 bp, Artificial Sequence
  Synthetic
gactccgtggacacgttaatgtatttcgtgggtactgttctgcgcagtcgccgggtctatctaacatctgtccct

SEQ ID NO: 177704 - DNA, 75 bp, Artificial Sequence
  Synthetic
tcgtgggtactgttctgcgcagtcgccgggtctatctaacatctgtccctgtatcaaatcatgtgggaccgggaa

SEQ ID NO: 177705 - DNA, 75 bp, Artificial Sequence
  Synthetic
atcccattgtccagagcagggtaacagctctgaagataactagccacccaacccccacgcacgtcgagaatgtgc

SEQ ID NO: 177706 - DNA, 75 bp, Artificial Sequence
  Synthetic
agctctgaagataactagccacccaacccccacgcacgtcgagaatgtgctaacaggagtgctcgacgacggcac

SEQ ID NO: 177707 - DNA, 75 bp, Artificial Sequence
  Synthetic
acttcagccgcttgctgatatatgagtgtaaaaaacttaaggccctgggcttacgttcttattgaagcatgttgc

SEQ ID NO: 177708 - DNA, 75 bp, Artificial Sequence
  Synthetic
gtgtaaaaaacttaaggccctgggcttacgttcttattgaagcatgttgcgcacatcagcgagctggaccgtcct

SEQ ID NO: 177709 - DNA, 75 bp, Artificial Sequence
  Synthetic
tttgggggggaaccaccgacaaagcgtctttatgatttccgcgaacacggagttggctacgtgcttttggtgggc

SEQ ID NO: 177710 - DNA, 75 bp, Artificial Sequence
  Synthetic
gtctttatgatttccgcgaacacggagttggctacgtgcttttggtgggctacgtacccaatgttaatgttctct

SEQ ID NO: 177711 - DNA, 75 bp, Artificial Sequence
  Synthetic
gtgtctccttggtattaggaatacgcttgccttttgcttaaacgtctgtaaaacactgtttggagtttcaaataa

SEQ ID NO: 177712 - DNA, 75 bp, Artificial Sequence
  Synthetic
cttgccttttgcttaaacgtctgtaaaacactgtttggagtttcaaataaaccgaagtactgcttaaacaatcca

SEQ ID NO: 177713 - DNA, 75 bp, Artificial Sequence
  Synthetic
agtgtgcattactagctgctgttggaagggctccagccagtgcaccccgggaacgtaacagccgttcagaaagga

SEQ ID NO: 177714 - DNA, 75 bp, Artificial Sequence
  Synthetic
aagggctccagccagtgcaccccgggaacgtaacagccgttcagaaaggacgaaaggttaaccagaaaagcctga

SEQ ID NO: 177715 - DNA, 75 bp, Artificial Sequence
  Synthetic
cgcctggtactcgaccagttgatcggccgtggagacgtgcgcgtcctcgcgcacacaccgcatctgcaagtatgt

SEQ ID NO: 177716 - DNA, 75 bp, Artificial Sequence
  Synthetic
gccgtggagacgtgcgcgtcctcgcgcacacaccgcatctgcaagtatgttgatagggactccaataggcgcggc

SEQ ID NO: 177717 - DNA, 75 bp, Artificial Sequence
  Synthetic
actgcccggttccaccaggcggcgttgtggccacgggcggttcgtcgcttggacctggaggggtgtcacattctg

SEQ ID NO: 177718 - DNA, 75 bp, Artificial Sequence
  Synthetic
tgctgacgtgggcgtggcgggatggtgccgtgtgcagtatgtttccaggaccgaactgtatgagtttattctgtg

SEQ ID NO: 177719 - DNA, 75 bp, Artificial Sequence
  Synthetic
tgccgtgtgcagtatgtttccaggaccgaactgtatgagtttattctgtgcaccacgccaataaaagggtgcgcc

SEQ ID NO: 177720 - DNA, 75 bp, Artificial Sequence
  Synthetic
ccacctctctccggcgtctttggcggtctcctgcaggttggcggcaaggcgctccctgtgacggctgagcagcat

SEQ ID NO: 177721 - DNA, 75 bp, Artificial Sequence
  Synthetic
gtctcctgcaggttggcggcaaggcgctccctgtgacggctgagcagcatgtttgctttgagctcgctcgtgtcc

SEQ ID NO: 177722 - DNA, 75 bp, Artificial Sequence
  Synthetic
cctggaccttagcgagaacacacctggacaatttaagttgatagaaactcccctgaacagcttcctcttggtttc

SEQ ID NO: 177723 - DNA, 75 bp, Artificial Sequence
  Synthetic
ggacaatttaagttgatagaaactcccctgaacagcttcctcttggtttccaacgtgatgcccgaggtccagcca

SEQ ID NO: 177724 - DNA, 75 bp, Artificial Sequence
  Synthetic
gcctagactggagaagctccagagagtcctcgggcagggtttcggggcggcgggtgaggaaatcgcactggaccc

SEQ ID NO: 177725 - DNA, 75 bp, Artificial Sequence
  Synthetic
gtcctcgggcagggtttcggggcggcgggtgaggaaatcgcactggacccgtctcacgtagaaacacacgaaaag

SEQ ID NO: 177726 - DNA, 75 bp, Artificial Sequence
  Synthetic
ccttttcgagaagccagcgctctacaggctatggacaggatactaacacacgtggtcctagaatacggtctggtt

SEQ ID NO: 177727 - DNA, 75 bp, Artificial Sequence
  Synthetic
gactctgaataaggatgcgctccttcgggaggctgtagatggcctgtgtgaccccggaacttggaagggtcttct

SEQ ID NO: 177728 - DNA, 75 bp, Artificial Sequence
  Synthetic
cgggaggctgtagatggcctgtgtgaccccggaacttggaagggtcttcttcctgacgacccccttccgttgcta

SEQ ID NO: 177729 - DNA, 75 bp, Artificial Sequence
  Synthetic
gtacaagcagcactgcggttacccgggcccggtgctacttccaggtcacatgtacgctcccaaacgggatctttt

SEQ ID NO: 177730 - DNA, 75 bp, Artificial Sequence
  Synthetic
ggcccggtgctacttccaggtcacatgtacgctcccaaacgggatcttttgtcgttcgttaatcatgccctgaag

SEQ ID NO: 177731 - DNA, 75 bp, Artificial Sequence
  Synthetic
ccgcccgccattcgctacttctcggatacaaagggtagtgagtcagatgaaaatcatagatgcttccgacactta

SEQ ID NO: 177732 - DNA, 75 bp, Artificial Sequence
  Synthetic
atacaaagggtagtgagtcagatgaaaatcatagatgcttccgacacttacatttcccacacctgcctcttgtgt

SEQ ID NO: 177733 - DNA, 75 bp, Artificial Sequence
  Synthetic
tggaatcctactgttgagtggaaaagggacccagtatataacaggcaatgttcagacccaaaggtgtccaactac

SEQ ID NO: 177734 - DNA, 75 bp, Artificial Sequence
  Synthetic
gggacccagtatataacaggcaatgttcagacccaaaggtgtccaactacgggcgactatctaatcatcccatcg

SEQ ID NO: 177735 - DNA, 75 bp, Artificial Sequence
  Synthetic
actctaaaagagagtttattaagtcggctctggaggccaacatcaacaggagggcagctgtatcgctatttgatc

SEQ ID NO: 177736 - DNA, 75 bp, Artificial Sequence
  Synthetic
ggctctggaggccaacatcaacaggagggcagctgtatcgctatttgatcgttttgggggtagcagcgccgtgtt

SEQ ID NO: 177737 - DNA, 75 bp, Artificial Sequence
  Synthetic
tgaagcgcgaagccgagctcgggactctggtacgcaaggcgggccagaggtttgaggcgctgaaaagggaacggt

SEQ ID NO: 177738 - DNA, 75 bp, Artificial Sequence
  Synthetic
tctggtacgcaaggcgggccagaggtttgaggcgctgaaaagggaacggtcaattttgcgccagccgcgcgacct

SEQ ID NO: 177739 - DNA, 75 bp, Artificial Sequence
  Synthetic
aagaagaggtggccgtgcgcctagatgcgctggaagagaatggagaggagacccccactcactcctcttcggaga

SEQ ID NO: 177740 - DNA, 75 bp, Artificial Sequence
  Synthetic
tgcgctggaagagaatggagaggagacccccactcactcctcttcggagatcaaggacacaatcgtcaggtggag

SEQ ID NO: 177741 - DNA, 75 bp, Artificial Sequence
  Synthetic
atttcagagagaccctgggcgtccacatggcagctgaatcagcatatacaggtgtccaagactaaaaaggccacc

SEQ ID NO: 177742 - DNA, 75 bp, Artificial Sequence
  Synthetic
catggcagctgaatcagcatatacaggtgtccaagactaaaaaggccaccgcgtatcttaaagcgccccgtgaat

SEQ ID NO: 177743 - DNA, 75 bp, Artificial Sequence
  Synthetic
cgccatccaaaacctggtatcctccgaatcatttatcaccgtgaccctacacggtacaaaccttggaaacctagt

SEQ ID NO: 177744 - DNA, 75 bp, Artificial Sequence
  Synthetic
ggcgcctttggcataatcgtccctatctccgaggatctgtgtgtgaagcagtttgatagccgccgggagtttttc

SEQ ID NO: 177745 - DNA, 75 bp, Artificial Sequence
  Synthetic
tctccgaggatctgtgtgtgaagcagtttgatagccgccgggagtttttctacgaggcaattgccaacgacctga

SEQ ID NO: 177746 - DNA, 75 bp, Artificial Sequence
  Synthetic
ctaggattcgtgcagccttgcataccctgtagatcgattgtgtatcctagaatgaagtgcaacctgctgcagctg

SEQ ID NO: 177747 - DNA, 75 bp, Artificial Sequence
  Synthetic
cctgtagatcgattgtgtatcctagaatgaagtgcaacctgctgcagctggactggagtcaggtcaacctgagtg

SEQ ID NO: 177748 - DNA, 75 bp, Artificial Sequence
  Synthetic
agatactgtggcatggtgcactgcgacgttagtccagacaatattttggccacaggagacctaacgcccatgaac

SEQ ID NO: 177749 - DNA, 75 bp, Artificial Sequence
  Synthetic
acgttagtccagacaatattttggccacaggagacctaacgcccatgaaccccgggaggctggtccttaccgatt

SEQ ID NO: 177750 - DNA, 75 bp, Artificial Sequence
  Synthetic
acctctaacctggggtttaagcaacactgctacgacttcagggtgccacccaaactcatttgtaagcatctctat

SEQ ID NO: 177751 - DNA, 75 bp, Artificial Sequence
  Synthetic
actgctacgacttcagggtgccacccaaactcatttgtaagcatctctataagccgtcttgcgtcctcttccagt

SEQ ID NO: 177752 - DNA, 75 bp, Artificial Sequence
  Synthetic
taccctatcagccctaacatgggactgaccatcgacatgtcctcgttgggctacactctgctgacatgcctggaa

SEQ ID NO: 177753 - DNA, 75 bp, Artificial Sequence
  Synthetic
tgaccatcgacatgtcctcgttgggctacactctgctgacatgcctggaactctatctcgatctgccgctaaaca

SEQ ID NO: 177754 - DNA, 75 bp, Artificial Sequence
  Synthetic
atgtactacttgggcttcatgattcccagggtggtgatgactcagatcctgtccgctgtgtggaccatgacgctt

SEQ ID NO: 177755 - DNA, 75 bp, Artificial Sequence
  Synthetic
ccagggtggtgatgactcagatcctgtccgctgtgtggaccatgacgcttgacctgggactagattgcaccggca

SEQ ID NO: 177756 - DNA, 75 bp, Artificial Sequence
  Synthetic
cagtgctatttatataaagccaaccaaaaggcagagtcgttagcgaactgctccgataagctaaactgccccatg

SEQ ID NO: 177757 - DNA, 75 bp, Artificial Sequence
  Synthetic
aaaaggcagagtcgttagcgaactgctccgataagctaaactgccccatgttaaagtctctcgttagaaagctac

SEQ ID NO: 177758 - DNA, 75 bp, Artificial Sequence
  Synthetic
gttttctgaagactatctggttgacaccctggatgggttaacagtggatgaccaacaggctgtcctcgcaagctt

SEQ ID NO: 177759 - DNA, 75 bp, Artificial Sequence
  Synthetic
accctggatgggttaacagtggatgaccaacaggctgtcctcgcaagcttgagcttttcaaagtttctaaagcac

SEQ ID NO: 177760 - DNA, 75 bp, Artificial Sequence
  Synthetic
tgcgctgcgcatggcttacaactatttccttttttcaaaagtgggcgagtttattggtagtgaggatgtgtgtaa

SEQ ID NO: 177761 - DNA, 75 bp, Artificial Sequence
  Synthetic
cataaattatgtagatggggatcccctccaggtcacgccgctaggtgggaccgtgagcgactcgaaaaattataa

SEQ ID NO: 177762 - DNA, 75 bp, Artificial Sequence
  Synthetic
cataaattatgtagatggggttcccctccaggtcacgccgctaggtgggaccgtgagcgactcgaaaaattataa

SEQ ID NO: 177763 - DNA, 75 bp, Artificial Sequence
  Synthetic
cataaattatgtagatggggctcccctccaggtcacgccgctaggtgggaccgtgagcgactcgaaaaattataa

SEQ ID NO: 177764 - DNA, 75 bp, Artificial Sequence
  Synthetic
cataaattatgtagatgggggtcccctccaggtcacgccgctaggtgggaccgtgagcgactcgaaaaattataa

SEQ ID NO: 177765 - DNA, 75 bp, Artificial Sequence
  Synthetic
ttccttttttcaaaagtgggcgagtttattggtagtgaggatgtgtgtaactttttcgtggaccgtgtgtttggt

SEQ ID NO: 177766 - DNA, 75 bp, Artificial Sequence
  Synthetic
catgcgcgccgcagaggcccagagaaaagcatcgcgcgaggaaacccagcgcaaaatggcacacaccatcactca

SEQ ID NO: 177767 - DNA, 75 bp, Artificial Sequence
  Synthetic
gaacgcacatcagcggcaccacatctgctgtctagtggagagggccactagtagtcagagtctgaaccccgtgtg

SEQ ID NO: 177768 - DNA, 75 bp, Artificial Sequence
  Synthetic
tgctgtctagtggagagggccactagtagtcagagtctgaaccccgtgtgggacgccctgcgagacggaattata

SEQ ID NO: 177769 - DNA, 75 bp, Artificial Sequence
  Synthetic
agccgtcaatcaaattcggaggcctcccattggccccaatccctagaactcccaagctgattggcccacagcggg

SEQ ID NO: 177770 - DNA, 75 bp, Artificial Sequence
  Synthetic
gatattcagcccatggcctataacgaacaaccactttgtcgcgggcccgcttgcctttgggctgcggtgcgagga

SEQ ID NO: 177771 - DNA, 75 bp, Artificial Sequence
  Synthetic
aacaaccactttgtcgcgggcccgcttgcctttgggctgcggtgcgaggaggtggtgaaaacgttgctggccacc

SEQ ID NO: 177772 - DNA, 75 bp, Artificial Sequence
  Synthetic
tccgcaaaatggaatatttggcgtgtcgctggatttcgcggcgaacgtcaaaactgacaccgagggtcgtctaca

SEQ ID NO: 177773 - DNA, 75 bp, Artificial Sequence
  Synthetic
tcgctggatttcgcggcgaacgtcaaaactgacaccgagggtcgtctacagtttgaccctaactgtaaagtgtat

SEQ ID NO: 177774 - DNA, 75 bp, Artificial Sequence
  Synthetic
atcctgctgctcctgctcatcctgctgctgctcatcctgctgctgctcatcctgctgctgctcatcctgctgctg

SEQ ID NO: 177775 - DNA, 75 bp, Artificial Sequence
  Synthetic
catatacgccgcgtatcagcggctgtacgaggcacccggaaagctggcactgaaggacttcttctatagcatttc

SEQ ID NO: 177776 - DNA, 75 bp, Artificial Sequence
  Synthetic
tacgaggcacccggaaagctggcactgaaggacttcttctatagcatttccaagcctgcggttgagtacgtggga

SEQ ID NO: 177777 - DNA, 75 bp, Artificial Sequence
  Synthetic
ttattctttataatagggcccgatgagtcatggggttgggatttttctactaggtcgtttcggtggatgggtgcc

SEQ ID NO: 177778 - DNA, 75 bp, Artificial Sequence
  Synthetic
atgggaggcgtgtcctcgcaaaaagaggaaattaacgccccttcacaatcttattagggagtgtattttgcacaa

SEQ ID NO: 177779 - DNA, 75 bp, Artificial Sequence
  Synthetic
aggaaattaacgccccttcacaatcttattagggagtgtattttgcacaactcgaccacggagtctgacgtctac

SEQ ID NO: 177780 - DNA, 75 bp, Artificial Sequence
  Synthetic
tggctcctgctgctgtggctcctgctgctgtggctcctgctgctgtggctcctgctgctgtggctcctgctgctg

SEQ ID NO: 177781 - DNA, 75 bp, Artificial Sequence
  Synthetic
cttcaaagccaacctcttcgtgaacgtccgtcacagctacttttatcaggtattgctgcagagttcgatcgtcga

SEQ ID NO: 177782 - DNA, 75 bp, Artificial Sequence
  Synthetic
gtccgtcacagctacttttatcaggtattgctgcagagttcgatcgtcgaggagtacattggcctagatagcggc

SEQ ID NO: 177783 - DNA, 75 bp, Artificial Sequence
  Synthetic
tgctgtggctcccgctgttgtggctcctgctgctgtggctcctgctgttgtggctcctgctgctgtggctcctgc

SEQ ID NO: 177784 - DNA, 75 bp, Artificial Sequence
  Synthetic
ctcgcgcactgcgcgcgcggcggcacgtgggacggatctcttggatttacccgtaacgaggagcggcgcacccca

SEQ ID NO: 177785 - DNA, 75 bp, Artificial Sequence
  Synthetic
aaagcggggctatcaggatcctgtcaactgtaccatcggtggcgatgctttagacccgcacgtggagattcctac

SEQ ID NO: 177786 - DNA, 75 bp, Artificial Sequence
  Synthetic
aactgtaccatcggtggcgatgctttagacccgcacgtggagattcctacgctgctaatcgtaacccccgtctac

SEQ ID NO: 177787 - DNA, 75 bp, Artificial Sequence
  Synthetic
agcaccccaggagccccggcagcaccccaggagccccggcagcaccccaggagccccggcagccccaggagcccc

SEQ ID NO: 177788 - DNA, 75 bp, Artificial Sequence
  Synthetic
gtcaagaagtgcgaaggacacctttccatatatcaaatgggatttctcctatctatctgcaaacgtccctcacag

SEQ ID NO: 177789 - DNA, 75 bp, Artificial Sequence
  Synthetic
cccaggagccccggcagcaccccaggagccccggcagcaccccaggagccccggccccaggagccccggcagcac

SEQ ID NO: 177790 - DNA, 75 bp, Artificial Sequence
  Synthetic
tcgacgtagtcgtggactatgaccccattcgcgtttcagaaaagggcatgttgcttgagcaatcgcaatccccat

SEQ ID NO: 177791 - DNA, 75 bp, Artificial Sequence
  Synthetic
aacagtatggttttctgtacgtattttattccgtggtgggtgaaaaataacgggggatggaggaagagggatggg

SEQ ID NO: 177792 - DNA, 75 bp, Artificial Sequence
  Synthetic
tttataatgccaatatatcagctaaatgaatatcatttgcgtttcgtcgatttcactgtcactttcatggtcgga

SEQ ID NO: 177793 - DNA, 75 bp, Artificial Sequence
  Synthetic
gggctctggtctttgctgggaggggcggcggtttctggtgaacagtcggagttctatcgaccgtcggcgccgacg

SEQ ID NO: 177794 - DNA, 75 bp, Artificial Sequence
  Synthetic
cggcggtttctggtgaacagtcggagttctatcgaccgtcggcgccgacgtcgccagaggcatgtatgccgcact

SEQ ID NO: 177795 - DNA, 75 bp, Artificial Sequence
  Synthetic
ggatgcacagtatagggatacaggagatattgatagccactatgtagtggagattagcctgcacgaacgcgtttt

SEQ ID NO: 177796 - DNA, 75 bp, Artificial Sequence
  Synthetic
gatattgatagccactatgtagtggagattagcctgcacgaacgcgttttcatacctgatgacaggcagcagtag

SEQ ID NO: 177797 - DNA, 75 bp, Artificial Sequence
  Synthetic
taaactttaccaggaaaaattccgtgtttatgtaccacacgaccgtcaaggctaggaacatgttcaccgcaccaa

SEQ ID NO: 177798 - DNA, 75 bp, Artificial Sequence
  Synthetic
gtttatgtaccacacgaccgtcaaggctaggaacatgttcaccgcaccaaaaatggcgtctgacacgagcacgta

SEQ ID NO: 177799 - DNA, 75 bp, Artificial Sequence
  Synthetic
ccaaggcggttgttgataggtacaggttgacgcagaccggtttccaccgagtcagcagtgactccatcatggtat

SEQ ID NO: 177800 - DNA, 75 bp, Artificial Sequence
  Synthetic
gttgacgcagaccggtttccaccgagtcagcagtgactccatcatggtattatcaggtacgtgctgttccaggag

SEQ ID NO: 177801 - DNA, 75 bp, Artificial Sequence
  Synthetic
caaaggatatgcaaaaatgaatgcagtagacaaaggctgccataagtacgtgtttatatgacagaacatggataa

SEQ ID NO: 177802 - DNA, 75 bp, Artificial Sequence
  Synthetic
gtagacaaaggctgccataagtacgtgtttatatgacagaacatggataaacagttgcatgctccacatccttaa

SEQ ID NO: 177803 - DNA, 75 bp, Artificial Sequence
  Synthetic
gcatgctcatcatggtagtggcgtgaacatgcttggcccgatatacggccaccgccgcgagacagtagtatacta

SEQ ID NO: 177804 - DNA, 75 bp, Artificial Sequence
  Synthetic
aacatgcttggcccgatatacggccaccgccgcgagacagtagtatactatggcaatgccgtccacgataaaagt

SEQ ID NO: 177805 - DNA, 75 bp, Artificial Sequence
  Synthetic
tgaggtgcttcgctgagttgcgcaccgtgaggtttagcgcgctgtagtttaccagattgttgaagtagcagggga

SEQ ID NO: 177806 - DNA, 75 bp, Artificial Sequence
  Synthetic
cgccacaccgccactcacaatcaccccaaataaaccgaccggaacccctcacgtctccccggaggctgatccaat

SEQ ID NO: 177807 - DNA, 75 bp, Artificial Sequence
  Synthetic
cgtgaggtttagcgcgctgtagtttaccagattgttgaagtagcaggggaaaccaaggccctcgtacgtggcggc

SEQ ID NO: 177808 - DNA, 75 bp, Artificial Sequence
  Synthetic
gcttgacccaggaggacatgagaaaacggtcgctctttgaagcgcgcatgtttctcggtctttttaactttcgcc

SEQ ID NO: 177809 - DNA, 75 bp, Artificial Sequence
  Synthetic
tttctcggtctttttaactttcgccaggcggcgctgcggcgggagagccaatctgatgccactgcctatcgcggt

SEQ ID NO: 177810 - DNA, 75 bp, Artificial Sequence
  Synthetic
gactcaatggcaacgagcgaagaaacggcggccggttatgtcatcggtgtctactttcacagcgttcacgtccac

SEQ ID NO: 177811 - DNA, 75 bp, Artificial Sequence
  Synthetic
attttctacccctggacccaaacgacggggagactgaatgctactttgtggtggacacgctgacgaaagaggcga

SEQ ID NO: 177812 - DNA, 75 bp, Artificial Sequence
  Synthetic
gcccgtgacctggcgatctgggagttggcgctgcgactgcagaatcagacgatcgtcaaggccgtccggacagcg

SEQ ID NO: 177813 - DNA, 75 bp, Artificial Sequence
  Synthetic
tggcgctgcgactgcagaatcagacgatcgtcaaggccgtccggacagcgtcgcttccggtggttctaattatga

SEQ ID NO: 177814 - DNA, 75 bp, Artificial Sequence
  Synthetic
cccagaccactagcctgtgcttacctacactgtgaggcgacggtgacctttgaggtcccactaaccgggcccgcg

SEQ ID NO: 177815 - DNA, 75 bp, Artificial Sequence
  Synthetic
tacactgtgaggcgacggtgacctttgaggtcccactaaccgggcccgcggcgtccaccggaacgtggcacagct

SEQ ID NO: 177816 - DNA, 75 bp, Artificial Sequence
  Synthetic
agtcgaggcatatactcctgccagtcgaacgaggcccctgaggccaagagggaaaagcgaggtttagacatatca

SEQ ID NO: 177817 - DNA, 75 bp, Artificial Sequence
  Synthetic
cgaacgaggcccctgaggccaagagggaaaagcgaggtttagacatatcagatgtgtttgtctgtctcacgtatg

SEQ ID NO: 177818 - DNA, 75 bp, Artificial Sequence
  Synthetic
gcttttcacgtcttatggatcaatgaggacagcaagtggaacggggcagccgtcgaatttttcagagccctacac

SEQ ID NO: 177819 - DNA, 75 bp, Artificial Sequence
  Synthetic
aggacagcaagtggaacggggcagccgtcgaatttttcagagccctacaccataagctgttcagtgaacgcaatg

SEQ ID NO: 177820 - DNA, 75 bp, Artificial Sequence
  Synthetic
acagcctttgcgccattacttcccgcattcccttgcatacctttgcggtatgggtcgcctacctctctggacagg

SEQ ID NO: 177821 - DNA, 75 bp, Artificial Sequence
  Synthetic
tccagcgacacccatttagtaacacatccgggacatgaactgccacaaacaccgttaagcctctatccatgcatt

SEQ ID NO: 177822 - DNA, 75 bp, Artificial Sequence
  Synthetic
cattcccttgcatacctttgcggtatgggtcgcctacctctctggacagggcgtccgtgcagtgggacctatttg

SEQ ID NO: 177823 - DNA, 75 bp, Artificial Sequence
  Synthetic
ggggggggaccgcgccggggtactgcagggttcgcagggttcgggggtactacctggttcctggggtgtgccagg

SEQ ID NO: 177824 - DNA, 75 bp, Artificial Sequence
  Synthetic
gatacagtgtttgggtacgactccctggccatttcaagggaatgtgaagatcagtatgtgtggcccacgcctgtc

SEQ ID NO: 177825 - DNA, 75 bp, Artificial Sequence
  Synthetic
tggccatttcaagggaatgtgaagatcagtatgtgtggcccacgcctgtcactgacattaatattaatttgtgca

SEQ ID NO: 177826 - DNA, 75 bp, Artificial Sequence
  Synthetic
gtgaatctagaagccctgttgcgcaccgactccgtattatcgcgggtctcgtccattgtctcactcgatacgctc

SEQ ID NO: 177827 - DNA, 75 bp, Artificial Sequence
  Synthetic
atttttcctcgtccaagctttggagcctgaggtgagacctactgtccctgcttgaagcggagagggggtggtgcg

SEQ ID NO: 177828 - DNA, 75 bp, Artificial Sequence
  Synthetic
cttgaagcggagagggggtggtgcgagttggcagttgacgggtttgtgatagctggagtgctgaccacggcacag

SEQ ID NO: 177829 - DNA, 75 bp, Artificial Sequence
  Synthetic
caaggatctcaaaagggcctgccagatggccgggtttactctgaagggggggacttcgggggatcttgtattctc

SEQ ID NO: 177830 - DNA, 75 bp, Artificial Sequence
  Synthetic
atggccgggtttactctgaagggggggacttcgggggatcttgtattctcatcgcatgcgaacttgctcttttca

SEQ ID NO: 177831 - DNA, 75 bp, Artificial Sequence
  Synthetic
gacggggggtgagcctaacccacgtcacatcaccggaccagacactgagggaaatggggaacacagaaactcccc

SEQ ID NO: 177832 - DNA, 75 bp, Artificial Sequence
  Synthetic
cacatcaccggaccagacactgagggaaatggggaacacagaaactcccccaacctctgcggctttgttacctgg

SEQ ID NO: 177833 - DNA, 75 bp, Artificial Sequence
  Synthetic
cacttcctggctgcagctgatagaggaagtgatacccctgtattttcataggcgaagacaaacatcattctggct

SEQ ID NO: 177834 - DNA, 75 bp, Artificial Sequence
  Synthetic
gaagtgatacccctgtattttcataggcgaagacaaacatcattctggctcatccccctatcgcactgtgaaggg

SEQ ID NO: 177835 - DNA, 75 bp, Artificial Sequence
  Synthetic
tatagtaacaaagtccggacccatgtgttaccgggcaggcttttcgcttcctgtggatgttaattacctgttcta

SEQ ID NO: 177836 - DNA, 75 bp, Artificial Sequence
  Synthetic
tgttaccgggcaggcttttcgcttcctgtggatgttaattacctgttctatttagagcagactctgaaagctgtc

SEQ ID NO: 177837 - DNA, 75 bp, Artificial Sequence
  Synthetic
taaataaaggtcaatgtttaatccatatgggggtgtgggatgggggtgagggatgggggtgtgggatgggggtgt

SEQ ID NO: 177838 - DNA, 75 bp, Artificial Sequence
  Synthetic
tatgggggtgtgggatgggggtgagggatgggggtgtgggatgggggtgtgggatgggggtgtgggatgggggtg

SEQ ID NO: 177839 - DNA, 75 bp, Artificial Sequence
  Synthetic
tctacagctagaggcctggaccaggcttttatctttattttgaaaaaagggaaacaatggggggtttgaaaaggg

SEQ ID NO: 177840 - DNA, 75 bp, Artificial Sequence
  Synthetic
gaaacaatggggggtttgaaaagggtgcacattttcagatattttaaaacttcattgttctccaggtgcttggta

SEQ ID NO: 177841 - DNA, 75 bp, Artificial Sequence
  Synthetic
gtcatcttcattctctccactagactccagtttaaaagactctagataaatgggtttcattagtccccccatggg

SEQ ID NO: 177842 - DNA, 75 bp, Artificial Sequence
  Synthetic
tccagtttaaaagactctagataaatgggtttcattagtccccccatgggggttgaagcgtcgcctatcgcctta

SEQ ID NO: 177843 - DNA, 75 bp, Artificial Sequence
  Synthetic
cagctcgtaaacaaaggcggccgtggcagtcaacgtctctataccgtgcatgacgaaggccgcgtccatccccgg

SEQ ID NO: 177844 - DNA, 75 bp, Artificial Sequence
  Synthetic
gcagtcaacgtctctataccgtgcatgacgaaggccgcgtccatccccggcgtcctctcatgtgtctttctggcg

SEQ ID NO: 177845 - DNA, 75 bp, Artificial Sequence
  Synthetic
gagcatcgataacaggcagcagagctcggttatgccgggagatgtaggtctaaggaggcacactcgctcttggaa

SEQ ID NO: 177846 - DNA, 75 bp, Artificial Sequence
  Synthetic
tcggttatgccgggagatgtaggtctaaggaggcacactcgctcttggaacacgtgagggtgtaggtctatgtgg

SEQ ID NO: 177847 - DNA, 75 bp, Artificial Sequence
  Synthetic
gttgggcgaggacaggcgagatttcacgtgctccctgagacacgctatatctaagtggcccatcacggacatttt

SEQ ID NO: 177848 - DNA, 75 bp, Artificial Sequence
  Synthetic
ttgtttttcctatgcacttccaggacaaggcggggcaccacagggtgggggtatacgggacaggcctcttctgac

SEQ ID NO: 177849 - DNA, 75 bp, Artificial Sequence
  Synthetic
cagggccctttccagggacattctcgaagggtggtgtaactagacagtatttctgtcccacgtcggttatataca

SEQ ID NO: 177850 - DNA, 75 bp, Artificial Sequence
  Synthetic
gaagggtggtgtaactagacagtatttctgtcccacgtcggttatatacacaaagagtctgctagtctgatataa

SEQ ID NO: 177851 - DNA, 75 bp, Artificial Sequence
  Synthetic
gctccatctgaagcaggtccgcgatcacatacgtgaatggaccaagcaggatggatatggtgtcctgagaatagg

SEQ ID NO: 177852 - DNA, 75 bp, Artificial Sequence
  Synthetic
cacatacgtgaatggaccaagcaggatggatatggtgtcctgagaataggtgacgctgagccgctgcccttggtt

SEQ ID NO: 177853 - DNA, 75 bp, Artificial Sequence
  Synthetic
ggttcgtgagatctttcatgctttctctcactgggggtatgtaagaagagaaaaagctatttagcacggcactgc

SEQ ID NO: 177854 - DNA, 75 bp, Artificial Sequence
  Synthetic
ccgatgggatatgggaagacgttagctgcagagaggggtcctgtaaacgtcccagagattgaaatgtgttggcgg

SEQ ID NO: 177855 - DNA, 75 bp, Artificial Sequence
  Synthetic
gacagctgtgtctcaatacattttagcctcttcatgcagagctccctctccttttcaagttgagttattgtgtca

SEQ ID NO: 177856 - DNA, 75 bp, Artificial Sequence
  Synthetic
gcctcttcatgcagagctccctctccttttcaagttgagttattgtgtcaaattgttcgtttatctggttggtga

SEQ ID NO: 177857 - DNA, 75 bp, Artificial Sequence
  Synthetic
gtctcttggcctgtgccgaatagtttattcttgtctactatgttttgggacacgtcggtgacaaagtcctccacg

SEQ ID NO: 177858 - DNA, 75 bp, Artificial Sequence
  Synthetic
tattcttgtctactatgttttgggacacgtcggtgacaaagtcctccacgacgtcggtgacaccgctcactgtct

SEQ ID NO: 177859 - DNA, 75 bp, Artificial Sequence
  Synthetic
gttctctgagaggcctgctccaggtgggtcatgatgtctttgtacacattgttacaggcgcttccaacgagggcc

SEQ ID NO: 177860 - DNA, 75 bp, Artificial Sequence
  Synthetic
gggtcatgatgtctttgtacacattgttacaggcgcttccaacgagggccttggtgggggctgtgttcaggagct

SEQ ID NO: 177861 - DNA, 75 bp, Artificial Sequence
  Synthetic
tacatcctctgaatggggctgtcaaagatcacccgcccagccaagatggcgggcatagtaatcacctccacatga

SEQ ID NO: 177862 - DNA, 75 bp, Artificial Sequence
  Synthetic
agatcacccgcccagccaagatggcgggcatagtaatcacctccacatgaacccttttctgcttatacaatccca

SEQ ID NO: 177863 - DNA, 75 bp, Artificial Sequence
  Synthetic
ggaatatagagggcgcttaaactagacaccaggttgctaatctcctgagtcacgctggtgagtatccggcctatg

SEQ ID NO: 177864 - DNA, 75 bp, Artificial Sequence
  Synthetic
acaccaggttgctaatctcctgagtcacgctggtgagtatccggcctatggttttttcaccagaggccagacgct

SEQ ID NO: 177865 - DNA, 75 bp, Artificial Sequence
  Synthetic
ggtgtgtgcttgacgactggtaccattcctaccgtgaccacccagtctacgtatctctcatacgagagctgtgtc

SEQ ID NO: 177866 - DNA, 75 bp, Artificial Sequence
  Synthetic
ttcctaccgtgaccacccagtctacgtatctctcatacgagagctgtgtcttggcgtagaggacccggttgatgg

SEQ ID NO: 177867 - DNA, 75 bp, Artificial Sequence
  Synthetic
tcgaaggttgaccttctgtaagacccccactgtgcttccttttctggccacctggtttttgctgaggactcgtat

SEQ ID NO: 177868 - DNA, 75 bp, Artificial Sequence
  Synthetic
cccactgtgcttccttttctggccacctggtttttgctgaggactcgtatgtcctccagtcggacaagacgtggt

SEQ ID NO: 177869 - DNA, 75 bp, Artificial Sequence
  Synthetic
ctgaaaaaaacacccgggtttcgcaggctgcagtgtagagtctgacctctgacataagaatacttgccttgcagg

SEQ ID NO: 177870 - DNA, 75 bp, Artificial Sequence
  Synthetic
ggctgcagtgtagagtctgacctctgacataagaatacttgccttgcaggatctcaaagagggagatggacagct

SEQ ID NO: 177871 - DNA, 75 bp, Artificial Sequence
  Synthetic
atgacatcggatgccaaagtcaggagcgtagtggaacagattgacaggttgtcaaatatcactacctcgcccccg

SEQ ID NO: 177872 - DNA, 75 bp, Artificial Sequence
  Synthetic
gcgtagtggaacagattgacaggttgtcaaatatcactacctcgcccccggagatgggctggtatgacctagagt

SEQ ID NO: 177873 - DNA, 75 bp, Artificial Sequence
  Synthetic
ataacggggactgcaggagcggggaaaagcaccagcgtatccgccctacatcagaatctcaactgcctaattacg

SEQ ID NO: 177874 - DNA, 75 bp, Artificial Sequence
  Synthetic
aaagcaccagcgtatccgccctacatcagaatctcaactgcctaattacgggggctacagtggtagcggcacaga

SEQ ID NO: 177875 - DNA, 75 bp, Artificial Sequence
  Synthetic
ggattcaagagcagacacattaatatctgccagaggaaagtgcccaaggtaactcagtcctccatcgagcaactc

SEQ ID NO: 177876 - DNA, 75 bp, Artificial Sequence
  Synthetic
tctgccagaggaaagtgcccaaggtaactcagtcctccatcgagcaactccagagatacgagctggctaggtact

SEQ ID NO: 177877 - DNA, 75 bp, Artificial Sequence
  Synthetic
gggcagtatagctccctctctcaaagcgctttcagactcctttgccgtatgggtggagccaatttgtggacgagt

SEQ ID NO: 177878 - DNA, 75 bp, Artificial Sequence
  Synthetic
gcgctttcagactcctttgccgtatgggtggagccaatttgtggacgagtaacattatcgtgatagacgaagctg

SEQ ID NO: 177879 - DNA, 75 bp, Artificial Sequence
  Synthetic
tacaacagttggctggacaccccgctatacagaaatggtgccgtgccttgcatagtctgcgtggggtctcccacc

SEQ ID NO: 177880 - DNA, 75 bp, Artificial Sequence
  Synthetic
tatacagaaatggtgccgtgccttgcatagtctgcgtggggtctcccacccagacggacgcctttcagtcggtct

SEQ ID NO: 177881 - DNA, 75 bp, Artificial Sequence
  Synthetic
accttcctattgggaaaacgtgaggttgcagattatattaggctggacgagaattgggccctatttataaacaat

SEQ ID NO: 177882 - DNA, 75 bp, Artificial Sequence
  Synthetic
ttgcagattatattaggctggacgagaattgggccctatttataaacaataagcgctgtacggatccccagtttg

SEQ ID NO: 177883 - DNA, 75 bp, Artificial Sequence
  Synthetic
atggactatatagataggtttgtggttccgaagagtaagattctggacccgctcgagtatgcagggtggacaaga

SEQ ID NO: 177884 - DNA, 75 bp, Artificial Sequence
  Synthetic
ttccgaagagtaagattctggacccgctcgagtatgcagggtggacaagactcttcatctcacaccaggaggtga

SEQ ID NO: 177885 - DNA, 75 bp, Artificial Sequence
  Synthetic
gtgtccacaaagcttttcacctgcccagtggtctgtgaggtgtttacagagccatttgaggagtacaaacgggcg

SEQ ID NO: 177886 - DNA, 75 bp, Artificial Sequence
  Synthetic
cagtggtctgtgaggtgtttacagagccatttgaggagtacaaacgggcggtaggcctcacacacatgactccca

SEQ ID NO: 177887 - DNA, 75 bp, Artificial Sequence
  Synthetic
gctgatcaggacatggctgtggttgggacctatatcacagacgcgtccacacagatcaccttcgccactaaattt

SEQ ID NO: 177888 - DNA, 75 bp, Artificial Sequence
  Synthetic
ggacctatatcacagacgcgtccacacagatcaccttcgccactaaatttgtcaaaaacagctatgctaccctta

SEQ ID NO: 177889 - DNA, 75 bp, Artificial Sequence
  Synthetic
ttcaagtccatcctagacggggagctatttatcgaaagtcattcgcacgataaccccgcttatgtgtacagtttc

SEQ ID NO: 177890 - DNA, 75 bp, Artificial Sequence
  Synthetic
tatttatcgaaagtcattcgcacgataaccccgcttatgtgtacagtttccttagtaccctgctatataatgcca

SEQ ID NO: 177891 - DNA, 75 bp, Artificial Sequence
  Synthetic
agggacctcagggaactgccggtgtctcaagagctgatctctgagatgagctccgaggacgttctggggcaggag

SEQ ID NO: 177892 - DNA, 75 bp, Artificial Sequence
  Synthetic
ctcaagagctgatctctgagatgagctccgaggacgttctggggcaggagggggacacagatgccttctacctca

SEQ ID NO: 177893 - DNA, 75 bp, Artificial Sequence
  Synthetic
gcctattactccggggccaaggaactattctgcaacaggctggccctggcacgccgacactttggtgacgagttc

SEQ ID NO: 177894 - DNA, 75 bp, Artificial Sequence
  Synthetic
tattctgcaacaggctggccctggcacgccgacactttggtgacgagttcctccactccgatttttcaacgttta

SEQ ID NO: 177895 - DNA, 75 bp, Artificial Sequence
  Synthetic
gggctccacggtctagtggcatacgcatccactatagacacctatataatccagggatatacgttcctcccagtg

SEQ ID NO: 177896 - DNA, 75 bp, Artificial Sequence
  Synthetic
catccactatagacacctatataatccagggatatacgttcctcccagtgagattcggccgtccaggaggacagc

SEQ ID NO: 177897 - DNA, 75 bp, Artificial Sequence
  Synthetic
tcatcggggttcattgcctgcctggaaaataacgtcaccaagatgacagagaccctcgaaggtggcgacgtgttt

SEQ ID NO: 177898 - DNA, 75 bp, Artificial Sequence
  Synthetic
aaaataacgtcaccaagatgacagagaccctcgaaggtggcgacgtgtttaacatatgttgtgcaggggactacg

SEQ ID NO: 177899 - DNA, 75 bp, Artificial Sequence
  Synthetic
ctaagtagggtggccatatcgttcggcaaccaccgcaatatcagagccagtctagtgtatgtgggtgtatccagg

SEQ ID NO: 177900 - DNA, 75 bp, Artificial Sequence
  Synthetic
gcaaccaccgcaatatcagagccagtctagtgtatgtgggtgtatccagggccatcgacgctcgttacctggtaa

SEQ ID NO: 177901 - DNA, 75 bp, Artificial Sequence
  Synthetic
tcctcaaagtacatcatcaaagccctatgcaaccccaagactactctgatctactgacccgtacccctctcttag

SEQ ID NO: 177902 - DNA, 75 bp, Artificial Sequence
  Synthetic
tatgcaaccccaagactactctgatctactgacccgtacccctctcttaggacactgatgtgtttgggaataaag

SEQ ID NO: 177903 - DNA, 75 bp, Artificial Sequence
  Synthetic
atcagtccagccacggccagttatatgcaccgtttccacacaggggtggcgtggaggccaggatgcgggttgggt

SEQ ID NO: 177904 - DNA, 75 bp, Artificial Sequence
  Synthetic
tgcaccgtttccacacaggggtggcgtggaggccaggatgcgggttgggtcgctgcacctggaccccgcggtagt

SEQ ID NO: 177905 - DNA, 75 bp, Artificial Sequence
  Synthetic
ggaggtgaccctttgtgctcgacggagacacgatcacgctcacggcggacgagggctcctcgtctgtgtcactcc

SEQ ID NO: 177906 - DNA, 75 bp, Artificial Sequence
  Synthetic
cactgctttgcggcttaagtttggttgtctctggcagcgcaccacatcctcgctaccagaggaggcggtagactg

SEQ ID NO: 177907 - DNA, 75 bp, Artificial Sequence
  Synthetic
cgctgctggggctcccgctgctggggctcccgctgctgtggctcccgctgctgtggctcctgctgttgtggctcc

SEQ ID NO: 177908 - DNA, 75 bp, Artificial Sequence
  Synthetic
cgctaccagaggaggcggtagactgccttttgcgcttctggcccacgtccatgagcccgattctctgactcaata

SEQ ID NO: 177909 - DNA, 75 bp, Artificial Sequence
  Synthetic
ccttttgcgcttctggcccacgtccatgagcccgattctctgactcaatacttccccttggtcttctccgtcctc

SEQ ID NO: 177910 - DNA, 75 bp, Artificial Sequence
  Synthetic
ttgtggctcctgctgctgtggctcctgctgttgtggctcctgctgctgtggctcctgctgttgtggctcctgctg

SEQ ID NO: 177911 - DNA, 75 bp, Artificial Sequence
  Synthetic
cctcattgttcacgtccggagagttggaactgtcatcgctatcagagtccgatgtcaggtcgacgatcgcggtgg

SEQ ID NO: 177912 - DNA, 75 bp, Artificial Sequence
  Synthetic
ggaactgtcatcgctatcagagtccgatgtcaggtcgacgatcgcggtgggtgcggcgcgcagggggcgccacga

SEQ ID NO: 177913 - DNA, 75 bp, Artificial Sequence
  Synthetic
tatttctggaagcaggtgaaagtccgtatgccccggtcccagtgtatgccgccatcggttccaggatagcaaccc

SEQ ID NO: 177914 - DNA, 75 bp, Artificial Sequence
  Synthetic
gtatgccccggtcccagtgtatgccgccatcggttccaggatagcaaccccctcgtcgtctgaaggtgagagccc

SEQ ID NO: 177915 - DNA, 75 bp, Artificial Sequence
  Synthetic
actccgccgtgtccgttgaactgcgcacgcggcccgctaccactgctaccggtttgggcgtatgggcccgtctgg

SEQ ID NO: 177916 - DNA, 75 bp, Artificial Sequence
  Synthetic
cacgcggcccgctaccactgctaccggtttgggcgtatgggcccgtctggccagaggcctcgggcgcaagtgaga

SEQ ID NO: 177917 - DNA, 75 bp, Artificial Sequence
  Synthetic
gaacatcgtcattttcttcttcatcttcatcttcctcatcctcgtcatattcagattcgccgctcgactgatccg

SEQ ID NO: 177918 - DNA, 75 bp, Artificial Sequence
  Synthetic
ttcatcttcctcatcctcgtcatattcagattcgccgctcgactgatccggggatatctgtagatccagaggggt

SEQ ID NO: 177919 - DNA, 75 bp, Artificial Sequence
  Synthetic
tatctatcaccgtgggtccagcatagccgcgcggcctgccaaatcctggaagtgatgaaagaggtggaggtggga

SEQ ID NO: 177920 - DNA, 75 bp, Artificial Sequence
  Synthetic
gccgcgcggcctgccaaatcctggaagtgatgaaagaggtggaggtgggaatatgaacttcacggggggtcgtct

SEQ ID NO: 177921 - DNA, 75 bp, Artificial Sequence
  Synthetic
ctaccaaggggggcagtctcaaagcccgtggacgcgatgtaggtgaccgtctcagggacggcggctttgccttta

SEQ ID NO: 177922 - DNA, 75 bp, Artificial Sequence
  Synthetic
acgaggtcctcacaaacatcgccatggccttgtacggggttgaccgctaggggcggaaatttacaaagcacacga

SEQ ID NO: 177923 - DNA, 75 bp, Artificial Sequence
  Synthetic
ggccttgtacggggttgaccgctaggggcggaaatttacaaagcacacgagttattgcctttactgctccaacag

SEQ ID NO: 177924 - DNA, 75 bp, Artificial Sequence
  Synthetic
ggttaaagtgattacagccctggaaccgaggccatcgcgagtgtcggccaccaagagaggccagcggagatggat

SEQ ID NO: 177925 - DNA, 75 bp, Artificial Sequence
  Synthetic
ccgaggccatcgcgagtgtcggccaccaagagaggccagcggagatggatgctgggccgtaagcaccaggtgttt

SEQ ID NO: 177926 - DNA, 75 bp, Artificial Sequence
  Synthetic
gaaaaacgcaatgttctaactttgaggatatgctactgatgatgaaactcgtgaaccaatcccagccaagtccct

SEQ ID NO: 177927 - DNA, 75 bp, Artificial Sequence
  Synthetic
ggatatgctactgatgatgaaactcgtgaaccaatcccagccaagtccctcgtgtgagccggccctccccttctc

SEQ ID NO: 177928 - DNA, 75 bp, Artificial Sequence
  Synthetic
tgtgggacttccaggtataggcaaggtgtggggtccacattcccggccgtcgacggagtcggcgacatgcttcct

SEQ ID NO: 177929 - DNA, 75 bp, Artificial Sequence
  Synthetic
cgaggcacccgtgggaaggagtactgaaattggggacggaagcctctagctctctaaagatgcttctcaaactgg

SEQ ID NO: 177930 - DNA, 75 bp, Artificial Sequence
  Synthetic
gaaattggggacggaagcctctagctctctaaagatgcttctcaaactgggtggaacctgacattgcggatccac

SEQ ID NO: 177931 - DNA, 75 bp, Artificial Sequence
  Synthetic
agatcaccactttaatatcctctggatcgcagcagtgggaccaccacatcagcttgtcctgtgggggatacactg

SEQ ID NO: 177932 - DNA, 75 bp, Artificial Sequence
  Synthetic
atcgcagcagtgggaccaccacatcagcttgtcctgtgggggatacactgtggtggttagcctaagttcccgaat

SEQ ID NO: 177933 - DNA, 75 bp, Artificial Sequence
  Synthetic
gaaaggaaatccacttaggtgccagtaacagatcccggtcgtccaccccctgactgatggatagggtgcccctaa

SEQ ID NO: 177934 - DNA, 75 bp, Artificial Sequence
  Synthetic
taacagatcccggtcgtccaccccctgactgatggatagggtgcccctaaagaccgtctgttgcaaccatgcgtc

SEQ ID NO: 177935 - DNA, 75 bp, Artificial Sequence
  Synthetic
ttgtgatttttaaatacgttttaggattcacgtgatactagaaagggcatttaaggttttgtgtacaattgtttt

SEQ ID NO: 177936 - DNA, 75 bp, Artificial Sequence
  Synthetic
cttttagcccgagtctgacttccgctaacagaacctgtccggttcatggcctttcccacgcttattataattatg

SEQ ID NO: 177937 - DNA, 75 bp, Artificial Sequence
  Synthetic
taacagaacctgtccggttcatggcctttcccacgcttattataattatgtttacgttgtgaatagagctatctg

SEQ ID NO: 177938 - DNA, 75 bp, Artificial Sequence
  Synthetic
taccacaacaacctcaggttttcctgcgacgcccaggaccccaatcttcgaacgaccgcgactaaaaatgacctc

SEQ ID NO: 177939 - DNA, 75 bp, Artificial Sequence
  Synthetic
gcgacgcccaggaccccaatcttcgaacgaccgcgactaaaaatgacctcagattaaacccattcacgcatgttt

SEQ ID NO: 177940 - DNA, 75 bp, Artificial Sequence
  Synthetic
tttgggggagcctcctcagtgcttgctacgtggagccctggacactacgtgaacaccccgcgccccgcgcccccc

SEQ ID NO: 177941 - DNA, 75 bp, Artificial Sequence
  Synthetic
ctacgtggagccctggacactacgtgaacaccccgcgccccgcgccccccaccccgcgccgcccctccccctccc

SEQ ID NO: 177942 - DNA, 75 bp, Artificial Sequence
  Synthetic
ttgcagtgattcggatcggcgaagtggatagagtggaccgcaaagaacaacggcagggtagaggctgccgatgcc

SEQ ID NO: 177943 - DNA, 75 bp, Artificial Sequence
  Synthetic
ggatagagtggaccgcaaagaacaacggcagggtagaggctgccgatgcctgaattgcgcaacatggtaaggcga

SEQ ID NO: 177944 - DNA, 75 bp, Artificial Sequence
  Synthetic
gcaaagatccccatggggcaaatccgggtttcacccttgtgttgcctggttcggtgctccccagggagccccctt

SEQ ID NO: 177945 - DNA, 75 bp, Artificial Sequence
  Synthetic
gggtttcacccttgtgttgcctggttcggtgctccccagggagcccccttccgtaatatctgttttatatagtga

SEQ ID NO: 177946 - DNA, 75 bp, Artificial Sequence
  Synthetic
cccgccggggtacggggctaggccacgcctactttttttttcgggcggccccccgaccctctctcggcccccggt

SEQ ID NO: 177947 - DNA, 75 bp, Artificial Sequence
  Synthetic
accttttcgcgacacgggggtgaggtctatttcccacgacatacttccgcggaaaaatacccacgctccttaatt

SEQ ID NO: 177948 - DNA, 75 bp, Artificial Sequence
  Synthetic
tctatttcccacgacatacttccgcggaaaaatacccacgctccttaatttccgtgggaagacgatgggggaaat

SEQ ID NO: 177949 - DNA, 75 bp, Artificial Sequence
  Synthetic
acgtctggctgagattttctaaaaagtcatccaatgaatcatcggaatcatcagcacactctagaactactccat

SEQ ID NO: 177950 - DNA, 75 bp, Artificial Sequence
  Synthetic
gtcatccaatgaatcatcggaatcatcagcacactctagaactactccatatgccggggtgcgcgggggtcccga

SEQ ID NO: 177951 - DNA, 75 bp, Artificial Sequence
  Synthetic
tacgggccgtgtgcacaagggtcacgtccccatccccaacacaaggacctttagataccctctcccggcatgtgc

SEQ ID NO: 177952 - DNA, 75 bp, Artificial Sequence
  Synthetic
gtccccatccccaacacaaggacctttagataccctctcccggcatgtgcgcgtatccgggcaagcaagctggtg

SEQ ID NO: 177953 - DNA, 75 bp, Artificial Sequence
  Synthetic
ttattatttccacaggaaccggtttctctaattgcatcaccagggtatccaaaagccgggcttccacgttgatcc

SEQ ID NO: 177954 - DNA, 75 bp, Artificial Sequence
  Synthetic
tttcctggtggggcgcggcagctgactcaaaaaggtcactgcctctgcccatgggcgggtgggtgacagtccgcc

SEQ ID NO: 177955 - DNA, 75 bp, Artificial Sequence
  Synthetic
aggtaatgtgctctatgaagatgtggtagagccagcagacgttcaaacacgatgaaatcaagctaagctcccgcc

SEQ ID NO: 177956 - DNA, 75 bp, Artificial Sequence
  Synthetic
gtagagccagcagacgttcaaacacgatgaaatcaagctaagctcccgccggaactccacatccacaaaggggta

SEQ ID NO: 177957 - DNA, 75 bp, Artificial Sequence
  Synthetic
ctgacccaccaaggagaacctggcgtcttgcaaagttgatgagccccgcagaaagaatgtgtctcccgtgggaca

SEQ ID NO: 177958 - DNA, 75 bp, Artificial Sequence
  Synthetic
tcttgcaaagttgatgagccccgcagaaagaatgtgtctcccgtgggacaaagagcttgggggggcagagatggc

SEQ ID NO: 177959 - DNA, 75 bp, Artificial Sequence
  Synthetic
aggcctgttccagtatcagcataaatctatctttgcagtcatcccagatcaaagtcatgtcagatgctgttgcct

SEQ ID NO: 177960 - DNA, 75 bp, Artificial Sequence
  Synthetic
tctatctttgcagtcatcccagatcaaagtcatgtcagatgctgttgcctggcattttgcccgcatgtacatttc

SEQ ID NO: 177961 - DNA, 75 bp, Artificial Sequence
  Synthetic
tgttgagcccccccggggaagccagcgtatgcttcaggaccaccagggacgctaagaaccccgggtgtccgcgct

SEQ ID NO: 177962 - DNA, 75 bp, Artificial Sequence
  Synthetic
cgtatgcttcaggaccaccagggacgctaagaaccccgggtgtccgcgctccggaaacagacctctgagaatacg

SEQ ID NO: 177963 - DNA, 75 bp, Artificial Sequence
  Synthetic
tccagctctcacaattttcatctccaatacccggaattgggatacacacctccatgttcagtcacatgtacgcta

SEQ ID NO: 177964 - DNA, 75 bp, Artificial Sequence
  Synthetic
aatacccggaattgggatacacacctccatgttcagtcacatgtacgctagggtctccccacccaacccccatag

SEQ ID NO: 177965 - DNA, 75 bp, Artificial Sequence
  Synthetic
tcattaagccccgcccagaaaccagtagctgggtggcaatgacacgtcccctttaaaaagtcaaccttactccgc

SEQ ID NO: 177966 - DNA, 75 bp, Artificial Sequence
  Synthetic
tagctgggtggcaatgacacgtcccctttaaaaagtcaaccttactccgcaaggggtagtctgttgtgagaatac

SEQ ID NO: 177967 - DNA, 75 bp, Artificial Sequence
  Synthetic
tttttattgtatactgaacaatgcgtgtttacaatggtgtaggtgggagcagagttcgccaagctctacgtccga

SEQ ID NO: 177968 - DNA, 75 bp, Artificial Sequence
  Synthetic
tgtttacaatggtgtaggtgggagcagagttcgccaagctctacgtccgaacagtcgggtgtcagggctcttatt

SEQ ID NO: 177969 - DNA, 75 bp, Artificial Sequence
  Synthetic
caggtcgtaccaggcaaaaaaggatcgggcggtgcttttcaggagagttagggacgtgctgattatgtggacaag

SEQ ID NO: 177970 - DNA, 75 bp, Artificial Sequence
  Synthetic
cgggcggtgcttttcaggagagttagggacgtgctgattatgtggacaagcttctgctcgtaaatgcaccgctgg

SEQ ID NO: 177971 - DNA, 75 bp, Artificial Sequence
  Synthetic
aaaatctgtatcctgaaagtcctcgtaaatgacagtttctaccaagaaaaacttttttaccacgctggccatcca

SEQ ID NO: 177972 - DNA, 75 bp, Artificial Sequence
  Synthetic
ttgtgcgttgttaggatatccctaacttcggagcggagacggccggacgctcccacaaaatgggagaggcaccac

SEQ ID NO: 177973 - DNA, 75 bp, Artificial Sequence
  Synthetic
tcccacaaaatgggagaggcaccactctgtgcagtccgcggtcgggggttctgattccaggggcgccgtgtgggg

SEQ ID NO: 177974 - DNA, 75 bp, Artificial Sequence
  Synthetic
tctgtgcagtccgcggtcgggggttctgattccaggggcgccgtgtgggggtattggagagtcaaaactctgggc

SEQ ID NO: 177975 - DNA, 75 bp, Artificial Sequence
  Synthetic
tggcagcatgccgttaataacaccccttatcttgtcgttgccaagtttgtacaactgctgcagggaataagccaa

SEQ ID NO: 177976 - DNA, 75 bp, Artificial Sequence
  Synthetic
cttatcttgtcgttgccaagtttgtacaactgctgcagggaataagccaaattcgccctagccgcgggaaccagg

SEQ ID NO: 177977 - DNA, 75 bp, Artificial Sequence
  Synthetic
gtatagggtcttctcaacgtttagagcgggtacgtggcagtctggattgagggtggcgacggacagggtatctaa

SEQ ID NO: 177978 - DNA, 75 bp, Artificial Sequence
  Synthetic
gcgggtacgtggcagtctggattgagggtggcgacggacagggtatctaactcctgaagtatctgatcccaggac

SEQ ID NO: 177979 - DNA, 75 bp, Artificial Sequence
  Synthetic
tctcgatgtcattgtaaaaactatgacacgccactctctccttagggtaagaagcttcggcggtcctgtgtggaa

SEQ ID NO: 177980 - DNA, 75 bp, Artificial Sequence
  Synthetic
acacgccactctctccttagggtaagaagcttcggcggtcctgtgtggaaagcttcgtcggcctctcggacgaac

SEQ ID NO: 177981 - DNA, 75 bp, Artificial Sequence
  Synthetic
acaatctacgatcccagtgacctaaatagagtggtggaagatgtgtgcattcggattatgaaagaatgttccaag

SEQ ID NO: 177982 - DNA, 75 bp, Artificial Sequence
  Synthetic
atagagtggtggaagatgtgtgcattcggattatgaaagaatgttccaagcttggtgcgctatgtggtctgttta

SEQ ID NO: 177983 - DNA, 75 bp, Artificial Sequence
  Synthetic
aggaccaaaggcgcggccgggtacaacgtgccatgcgcagaggcatcccaaggcattattcggatcctcacggag

SEQ ID NO: 177984 - DNA, 75 bp, Artificial Sequence
  Synthetic
acgtgccatgcgcagaggcatcccaaggcattattcggatcctcacggagaggatcttattctgcacagaaaagg

SEQ ID NO: 177985 - DNA, 75 bp, Artificial Sequence
  Synthetic
aagctactacacgaaatatacactgaaatgaaggccaaatgcctgggggcctggaggcgactcgtctgcaatcgg

SEQ ID NO: 177986 - DNA, 75 bp, Artificial Sequence
  Synthetic
aaatgaaggccaaatgcctgggggcctggaggcgactcgtctgcaatcggaggcccattatgatattaacctctt

SEQ ID NO: 177987 - DNA, 75 bp, Artificial Sequence
  Synthetic
cagtccagggccctctgccttttggttttccaaccggtctaccttccgaggattatggcgccgctggagatcatg

SEQ ID NO: 177988 - DNA, 75 bp, Artificial Sequence
  Synthetic
ttttccaaccggtctaccttccgaggattatggcgccgctggagatcatgaccaagggtcagctcgcccctgaaa

SEQ ID NO: 177989 - DNA, 75 bp, Artificial Sequence
  Synthetic
ggcaaggtcactggactgtcctatccaggaagcggtctcatgccagaatctttaattttgccaatcctggagcca

SEQ ID NO: 177990 - DNA, 75 bp, Artificial Sequence
  Synthetic
caggaagcggtctcatgccagaatctttaattttgccaatcctggagccaggactgttgccggcttccatggtag

SEQ ID NO: 177991 - DNA, 75 bp, Artificial Sequence
  Synthetic
ctgagccagtttgtcattagcaaaccccatcccaacatgccgcacaccgtcagcatcatcccctttaacccatcg

SEQ ID NO: 177992 - DNA, 75 bp, Artificial Sequence
  Synthetic
cccatcccaacatgccgcacaccgtcagcatcatcccctttaacccatcgggtacagacccggcgtttattagta

SEQ ID NO: 177993 - DNA, 75 bp, Artificial Sequence
  Synthetic
ttaaaaccggccaccggtagttcacagacggtgtcagtcaaggcggttgctcaaggggccgtgattactgcgaca

SEQ ID NO: 177994 - DNA, 75 bp, Artificial Sequence
  Synthetic
agacggtgtcagtcaaggcggttgctcaaggggccgtgattactgcgacaacggtgccgcaggcaatgccagcgc

SEQ ID NO: 177995 - DNA, 75 bp, Artificial Sequence
  Synthetic
gatcaggtcgctgcatgttttgtcgcagagaacaccggagattctcccgacaacccgagctctttcctgacgtca

SEQ ID NO: 177996 - DNA, 75 bp, Artificial Sequence
  Synthetic
cagagaacaccggagattctcccgacaacccgagctctttcctgacgtcatgtcacccttgcgatccgaacacgg

SEQ ID NO: 177997 - DNA, 75 bp, Artificial Sequence
  Synthetic
gttacctgtgccccctcttcgacaccaccccccgattcaacagtccgggccccggtggtgcagttgccaacagta

SEQ ID NO: 177998 - DNA, 75 bp, Artificial Sequence
  Synthetic
caccccccgattcaacagtccgggccccggtggtgcagttgccaacagtagtccctctgccggccagcgcgttcc

SEQ ID NO: 177999 - DNA, 75 bp, Artificial Sequence
  Synthetic
catgacggagaccaaggtgtgccgtgtagagattcaacggcggcggctacggcggcagaggcgacaacacccaaa

SEQ ID NO: 178000 - DNA, 75 bp, Artificial Sequence
  Synthetic
gtagagattcaacggcggcggctacggcggcagaggcgacaacacccaaacgaaagcagagaagcaaagagagga

SEQ ID NO: 178001 - DNA, 75 bp, Artificial Sequence
  Synthetic
tcgaccacgacacctggtacctctttgggatcaattaccaccccccaggatgtgcacgccacggatgtcgccacg

SEQ ID NO: 178002 - DNA, 75 bp, Artificial Sequence
  Synthetic
tgggatcaattaccaccccccaggatgtgcacgccacggatgtcgccacgtctgagggaccatcggaggcacaac

SEQ ID NO: 178003 - DNA, 75 bp, Artificial Sequence
  Synthetic
gccctgttagacgaagcgggccctgaaacatgggatgtcgggtcgcctctctcccccactgacgacgcgctgttg

SEQ ID NO: 178004 - DNA, 75 bp, Artificial Sequence
  Synthetic
aaacatgggatgtcgggtcgcctctctcccccactgacgacgcgctgttgtccagtattctgcaaggactgtacc

SEQ ID NO: 178005 - DNA, 75 bp, Artificial Sequence
  Synthetic
ccggagtctccggcggatataccgtcaccttctggtggagagtatacgcaactgcaaccggtcagggcgacctcg

SEQ ID NO: 178006 - DNA, 75 bp, Artificial Sequence
  Synthetic
caccttctggtggagagtatacgcaactgcaaccggtcagggcgacctcggcgacgcccgctaacgaggtacagg

SEQ ID NO: 178007 - DNA, 75 bp, Artificial Sequence
  Synthetic
gccggtggcaaaaaggccccagtcaacatcctcggggtgccccgagacgcggacaccatcggacagcgccagcca

SEQ ID NO: 178008 - DNA, 75 bp, Artificial Sequence
  Synthetic
tgaagtgttcgcaagggcgtctgtgcctgcgttaacttcccaggcagtttatttttaacagtttggtgcaaagtg

SEQ ID NO: 178009 - DNA, 75 bp, Artificial Sequence
  Synthetic
aatagctcattttctcacgaatctggttgattgtgactatttgtgaaacaataatgattaaagggggtggtattt

SEQ ID NO: 178010 - DNA, 75 bp, Artificial Sequence
  Synthetic
gcccagaatgaaggacatacctactaagagttccccgggaacggacaattctgagaaagatgaagctgtcattga

SEQ ID NO: 178011 - DNA, 75 bp, Artificial Sequence
  Synthetic
aagagttccccgggaacggacaattctgagaaagatgaagctgtcattgaggaagatctaagcctcaacgggcaa

SEQ ID NO: 178012 - DNA, 75 bp, Artificial Sequence
  Synthetic
aagctcgctgttgtcaacctacgtaggttgccagcccccggccataccggtctgtgaaacggtcattgaccttac

SEQ ID NO: 178013 - DNA, 75 bp, Artificial Sequence
  Synthetic
ggttgccagcccccggccataccggtctgtgaaacggtcattgaccttacagcgccttcccaaagtggcgcgccc

SEQ ID NO: 178014 - DNA, 75 bp, Artificial Sequence
  Synthetic
ccccgatccttcctggacgctctctcacacaccaccaagaggaccacacatttcgcaacagcttccaactcgcag

SEQ ID NO: 178015 - DNA, 75 bp, Artificial Sequence
  Synthetic
cacacaccaccaagaggaccacacatttcgcaacagcttccaactcgcagatccaagaggcgactacatagaaag

SEQ ID NO: 178016 - DNA, 75 bp, Artificial Sequence
  Synthetic
cgtgcctgcgtctgtagttaaggtagggaacatcaccccccattatggggaagaactgacaaggggtgacgccgt

SEQ ID NO: 178017 - DNA, 75 bp, Artificial Sequence
  Synthetic
gggaacatcaccccccattatggggaagaactgacaaggggtgacgccgtcccagccgcccctataacacccccc

SEQ ID NO: 178018 - DNA, 75 bp, Artificial Sequence
  Synthetic
tgtttttgtctctttaaaggccgaagtatgtgatcagtcacattctcccacgcgaaagcaaggcagatacggccg

SEQ ID NO: 178019 - DNA, 75 bp, Artificial Sequence
  Synthetic
gtatgtgatcagtcacattctcccacgcgaaagcaaggcagatacggccgcgtgtcatcgaaagcatacacaaga

SEQ ID NO: 178020 - DNA, 75 bp, Artificial Sequence
  Synthetic
ttactcaaatgggaacaatggcgccaccttgctgtctttgtaggcattagaagaaaaggatgcacaactatgttt

SEQ ID NO: 178021 - DNA, 75 bp, Artificial Sequence
  Synthetic
accttgctgtctttgtaggcattagaagaaaaggatgcacaactatgtttcctagcggcgagattggaggcacat

SEQ ID NO: 178022 - DNA, 75 bp, Artificial Sequence
  Synthetic
gccagcgtcgccaacggacgcgccactcccaccatgttgaagcttggttgtgccgtcgtccgggagaaccatgcc

SEQ ID NO: 178023 - DNA, 75 bp, Artificial Sequence
  Synthetic
ctcccaccatgttgaagcttggttgtgccgtcgtccgggagaaccatgccagactttgtgtggtaagaaggaatt

SEQ ID NO: 178024 - DNA, 75 bp, Artificial Sequence
  Synthetic
gggattaataaccatgagttccacacagattcgcacagaaatccctgtggcgctcctaatcctatgcctttgtct

SEQ ID NO: 178025 - DNA, 75 bp, Artificial Sequence
  Synthetic
cagattcgcacagaaatccctgtggcgctcctaatcctatgcctttgtctggtggcgtgccatgccaattgtccc

SEQ ID NO: 178026 - DNA, 75 bp, Artificial Sequence
  Synthetic
ttatcaggactggctaggcaggatgaactgttcctacgagaatatgacggccctagaggccgtctccctaaacgg

SEQ ID NO: 178027 - DNA, 75 bp, Artificial Sequence
  Synthetic
aactgttcctacgagaatatgacggccctagaggccgtctccctaaacgggaccagactagcagctggatctccg

SEQ ID NO: 178028 - DNA, 75 bp, Artificial Sequence
  Synthetic
tgggtctggagaagatgcaatagatgaatcggggtcgggggaggaagagcgtcccgtgacctcccacgtgacttt

SEQ ID NO: 178029 - DNA, 75 bp, Artificial Sequence
  Synthetic
acagaactgaccgatgccttaatatcagccttttcaggtgtattacacgtttcaactgtaatccctcgcaattgg

SEQ ID NO: 178030 - DNA, 75 bp, Artificial Sequence
  Synthetic
ctacaggatcatattcatctggggaaccatccaggaccacgcgaattcgcgtatcaccggtcgcagaaaacggca

SEQ ID NO: 178031 - DNA, 75 bp, Artificial Sequence
  Synthetic
accatccaggaccacgcgaattcgcgtatcaccggtcgcagaaaacggcagaaatagtggtgctagtaaccgtgt

SEQ ID NO: 178032 - DNA, 75 bp, Artificial Sequence
  Synthetic
atgcagaaatacggacccatctttacatactatgggctgtgggtttattgctgggacttgtccttatactttacc

SEQ ID NO: 178033 - DNA, 75 bp, Artificial Sequence
  Synthetic
cacgtgattcttccgcaccggacactaaaatactggcatacccgaatacattgggtgggtccctattcacttcct

SEQ ID NO: 178034 - DNA, 75 bp, Artificial Sequence
  Synthetic
catactatgggctgtgggtttattgctgggacttgtccttatactttacctgtgcgttccacgatgccggcgtaa

SEQ ID NO: 178035 - DNA, 75 bp, Artificial Sequence
  Synthetic
attgttcacatgataaagagtggtactctttactggtttgggggttgggttgtggcgtggtggctggtccgcggt

SEQ ID NO: 178036 - DNA, 75 bp, Artificial Sequence
  Synthetic
ctctttactggtttgggggttgggttgtggcgtggtggctggtccgcggttcagtcatcaacccccgcccgtgtt

SEQ ID NO: 178037 - DNA, 75 bp, Artificial Sequence
  Synthetic
ggtgcccccgtctgacatgcagacgtcgattctaagcgaaagtcccttcagggcatcgtccacttgcttttgtgt

SEQ ID NO: 178038 - DNA, 75 bp, Artificial Sequence
  Synthetic
tcgattctaagcgaaagtcccttcagggcatcgtccacttgcttttgtgttacaaccttgctgaatattgtcctg

SEQ ID NO: 178039 - DNA, 75 bp, Artificial Sequence
  Synthetic
agcggtaagctgcgcttccttctcggtggccgtcagaggccgatctctcggatcggcagtggatcccagtgcttt

SEQ ID NO: 178040 - DNA, 75 bp, Artificial Sequence
  Synthetic
gtggccgtcagaggccgatctctcggatcggcagtggatcccagtgctttccgaagctcccgattctccacagtc

SEQ ID NO: 178041 - DNA, 75 bp, Artificial Sequence
  Synthetic
tctgcccctgggcgcggccatgtcaggtacgcgtagatgtacgtgttggtgatgctcacaacaaaagcccaaatc

SEQ ID NO: 178042 - DNA, 75 bp, Artificial Sequence
  Synthetic
taaatgcagcattccagtaacaagagacgccttgttaaaactttgccacacataaaggcaccatagaaaaatgag

SEQ ID NO: 178043 - DNA, 75 bp, Artificial Sequence
  Synthetic
tccacaaacttgaaaaaacaaagatataccagatagaaaaatgtggccacgacgactagtaacgcgttaatcaag

SEQ ID NO: 178044 - DNA, 75 bp, Artificial Sequence
  Synthetic
ataccagatagaaaaatgtggccacgacgactagtaacgcgttaatcaaggcccagacgctagaaaagctagaaa

SEQ ID NO: 178045 - DNA, 75 bp, Artificial Sequence
  Synthetic
gtagtgactgatgtgggaccgggcgaaggcctggcgctgagcccagccgtactgggactagaacgctctgtagat

SEQ ID NO: 178046 - DNA, 75 bp, Artificial Sequence
  Synthetic
gatgcgacacctgtcgagttggccgtaacccagcagtgacctagtatcgaggccacaaataaagccagggccacc

SEQ ID NO: 178047 - DNA, 75 bp, Artificial Sequence
  Synthetic
acgttccgcgttcgcctcttatatacactctgcaatgcagtccgactctgcccctctacccagggtggaatatgt

SEQ ID NO: 178048 - DNA, 75 bp, Artificial Sequence
  Synthetic
cactctgcaatgcagtccgactctgcccctctacccagggtggaatatgtgttcgaaacaagcaaatttagaatg

SEQ ID NO: 178049 - DNA, 75 bp, Artificial Sequence
  Synthetic
actggtgagaccccacgagccgttcatcatgcccaccggaatacacttcacgcgaacccctagctgcgctttcat

SEQ ID NO: 178050 - DNA, 75 bp, Artificial Sequence
  Synthetic
gtattttgccacacgggcctaatcgacggaggctaccgcggggagatacaggttattttactcaacaagaggaag

SEQ ID NO: 178051 - DNA, 75 bp, Artificial Sequence
  Synthetic
ggttattttactcaacaagaggaagtaccctgtgacgctgtatcgcggggagctcaacatctgcctgtctgcttt

SEQ ID NO: 178052 - DNA, 75 bp, Artificial Sequence
  Synthetic
taccctgtgacgctgtatcgcggggagctcaacatctgcctgtctgctttcaattacgtgctacctccgttgagg

SEQ ID NO: 178053 - DNA, 75 bp, Artificial Sequence
  Synthetic
cgtgatggtgatgcactctatggttatccctcctactactgaccaaccgttcatgatatacctaggagtggagac

SEQ ID NO: 178054 - DNA, 75 bp, Artificial Sequence
  Synthetic
atccctcctactactgaccaaccgttcatgatatacctaggagtggagaccccaggcccccctgaaccccacgtg

SEQ ID NO: 178055 - DNA, 75 bp, Artificial Sequence
  Synthetic
cgttagtgagtggggaccgcgaggattgcagctgaagttttataactactcggggcagccgtggctggcgcagcc

SEQ ID NO: 178056 - DNA, 75 bp, Artificial Sequence
  Synthetic
ttgcagctgaagttttataactactcggggcagccgtggctggcgcagcccggtagccgcatatgccagattgtg

SEQ ID NO: 178057 - DNA, 75 bp, Artificial Sequence
  Synthetic
taggaagctagctcctggcgtccgtttccgggaggctcgagtgcattttcgcgaggatacaaatagcgtccgaaa

SEQ ID NO: 178058 - DNA, 75 bp, Artificial Sequence
  Synthetic
cacgaacccaacgtagccaccgcttccgctgacattcgtggaaccaaggggctggggtcgtctgggttttagagc

SEQ ID NO: 178059 - DNA, 75 bp, Artificial Sequence
  Synthetic
gctggggtcgtctgggttttagagccgccgccaaatgcggccagtttattagggcgattcgatcccgcaacccac

SEQ ID NO: 178060 - DNA, 75 bp, Artificial Sequence
  Synthetic
cgccgccaaatgcggccagtttattagggcgattcgatcccgcaacccacagcatcccccaaataaaaaaacgag

SEQ ID NO: 178061 - DNA, 75 bp, Artificial Sequence
  Synthetic
gatacaaggctcgtaaattgttacagctgcaaaaaacagataagatgaagagtatcctggaaatgggggaaggga

SEQ ID NO: 178062 - DNA, 75 bp, Artificial Sequence
  Synthetic
gaataaagccaacctatgtcgaacctatcgcgctttctgtcgtctcttccagggttgacgaaggccggggaggga

SEQ ID NO: 178063 - DNA, 75 bp, Artificial Sequence
  Synthetic
tatcgcgctttctgtcgtctcttccagggttgacgaaggccggggagggattgacgaatgcatcgcggaaacgga

SEQ ID NO: 178064 - DNA, 75 bp, Artificial Sequence
  Synthetic
gatcccggcgcgccaccctccccggagggggatcccggcgcgccaccctccccggcaacaacctgttgccatgta

SEQ ID NO: 178065 - DNA, 75 bp, Artificial Sequence
  Synthetic
tagtaacacatccgggacatgaactgccacaaacaccgttaagcctctatccatgcattcggattggagtgagga

SEQ ID NO: 178066 - DNA, 75 bp, Artificial Sequence
  Synthetic
ttcctggggtgcgccgcgccgggttcctggggtgcgccgcgccgggttcctggggtgcgggggggggaccgcgcc

SEQ ID NO: 178067 - DNA, 75 bp, Artificial Sequence
  Synthetic
ccaggagccccggcagcaccccaggagccccggcagcaccccaggagccccggcagcaccccaggagccccggca

SEQ ID NO: 178068 - DNA, 75 bp, Artificial Sequence
  Synthetic
cggcaggcgtgagaggcaatacagaagtgggttccgacaaggagtggctgatctcagaggcccatattaccgagt

SEQ ID NO: 178069 - DNA, 75 bp, Artificial Sequence
  Synthetic
ggtaatctcgccgaccgccaaggccagcattgtgttccacacgacgttctgaatagactgcagttttttcacctg

SEQ ID NO: 178070 - DNA, 75 bp, Artificial Sequence
  Synthetic
ggttttcacggtctcctggcagcccgccggaattttagccacgtcaaaacgcttcaggtagtctgtgatcttgtt

SEQ ID NO: 178071 - DNA, 75 bp, Artificial Sequence
  Synthetic
gccggaattttagccacgtcaaaacgcttcaggtagtctgtgatcttgtttgactgtacagccagaaggtaggtc

SEQ ID NO: 178072 - DNA, 75 bp, Artificial Sequence
  Synthetic
cactccgggggggaggcccaaatctatctcttgccgccagcgctctggacagccttccagagggtcaccgaggcg

SEQ ID NO: 178073 - DNA, 75 bp, Artificial Sequence
  Synthetic
atctcttgccgccagcgctctggacagccttccagagggtcaccgaggcgcttgtaagcgtggttgccgcgtcca

SEQ ID NO: 178074 - DNA, 75 bp, Artificial Sequence
  Synthetic
gccgcgaggcgctgacagtaagggttattttttgtacgagtggcgacagcgccgagacgatcgccgacgtcctta

SEQ ID NO: 178075 - DNA, 75 bp, Artificial Sequence
  Synthetic
tattttttgtacgagtggcgacagcgccgagacgatcgccgacgtccttacgggggccccaacgtcagcgtcctt

SEQ ID NO: 178076 - DNA, 75 bp, Artificial Sequence
  Synthetic
taaccctaaaattgtgcctccccgcacggcgtcctggcaacggcacaaggtgttcgcccgtgttggtcctacgta

SEQ ID NO: 178077 - DNA, 75 bp, Artificial Sequence
  Synthetic
cgtgcactttccagagccaggtggcctggctcagaacgaaatttgttaccgcattgagaaaactttacaagatga

SEQ ID NO: 178078 - DNA, 75 bp, Artificial Sequence
  Synthetic
ctggctcagaacgaaatttgttaccgcattgagaaaactttacaagatgactccctcaccctactggatgctgtc

SEQ ID NO: 178079 - DNA, 75 bp, Artificial Sequence
  Synthetic
tttttgaacacactgtggtctgtaccacagagacagtttctcacctgtctagactgttttcgcctcaacagggac

SEQ ID NO: 178080 - DNA, 75 bp, Artificial Sequence
  Synthetic
cacagagacagtttctcacctgtctagactgttttcgcctcaacagggacagacgctggtttccgttaccagcca

SEQ ID NO: 178081 - DNA, 75 bp, Artificial Sequence
  Synthetic
aatatggcggaacttgatctatataccaccaatgtgtcatttatggggcgcacatatcgtctggacgtagacaac

SEQ ID NO: 178082 - DNA, 75 bp, Artificial Sequence
  Synthetic
ccgcgttcgtcgcttatgtaaaagagaaattagcgagagacagtctggagacggaggccatcgaccgcaccatag

SEQ ID NO: 178083 - DNA, 75 bp, Artificial Sequence
  Synthetic
gtctaaccaggacctggtccatttcatatatatctccttttatcagtgcctcaacaaacgggcgttcctgcgcta

SEQ ID NO: 178084 - DNA, 75 bp, Artificial Sequence
  Synthetic
ctcaattgtgtggcgccctacacggggagtttcgtgaccacgtccagtcctactaccacaaaaaaacctacctat

SEQ ID NO: 178085 - DNA, 75 bp, Artificial Sequence
  Synthetic
ccacttacatagacattcggtacgtgggtggcgtattaccagacggctattttggcgggagtcttgtaggcgagc

SEQ ID NO: 178086 - DNA, 75 bp, Artificial Sequence
  Synthetic
accattagccaacaggtgccgcacctgaggttgcaaaacgagttcgctggcatgctagacgtggccgcactgcga

SEQ ID NO: 178087 - DNA, 75 bp, Artificial Sequence
  Synthetic
tgaggttgcaaaacgagttcgctggcatgctagacgtggccgcactgcgaggttccgatgacggtcagtttaaag

SEQ ID NO: 178088 - DNA, 75 bp, Artificial Sequence
  Synthetic
ctgggcaagcagtttttcacaatgcttcaggaagacggcctagagcgatactgggagcaaagtgtgatatttcca

SEQ ID NO: 178089 - DNA, 75 bp, Artificial Sequence
  Synthetic
ttcaggaagacggcctagagcgatactgggagcaaagtgtgatatttccaggcgaccaggactgggatatgttat

SEQ ID NO: 178090 - DNA, 75 bp, Artificial Sequence
  Synthetic
ctgccaacactgaaggaacagctccttgtttcaagacacgaatacttcaaccctcgcttgccagtgtatagatgg

SEQ ID NO: 178091 - DNA, 75 bp, Artificial Sequence
  Synthetic
ttgtttcaagacacgaatacttcaaccctcgcttgccagtgtatagatgggtattagactttgacctgcccgtct

SEQ ID NO: 178092 - DNA, 75 bp, Artificial Sequence
  Synthetic
ctgcgtgaggccatactcgacatcattcaactccttggaccagtggatcctcgaacacacccagtatattttttc

SEQ ID NO: 178093 - DNA, 75 bp, Artificial Sequence
  Synthetic
ttcaactccttggaccagtggatcctcgaacacacccagtatattttttcaaatcagcctgtccaccggacgagt

SEQ ID NO: 178094 - DNA, 75 bp, Artificial Sequence
  Synthetic
ctgggtatgcgtattatcgtcccgttcccagaaggagtatgcgtcgttgggtcggagcccatggtggcactcact

SEQ ID NO: 178095 - DNA, 75 bp, Artificial Sequence
  Synthetic
tcccagaaggagtatgcgtcgttgggtcggagcccatggtggcactcactggcattctaaacaggacgataaagc

SEQ ID NO: 178096 - DNA, 75 bp, Artificial Sequence
  Synthetic
cctttcgactgtggcatatacggccgaggacgaagcgtccggcttccccactgttacaaggtgggcttagtgggg

SEQ ID NO: 178097 - DNA, 75 bp, Artificial Sequence
  Synthetic
gaggacgaagcgtccggcttccccactgttacaaggtgggcttagtgggggaactctgccgcctactgaagatac

SEQ ID NO: 178098 - DNA, 75 bp, Artificial Sequence
  Synthetic
tttacgcttcgcgaactgctccatcactccccgggccacagcgccggtcatgtcggccgaatcatctatagcatc

SEQ ID NO: 178099 - DNA, 75 bp, Artificial Sequence
  Synthetic
actccccgggccacagcgccggtcatgtcggccgaatcatctatagcatcatggatcgcaatgagaattttttag

SEQ ID NO: 178100 - DNA, 75 bp, Artificial Sequence
  Synthetic
cggatagagaccctatccggtcgttcaatagaggactggctacactcggccgtttgggataaagcatacgacact

SEQ ID NO: 178101 - DNA, 75 bp, Artificial Sequence
  Synthetic
caatagaggactggctacactcggccgtttgggataaagcatacgacactatatgtaaatttttcccagatgaaa

SEQ ID NO: 178102 - DNA, 75 bp, Artificial Sequence
  Synthetic
atccagttaagaccccgtcagggaagacacttcctctgcatcaaccataatcataaaaacaagtcaaaaacagtc

SEQ ID NO: 178103 - DNA, 75 bp, Artificial Sequence
  Synthetic
gacacttcctctgcatcaaccataatcataaaaacaagtcaaaaacagtccgtgtattccttacccttcattcca

SEQ ID NO: 178104 - DNA, 75 bp, Artificial Sequence
  Synthetic
aagtgtaacaataatgttcccacggcccatttttcgtttgtggtaccagtgggactggccagttaatcccactat

SEQ ID NO: 178105 - DNA, 75 bp, Artificial Sequence
  Synthetic
cccatttttcgtttgtggtaccagtgggactggccagttaatcccactatataacctggctgccaggttcccaaa

SEQ ID NO: 178106 - DNA, 75 bp, Artificial Sequence
  Synthetic
atataagaaccaaaggacatggtacaagcaatgatagacatggacattatgaagggcatcctagagggtaagtcc

SEQ ID NO: 178107 - DNA, 75 bp, Artificial Sequence
  Synthetic
aagcaatgatagacatggacattatgaagggcatcctagagggtaagtcctcgtctacaacagacttttcccatt

SEQ ID NO: 178108 - DNA, 75 bp, Artificial Sequence
  Synthetic
tcatttatcgcgtttgatattacagactctgtgtcctcctctgagtttgacgaatcgagggacgacgagacggac

SEQ ID NO: 178109 - DNA, 75 bp, Artificial Sequence
  Synthetic
actctgtgtcctcctctgagtttgacgaatcgagggacgacgagacggacgcaccgacactggaagacgagcaat

SEQ ID NO: 178110 - DNA, 75 bp, Artificial Sequence
  Synthetic
tcggcccagggaatcccaccccccctgggccgcatcccaaaaaaatctcaaggtcgttctcaactgcgcagtgag

SEQ ID NO: 178111 - DNA, 75 bp, Artificial Sequence
  Synthetic
tgggccgcatcccaaaaaaatctcaaggtcgttctcaactgcgcagtgagatccagttttgctccccactgtctc

SEQ ID NO: 178112 - DNA, 75 bp, Artificial Sequence
  Synthetic
ggaaccgccggtcaaaacacacgtcctccccctgaaaagcgtcctcggcgcagaccacgcgaccgcctacaatac

SEQ ID NO: 178113 - DNA, 75 bp, Artificial Sequence
  Synthetic
ctccccctgaaaagcgtcctcggcgcagaccacgcgaccgcctacaatacggcagaacaacacggggcggacagt

SEQ ID NO: 178114 - DNA, 75 bp, Artificial Sequence
  Synthetic
cggcaggatgacgacgtcagacagggtgtgtctgacgccgtaaagaaactcagactccctgcgagcatgataatt

SEQ ID NO: 178115 - DNA, 75 bp, Artificial Sequence
  Synthetic
gtgtgtctgacgccgtaaagaaactcagactccctgcgagcatgataattgacggtgagagcccccgcttcgacg

SEQ ID NO: 178116 - DNA, 75 bp, Artificial Sequence
  Synthetic
gccccaccatcccacgtcccggaggtgtttacggacagggatatcaccgctctcataagagcagggggcaaagac

SEQ ID NO: 178117 - DNA, 75 bp, Artificial Sequence
  Synthetic
gacgaactcataaacaaaaaaatcagcgcaaaaaagattgaccacctccacagacagatgctgtcttttgtgacc

SEQ ID NO: 178118 - DNA, 75 bp, Artificial Sequence
  Synthetic
cgccggaggcctgcaaacgcttggggctttcgtggaggaacaaatgacgtgggcccagacggttgtgcgccacgg

SEQ ID NO: 178119 - DNA, 75 bp, Artificial Sequence
  Synthetic
gatataattttggacaccgcaatatttgtctgcaatgcgtttgttaccagatttagattacttcatctttcctgc

SEQ ID NO: 178120 - DNA, 75 bp, Artificial Sequence
  Synthetic
ggtagcgatgggaaaccgcttagtagaggcatgtaaccttcttggcgaggtcaagcttaacttcaggggagggct

SEQ ID NO: 178121 - DNA, 75 bp, Artificial Sequence
  Synthetic
gaggcatgtaaccttcttggcgaggtcaagcttaacttcaggggagggctgctcttggcctttgtcctaactatc

SEQ ID NO: 178122 - DNA, 75 bp, Artificial Sequence
  Synthetic
tagaacacttctggaatactacaggccaggggatgtgatggggctactaaacgtgatagtaatggaacatcacag

SEQ ID NO: 178123 - DNA, 75 bp, Artificial Sequence
  Synthetic
ccaggggatgtgatggggctactaaacgtgatagtaatggaacatcacagcttgtgcagaaacagtgaatgtgca

SEQ ID NO: 178124 - DNA, 75 bp, Artificial Sequence
  Synthetic
cttttatccactttcttaaggattgccaaaccccatggcagagtgtctcccgtattccatgtaactcacgtagcc

SEQ ID NO: 178125 - DNA, 75 bp, Artificial Sequence
  Synthetic
atcgcaccttaaacacaacaccagaccgccaccaggtggcacccaacatccattatggaaaaaccccgcgccacc

SEQ ID NO: 178126 - DNA, 75 bp, Artificial Sequence
  Synthetic
tctttattgatatgatatactccctcccataacaatacggtgtaggcattttgtattatttattgcatggcatcc

SEQ ID NO: 178127 - DNA, 75 bp, Artificial Sequence
  Synthetic
gtacgacgcaggcgtctgagaaattactgcacctcgccgcaaagtctcgcggggacggggcgtggggctctaact

SEQ ID NO: 178128 - DNA, 75 bp, Artificial Sequence
  Synthetic
acgtgagagggtgctggtaacggtgaatttgccaaccccaccagaaatgtattcgggttaaatatcctcgtcggt

SEQ ID NO: 178129 - DNA, 75 bp, Artificial Sequence
  Synthetic
aatttgccaaccccaccagaaatgtattcgggttaaatatcctcgtcggttttccctggggcagcaagagggggc

SEQ ID NO: 178130 - DNA, 75 bp, Artificial Sequence
  Synthetic
taacatacgcaaaatatgccattacaagagctagtcagcagaatgccttttgcacatgcgtccagcgtatcgcat

SEQ ID NO: 178131 - DNA, 75 bp, Artificial Sequence
  Synthetic
aagagctagtcagcagaatgccttttgcacatgcgtccagcgtatcgcatagctcccgcttggctatctcgcagg

SEQ ID NO: 178132 - DNA, 75 bp, Artificial Sequence
  Synthetic
cagtaatgaactgcggggtccctacgcaaggccgatgagattcgacagcccgactggcttgtcgtcagtaactca

SEQ ID NO: 178133 - DNA, 75 bp, Artificial Sequence
  Synthetic
gcaaggccgatgagattcgacagcccgactggcttgtcgtcagtaactcatgaacctgttcgccattataataca

SEQ ID NO: 178134 - DNA, 75 bp, Artificial Sequence
  Synthetic
gtcgtacaagatggcacgggcgttacaatctcgcctggcaagcactgccccggggaaaaaaatccctcttgcaag

SEQ ID NO: 178135 - DNA, 75 bp, Artificial Sequence
  Synthetic
caatctcgcctggcaagcactgccccggggaaaaaaatccctcttgcaagagacgtgccatattgttaaaatcgt

SEQ ID NO: 178136 - DNA, 75 bp, Artificial Sequence
  Synthetic
ttacgtactctaaagaccagaaaatggtgtccatcctgagaaatgcctttgccaatctcttgtaaaccccgcgtc

SEQ ID NO: 178137 - DNA, 75 bp, Artificial Sequence
  Synthetic
ggtgtccatcctgagaaatgcctttgccaatctcttgtaaaccccgcgtcctgcgtagcgcggcaagcattcgcc

SEQ ID NO: 178138 - DNA, 75 bp, Artificial Sequence
  Synthetic
tcgcggatatacacaacacccaattccccgtctctgcgccattcaaaacaggggtccgcgaggggcgtaactggt

SEQ ID NO: 178139 - DNA, 75 bp, Artificial Sequence
  Synthetic
ccccgtctctgcgccattcaaaacaggggtccgcgaggggcgtaactggtatacggaagcgggtgcgctcttcgt

SEQ ID NO: 178140 - DNA, 75 bp, Artificial Sequence
  Synthetic
caatccttgattgacgctttcccctcactggcaccggtagatattcttagttgtcgtgtccggctccactccgtt

SEQ ID NO: 178141 - DNA, 75 bp, Artificial Sequence
  Synthetic
cactggcaccggtagatattcttagttgtcgtgtccggctccactccgttatcgcagccaccacagcctgccgtg

SEQ ID NO: 178142 - DNA, 75 bp, Artificial Sequence
  Synthetic
ggtgactccgacctggatggttcatcgcaaggagccccggagccagatgttcccggtgacccttgtgacaaacaa

SEQ ID NO: 178143 - DNA, 75 bp, Artificial Sequence
  Synthetic
cgcaaggagccccggagccagatgttcccggtgacccttgtgacaaacaaggttttttgggtatcgccccaggcg

SEQ ID NO: 178144 - DNA, 75 bp, Artificial Sequence
  Synthetic
tagctcgcgccgcaatgtccagtggtaagcacagctatgccggggagccaccggccatcagatatagagaggcga

SEQ ID NO: 178145 - DNA, 75 bp, Artificial Sequence
  Synthetic
taagcacagctatgccggggagccaccggccatcagatatagagaggcgacaggctctctatatatcacggctag

SEQ ID NO: 178146 - DNA, 75 bp, Artificial Sequence
  Synthetic
aaccagcgtttctcaaattaaccgaaactacatttttctattttaagtacgggatacaaagcagggtctgaggca

SEQ ID NO: 178147 - DNA, 75 bp, Artificial Sequence
  Synthetic
aagagcactctacctattaactcgtggagaaacatcatacaaaatctgtacattatttttaatactttaatttgt

SEQ ID NO: 178148 - DNA, 75 bp, Artificial Sequence
  Synthetic
gcagggtcccgcctatagccaactcctaagcgggttttttgctaaagcacttttttagactgtcccagaaaccac

SEQ ID NO: 178149 - DNA, 75 bp, Artificial Sequence
  Synthetic
ctaagcgggttttttgctaaagcacttttttagactgtcccagaaaccacatagcttccttttcactcatttgaa

SEQ ID NO: 178150 - DNA, 75 bp, Artificial Sequence
  Synthetic
cgcgcctttaccgctggtgcgaaatctagccatcctatcaccgcggatccgctggaccaatataccacgcccact

SEQ ID NO: 178151 - DNA, 75 bp, Artificial Sequence
  Synthetic
ttatttggactacaagattacatccggttttataattcacatatatgatcaatgtagactatcccaaatggagcc

SEQ ID NO: 178152 - DNA, 75 bp, Artificial Sequence
  Synthetic
ccggggatgcgccgaaaaataccgtcccgcacgtcactgggttgacgctcagcggtgtctgtgggattgcggctg

SEQ ID NO: 178153 - DNA, 75 bp, Artificial Sequence
  Synthetic
cccgcacgtcactgggttgacgctcagcggtgtctgtgggattgcggctgtggttgccaggtatcgcgcggtgtt

SEQ ID NO: 178154 - DNA, 75 bp, Artificial Sequence
  Synthetic
agcgggaatttggattaccaaaccaccagccttccacttgagtggcgtttctggagtatattccagacatcgagc

SEQ ID NO: 178155 - DNA, 75 bp, Artificial Sequence
  Synthetic
ccagccttccacttgagtggcgtttctggagtatattccagacatcgagcaaaatattgggaatccgtggccaag

SEQ ID NO: 178156 - DNA, 75 bp, Artificial Sequence
  Synthetic
taagacgcggtatgcgaagcagttctggtacgaaactctgacataggtgccccaacgtatccccaacaggccagc

SEQ ID NO: 178157 - DNA, 75 bp, Artificial Sequence
  Synthetic
tggtacgaaactctgacataggtgccccaacgtatccccaacaggccagctacataacattgcctcgcccgcgtc

SEQ ID NO: 178158 - DNA, 75 bp, Artificial Sequence
  Synthetic
caacaaaagacacccgctgactatcagggggatcaaaaaacatctttgaaggtggcttttcgggaccggagtggc

SEQ ID NO: 178159 - DNA, 75 bp, Artificial Sequence
  Synthetic
agggggatcaaaaaacatctttgaaggtggcttttcgggaccggagtggctaacgggcgtacgccgcccgtgcgg

SEQ ID NO: 178160 - DNA, 75 bp, Artificial Sequence
  Synthetic
tcggttcctcctgcagctcagacaaaatgttacccaacccttcttcccacgtacatatatcctctccttgaaggt

SEQ ID NO: 178161 - DNA, 75 bp, Artificial Sequence
  Synthetic
aatgttacccaacccttcttcccacgtacatatatcctctccttgaaggttcgagagcgtaagagggagacccaa

SEQ ID NO: 178162 - DNA, 75 bp, Artificial Sequence
  Synthetic
tatctccagcatatgtactaacaagtggaactctgggcctttcgccactacccgggcacacacactcccgccgct

SEQ ID NO: 178163 - DNA, 75 bp, Artificial Sequence
  Synthetic
tggaactctgggcctttcgccactacccgggcacacacactcccgccgctccagctctgtcggtaaatgcgaaac

SEQ ID NO: 178164 - DNA, 75 bp, Artificial Sequence
  Synthetic
aaacgcgcggcccactgacaggtaggggcgtggatgctacagtggtagatggggtatcggaatccccagtgaggt

SEQ ID NO: 178165 - DNA, 75 bp, Artificial Sequence
  Synthetic
gggcgtggatgctacagtggtagatggggtatcggaatccccagtgaggtcaataatctccacttcgagggcacc

SEQ ID NO: 178166 - DNA, 75 bp, Artificial Sequence
  Synthetic
agacgtacggtattccagacgaggatggctcctgtcgctctgccacctctggggtgggtggtgcgccggcggagg

SEQ ID NO: 178167 - DNA, 75 bp, Artificial Sequence
  Synthetic
tggctcctgtcgctctgccacctctggggtgggtggtgcgccggcggagggcgtggccgacgcgccaccctgcgt

SEQ ID NO: 178168 - DNA, 75 bp, Artificial Sequence
  Synthetic
gcggtgtgcgaacttccggcaccacggcgtgaccaactggtgggtgccaaacaggcgcgcgtatgggtcgcgtag

SEQ ID NO: 178169 - DNA, 75 bp, Artificial Sequence
  Synthetic
ggcgtgaccaactggtgggtgccaaacaggcgcgcgtatgggtcgcgtagctggcggttctgccaatggactcca

SEQ ID NO: 178170 - DNA, 75 bp, Artificial Sequence
  Synthetic
gaggttcgaagggatacacccgctcactcgcagcaccctgaggagcccggccttctgtagatgccccgcaagcgc

SEQ ID NO: 178171 - DNA, 75 bp, Artificial Sequence
  Synthetic
actcgcagcaccctgaggagcccggccttctgtagatgccccgcaagcgccttcggcaccggtttcccggcgggg

SEQ ID NO: 178172 - DNA, 75 bp, Artificial Sequence
  Synthetic
ccagaggtgcaccctggctgaactcaccgacaaatgttcccgcttgggcgtgcggcggaatccaactgggggcag

SEQ ID NO: 178173 - DNA, 75 bp, Artificial Sequence
  Synthetic
accgacaaatgttcccgcttgggcgtgcggcggaatccaactgggggcagcaggattcagctggctgctaggaat

SEQ ID NO: 178174 - DNA, 75 bp, Artificial Sequence
  Synthetic
gcggatgcactttctccgggagaccagacgcgccctgaggccaccatcccgtgacaggaagatctccccatggaa

SEQ ID NO: 178175 - DNA, 75 bp, Artificial Sequence
  Synthetic
agacgcgccctgaggccaccatcccgtgacaggaagatctccccatggaaaacacgcaggtatccacggggacgt

SEQ ID NO: 178176 - DNA, 75 bp, Artificial Sequence
  Synthetic
cccccggcgtctgtgcgacgccggagacccctgacacagtaccggcaagccgtgtttcgtgctgcggcttgggcg

SEQ ID NO: 178177 - DNA, 75 bp, Artificial Sequence
  Synthetic
gacccctgacacagtaccggcaagccgtgtttcgtgctgcggcttgggcggcgccgtgcccggtaggcctgcacc

SEQ ID NO: 178178 - DNA, 75 bp, Artificial Sequence
  Synthetic
ctccgggaacccgccacgtaaaggacgaggcctgcgtaacttgtcgcgtcccagaggaccccatacctgaggtag

SEQ ID NO: 178179 - DNA, 75 bp, Artificial Sequence
  Synthetic
cgaggcctgcgtaacttgtcgcgtcccagaggaccccatacctgaggtagatgcgccctcattcactggtatcca

SEQ ID NO: 178180 - DNA, 75 bp, Artificial Sequence
  Synthetic
agcggttcgatttccgagggcgacccctcagccccgatggcgccttagggggagcaggtgctgcagcccctgcct

SEQ ID NO: 178181 - DNA, 75 bp, Artificial Sequence
  Synthetic
cctcagccccgatggcgccttagggggagcaggtgctgcagcccctgcctcctcgtagctttgttctctaagtaa

SEQ ID NO: 178182 - DNA, 75 bp, Artificial Sequence
  Synthetic
accaacgcatcaaacctcacacccccttccccgagttacatacctagtgtcactgcgtcgcgtagccgtggtttg

SEQ ID NO: 178183 - DNA, 75 bp, Artificial Sequence
  Synthetic
cttccccgagttacatacctagtgtcactgcgtcgcgtagccgtggtttgcattgggggggacaacagacactga

SEQ ID NO: 178184 - DNA, 75 bp, Artificial Sequence
  Synthetic
acagtttttaaacggcgttcgcaccaactgccatactacgtagctaccaccaaatgtgtcgctgtaccgtaaatc

SEQ ID NO: 178185 - DNA, 75 bp, Artificial Sequence
  Synthetic
aactgccatactacgtagctaccaccaaatgtgtcgctgtaccgtaaatcgttccgcacgacggccctcctggtt

SEQ ID NO: 178186 - DNA, 75 bp, Artificial Sequence
  Synthetic
cgatggtccgtagactctatcacactcctcatcaaatgcatggtacaccgaataccagccaggcgggatatcgct

SEQ ID NO: 178187 - DNA, 75 bp, Artificial Sequence
  Synthetic
tcctcatcaaatgcatggtacaccgaataccagccaggcgggatatcgctgccggcaggcaggggcgcgggggct

SEQ ID NO: 178188 - DNA, 75 bp, Artificial Sequence
  Synthetic
gttttcaagggcatcaataatccataacgtggcccattctgagccaccggctttaggcatggtccgacacagaaa

SEQ ID NO: 178189 - DNA, 75 bp, Artificial Sequence
  Synthetic
aacgtggcccattctgagccaccggctttaggcatggtccgacacagaaaccgatcggcgttcgtctttgaggca

SEQ ID NO: 178190 - DNA, 75 bp, Artificial Sequence
  Synthetic
cacgaccgttacgcaaatttgaggagctactcacctaaaagtagctcctttgacaaatgtcctggttttatacca

SEQ ID NO: 178191 - DNA, 75 bp, Artificial Sequence
  Synthetic
gctactcacctaaaagtagctcctttgacaaatgtcctggttttataccaattgttcacaatgacatattgtgct

SEQ ID NO: 178192 - DNA, 75 bp, Artificial Sequence
  Synthetic
tgtgccatcatattgtgtggcacaaaaaaagcaacttttcacgcacgcagcataagacccgagccagtcgcgccc

SEQ ID NO: 178193 - DNA, 75 bp, Artificial Sequence
  Synthetic
aaaaagcaacttttcacgcacgcagcataagacccgagccagtcgcgccctccatcgcgcctgcgaattttccca

SEQ ID NO: 178194 - DNA, 75 bp, Artificial Sequence
  Synthetic
cacgccccttaagctgtcctctctcccaaggggactagattataacagtgacatacgaaaccgagacgctctcaa

SEQ ID NO: 178195 - DNA, 75 bp, Artificial Sequence
  Synthetic
ccaaggggactagattataacagtgacatacgaaaccgagacgctctcaaatgctttctattttatttatcgatt

SEQ ID NO: 178196 - DNA, 75 bp, Artificial Sequence
  Synthetic
ggtaaccctggcttgaggtttcctctgttatcaaacaaacctgaccacaactgtacagagaaaagtgggtgaaat

SEQ ID NO: 178197 - DNA, 75 bp, Artificial Sequence
  Synthetic
tgttatcaaacaaacctgaccacaactgtacagagaaaagtgggtgaaatgtagtgtttattttatcctcacact

SEQ ID NO: 178198 - DNA, 75 bp, Artificial Sequence
  Synthetic
tagtcatcacatgtaactgaacgcaatctgagcttgatgacgagggggaccatatcgaactgttctgccgacgtt

SEQ ID NO: 178199 - DNA, 75 bp, Artificial Sequence
  Synthetic
atctgagcttgatgacgagggggaccatatcgaactgttctgccgacgttgggtcacctccgatgaacacagttg

SEQ ID NO: 178200 - DNA, 75 bp, Artificial Sequence
  Synthetic
acatccagaacagccctagatgacagtccgcagatcacaccaaacttctttggaggattatttccatgatataat

SEQ ID NO: 178201 - DNA, 75 bp, Artificial Sequence
  Synthetic
gtccgcagatcacaccaaacttctttggaggattatttccatgatataatacggtagacttgcacaaattcttaa

SEQ ID NO: 178202 - DNA, 75 bp, Artificial Sequence
  Synthetic
cgcagcacggccgccagcaggttaacgtctcctggccctgtgttattgtcgtcaggtttgggcaacaaaactctt

SEQ ID NO: 178203 - DNA, 75 bp, Artificial Sequence
  Synthetic
cgtctcctggccctgtgttattgtcgtcaggtttgggcaacaaaactcttaaccctttgcgcgaatgcaagcaag

SEQ ID NO: 178204 - DNA, 75 bp, Artificial Sequence
  Synthetic
cgttccacttccaaagacattgcagggcggccaaaataaaacacttccacaccaagcctatcggttatcattact

SEQ ID NO: 178205 - DNA, 75 bp, Artificial Sequence
  Synthetic
ggcggccaaaataaaacacttccacaccaagcctatcggttatcattactggcggccgtgccactctataatatg

SEQ ID NO: 178206 - DNA, 75 bp, Artificial Sequence
  Synthetic
ctccgtggcccatcatcccataaaaattcgccaacaactggccggcgtctggacgccggcggcagtccagcacca

SEQ ID NO: 178207 - DNA, 75 bp, Artificial Sequence
  Synthetic
attcgccaacaactggccggcgtctggacgccggcggcagtccagcaccatcatcgacttcttcgtcacttatct

SEQ ID NO: 178208 - DNA, 75 bp, Artificial Sequence
  Synthetic
tacacatcctctacacccgccccgacagccgaggcggcgattgagccctctgttaccacgccgcttgcatccgtg

SEQ ID NO: 178209 - DNA, 75 bp, Artificial Sequence
  Synthetic
cagccgaggcggcgattgagccctctgttaccacgccgcttgcatccgtgtcgcctccgggctgtgatgttgcga

SEQ ID NO: 178210 - DNA, 75 bp, Artificial Sequence
  Synthetic
gccctcattagcatgtccatctcctgtcccacgtggtacatcaatgcacatgcagattctttatcaagcagtgtg

SEQ ID NO: 178211 - DNA, 75 bp, Artificial Sequence
  Synthetic
gtcccacgtggtacatcaatgcacatgcagattctttatcaagcagtgtgaggtcatcttcaacgttgtctgtgt

SEQ ID NO: 178212 - DNA, 75 bp, Artificial Sequence
  Synthetic
gagggtccttcgtctccagagccaggagagtcggcattggcatcatcaactggctgaaccccagacgcactatgg

SEQ ID NO: 178213 - DNA, 75 bp, Artificial Sequence
  Synthetic
agtcctcagattccgcgcccgtctgcgtgaccggcacatcgcaaaaggctgggtgatcctcctcactggaatccg

SEQ ID NO: 178214 - DNA, 75 bp, Artificial Sequence
  Synthetic
cggactagggtggccaaaccatttgccccacccctccccactctttccccaggggacacatcttaccttggtctt

SEQ ID NO: 178215 - DNA, 75 bp, Artificial Sequence
  Synthetic
ccccacccctccccactctttccccaggggacacatcttaccttggtcttctccgatgcttctcgagccgtacac

SEQ ID NO: 178216 - DNA, 75 bp, Artificial Sequence
  Synthetic
ctggcatgaacgcaccaccagcattcctttacctcggcacacaggaggcgccaccttctacaattaattccctgt

SEQ ID NO: 178217 - DNA, 75 bp, Artificial Sequence
  Synthetic
cctttacctcggcacacaggaggcgccaccttctacaattaattccctgtacgacctcgtactcttcacctggca

SEQ ID NO: 178218 - DNA, 75 bp, Artificial Sequence
  Synthetic
ggcgagcccagtaaatctctgggatgcaggcccttcgataggcattccctcttaaaatcaatgaaaaactgtagg

SEQ ID NO: 178219 - DNA, 75 bp, Artificial Sequence
  Synthetic
gcaggcccttcgataggcattccctcttaaaatcaatgaaaaactgtaggctatccagaggaattacgtcattac

SEQ ID NO: 178220 - DNA, 75 bp, Artificial Sequence
  Synthetic
aaaggatatttatcagagtccaaagcacctacaataaactcagaaatccaggtaagcctgcgtcccgccatgttg

SEQ ID NO: 178221 - DNA, 75 bp, Artificial Sequence
  Synthetic
cacctacaataaactcagaaatccaggtaagcctgcgtcccgccatgttgacctgtcagaatggtctgcctccga

SEQ ID NO: 178222 - DNA, 75 bp, Artificial Sequence
  Synthetic
ttcctgcagctttaaccttcagtcacgggtcaaaaagcattgcctgtattagacacatgtgtttctcactatgaa

SEQ ID NO: 178223 - DNA, 75 bp, Artificial Sequence
  Synthetic
catctggggtgatgctgccccggaccagctttgaaacagggtattgcatgcataatgaagcccacatgtttgtct

SEQ ID NO: 178224 - DNA, 75 bp, Artificial Sequence
  Synthetic
cataatgaagcccacatgtttgtcttactttactaacctcattaccttgcattgcaggggacacccccttgcctt

SEQ ID NO: 178225 - DNA, 75 bp, Artificial Sequence
  Synthetic
atgggcctactataacaggaaacatagaagttgcggatagagcctggtttctaacggcaatgatatttatagtgc

SEQ ID NO: 178226 - DNA, 75 bp, Artificial Sequence
  Synthetic
agacttgtcaaaattttagtctctgtggtaaaatggggcaaggtaaatgtgcaaaatgactggatagtgatccca

SEQ ID NO: 178227 - DNA, 75 bp, Artificial Sequence
  Synthetic
tggtaaaatggggcaaggtaaatgtgcaaaatgactggatagtgatcccagtcatattcaggcgacggccggcgg

SEQ ID NO: 178228 - DNA, 75 bp, Artificial Sequence
  Synthetic
ctccacgtcaaaagcttgttggatctcgtggcggtgggacaggggcctacatttgcctattcttcttcgcgatgc

SEQ ID NO: 178229 - DNA, 75 bp, Artificial Sequence
  Synthetic
tcgtggcggtgggacaggggcctacatttgcctattcttcttcgcgatgcatttccaacaaagtatgctgggtat

SEQ ID NO: 178230 - DNA, 75 bp, Artificial Sequence
  Synthetic
tcccatggaaaacctgtccagcgtctgttccaaagttcggtttgcgtccacactacagtgggccgttctgggaag

SEQ ID NO: 178231 - DNA, 75 bp, Artificial Sequence
  Synthetic
tgttccaaagttcggtttgcgtccacactacagtgggccgttctgggaagtaagcatttatacgggggtaccgtc

SEQ ID NO: 178232 - DNA, 75 bp, Artificial Sequence
  Synthetic
gccccccgttaaatcaaagtgggtcttcaccttttctccgaaataatacacttccaccactaggggcacaagctt

SEQ ID NO: 178233 - DNA, 75 bp, Artificial Sequence
  Synthetic
ttcaccttttctccgaaataatacacttccaccactaggggcacaagcttgtcacccactttgtaaatagcctgt

SEQ ID NO: 178234 - DNA, 75 bp, Artificial Sequence
  Synthetic
cctcatgtcgcttccataccagtaaaatgtctggtcagctttctcttggtcctcgacgtcccggtcatcacgaca

SEQ ID NO: 178235 - DNA, 75 bp, Artificial Sequence
  Synthetic
aatgtctggtcagctttctcttggtcctcgacgtcccggtcatcacgacacaacggtggaatacaatcaataaaa

SEQ ID NO: 178236 - DNA, 75 bp, Artificial Sequence
  Synthetic
aggtgccgaactctcaaggggatgcgtggcgggaagtactgagacactctccgtggacccctcctcacctccctc

SEQ ID NO: 178237 - DNA, 75 bp, Artificial Sequence
  Synthetic
gaagcgcgcatgtttctcggtctttttaactttcgccaggcggcgctgcggcgggagagccaatctgatgccact

SEQ ID NO: 178238 - DNA, 75 bp, Artificial Sequence
  Synthetic
ccaacatctgacaagagatctaacaaacacccctcaatgtgatccaccatcggtaggcaatcatccagcccactg

SEQ ID NO: 178239 - DNA, 75 bp, Artificial Sequence
  Synthetic
aacacccctcaatgtgatccaccatcggtaggcaatcatccagcccactgacatgactggggacggggccttctg

SEQ ID NO: 178240 - DNA, 75 bp, Artificial Sequence
  Synthetic
gtctcatgtggaaaaataacaggagaaggtaaaccccccgttggcaaacatagatccgtcggggtgtgcacgtgt

SEQ ID NO: 178241 - DNA, 75 bp, Artificial Sequence
  Synthetic
aaggtaaaccccccgttggcaaacatagatccgtcggggtgtgcacgtgtaatgggccctgcacctggctcgtgg

SEQ ID NO: 178242 - DNA, 75 bp, Artificial Sequence
  Synthetic
ccaaaccccgacggttctggctcttcaaaaaacaaactgtgcatatccctccctacaaaaccctgagcccccacc

SEQ ID NO: 178243 - DNA, 75 bp, Artificial Sequence
  Synthetic
caaaaaacaaactgtgcatatccctccctacaaaaccctgagcccccacccaaagttcgttttcgctgtcactcg

SEQ ID NO: 178244 - DNA, 75 bp, Artificial Sequence
  Synthetic
gttgtgggcgtggcgactgccgccgcctgtttcctggcggcctccctaaacaaaagttaattacacaaaggtaag

SEQ ID NO: 178245 - DNA, 75 bp, Artificial Sequence
  Synthetic
cctgtttcctggcggcctccctaaacaaaagttaattacacaaaggtaagtctgagtgacatctccaatttcccg

SEQ ID NO: 178246 - DNA, 75 bp, Artificial Sequence
  Synthetic
acatcaaccatcctacctctgggctttttttctaaggctccttctaagtgccttttctctgtgtttgtcatcatg

SEQ ID NO: 178247 - DNA, 75 bp, Artificial Sequence
  Synthetic
ttttttctaaggctccttctaagtgccttttctctgtgtttgtcatcatggggatagatcccaaacaatgctttt

SEQ ID NO: 178248 - DNA, 75 bp, Artificial Sequence
  Synthetic
acatcccttgtatggcctaggtgtcataatccagcggttgagtttcatttttcccttatagatggtaaagggcct

SEQ ID NO: 178249 - DNA, 75 bp, Artificial Sequence
  Synthetic
ataatccagcggttgagtttcatttttcccttatagatggtaaagggcctctcctgtctggctcgattggcggtc

SEQ ID NO: 178250 - DNA, 75 bp, Artificial Sequence
  Synthetic
tggcagcccgtgcctacgtcgctcctccaaaaatgcctcatagaagtcatcgaagccttctggcattctctcccg

SEQ ID NO: 178251 - DNA, 75 bp, Artificial Sequence
  Synthetic
tccaaaaatgcctcatagaagtcatcgaagccttctggcattctctcccgccggtttcgacccggcacggtgaat

SEQ ID NO: 178252 - DNA, 75 bp, Artificial Sequence
  Synthetic
ttagatacaactcacttttgtcgactgtattatcatggtccacctctaggggtcacaaatgggccgcaatcgtga

SEQ ID NO: 178253 - DNA, 75 bp, Artificial Sequence
  Synthetic
taaagcatctataataaagtccgtgagccattccgactccgtgtagcgaggcatctttttaggcaaaagccacga

SEQ ID NO: 178254 - DNA, 75 bp, Artificial Sequence
  Synthetic
cacaaaacaccttttccgtgggcgactttctcgccacaactagctggaccccaaccccactggcacgtagactct

SEQ ID NO: 178255 - DNA, 75 bp, Artificial Sequence
  Synthetic
cccccagccggttgtcgggctgcggaaacttgtggttagaactcactacggaaaagggaaccaatgcagttgaac

SEQ ID NO: 178256 - DNA, 75 bp, Artificial Sequence
  Synthetic
aaacttgtggttagaactcactacggaaaagggaaccaatgcagttgaactactggcacacacccataacccggg

SEQ ID NO: 178257 - DNA, 75 bp, Artificial Sequence
  Synthetic
agggaggggtgtcatggtcaacaaaccaagaaaaacacatgtattattcaattagccaacaactttatttattac

SEQ ID NO: 178258 - DNA, 75 bp, Artificial Sequence
  Synthetic
ccaagaaaaacacatgtattattcaattagccaacaactttatttattaccgacaggagacatgagatacataaa

SEQ ID NO: 178259 - DNA, 75 bp, Artificial Sequence
  Synthetic
gtggagttttcgcctaattagctgaatctcgacccccattgcggccagcatgctcacgaggaataggcagcagag

SEQ ID NO: 178260 - DNA, 75 bp, Artificial Sequence
  Synthetic
atctcgacccccattgcggccagcatgctcacgaggaataggcagcagaggcaggacctaactaggagcatatcc

SEQ ID NO: 178261 - DNA, 75 bp, Artificial Sequence
  Synthetic
caggagaacaaatagcgctcgtcgggaggcgacggatacgcccacgcatgacagtaacccaacataaaatagcgt

SEQ ID NO: 178262 - DNA, 75 bp, Artificial Sequence
  Synthetic
gaggcgacggatacgcccacgcatgacagtaacccaacataaaatagcgtcatatacttatccaggccaatcagg

SEQ ID NO: 178263 - DNA, 75 bp, Artificial Sequence
  Synthetic
taaggtcacaaacacgacaacctcgcgcctacagtaggcccaggcctggaacactgaataggtgatgtacttccc

SEQ ID NO: 178264 - DNA, 75 bp, Artificial Sequence
  Synthetic
cgcctacagtaggcccaggcctggaacactgaataggtgatgtacttcccgggcatgatgaatatggccctcctc

SEQ ID NO: 178265 - DNA, 75 bp, Artificial Sequence
  Synthetic
caaaagtcccccgaccaagaagacaatgaagggcagccagaaaacgccggacacaaagaccttcttaaacaacag

SEQ ID NO: 178266 - DNA, 75 bp, Artificial Sequence
  Synthetic
cagaagcccagctcatagtacctgtgtactattggcggcgcctgatacaccgccgttgcggtggctagcggataa

SEQ ID NO: 178267 - DNA, 75 bp, Artificial Sequence
  Synthetic
cgccgttgcggtggctagcggataaggtaacagcagtaaacagttaagtacgcacagacccggtatgaagggcac

SEQ ID NO: 178268 - DNA, 75 bp, Artificial Sequence
  Synthetic
ggtaacagcagtaaacagttaagtacgcacagacccggtatgaagggcacacgagaaaatgtaaacccagaaaag

SEQ ID NO: 178269 - DNA, 75 bp, Artificial Sequence
  Synthetic
cctccggtccagctgtttttgcgccgcagggcacagacacatgcatatcagggccaagtgcgtgactggcagcga

SEQ ID NO: 178270 - DNA, 75 bp, Artificial Sequence
  Synthetic
gcagggcacagacacatgcatatcagggccaagtgcgtgactggcagcgaccagaaaaacacggccgtgatctct

SEQ ID NO: 178271 - DNA, 75 bp, Artificial Sequence
  Synthetic
aaagggggtcgccgccaacgtcccgctcagataactgaagagcgacagagcgcgctcactgtccaggcggcacat

SEQ ID NO: 178272 - DNA, 75 bp, Artificial Sequence
  Synthetic
ctcagataactgaagagcgacagagcgcgctcactgtccaggcggcacatggtgtcaaatcagggggttaaatgt

SEQ ID NO: 178273 - DNA, 75 bp, Artificial Sequence
  Synthetic
tcttgtgaggcctctttgtgctgtccttagttggcgccgctggggggcagctggtgacagaggcagcgtcctcag

SEQ ID NO: 178274 - DNA, 75 bp, Artificial Sequence
  Synthetic
ctggtgacagaggcagcgtcctcagaggcgtcctccagcggcccaaagggaccaactggtgtgagagggggagaa

SEQ ID NO: 178275 - DNA, 75 bp, Artificial Sequence
  Synthetic
aaccttttgcgaagactcgcctccctcggcagacacagatcggtttacctctaaaagtaggacacttaactttac

SEQ ID NO: 178276 - DNA, 75 bp, Artificial Sequence
  Synthetic
tcggcagacacagatcggtttacctctaaaagtaggacacttaactttacgtcacctgattggcagccagtgggc

SEQ ID NO: 178277 - DNA, 75 bp, Artificial Sequence
  Synthetic
aaaccaacccgggactttacacagtctcagggcggcgattaaggactccaggctaacccggctcagggcgtcggt

SEQ ID NO: 178278 - DNA, 75 bp, Artificial Sequence
  Synthetic
ttcttccccttcagaccatcccagccagaaacgggtttggtttctggcttgaaatcaatgatcttgctcacgcca

SEQ ID NO: 178279 - DNA, 75 bp, Artificial Sequence
  Synthetic
gaaatcaatgatcttgctcacgccaccaagagaaaatgtcacgatcgacagcgtctcgctgacagacacagtcac

SEQ ID NO: 178280 - DNA, 75 bp, Artificial Sequence
  Synthetic
ccaagagaaaatgtcacgatcgacagcgtctcgctgacagacacagtcaccgtttggtcctcttttgttttttgc

SEQ ID NO: 178281 - DNA, 75 bp, Artificial Sequence
  Synthetic
cctggtggtcctaccaccggcttccatccgatcgtggaaaggtaggatacccttttggtccaccacgcttttgtg

SEQ ID NO: 178282 - DNA, 75 bp, Artificial Sequence
  Synthetic
atccgatcgtggaaaggtaggatacccttttggtccaccacgcttttgtgcacggtggaggtgaggttgtccccg

SEQ ID NO: 178283 - DNA, 75 bp, Artificial Sequence
  Synthetic
ctccccctttcgataaaaggctatgccagcgtcgagtacattcgcaccgaatagctcacgcgtgtgcgtgaagcc

SEQ ID NO: 178284 - DNA, 75 bp, Artificial Sequence
  Synthetic
ccagcgtcgagtacattcgcaccgaatagctcacgcgtgtgcgtgaagccgctaccgacggacgtattcctgaag

SEQ ID NO: 178285 - DNA, 75 bp, Artificial Sequence
  Synthetic
ggcattctttattcttaaccccagaacgccagctgtccccacgctggacagcacactgagggttggcgtgcaagc

SEQ ID NO: 178286 - DNA, 75 bp, Artificial Sequence
  Synthetic
acgccagctgtccccacgctggacagcacactgagggttggcgtgcaagccgatccgtgcacttgcactactccg

SEQ ID NO: 178287 - DNA, 75 bp, Artificial Sequence
  Synthetic
gagggtcacgtccaccctgaccccatagtgaaaatccacaggcatgattgcggccgtagacgcacagagaaatca

SEQ ID NO: 178288 - DNA, 75 bp, Artificial Sequence
  Synthetic
tagtgaaaatccacaggcatgattgcggccgtagacgcacagagaaatcacaggaaagctgcgcgcacactgggt

SEQ ID NO: 178289 - DNA, 75 bp, Artificial Sequence
  Synthetic
gtgtgcgacatggacaggttaaccttcacaaatcgtcagtcacacacgtggtgtaatcagaattgtctcgctcaa

SEQ ID NO: 178290 - DNA, 75 bp, Artificial Sequence
  Synthetic
tcacaaatcgtcagtcacacacgtggtgtaatcagaattgtctcgctcaaaaaaattcacagccttgaaactgcc

SEQ ID NO: 178291 - DNA, 75 bp, Artificial Sequence
  Synthetic
gaacgaaaatatcacgcagaatcctgtcagcggtggcttccaggaacctccggatgtccaccacgttaacaagcg

SEQ ID NO: 178292 - DNA, 75 bp, Artificial Sequence
  Synthetic
gtcagcggtggcttccaggaacctccggatgtccaccacgttaacaagcgtcaccccggccgccttggcctggat

SEQ ID NO: 178293 - DNA, 75 bp, Artificial Sequence
  Synthetic
cgtgactgggtttttcctgtatctccaccatagtgttgtacaacatactggcggccttggtgtgcagcagctcgt

SEQ ID NO: 178294 - DNA, 75 bp, Artificial Sequence
  Synthetic
caccatagtgttgtacaacatactggcggccttggtgtgcagcagctcgtccctggaaatgtaatcgttggcaag

SEQ ID NO: 178295 - DNA, 75 bp, Artificial Sequence
  Synthetic
aggagctaataaagtatatcccctccacaatcaaaaacatcagaatcttctgagctttggtggtcgccttacgca

SEQ ID NO: 178296 - DNA, 75 bp, Artificial Sequence
  Synthetic
cacaatcaaaaacatcagaatcttctgagctttggtggtcgccttacgcaccctggagtgaagccactccagctt

SEQ ID NO: 178297 - DNA, 75 bp, Artificial Sequence
  Synthetic
cgcctcgactgttgttgaaaaatatcttcaagatattggcatacacgacaccgtggatattctccatggcaacct

SEQ ID NO: 178298 - DNA, 75 bp, Artificial Sequence
  Synthetic
cttcaagatattggcatacacgacaccgtggatattctccatggcaacctgttcggcataatagtgggccacgtc

SEQ ID NO: 178299 - DNA, 75 bp, Artificial Sequence
  Synthetic
gttcggccattcccaaaaacgtaaacaaaaatctataaaagtccttgtcggcatcgctgagctggtgcacgtggg

SEQ ID NO: 178300 - DNA, 75 bp, Artificial Sequence
  Synthetic
caaaaatctataaaagtccttgtcggcatcgctgagctggtgcacgtgggaaacatcaaggtgcaggggtatctg

SEQ ID NO: 178301 - DNA, 75 bp, Artificial Sequence
  Synthetic
cgtcgtgatcgcttgtatacagaaatcgatcaactgaatccattggcctcacccggcttgcagagacctacctac

SEQ ID NO: 178302 - DNA, 75 bp, Artificial Sequence
  Synthetic
tcgatcaactgaatccattggcctcacccggcttgcagagacctacctactgacagaccaggcactcggggtctg

SEQ ID NO: 178303 - DNA, 75 bp, Artificial Sequence
  Synthetic
tcttgtttcatcccagagtgaggcggtgaccctggatctgccaggcactgaagagccgtcagactagattgcttc

SEQ ID NO: 178304 - DNA, 75 bp, Artificial Sequence
  Synthetic
gtgaccctggatctgccaggcactgaagagccgtcagactagattgcttctgaaccctacagtagtacatgaggg

SEQ ID NO: 178305 - DNA, 75 bp, Artificial Sequence
  Synthetic
gcattcctgactctgtcctccttgaggaagaagctcatggactggctctggtctacaaacggcgccctggcacga

SEQ ID NO: 178306 - DNA, 75 bp, Artificial Sequence
  Synthetic
ggaagaagctcatggactggctctggtctacaaacggcgccctggcacgagccctatccagtagcttaaatggac

SEQ ID NO: 178307 - DNA, 75 bp, Artificial Sequence
  Synthetic
gggaacgtggaaacgtccccaccatactgtctaaccacccgaaggtcgtcggggagaaccttcttaaaaaaagtc

SEQ ID NO: 178308 - DNA, 75 bp, Artificial Sequence
  Synthetic
actgtctaaccacccgaaggtcgtcggggagaaccttcttaaaaaaagtcacattgggcctcaacacctcttctt

SEQ ID NO: 178309 - DNA, 75 bp, Artificial Sequence
  Synthetic
gcatagccagttacttgcgaggtcccagccgtcggcatcaccgccagaaactgagaattgaatatgccatgctcg

SEQ ID NO: 178310 - DNA, 75 bp, Artificial Sequence
  Synthetic
agcgatggcgtggtacaaacgaagcatcctccccctcccatgtttgccaatgaaacctgcccttggcgaagttac

SEQ ID NO: 178311 - DNA, 75 bp, Artificial Sequence
  Synthetic
tgactagtctccaccgcggtgtagtacatagactggaatatattcttgtctaactcagcgctctcagcatcgagg

SEQ ID NO: 178312 - DNA, 75 bp, Artificial Sequence
  Synthetic
acatagactggaatatattcttgtctaactcagcgctctcagcatcgaggtacccgtaccccaattccgcaaaca

SEQ ID NO: 178313 - DNA, 75 bp, Artificial Sequence
  Synthetic
cgctcgacccccggtgttggatgggaaccacccagaatgcaggcgttgatgacgaggactgccacccttactgcg

SEQ ID NO: 178314 - DNA, 75 bp, Artificial Sequence
  Synthetic
aaccacccagaatgcaggcgttgatgacgaggactgccacccttactgcgtcgcccaaggcctcaaaacaaaaaa

SEQ ID NO: 178315 - DNA, 75 bp, Artificial Sequence
  Synthetic
agacactttggaaggcagatatttgccaggttgcacaccgaagtgtttcttcctggcagttggactatctctgca

SEQ ID NO: 178316 - DNA, 75 bp, Artificial Sequence
  Synthetic
ccaggttgcacaccgaagtgtttcttcctggcagttggactatctctgcacacaagtttgagcagttaatggcca

SEQ ID NO: 178317 - DNA, 75 bp, Artificial Sequence
  Synthetic
acgtacggtgagcctgtctttatgatggtgtggataagagtgaacatcatagacttcaacggcatgcaactaacg

SEQ ID NO: 178318 - DNA, 75 bp, Artificial Sequence
  Synthetic
tggtgtggataagagtgaacatcatagacttcaacggcatgcaactaacgtactttccagcccgcaccaggcgct

SEQ ID NO: 178319 - DNA, 75 bp, Artificial Sequence
  Synthetic
gtggctggatcgaacaaataccataacttggatgggtccttttcatacatcctgaaaaacaatgttgggatgcac

SEQ ID NO: 178320 - DNA, 75 bp, Artificial Sequence
  Synthetic
acttggatgggtccttttcatacatcctgaaaaacaatgttgggatgcacacgccctgaaagagactgtgacatc

SEQ ID NO: 178321 - DNA, 75 bp, Artificial Sequence
  Synthetic
tgccagagttccatgtatgcgctcgcgccaacgggcctgatgttattgtcattgaaataatgaacctgggcatcc

SEQ ID NO: 178322 - DNA, 75 bp, Artificial Sequence
  Synthetic
accagtttgaggcaactggctatgttcttttggtgggagaatgacgtaacatccagacccacgcctgacttactg

SEQ ID NO: 178323 - DNA, 75 bp, Artificial Sequence
  Synthetic
attcatcatggagggctgcagaataaaacagctggcgagttgtccgccttcgactccagctgagcgcagtattgg

SEQ ID NO: 178324 - DNA, 75 bp, Artificial Sequence
  Synthetic
aaacagctggcgagttgtccgccttcgactccagctgagcgcagtattggcgtggcgcagcacacgtgctgcgca

SEQ ID NO: 178325 - DNA, 75 bp, Artificial Sequence
  Synthetic
agcgtcctcaataaggtcccgcgccaaccaatacaggcattcatgctctaagcactgacaggcaacaaacacgga

SEQ ID NO: 178326 - DNA, 75 bp, Artificial Sequence
  Synthetic
aaccaatacaggcattcatgctctaagcactgacaggcaacaaacacggaaaccctcataaacatttgcgccacg

SEQ ID NO: 178327 - DNA, 75 bp, Artificial Sequence
  Synthetic
caacctcacggccgataggtagccacagttaagtgtgtcctcgtaagctttggaccgtctgtaggcgcacaacat

SEQ ID NO: 178328 - DNA, 75 bp, Artificial Sequence
  Synthetic
cagttaagtgtgtcctcgtaagctttggaccgtctgtaggcgcacaacatatcttccaaggcatcaatgttcttt

SEQ ID NO: 178329 - DNA, 75 bp, Artificial Sequence
  Synthetic
atactgcttgagagtcgctgggcacctagcctccataatttggtgccacagccgccccgccatggcattggcccg

SEQ ID NO: 178330 - DNA, 75 bp, Artificial Sequence
  Synthetic
gccgccccgccatggcattggcccgcacgtcccacccgaccctaacctttagaaagtctatgagagattgggcac

SEQ ID NO: 178331 - DNA, 75 bp, Artificial Sequence
  Synthetic
tctggtgggacagctcccaagtgaacctgacaaaatgtccggacagacatgaccttacagaaacacagtccaggg

SEQ ID NO: 178332 - DNA, 75 bp, Artificial Sequence
  Synthetic
aacaccagtacaggcaaggacgtgcccttcacgttcagactttggtgcaccggatgagaatcaaagggaactgtg

SEQ ID NO: 178333 - DNA, 75 bp, Artificial Sequence
  Synthetic
caagccgatttatatacagctcgtgcctcagctgaatatacttggtccggattacatccgtaaagtgatccttta

SEQ ID NO: 178334 - DNA, 75 bp, Artificial Sequence
  Synthetic
cctcagctgaatatacttggtccggattacatccgtaaagtgatcctttatcatggccacaacctccgcaaagcc

SEQ ID NO: 178335 - DNA, 75 bp, Artificial Sequence
  Synthetic
ggagataaaccaacgaggcataaatagtaacgtttaggcctgccggttcccggcgctggaccatgggacatgact

SEQ ID NO: 178336 - DNA, 75 bp, Artificial Sequence
  Synthetic
agtaacgtttaggcctgccggttcccggcgctggaccatgggacatgactcatccaaatcaactagcatatcaca

SEQ ID NO: 178337 - DNA, 75 bp, Artificial Sequence
  Synthetic
ctcccttcatggcggaggtgaccttggtcacgaaggtactgtggacactctggaccattggacctactggggtaa

SEQ ID NO: 178338 - DNA, 75 bp, Artificial Sequence
  Synthetic
ggtcacgaaggtactgtggacactctggaccattggacctactggggtaaggagggtatgaaactccccagtgtc

SEQ ID NO: 178339 - DNA, 75 bp, Artificial Sequence
  Synthetic
cgtaccacacaccggccactttgtgagtctgtggcgcttttgccgcttccattccagagagcataaacagggacg

SEQ ID NO: 178340 - DNA, 75 bp, Artificial Sequence
  Synthetic
agtctgtggcgcttttgccgcttccattccagagagcataaacagggacgtgggtgttagcagcatatccataga

SEQ ID NO: 178341 - DNA, 75 bp, Artificial Sequence
  Synthetic
gctcctctaactcctgctcctgctcctctaactcctgctcctgctcctcctgctgctcctgctcctcctgctgct

SEQ ID NO: 178342 - DNA, 75 bp, Artificial Sequence
  Synthetic
cctggggactaaaggtctgtgaatacacgaggaaatctccataggtcggctgcctaaacggcgcctgccgcaagg

SEQ ID NO: 178343 - DNA, 75 bp, Artificial Sequence
  Synthetic
cacgaggaaatctccataggtcggctgcctaaacggcgcctgccgcaaggcctcatgcagcgagccaaccgtggg

SEQ ID NO: 178344 - DNA, 75 bp, Artificial Sequence
  Synthetic
actccggtcctctagtgagggatacccggtgagttggtggaggtaaaagacccaacacttgcctacccaggcgag

SEQ ID NO: 178345 - DNA, 75 bp, Artificial Sequence
  Synthetic
ccggtgagttggtggaggtaaaagacccaacacttgcctacccaggcgagccgcattttcagcctgcaccttcat

SEQ ID NO: 178346 - DNA, 75 bp, Artificial Sequence
  Synthetic
gcctgagtgggggaggcgggagccttcaccagacaaagctgttgatggaatttcaactccgaggactgccggtgc

SEQ ID NO: 178347 - DNA, 75 bp, Artificial Sequence
  Synthetic
ctgctggggctcccgctgctggggctcccgctgctggggctcccgctgctggggctcccgctgctgtggctcccg

SEQ ID NO: 178348 - DNA, 75 bp, Artificial Sequence
  Synthetic
tcaccagacaaagctgttgatggaatttcaactccgaggactgccggtgcctgccctcttaaacagcagcacaac

SEQ ID NO: 178349 - DNA, 75 bp, Artificial Sequence
  Synthetic
ttatacgcgactatcgcgtgttcgcactggttcgcgcggcgtattttttagaacccccttctagcatcgaccccc

SEQ ID NO: 178350 - DNA, 75 bp, Artificial Sequence
  Synthetic
actggttcgcgcggcgtattttttagaacccccttctagcatcgacccccttgaggcagcgcgcgctcttggacg

SEQ ID NO: 178351 - DNA, 75 bp, Artificial Sequence
  Synthetic
agccacccacctccgacgacaccctgaataactgtacattgctcaaactactagcccactacgcggatcagatag

SEQ ID NO: 178352 - DNA, 75 bp, Artificial Sequence
  Synthetic
gaataactgtacattgctcaaactactagcccactacgcggatcagatagcaggtttcaaaacccccgctctccc

SEQ ID NO: 178353 - DNA, 75 bp, Artificial Sequence
  Synthetic
accacgcatgttttcagaaatactgggcagctgcactacccccaatgtggatactgacatacgaccctcccactt

SEQ ID NO: 178354 - DNA, 75 bp, Artificial Sequence
  Synthetic
ggcagctgcactacccccaatgtggatactgacatacgaccctcccacttctccgttacaggactggcttatagt

SEQ ID NO: 178355 - DNA, 75 bp, Artificial Sequence
  Synthetic
aggaggtgttagccaaaacattagtaacagaacaccacgagttgttcgtatcgcggtcgaattcgaccgagaccg

SEQ ID NO: 178356 - DNA, 75 bp, Artificial Sequence
  Synthetic
aacagaacaccacgagttgttcgtatcgcggtcgaattcgaccgagaccgccgtcaccatgcccgtatccaaaga

SEQ ID NO: 178357 - DNA, 75 bp, Artificial Sequence
  Synthetic
aaaatactcccattcttgccttcaccgacgtggaactatccacactcaaaccccactatctgttcatctatgatt

SEQ ID NO: 178358 - DNA, 75 bp, Artificial Sequence
  Synthetic
cgacgtggaactatccacactcaaaccccactatctgttcatctatgattttatcatagaggcattatgcaagag

SEQ ID NO: 178359 - DNA, 75 bp, Artificial Sequence
  Synthetic
gtatagacttcatgactgacctaggtcagtacctagataccgctactagcggcaagcagcagctgacgcacagcc

SEQ ID NO: 178360 - DNA, 75 bp, Artificial Sequence
  Synthetic
tcagtacctagataccgctactagcggcaagcagcagctgacgcacagccaaataaaggaaatcaaatacaggct

SEQ ID NO: 178361 - DNA, 75 bp, Artificial Sequence
  Synthetic
tcatgaccctcccatatcgaccgacccccaacctcgctaacctgtccacgtttatggggatggttcaccaactga

SEQ ID NO: 178362 - DNA, 75 bp, Artificial Sequence
  Synthetic
ccccaacctcgctaacctgtccacgtttatggggatggttcaccaactgaccatgttcggacactatttctaccg

SEQ ID NO: 178363 - DNA, 75 bp, Artificial Sequence
  Synthetic
agatactgacacgcgccagcgcggagcaaacggaacgtaacccgtggagacatccgggtatctcggacattccac

SEQ ID NO: 178364 - DNA, 75 bp, Artificial Sequence
  Synthetic
gcaaacggaacgtaacccgtggagacatccgggtatctcggacattccactgcgttggaaaatatcgcgtgctct

SEQ ID NO: 178365 - DNA, 75 bp, Artificial Sequence
  Synthetic
ccgcgctgccctcgcaactcatgcgggccatcttcgagatctcggtcaagaccacatggggaggcgccgtaccgg

SEQ ID NO: 178366 - DNA, 75 bp, Artificial Sequence
  Synthetic
ggccatcttcgagatctcggtcaagaccacatggggaggcgccgtaccggcaaacctggcgcgcgacattgacac

SEQ ID NO: 178367 - DNA, 75 bp, Artificial Sequence
  Synthetic
atgttgagacatactgtcaaggtctgcgggtgggagacacggagtacgatgaggacattgtgagaagcccgctct

SEQ ID NO: 178368 - DNA, 75 bp, Artificial Sequence
  Synthetic
gcgggtgggagacacggagtacgatgaggacattgtgagaagcccgctctttgcagacgcgtttaccaagagtca

SEQ ID NO: 178369 - DNA, 75 bp, Artificial Sequence
  Synthetic
gagctctgtttcagataagatggctgataatatttgctgccgaggcggcaaccgggctcatccctgccaggcgcc

SEQ ID NO: 178370 - DNA, 75 bp, Artificial Sequence
  Synthetic
gataatatttgctgccgaggcggcaaccgggctcatccctgccaggcgcccgctagccagagcctacttccacat

SEQ ID NO: 178371 - DNA, 75 bp, Artificial Sequence
  Synthetic
tggactgtatccaggagctcttcacccacatcaggcaggctgttccagacgcacagtgtccgcacgcctttctac

SEQ ID NO: 178372 - DNA, 75 bp, Artificial Sequence
  Synthetic
ccacatcaggcaggctgttccagacgcacagtgtccgcacgcctttctacagtccctgttcgtctttcaattccg

SEQ ID NO: 178373 - DNA, 75 bp, Artificial Sequence
  Synthetic
tgcagacatccctccccccggtgataagtctggccaaccttggagacaagctgtgtcgtctcgagttcgagtacg

SEQ ID NO: 178374 - DNA, 75 bp, Artificial Sequence
  Synthetic
aagtctggccaaccttggagacaagctgtgtcgtctcgagttcgagtacgacagcgagggcgacttcgtgcgcgt

SEQ ID NO: 178375 - DNA, 75 bp, Artificial Sequence
  Synthetic
agaagacaatacagaccatcgaacaggccaccagggaggccaccgtagccatgacaacaatcgcaaagccaatat

SEQ ID NO: 178376 - DNA, 75 bp, Artificial Sequence
  Synthetic
accccgcctacatccggttactgcagcggctagaatatcttaacagactcaaccaccacattctcaggattccct

SEQ ID NO: 178377 - DNA, 75 bp, Artificial Sequence
  Synthetic
gcacggttgacaaaattggcagcggacgcagcaaacacttgtagctactccctcaccaagtactttggagtttta

SEQ ID NO: 178378 - DNA, 75 bp, Artificial Sequence
  Synthetic
acgcagcaaacacttgtagctactccctcaccaagtactttggagttttattccaacaccagctggtccccacgg

SEQ ID NO: 178379 - DNA, 75 bp, Artificial Sequence
  Synthetic
gcctttttacagagcctggcacaacccgtagtgcagggacaacggcagggggcggctggcgggtcgggtgtcctg

SEQ ID NO: 178380 - DNA, 75 bp, Artificial Sequence
  Synthetic
ccgtagtgcagggacaacggcagggggcggctggcgggtcgggtgtcctgacgcagaaagaacttgagctcttga

SEQ ID NO: 178381 - DNA, 75 bp, Artificial Sequence
  Synthetic
attaaacgttcatattcaaataaatatgacgtccctgaggtctcagtcgactgggaaacgtactcccggtctgcc

SEQ ID NO: 178382 - DNA, 75 bp, Artificial Sequence
  Synthetic
atgacgtccctgaggtctcagtcgactgggaaacgtactcccggtctgccttcgaggcaccggacgacgaactcc

SEQ ID NO: 178383 - DNA, 75 bp, Artificial Sequence
  Synthetic
aggccatggcagcccagcctctgtacatggagggaatggcctccacccaccaagctaactgtatattcggagaac

SEQ ID NO: 178384 - DNA, 75 bp, Artificial Sequence
  Synthetic
catggagggaatggcctccacccaccaagctaactgtatattcggagaacatgctggatcccagtgcctcagcaa

SEQ ID NO: 178385 - DNA, 75 bp, Artificial Sequence
  Synthetic
tcgacagagccagcctggacgatgtacttgaacagggcatgaggctggacctcctcctacgaaaatctggcatgc

SEQ ID NO: 178386 - DNA, 75 bp, Artificial Sequence
  Synthetic
acttgaacagggcatgaggctggacctcctcctacgaaaatctggcatgctgggatttagacaatatgcccaact

SEQ ID NO: 178387 - DNA, 75 bp, Artificial Sequence
  Synthetic
tccagtctccagagttttatgggctcatcggacaggacgcggccatccgcgagccattcatcgagtccttgaggt

SEQ ID NO: 178388 - DNA, 75 bp, Artificial Sequence
  Synthetic
catcggacaggacgcggccatccgcgagccattcatcgagtccttgaggtcggttttgagtcgaaactacgcggg

SEQ ID NO: 178389 - DNA, 75 bp, Artificial Sequence
  Synthetic
tcgtcaaggacaaaacgtattacatgtttgacccccactgcataccaaacatccccaacagtcctgcacacgtca

SEQ ID NO: 178390 - DNA, 75 bp, Artificial Sequence
  Synthetic
taaagactaacgacgttggcgttttattaccgtacatagccacacatgacactgaatacaccgggtgcttccttt

SEQ ID NO: 178391 - DNA, 75 bp, Artificial Sequence
  Synthetic
taccgcaccattgtgttcgaagaactccacgggcccagaatggatatctcccgcggggtggaatcatgctccatc

SEQ ID NO: 178392 - DNA, 75 bp, Artificial Sequence
  Synthetic
tccacgggcccagaatggatatctcccgcggggtggaatcatgctccatcaccgaaatcacgtccccttctgtat

SEQ ID NO: 178393 - DNA, 75 bp, Artificial Sequence
  Synthetic
gacgaaacgcgcccgcgcagacctcgcgtcgtcattcctccttacgatccgacagaccgcccacgaccgcctcac

SEQ ID NO: 178394 - DNA, 75 bp, Artificial Sequence
  Synthetic
cggcggtaacaaaggacgcggcggaaagacgggacgtggcggaaatgaaggacgcggtggccaccagccaccaga

SEQ ID NO: 178395 - DNA, 75 bp, Artificial Sequence
  Synthetic
gcggaacacatggaccagtccgacggacaaggcgccgatggagacatggatagtacacccgcaaatggtgagaca

SEQ ID NO: 178396 - DNA, 75 bp, Artificial Sequence
  Synthetic
gacaaggcgccgatggagacatggatagtacacccgcaaatggtgagacatccgttacggaaaccccgggccccg

SEQ ID NO: 178397 - DNA, 75 bp, Artificial Sequence
  Synthetic
gcgaccccaggcgccacagcgctgctctctgacctaactgccacaagagggcagaaacgcaaattttcctcgctt

SEQ ID NO: 178398 - DNA, 75 bp, Artificial Sequence
  Synthetic
tctctgacctaactgccacaagagggcagaaacgcaaattttcctcgcttaaagaatcttatcccatcgacagcc

SEQ ID NO: 178399 - DNA, 75 bp, Artificial Sequence
  Synthetic
gatactgaagatatttggattgacgacccactcacacccttgtacccactaacggatacaccatctttcgacata

SEQ ID NO: 178400 - DNA, 75 bp, Artificial Sequence
  Synthetic
acccactcacacccttgtacccactaacggatacaccatctttcgacataacggcggacgtcacacccgacaaca

SEQ ID NO: 178401 - DNA, 75 bp, Artificial Sequence
  Synthetic
acggatgcggacaggtatgccagcgccagtcaggaatcgctgggcaccctggtctcgccatacgattttacaaac

SEQ ID NO: 178402 - DNA, 75 bp, Artificial Sequence
  Synthetic
tcgcgaccttttcgagaagccagcgctctacaggctatggataggatactaacacacgtggtcctagaatacggt

SEQ ID NO: 178403 - DNA, 75 bp, Artificial Sequence
  Synthetic
ccagtttttcattttgtggggcgaaaaactcggcataccaacggaggacgcaaagacgctcctggaaagcgcact

SEQ ID NO: 178404 - DNA, 75 bp, Artificial Sequence
  Synthetic
caaagacgctcctggaaagcgcactggagatccccgcaatgtgcgagatcgtccaacagggccggttgaaggagc

SEQ ID NO: 178405 - DNA, 75 bp, Artificial Sequence
  Synthetic
ctacacgccactagtcgtcaggacttcaagtccctgatacaggcattcaacgccgaagggattaggatcgcctcg

SEQ ID NO: 178406 - DNA, 75 bp, Artificial Sequence
  Synthetic
tcaagtccctgatacaggcattcaacgccgaagggattaggatcgcctcgcgtgagagggagacgtccatggccg

SEQ ID NO: 178407 - DNA, 75 bp, Artificial Sequence
  Synthetic
tgtgcccgccaggacgcacaaaccattcaagacggcgtcggtctcctcagggccgaggttaacaagagaaacgca

SEQ ID NO: 178408 - DNA, 75 bp, Artificial Sequence
  Synthetic
ttcaagacggcgtcggtctcctcagggccgaggttaacaagagaaacgcacagatagcccaggaggctgcgtatt

SEQ ID NO: 178409 - DNA, 75 bp, Artificial Sequence
  Synthetic
caacagacgttcgaagtgctgccggacctcaaactgcgcacgctcgtggagcacctgaccctggttgaggcgcag

SEQ ID NO: 178410 - DNA, 75 bp, Artificial Sequence
  Synthetic
acctcaaactgcgcacgctcgtggagcacctgaccctggttgaggcgcaggtgacaacgcaaacggtggaaagtc

SEQ ID NO: 178411 - DNA, 75 bp, Artificial Sequence
  Synthetic
gtgcccaacgtccacagtatactgtctaacatatccaacactctaaaagttatagattatgtaattccaaaattt

SEQ ID NO: 178412 - DNA, 75 bp, Artificial Sequence
  Synthetic
ctaacatatccaacactctaaaagttatagattatgtaattccaaaatttataataaacaccgatacactggccc

SEQ ID NO: 178413 - DNA, 75 bp, Artificial Sequence
  Synthetic
tcccttgactggcctcacgcacctgcagaggcggtagagccactacccgtgctgacttctctgcgaggtaaaatc

SEQ ID NO: 178414 - DNA, 75 bp, Artificial Sequence
  Synthetic
acaaaaacgctgtagatcaaattctaaccgacgccgaaggcctccttaagaacattaccgatccaaacggcgcac

SEQ ID NO: 178415 - DNA, 75 bp, Artificial Sequence
  Synthetic
aacgcgggggtccttctcaagggcgaaaagagcgagaggttctcccggctgaagaccgccatccaaaacctggta

SEQ ID NO: 178416 - DNA, 75 bp, Artificial Sequence
  Synthetic
gaagaccgccatccaaaacctggtatcctccgaatcatttatcaccgtgaccctacacagtacaaaccttggaaa

SEQ ID NO: 178417 - DNA, 75 bp, Artificial Sequence
  Synthetic
acctcctgacaagcccgtccgtgagacagtccctttccaccctgtgcacaaccctgctgcgagatgccctggacg

SEQ ID NO: 178418 - DNA, 75 bp, Artificial Sequence
  Synthetic
acagtccctttccaccctgtgcacaaccctgctgcgagatgccctggacgccctggaaaaaaaggatccggccct

SEQ ID NO: 178419 - DNA, 75 bp, Artificial Sequence
  Synthetic
cggtgcaggactacaaggagacggtacagataatatccagccttgtgggcatccaaaaattagtcagggaccagg

SEQ ID NO: 178420 - DNA, 75 bp, Artificial Sequence
  Synthetic
actctggccacgaccgccatcgagacggctacgaaacggaaactatacagattgatccaaagggacctcaaagag

SEQ ID NO: 178421 - DNA, 75 bp, Artificial Sequence
  Synthetic
cggctacgaaacggaaactatacagattgatccaaagggacctcaaagaggctcaaaaacacgagaccaatcggg

SEQ ID NO: 178422 - DNA, 75 bp, Artificial Sequence
  Synthetic
attgatccaaagggacctcaaagaggctcaaaaacacgagaccaatcgggccatggaggaatggaagcagaaagt

SEQ ID NO: 178423 - DNA, 75 bp, Artificial Sequence
  Synthetic
aggctcccaccgcgaaggctagagagtttgcagagaagcacttcaaaatactactccccgtacccgcggacgccc

SEQ ID NO: 178424 - DNA, 75 bp, Artificial Sequence
  Synthetic
gtttgcagagaagcacttcaaaatactactccccgtacccgcggacgcccccgtccaagcgtctccaacgccgat

SEQ ID NO: 178425 - DNA, 75 bp, Artificial Sequence
  Synthetic
catccatccacggggaacaggcgtggaagaagatacagcaggcgttcaaggatttcaacttcgccgtcctgcggc

SEQ ID NO: 178426 - DNA, 75 bp, Artificial Sequence
  Synthetic
gaagaagatacagcaggcgttcaaggatttcaacttcgccgtcctgcggcccgctgactgggatgccctggcagc

SEQ ID NO: 178427 - DNA, 75 bp, Artificial Sequence
  Synthetic
tctcagggttcctggagacgatcctagggacgctgaacgacatctacatggataagctccgctcctttctgcccg

SEQ ID NO: 178428 - DNA, 75 bp, Artificial Sequence
  Synthetic
cttcgactggctaacgccgtatcaggaccaagtcagctttttcttgcgcaccatagggctgccgctggtgcgagc

SEQ ID NO: 178429 - DNA, 75 bp, Artificial Sequence
  Synthetic
agtccggcgatttgcagcaggccacggtgggcacgcccctggagctccctgccacagagtacgcgcgcatcgcct

SEQ ID NO: 178430 - DNA, 75 bp, Artificial Sequence
  Synthetic
ccaacatgaagtccgtgttcaacgaccacggacttcaggtgcgatcagaggtcgcggattatgtggaggcccaac

SEQ ID NO: 178431 - DNA, 75 bp, Artificial Sequence
  Synthetic
aagactctgattccacatccggacgcaatcgtcgcggacggactacccgcctttcttaagacgtccctactgcag

SEQ ID NO: 178432 - DNA, 75 bp, Artificial Sequence
  Synthetic
gagcgacatgcgcgccgcagaggcccagagaaaagcatcgcgcgaggaaacccagcgcaaaatggcacacgccat

SEQ ID NO: 178433 - DNA, 75 bp, Artificial Sequence
  Synthetic
ccttacaggacccggtgggcttcctcgagggcatcatatacgacaaggtcctggagcgcgaatcctacgagacgg

SEQ ID NO: 178434 - DNA, 75 bp, Artificial Sequence
  Synthetic
cgagggcatcatatacgacaaggtcctggagcgcgaatcctacgagacgggtctcgagggactgtcctggctcga

SEQ ID NO: 178435 - DNA, 75 bp, Artificial Sequence
  Synthetic
gaatgcacgtgctgctggacgaggtgaaaaagcagcgagcaaacactgagaccgctctcgagctagaggccgcgg

SEQ ID NO: 178436 - DNA, 75 bp, Artificial Sequence
  Synthetic
gaaaaagcagcgagcaaacactgagaccgctctcgagctagaggccgcggctacgcacggcgacgacgctagact

SEQ ID NO: 178437 - DNA, 75 bp, Artificial Sequence
  Synthetic
aggccgcggtggaatcctggcggcagaaaatccaaaccctgaaatccctggtacaggaagcggagcaggccggcc

SEQ ID NO: 178438 - DNA, 75 bp, Artificial Sequence
  Synthetic
ggccggccaggcccaggagaccatatcaccatccacactccagggactgtaccaacagggacaggaggccatggc

SEQ ID NO: 178439 - DNA, 75 bp, Artificial Sequence
  Synthetic
agctggccgagctacagcagtacgtcaagtacaagaagcagtatctggaacactttgaggccacccaaagcgtag

SEQ ID NO: 178440 - DNA, 75 bp, Artificial Sequence
  Synthetic
ggaggttacgatcccagccctgcattacgcgggacctttcgacaacttggagcggctctcacgatacctacacat

SEQ ID NO: 178441 - DNA, 75 bp, Artificial Sequence
  Synthetic
tcgaccccacgcgcccggcctgcgtcccagccggcggccacgaacccccgttgcacagacaggtggtgttctcca

SEQ ID NO: 178442 - DNA, 75 bp, Artificial Sequence
  Synthetic
agcgttgtccgtagcgggccccgtgcctggacggggtctgcccggaacaccgcagatccgaaggggcgtggaggc

SEQ ID NO: 178443 - DNA, 75 bp, Artificial Sequence
  Synthetic
cgcagatccgaaggggcgtggaggctgccgcttgtttcctccaccagtgggacgagatatctcgcctccttccag

SEQ ID NO: 178444 - DNA, 75 bp, Artificial Sequence
  Synthetic
gacgagatatctcgcctccttccagaggtactggacacctttttccacaacgcgccccttcccgcagagtcttcc

SEQ ID NO: 178445 - DNA, 75 bp, Artificial Sequence
  Synthetic
tgggcgcgccgtcttgggcccacgggagccggagcacgccgccccggacgcgtacccaagggaggtggcgctggc

SEQ ID NO: 178446 - DNA, 75 bp, Artificial Sequence
  Synthetic
gagccggagcacgccgccccggacgcgtacccaagggaggtggcgctggccccgcgcgacctgacctaccttcta

SEQ ID NO: 178447 - DNA, 75 bp, Artificial Sequence
  Synthetic
cgcggaggcggcgcacgcatgtcttgtcacgctgccaacaatgctcaaggctgtgccgtacctcacgctggaagc

SEQ ID NO: 178448 - DNA, 75 bp, Artificial Sequence
  Synthetic
gtcacgctgccaacaatgctcaaggctgtgccgtacctcacgctggaagcctcagctggaccactgccggcggac

SEQ ID NO: 178449 - DNA, 75 bp, Artificial Sequence
  Synthetic
gcaccacgtcaacgtgcaggagaaactgtggctgcgtaatgattttatgtcgctgtgtcaccgttccccggggcg

SEQ ID NO: 178450 - DNA, 75 bp, Artificial Sequence
  Synthetic
tggaccacctcgtccacaaacttgaaaaaacaaagatataccagatagaaaaatgtggccacgacgactagtaac

SEQ ID NO: 178451 - DNA, 75 bp, Artificial Sequence
  Synthetic
taataaggcagctgtggtccaccttgcggccccttactgcggatgaatccgacacggcttctggactgctgcggg

SEQ ID NO: 178452 - DNA, 75 bp, Artificial Sequence
  Synthetic
gccgcccaagacgccgcggcgggaggcggtggcgcccggcgcaacactgccaccgtacccctacggccttgccac

SEQ ID NO: 178453 - DNA, 75 bp, Artificial Sequence
  Synthetic
caggaacgctctggcggcgctggcaagatgccggtgtccgggtttgagatagttttaggcgcactgctgttccgc

SEQ ID NO: 178454 - DNA, 75 bp, Artificial Sequence
  Synthetic
cgagggcggtttccagatactgactcctctcctggactgttgcccagatcgcgagccattcgcctccctggccgc

SEQ ID NO: 178455 - DNA, 75 bp, Artificial Sequence
  Synthetic
cctctcctggactgttgcccagatcgcgagccattcgcctccctggccgccgcaccacgaaggacggtgccactg

SEQ ID NO: 178456 - DNA, 75 bp, Artificial Sequence
  Synthetic
gcgtcaagccgcctggcttcaatataccttcgcaaattaccagatccccagcaccgacaacccgataccgatcgt

SEQ ID NO: 178457 - DNA, 75 bp, Artificial Sequence
  Synthetic
accttcgcaaattaccagatccccagcaccgacaacccgataccgatcgttgtgctaaacgctaacaataacctt

SEQ ID NO: 178458 - DNA, 75 bp, Artificial Sequence
  Synthetic
ctatgtagtccctctgaagccgcagggtagatggcctgaaataatgaccacagcaacaaccccctgccgcctacc

SEQ ID NO: 178459 - DNA, 75 bp, Artificial Sequence
  Synthetic
ggtcgccgccacgccgccactcacaatcaccccaaataaaccgaccggaacccctcacgtctccccggaggctga

SEQ ID NO: 178460 - DNA, 75 bp, Artificial Sequence
  Synthetic
acatgcctagtcgtattctcccgtcgctaccgaccccgaaacccagagagcctagaatcacgctaccccacgcac

SEQ ID NO: 178461 - DNA, 75 bp, Artificial Sequence
  Synthetic
gctaccgaccccgaaacccagagagcctagaatcacgctaccccacgcactgcccgttatatcacccccagcaca

SEQ ID NO: 178462 - DNA, 75 bp, Artificial Sequence
  Synthetic
aaggggttctccaaagcaaacgtggaactctcgtgctgcggcccgccgcggtcattgacccacggaagcccgtct

SEQ ID NO: 178463 - DNA, 75 bp, Artificial Sequence
  Synthetic
gacggcgctccagcccccccggactgagggcgaaggccggcgccctcccgacacgcaacccgtcactttaacctt

SEQ ID NO: 178464 - DNA, 75 bp, Artificial Sequence
  Synthetic
aaacaactcccccatccacgcccccacacgccatagacattagcccaccacagacacctcccatgtccacctcac

SEQ ID NO: 178465 - DNA, 75 bp, Artificial Sequence
  Synthetic
acacgccatagacattagcccaccacagacacctcccatgtccacctcacctcacgcgagagacacaagcccccc

SEQ ID NO: 178466 - DNA, 75 bp, Artificial Sequence
  Synthetic
cgtcgggagaggcaagagtcaagcgagtggagatcgaacagggcctttccacacgcaatgaagcccctccccttg

SEQ ID NO: 178467 - DNA, 75 bp, Artificial Sequence
  Synthetic
cgttaccccaaggcgcaccgtagcccgcgaaatcaggatcccgccggagataaaggcgggttgggacactgcacc

SEQ ID NO: 178468 - DNA, 75 bp, Artificial Sequence
  Synthetic
agcagtcgccagtttttccatctccatgagcgaaacgcattccccggcccttttgtttaagagggactggagcgc

SEQ ID NO: 178469 - DNA, 75 bp, Artificial Sequence
  Synthetic
taaaggcgggttgggacactgcaccggacattcctctgccccacagctccccggagtcatccccaccgacttccc

SEQ ID NO: 178470 - DNA, 75 bp, Artificial Sequence
  Synthetic
atcgcctcttcccaacctcgtagagagatacgcgcggggtttcctggacacgccctctgtagaggtgatgtccct

SEQ ID NO: 178471 - DNA, 75 bp, Artificial Sequence
  Synthetic
catccgtggtgcccatgccccatccaattatgtggtcacccatagtacccatcagtttacaaaacacagacatag

SEQ ID NO: 178472 - DNA, 75 bp, Artificial Sequence
  Synthetic
aattatgtggtcacccatagtacccatcagtttacaaaacacagacatagacactgcaaagataacactgattag

SEQ ID NO: 178473 - DNA, 75 bp, Artificial Sequence
  Synthetic
cggagacggttgacagaataaagaagtggtacttgtgactccacggttgtccaatcgttgcctatttctttttgc

SEQ ID NO: 178474 - DNA, 75 bp, Artificial Sequence
  Synthetic
gtggtacttgtgactccacggttgtccaatcgttgcctatttctttttgccagaggggggtttcctcgcgtcggc

SEQ ID NO: 178475 - DNA, 75 bp, Artificial Sequence
  Synthetic
ctgacgccggcgacaatgaatggggaccagaggacagggtggttatactgcttcccgagacccccagtgagtcct

SEQ ID NO: 178476 - DNA, 75 bp, Artificial Sequence
  Synthetic
agggcctggcctcgaaggcacggtgaacgtccccgcgtcgtaagccgacgccgcggaaactcggtcagcgcgctc

SEQ ID NO: 178477 - DNA, 75 bp, Artificial Sequence
  Synthetic
ccgcggaaactcggtcagcgcgctcgcgcggtttctgatccctaagggtctgcagatgatcccgcctttgaattc

SEQ ID NO: 178478 - DNA, 75 bp, Artificial Sequence
  Synthetic
ggcctcggggttccttggcggccggccactggaggcgtccgacattaaatatatgctgctcagcgaccagaccgc

SEQ ID NO: 178479 - DNA, 75 bp, Artificial Sequence
  Synthetic
gcgcggtttctgatccctaagggtctgcagatgatcccgcctttgaattccacccatcctcctcagataggcctc

SEQ ID NO: 178480 - DNA, 75 bp, Artificial Sequence
  Synthetic
caaatcaggacgcgtgcactttccagagccaggtggcctggctcagaacgaaatttgttaccgcattgagaaaac

SEQ ID NO: 178481 - DNA, 75 bp, Artificial Sequence
  Synthetic
ggtattcggcctgcgacatatttccctgatccagggtattcatgcgagccaccaggggatggtgagcgtagtcat

SEQ ID NO: 178482 - DNA, 75 bp, Artificial Sequence
  Synthetic
ctgatccagggtattcatgcgagccaccaggggatggtgagcgtagtcatgatccagtcgctcctggatcacggg

SEQ ID NO: 178483 - DNA, 75 bp, Artificial Sequence
  Synthetic
tcaggaggaacacttcccgcaacagaactccagcagctgtgaggtgagctgaagcagtccgcgcacgtcacggtg

SEQ ID NO: 178484 - DNA, 75 bp, Artificial Sequence
  Synthetic
aactccagcagctgtgaggtgagctgaagcagtccgcgcacgtcacggtgctttaatagggcagcctcgcagtcg

SEQ ID NO: 178485 - DNA, 75 bp, Artificial Sequence
  Synthetic
aatggcaagggccgcgttgttagctagaacagccctgattacgacgcgtgctagggtcccgcgtccggtaatatc

SEQ ID NO: 178486 - DNA, 75 bp, Artificial Sequence
  Synthetic
agaacagccctgattacgacgcgtgctagggtcccgcgtccggtaatatcgcacaggggatacaccctcatatgt

SEQ ID NO: 178487 - DNA, 75 bp, Artificial Sequence
  Synthetic
gaactgcttctctttcctgtccctgctgaaaaacacgttggtgggaggaaaattgacagtatgaaacttgcccct

SEQ ID NO: 178488 - DNA, 75 bp, Artificial Sequence
  Synthetic
aattgacagtatgaaacttgcccctgccaaagttaagacagtgtccacactccatgcacacaaccgcccgagcgc

SEQ ID NO: 178489 - DNA, 75 bp, Artificial Sequence
  Synthetic
ggtatggacacgcagggggagagaacattgtatgccagaagcctcctgccaaggttccgcacgagaccaggtccc

SEQ ID NO: 178490 - DNA, 75 bp, Artificial Sequence
  Synthetic
cattgtatgccagaagcctcctgccaaggttccgcacgagaccaggtccctcctgctcgcaggcgggcagcacta

SEQ ID NO: 178491 - DNA, 75 bp, Artificial Sequence
  Synthetic
tcgaacgggttaccgcagggaaccgtaggggcgacgcgctccaaggcctcccggaggccggtatctgccgcccct

SEQ ID NO: 178492 - DNA, 75 bp, Artificial Sequence
  Synthetic
tcgcagccacaccgcgacgggtgggcgagggcacctccaggaggggacgacgcggcaacggcccatgccacttct

SEQ ID NO: 178493 - DNA, 75 bp, Artificial Sequence
  Synthetic
gccctaaccctagccatagtcctaactctagccataaccctaaccttagccataaacccaaccctaacctcagcc

SEQ ID NO: 178494 - DNA, 75 bp, Artificial Sequence
  Synthetic
cgcggcaacggcccatgccacttcttccttagccagggtagcgacggtgggggcttcgaacagcaggtcactaac

SEQ ID NO: 178495 - DNA, 75 bp, Artificial Sequence
  Synthetic
cataaacccaaccctaacctcagccccagttcaatcctaatcctaaccttaaccttagccaaaacttaaccctag

SEQ ID NO: 178496 - DNA, 75 bp, Artificial Sequence
  Synthetic
tccttagccagggtagcgacggtgggggcttcgaacagcaggtcactaacggaaagcgagagcaaagcgccaaca

SEQ ID NO: 178497 - DNA, 75 bp, Artificial Sequence
  Synthetic
ccagttcaatcctaatcctaaccttaaccttagccaaaacttaaccctagtcccagccccaaccttcatcataac

SEQ ID NO: 178498 - DNA, 75 bp, Artificial Sequence
  Synthetic
gcccatacgtggcgcggtatcgccctagcatggtcggcggcctgggcacgggacagcgtcaccacaacccatacg

SEQ ID NO: 178499 - DNA, 75 bp, Artificial Sequence
  Synthetic
cccatttttaaccttataaaaaagcacatgcatatttagtgtcgctcaatcgggcgtatattgtgggtttccgcc

SEQ ID NO: 178500 - DNA, 75 bp, Artificial Sequence
  Synthetic
tagcatggtcggcggcctgggcacgggacagcgtcaccacaacccatacgtgggcgccaagcagctgctgcgccg

SEQ ID NO: 178501 - DNA, 75 bp, Artificial Sequence
  Synthetic
acatgcatatttagtgtcgctcaatcgggcgtatattgtgggtttccgcccggaccaatgttaagtgggttcact

SEQ ID NO: 178502 - DNA, 75 bp, Artificial Sequence
  Synthetic
gcgatcgcctgcgccagcgacgggcggtccaacaggtgcctggcccaggagggcatgtttccctggaaaccccgc

SEQ ID NO: 178503 - DNA, 75 bp, Artificial Sequence
  Synthetic
aagcattgcagatgcctgatagataaaccctgcacccttggataaagtttaaagatgacaagcctaacactttta

SEQ ID NO: 178504 - DNA, 75 bp, Artificial Sequence
  Synthetic
ggtccaacaggtgcctggcccaggagggcatgtttccctggaaaccccgctccccgaatatgacaaaagccacat

SEQ ID NO: 178505 - DNA, 75 bp, Artificial Sequence
  Synthetic
aaccctgcacccttggataaagtttaaagatgacaagcctaacacttttacttgtatgttttatcttggttggga

SEQ ID NO: 178506 - DNA, 75 bp, Artificial Sequence
  Synthetic
agctgggcctcatccaaaccaaaccaagacacaagaaagcgatcccagcgctgatccagggccatgaccttctca

SEQ ID NO: 178507 - DNA, 75 bp, Artificial Sequence
  Synthetic
tgtccaacattgcctaatacaccctacaatctccagtgtggaccaggacaacgtggaacagtgaagtggtttaat

SEQ ID NO: 178508 - DNA, 75 bp, Artificial Sequence
  Synthetic
aagacacaagaaagcgatcccagcgctgatccagggccatgaccttctcaccagcgcgaccgcacggcctaagct

SEQ ID NO: 178509 - DNA, 75 bp, Artificial Sequence
  Synthetic
acaatctccagtgtggaccaggacaacgtggaacagtgaagtggtttaataatggaacacaacaaacggacctgt

SEQ ID NO: 178510 - DNA, 75 bp, Artificial Sequence
  Synthetic
aatataccgctgtgacgtctgatgtacaggcccgcgcgtcgcggccgttggtgggaaaaccggcaccaccctgtg

SEQ ID NO: 178511 - DNA, 75 bp, Artificial Sequence
  Synthetic
acctgtgcaatcaaacattcaaacagaagcaacgcggtaaatttgggggcccactatcctctcgtactgcagaca

SEQ ID NO: 178512 - DNA, 75 bp, Artificial Sequence
  Synthetic
acaggcccgcgcgtcgcggccgttggtgggaaaaccggcaccaccctgtgcggccgaatccgccacgggggctgc

SEQ ID NO: 178513 - DNA, 75 bp, Artificial Sequence
  Synthetic
gaagcaacgcggtaaatttgggggcccactatcctctcgtactgcagacacaatgctctcgtcctccatggcaaa

SEQ ID NO: 178514 - DNA, 75 bp, Artificial Sequence
  Synthetic
gcgtcaccaccaaaaattgcaaaacctgcctgtagtccgtgaagtaggtacggcatattaccatggagttgtaca

SEQ ID NO: 178515 - DNA, 75 bp, Artificial Sequence
  Synthetic
aataaatttgacttttggttacacaagggaaacctgagtacaaaggtacacgctggacataaattttataacttt

SEQ ID NO: 178516 - DNA, 75 bp, Artificial Sequence
  Synthetic
ctgcctgtagtccgtgaagtaggtacggcatattaccatggagttgtacacgcccaggttctttgagaacaccag

SEQ ID NO: 178517 - DNA, 75 bp, Artificial Sequence
  Synthetic
ttgctgaccaacaaaacatcgggatgttatgactgcacgcatgcaggacaaaataattcaaaggaactagtttct

SEQ ID NO: 178518 - DNA, 75 bp, Artificial Sequence
  Synthetic
ttttggcaaggtatacgtccgactccacgggaaggacgtgcccaaactgggacacggcgtcgcttggtcggcaca

SEQ ID NO: 178519 - DNA, 75 bp, Artificial Sequence
  Synthetic
cacgggaaggacgtgcccaaactgggacacggcgtcgcttggtcggcacagaaagcacttcagggttgtggaaag

SEQ ID NO: 178520 - DNA, 75 bp, Artificial Sequence
  Synthetic
caccacccgggagacaaccaccagtggccacaccacccaggcgcccaccacccgggagacaaccaccagtggcca

SEQ ID NO: 178521 - DNA, 75 bp, Artificial Sequence
  Synthetic
ccaggaggtgcgcccaaaacttatacacaaactctaagtggtacacgcaaccgtgctgcattctaaccgtacata

SEQ ID NO: 178522 - DNA, 75 bp, Artificial Sequence
  Synthetic
cacaaactctaagtggtacacgcaaccgtgctgcattctaaccgtacatatggcggtagcaccgcccttagcata

SEQ ID NO: 178523 - DNA, 75 bp, Artificial Sequence
  Synthetic
gtcccaagtatgaggataccacccgacacagttcgtccactacacgcttaccaacgacactcatggcgacagcgg

SEQ ID NO: 178524 - DNA, 75 bp, Artificial Sequence
  Synthetic
agccacaccacccaggcgccaaccacccgggaaacaagcaccaggagccacaccacccaggcgccaaccacccgg

SEQ ID NO: 178525 - DNA, 75 bp, Artificial Sequence
  Synthetic
acacagttcgtccactacacgcttaccaacgacactcatggcgacagcggggtggggctggcaaggcccccaaag

SEQ ID NO: 178526 - DNA, 75 bp, Artificial Sequence
  Synthetic
cgtccgtgctcacgatcttgcgcaggacctgccttaccgtgtccaccttgctctccaacaccagagtatgatcgc

SEQ ID NO: 178527 - DNA, 75 bp, Artificial Sequence
  Synthetic
gacctgccttaccgtgtccaccttgctctccaacaccagagtatgatcgcaggctgcaggctgtgcccgctggac

SEQ ID NO: 178528 - DNA, 75 bp, Artificial Sequence
  Synthetic
caattactccaaataacggagattattaccaaccaaacacaaaacaacagcatgccaactgctcttggacccgca

SEQ ID NO: 178529 - DNA, 75 bp, Artificial Sequence
  Synthetic
ttaccaaccaaacacaaaacaacagcatgccaactgctcttggacccgcaaagctatccacaaatcaaaccatag

SEQ ID NO: 178530 - DNA, 75 bp, Artificial Sequence
  Synthetic
agatcgtgggaaataaaatttgcatgtcacgaggcagaagctggtcagacgcgtactccatgttgggttccacgg

SEQ ID NO: 178531 - DNA, 75 bp, Artificial Sequence
  Synthetic
gtcacgaggcagaagctggtcagacgcgtactccatgttgggttccacggggaggggaacacacgccccaagaca

SEQ ID NO: 178532 - DNA, 75 bp, Artificial Sequence
  Synthetic
atcggcattatactatccatgatagcatgctgtgtgtataaatggctaatgatgcggcagcagcaacagcagcaa

SEQ ID NO: 178533 - DNA, 75 bp, Artificial Sequence
  Synthetic
catgctgtgtgtataaatggctaatgatgcggcagcagcaacagcagcaacagcagccgcaacagcagccgcaac

SEQ ID NO: 178534 - DNA, 75 bp, Artificial Sequence
  Synthetic
ccgcagcgagccggtttgcagagtggtcacctgccctgctccacacccacccccgcgtctcttccaactctcaac

SEQ ID NO: 178535 - DNA, 75 bp, Artificial Sequence
  Synthetic
gtcacctgccctgctccacacccacccccgcgtctcttccaactctcaactcacgatccagggaaaccaccgtcc

SEQ ID NO: 178536 - DNA, 75 bp, Artificial Sequence
  Synthetic
cagcagcagcagcaccaccagcagcagcagcaccaccagcagcagcaacggcaacagcaacagcagcagcaccac

SEQ ID NO: 178537 - DNA, 75 bp, Artificial Sequence
  Synthetic
agcagcaccaccagcagcagcaacggcaacagcaacagcagcagcaccaccaccagcagcagcagcaacagcaac

SEQ ID NO: 178538 - DNA, 75 bp, Artificial Sequence
  Synthetic
atgagctccaaaaactactggcagcctccctgctcccggagcacccggaggagagcctcggtaaccccataatga

SEQ ID NO: 178539 - DNA, 75 bp, Artificial Sequence
  Synthetic
ctccctgctcccggagcacccggaggagagcctcggtaaccccataatgacacagattcaccagtcgctccaacc

SEQ ID NO: 178540 - DNA, 75 bp, Artificial Sequence
  Synthetic
cagctgccagactacatgcccctcttggaccgccaaccatccctatataatatagcatcatcgtgagcaggtaag

SEQ ID NO: 178541 - DNA, 75 bp, Artificial Sequence
  Synthetic
tggaccgccaaccatccctatataatatagcatcatcgtgagcaggtaagtttgttttgttttacatattattta

SEQ ID NO: 178542 - DNA, 75 bp, Artificial Sequence
  Synthetic
cgtccacccccatgggtttcttcgaggactatgcctgcctctgcttcttctgtctatacgccccacactgctgga

SEQ ID NO: 178543 - DNA, 75 bp, Artificial Sequence
  Synthetic
ggactatgcctgcctctgcttcttctgtctatacgccccacactgctggacctcgaccatggcggcagcggcaga

SEQ ID NO: 178544 - DNA, 75 bp, Artificial Sequence
  Synthetic
ggcacacagttgaactgacatctattcgcctcgcgctatcaccatagcttcacgatggcattgcatctgtgtatt

SEQ ID NO: 178545 - DNA, 75 bp, Artificial Sequence
  Synthetic
tcgcctcgcgctatcaccatagcttcacgatggcattgcatctgtgtatttttctgaccattattctggagacat

SEQ ID NO: 178546 - DNA, 75 bp, Artificial Sequence
  Synthetic
ggctattcggaccgggtcgccttatgggtatcgacttgcagctgcacttctttgttcaaaagtgctttaagacca

SEQ ID NO: 178547 - DNA, 75 bp, Artificial Sequence
  Synthetic
gggtatcgacttgcagctgcacttctttgttcaaaagtgctttaagaccaccgccgccgaaaaaatactgggaat

SEQ ID NO: 178548 - DNA, 75 bp, Artificial Sequence
  Synthetic
tacaaatctaaaacacgcaccaaaggtccagtccaggtgggccaaactgtggagcttacatgcaggttgggatat

SEQ ID NO: 178549 - DNA, 75 bp, Artificial Sequence
  Synthetic
gtccagtccaggtgggccaaactgtggagcttacatgcaggttgggatattttaccagctctaaagttagtaata

SEQ ID NO: 178550 - DNA, 75 bp, Artificial Sequence
  Synthetic
gcaccatcacctgcaacttctgcttcaaaacgtcctggcccaggacagacaaggaggaggccaccggccccaccc

SEQ ID NO: 178551 - DNA, 75 bp, Artificial Sequence
  Synthetic
caaaacgtcctggcccaggacagacaaggaggaggccaccggccccaccccatgctgccagattacagacaccac

SEQ ID NO: 178552 - DNA, 75 bp, Artificial Sequence
  Synthetic
tgtgaaaaaaagtcttgtgagaatccaggagaattaaccaatggaaacatcatttttgataaaggcccagatgcg

SEQ ID NO: 178553 - DNA, 75 bp, Artificial Sequence
  Synthetic
caggagaattaaccaatggaaacatcatttttgataaaggcccagatgcgttaaaatatggcgcaacaataacat

SEQ ID NO: 178554 - DNA, 75 bp, Artificial Sequence
  Synthetic
gcgcaagtcgccccacaaagcccagcctacttcccgcgctaatagatatctggtccacgagctcagagctccttg

SEQ ID NO: 178555 - DNA, 75 bp, Artificial Sequence
  Synthetic
acgagccgcgccctcgactgatcgcaagcgacatgagtgaactcaaatccgtggtcgcatcccacgatccgttct

SEQ ID NO: 178556 - DNA, 75 bp, Artificial Sequence
  Synthetic
atgctcggcttatctggacaagtatcatggagttcagcggcacctatctgtgaaaagaagaaatgcataccaccc

SEQ ID NO: 178557 - DNA, 75 bp, Artificial Sequence
  Synthetic
catggagttcagcggcacctatctgtgaaaagaagaaatgcataccacccaaatttccaaatggaacttttgcac

SEQ ID NO: 178558 - DNA, 75 bp, Artificial Sequence
  Synthetic
ccaaccctggggctacgatacaaaaacgggactgcatccgtctgcctcctctgcgagtgccttgcggcacaccca

SEQ ID NO: 178559 - DNA, 75 bp, Artificial Sequence
  Synthetic
acgggactgcatccgtctgcctcctctgcgagtgccttgcggcacacccagaggcacccaaggcgctgcagaccc

SEQ ID NO: 178560 - DNA, 75 bp, Artificial Sequence
  Synthetic
aaaggattaacgcttattgggaaacataccacctcgtgtggatcgaacgaatggaccgaccctatcccaacgtgt

SEQ ID NO: 178561 - DNA, 75 bp, Artificial Sequence
  Synthetic
ataccacctcgtgtggatcgaacgaatggaccgaccctatcccaacgtgtgaacgaactggctgtaaatttccac

SEQ ID NO: 178562 - DNA, 75 bp, Artificial Sequence
  Synthetic
agaattgcctttgtgttggacaacccattcgccatgccatatgtctcagatccgctacttagagagctgatccgg

SEQ ID NO: 178563 - DNA, 75 bp, Artificial Sequence
  Synthetic
cattcgccatgccatatgtctcagatccgctacttagagagctgatccggggctgtaccccacaggaaattcaca

SEQ ID NO: 178564 - DNA, 75 bp, Artificial Sequence
  Synthetic
ggacaatcagttacagtcaagtgcaatgttggatatttcttgcaaggaaccgaaatgtcaacgtgcacgattaca

SEQ ID NO: 178565 - DNA, 75 bp, Artificial Sequence
  Synthetic
atgttggatatttcttgcaaggaaccgaaatgtcaacgtgcacgattacagaatggaacccaccacttgcagatt

SEQ ID NO: 178566 - DNA, 75 bp, Artificial Sequence
  Synthetic
gcgtggtctcttctctaccgtgaatcgcaccttaaacacaccaccagaccgccaccaggtggcacccaacatcca

SEQ ID NO: 178567 - DNA, 75 bp, Artificial Sequence
  Synthetic
gaggacgtactattccgcctgcccagggagcaggagtataaaaagctcagggcatccgcggccgccggacagctc

SEQ ID NO: 178568 - DNA, 75 bp, Artificial Sequence
  Synthetic
gggagcaggagtataaaaagctcagggcatccgcggccgccggacagctcctcgatgccaacaccctgttcgact

SEQ ID NO: 178569 - DNA, 75 bp, Artificial Sequence
  Synthetic
gtgaccacccacggtcaagggcatattccagaagacacctcgcgcgggccccctacaccgcttaatccagaggta

SEQ ID NO: 178570 - DNA, 75 bp, Artificial Sequence
  Synthetic
ttccagaagacacctcgcgcgggccccctacaccgcttaatccagaggtacaaaccacgcctgatttaaacgtgc

SEQ ID NO: 178571 - DNA, 75 bp, Artificial Sequence
  Synthetic
cgcaccttaaacacaccaccagaccgccaccaggtggcacccaacatccattatggaaaaaccccgcgccacctt

SEQ ID NO: 178572 - DNA, 75 bp, Artificial Sequence
  Synthetic
agggtggggaaaaccacctcactagacattattcgggagctaaccgcacaactaaaaagacaccgcctagacctg

SEQ ID NO: 178573 - DNA, 75 bp, Artificial Sequence
  Synthetic
acattattcgggagctaaccgcacaactaaaaagacaccgcctagacctggcccacccctcacagacgtcacact

SEQ ID NO: 178574 - DNA, 75 bp, Artificial Sequence
  Synthetic
ccaacccagcatacgacaaatgctccatctacttctacagaccccatcgagcaaacacctaccgaaaccacccat

SEQ ID NO: 178575 - DNA, 75 bp, Artificial Sequence
  Synthetic
catctacttctacagaccccatcgagcaaacacctaccgaaaccacccatcgtaagaacaccacgcccgcaacag

SEQ ID NO: 178576 - DNA, 75 bp, Artificial Sequence
  Synthetic
aatcagtgtccagccacatcagcttggcgacctcaaccggtcgcagtggaccgcgagacatcagaagatgcttgt

SEQ ID NO: 178577 - DNA, 75 bp, Artificial Sequence
  Synthetic
ggcgacctcaaccggtcgcagtggaccgcgagacatcagaagatgcttgtcatcccgcctgcggtcggtcccgcc

SEQ ID NO: 178578 - DNA, 75 bp, Artificial Sequence
  Synthetic
gatacaacacctacacaaatgcccacaacagtcacaacaactcaccataaagctacatttacagcttctacaccg

SEQ ID NO: 178579 - DNA, 75 bp, Artificial Sequence
  Synthetic
caacagtcacaacaactcaccataaagctacatttacagcttctacaccgcaatatacaacccaaccgcacatgc

SEQ ID NO: 178580 - DNA, 75 bp, Artificial Sequence
  Synthetic
agtttatctcagacaaggtattttttagcatcctatcgcacagacacgagctaggagtggactttctccgtgaga

SEQ ID NO: 178581 - DNA, 75 bp, Artificial Sequence
  Synthetic
tagcatcctatcgcacagacacgagctaggagtggactttctccgtgagatggagaccccgatatgcacctccaa

SEQ ID NO: 178582 - DNA, 75 bp, Artificial Sequence
  Synthetic
ccaaacacgggactgccaacatttaacaccccttacaatataactgtaaaacctacaactaatgcttccttctct

SEQ ID NO: 178583 - DNA, 75 bp, Artificial Sequence
  Synthetic
acaccccttacaatataactgtaaaacctacaactaatgcttccttctctccaacagatgcaccacccgtgaccc

SEQ ID NO: 178584 - DNA, 75 bp, Artificial Sequence
  Synthetic
tctccctctctccgtttggacactcctcaaacatggggttccagtgcgctctgtgcccatccacagaaaatccca

SEQ ID NO: 178585 - DNA, 75 bp, Artificial Sequence
  Synthetic
ctcaaacatggggttccagtgcgctctgtgcccatccacagaaaatcccaccgttgcccaaggctcccggcctca

SEQ ID NO: 178586 - DNA, 75 bp, Artificial Sequence
  Synthetic
aacacccgggccctggaaaagcatatggtaattggagttctcagcctcgttgccatagcctgtggtttcatcacg

SEQ ID NO: 178587 - DNA, 75 bp, Artificial Sequence
  Synthetic
tggtaattggagttctcagcctcgttgccatagcctgtggtttcatcacgctagttcattacgtgttttttcgct

SEQ ID NO: 178588 - DNA, 75 bp, Artificial Sequence
  Synthetic
cgctggccttttatcaccacgcagacaaagtgatccaacacaagacgttttacctatcactcctcagtcactcca

SEQ ID NO: 178589 - DNA, 75 bp, Artificial Sequence
  Synthetic
caaagtgatccaacacaagacgttttacctatcactcctcagtcactccatggatgtggttcggcagagcttcct

SEQ ID NO: 178590 - DNA, 75 bp, Artificial Sequence
  Synthetic
ttcattttaacccttcatccgccaccgctgtgtatgtattcagaataaacatcacgcctcatccccattcggtct

SEQ ID NO: 178591 - DNA, 75 bp, Artificial Sequence
  Synthetic
cgctgtgtatgtattcagaataaacatcacgcctcatccccattcggtctccgctgtgccatgaatacctaacac

SEQ ID NO: 178592 - DNA, 75 bp, Artificial Sequence
  Synthetic
atcccctacccatcttcactaccaacaacggcatgctaacaatgtgcatcctttttaaaacccgggcactacatc

SEQ ID NO: 178593 - DNA, 75 bp, Artificial Sequence
  Synthetic
caacggcatgctaacaatgtgcatcctttttaaaacccgggcactacatctgggagaaactgcgcttaggctgct

SEQ ID NO: 178594 - DNA, 75 bp, Artificial Sequence
  Synthetic
ccttttttgggcgcgccgataaatgtaaccgcaaatgccgggaggagggcggggtggaggtataaatacaacatc

SEQ ID NO: 178595 - DNA, 75 bp, Artificial Sequence
  Synthetic
taaccgcaaatgccgggaggagggcggggtggaggtataaatacaacatcatacgcatatgatgcaggacccgat

SEQ ID NO: 178596 - DNA, 75 bp, Artificial Sequence
  Synthetic
cctacgtggtcaagtttgtcccaacgcacccggacaccgcaagcattgcagtgcaggtacacaccatatgcgaag

SEQ ID NO: 178597 - DNA, 75 bp, Artificial Sequence
  Synthetic
gcacccggacaccgcaagcattgcagtgcaggtacacaccatatgcgaagcggttgcggcgctagactgcaccga

SEQ ID NO: 178598 - DNA, 75 bp, Artificial Sequence
  Synthetic
taaaattgcacaaggccagccgcccgaggaaaatctaggatcatccgcgcccatcgggccttgtggctatatcta

SEQ ID NO: 178599 - DNA, 75 bp, Artificial Sequence
  Synthetic
gaggaaaatctaggatcatccgcgcccatcgggccttgtggctatatctatgcatacgcaaacggcacctaccct

SEQ ID NO: 178600 - DNA, 75 bp, Artificial Sequence
  Synthetic
aacctcacatgtagcctgtcaccccagctcctattgcaactgaccatgttcaggtggtaataaagtcattaaacg

SEQ ID NO: 178601 - DNA, 75 bp, Artificial Sequence
  Synthetic
ttcattaccactactacacggcctcaccgtcgaaaccaactttcccctgaacgtcaaagcaattcataaaaaact

SEQ ID NO: 178602 - DNA, 75 bp, Artificial Sequence
  Synthetic
accgtcgaaaccaactttcccctgaacgtcaaagcaattcataaaaaactagacgcaaccacacttgcggttaag

SEQ ID NO: 178603 - DNA, 75 bp, Artificial Sequence
  Synthetic
ctgcaatgtactgccatgaaaggtggttctatatccaccacttggcgtctgccgaagtcagtgccacaatttcat

SEQ ID NO: 178604 - DNA, 75 bp, Artificial Sequence
  Synthetic
tcggccactctttcaagggcctggcctagagaagctatgccgagacaccagggaactctttgggttttccaactt

SEQ ID NO: 178605 - DNA, 75 bp, Artificial Sequence
  Synthetic
ctagagaagctatgccgagacaccagggaactctttgggttttccaacttctcggcatcgcccccccagggagct

SEQ ID NO: 178606 - DNA, 75 bp, Artificial Sequence
  Synthetic
attcgtgtggtttgggagagcggacgccatttgcgtgcaaaatgtgctttgctggaggccaacttccgtcgcgct

SEQ ID NO: 178607 - DNA, 75 bp, Artificial Sequence
  Synthetic
gccatttgcgtgcaaaatgtgctttgctggaggccaacttccgtcgcgctggttgatgcgcggcacattgtgtca

SEQ ID NO: 178608 - DNA, 75 bp, Artificial Sequence
  Synthetic
tctagcagcgatcgtaaccgagggctttaaagagaggctttacgccggcaaactggtccccgttccgtcccagac

SEQ ID NO: 178609 - DNA, 75 bp, Artificial Sequence
  Synthetic
tttaaagagaggctttacgccggcaaactggtccccgttccgtcccagacgcaacctgtgcgcatcggcgataca

SEQ ID NO: 178610 - DNA, 75 bp, Artificial Sequence
  Synthetic
cctggttgacaccgcgtgccggccttctgaactgtgactgtgttatgagccacgggtatgccctcgatacgcctg

SEQ ID NO: 178611 - DNA, 75 bp, Artificial Sequence
  Synthetic
tctgaactgtgactgtgttatgagccacgggtatgccctcgatacgcctgctcttcagcattgtatgtgtttaat

SEQ ID NO: 178612 - DNA, 75 bp, Artificial Sequence
  Synthetic
cgccaaatgccctcccaggttctacagtcccgaactcagtcaatatctacacgattctctatatacctgtctggc

SEQ ID NO: 178613 - DNA, 75 bp, Artificial Sequence
  Synthetic
ctacatttttctattttaagtacgggatacaaagcagggtctgaggcaatctgccgccctatgtcagaaagagca

SEQ ID NO: 178614 - DNA, 75 bp, Artificial Sequence
  Synthetic
actctttgggagggcacgctagcttcagtgcgcgcccgttgcaactcgtgtcctgaatgctacggggccacgctg

SEQ ID NO: 178615 - DNA, 75 bp, Artificial Sequence
  Synthetic
agtcccgaactcagtcaatatctacacgattctctatatacctgtctggcacaggcgctacgcctgaagaacgtc

SEQ ID NO: 178616 - DNA, 75 bp, Artificial Sequence
  Synthetic
cagtgcgcgcccgttgcaactcgtgtcctgaatgctacggggccacgctggccactcggggggacaacactaatc

SEQ ID NO: 178617 - DNA, 75 bp, Artificial Sequence
  Synthetic
gccaacagacaaacgagtggtggtatcgccccaagcctccagcgccacccatttagtaacacatccgggacatga

SEQ ID NO: 178618 - DNA, 75 bp, Artificial Sequence
  Synthetic
ggtagctaagctggtacatgctaaagagtttccacagggagctttccgtggcgcagagggcgcgaccctagcggt

SEQ ID NO: 178619 - DNA, 75 bp, Artificial Sequence
  Synthetic
gagtttccacagggagctttccgtggcgcagagggcgcgaccctagcggttttagacagtctggtggccgagttg

SEQ ID NO: 178620 - DNA, 75 bp, Artificial Sequence
  Synthetic
cgcgctcaactacgagacctggcccatcttcgaaaactgcacagcgccagaggacagagttagggccctcgaggc

SEQ ID NO: 178621 - DNA, 75 bp, Artificial Sequence
  Synthetic
ggaggagggcaccaggttcccggggaggagggcaccaggttcccggggaggagggcaccaggttcccggggagga

SEQ ID NO: 178622 - DNA, 75 bp, Artificial Sequence
  Synthetic
atcttcgaaaactgcacagcgccagaggacagagttagggccctcgaggcgtggaacgccgagcaggcgctgcac

SEQ ID NO: 178623 - DNA, 75 bp, Artificial Sequence
  Synthetic
ggcaaagctccagacaaagaccgccaaaggggacggcaacatatacaactcattctacctacaacacggtctcgg

SEQ ID NO: 178624 - DNA, 75 bp, Artificial Sequence
  Synthetic
ggggtggcggcagtgcgacgcaagtatccacaataagtttatttggactacaagattacatccggttttataatt

SEQ ID NO: 178625 - DNA, 75 bp, Artificial Sequence
  Synthetic
aaaggggacggcaacatatacaactcattctacctacaacacggtctcggctatctctccgaggcaacaattaag

SEQ ID NO: 178626 - DNA, 75 bp, Artificial Sequence
  Synthetic
ccgcgccgggttcccggggtgcgccgcgccgggttcccggggtgcgccgcgccgggttcctggggtgcgccgcgc

SEQ ID NO: 178627 - DNA, 75 bp, Artificial Sequence
  Synthetic
caattcatacacgttgtcccacctggtttacgcggcctcgttttccccgcatatcctggccagaatatgctatta

SEQ ID NO: 178628 - DNA, 75 bp, Artificial Sequence
  Synthetic
gtttacgcggcctcgttttccccgcatatcctggccagaatatgctattaccttcagtttatcccacaccacaag

SEQ ID NO: 178629 - DNA, 75 bp, Artificial Sequence
  Synthetic
cctcagtcccatgtgcgacctctgcagaggagagcgaccatcggtgtgcatacacaccttgttctataggttaca

SEQ ID NO: 178630 - DNA, 75 bp, Artificial Sequence
  Synthetic
agaggagagcgaccatcggtgtgcatacacaccttgttctataggttacaagaccggtttccacccgtcctggcc

SEQ ID NO: 178631 - DNA, 75 bp, Artificial Sequence
  Synthetic
cgacttggacatcctaggcaactttgcaacgttcagggaacgagaagaggacggaaaccccgccgacgaaacacc

SEQ ID NO: 178632 - DNA, 75 bp, Artificial Sequence
  Synthetic
gcaacgttcagggaacgagaagaggacggaaaccccgccgacgaaacacccaagtacacgtactggcagctgtgt

SEQ ID NO: 178633 - DNA, 75 bp, Artificial Sequence
  Synthetic
ctcctcgatacgtgtaaatccaagagatccgtcctccgtgccgccgcgcgcgtaatgcgcgaggggggtcggtct

SEQ ID NO: 178634 - DNA, 75 bp, Artificial Sequence
  Synthetic
gatccgtcctccgtgccgccgcgcgcgtaatgcgcgaggggggtcggtctcccctcttctttatagcgtttcctg

SEQ ID NO: 178635 - DNA, 75 bp, Artificial Sequence
  Synthetic
cagtctgaataatcttatagtggacattcccagttttctgaaagtgtttaaaaacatcgacggcatcgtagacgg

SEQ ID NO: 178636 - DNA, 75 bp, Artificial Sequence
  Synthetic
attcccagttttctgaaagtgtttaaaaacatcgacggcatcgtagacggtgagctcgtaaagttcatcaactgc

SEQ ID NO: 178637 - DNA, 75 bp, Artificial Sequence
  Synthetic
catttcccggggccgcgccagaggtgagcgtggacctagcatcccgctcccatttaccgaaaccacccagaggcg

SEQ ID NO: 178638 - DNA, 75 bp, Artificial Sequence
  Synthetic
gagcgtggacctagcatcccgctcccatttaccgaaaccacccagaggcgagattccagggccgtgactcactag

SEQ ID NO: 178639 - DNA, 75 bp, Artificial Sequence
  Synthetic
catcttgcagtttgcatgcaacgtctactggcaagccccgtgtgccgtgtttctccacctatactacagatctct

SEQ ID NO: 178640 - DNA, 75 bp, Artificial Sequence
  Synthetic
tactggcaagccccgtgtgccgtgtttctccacctatactacagatctcttctgacagtgattcaggatatctgc

SEQ ID NO: 178641 - DNA, 75 bp, Artificial Sequence
  Synthetic
tgggcggggcccctataatcctggcccccatctaccgaaacgacccagtagaaaaatcccaaccccatgactcat

SEQ ID NO: 178642 - DNA, 75 bp, Artificial Sequence
  Synthetic
ccccatctaccgaaacgacccagtagaaaaatcccaaccccatgactcatcaggccctattatatagaatatccc

SEQ ID NO: 178643 - DNA, 75 bp, Artificial Sequence
  Synthetic
gccatcagagtggctgaaaatgcactttcaaactatgtggactaactttaagggcgcgtgttttgacaagggggc

SEQ ID NO: 178644 - DNA, 75 bp, Artificial Sequence
  Synthetic
tttcaaactatgtggactaactttaagggcgcgtgttttgacaagggggccattacgggcagtgaactcaaaata

SEQ ID NO: 178645 - DNA, 75 bp, Artificial Sequence
  Synthetic
aaggagggttgaatacagttgggggtagtccgctggtattcccagctgaggttgccttatttggtaatgcttccg

SEQ ID NO: 178646 - DNA, 75 bp, Artificial Sequence
  Synthetic
aggcatgtttgcccctaccagagtgcaggtgaggctctccagagcgatgctcatggttcctagaaccattaaaat

SEQ ID NO: 178647 - DNA, 75 bp, Artificial Sequence
  Synthetic
gaaataccacctgagtaccccattggtttataccttgtttaattgtagaattacagctggatttacccagccggg

SEQ ID NO: 178648 - DNA, 75 bp, Artificial Sequence
  Synthetic
caggtgaggctctccagagcgatgctcatggttcctagaaccattaaaataaaaaacagaatcatattcgccaac

SEQ ID NO: 178649 - DNA, 75 bp, Artificial Sequence
  Synthetic
gctgggtagacccagctgggtatacctactggaataggggctgcgatgactcagctgcgctaggattaaaggatt

SEQ ID NO: 178650 - DNA, 75 bp, Artificial Sequence
  Synthetic
caaagactcttacgttgtgggcgggccttacataaaattcctgcacatgttgcacagaacactgttccctgccac

SEQ ID NO: 178651 - DNA, 75 bp, Artificial Sequence
  Synthetic
ccttacataaaattcctgcacatgttgcacagaacactgttccctgccactaagacatccgctctgtacatgtgg

SEQ ID NO: 178652 - DNA, 75 bp, Artificial Sequence
  Synthetic
ggagttctagggataggggccaatgggaggcctccgaatttgattgacggctggggcgtccaatggaatggcgcg

SEQ ID NO: 178653 - DNA, 75 bp, Artificial Sequence
  Synthetic
agcccagattgtggagctgtgtacctacattaagacgagcagccaggcatttgacgaggcgaacgtgttagacat

SEQ ID NO: 178654 - DNA, 75 bp, Artificial Sequence
  Synthetic
tacattaagacgagcagccaggcatttgacgaggcgaacgtgttagacattatcccagaaaccctgacagcttat

SEQ ID NO: 178655 - DNA, 75 bp, Artificial Sequence
  Synthetic
cggccgaatgggccaatggcggctcggaaaactttgattgacgggccggcggaccaatgggagaggggcagagga

SEQ ID NO: 178656 - DNA, 75 bp, Artificial Sequence
  Synthetic
ggaccaatgggagaggggcagaggattacgggggattagcaaattcaagatggcggcgcccataaaatggccaaa

SEQ ID NO: 178657 - DNA, 75 bp, Artificial Sequence
  Synthetic
gttctacgcaaccaccctgtcgtgcctcacacctgcctgtcagacagtggccgcggacgaatacccccacgtgct

SEQ ID NO: 178658 - DNA, 75 bp, Artificial Sequence
  Synthetic
ttacgggggattagcaaattcaagatggcggcgcccataaaatggccaaaaattataatttttcgagtcgctcac

SEQ ID NO: 178659 - DNA, 75 bp, Artificial Sequence
  Synthetic
ctcacacctgcctgtcagacagtggccgcggacgaatacccccacgtgctgggcgaggtacatctaaactcccca

SEQ ID NO: 178660 - DNA, 75 bp, Artificial Sequence
  Synthetic
tgaatttttctgcgcatgcgcgactcctcatctacataatttatgcacataaaaggattagcgcatgcaaattag

SEQ ID NO: 178661 - DNA, 75 bp, Artificial Sequence
  Synthetic
taccctaaaacacgcggtttccgcgaccgggcgtcttcgtcccatcgtaacggtaccgctcgtagtaaacaaata

SEQ ID NO: 178662 - DNA, 75 bp, Artificial Sequence
  Synthetic
cctcatctacataatttatgcacataaaaggattagcgcatgcaaattagtcagatagcagggccatccacactt

SEQ ID NO: 178663 - DNA, 75 bp, Artificial Sequence
  Synthetic
accgggcgtcttcgtcccatcgtaacggtaccgctcgtagtaaacaaatacacaggtagcaacggaaacacgaac

SEQ ID NO: 178664 - DNA, 75 bp, Artificial Sequence
  Synthetic
tcagtcgcgcctagctgcttccaacagacaaaagcggggcgttagtgagggagtgcgcgcgctgcgctgacttgg

SEQ ID NO: 178665 - DNA, 75 bp, Artificial Sequence
  Synthetic
aaacctcagagcagacaccgttccgttcaaaaagaataacgcctccagcatgatgcgaaaaagacacgtgatcat

SEQ ID NO: 178666 - DNA, 75 bp, Artificial Sequence
  Synthetic
ttcaaaaagaataacgcctccagcatgatgcgaaaaagacacgtgatcatgaccccaacggtggacagattagtt

SEQ ID NO: 178667 - DNA, 75 bp, Artificial Sequence
  Synthetic
ccgatttccagtgcatgctttgtcaccccagcgctagaatggaattttcattattgagcaatttgggcaccctgg

SEQ ID NO: 178668 - DNA, 75 bp, Artificial Sequence
  Synthetic
gcgcaacgtgctcgctgtattagaagataagaacaatcccaatccggcaaagagcgcgctcttagagctcgtgaa

SEQ ID NO: 178669 - DNA, 75 bp, Artificial Sequence
  Synthetic
gataagaacaatcccaatccggcaaagagcgcgctcttagagctcgtgaaacacctcggcggttcgtgtgaacat

SEQ ID NO: 178670 - DNA, 75 bp, Artificial Sequence
  Synthetic
ctaaggtaccatttggcatatttggacgtcctgggcaggttagctacccaccagaatatatgggactctgggcag

SEQ ID NO: 178671 - DNA, 75 bp, Artificial Sequence
  Synthetic
acgtcctgggcaggttagctacccaccagaatatatgggactctgggcaggatagccacccacaattgttttgcg

SEQ ID NO: 178672 - DNA, 75 bp, Artificial Sequence
  Synthetic
tgacgaagtggaaaaccttctggaaactataaggcggtctggcagaccgtggacaagagaaggagctgaggaagc

SEQ ID NO: 178673 - DNA, 75 bp, Artificial Sequence
  Synthetic
actataaggcggtctggcagaccgtggacaagagaaggagctgaggaagcactccaagccgagcccgaagaagac

SEQ ID NO: 178674 - DNA, 75 bp, Artificial Sequence
  Synthetic
ccgaacgttcagctttgcgtgctttcgacgtccaggcggctggcacacgggccgtgagcgccagcaacatgggat

SEQ ID NO: 178675 - DNA, 75 bp, Artificial Sequence
  Synthetic
cgacgtccaggcggctggcacacgggccgtgagcgccagcaacatgggatcatggtagtaagatacagcataaat

SEQ ID NO: 178676 - DNA, 75 bp, Artificial Sequence
  Synthetic
agaggattttttccccacctccggaatcccaagcctcgctgcggggaaaaagcgaaaaatcacctctcttctgtc

SEQ ID NO: 178677 - DNA, 75 bp, Artificial Sequence
  Synthetic
atcccaagcctcgctgcggggaaaaagcgaaaaatcacctctcttctgtcagacctagatctgtagagccatgac

SEQ ID NO: 178678 - DNA, 75 bp, Artificial Sequence
  Synthetic
tcggtgggcacgcgtacggtggtctcatgggtattggacttgtaggcgaggggaggcgcatacgacaaaaattgc

SEQ ID NO: 178679 - DNA, 75 bp, Artificial Sequence
  Synthetic
catgggtattggacttgtaggcgaggggaggcgcatacgacaaaaattgccgccgtgaaggtcgggaacccgccc

SEQ ID NO: 178680 - DNA, 75 bp, Artificial Sequence
  Synthetic
tctgcctagtggaattcgcggatccttccaccatcgacagagaaaaactcaagcgaacccgcgatagatttgagg

SEQ ID NO: 178681 - DNA, 75 bp, Artificial Sequence
  Synthetic
ttccaccatcgacagagaaaaactcaagcgaacccgcgatagatttgaggtcatgcgccgtgctttgctggtaga

SEQ ID NO: 178682 - DNA, 75 bp, Artificial Sequence
  Synthetic
atcataacaccgccctagaaatgtttaagctgtgaccaaagcgaacctcgcatgaggcatacgcgagcgtggagg

SEQ ID NO: 178683 - DNA, 75 bp, Artificial Sequence
  Synthetic
taagctgtgaccaaagcgaacctcgcatgaggcatacgcgagcgtggaggtaggattcccaaggctattgagaga

SEQ ID NO: 178684 - DNA, 75 bp, Artificial Sequence
  Synthetic
agcacctcatagagaatatttcggagacaatggcgcgcctgtcagactgtctagacaaaacactcgcgccgctcg

SEQ ID NO: 178685 - DNA, 75 bp, Artificial Sequence
  Synthetic
gacaatggcgcgcctgtcagactgtctagacaaaacactcgcgccgctcgagcattttcgtacactgcacagcaa

SEQ ID NO: 178686 - DNA, 75 bp, Artificial Sequence
  Synthetic
aaaaagactcgctcaacagcccgaaaaccatcagcccgcaccgccgatggattaggtgctgctggacaagtcttt

SEQ ID NO: 178687 - DNA, 75 bp, Artificial Sequence
  Synthetic
aaccatcagcccgcaccgccgatggattaggtgctgctggacaagtctttctaaacccgcgcagggtttgtgtcg

SEQ ID NO: 178688 - DNA, 75 bp, Artificial Sequence
  Synthetic
ggagcgtaaacataagcctgtcattaataaatgatatagaactatttttcaaacgactcagcagcgtgttttatt

SEQ ID NO: 178689 - DNA, 75 bp, Artificial Sequence
  Synthetic
aataaatgatatagaactatttttcaaacgactcagcagcgtgttttattgtatcgatgcgcgccaggcgttgga

SEQ ID NO: 178690 - DNA, 75 bp, Artificial Sequence
  Synthetic
gaagttgacaccagcccgcagttacccaaccttctatttttttggagtgttgacaagtttccatcgcccgtttgg

SEQ ID NO: 178691 - DNA, 75 bp, Artificial Sequence
  Synthetic
ccaaccttctatttttttggagtgttgacaagtttccatcgcccgtttggcgtttcccgcatggtgtcaaattag

SEQ ID NO: 178692 - DNA, 75 bp, Artificial Sequence
  Synthetic
ctatccccgccccggacacatacgtctcaagtataccgtgtatcgagtgccttgaggaagccagcgtagcaccta

SEQ ID NO: 178693 - DNA, 75 bp, Artificial Sequence
  Synthetic
ctcaagtataccgtgtatcgagtgccttgaggaagccagcgtagcacctaatcagggcgaaagcctcccctctct

SEQ ID NO: 178694 - DNA, 75 bp, Artificial Sequence
  Synthetic
aactgccgcccccgcccactcatttttttaccctgttatttgctgtatttacatctacggacccccttttggtga

SEQ ID NO: 178695 - DNA, 75 bp, Artificial Sequence
  Synthetic
ttttaccctgttatttgctgtatttacatctacggacccccttttggtgagattgccgtggttctaaataacgtt

SEQ ID NO: 178696 - DNA, 75 bp, Artificial Sequence
  Synthetic
ccatcctgggcctcttcgaaaacgagctccaacaactcgggataaacgcggagatgactccgaccgagaacccaa

SEQ ID NO: 178697 - DNA, 75 bp, Artificial Sequence
  Synthetic
gctccaacaactcgggataaacgcggagatgactccgaccgagaacccaagcaatgattcccccgcgccagactc

SEQ ID NO: 178698 - DNA, 75 bp, Artificial Sequence
  Synthetic
agcatttgctggacccgcataggtttttgtggcaccaggttatggtcttatgagcgggcttgaccggcaagttcc

SEQ ID NO: 178699 - DNA, 75 bp, Artificial Sequence
  Synthetic
tttgtggcaccaggttatggtcttatgagcgggcttgaccggcaagttccaggcatcctaagtgcttgatgtaga

SEQ ID NO: 178700 - DNA, 75 bp, Artificial Sequence
  Synthetic
acgtgacaaccgcgcttatggagctctcaaatttaatatattggcgatccggggaagatgacccagataccgctg

SEQ ID NO: 178701 - DNA, 75 bp, Artificial Sequence
  Synthetic
ctcaaatttaatatattggcgatccggggaagatgacccagataccgctggcgacaagcaatgttctcatatggc

SEQ ID NO: 178702 - DNA, 75 bp, Artificial Sequence
  Synthetic
gccgtgcccacgaggtttgagaggcgtagacatccgtgtcgactgctggacggaggtagtataatcagctaggcc

SEQ ID NO: 178703 - DNA, 75 bp, Artificial Sequence
  Synthetic
accacaggcagggacagcgtcagcctcccacacatttttttgactgtttcaaaccagaggcattggagagcattt

SEQ ID NO: 178704 - DNA, 75 bp, Artificial Sequence
  Synthetic
tcccacacatttttttgactgtttcaaaccagaggcattggagagcattttctgcggcggtctgttcaactctat

SEQ ID NO: 178705 - DNA, 75 bp, Artificial Sequence
  Synthetic
ttctgtgaccgcgacgttgacgttagacacacgtcgctgccgtcctcagaatgtgatagcccattacaggcattg

SEQ ID NO: 178706 - DNA, 75 bp, Artificial Sequence
  Synthetic
aacgcgttaactacgctgcagccatacaaaaacaaaacgaattttacgttagactaagtcgactcttgacccccg

SEQ ID NO: 178707 - DNA, 75 bp, Artificial Sequence
  Synthetic
acaaaaacaaaacgaattttacgttagactaagtcgactcttgacccccgacagcgatccgggcgtcaaccacaa

SEQ ID NO: 178708 - DNA, 75 bp, Artificial Sequence
  Synthetic
tcaccgcggcagctctagccctggaagatctggaagcttgcttcaatggctcagatcgacccggactacagttag

SEQ ID NO: 178709 - DNA, 75 bp, Artificial Sequence
  Synthetic
atgaggtcctacgcgacgcccgtcgccgtaaggatcaataccttcaaaaggtcacccgcgacgggtttaggaaat

SEQ ID NO: 178710 - DNA, 75 bp, Artificial Sequence
  Synthetic
ccgtaaggatcaataccttcaaaaggtcacccgcgacgggtttaggaaattgacagaatgcctcaaaaaccaaag

SEQ ID NO: 178711 - DNA, 75 bp, Artificial Sequence
  Synthetic
gcgccgggaacacgcaggtggcagcggatgtgttttgcccaaacacgagggttgcaggaaacaggtgctgccggg

SEQ ID NO: 178712 - DNA, 75 bp, Artificial Sequence
  Synthetic
tcctgtaatcgcccgcatccggccgtcctgggcagcaccgcaccctgcgtaaacaaccgcgtactttttcctcgt

SEQ ID NO: 178713 - DNA, 75 bp, Artificial Sequence
  Synthetic
accgcgaggcggcagtcctccagaatcactttttagtccgatccagattcacttcccaaccatggcaagaccata

SEQ ID NO: 178714 - DNA, 75 bp, Artificial Sequence
  Synthetic
tcactttttagtccgatccagattcacttcccaaccatggcaagaccatacaacgagcaagacatcgctgttcga

SEQ ID NO: 178715 - DNA, 75 bp, Artificial Sequence
  Synthetic
tgttttattcgccttcaaacagaagcacgcattctaatgattcttacaaaacttgttagtgtttattaaatcaga

SEQ ID NO: 178716 - DNA, 75 bp, Artificial Sequence
  Synthetic
aacatgtcgagttgctaactcagcaattctacagacttatcaccggcccgctgtccagacgacacaccatgttcc

SEQ ID NO: 178717 - DNA, 75 bp, Artificial Sequence
  Synthetic
cacgcattctaatgattcttacaaaacttgttagtgtttattaaatcagatacatacattctacggaccaaaaat

SEQ ID NO: 178718 - DNA, 75 bp, Artificial Sequence
  Synthetic
attctacagacttatcaccggcccgctgtccagacgacacaccatgttcccacacccccccaatgtcggactggc

SEQ ID NO: 178719 - DNA, 75 bp, Artificial Sequence
  Synthetic
tgggccggaaaggtgaaggcccattagggtttgcacttggcgctgtaggtctactcttgacaaagatctaagcat

SEQ ID NO: 178720 - DNA, 75 bp, Artificial Sequence
  Synthetic
cagagatgatatggcctacaatagaaccgaaagactggatcgaccccaacttcaacatgttctacgaattcaagg

SEQ ID NO: 178721 - DNA, 75 bp, Artificial Sequence
  Synthetic
agggtttgcacttggcgctgtaggtctactcttgacaaagatctaagcattgacattagggcatccacgtcagtg

SEQ ID NO: 178722 - DNA, 75 bp, Artificial Sequence
  Synthetic
accgaaagactggatcgaccccaacttcaacatgttctacgaattcaaggagggggacctgaacgccacccagcg

SEQ ID NO: 178723 - DNA, 75 bp, Artificial Sequence
  Synthetic
ctgtggtgtgctgcgagaccctatagtgtccttgcttaaaaatatcaaagacctaatatccctcgcacacagctc

SEQ ID NO: 178724 - DNA, 75 bp, Artificial Sequence
  Synthetic
accgcacctgggaaaaaaacctcaaaatatttctcacggaagcaggcgaagtgacagaacaaaaaccagggtgcg

SEQ ID NO: 178725 - DNA, 75 bp, Artificial Sequence
  Synthetic
gtgtccttgcttaaaaatatcaaagacctaatatccctcgcacacagctccccgtctacgtggagaacagtgagc

SEQ ID NO: 178726 - DNA, 75 bp, Artificial Sequence
  Synthetic
aatatttctcacggaagcaggcgaagtgacagaacaaaaaccagggtgcgcaccaagcggaatctacgtcacata

SEQ ID NO: 178727 - DNA, 75 bp, Artificial Sequence
  Synthetic
acgcgggtctaagtgaagcaggtcgcgcaagaggtctctgcgacctgcacgaaacagacattccgctaacagggg

SEQ ID NO: 178728 - DNA, 75 bp, Artificial Sequence
  Synthetic
ttaaagacatctacgccctcctctaccatcaccttcagctcggcgaccacaatggcccctaatgcatcctgggtg

SEQ ID NO: 178729 - DNA, 75 bp, Artificial Sequence
  Synthetic
cgcaagaggtctctgcgacctgcacgaaacagacattccgctaacaggggaaacgttaacctgccctcctccttt

SEQ ID NO: 178730 - DNA, 75 bp, Artificial Sequence
  Synthetic
ccatcaccttcagctcggcgaccacaatggcccctaatgcatcctgggtggtgcgcggctgcacgtggctactgc

SEQ ID NO: 178731 - DNA, 75 bp, Artificial Sequence
  Synthetic
cacgtttaggaggaacaataccacttccctgtcatccgtgcccagtttccgcgccacctcacagagaacctcgta

SEQ ID NO: 178732 - DNA, 75 bp, Artificial Sequence
  Synthetic
acgtctgtctcggaagcagacaccacacccaccgtcgcgggcacctccggaacccctgcgtccggcagcaccacg

SEQ ID NO: 178733 - DNA, 75 bp, Artificial Sequence
  Synthetic
tccctgtcatccgtgcccagtttccgcgccacctcacagagaacctcgtaagtggccatggtgccggcttgtata

SEQ ID NO: 178734 - DNA, 75 bp, Artificial Sequence
  Synthetic
cacccaccgtcgcgggcacctccggaacccctgcgtccggcagcaccacgtcaccaacaggcgacacacctgaag

SEQ ID NO: 178735 - DNA, 75 bp, Artificial Sequence
  Synthetic
aaacaaaatcacaagcttaatagctgtccagaatgcgcagatcaaagtccgaaacagatgttaggatctgttcca

SEQ ID NO: 178736 - DNA, 75 bp, Artificial Sequence
  Synthetic
ctattccgatttaatttggaccaaacatgtccggacaccaagggcaaacctcaccacgagggcatactgctcgtg

SEQ ID NO: 178737 - DNA, 75 bp, Artificial Sequence
  Synthetic
gtccagaatgcgcagatcaaagtccgaaacagatgttaggatctgttccactgccgcctgtagaacggaaacatc

SEQ ID NO: 178738 - DNA, 75 bp, Artificial Sequence
  Synthetic
catgtccggacaccaagggcaaacctcaccacgagggcatactgctcgtgtacaaaagaaacatcgtcccatacc

SEQ ID NO: 178739 - DNA, 75 bp, Artificial Sequence
  Synthetic
cctgcggaatgacgttggcaggaaccaacagcgcacagcctgcagcgctgataatagaggcgggcaatgagccag

SEQ ID NO: 178740 - DNA, 75 bp, Artificial Sequence
  Synthetic
cgcggtatgacagaagcagcaatcacaaacaaatatgagatccccaggcccgtgcctctctacgagatcagtcac

SEQ ID NO: 178741 - DNA, 75 bp, Artificial Sequence
  Synthetic
caacagcgcacagcctgcagcgctgataatagaggcgggcaatgagccagtctttgggtcaactaaggcttttgt

SEQ ID NO: 178742 - DNA, 75 bp, Artificial Sequence
  Synthetic
caaacaaatatgagatccccaggcccgtgcctctctacgagatcagtcacatggacagcacctaccagtgcttta

SEQ ID NO: 178743 - DNA, 75 bp, Artificial Sequence
  Synthetic
ccagcaatttaagtaacaagaaggaagtgacgtccgtcgctaagactgcctctgttcgccacgccaacttctcaa

SEQ ID NO: 178744 - DNA, 75 bp, Artificial Sequence
  Synthetic
gatgacgtaaacaaaaccgtatttctccagcccgtcgaaggtctaactgacaacatacaaagatactttagccaa

SEQ ID NO: 178745 - DNA, 75 bp, Artificial Sequence
  Synthetic
agtgacgtccgtcgctaagactgcctctgttcgccacgccaacttctcaaggagttctttctcctggtctataag

SEQ ID NO: 178746 - DNA, 75 bp, Artificial Sequence
  Synthetic
tccagcccgtcgaaggtctaactgacaacatacaaagatactttagccaaccagtactgtactctgaacccggat

SEQ ID NO: 178747 - DNA, 75 bp, Artificial Sequence
  Synthetic
aaataggcgtgaggcttctgagcttactggccactaacaggcaggcgctccctgtcttttgaaagtgttctttgg

SEQ ID NO: 178748 - DNA, 75 bp, Artificial Sequence
  Synthetic
gacatgatggcccggtcagcccacccatatacatattttgtgaccgccctcggagacacggtggaggtatccccg

SEQ ID NO: 178749 - DNA, 75 bp, Artificial Sequence
  Synthetic
actggccactaacaggcaggcgctccctgtcttttgaaagtgttctttggacacctgctttataagtaggagtct

SEQ ID NO: 178750 - DNA, 75 bp, Artificial Sequence
  Synthetic
catatacatattttgtgaccgccctcggagacacggtggaggtatccccgttttgccacaacgattcttcttgta

SEQ ID NO: 178751 - DNA, 75 bp, Artificial Sequence
  Synthetic
cctggcaaactgaaaacatccatgtgcccagtaacttacgcatatgcgaagtaagagattgttgaaaggtcccaa

SEQ ID NO: 178752 - DNA, 75 bp, Artificial Sequence
  Synthetic
cacacaatagtcagttatgccaaccgtggcaccactcccgcttcgcaaaaccgcatctttgtggattctggagag

SEQ ID NO: 178753 - DNA, 75 bp, Artificial Sequence
  Synthetic
gcccagtaacttacgcatatgcgaagtaagagattgttgaaaggtcccaaatacagagtcagaagttaaaaagcg

SEQ ID NO: 178754 - DNA, 75 bp, Artificial Sequence
  Synthetic
gtggcaccactcccgcttcgcaaaaccgcatctttgtggattctggagagtacaccatctcatgggcagcagaaa

SEQ ID NO: 178755 - DNA, 75 bp, Artificial Sequence
  Synthetic
gatccagaagtcccgagggcgggttattggcagttgccatatagagtggcgagcgtatgtggcctacctgtagag

SEQ ID NO: 178756 - DNA, 75 bp, Artificial Sequence
  Synthetic
tctattcgaacgacgcacgatacaagctaccactttgtggctaacgagataacggccacgtttgctaccccgcta

SEQ ID NO: 178757 - DNA, 75 bp, Artificial Sequence
  Synthetic
attggcagttgccatatagagtggcgagcgtatgtggcctacctgtagagcctggagtttcagggtgctctgtca

SEQ ID NO: 178758 - DNA, 75 bp, Artificial Sequence
  Synthetic
gctaccactttgtggctaacgagataacggccacgtttgctaccccgctaacggaggtagcaaattttagcacca

SEQ ID NO: 178759 - DNA, 75 bp, Artificial Sequence
  Synthetic
gtgtgttcagttgaggtagatgggtcgtgagaacactgccccacacacacaccagcacccatggcgccaaatgca

SEQ ID NO: 178760 - DNA, 75 bp, Artificial Sequence
  Synthetic
aacaaactaaactccacacacgtcccagacggcccagtccaatatttccacacggaaggtggcctatttctcgtc

SEQ ID NO: 178761 - DNA, 75 bp, Artificial Sequence
  Synthetic
cgtgagaacactgccccacacacacaccagcacccatggcgccaaatgcaagtgcggagcggcgacggtggcttc

SEQ ID NO: 178762 - DNA, 75 bp, Artificial Sequence
  Synthetic
cagacggcccagtccaatatttccacacggaaggtggcctatttctcgtctggcaggctatggtccctctaaacc

SEQ ID NO: 178763 - DNA, 75 bp, Artificial Sequence
  Synthetic
gagtccccaggaccttggttttcccctggctgggttaatggcaggggctttttaaacttaactatggaagattgt

SEQ ID NO: 178764 - DNA, 75 bp, Artificial Sequence
  Synthetic
accacctcaaagggcaggcggcgccgagacgtatcaactaccgccagttcgggttccgcatatgggacggcaacc

SEQ ID NO: 178765 - DNA, 75 bp, Artificial Sequence
  Synthetic
gagacgtatcaactaccgccagttcgggttccgcatatgggacggcaaccgcgcaactgcagtttgcttacgata

SEQ ID NO: 178766 - DNA, 75 bp, Artificial Sequence
  Synthetic
aggtttcctgccagggggtgactagcttcccaggctaggcgggccatttgtactttcttacttgtgtctttgttc

SEQ ID NO: 178767 - DNA, 75 bp, Artificial Sequence
  Synthetic
gtgagtttggccactcccaagcccacatgggcctactataacaggagcctggtttctaacggcaatgatatttat

SEQ ID NO: 178768 - DNA, 75 bp, Artificial Sequence
  Synthetic
tgtcgcgaacaggtgagagaaaacctaatgtggtatgagctcagcaagatcaaccccacgagcgtgatgacggca

SEQ ID NO: 178769 - DNA, 75 bp, Artificial Sequence
  Synthetic
gtggggcaagcaggacacggggcctgcctttactcctccaaactggaaggcctgagataattttttaagtccgta

SEQ ID NO: 178770 - DNA, 75 bp, Artificial Sequence
  Synthetic
gcctttactcctccaaactggaaggcctgagataattttttaagtccgtatgggtcattgccccaaaaaatcact

SEQ ID NO: 178771 - DNA, 75 bp, Artificial Sequence
  Synthetic
taatgtggtatgagctcagcaagatcaaccccacgagcgtgatgacggcaatctacggacgacctgtatccgcca

SEQ ID NO: 178772 - DNA, 75 bp, Artificial Sequence
  Synthetic
gactccgtgagtattcataagagcctgcgttcgccatcgaggggagtctgctactcgcgcccccaagtcaccttt

SEQ ID NO: 178773 - DNA, 75 bp, Artificial Sequence
  Synthetic
gcgtctataaaagatgtgttgtggcctagctttcgcaggacaatcatctatctgtctgtaagggaccggtggttg

SEQ ID NO: 178774 - DNA, 75 bp, Artificial Sequence
  Synthetic
ctagctttcgcaggacaatcatctatctgtctgtaagggaccggtggttgttggtatcttggatgtggctttttt

SEQ ID NO: 178775 - DNA, 75 bp, Artificial Sequence
  Synthetic
tgcgttcgccatcgaggggagtctgctactcgcgcccccaagtcacctttaagtttcttaacagttccaccctct

SEQ ID NO: 178776 - DNA, 75 bp, Artificial Sequence
  Synthetic
gtagagacctgccgagactcctgcgaacactactttatcacgcgcaacgaaacgctggtgtacaaagattatgca

SEQ ID NO: 178777 - DNA, 75 bp, Artificial Sequence
  Synthetic
tgatgttctgagtacatagcggtattcgcgagatgggccaggttgtgggtcatcgtctggtgtattatctcctgg

SEQ ID NO: 178778 - DNA, 75 bp, Artificial Sequence
  Synthetic
tcgcgagatgggccaggttgtgggtcatcgtctggtgtattatctcctggtgggctactggcaatttgttcatgt

SEQ ID NO: 178779 - DNA, 75 bp, Artificial Sequence
  Synthetic
aacactactttatcacgcgcaacgaaacgctggtgtacaaagattatgcatacgcgggttccatcaacacgacgg

SEQ ID NO: 178780 - DNA, 75 bp, Artificial Sequence
  Synthetic
aacatcgacttcagggccatcgagttgtacagcacctcggagcggcgactggcgagtaacgtctttgacatcgaa

SEQ ID NO: 178781 - DNA, 75 bp, Artificial Sequence
  Synthetic
gtgcaagattatgggctcttccaccgtctcctgctcctgctgttccaccccctgctgctcctgctcttccacctc

SEQ ID NO: 178782 - DNA, 75 bp, Artificial Sequence
  Synthetic
tgtacagcacctcggagcggcgactggcgagtaacgtctttgacatcgaaacgatgttcagggaatacaactact

SEQ ID NO: 178783 - DNA, 75 bp, Artificial Sequence
  Synthetic
cctgctcttccacctcctctaactcctgctcctcctgctcctcctgctcctgctcttgctcctccacctcctcta

SEQ ID NO: 178784 - DNA, 75 bp, Artificial Sequence
  Synthetic
ctgaaccgggaccgcttcgtccgcgacatgtctgaactcgtggcagatctcggcggcatcggtaaaacagtggtg

SEQ ID NO: 178785 - DNA, 75 bp, Artificial Sequence
  Synthetic
acatgtctgaactcgtggcagatctcggcggcatcggtaaaacagtggtgaacgtggccagtagcgtggttactc

SEQ ID NO: 178786 - DNA, 75 bp, Artificial Sequence
  Synthetic
cctgctcctgctcctctaactcctgctcctgctcctctaactcctgctcctgctcctctaactcctgctcctgct

SEQ ID NO: 178787 - DNA, 75 bp, Artificial Sequence
  Synthetic
ggggggatgctaatgatcgtgatcgtcgtcggtatcgtgctcatcatattcatgttaaaccgccgaacgaacgcc

SEQ ID NO: 178788 - DNA, 75 bp, Artificial Sequence
  Synthetic
tcgtcggtatcgtgctcatcatattcatgttaaaccgccgaacgaacgccatggcccaggcgccagtcaagatga

SEQ ID NO: 178789 - DNA, 75 bp, Artificial Sequence
  Synthetic
actctccgtggacccctcctcacctccctccgactgcatcgggccctgagggctcgcagtttcacacagaagttc

SEQ ID NO: 178790 - DNA, 75 bp, Artificial Sequence
  Synthetic
aaggacgagatcaaaaagattttacttggcatgcatcagcttcaccaggaagaacgccaaaaagaggccgagcgc

SEQ ID NO: 178791 - DNA, 75 bp, Artificial Sequence
  Synthetic
ttggcatgcatcagcttcaccaggaagaacgccaaaaagaggccgagcgcaagcgggaaacgccctcgatgtttc

SEQ ID NO: 178792 - DNA, 75 bp, Artificial Sequence
  Synthetic
tgctcctgctcctcctgctgctcctgctcctcctgctgctcctgctcctcctgctgctcctgctcctcctgctgc

SEQ ID NO: 178793 - DNA, 75 bp, Artificial Sequence
  Synthetic
cggcaacaggaaacagagttggaagaggcagaggcctcagtgtaaccggtccgcgaagagacggtcgcctcgcca

SEQ ID NO: 178794 - DNA, 75 bp, Artificial Sequence
  Synthetic
aggcagaggcctcagtgtaaccggtccgcgaagagacggtcgcctcgccaccggcgccatggacttctttaaccc

SEQ ID NO: 178795 - DNA, 75 bp, Artificial Sequence
  Synthetic
tcctgctgctgctcatcctgctgctgctcatcctgctgctgctcctcctgctgctcctgctcctcctgctgctcc

SEQ ID NO: 178796 - DNA, 75 bp, Artificial Sequence
  Synthetic
caccctccaaccccccacaggcgaacccggccctccagatatgccgcctcattcccgcatgtttccgggagaccg

SEQ ID NO: 178797 - DNA, 75 bp, Artificial Sequence
  Synthetic
cccggccctccagatatgccgcctcattcccgcatgtttccgggagaccggcctgccgggcgtagtgccggttga

SEQ ID NO: 178798 - DNA, 75 bp, Artificial Sequence
  Synthetic
tgaaagacgagcgcgcgtcaatgtggacccgccgccgcgcgtccggagtaccaacgggcgagacgcgcgcccccc

SEQ ID NO: 178799 - DNA, 75 bp, Artificial Sequence
  Synthetic
ctgctcatcctgctgctgctcatcctgctgctgctcatcctgctgctgtggctcctgctgttgtggctcctgctg

SEQ ID NO: 178800 - DNA, 75 bp, Artificial Sequence
  Synthetic
gacccgccgccgcgcgtccggagtaccaacgggcgagacgcgcgcccccctcgtgtttcacgtgtacgacatcgt

SEQ ID NO: 178801 - DNA, 75 bp, Artificial Sequence
  Synthetic
tgctgctgctcatcctgctgctgtggctcctgctgttgtggctcctgctgttgtggctcctgctgttgtggctcc

SEQ ID NO: 178802 - DNA, 75 bp, Artificial Sequence
  Synthetic
agaccgacatcattcctagcggtaccgttctaaagctcttgggccgcacggtagacggaaccagcgtctgcgtca

SEQ ID NO: 178803 - DNA, 75 bp, Artificial Sequence
  Synthetic
cgttctaaagctcttgggccgcacggtagacggaaccagcgtctgcgtcaacgtgttcaggcagcgatgctattt

SEQ ID NO: 178804 - DNA, 75 bp, Artificial Sequence
  Synthetic
cgctgctgtggctcccgctgctgtggctcccgctgctgtggctcccgctgctggggctcccgctgctggggctcc

SEQ ID NO: 178805 - DNA, 75 bp, Artificial Sequence
  Synthetic
ccctgcagtccacggtcggtcgcgccccctgtgccttcaccacggaacttgtcaaaaaaaagattctccgcgtat

SEQ ID NO: 178806 - DNA, 75 bp, Artificial Sequence
  Synthetic
cccctgtgccttcaccacggaacttgtcaaaaaaaagattctccgcgtatacgacacggcggaatacgaagtata

SEQ ID NO: 178807 - DNA, 75 bp, Artificial Sequence
  Synthetic
tgactgcctgcggctgcgaagtcttcgaatccaacgtagatgcgattcggcgcttcgtgctggatcggggcttta

SEQ ID NO: 178808 - DNA, 75 bp, Artificial Sequence
  Synthetic
cgaatccaacgtagatgcgattcggcgcttcgtgctggatcggggctttacaacatttggctggtacgcgtgcgc

SEQ ID NO: 178809 - DNA, 75 bp, Artificial Sequence
  Synthetic
ctgttgtgaactttggatgctcaacgttttgtttccatcgcccccgtcctcctcgtcctccttcttgtcctcctc

SEQ ID NO: 178810 - DNA, 75 bp, Artificial Sequence
  Synthetic
tcgactgcagttgggaagacctggagcttagaccggatctccacacgtggccccgttaccggatcctctcatttg

SEQ ID NO: 178811 - DNA, 75 bp, Artificial Sequence
  Synthetic
ctcgtcatcctcctcgtcctcattgtcctcatcatcgtcatcctcctcgtcctcctcctcctcctcgtcctcctc

SEQ ID NO: 178812 - DNA, 75 bp, Artificial Sequence
  Synthetic
gcttagaccggatctccacacgtggccccgttaccggatcctctcatttgatatcgaatgtatgggagaggaagg

SEQ ID NO: 178813 - DNA, 75 bp, Artificial Sequence
  Synthetic
cgtcatcctcctcgtcatcctcctcgtcatcctcctcgtcatcctcctcgtcatcctcctcgtcatcctcctcgt

SEQ ID NO: 178814 - DNA, 75 bp, Artificial Sequence
  Synthetic
tgtttcacgacgcgggagaagacgccccgtacacgcgcatgctcctgagcctaggcacgtgcgacccgctggaga

SEQ ID NO: 178815 - DNA, 75 bp, Artificial Sequence
  Synthetic
cccgtacacgcgcatgctcctgagcctaggcacgtgcgacccgctggagaacacggagatatttgagtttccatc

SEQ ID NO: 178816 - DNA, 75 bp, Artificial Sequence
  Synthetic
ctcatcatccttattgtcattgtcatccttgtcaacctgactttccttgctaatctcgttgtccccattatcctc

SEQ ID NO: 178817 - DNA, 75 bp, Artificial Sequence
  Synthetic
taatctcgttgtccccattatcctcgccagcctgattattttcggaacattctttttcattcttggatgcttctt

SEQ ID NO: 178818 - DNA, 75 bp, Artificial Sequence
  Synthetic
tcgacttcattaccggatacaatatagcaaattttgatttgccatacattatcaccagggccacgcaggtgtaca

SEQ ID NO: 178819 - DNA, 75 bp, Artificial Sequence
  Synthetic
agcaaattttgatttgccatacattatcaccagggccacgcaggtgtacaactttgacctgaagaactataccaa

SEQ ID NO: 178820 - DNA, 75 bp, Artificial Sequence
  Synthetic
ctgcaatctccgcaaggagcaccaacatggctgtgtcatcaccccaggatccctcagacggggatgatgatccta

SEQ ID NO: 178821 - DNA, 75 bp, Artificial Sequence
  Synthetic
ggggcttcctgcgatcacaatcaaaagtaaagatatctggcatcgtcccaattgacatgtatcaggtctgtcgag

SEQ ID NO: 178822 - DNA, 75 bp, Artificial Sequence
  Synthetic
agtaaagatatctggcatcgtcccaattgacatgtatcaggtctgtcgagataaactcagtctgtcagactacaa

SEQ ID NO: 178823 - DNA, 75 bp, Artificial Sequence
  Synthetic
gatgatcccacgtagatcggggactctgtggcccatggggggtacacactacggttggcgaagtcacatctaggg

SEQ ID NO: 178824 - DNA, 75 bp, Artificial Sequence
  Synthetic
ctgtggcccatggggggtacacactacggttggcgaagtcacatctagggggagagactgggggcgactgacata

SEQ ID NO: 178825 - DNA, 75 bp, Artificial Sequence
  Synthetic
cctacagagacatcccgccactgtttcgatccggggccgcgggtcgcgccaagatcggtcgatattgtgtgatag

SEQ ID NO: 178826 - DNA, 75 bp, Artificial Sequence
  Synthetic
tcgatccggggccgcgggtcgcgccaagatcggtcgatattgtgtgatagattctgtcctggtgatggacctcct

SEQ ID NO: 178827 - DNA, 75 bp, Artificial Sequence
  Synthetic
aggctacgcagggtagacggagctaaagagtctggtgacgacttggagggaggctcgggtggaggagtcgtgggt

SEQ ID NO: 178828 - DNA, 75 bp, Artificial Sequence
  Synthetic
aagagtctggtgacgacttggagggaggctcgggtggaggagtcgtgggtgagtgtggaggtgtagtctgctgcg

SEQ ID NO: 178829 - DNA, 75 bp, Artificial Sequence
  Synthetic
ggattcccgcccgccgcgtattgaccgacggacaacagatcagggtcttctcctgcctgttagaggcggcatctc

SEQ ID NO: 178830 - DNA, 75 bp, Artificial Sequence
  Synthetic
cgacggacaacagatcagggtcttctcctgcctgttagaggcggcatctcgagaaggatacattctacctgttcc

SEQ ID NO: 178831 - DNA, 75 bp, Artificial Sequence
  Synthetic
gaaagcggtggcctttgagaagactctggagactgcgtgggtggcaatgcaggagatggagaatgagtatccgtg

SEQ ID NO: 178832 - DNA, 75 bp, Artificial Sequence
  Synthetic
ctggagactgcgtgggtggcaatgcaggagatggagaatgagtatccgtggtccccggagacacaggatgggatg

SEQ ID NO: 178833 - DNA, 75 bp, Artificial Sequence
  Synthetic
taccaggcttttacgacgacccggtactcgtggtggattttgccagcctctaccccagcatcatgcaggcacaca

SEQ ID NO: 178834 - DNA, 75 bp, Artificial Sequence
  Synthetic
actcgtggtggattttgccagcctctaccccagcatcatgcaggcacacaacctctgttattctaccctgattac

SEQ ID NO: 178835 - DNA, 75 bp, Artificial Sequence
  Synthetic
ggtaaaggtgttgcgggagcgggtgaaggaatgggagccaccggtaaagtaggactagacacaaatgctggcagc

SEQ ID NO: 178836 - DNA, 75 bp, Artificial Sequence
  Synthetic
ccggatgtgaacactgtgggacttcctggtataggcaaggtgtggggtccacattcccggccgtcgacggagtcg

SEQ ID NO: 178837 - DNA, 75 bp, Artificial Sequence
  Synthetic
ccttccacctgagcgggggaacggtacactttgtaaaaaagcacgtccgcgagtcactactgtccaaactgctca

SEQ ID NO: 178838 - DNA, 75 bp, Artificial Sequence
  Synthetic
acactttgtaaaaaagcacgtccgcgagtcactactgtccaaactgctcacaacatggctggccaagaggaaaga

SEQ ID NO: 178839 - DNA, 75 bp, Artificial Sequence
  Synthetic
tctttccggagacctgtttcgtttcctacaacttcctctcgttaagggcgcgccggtgctccgtcccgacctcag

SEQ ID NO: 178840 - DNA, 75 bp, Artificial Sequence
  Synthetic
ctacaacttcctctcgttaagggcgcgccggtgctccgtcccgacctcaggcgcattcccgggggcgccatcctc

SEQ ID NO: 178841 - DNA, 75 bp, Artificial Sequence
  Synthetic
tggataaacaacagctggccatcaaggtcacatgtaacgcggtgtacgggttcaccggcgtcgcttccggcatcc

SEQ ID NO: 178842 - DNA, 75 bp, Artificial Sequence
  Synthetic
ggtcacatgtaacgcggtgtacgggttcaccggcgtcgcttccggcatcctaccgtgcctgaacatcgcagagac

SEQ ID NO: 178843 - DNA, 75 bp, Artificial Sequence
  Synthetic
tattcacattatgcaatacccgtagtgaccacaagggggagctctcagacaattaagcggttacacacagtagca

SEQ ID NO: 178844 - DNA, 75 bp, Artificial Sequence
  Synthetic
tgaccacaagggggagctctcagacaattaagcggttacacacagtagcaggctgcagtaccgcccatggccaca

SEQ ID NO: 178845 - DNA, 75 bp, Artificial Sequence
  Synthetic
agggaatctcgccaacggcactggcagacctactgcagcgaccgatcgaggcgtctccggaagccaggtttaaag

SEQ ID NO: 178846 - DNA, 75 bp, Artificial Sequence
  Synthetic
agacctactgcagcgaccgatcgaggcgtctccggaagccaggtttaaagtgatatacggagataccgactcact

SEQ ID NO: 178847 - DNA, 75 bp, Artificial Sequence
  Synthetic
taccgccgatggccaccagatggcacgcgccgccagcaaatttaagtcctggtggctcacctgccaggtaaacaa

SEQ ID NO: 178848 - DNA, 75 bp, Artificial Sequence
  Synthetic
cgcgccgccagcaaatttaagtcctggtggctcacctgccaggtaaacaaggttaaagtgggtttgctggccttg

SEQ ID NO: 178849 - DNA, 75 bp, Artificial Sequence
  Synthetic
acgacctggcagccattacgaccaagacccttttcaaagcgcccatcaagctggaagcggagaagatatttcagt

SEQ ID NO: 178850 - DNA, 75 bp, Artificial Sequence
  Synthetic
gacccttttcaaagcgcccatcaagctggaagcggagaagatatttcagtgcctgctcctcctgactaagaagcg

SEQ ID NO: 178851 - DNA, 75 bp, Artificial Sequence
  Synthetic
agaaacagaaacggccaataacccatgtttttcgaaaaccaccacacaccttaacacaaatcatgtacacctggt

SEQ ID NO: 178852 - DNA, 75 bp, Artificial Sequence
  Synthetic
tgtttttcgaaaaccaccacacaccttaacacaaatcatgtacacctggtattactatttcccacacatcttata

SEQ ID NO: 178853 - DNA, 75 bp, Artificial Sequence
  Synthetic
tcattcggaaaaccgcctgcaggtttgtccaagagacgagccgtgagatactggagctgctcctgcgagacccgg

SEQ ID NO: 178854 - DNA, 75 bp, Artificial Sequence
  Synthetic
tgtccaagagacgagccgtgagatactggagctgctcctgcgagacccggcagtcaaagcggccgcaaaactgat

SEQ ID NO: 178855 - DNA, 75 bp, Artificial Sequence
  Synthetic
gcgctactcactgtttataagtcagccggaccaagctgctgctcttggggacgtgactgcttcgtggcgcagctg

SEQ ID NO: 178856 - DNA, 75 bp, Artificial Sequence
  Synthetic
ccggaccaagctgctgctcttggggacgtgactgcttcgtggcgcagctgcctccaaatgatacacacatttttt

SEQ ID NO: 178857 - DNA, 75 bp, Artificial Sequence
  Synthetic
tagtgaaaataatcacaatccttaatcacagctacaggcggctagagcacggagacgtgccggtggaaaaactaa

SEQ ID NO: 178858 - DNA, 75 bp, Artificial Sequence
  Synthetic
tcacagctacaggcggctagagcacggagacgtgccggtggaaaaactaacttttactaccgaactgggacgacc

SEQ ID NO: 178859 - DNA, 75 bp, Artificial Sequence
  Synthetic
tctgattggtgccccaggcaggactgccataaaaactgaagaaggcgtgtctgctttgcagaatttaccccccac

SEQ ID NO: 178860 - DNA, 75 bp, Artificial Sequence
  Synthetic
gccataaaaactgaagaaggcgtgtctgctttgcagaatttaccccccactgtgctcccggttgctggcaccggt

SEQ ID NO: 178861 - DNA, 75 bp, Artificial Sequence
  Synthetic
agctacagctcagacaggaggagctgccccagattcacgacaggataccatacgttttcatccgggcacccggca

SEQ ID NO: 178862 - DNA, 75 bp, Artificial Sequence
  Synthetic
gccccagattcacgacaggataccatacgttttcatccgggcacccggcaatctgaagtcggacctcgccgaaca

SEQ ID NO: 178863 - DNA, 75 bp, Artificial Sequence
  Synthetic
ctctcgggggtccatgtctagcctcttcatttcattaccttgggtggcgttcatctggctagccctccttggcgc

SEQ ID NO: 178864 - DNA, 75 bp, Artificial Sequence
  Synthetic
ttcatttcattaccttgggtggcgttcatctggctagccctccttggcgcggttgggggtgcccgcgttcagggg

SEQ ID NO: 178865 - DNA, 75 bp, Artificial Sequence
  Synthetic
ttgacaaggcggtgcacggcgccgccaacatcctgcaatgtctgtttcacaacgatacggccgccacagtggccg

SEQ ID NO: 178866 - DNA, 75 bp, Artificial Sequence
  Synthetic
caacatcctgcaatgtctgtttcacaacgatacggccgccacagtggccgccctgtacaatttcctagacgtccc

SEQ ID NO: 178867 - DNA, 75 bp, Artificial Sequence
  Synthetic
catagttagcgttacctggcaaaaaaggcagctccccggtcccgtaaacgtcgccacgtacagccattcatatgg

SEQ ID NO: 178868 - DNA, 75 bp, Artificial Sequence
  Synthetic
aggcagctccccggtcccgtaaacgtcgccacgtacagccattcatatggggtggtggttcagacccagtaccgc

SEQ ID NO: 178869 - DNA, 75 bp, Artificial Sequence
  Synthetic
caaatttccaccgtcccggaccaacggaagcgccagacgccacagaccgcgcgagtatccacatcggtccccgcg

SEQ ID NO: 178870 - DNA, 75 bp, Artificial Sequence
  Synthetic
ggaagcgccagacgccacagaccgcgcgagtatccacatcggtccccgcgccccgcgcttgccatgcagaccccc

SEQ ID NO: 178871 - DNA, 75 bp, Artificial Sequence
  Synthetic
ccataaccttgcagtggatgatgagggctgttacctgtgtatctttaactcatttggtggccggcaggtgtcatg

SEQ ID NO: 178872 - DNA, 75 bp, Artificial Sequence
  Synthetic
ggctgttacctgtgtatctttaactcatttggtggccggcaggtgtcatgcacagcctgcctggaagtgacatct

SEQ ID NO: 178873 - DNA, 75 bp, Artificial Sequence
  Synthetic
tacgtgtactggacggcgcgaggtgccccgcgccagactccgcggaggctattttagactgaagctaccattttc

SEQ ID NO: 178874 - DNA, 75 bp, Artificial Sequence
  Synthetic
ccccgcgccagactccgcggaggctattttagactgaagctaccattttcggtagaaagcttgctaaaagaccat

SEQ ID NO: 178875 - DNA, 75 bp, Artificial Sequence
  Synthetic
cacctgtttggcaactggtcgcccaccccccaatgtcacctgggccgcaccctggaacaacgcctcttctaccca

SEQ ID NO: 178876 - DNA, 75 bp, Artificial Sequence
  Synthetic
ccccccaatgtcacctgggccgcaccctggaacaacgcctcttctacccaggagcagttcactgacagtgatggt

SEQ ID NO: 178877 - DNA, 75 bp, Artificial Sequence
  Synthetic
gtgcgtggccgtggtggccgagtatcggacagaaacgacggcggcgggcccgacggtggtcccctgcttgataac

SEQ ID NO: 178878 - DNA, 75 bp, Artificial Sequence
  Synthetic
cggacagaaacgacggcggcgggcccgacggtggtcccctgcttgataacaaacttacaggccccgctctgcatt

SEQ ID NO: 178879 - DNA, 75 bp, Artificial Sequence
  Synthetic
cccaagtgagggaatatgtctcatcacctggggaaatgagagcatatcaatcccggcttctattcaaggcccctt

SEQ ID NO: 178880 - DNA, 75 bp, Artificial Sequence
  Synthetic
acctggggaaatgagagcatatcaatcccggcttctattcaaggccccttggcccatgaccttcccgcggcccag

SEQ ID NO: 178881 - DNA, 75 bp, Artificial Sequence
  Synthetic
tatcttttttgtgacgccggttcagccccatgagatgaccacctacgtctaccacgaagacggcggcccgtccga

SEQ ID NO: 178882 - DNA, 75 bp, Artificial Sequence
  Synthetic
ccccatgagatgaccacctacgtctaccacgaagacggcggcccgtccgatggtgaaacgtatgagccacaaggc

SEQ ID NO: 178883 - DNA, 75 bp, Artificial Sequence
  Synthetic
cgcattacatcattgccgccgcaagcagggcggtgcatcacctacttcagatgacatggaccccctatccaccca

SEQ ID NO: 178884 - DNA, 75 bp, Artificial Sequence
  Synthetic
cagggcggtgcatcacctacttcagatgacatggaccccctatccacccagtgactagatggacaccccgtgaac

SEQ ID NO: 178885 - DNA, 75 bp, Artificial Sequence
  Synthetic
ggcggtcgccccgcgcacttatgtgacctatttcgccaccccggcgcccctgtcgtacatggatcttctcagctt

SEQ ID NO: 178886 - DNA, 75 bp, Artificial Sequence
  Synthetic
acctatttcgccaccccggcgcccctgtcgtacatggatcttctcagcttcgaggtaacgggaccagagggccgt

SEQ ID NO: 178887 - DNA, 75 bp, Artificial Sequence
  Synthetic
cccaaagactgttttttacagcccgatggcccttcaggcctccttgagtgtctagctggtcccgtggtcattgtg

SEQ ID NO: 178888 - DNA, 75 bp, Artificial Sequence
  Synthetic
atggcccttcaggcctccttgagtgtctagctggtcccgtggtcattgtgtggtttggcagtcacttccccattt

SEQ ID NO: 178889 - DNA, 75 bp, Artificial Sequence
  Synthetic
cgtgtacaaactcacggcatataacacgttaccgcaaaaggttgcctgtctaaattttaatctagcattcaagcc

SEQ ID NO: 178890 - DNA, 75 bp, Artificial Sequence
  Synthetic
acgttaccgcaaaaggttgcctgtctaaattttaatctagcattcaagcccatcgacgcgccaaaaatactggtg

SEQ ID NO: 178891 - DNA, 75 bp, Artificial Sequence
  Synthetic
tctttcccgtcaggggagtgacaagctataggacagaaaggtcacctggcccaaacggaggatcctaggtgggtg

SEQ ID NO: 178892 - DNA, 75 bp, Artificial Sequence
  Synthetic
ctataggacagaaaggtcacctggcccaaacggaggatcctaggtgggtgtgcatttattagacgttggtgtgtt

SEQ ID NO: 178893 - DNA, 75 bp, Artificial Sequence
  Synthetic
ggctatctatccggactgcgaaaaaactatccagcccggagagaccacgaccctgcgaatccaactcctcttcga

SEQ ID NO: 178894 - DNA, 75 bp, Artificial Sequence
  Synthetic
actatccagcccggagagaccacgaccctgcgaatccaactcctcttcgagcagccgagcgaggaggccccgctt

SEQ ID NO: 178895 - DNA, 75 bp, Artificial Sequence
  Synthetic
taggttaggttgaaagccggggtaaaaggcgtggctaaacaacacctatactacttgttattgtaggccatggcg

SEQ ID NO: 178896 - DNA, 75 bp, Artificial Sequence
  Synthetic
aaggcgtggctaaacaacacctatactacttgttattgtaggccatggcggccgaggatttcctaaccatcttct

SEQ ID NO: 178897 - DNA, 75 bp, Artificial Sequence
  Synthetic
atcgatcgtaacgcaggcccgctccgagcagctctggatattcaacccaaacaactacccggtgcatatttcaag

SEQ ID NO: 178898 - DNA, 75 bp, Artificial Sequence
  Synthetic
gagcagctctggatattcaacccaaacaactacccggtgcatatttcaagaaataccgtagtcgcctgcgccatg

SEQ ID NO: 178899 - DNA, 75 bp, Artificial Sequence
  Synthetic
tactctggaaacttcagcctagaagtgagcgtgtgtgagatgaccaccgtggtgccttacacgtggaacgttgga

SEQ ID NO: 178900 - DNA, 75 bp, Artificial Sequence
  Synthetic
tgagcgtgtgtgagatgaccaccgtggtgccttacacgtggaacgttggaatactctctctgattttcctcataa

SEQ ID NO: 178901 - DNA, 75 bp, Artificial Sequence
  Synthetic
gccggcacatcgcacgtggcacgtaggatcgcacgaaattcaacagggacacgggggcataaccgccccaaagtg

SEQ ID NO: 178902 - DNA, 75 bp, Artificial Sequence
  Synthetic
ggatcgcacgaaattcaacagggacacgggggcataaccgccccaaagtgccacattgccatcagggagtcgcac

SEQ ID NO: 178903 - DNA, 75 bp, Artificial Sequence
  Synthetic
cgggcaggagcgatagatatactgctcctgggtatctgcctaaactcgctgtgtcttagcatatctctattggca

SEQ ID NO: 178904 - DNA, 75 bp, Artificial Sequence
  Synthetic
cttaactgtaataataaaagttaataaagtgttaaccaactaaacatggcgtttcatttgttatgaatgcacaca

SEQ ID NO: 178905 - DNA, 75 bp, Artificial Sequence
  Synthetic
aaagtgttaaccaactaaacatggcgtttcatttgttatgaatgcacacaggtaacatagcgaaacacgcccaga

SEQ ID NO: 178906 - DNA, 75 bp, Artificial Sequence
  Synthetic
tatgtctacttggatatcttcagtgttgtgtgcgtcagtctagtgaggtacctcctggtggcatattctacgcgt

SEQ ID NO: 178907 - DNA, 75 bp, Artificial Sequence
  Synthetic
ggttttatttgtacggaggtttcgatgggaaacgcgccacccaaactccaccctcgaaacagctcacaccagcga

SEQ ID NO: 178908 - DNA, 75 bp, Artificial Sequence
  Synthetic
tgggaaacgcgccacccaaactccaccctcgaaacagctcacaccagcgagggcggggttggacgagccggggta

SEQ ID NO: 178909 - DNA, 75 bp, Artificial Sequence
  Synthetic
gatgggtactgacatccgctgcactgttaattgcattggtgctgtcgggggatgcctgtcggcacaggagcaggg

SEQ ID NO: 178910 - DNA, 75 bp, Artificial Sequence
  Synthetic
gaatctctcaatccgtcgcaaaatgttaaacgccgcaatatgcttgttccaggtcgtcagccggcgcagcagtgg

SEQ ID NO: 178911 - DNA, 75 bp, Artificial Sequence
  Synthetic
atgactgcagactggcgactgcatgtcagaaccgtgtcagttactgcaggtttcctgttacccctggccctcctt

SEQ ID NO: 178912 - DNA, 75 bp, Artificial Sequence
  Synthetic
tcagaaccgtgtcagttactgcaggtttcctgttacccctggccctccttattctgttttatgctctcacctggt

SEQ ID NO: 178913 - DNA, 75 bp, Artificial Sequence
  Synthetic
ttaaacgccgcaatatgcttgttccaggtcgtcagccggcgcagcagtggcagcatcttcggcttcggaaccgga

SEQ ID NO: 178914 - DNA, 75 bp, Artificial Sequence
  Synthetic
cgcgatggcgcgcgccagcatatgcatggcccctacatgctccacgtattcaccgaaatgctcgttaagaaatac

SEQ ID NO: 178915 - DNA, 75 bp, Artificial Sequence
  Synthetic
attgttgctgtggtgctgctgttttttgtgttttgcttcccttaccacgtactaaatctactggacactctgcta

SEQ ID NO: 178916 - DNA, 75 bp, Artificial Sequence
  Synthetic
ttgtgttttgcttcccttaccacgtactaaatctactggacactctgctaaggcgacgctggatccgggacagct

SEQ ID NO: 178917 - DNA, 75 bp, Artificial Sequence
  Synthetic
atggcccctacatgctccacgtattcaccgaaatgctcgttaagaaatacaaagggttcaaccaggccccagaca

SEQ ID NO: 178918 - DNA, 75 bp, Artificial Sequence
  Synthetic
acagccactgccctgctccactacgggcatgtcagcattaaaaaaggccatgggttctagttttccctggcatat

SEQ ID NO: 178919 - DNA, 75 bp, Artificial Sequence
  Synthetic
caggcactgtacagcgccgttgttcccctgatatactcctgcctgggatccctctttaggcagaggatgtacggt

SEQ ID NO: 178920 - DNA, 75 bp, Artificial Sequence
  Synthetic
ccctgatatactcctgcctgggatccctctttaggcagaggatgtacggtctcttccaaagcctcaggcagtctt

SEQ ID NO: 178921 - DNA, 75 bp, Artificial Sequence
  Synthetic
ggcatgtcagcattaaaaaaggccatgggttctagttttccctggcatatgcccgtgttggcacagaggtcttca

SEQ ID NO: 178922 - DNA, 75 bp, Artificial Sequence
  Synthetic
ctccttgtcaaaggcctgtgattcaggctgtccgctgcagaacacctgagcgaacagtaggccaacgatggccaa

SEQ ID NO: 178923 - DNA, 75 bp, Artificial Sequence
  Synthetic
cttaatttaatctagcctcccgttcccatgatgcagagaggcgaatctggtttgtacacagatgtgactatgtat

SEQ ID NO: 178924 - DNA, 75 bp, Artificial Sequence
  Synthetic
ccatgatgcagagaggcgaatctggtttgtacacagatgtgactatgtatttgttttattatgcgattaaatgag

SEQ ID NO: 178925 - DNA, 75 bp, Artificial Sequence
  Synthetic
ggctgtccgctgcagaacacctgagcgaacagtaggccaacgatggccaacacttggaaacgcgacatgttagca

SEQ ID NO: 178926 - DNA, 75 bp, Artificial Sequence
  Synthetic
cctttatgtaggtttcaaaaacgtacgcaatcccgctctcgaggcgcacgttcggcgcttcccctggaagcggct

SEQ ID NO: 178927 - DNA, 75 bp, Artificial Sequence
  Synthetic
gctccataggtagattgactggaacgccatggcccacggggacatggacaggggtgttaggtctggtggaacatg

SEQ ID NO: 178928 - DNA, 75 bp, Artificial Sequence
  Synthetic
gccatggcccacggggacatggacaggggtgttaggtctggtggaacatgctgccactgccacggatggaacatc

SEQ ID NO: 178929 - DNA, 75 bp, Artificial Sequence
  Synthetic
cgcaatcccgctctcgaggcgcacgttcggcgcttcccctggaagcggctcaatgcgttggtacgcacctagaga

SEQ ID NO: 178930 - DNA, 75 bp, Artificial Sequence
  Synthetic
aaaacacacgaactgtgcccggcctagaaagcgcctctcgataaagcgccacgcctcctatgatccaaatgttgc

SEQ ID NO: 178931 - DNA, 75 bp, Artificial Sequence
  Synthetic
tccggccaccgtggagttgcctgtggggtttctgggatagtgtctggctggcagggtctcatccgcggcatttcc

SEQ ID NO: 178932 - DNA, 75 bp, Artificial Sequence
  Synthetic
gggtttctgggatagtgtctggctggcagggtctcatccgcggcatttccatggtaggtgagggttatctcgcct

SEQ ID NO: 178933 - DNA, 75 bp, Artificial Sequence
  Synthetic
agaaagcgcctctcgataaagcgccacgcctcctatgatccaaatgttgcccggcttccgttcgaagggaaactc

SEQ ID NO: 178934 - DNA, 75 bp, Artificial Sequence
  Synthetic
ccggaggcggttccttcagcgtacgactcaagactacatttatccttcctgaaagaggccgtctcttcggcggca

SEQ ID NO: 178935 - DNA, 75 bp, Artificial Sequence
  Synthetic
gtactcgccctgggcccagctgggcagcaccgtcccccgcaacactcggaggaaaacgctcttagtgttctgagg

SEQ ID NO: 178936 - DNA, 75 bp, Artificial Sequence
  Synthetic
agcaccgtcccccgcaacactcggaggaaaacgctcttagtgttctgagggatctgtatgtttagccagtggctg

SEQ ID NO: 178937 - DNA, 75 bp, Artificial Sequence
  Synthetic
actcaagactacatttatccttcctgaaagaggccgtctcttcggcggcagcgattcccaggtccgccgacccat

SEQ ID NO: 178938 - DNA, 75 bp, Artificial Sequence
  Synthetic
accgctccatgtcgccccgcaagcgcggccacggtaacccgccgcgaacacctatccccccgccatgacacacgg

SEQ ID NO: 178939 - DNA, 75 bp, Artificial Sequence
  Synthetic
tggtgtgggtccgtacgtgtatggtgaggattccgaccggcccactacacccagggccaccagaagctggaagcc

SEQ ID NO: 178940 - DNA, 75 bp, Artificial Sequence
  Synthetic
cggccacggtaacccgccgcgaacacctatccccccgccatgacacacggccagtacacagtttagctccaccgg

SEQ ID NO: 178941 - DNA, 75 bp, Artificial Sequence
  Synthetic
gtgtcgggcctgtttagaaactctgtcagggtggaggcacaggtagggtcgttacacagcgccaggacccatccc

SEQ ID NO: 178942 - DNA, 75 bp, Artificial Sequence
  Synthetic
atatcaactttattattgtacacacaggccgaccctcacacccaaatccacccaaccccgtggcttccaaattat

SEQ ID NO: 178943 - DNA, 75 bp, Artificial Sequence
  Synthetic
gttacacagcgccaggacccatcccctggcgctggcgtagctggcctggcagcctgttctgagacatgtaatcag

SEQ ID NO: 178944 - DNA, 75 bp, Artificial Sequence
  Synthetic
ctggcgctggcgtagctggcctggcagcctgttctgagacatgtaatcagaccagagaaccccgacaaggactgt

SEQ ID NO: 178945 - DNA, 75 bp, Artificial Sequence
  Synthetic
aggccgaccctcacacccaaatccacccaaccccgtggcttccaaattatttcttttttgtcccgcgagagttcc

SEQ ID NO: 178946 - DNA, 75 bp, Artificial Sequence
  Synthetic
ccttcttccgagtttcccgcagcatcgccggggtgctcttgttcatcgcgcggatccggccgcgcgatctccacg

SEQ ID NO: 178947 - DNA, 75 bp, Artificial Sequence
  Synthetic
ctgcaacgcggccatgagcgcgtacggggcgctgctcccaggcagcaccaacgcggccacacggcgcggggaggt

SEQ ID NO: 178948 - DNA, 75 bp, Artificial Sequence
  Synthetic
ggggcgctgctcccaggcagcaccaacgcggccacacggcgcggggaggtggggcatgaaaacaggcgcagctga

SEQ ID NO: 178949 - DNA, 75 bp, Artificial Sequence
  Synthetic
cgccggggtgctcttgttcatcgcgcggatccggccgcgcgatctccacgagttctatgtcatccgccggcccgc

SEQ ID NO: 178950 - DNA, 75 bp, Artificial Sequence
  Synthetic
gtgttggccgccataaacacgcgactaaagtgcctcgttacatacaaaataaagcccagcccaaacaggcagatt

SEQ ID NO: 178951 - DNA, 75 bp, Artificial Sequence
  Synthetic
caggtccttcctgtgcatgtcctccagtgggtgcaggggaggcgtcaccaggttccacatttcgtcagaaaagga

SEQ ID NO: 178952 - DNA, 75 bp, Artificial Sequence
  Synthetic
agtgggtgcaggggaggcgtcaccaggttccacatttcgtcagaaaaggaggtccatgagacttgcaaggaagtc

SEQ ID NO: 178953 - DNA, 75 bp, Artificial Sequence
  Synthetic
taaagtgcctcgttacatacaaaataaagcccagcccaaacaggcagattatttcaaacaccacaaaaaatatgt

SEQ ID NO: 178954 - DNA, 75 bp, Artificial Sequence
  Synthetic
acgtagagcacgaccccaacagttaagaccatagcacaaaataaagttggaattccaacgagcagcaggcccatt

SEQ ID NO: 178955 - DNA, 75 bp, Artificial Sequence
  Synthetic
gccttgtccctcggggccaacggtgcccagtgggtgtgccacgcagcggtagtccctagccgcccgcagcacctc

SEQ ID NO: 178956 - DNA, 75 bp, Artificial Sequence
  Synthetic
cccagtgggtgtgccacgcagcggtagtccctagccgcccgcagcacctctgacaagtgtacctggggcacctca

SEQ ID NO: 178957 - DNA, 75 bp, Artificial Sequence
  Synthetic
agaccatagcacaaaataaagttggaattccaacgagcagcaggcccatttcaaacatctcccaaacttccatag

SEQ ID NO: 178958 - DNA, 75 bp, Artificial Sequence
  Synthetic
tacacaacccggcatagctggcacgcgctgtttctggaaacggtcagccaccgaccgaggcattcggcgtgaacg

SEQ ID NO: 178959 - DNA, 75 bp, Artificial Sequence
  Synthetic
ggcgggtagtgagagctgcagtcccctgcagccggccagggccatctcgattgcagatgggagaagccccccgtc

SEQ ID NO: 178960 - DNA, 75 bp, Artificial Sequence
  Synthetic
ctgcagccggccagggccatctcgattgcagatgggagaagccccccgtcccctatgtcgtgccccgatacaatg

SEQ ID NO: 178961 - DNA, 75 bp, Artificial Sequence
  Synthetic
cgctgtttctggaaacggtcagccaccgaccgaggcattcggcgtgaacgtgttccatctcgcccgtacaggcgc

SEQ ID NO: 178962 - DNA, 75 bp, Artificial Sequence
  Synthetic
ggtggatcgttggacgccatgtctgtgacggggcgaacacagaaagattagattcataaaagttaatttagcgca

SEQ ID NO: 178963 - DNA, 75 bp, Artificial Sequence
  Synthetic
ggacgggttcagagggggtattgggtgcctggatgccaggaagttgtgctcgaaggtggacccggctatgagaca

SEQ ID NO: 178964 - DNA, 75 bp, Artificial Sequence
  Synthetic
tgcctggatgccaggaagttgtgctcgaaggtggacccggctatgagacagctctgattcacggccaggtatacc

SEQ ID NO: 178965 - DNA, 75 bp, Artificial Sequence
  Synthetic
tgacggggcgaacacagaaagattagattcataaaagttaatttagcgcaagccggcgccacgcctatccccaac

SEQ ID NO: 178966 - DNA, 75 bp, Artificial Sequence
  Synthetic
cgagccacgcccatggccgaccgggacgggcaccccctaaaggcattactgggtcacaccgccatgtccatgcga

SEQ ID NO: 178967 - DNA, 75 bp, Artificial Sequence
  Synthetic
cttgacctcggcccagctggtaaacaccaccgagttgaagggaaggacctccaccgtttcttgctgttgtgtgat

SEQ ID NO: 178968 - DNA, 75 bp, Artificial Sequence
  Synthetic
accaccgagttgaagggaaggacctccaccgtttcttgctgttgtgtgatgcgcacatggcgctccgaaagcgtc

SEQ ID NO: 178969 - DNA, 75 bp, Artificial Sequence
  Synthetic
acgggcaccccctaaaggcattactgggtcacaccgccatgtccatgcgaatggctggatgtggatcatatccct

SEQ ID NO: 178970 - DNA, 75 bp, Artificial Sequence
  Synthetic
actatgtgtaggcgagggaagggtcgcggctccctcgagagctgcaccttaacggcctcaatgtgattcttatag

SEQ ID NO: 178971 - DNA, 75 bp, Artificial Sequence
  Synthetic
gaattccttgcaggcgaagaggcactcctgtaggaggccggcttggtggtcctccggactccacgccacggcgcc

SEQ ID NO: 178972 - DNA, 75 bp, Artificial Sequence
  Synthetic
tcctgtaggaggccggcttggtggtcctccggactccacgccacggcgccagttagcactacgtcctggagcttg

SEQ ID NO: 178973 - DNA, 75 bp, Artificial Sequence
  Synthetic
gcggctccctcgagagctgcaccttaacggcctcaatgtgattcttatagatgtgcgcgtcgcctaacacgtgaa

SEQ ID NO: 178974 - DNA, 75 bp, Artificial Sequence
  Synthetic
agcgcgtaactcgcaatgttaaagggaacaccgagacccatgtcgcctgaccgctgatagagctgacaagagagc

SEQ ID NO: 178975 - DNA, 75 bp, Artificial Sequence
  Synthetic
ggccccggtggatacattagtagccatcttgtaggcctgctcccccatggccatggcctgacccctccacgctgg

SEQ ID NO: 178976 - DNA, 75 bp, Artificial Sequence
  Synthetic
atcttgtaggcctgctcccccatggccatggcctgacccctccacgctggcactggaagcagctcctggggcagg

SEQ ID NO: 178977 - DNA, 75 bp, Artificial Sequence
  Synthetic
gaacaccgagacccatgtcgcctgaccgctgatagagctgacaagagagctcgccagccgagacgtaaaactgac

SEQ ID NO: 178978 - DNA, 75 bp, Artificial Sequence
  Synthetic
caggcagacatcaccattcgtcgatcacaggggtgatttttaatgagatctaaaatgtacgccaactgatcgaca

SEQ ID NO: 178979 - DNA, 75 bp, Artificial Sequence
  Synthetic
agtgatggcctccaccgtgtcgggcactctgggcgccaccctctcggccagcatggacgagtgcagcaccaggtg

SEQ ID NO: 178980 - DNA, 75 bp, Artificial Sequence
  Synthetic
cacaggggtgatttttaatgagatctaaaatgtacgccaactgatcgacaccccgccccgaataatctgcatcgg

SEQ ID NO: 178981 - DNA, 75 bp, Artificial Sequence
  Synthetic
cccaggtccccctcgcgcctgtgacccaaacctctcgccgtcaaaaattccttggaaccattggcgttccatatt

SEQ ID NO: 178982 - DNA, 75 bp, Artificial Sequence
  Synthetic
ccaaacctctcgccgtcaaaaattccttggaaccattggcgttccatattttcaccccacgctcagacaaccgcc

SEQ ID NO: 178983 - DNA, 75 bp, Artificial Sequence
  Synthetic
ccaaccgtcgcgtggcgaagtaactggtggattgtggagccggtggcaaaaaggccccagtcaacatcctcgggg

SEQ ID NO: 178984 - DNA, 75 bp, Artificial Sequence
  Synthetic
aaggccccagtcaacatcctcggggtgccccgagacgcggacaccatcggacagcgccagccagggggacggggg

SEQ ID NO: 178985 - DNA, 75 bp, Artificial Sequence
  Synthetic
cgccaatatacacgcttggtcgtaagcagaggaaattcaccccgcaaactgtaccgagcatgcatcccaaaaaca

SEQ ID NO: 178986 - DNA, 75 bp, Artificial Sequence
  Synthetic
gcagaggaaattcaccccgcaaactgtaccgagcatgcatcccaaaaacagagagggttccaacgccggtgcgat

SEQ ID NO: 178987 - DNA, 75 bp, Artificial Sequence
  Synthetic
ggtcgtctactattctgatgcctggctgctccgaggtcctcccgaggaccgttatctggcacgcgcacaggcgcg

SEQ ID NO: 178988 - DNA, 75 bp, Artificial Sequence
  Synthetic
aatcgctctcccgggttaaccggtcggtccgcatcggcgggcaaaggcagagcccgacacgcggcgagatacgac

SEQ ID NO: 178989 - DNA, 75 bp, Artificial Sequence
  Synthetic
ggtctcgcccagatccccaggcaccgcgcccgactctgccaccaccgcaaacaccagggagcaatacacgttgag

SEQ ID NO: 178990 - DNA, 75 bp, Artificial Sequence
  Synthetic
ggtccgcatcggcgggcaaaggcagagcccgacacgcggcgagatacgaccgcgcgtctgcacgcccacggcggc

SEQ ID NO: 178991 - DNA, 75 bp, Artificial Sequence
  Synthetic
acaccagggagcaatacacgttgagaaagtgctctgccaccgccgcctccacggcatccggaccggcagcgggat

SEQ ID NO: 178992 - DNA, 75 bp, Artificial Sequence
  Synthetic
aaagtgctctgccaccgccgcctccacggcatccggaccggcagcgggatccgctggcaggtgggcgcgcacctc

SEQ ID NO: 178993 - DNA, 75 bp, Artificial Sequence
  Synthetic
cccaagcacgcgggtcgcccggtcgacccttcgggcatgactccagtctaacctgcgcgcagcgagcgagcgtcc

SEQ ID NO: 178994 - DNA, 75 bp, Artificial Sequence
  Synthetic
acccttcgggcatgactccagtctaacctgcgcgcagcgagcgagcgtcccgtcggccggaataagtgccacaaa

SEQ ID NO: 178995 - DNA, 75 bp, Artificial Sequence
  Synthetic
cctgcaggtgcctcaccaccggggccgggtcatgcgatctgtttagtccggagaagatagggcccttggcaagcc

SEQ ID NO: 178996 - DNA, 75 bp, Artificial Sequence
  Synthetic
cgggtcatgcgatctgtttagtccggagaagatagggcccttggcaagccgctgaaccagcttcagggtctccaa

SEQ ID NO: 178997 - DNA, 75 bp, Artificial Sequence
  Synthetic
accccgcataaccacgcccgtatcctcccaatcgcacgtcacccgacgtaaacgccatcccctcccggttagcag

SEQ ID NO: 178998 - DNA, 75 bp, Artificial Sequence
  Synthetic
tcccaatcgcacgtcacccgacgtaaacgccatcccctcccggttagcagaaaaggcaacaaacaaacgtcaaag

SEQ ID NO: 178999 - DNA, 75 bp, Artificial Sequence
  Synthetic
ccggtccgtccgtgggctcaaacctgcccagacacaccactgtctgctgggggatcatccttctcagggagatgc

SEQ ID NO: 179000 - DNA, 75 bp, Artificial Sequence
  Synthetic
gcccagacacaccactgtctgctgggggatcatccttctcagggagatgcattctttggaagtagtggtagagat

SEQ ID NO: 179001 - DNA, 75 bp, Artificial Sequence
  Synthetic
aacatagggagcgttaactatcggtgtcgagattgaaagtccaccacgctttaggccgtagcgggaacctgctgc

SEQ ID NO: 179002 - DNA, 75 bp, Artificial Sequence
  Synthetic
gtcgagattgaaagtccaccacgctttaggccgtagcgggaacctgctgcatgagtttctgcacccagtccttag

SEQ ID NO: 179003 - DNA, 75 bp, Artificial Sequence
  Synthetic
tttttaagaaaccccccagggtggggactcccgctccctgcagcatctcggcctgctgtacgcccttggcgaata

SEQ ID NO: 179004 - DNA, 75 bp, Artificial Sequence
  Synthetic
gactcccgctccctgcagcatctcggcctgctgtacgcccttggcgaatatgcgacgaaatcggctgtgcgcacg

SEQ ID NO: 179005 - DNA, 75 bp, Artificial Sequence
  Synthetic
ggcttggtacacaggtgcgacgtgggataccagctccccagcagccaacggggaagcggtttgcgctgatagccc

SEQ ID NO: 179006 - DNA, 75 bp, Artificial Sequence
  Synthetic
gataccagctccccagcagccaacggggaagcggtttgcgctgatagcccgtgcagcaatagcgattcccatgac

SEQ ID NO: 179007 - DNA, 75 bp, Artificial Sequence
  Synthetic
tctgtccgcctggaaacagggtgctgtgaaacaacaggttgccaaggccgcgaatacccctctgcacgctgctgt

SEQ ID NO: 179008 - DNA, 75 bp, Artificial Sequence
  Synthetic
gtgaaacaacaggttgccaaggccgcgaatacccctctgcacgctgctgtggacgtgggtgtatgctccgtggat

SEQ ID NO: 179009 - DNA, 75 bp, Artificial Sequence
  Synthetic
agagcggtcatcaaaagccacacacgaatcttcatgacggtgactttaggttagacacgtacgttaagctcccct

SEQ ID NO: 179010 - DNA, 75 bp, Artificial Sequence
  Synthetic
gaatcttcatgacggtgactttaggttagacacgtacgttaagctcccctggtgtcggtctcccgtaacgggccg

SEQ ID NO: 179011 - DNA, 75 bp, Artificial Sequence
  Synthetic
ttcccggtatcacaaagtacctggccacgttataattgtccccggttgaagcctgcaccgccagcggtagcaggt

SEQ ID NO: 179012 - DNA, 75 bp, Artificial Sequence
  Synthetic
cacgttataattgtccccggttgaagcctgcaccgccagcggtagcaggtctgcccccagggatatcataacagc

SEQ ID NO: 179013 - DNA, 75 bp, Artificial Sequence
  Synthetic
cgcccccgtttcagaaagcgaagcccggtgtgcgtcagacgcgactcttaatccggccaggtattttttcccact

SEQ ID NO: 179014 - DNA, 75 bp, Artificial Sequence
  Synthetic
cggtgtgcgtcagacgcgactcttaatccggccaggtattttttcccactccgccatcacccaaagccctcagcc

SEQ ID NO: 179015 - DNA, 75 bp, Artificial Sequence
  Synthetic
cctcgggcacttccaacccctcgtacggtaccaggtcagtattttgtgtaaatgccctgataaactgaggtgggt

SEQ ID NO: 179016 - DNA, 75 bp, Artificial Sequence
  Synthetic
cggtaccaggtcagtattttgtgtaaatgccctgataaactgaggtgggtgtggttctagcagggtctgtgtgat

SEQ ID NO: 179017 - DNA, 75 bp, Artificial Sequence
  Synthetic
gagccatgaggcgccgagtgcgggcgtccggccaggcacagactttacgtccgggccgtgtgagaaaaataaccg

SEQ ID NO: 179018 - DNA, 75 bp, Artificial Sequence
  Synthetic
gtccggccaggcacagactttacgtccgggccgtgtgagaaaaataaccgcctggcggcgacaatacaccttcga

SEQ ID NO: 179019 - DNA, 75 bp, Artificial Sequence
  Synthetic
ctagctctcgcagcaaaactccaagctctgttgacagtgttgtgggcctgtggtttatgtttggcccgtagccaa

SEQ ID NO: 179020 - DNA, 75 bp, Artificial Sequence
  Synthetic
ctctgttgacagtgttgtgggcctgtggtttatgtttggcccgtagccaaaggatacaacacgctcgctcccccg

SEQ ID NO: 179021 - DNA, 75 bp, Artificial Sequence
  Synthetic
cggcctcgcaacagtcagacgccaccagcgtcgcggggccgctggcagcacagaacccacacagccagtccccca

SEQ ID NO: 179022 - DNA, 75 bp, Artificial Sequence
  Synthetic
cagcgtcgcggggccgctggcagcacagaacccacacagccagtcccccaccaccaaacacaaaagcaagagtcc

SEQ ID NO: 179023 - DNA, 75 bp, Artificial Sequence
  Synthetic
cagcgagcaccgtctgtatttccacatcccgtctctctcgctcctccctcgaagtgggaggtcttcggaaagtta

SEQ ID NO: 179024 - DNA, 75 bp, Artificial Sequence
  Synthetic
atgttttagacgcgtggacaccgcaactttaagcgttcccgactctcgatttcaatacgtgtgtgcgaagcacgg

SEQ ID NO: 179025 - DNA, 75 bp, Artificial Sequence
  Synthetic
gccaccgggtacgagagtgagtgtgcccgtacggcttgtataaaagctgacaaaagcttcctcatccgcggtgag

SEQ ID NO: 179026 - DNA, 75 bp, Artificial Sequence
  Synthetic
actttaagcgttcccgactctcgatttcaatacgtgtgtgcgaagcacgggcaccaccacagctacacgccgaga

SEQ ID NO: 179027 - DNA, 75 bp, Artificial Sequence
  Synthetic
caaaagcttcctcatccgcggtgagatcactctccaaccacagcccagtgacgtcgtaggccatgcctagagggt

SEQ ID NO: 179028 - DNA, 75 bp, Artificial Sequence
  Synthetic
atcactctccaaccacagcccagtgacgtcgtaggccatgcctagagggtgccccgcccccggggacaccctctg

SEQ ID NO: 179029 - DNA, 75 bp, Artificial Sequence
  Synthetic
ggacgcacaacagcccgggaacggcagtcagggacacaaaccgccaaccgacaacccaacccgcactagcttcta

SEQ ID NO: 179030 - DNA, 75 bp, Artificial Sequence
  Synthetic
agtcagggacacaaaccgccaaccgacaacccaacccgcactagcttctactaacgcaatggggatgctagccgc

SEQ ID NO: 179031 - DNA, 75 bp, Artificial Sequence
  Synthetic
tgagaatccccaaatattacgcaggcacaggttgctctgcagagtttgttttcgctttcgtggaatccacagtta

SEQ ID NO: 179032 - DNA, 75 bp, Artificial Sequence
  Synthetic
cacaggttgctctgcagagtttgttttcgctttcgtggaatccacagttacatgtagccatgtcactaacctcaa

SEQ ID NO: 179033 - DNA, 75 bp, Artificial Sequence
  Synthetic
tgacggccgcggggtgatacattaaagctacatttgggattaaaggcttagaaactgaatgtttaatatgctttg

SEQ ID NO: 179034 - DNA, 75 bp, Artificial Sequence
  Synthetic
agctacatttgggattaaaggcttagaaactgaatgtttaatatgctttgacctcggctcccgtggacgggtata

SEQ ID NO: 179035 - DNA, 75 bp, Artificial Sequence
  Synthetic
agttcctgggaaataaaacctcctcatacaggtcgtctgtcggttgggtggcggcttgggcggtgtctatacgga

SEQ ID NO: 179036 - DNA, 75 bp, Artificial Sequence
  Synthetic
atacaggtcgtctgtcggttgggtggcggcttgggcggtgtctatacggaaggcactcccaccatcaacccttaa

SEQ ID NO: 179037 - DNA, 75 bp, Artificial Sequence
  Synthetic
tacctgaattgcctgagcaaggtctgccgcggcctcgccgggatagttcccacggttacgtgaggttaaacgtgc

SEQ ID NO: 179038 - DNA, 75 bp, Artificial Sequence
  Synthetic
gccgcggcctcgccgggatagttcccacggttacgtgaggttaaacgtgcaacgggcgagtggcgccgcccgcac

SEQ ID NO: 179039 - DNA, 75 bp, Artificial Sequence
  Synthetic
ccgcaccggacactaaaatactggcatacccgaatacattgggtgggtccctattcacttcctgtaactccacct

SEQ ID NO: 179040 - DNA, 75 bp, Artificial Sequence
  Synthetic
cgatcgtcgcgcggggtcatcgtcgggtcagagttccacattcacacactcggggtcgccaaaaggtcacgcgcg

SEQ ID NO: 179041 - DNA, 75 bp, Artificial Sequence
  Synthetic
ggtcagagttccacattcacacactcggggtcgccaaaaggtcacgcgcgagaggcggccgcgaaaccggggtca

SEQ ID NO: 179042 - DNA, 75 bp, Artificial Sequence
  Synthetic
ctaacaggctgtctaaaaaaaggtggtaatggtggagggctaattacattattgccaaggtggttgtcattgtgg

SEQ ID NO: 179043 - DNA, 75 bp, Artificial Sequence
  Synthetic
gtaatggtggagggctaattacattattgccaaggtggttgtcattgtggtgtaagttctggtcccgcgtgtata

SEQ ID NO: 179044 - DNA, 75 bp, Artificial Sequence
  Synthetic
cacgggcaggtcaccgaaatgtggacacaggtgggcgtggacaccaggggccggcgtgcgcggcaggggtcaccc

SEQ ID NO: 179045 - DNA, 75 bp, Artificial Sequence
  Synthetic
cacaggtgggcgtggacaccaggggccggcgtgcgcggcaggggtcacccgaaggtcacctgcgcatgcgcagtc

SEQ ID NO: 179046 - DNA, 75 bp, Artificial Sequence
  Synthetic
ttatataaataaaataccagcagtccttgtaacgtacctaaattttaaaatagaaaaatactttttttacatagt

SEQ ID NO: 179047 - DNA, 75 bp, Artificial Sequence
  Synthetic
tagaaaaatactttttttacatagtatatgtcatgtggtgatataatttatggtaattagtctttaacttactga

SEQ ID NO: 179048 - DNA, 75 bp, Artificial Sequence
  Synthetic
ccatcttaatccacctaatccccgtctaatccccggctagcgacgcgattggttaaaaaaaccgtcaatcaaacg

SEQ ID NO: 179049 - DNA, 75 bp, Artificial Sequence
  Synthetic
ctaatccccggctagcgacgcgattggttaaaaaaaccgtcaatcaaacgaaacaccgcggcgattggctcaacc

SEQ ID NO: 179050 - DNA, 75 bp, Artificial Sequence
  Synthetic
ctagggagaagcattactaattgtacacaacctccagtgtgggaccacgctaaaaaatagaggatagttatgttt

SEQ ID NO: 179051 - DNA, 75 bp, Artificial Sequence
  Synthetic
cacaacctccagtgtgggaccacgctaaaaaatagaggatagttatgtttttgtgtcattgttaaaaaataaaat

SEQ ID NO: 179052 - DNA, 75 bp, Artificial Sequence
  Synthetic
aatcaaataattccgcggcaccattggttcgttgtgctgtcaatcatctgattccgcatgccgattggcgcaaag

SEQ ID NO: 179053 - DNA, 75 bp, Artificial Sequence
  Synthetic
ggttcgttgtgctgtcaatcatctgattccgcatgccgattggcgcaaagcagtagccaatgagcgggttgggtt

SEQ ID NO: 179054 - DNA, 75 bp, Artificial Sequence
  Synthetic
tccagtaacaagagacgccttgttaaaactttgccacacataaaggcaccatagaaaaatgaggcatacaagaag

SEQ ID NO: 179055 - DNA, 75 bp, Artificial Sequence
  Synthetic
aaaaaaaattgttcagcctgggtttccagtagatattcctagctaggtttcttaatttaggtatccaggctagat

SEQ ID NO: 179056 - DNA, 75 bp, Artificial Sequence
  Synthetic
ccagtagatattcctagctaggtttcttaatttaggtatccaggctagatattttagctatatatatctaattag

SEQ ID NO: 179057 - DNA, 75 bp, Artificial Sequence
  Synthetic
atttatttagatgcttgaaccataccatcaatgctatacaacaaacctttgatattgccagtggtgctagtaatt

SEQ ID NO: 179058 - DNA, 75 bp, Artificial Sequence
  Synthetic
catcaatgctatacaacaaacctttgatattgccagtggtgctagtaattgcaagtagttcggttgttaaagttt

SEQ ID NO: 179059 - DNA, 75 bp, Artificial Sequence
  Synthetic
cttgttaattgaagcccctcaaagctatgggacctagtaaatacctataattagtattcctaagcttaatccttt

SEQ ID NO: 179060 - DNA, 75 bp, Artificial Sequence
  Synthetic
tatgggacctagtaaatacctataattagtattcctaagcttaatcctttagcttagttatctaattaatattca

SEQ ID NO: 179061 - DNA, 75 bp, Artificial Sequence
  Synthetic
tttggtggagcccatgacttatgaagagtgctgattatgccagtgaatcctacaaaaaatgtcgttaacagcaac

SEQ ID NO: 179062 - DNA, 75 bp, Artificial Sequence
  Synthetic
gagtgctgattatgccagtgaatcctacaaaaaatgtcgttaacagcaacatgtactatgcaccaactaaaactt

SEQ ID NO: 179063 - DNA, 75 bp, Artificial Sequence
  Synthetic
aaaggctctaattagtatgcaaaaattttaatcccctaattagtatgcacaacccgcatgcctcaatttttaggg

SEQ ID NO: 179064 - DNA, 75 bp, Artificial Sequence
  Synthetic
ttttaatcccctaattagtatgcacaacccgcatgcctcaatttttagggtccgtgcatttttgggcctggtgac

SEQ ID NO: 179065 - DNA, 75 bp, Artificial Sequence
  Synthetic
atcctgcagcggtggcagtacatgtatgcgttttacagcaggatacagggtaacccatgaccaagcctataaaaa

SEQ ID NO: 179066 - DNA, 75 bp, Artificial Sequence
  Synthetic
actattttgcttatcttgacttctatgggcagggcatactgtatataaggagcgcgtgccgccagtctgccactg

SEQ ID NO: 179067 - DNA, 75 bp, Artificial Sequence
  Synthetic
ttagttgacaggcctatctgtgaatttccggtgtgaaaacagtggttaacttacctgcacaaatgaaagagacag

SEQ ID NO: 179068 - DNA, 75 bp, Artificial Sequence
  Synthetic
ttacctgcacaaatgaaagagacagatgacactaatttaatattgcctgttttcacggtggcaaatgcatacaag

SEQ ID NO: 179069 - DNA, 75 bp, Artificial Sequence
  Synthetic
tgggcagggcatactgtatataaggagcgcgtgccgccagtctgccactggcacttgccagtcgcttactgggct

SEQ ID NO: 179070 - DNA, 75 bp, Artificial Sequence
  Synthetic
ttggaaaaaatatccaagacgattgccaggtgtttgacatgtggaccagcatgtttgtcatcaacacagcaaacg

SEQ ID NO: 179071 - DNA, 75 bp, Artificial Sequence
  Synthetic
cgcggcggcaacctccagcgttgccaccgagccgcgtttttgcatggcgtttacgttgtaacccgggtttttgct

SEQ ID NO: 179072 - DNA, 75 bp, Artificial Sequence
  Synthetic
accgagccgcgtttttgcatggcgtttacgttgtaacccgggtttttgctcctgctctccctgtggcttttttct

SEQ ID NO: 179073 - DNA, 75 bp, Artificial Sequence
  Synthetic
tgttttattaacgtcaaaaaagctataaaatacaaaaagaatgttaagtgccataataagtatgagtttgttgga

SEQ ID NO: 179074 - DNA, 75 bp, Artificial Sequence
  Synthetic
gatttttctccccgctacccgacggaggtttggaacgcaatcgtgcctgcgctagcaatttgccctgggccccgc

SEQ ID NO: 179075 - DNA, 75 bp, Artificial Sequence
  Synthetic
aggtttggaacgcaatcgtgcctgcgctagcaatttgccctgggccccgctgggttttggggaacgccgttttgc

SEQ ID NO: 179076 - DNA, 75 bp, Artificial Sequence
  Synthetic
cctacctgttaccagtgataaaatggccgtggtgattaagcaagcataggttacagagttggtagttgacaagtt

SEQ ID NO: 179077 - DNA, 75 bp, Artificial Sequence
  Synthetic
ttacagagttggtagttgacaagttccaaagtttaaggacaatgcaagctataaaaacaaatgtatgtgaatata

SEQ ID NO: 179078 - DNA, 75 bp, Artificial Sequence
  Synthetic
tggattatataacgttcctttcaaaaattctaggctcgagcccgttgtggtcagaatctaaccctaaccctggcc

SEQ ID NO: 179079 - DNA, 75 bp, Artificial Sequence
  Synthetic
aattctaggctcgagcccgttgtggtcagaatctaaccctaaccctggccatcttaaagggggcacgtaggcctc

SEQ ID NO: 179080 - DNA, 75 bp, Artificial Sequence
  Synthetic
cttaccaggaattcctggtagccagtacttaccaataattcctaggtgccaggatgaaggccatttaggattgtt

SEQ ID NO: 179081 - DNA, 75 bp, Artificial Sequence
  Synthetic
tacttaccaataattcctaggtgccaggatgaaggccatttaggattgttgctagagattgcctgtgtatactta

SEQ ID NO: 179082 - DNA, 75 bp, Artificial Sequence
  Synthetic
tacgcggctgtgtcggctgggtaggattgcatgaacccgtcaggagtcagcctctggttgctttccggattgtat

SEQ ID NO: 179083 - DNA, 75 bp, Artificial Sequence
  Synthetic
attgcatgaacccgtcaggagtcagcctctggttgctttccggattgtatttgggtttagttggacccaaaaaat

SEQ ID NO: 179084 - DNA, 75 bp, Artificial Sequence
  Synthetic
atcaattgagttggtagttacacagacaagagtgatacaccaaaaacataccagtagggcccaaagccataaatt

SEQ ID NO: 179085 - DNA, 75 bp, Artificial Sequence
  Synthetic
acaagagtgatacaccaaaaacataccagtagggcccaaagccataaattccagaagaatatgagtgtcttcatt

SEQ ID NO: 179086 - DNA, 75 bp, Artificial Sequence
  Synthetic
aggggcgtttaatgtagcttcccgtgcacgatagccgacggcaattcaattttaattgtcagtcgttcggcccta

SEQ ID NO: 179087 - DNA, 75 bp, Artificial Sequence
  Synthetic
gcacgatagccgacggcaattcaattttaattgtcagtcgttcggccctaaaaagtattgagctctgtttttgtt

SEQ ID NO: 179088 - DNA, 75 bp, Artificial Sequence
  Synthetic
gtgatttttaaatacgttttaggattcacgtgatactagaaagggcatttaaggttttgtgtacaattgttttag

SEQ ID NO: 179089 - DNA, 75 bp, Artificial Sequence
  Synthetic
tcacgtgatactagaaagggcatttaaggttttgtgtacaattgttttaggaagccacatggaattttgctgatt

SEQ ID NO: 179090 - DNA, 75 bp, Artificial Sequence
  Synthetic
gtgagctcggcgacacaaacgtttcgttatgctgtttttgttggttatctgaacctatttgcgatgttcattcgg

SEQ ID NO: 179091 - DNA, 75 bp, Artificial Sequence
  Synthetic
gttatgctgtttttgttggttatctgaacctatttgcgatgttcattcggatgcggcttaatgtatggtaagcta

SEQ ID NO: 179092 - DNA, 75 bp, Artificial Sequence
  Synthetic
atgggggaagggaagggcgcgcctggtccccgcccccgcccgcgggggaccccgggcagcgagggaagggggcgc

SEQ ID NO: 179093 - DNA, 75 bp, Artificial Sequence
  Synthetic
tgtgtggtgagctgagacacccgacccttgtttgctaacacggacaattaactgtctgtacggatcgagagaatg

SEQ ID NO: 179094 - DNA, 75 bp, Artificial Sequence
  Synthetic
ccttgtttgctaacacggacaattaactgtctgtacggatcgagagaatgctgtgatgtagtgttggtttggtca

SEQ ID NO: 179095 - DNA, 75 bp, Artificial Sequence
  Synthetic
gctggaatattatctagttacaggttgcggtgtgatgttgcgactgtcagttggtaagtactaacttcctccgtg

SEQ ID NO: 179096 - DNA, 75 bp, Artificial Sequence
  Synthetic
tgcggtgtgatgttgcgactgtcagttggtaagtactaacttcctccgtggtttccctgtggtcaaggcgttgtt

SEQ ID NO: 179097 - DNA, 75 bp, Artificial Sequence
  Synthetic
cgcgccgcccctccccctccccccgctcgcctcccggcgctgccgccaggccccggccggagccggccgcccgcg

SEQ ID NO: 179098 - DNA, 75 bp, Artificial Sequence
  Synthetic
gggggcagggcgcgcccggcggctccctcgcggggcgggggacgggggaggggggagccgggcccccgcgcgccg

SEQ ID NO: 179099 - DNA, 75 bp, Artificial Sequence
  Synthetic
gaacgcggaatcggatgtggtcattgttgaaatgtattagtccgagacgactatgtggtgaacctgataatctgt

SEQ ID NO: 179100 - DNA, 75 bp, Artificial Sequence
  Synthetic
gttgaaatgtattagtccgagacgactatgtggtgaacctgataatctgttctctttgcaggtggtgccgtaggc

SEQ ID NO: 179101 - DNA, 75 bp, Artificial Sequence
  Synthetic
ccggggccccgagccccgagccccgccggggtacggggctaggccacgcctactttttttttcgggcggcccccc

SEQ ID NO: 179102 - DNA, 75 bp, Artificial Sequence
  Synthetic
ccggggtacggggctaggccacgcctactttttttttcgggcggccccccgaccctctctcggcccccccggtcc

SEQ ID NO: 179103 - DNA, 75 bp, Artificial Sequence
  Synthetic
actttattgggggtttttatcccgacgggcctcgccgcgtaaacgatggccgatgtgttccaaatacgtaaacag

SEQ ID NO: 179104 - DNA, 75 bp, Artificial Sequence
  Synthetic
cgatgtgttccaaatacgtaaacagtcatcgtgaacagtccccgtgccccacaatccacaaacccaacatatcac

SEQ ID NO: 179105 - DNA, 75 bp, Artificial Sequence
  Synthetic
ggccgcggcggcgcccgcggcggcggcggcgcttgctttcgttttctcccgcggccccccgggcgcgagccgcgc

SEQ ID NO: 179106 - DNA, 75 bp, Artificial Sequence
  Synthetic
gcggcgcttgctttcgttttctcccgcggccccccgggcgcgagccgcgcggcggcggcgggcgccccctccccc

SEQ ID NO: 179107 - DNA, 75 bp, Artificial Sequence
  Synthetic
gggagagggcggcagcggggagagggcggcagcggggagagggcggcagcggggagagggcggcagcggggagag

SEQ ID NO: 179108 - DNA, 75 bp, Artificial Sequence
  Synthetic
gcgccgccgcgccccgatcccgcgggcgccccgcccccctgccggggacgccgccggggcctgcggcgcctcccg

SEQ ID NO: 179109 - DNA, 75 bp, Artificial Sequence
  Synthetic
gcgccccgcccccctgccggggacgccgccggggcctgcggcgcctcccgcccgggcatggggccgcgcgccgcc

SEQ ID NO: 179110 - DNA, 75 bp, Artificial Sequence
  Synthetic
ctgttgtcacccttatctgcaattttagttgtgtgggacaatctgggcatcgacacagcctttggattacatggt

SEQ ID NO: 179111 - DNA, 75 bp, Artificial Sequence
  Synthetic
ggggagagggcggcagcggggagagggcggcagcggggagagggcgccagcggggagagggcggcagcggggaga

SEQ ID NO: 179112 - DNA, 75 bp, Artificial Sequence
  Synthetic
attgttctacctctggaaataatgttaccgtttggcatctaccaaacggacgaaatgaaaccgtgtcacaaacta

SEQ ID NO: 179113 - DNA, 75 bp, Artificial Sequence
  Synthetic
aagcgcagttatgcgctttggtacgtttctcggtagcgtccgtgacggcatacggtaggcaaattttcctcggtt

SEQ ID NO: 179114 - DNA, 75 bp, Artificial Sequence
  Synthetic
tctgacgggctgtcgtctcgcctgtcaaatcgtctatgtttttcggcgcgttgtgccaatataactctagaaact

SEQ ID NO: 179115 - DNA, 75 bp, Artificial Sequence
  Synthetic
tttctcggtagcgtccgtgacggcatacggtaggcaaattttcctcggttgttggatataagtgctgttcccacc

SEQ ID NO: 179116 - DNA, 75 bp, Artificial Sequence
  Synthetic
aatactgtatctgtcagcagtactacaggctttagaacattcagtactaatagcgatgcaaccacacatgatata

SEQ ID NO: 179117 - DNA, 75 bp, Artificial Sequence
  Synthetic
ccagatgttgcggcgattgaggggattttacttgtgtgtggtttggaccggcccgaatatgtgcatcatccagtg

SEQ ID NO: 179118 - DNA, 75 bp, Artificial Sequence
  Synthetic
ttttacttgtgtgtggtttggaccggcccgaatatgtgcatcatccagtgctgagtcctattcggacgtgtgtgt

SEQ ID NO: 179119 - DNA, 75 bp, Artificial Sequence
  Synthetic
gcgcgcatcgagagtgtggctggcctggcgcgcctgggacgagggatgttacacatgaacagggaaggtggaatg

SEQ ID NO: 179120 - DNA, 75 bp, Artificial Sequence
  Synthetic
tggcgcgcctgggacgagggatgttacacatgaacagggaaggtggaatgaattggggacgcgctttagctctgc

SEQ ID NO: 179121 - DNA, 75 bp, Artificial Sequence
  Synthetic
attattccctacacgatttgtgcacggaagactatacgcaaccagtggattggtactgacattcaggtaagataa

SEQ ID NO: 179122 - DNA, 75 bp, Artificial Sequence
  Synthetic
acggcgtttgctatgggcatgtttccgttgtatatgtatcaggccatcgggcctcagtggtttcgggcgcatggg

SEQ ID NO: 179123 - DNA, 75 bp, Artificial Sequence
  Synthetic
cgttgtatatgtatcaggccatcgggcctcagtggtttcgggcgcatgggggctggagtggatttaaaatctact

SEQ ID NO: 179124 - DNA, 75 bp, Artificial Sequence
  Synthetic
gccgcggtgggactggtggccgcagtgtctgcctgttgggttgcttaccggcgcggttcttggtgattgtataca

SEQ ID NO: 179125 - DNA, 75 bp, Artificial Sequence
  Synthetic
tgtctgcctgttgggttgcttaccggcgcggttcttggtgattgtatacagtgtgtgaataaaaagcattaacta

SEQ ID NO: 179126 - DNA, 75 bp, Artificial Sequence
  Synthetic
tcgcgagaagttcctcgcgaaacatctgctgaatacgggtggtcgcgctgtgtcggctgctggcgtttaccgggt

SEQ ID NO: 179127 - DNA, 75 bp, Artificial Sequence
  Synthetic
ctgctgaatacgggtggtcgcgctgtgtcggctgctggcgtttaccgggttggttgccgaggcggccgccgagtg

SEQ ID NO: 179128 - DNA, 75 bp, Artificial Sequence
  Synthetic
gtgccatcgggggtccgggctgggtcgacgcctcgagtgggacctcctgtgttgcctgtccaacgggagcaggtg

SEQ ID NO: 179129 - DNA, 75 bp, Artificial Sequence
  Synthetic
cgacgcctcgagtgggacctcctgtgttgcctgtccaacgggagcaggtgttggggggccggacagttgagggtt

SEQ ID NO: 179130 - DNA, 75 bp, Artificial Sequence
  Synthetic
gtggtgcagatggttggtgggggggtggcggaggtggggcggctgcggtgaccggatagctgtagtagctgtatg

SEQ ID NO: 179131 - DNA, 75 bp, Artificial Sequence
  Synthetic
tggcggaggtggggcggctgcggtgaccggatagctgtagtagctgtatggctggtctgcaaactctggaacggg

SEQ ID NO: 179132 - DNA, 75 bp, Artificial Sequence
  Synthetic
cgctctgtccatggtgtgaccagcgttgctgaagagtactgtgtttcaggtcgcgaagctcggactgaatctccg

SEQ ID NO: 179133 - DNA, 75 bp, Artificial Sequence
  Synthetic
ttgctgaagagtactgtgtttcaggtcgcgaagctcggactgaatctccgcaatacttttagacatggtgatgat

SEQ ID NO: 179134 - DNA, 75 bp, Artificial Sequence
  Synthetic
cgtcgtcgtcgcgttttcgtttgcctggacgggacacgggcacagcagacgggcactggtagtaggttccctcta

SEQ ID NO: 179135 - DNA, 75 bp, Artificial Sequence
  Synthetic
tggacgggacacgggcacagcagacgggcactggtagtaggttccctctacgtggggtctgcaagggtataggta

SEQ ID NO: 179136 - DNA, 75 bp, Artificial Sequence
  Synthetic
cagcgtatcctgggaatccggacattgacaggttgggcgcgaacctggcagcggtctgcttcatgccgtccaggc

SEQ ID NO: 179137 - DNA, 75 bp, Artificial Sequence
  Synthetic
tgacaggttgggcgcgaacctggcagcggtctgcttcatgccgtccaggctgctctgcagcatgctgaggaaggt

SEQ ID NO: 179138 - DNA, 75 bp, Artificial Sequence
  Synthetic
ccacggagggcaaagtgtcctgcgtgtaattaggtgtttggctggcctttaaatacgctttgcctgacacgttgg

SEQ ID NO: 179139 - DNA, 75 bp, Artificial Sequence
  Synthetic
gtaattaggtgtttggctggcctttaaatacgctttgcctgacacgttggccactccccggtctgtgcgcaacag

SEQ ID NO: 179140 - DNA, 75 bp, Artificial Sequence
  Synthetic
attccaggggggcatgaaaggcgggagttgggagtttcgttgccgggtactcacagaaactttttagtatctgtt

SEQ ID NO: 179141 - DNA, 75 bp, Artificial Sequence
  Synthetic
agttgggagtttcgttgccgggtactcacagaaactttttagtatctgttctttttcgggtgctgacagcgacga

SEQ ID NO: 179142 - DNA, 75 bp, Artificial Sequence
  Synthetic
cgcggcgacggcccagcgcgcacagcgatacgtgttgaaacaccgcggtgtccggttcgcgttccaactcgtttg

SEQ ID NO: 179143 - DNA, 75 bp, Artificial Sequence
  Synthetic
cgatacgtgttgaaacaccgcggtgtccggttcgcgttccaactcgtttgggtggagagatgacagggacaggcc

SEQ ID NO: 179144 - DNA, 75 bp, Artificial Sequence
  Synthetic
tgacgggcgcggcggctacgtgggaacaatcggccagactggtggcgagggttataaatgattctgaggttatca

SEQ ID NO: 179145 - DNA, 75 bp, Artificial Sequence
  Synthetic
acaatcggccagactggtggcgagggttataaatgattctgaggttatcaagccaccacaaaaaattccgtgcga

SEQ ID NO: 179146 - DNA, 75 bp, Artificial Sequence
  Synthetic
ctatggtgagtgggaggggatcggtgactggaagaaacgatgaaacttgtttagggtctagatacagctctcgct

SEQ ID NO: 179147 - DNA, 75 bp, Artificial Sequence
  Synthetic
gactggaagaaacgatgaaacttgtttagggtctagatacagctctcgctgtaattttggacaagctatcacgtc

SEQ ID NO: 179148 - DNA, 75 bp, Artificial Sequence
  Synthetic
gcgagtctccctccttgacccctgggttgagaaagttgttgtggcgatgtctgcacggaaaaaatttaaatacct

SEQ ID NO: 179149 - DNA, 75 bp, Artificial Sequence
  Synthetic
gttgagaaagttgttgtggcgatgtctgcacggaaaaaatttaaatacctttcatccccaagaactcaggtttct

SEQ ID NO: 179150 - DNA, 75 bp, Artificial Sequence
  Synthetic
tgcgagaagccgttgcttgcgccgggacccacgatactgcggttctggcgagaaaggtccccgtggagatgtgga

SEQ ID NO: 179151 - DNA, 75 bp, Artificial Sequence
  Synthetic
gacccacgatactgcggttctggcgagaaaggtccccgtggagatgtggaagctagtctatgatggccttttggc

SEQ ID NO: 179152 - DNA, 75 bp, Artificial Sequence
  Synthetic
tgtggcttcatcttcatgaccacgggaagcttcttaaaggtcttgcggattttctgttcaggcggctcggggtga

SEQ ID NO: 179153 - DNA, 75 bp, Artificial Sequence
  Synthetic
gaagcttcttaaaggtcttgcggattttctgttcaggcggctcggggtgacgcacagcgttaaaattgctccaga

SEQ ID NO: 179154 - DNA, 75 bp, Artificial Sequence
  Synthetic
gtcgtatgttgttggtgctggggtattgtcttcatttttggggacgtgcggaccacgagccgtgggtcaggtttt

SEQ ID NO: 179155 - DNA, 75 bp, Artificial Sequence
  Synthetic
ttgtcttcatttttggggacgtgcggaccacgagccgtgggtcaggttttttgcgggcaaggtgtttgttacgta

SEQ ID NO: 179156 - DNA, 75 bp, Artificial Sequence
  Synthetic
ccagtgaaaccggctacacgggccccgtggaggcggtgtgtcaagatatctcggcgatgcacggcattgtggccc

SEQ ID NO: 179157 - DNA, 75 bp, Artificial Sequence
  Synthetic
cgtggaggcggtgtgtcaagatatctcggcgatgcacggcattgtggccctctcggacgaccttgtcgccccagg

SEQ ID NO: 179158 - DNA, 75 bp, Artificial Sequence
  Synthetic
cgaccgcaagagccactggaaggcatcccaataccacaaagtatgctctgtcgtagtcgtcgagtcccccgaatt

SEQ ID NO: 179159 - DNA, 75 bp, Artificial Sequence
  Synthetic
tcccaataccacaaagtatgctctgtcgtagtcgtcgagtcccccgaattgagtttttacaatatcttgtaggaa

SEQ ID NO: 179160 - DNA, 75 bp, Artificial Sequence
  Synthetic
ccaatcgaagggccgtacgcgcttgaaggagagccatgggatcttggaacgtcaattgttgattaatgacgtcga

SEQ ID NO: 179161 - DNA, 75 bp, Artificial Sequence
  Synthetic
aaggagagccatgggatcttggaacgtcaattgttgattaatgacgtcgaatatttcattaaatctgcttcctgt

SEQ ID NO: 179162 - DNA, 75 bp, Artificial Sequence
  Synthetic
cgagagccgccagcacaatcccgggaaacaaaaaagacatggtagcgtgtggggcattcgttaggatcggcgtca

SEQ ID NO: 179163 - DNA, 75 bp, Artificial Sequence
  Synthetic
aaacaaaaaagacatggtagcgtgtggggcattcgttaggatcggcgtcacgtatgatttgcagatgaacccaaa

SEQ ID NO: 179164 - DNA, 75 bp, Artificial Sequence
  Synthetic
atgctagtttggatccaaggagcgcaattagatcaagccgtctgtgtgtgcgtgtgggagttacttgtgcgaatt

SEQ ID NO: 179165 - DNA, 75 bp, Artificial Sequence
  Synthetic
aattagatcaagccgtctgtgtgtgcgtgtgggagttacttgtgcgaattcgagtaggaggtaaaccatgattag

SEQ ID NO: 179166 - DNA, 75 bp, Artificial Sequence
  Synthetic
acgggggaatatcttcgccaaaaacgcgggctgtaatggcgtatgttaaatcgaccgccggtcctgtgccgggaa

SEQ ID NO: 179167 - DNA, 75 bp, Artificial Sequence
  Synthetic
gcgggctgtaatggcgtatgttaaatcgaccgccggtcctgtgccgggaaccaacgtttggcgtgtgttggcaaa

SEQ ID NO: 179168 - DNA, 75 bp, Artificial Sequence
  Synthetic
ccgaagggtagcgactctccctgttcaacggggcgagagatgttcgctcctgtgggttggcgtacgtgaagttga

SEQ ID NO: 179169 - DNA, 75 bp, Artificial Sequence
  Synthetic
caacggggcgagagatgttcgctcctgtgggttggcgtacgtgaagttgaatcgtccacccactggttcgtgctt

SEQ ID NO: 179170 - DNA, 75 bp, Artificial Sequence
  Synthetic
cttccatggtggttgggggtggtgctgaagtgcgctggctgtaatatgcgtttatgaggcacagggctgcctgcg

SEQ ID NO: 179171 - DNA, 75 bp, Artificial Sequence
  Synthetic
tgaagtgcgctggctgtaatatgcgtttatgaggcacagggctgcctgcgtgtctgtgaggtggcggggatcgct

SEQ ID NO: 179172 - DNA, 75 bp, Artificial Sequence
  Synthetic
gtttcagagaggttgaattttgaaagttgacggtgcctcgaagttcccgcgggaaaactcggcgttgcattgcgt

SEQ ID NO: 179173 - DNA, 75 bp, Artificial Sequence
  Synthetic
gttgacggtgcctcgaagttcccgcgggaaaactcggcgttgcattgcgttttctgttaattgaataaaccaggg

SEQ ID NO: 179174 - DNA, 75 bp, Artificial Sequence
  Synthetic
gttctgctcggatgtccgcatccgttgagaattgaggatcgcccggaacgatcgcaatggtagttaccctaggcg

SEQ ID NO: 179175 - DNA, 75 bp, Artificial Sequence
  Synthetic
tgagaattgaggatcgcccggaacgatcgcaatggtagttaccctaggcgaggaacctgaggttggtgctgattt

SEQ ID NO: 179176 - DNA, 75 bp, Artificial Sequence
  Synthetic
ggcttattgcggcctctacagcctgaagatcggcgtctataatttgcgctttggtcgcttggtctcgtacgaggt

SEQ ID NO: 179177 - DNA, 75 bp, Artificial Sequence
  Synthetic
aagatcggcgtctataatttgcgctttggtcgcttggtctcgtacgaggttgtccagttctatggcaagcagtct

SEQ ID NO: 179178 - DNA, 75 bp, Artificial Sequence
  Synthetic
gtgcgattcgctttgcttctacgagagccggtttgtatacgaacagcacgttttctgggtggggtgtccagaatc

SEQ ID NO: 179179 - DNA, 75 bp, Artificial Sequence
  Synthetic
agccggtttgtatacgaacagcacgttttctgggtggggtgtccagaatcgaccgaccgcggaccacgggggtcg

SEQ ID NO: 179180 - DNA, 75 bp, Artificial Sequence
  Synthetic
tgcagaaaagcggtgagtttgtttgcagctgtacgcaccgcaagcgacccagtgggcggagtttcgagttgcatt

SEQ ID NO: 179181 - DNA, 75 bp, Artificial Sequence
  Synthetic
cagctgtacgcaccgcaagcgacccagtgggcggagtttcgagttgcattgtttttagggttttttgattcttaa

SEQ ID NO: 179182 - DNA, 75 bp, Artificial Sequence
  Synthetic
tgtgacaggtatcttacggagtcggcgagctggcacaagccttgggttctctgggaggctctcacggtgtcgttg

SEQ ID NO: 179183 - DNA, 75 bp, Artificial Sequence
  Synthetic
cgagctggcacaagccttgggttctctgggaggctctcacggtgtcgttgaacataatactgttgctcatgcaag

SEQ ID NO: 179184 - DNA, 75 bp, Artificial Sequence
  Synthetic
atgatacagtctgctatgcgttgacctagagtcacctcaaaaaaaattttgtggggccccgggggagggctctcg

SEQ ID NO: 179185 - DNA, 75 bp, Artificial Sequence
  Synthetic
ctagagtcacctcaaaaaaaattttgtggggccccgggggagggctctcggtttcgagagagagaaagtgtagga

SEQ ID NO: 179186 - DNA, 75 bp, Artificial Sequence
  Synthetic
aataaaactaaacagttccattctccgggcttgcggacagacacagttttatgcaactactctctcttgcctttc

SEQ ID NO: 179187 - DNA, 75 bp, Artificial Sequence
  Synthetic
gctcgagctccggcttgttttctggcggcggggagtcctcgtaaaagtttttttgcttggcattccgtagccgtt

SEQ ID NO: 179188 - DNA, 75 bp, Artificial Sequence
  Synthetic
gaggagtacccccacgtactggggccagtggggttgtcatctccagatgaatacagggcaaaagtcgccggcagg

SEQ ID NO: 179189 - DNA, 75 bp, Artificial Sequence
  Synthetic
cggcggggagtcctcgtaaaagtttttttgcttggcattccgtagccgttgtcatggcggagcgggggttcgagt

SEQ ID NO: 179190 - DNA, 75 bp, Artificial Sequence
  Synthetic
tgggatggtgtaagttttgaggcggacgatctgtctctggccagccttaccctatctgagcgggctcgagaagcc

SEQ ID NO: 179191 - DNA, 75 bp, Artificial Sequence
  Synthetic
acgatctgtctctggccagccttaccctatctgagcgggctcgagaagccaacgggatctaccttcctatggatt

SEQ ID NO: 179192 - DNA, 75 bp, Artificial Sequence
  Synthetic
tggcgcgttcttagaaatgcccctgtttatgacactcctagatatccgcctagagcggtggcatcgtgttccgat

SEQ ID NO: 179193 - DNA, 75 bp, Artificial Sequence
  Synthetic
tttatgacactcctagatatccgcctagagcggtggcatcgtgttccgatgccccgtgtgacacaatgaaccagt

SEQ ID NO: 179194 - DNA, 75 bp, Artificial Sequence
  Synthetic
gctaggccgccgctaccaaagaacccccctccttcgcgaaaccgggtggttgaaccccctaatgaagatgttgga

SEQ ID NO: 179195 - DNA, 75 bp, Artificial Sequence
  Synthetic
cccctccttcgcgaaaccgggtggttgaaccccctaatgaagatgttggacggaccgacctgcacagcatgcgcc

SEQ ID NO: 179196 - DNA, 75 bp, Artificial Sequence
  Synthetic
acgcagggcggccaagcatcggatcgtcgagaggcttttgcgctcagtcctggcggagggcgggggactattggc

SEQ ID NO: 179197 - DNA, 75 bp, Artificial Sequence
  Synthetic
gtcgagaggcttttgcgctcagtcctggcggagggcgggggactattggcagtaatatacgatcgttgtttgggt

SEQ ID NO: 179198 - DNA, 75 bp, Artificial Sequence
  Synthetic
cccctgcatttaattcgccctgcagtggcggtggactataggaatgcgtactttgtgtatcttgaggggccaatg

SEQ ID NO: 179199 - DNA, 75 bp, Artificial Sequence
  Synthetic
tggcggtggactataggaatgcgtactttgtgtatcttgaggggccaatgggcgttggaaagacaacgctaatca

SEQ ID NO: 179200 - DNA, 75 bp, Artificial Sequence
  Synthetic
cctatgaattactggactcaggtgtttacggattgtcatcgggatatatacactgttattaggactggcaaggca

SEQ ID NO: 179201 - DNA, 75 bp, Artificial Sequence
  Synthetic
ttacggattgtcatcgggatatatacactgttattaggactggcaaggcaggcgaccccgggacgtcggcccgta

SEQ ID NO: 179202 - DNA, 75 bp, Artificial Sequence
  Synthetic
aaaacgtggctgatgctctggccacgttgggagtgtgcactagcagaaaactgtctccagaagagcatttttccc

SEQ ID NO: 179203 - DNA, 75 bp, Artificial Sequence
  Synthetic
gccgttcgcaggatggtgcagccctggcgtgttggtggggaagcgacccgtgggacgcattggtgtctcagcgac

SEQ ID NO: 179204 - DNA, 75 bp, Artificial Sequence
  Synthetic
ggcgtgttggtggggaagcgacccgtgggacgcattggtgtctcagcgaccggcacttgttgtcgccgacggtgg

SEQ ID NO: 179205 - DNA, 75 bp, Artificial Sequence
  Synthetic
tttcagttaattgcaagctttcgcgctatggagggggacatcgtaacaattgttgcccttcgcagcgccgaaacg

SEQ ID NO: 179206 - DNA, 75 bp, Artificial Sequence
  Synthetic
ctatggagggggacatcgtaacaattgttgcccttcgcagcgccgaaacgttgcgacggttgaaggccaggggtc

SEQ ID NO: 179207 - DNA, 75 bp, Artificial Sequence
  Synthetic
gcttaccatgctgtgtactgtacctggattatgttacagtatattactgttgagcagatggtacagttatgcgtg

SEQ ID NO: 179208 - DNA, 75 bp, Artificial Sequence
  Synthetic
ggattatgttacagtatattactgttgagcagatggtacagttatgcgtgcagaccacaaacgtgcctgaaattt

SEQ ID NO: 179209 - DNA, 75 bp, Artificial Sequence
  Synthetic
cacgagcagagtatgattccactgattgccgggattttgcatcccgtgcgacaccatcctgtgatcattgaactc

SEQ ID NO: 179210 - DNA, 75 bp, Artificial Sequence
  Synthetic
ttgccgggattttgcatcccgtgcgacaccatcctgtgatcattgaactctgctttggcttcttccacgagttat

SEQ ID NO: 179211 - DNA, 75 bp, Artificial Sequence
  Synthetic
tgtggtatgtggtctgatatctacaggcagatcctgtccaatccggctattaaacctcgggcggtgaactggtcc

SEQ ID NO: 179212 - DNA, 75 bp, Artificial Sequence
  Synthetic
ggcagatcctgtccaatccggctattaaacctcgggcggtgaactggtccgcgttggaaagccacgccaaggcgc

SEQ ID NO: 179213 - DNA, 75 bp, Artificial Sequence
  Synthetic
tgtttattttgggatgtcagggagaacaaaacgccaccaacctaccctatgaaaacctttcagtggccttggaat

SEQ ID NO: 179214 - DNA, 75 bp, Artificial Sequence
  Synthetic
acaaaacgccaccaacctaccctatgaaaacctttcagtggccttggaatacaacgggacatgtttctcgttgaa

SEQ ID NO: 179215 - DNA, 75 bp, Artificial Sequence
  Synthetic
ggaagacggcgcgtgtggtggaagggcttggggtaacgctgcaaaaaaaggaaaacctgtggcgtgtatcgggta

SEQ ID NO: 179216 - DNA, 75 bp, Artificial Sequence
  Synthetic
gcttggggtaacgctgcaaaaaaaggaaaacctgtggcgtgtatcgggtactcaaagtcctctttcagggggtaa

SEQ ID NO: 179217 - DNA, 75 bp, Artificial Sequence
  Synthetic
cagccgattttaactacagtgcgctgcctggctacctgggagattttggcgtggcctccgatgggttgctttcca

SEQ ID NO: 179218 - DNA, 75 bp, Artificial Sequence
  Synthetic
gcctggctacctgggagattttggcgtggcctccgatgggttgctttccaacgtgtttacctcggcgtggacagt

SEQ ID NO: 179219 - DNA, 75 bp, Artificial Sequence
  Synthetic
cagcgctcaggatgttcgctgcccttggcaacgaggcgcccgggacgcgattggtcggatatgtctctagcgagc

SEQ ID NO: 179220 - DNA, 75 bp, Artificial Sequence
  Synthetic
tggcaacgaggcgcccgggacgcgattggtcggatatgtctctagcgagctggtcctggtgacgttggtgaacca

SEQ ID NO: 179221 - DNA, 75 bp, Artificial Sequence
  Synthetic
gggcccttccgtccctcgccggttaccttacttatggtgaagtcaccgtagcgttagatgccaactacagtttgg

SEQ ID NO: 179222 - DNA, 75 bp, Artificial Sequence
  Synthetic
ccttacttatggtgaagtcaccgtagcgttagatgccaactacagtttggtagccattgtgcccgcaagcgcgtt

SEQ ID NO: 179223 - DNA, 75 bp, Artificial Sequence
  Synthetic
ccgatgctgatgactttattcgggcaacggtgggaaggatgtttgggctggagtctatgcggcagtgtgccagtc

SEQ ID NO: 179224 - DNA, 75 bp, Artificial Sequence
  Synthetic
aacggtgggaaggatgtttgggctggagtctatgcggcagtgtgccagtccggcggccgcctggcataacctggc

SEQ ID NO: 179225 - DNA, 75 bp, Artificial Sequence
  Synthetic
gcgaacaggccttcgtgaacgcgacttgtgtttgtcgccaggtggcggacttagatttgctcacccgcctcttag

SEQ ID NO: 179226 - DNA, 75 bp, Artificial Sequence
  Synthetic
acttctcacgcctcagggctcaccggggtttgaggaaccgaaacccgcaggactcacaacggggctgtacctaac

SEQ ID NO: 179227 - DNA, 75 bp, Artificial Sequence
  Synthetic
ttgtgtttgtcgccaggtggcggacttagatttgctcacccgcctcttaggtctctgttatcctacactctctgt

SEQ ID NO: 179228 - DNA, 75 bp, Artificial Sequence
  Synthetic
gcagtctcccagcaggcgcacttgcgaccttgtcccttgcgcatcaggagaccgttttagatatgtttgcactgg

SEQ ID NO: 179229 - DNA, 75 bp, Artificial Sequence
  Synthetic
gaccttgtcccttgcgcatcaggagaccgttttagatatgtttgcactgggtgttcgtgacggtgacctgccggc

SEQ ID NO: 179230 - DNA, 75 bp, Artificial Sequence
  Synthetic
gatcttcctctaaggcccccaccaaacctggtgaggaagcatctggtcctaagagtgtggacttttaccagttca

SEQ ID NO: 179231 - DNA, 75 bp, Artificial Sequence
  Synthetic
acagctacgtgtatgttttggaggaggcagaccgcaggctcctattggacatctatgctatactgaccgccaacc

SEQ ID NO: 179232 - DNA, 75 bp, Artificial Sequence
  Synthetic
ggcagaccgcaggctcctattggacatctatgctatactgaccgccaaccagagtcgcctgcatgaggtctctga

SEQ ID NO: 179233 - DNA, 75 bp, Artificial Sequence
  Synthetic
tagaaatcgcagagatggtgtcacgctttgccagcccgcacgcgaggaacctctatgcatttttttccccgtgct

SEQ ID NO: 179234 - DNA, 75 bp, Artificial Sequence
  Synthetic
ctttgccagcccgcacgcgaggaacctctatgcatttttttccccgtgctttcttgcccttcggtatgacttaac

SEQ ID NO: 179235 - DNA, 75 bp, Artificial Sequence
  Synthetic
tggatctggcgctggggacatctggattttgggagcttctccacgatctacaccttggtagctcggctgccctgc

SEQ ID NO: 179236 - DNA, 75 bp, Artificial Sequence
  Synthetic
attttgggagcttctccacgatctacaccttggtagctcggctgccctgcccgcggttaactgcactcggattgc

SEQ ID NO: 179237 - DNA, 75 bp, Artificial Sequence
  Synthetic
ttagtcccggccctttaccggatgcccgggtttatgaaatctccgagatttttctaaagagtgccatgttcattt

SEQ ID NO: 179238 - DNA, 75 bp, Artificial Sequence
  Synthetic
ccgggtttatgaaatctccgagatttttctaaagagtgccatgttcatttcggcactaaaacctaattgctctaa

SEQ ID NO: 179239 - DNA, 75 bp, Artificial Sequence
  Synthetic
ccgcgccgcggagtggttgtcctctgtgccattcggtgatcctgagctacgatgaacgtcagggcctccagtctc

SEQ ID NO: 179240 - DNA, 75 bp, Artificial Sequence
  Synthetic
gtgccattcggtgatcctgagctacgatgaacgtcagggcctccagtctcttatgtatatcactaacgctgtggt

SEQ ID NO: 179241 - DNA, 75 bp, Artificial Sequence
  Synthetic
tgcacgtgcactatctttggcttatggacaacggtacggtggtggaggttagggggttgtacagaagacgcgcag

SEQ ID NO: 179242 - DNA, 75 bp, Artificial Sequence
  Synthetic
ggacaacggtacggtggtggaggttagggggttgtacagaagacgcgcagtcagtgtgctgtatatgttgctttt

SEQ ID NO: 179243 - DNA, 75 bp, Artificial Sequence
  Synthetic
tgctcgtctaaatggtcaataaagagtagatcttcaacaggcttcctgtgcattcttttcgaattggcatatgcc

SEQ ID NO: 179244 - DNA, 75 bp, Artificial Sequence
  Synthetic
gtagatcttcaacaggcttcctgtgcattcttttcgaattggcatatgccgcgataacattccgagaacctcaaa

SEQ ID NO: 179245 - DNA, 75 bp, Artificial Sequence
  Synthetic
cggcgctctttcggtccttgggtgtgcacatgagaaaatacttttccatggccttctggaggcttggtgagcaca

SEQ ID NO: 179246 - DNA, 75 bp, Artificial Sequence
  Synthetic
gcacatgagaaaatacttttccatggccttctggaggcttggtgagcacagtggcgccgtggtgatgggctctgg

SEQ ID NO: 179247 - DNA, 75 bp, Artificial Sequence
  Synthetic
gacgtttgactctcccaaccatctccttaaagtattctatctggtgaggttgaacgggggcggcgtcggttccgt

SEQ ID NO: 179248 - DNA, 75 bp, Artificial Sequence
  Synthetic
cttaaagtattctatctggtgaggttgaacgggggcggcgtcggttccgtagatagattcaaagcagggaagtac

SEQ ID NO: 179249 - DNA, 75 bp, Artificial Sequence
  Synthetic
ggattcgcgtgagcttcaggtgaggtaagtagatgatactgttgttcgctcgttccattatagttacagtgttaa

SEQ ID NO: 179250 - DNA, 75 bp, Artificial Sequence
  Synthetic
taagtagatgatactgttgttcgctcgttccattatagttacagtgttaaacgccccaactggacagtgccccaa

SEQ ID NO: 179251 - DNA, 75 bp, Artificial Sequence
  Synthetic
tgataacgcgtgcggcgggctcatctgcggtggcgtattttaagatggatttagggtggccgggcatttgtgagg

SEQ ID NO: 179252 - DNA, 75 bp, Artificial Sequence
  Synthetic
tgcggtggcgtattttaagatggatttagggtggccgggcatttgtgaggcagatgtgtttggatggcctggcgt

SEQ ID NO: 179253 - DNA, 75 bp, Artificial Sequence
  Synthetic
tagctttctcgtcgatgcatagtcgtctcccctgtgcgtccgttcgtatttttggcgctgcgggtttcaaatgca

SEQ ID NO: 179254 - DNA, 75 bp, Artificial Sequence
  Synthetic
tctcccctgtgcgtccgttcgtatttttggcgctgcgggtttcaaatgcacctccttaaaatcagcgtaggtgtc

SEQ ID NO: 179255 - DNA, 75 bp, Artificial Sequence
  Synthetic
aatcggagctacagaccactggggtggcatacagtgtaacgcccgctgaggcgtctgttttgccgacgcacaggt

SEQ ID NO: 179256 - DNA, 75 bp, Artificial Sequence
  Synthetic
ggcatacagtgtaacgcccgctgaggcgtctgttttgccgacgcacaggtgactgttgagcgcgtatgggtgtgg

SEQ ID NO: 179257 - DNA, 75 bp, Artificial Sequence
  Synthetic
gtgataggctaccacccgaccgcctgttgaatttgtgaaacagcatggggaccggtacctcttgtccggcgagtc

SEQ ID NO: 179258 - DNA, 75 bp, Artificial Sequence
  Synthetic
gttgaatttgtgaaacagcatggggaccggtacctcttgtccggcgagtcccaccatggcagcggcagccggcga

SEQ ID NO: 179259 - DNA, 75 bp, Artificial Sequence
  Synthetic
cgtcgaggcgcgcacgcgcgtctgggatgctcagggtttgcatctcgaaggcgaatcgggtgcggattaagtgct

SEQ ID NO: 179260 - DNA, 75 bp, Artificial Sequence
  Synthetic
gatgctcagggtttgcatctcgaaggcgaatcgggtgcggattaagtgcttcgtgggttgtgcttccgaataccc

SEQ ID NO: 179261 - DNA, 75 bp, Artificial Sequence
  Synthetic
gccgcggcgtcggaacgcgtgtctaacgataagtggtttcagagaggcgcagttgtgtccggtagtttccacaaa

SEQ ID NO: 179262 - DNA, 75 bp, Artificial Sequence
  Synthetic
acgataagtggtttcagagaggcgcagttgtgtccggtagtttccacaaagcatgcaaagttggcgttgcgaccc

SEQ ID NO: 179263 - DNA, 75 bp, Artificial Sequence
  Synthetic
gttacactttttatatcccaaaagggcacattcgtgcttgctcttggtgtgactgattattttctttgaaaagtc

SEQ ID NO: 179264 - DNA, 75 bp, Artificial Sequence
  Synthetic
gcacattcgtgcttgctcttggtgtgactgattattttctttgaaaagtcaaatagcccactggatactgctcgg

SEQ ID NO: 179265 - DNA, 75 bp, Artificial Sequence
  Synthetic
ttctaaaaatctcttatggagcgtttgtatctgtgacctgttgcgtgcctccagtagagaaaagatgcgattctt

SEQ ID NO: 179266 - DNA, 75 bp, Artificial Sequence
  Synthetic
tgtatctgtgacctgttgcgtgcctccagtagagaaaagatgcgattctttgtaatgtctatccgcgcgctggga

SEQ ID NO: 179267 - DNA, 75 bp, Artificial Sequence
  Synthetic
tccataaacctttgatactgtggcggtagcggccttaaaccacgagacgtttaggccttccttgcttgataccac

SEQ ID NO: 179268 - DNA, 75 bp, Artificial Sequence
  Synthetic
gtagcggccttaaaccacgagacgtttaggccttccttgcttgataccaccgacggaaaattggtggtccaaaat

SEQ ID NO: 179269 - DNA, 75 bp, Artificial Sequence
  Synthetic
gtctaaagtagagttccaatttgcaacggaaacgggaaagatgtgactgatgggtagaaagcatttgagagtgcc

SEQ ID NO: 179270 - DNA, 75 bp, Artificial Sequence
  Synthetic
acggaaacgggaaagatgtgactgatgggtagaaagcatttgagagtgcccatggcgaaaaaaaagtgtagtagg

SEQ ID NO: 179271 - DNA, 75 bp, Artificial Sequence
  Synthetic
gaagaagacgctaatggtgaatgagggttcttttacggaatactttctgatcacaaagttattagtaagacgagg

SEQ ID NO: 179272 - DNA, 75 bp, Artificial Sequence
  Synthetic
ggttcttttacggaatactttctgatcacaaagttattagtaagacgaggcacgttgaggatagttggttgcaat

SEQ ID NO: 179273 - DNA, 75 bp, Artificial Sequence
  Synthetic
gaatattgttgttttgaagttctctaggctcaggtgttttgtaggttcaaacatgtcttccgtcataactgcttg

SEQ ID NO: 179274 - DNA, 75 bp, Artificial Sequence
  Synthetic
aggctcaggtgttttgtaggttcaaacatgtcttccgtcataactgcttgtcccatcgatggggcacaaggctgg

SEQ ID NO: 179275 - DNA, 75 bp, Artificial Sequence
  Synthetic
tttgggggcgtatcggatccgttccagcatggcagctagtaggcgcggcctttcgttggatgctaaaaaattagc

SEQ ID NO: 179276 - DNA, 75 bp, Artificial Sequence
  Synthetic
agcatggcagctagtaggcgcggcctttcgttggatgctaaaaaattagcccctggatagagattctcgtggctg

SEQ ID NO: 179277 - DNA, 75 bp, Artificial Sequence
  Synthetic
tggagatgttggatacaccagatagtattgtccctcggtggtgttcacgacgactttgtggcttttggatcctgg

SEQ ID NO: 179278 - DNA, 75 bp, Artificial Sequence
  Synthetic
tattgtccctcggtggtgttcacgacgactttgtggcttttggatcctgggtccttgcgcaaaatttttacctgc

SEQ ID NO: 179279 - DNA, 75 bp, Artificial Sequence
  Synthetic
tgatgacacgttaatttcctggtgcttgttttgtttagataggtttttcaatacgttcggatacttctcgatgtt

SEQ ID NO: 179280 - DNA, 75 bp, Artificial Sequence
  Synthetic
ttgttttgtttagataggtttttcaatacgttcggatacttctcgatgttccgtgcgatgataagtcgcaattcg

SEQ ID NO: 179281 - DNA, 75 bp, Artificial Sequence
  Synthetic
tttgagaaagttgaagtgagactctggttgcggttggggaaggagggagaatgacaggtgtgtcagaagttctac

SEQ ID NO: 179282 - DNA, 75 bp, Artificial Sequence
  Synthetic
ggttgcggttggggaaggagggagaatgacaggtgtgtcagaagttctaccagtgcaaagtaatgtttctggcac

SEQ ID NO: 179283 - DNA, 75 bp, Artificial Sequence
  Synthetic
ttcaaagtcccaaaattcaagatatctgcagattaatttgaacatcgttggatagcatacggtcccggataacat

SEQ ID NO: 179284 - DNA, 75 bp, Artificial Sequence
  Synthetic
ctgcagattaatttgaacatcgttggatagcatacggtcccggataacatggcaccgcagaaaacggagcgaatg

SEQ ID NO: 179285 - DNA, 75 bp, Artificial Sequence
  Synthetic
tggtcgcgcaaaggtgggaaactactgtgttattgactcggtcctggttatggatcttctgctacggtttcagac

SEQ ID NO: 179286 - DNA, 75 bp, Artificial Sequence
  Synthetic
aactgctggcaagtacatattggttgttatcattccgcagacgaacccgtcatcgccgctcattattaaacccgg

SEQ ID NO: 179287 - DNA, 75 bp, Artificial Sequence
  Synthetic
gttatcattccgcagacgaacccgtcatcgccgctcattattaaacccggacccttgtagtgaggtcctggtttt

SEQ ID NO: 179288 - DNA, 75 bp, Artificial Sequence
  Synthetic
tagaagcctccgcactgctctgcatgcaaaaaaggtaggctctgtccgcatgtgattatcgagatctgtcagcgt

SEQ ID NO: 179289 - DNA, 75 bp, Artificial Sequence
  Synthetic
gcaaaaaaggtaggctctgtccgcatgtgattatcgagatctgtcagcgtcaacggtgaaggcggacagaagttt

SEQ ID NO: 179290 - DNA, 75 bp, Artificial Sequence
  Synthetic
cccgcctgtgtgccgcgtgatttccaacgcttgacattccggcagtaaaacagtgggttctgattgtgtaggcat

SEQ ID NO: 179291 - DNA, 75 bp, Artificial Sequence
  Synthetic
aacgcttgacattccggcagtaaaacagtgggttctgattgtgtaggcatggaagccgcgttggagcaaagaccc

SEQ ID NO: 179292 - DNA, 75 bp, Artificial Sequence
  Synthetic
ggcggccgatggtctcttcaagagcttcgagctgcttctcggcaaggatgccagagaaggcggtgttaagtttga

SEQ ID NO: 179293 - DNA, 75 bp, Artificial Sequence
  Synthetic
ttcgagctgcttctcggcaaggatgccagagaaggcggtgttaagtttgaagtgctgctcggcgtctacaccaat

SEQ ID NO: 179294 - DNA, 75 bp, Artificial Sequence
  Synthetic
caatacagaattccgtgacctgcgcaggatgacagatggtaagattcagtttaagatctctgttcccacaattgc

SEQ ID NO: 179295 - DNA, 75 bp, Artificial Sequence
  Synthetic
tggtaatgcttccggaaataccacctgagtaccccattggtttataccttgtttaattgtagaattacagctgga

SEQ ID NO: 179296 - DNA, 75 bp, Artificial Sequence
  Synthetic
aggatgacagatggtaagattcagtttaagatctctgttcccacaattgcatatggagacggacgcagacctaac

SEQ ID NO: 179297 - DNA, 75 bp, Artificial Sequence
  Synthetic
tgctgaaatagaactcgccactgctgacattgaactgctattttctgagaaagagacgccgctcgacttcacgga

SEQ ID NO: 179298 - DNA, 75 bp, Artificial Sequence
  Synthetic
gacattgaactgctattttctgagaaagagacgccgctcgacttcacggaatatgctggggcggtgaagacaatc

SEQ ID NO: 179299 - DNA, 75 bp, Artificial Sequence
  Synthetic
gtgggccaatcagcttgggagttctagggataggggccaatgggaggcctccgaatttgattgacggctggggcg

SEQ ID NO: 179300 - DNA, 75 bp, Artificial Sequence
  Synthetic
cactgtattgaatgtgaagctgagacacgcaccgcctattttcatactgaagacgctaggggacccggtgtattc

SEQ ID NO: 179301 - DNA, 75 bp, Artificial Sequence
  Synthetic
cacgcaccgcctattttcatactgaagacgctaggggacccggtgtattctgagcgtggcctgaagaaagcggtg

SEQ ID NO: 179302 - DNA, 75 bp, Artificial Sequence
  Synthetic
ttgattgacgggccggcggaccaatgggagcggggcagaggattatgggggattagcaaattcaagatggcggcg

SEQ ID NO: 179303 - DNA, 75 bp, Artificial Sequence
  Synthetic
ttttttggataaggcagacatgatggccagggggaagcagtatgtgctttctatgctttcagatctggttggtgc

SEQ ID NO: 179304 - DNA, 75 bp, Artificial Sequence
  Synthetic
gccagggggaagcagtatgtgctttctatgctttcagatctggttggtgcggtgtgtgccgatactgtttttaaa

SEQ ID NO: 179305 - DNA, 75 bp, Artificial Sequence
  Synthetic
ggagaccacggatagcgtgatgagaaaactgctaaatttactgggtcaggttgagagtggaatgacggggcctgc

SEQ ID NO: 179306 - DNA, 75 bp, Artificial Sequence
  Synthetic
aaactgctaaatttactgggtcaggttgagagtggaatgacggggcctgcggcttatgcgagctacgtggttcgg

SEQ ID NO: 179307 - DNA, 75 bp, Artificial Sequence
  Synthetic
tgaacagtttatggcgcgtatagtggatcgtcccaacgtcccaccgtctgtggatggtgatagagctgccctggc

SEQ ID NO: 179308 - DNA, 75 bp, Artificial Sequence
  Synthetic
gatcgtcccaacgtcccaccgtctgtggatggtgatagagctgccctggccgacggtcacgacgccctgcagagg

SEQ ID NO: 179309 - DNA, 75 bp, Artificial Sequence
  Synthetic
agaaagcttacaacgcatgtataacgaaacgcagttcccctgcccactgaataggcgaattcagtatagctacta

SEQ ID NO: 179310 - DNA, 75 bp, Artificial Sequence
  Synthetic
gaaacgcagttcccctgcccactgaataggcgaattcagtatagctactacttcccagtgggacttcatatgccg

SEQ ID NO: 179311 - DNA, 75 bp, Artificial Sequence
  Synthetic
tcagctgtctacggaaacgtgggtggttaacaagaacaacgttctcctcagctttgggtatcataacgcgctgaa

SEQ ID NO: 179312 - DNA, 75 bp, Artificial Sequence
  Synthetic
gttaacaagaacaacgttctcctcagctttgggtatcataacgcgctgaagtctatctgccacccacggatgcac

SEQ ID NO: 179313 - DNA, 75 bp, Artificial Sequence
  Synthetic
gagggaaaacgcatatgggacggcgtatgaaccaacgccaaatatgaatctcttcagaatatttcatcaatacta

SEQ ID NO: 179314 - DNA, 75 bp, Artificial Sequence
  Synthetic
tatgaaccaacgccaaatatgaatctcttcagaatatttcatcaatactatcagggaaagcaggtggcttttgtg

SEQ ID NO: 179315 - DNA, 75 bp, Artificial Sequence
  Synthetic
tacctcccatcagctcatgcggttagaagttcacccattttttgatttttatgtcagggccaatcccggagaacg

SEQ ID NO: 179316 - DNA, 75 bp, Artificial Sequence
  Synthetic
gaagttcacccattttttgatttttatgtcagggccaatcccggagaacgcgcgtgctatcgtgccacgcaccga

SEQ ID NO: 179317 - DNA, 75 bp, Artificial Sequence
  Synthetic
cacatatgtgttcaagggcggcgatttgcctcccggagcagaggaacccgaaacactacactccgccgaggcacc

SEQ ID NO: 179318 - DNA, 75 bp, Artificial Sequence
  Synthetic
tgccaggggtaaccaatttgaggcggcaacgggtcttgcacacgttatcgatgctacaaccatggaagtttttca

SEQ ID NO: 179319 - DNA, 75 bp, Artificial Sequence
  Synthetic
gcaacgggtcttgcacacgttatcgatgctacaaccatggaagtttttcaggataccgcttttgatcctgcatat

SEQ ID NO: 179320 - DNA, 75 bp, Artificial Sequence
  Synthetic
gacctcctgacattcgagtccattgggtgtgacaacgtggaaggtgaccccgagcaattgacacccaagtacttg

SEQ ID NO: 179321 - DNA, 75 bp, Artificial Sequence
  Synthetic
gtttgtaatgaacgcgcctctcattgccttgacgatccagacgtactgggtcaattctggcaagcttgcatttgt

SEQ ID NO: 179322 - DNA, 75 bp, Artificial Sequence
  Synthetic
gccttgacgatccagacgtactgggtcaattctggcaagcttgcatttgtgaacagcttccatatgattagattt

SEQ ID NO: 179323 - DNA, 75 bp, Artificial Sequence
  Synthetic
acgttcacgcagacgggagaaagactttgcaaagtaaccgtttacaacacccattcgacagcatgcaagaaggcc

SEQ ID NO: 179324 - DNA, 75 bp, Artificial Sequence
  Synthetic
ctacagaaaaatttatggcgaactgcttgcgttagagcaggcgttgctaaaactggccgggcatgaaacggttgg

SEQ ID NO: 179325 - DNA, 75 bp, Artificial Sequence
  Synthetic
cttgcgttagagcaggcgttgctaaaactggccgggcatgaaacggttgggcgcgtacccgttaccgagctagtt

SEQ ID NO: 179326 - DNA, 75 bp, Artificial Sequence
  Synthetic
agcatggtgccaacgccggagactgcgcctttgtcatcatggggctcgcccgtgaaacaaagtttgtctcatttc

SEQ ID NO: 179327 - DNA, 75 bp, Artificial Sequence
  Synthetic
ttttacagatcttctggagaagtcgtaccggcagcccgtcgttcggatcggagaccagaattacgaccacgcggt

SEQ ID NO: 179328 - DNA, 75 bp, Artificial Sequence
  Synthetic
taccggcagcccgtcgttcggatcggagaccagaattacgaccacgcggttgaccgcgccacatatattgatctt

SEQ ID NO: 179329 - DNA, 75 bp, Artificial Sequence
  Synthetic
gagaatcaacgaggaccacgacgagcggcatattctggatgtcgctcccttgaacgagaacgaatatcatccggt

SEQ ID NO: 179330 - DNA, 75 bp, Artificial Sequence
  Synthetic
cggcatattctggatgtcgctcccttgaacgagaacgaatatcatccggttctcgaaaagctattctattttgtg

SEQ ID NO: 179331 - DNA, 75 bp, Artificial Sequence
  Synthetic
tctacgactgcaaggaagagagctggcacgtggggctcttccagatcaaacgcggaccgggaggggtctgtacac

SEQ ID NO: 179332 - DNA, 75 bp, Artificial Sequence
  Synthetic
ccaaaacgtggccctgactctgacatacaacggccccgtgtttgctgatgtggtaaatgcacaggacgatatttt

SEQ ID NO: 179333 - DNA, 75 bp, Artificial Sequence
  Synthetic
tacaacggccccgtgtttgctgatgtggtaaatgcacaggacgatattttgacacatttggagaacggaactttg

SEQ ID NO: 179334 - DNA, 75 bp, Artificial Sequence
  Synthetic
gacagctcgggcgcggcgagcccgtgtgggattccgtcattcacccgagccacatcgtcatctctaatcgagtac

SEQ ID NO: 179335 - DNA, 75 bp, Artificial Sequence
  Synthetic
tatactgtgcacttcgttcttaacttgcccttttgtgacacaggccgcccgggtggtaacccggagggatcccgc

SEQ ID NO: 179336 - DNA, 75 bp, Artificial Sequence
  Synthetic
cacatcgtcatctctaatcgagtacccctcttactaagagaacagcacatatgtctcccttcgtgccccagcgtc

SEQ ID NO: 179337 - DNA, 75 bp, Artificial Sequence
  Synthetic
tttctataattggtgtcaccgcggcagctctagccctggaagatctggaagcttgcttcaagcgaagtagaccca

SEQ ID NO: 179338 - DNA, 75 bp, Artificial Sequence
  Synthetic
tgcccttttgtgacacaggccgcccgggtggtaacccggagggatcccgctcagtcgttgtctacacacgagcgg

SEQ ID NO: 179339 - DNA, 75 bp, Artificial Sequence
  Synthetic
gattgccgatcgctcgcgcgacgcggcggaaacgcttttttacccagtgcccttccataagctgtatggcgaccc

SEQ ID NO: 179340 - DNA, 75 bp, Artificial Sequence
  Synthetic
gcggaaacgcttttttacccagtgcccttccataagctgtatggcgaccccatggtggcggctactctgcaccca

SEQ ID NO: 179341 - DNA, 75 bp, Artificial Sequence
  Synthetic
gttcaatgttccctctaatctcatggccgagtacgaagagtggcacaaatctccaatggccgcatacgtgtcagc

SEQ ID NO: 179342 - DNA, 75 bp, Artificial Sequence
  Synthetic
gccgagtacgaagagtggcacaaatctccaatggccgcatacgtgtcagcgtgtccacccgtacctctgtctctc

SEQ ID NO: 179343 - DNA, 75 bp, Artificial Sequence
  Synthetic
ccagtccaaacacaggattcatcccgggttcgccctgaccgtggtgcgaacggacgaggtgctggctgaaaatat

SEQ ID NO: 179344 - DNA, 75 bp, Artificial Sequence
  Synthetic
gggttcgccctgaccgtggtgcgaacggacgaggtgctggctgaaaatattctctacagcgcccgcgcgtccacc

SEQ ID NO: 179345 - DNA, 75 bp, Artificial Sequence
  Synthetic
tgctgtctcctttgagattacacacgagattgcgtcgttggagaccgccctcgggtactcctcggccatcgcacc

SEQ ID NO: 179346 - DNA, 75 bp, Artificial Sequence
  Synthetic
gagattgcgtcgttggagaccgccctcgggtactcctcggccatcgcacccgcgcacgttgcggcgattacgacg

SEQ ID NO: 179347 - DNA, 75 bp, Artificial Sequence
  Synthetic
gtaccaagaccgccagcttaacgaatatgttcgtgtgaaggcgggtgcgcatggtacgggtcctggggctgcaca

SEQ ID NO: 179348 - DNA, 75 bp, Artificial Sequence
  Synthetic
tatgttcgtgtgaaggcgggtgcgcatggtacgggtcctggggctgcacatcgtcgtgaccccgtggggtatgtt

SEQ ID NO: 179349 - DNA, 75 bp, Artificial Sequence
  Synthetic
agccacctgcgaggtcgtgcccacgccagtcacagctgatgtcgcctactatcagaacccaaatagcccccgtgg

SEQ ID NO: 179350 - DNA, 75 bp, Artificial Sequence
  Synthetic
ccagtcacagctgatgtcgcctactatcagaacccaaatagcccccgtggtcgcgctgcgtgtgtgatctcctgt

SEQ ID NO: 179351 - DNA, 75 bp, Artificial Sequence
  Synthetic
accggatcctgcttatgagtatcgggcaactaacaacccgtgggcctcgcagcgtgggtctctgggagacgttct

SEQ ID NO: 179352 - DNA, 75 bp, Artificial Sequence
  Synthetic
gcaactaacaacccgtgggcctcgcagcgtgggtctctgggagacgttctctacaacaccacgtttcgccaggcc

SEQ ID NO: 179353 - DNA, 75 bp, Artificial Sequence
  Synthetic
attgctttcaaataaaacggtgttctctcaacctcctccgggctcactagtattgtgttcccatacgcgcctgtc

SEQ ID NO: 179354 - DNA, 75 bp, Artificial Sequence
  Synthetic
tattctacggcacaaccgtggtttgttcacgctggtgaacgagtactcggccaggctggcaggggctccggcgac

SEQ ID NO: 179355 - DNA, 75 bp, Artificial Sequence
  Synthetic
ttcacgctggtgaacgagtactcggccaggctggcaggggctccggcgactagtaccacagatctgcagtacgtt

SEQ ID NO: 179356 - DNA, 75 bp, Artificial Sequence
  Synthetic
ggaggcctttccaacgttggcggccagtcacagagccatgctagacgagtacatgtctaacacgcgaacgcatgc

SEQ ID NO: 179357 - DNA, 75 bp, Artificial Sequence
  Synthetic
agtcacagagccatgctagacgagtacatgtctaacacgcgaacgcatgccccggtgcacatgggcaattaccta

SEQ ID NO: 179358 - DNA, 75 bp, Artificial Sequence
  Synthetic
cgcttactagaaaacttctagctctccgctaccaaagcatggcgctcgaccgtagcattattgtaactttaacct

SEQ ID NO: 179359 - DNA, 75 bp, Artificial Sequence
  Synthetic
ccgctaccaaagcatggcgctcgaccgtagcattattgtaactttaacctccaggctgtttgccgacgagctagc

SEQ ID NO: 179360 - DNA, 75 bp, Artificial Sequence
  Synthetic
ggatccagagtatacaggccttgggtttaggatcggtatgttctagagaaacggcaaccgattacatacaagtat

SEQ ID NO: 179361 - DNA, 75 bp, Artificial Sequence
  Synthetic
aaaacttaaacaacacctcgaattcaaaaaagccatcggcgagctttttaaggcagctagtctcattaaatccta

SEQ ID NO: 179362 - DNA, 75 bp, Artificial Sequence
  Synthetic
tttaggatcggtatgttctagagaaacggcaaccgattacatacaagtattcaagtacttggccagctgtacgct

SEQ ID NO: 179363 - DNA, 75 bp, Artificial Sequence
  Synthetic
attcgatggacaatgtgcagattaagaacgtgtacagtccattttttcagtgggacaatcatacgcggcttgcgg

SEQ ID NO: 179364 - DNA, 75 bp, Artificial Sequence
  Synthetic
gaacgtgtacagtccattttttcagtgggacaatcatacgcggcttgcggtgctgcctccggttttcgatcgaag

SEQ ID NO: 179365 - DNA, 75 bp, Artificial Sequence
  Synthetic
tggtggttccggaaagccttggtcacgtgatcttgcagcaacttctcgtatatcacctttatgcaagggttgccg

SEQ ID NO: 179366 - DNA, 75 bp, Artificial Sequence
  Synthetic
cgtgatcttgcagcaacttctcgtatatcacctttatgcaagggttgccggtggcgcgccagatgctgtcaacat

SEQ ID NO: 179367 - DNA, 75 bp, Artificial Sequence
  Synthetic
accagctcgacgtggcaaatgtagatccgcgcaacgctctgggccttctggacgatctatctatgtatctgtgta

SEQ ID NO: 179368 - DNA, 75 bp, Artificial Sequence
  Synthetic
tccgcgcaacgctctgggccttctggacgatctatctatgtatctgtgtatattttcggcgctgttaccgagggt

SEQ ID NO: 179369 - DNA, 75 bp, Artificial Sequence
  Synthetic
caagctatcatgcgagagaaacacgtcacacgcaaagtcatgtaaaacccgggttaaaaatagcctaactggcca

SEQ ID NO: 179370 - DNA, 75 bp, Artificial Sequence
  Synthetic
tggaggtgttcgagggtgtggttcccgaggaggtgactcgcatcgacatagatcagcttaacgttgctgacgata

SEQ ID NO: 179371 - DNA, 75 bp, Artificial Sequence
  Synthetic
cgaggaggtgactcgcatcgacatagatcagcttaacgttgctgacgatataacgcgcatgcgtgttatgttctc

SEQ ID NO: 179372 - DNA, 75 bp, Artificial Sequence
  Synthetic
tatactcctatgcagaagagacgcttacggcctcctgctggtacgccccgagctaaacgctaactcatgataggc

SEQ ID NO: 179373 - DNA, 75 bp, Artificial Sequence
  Synthetic
tacggcctcctgctggtacgccccgagctaaacgctaactcatgataggccaagagatcatggtgttatctagag

SEQ ID NO: 179374 - DNA, 75 bp, Artificial Sequence
  Synthetic
accaccatttataggagggacgccagtgattggattccagagacagccgcgatgaaagatgcgtttcatagccac

SEQ ID NO: 179375 - DNA, 75 bp, Artificial Sequence
  Synthetic
gtgattggattccagagacagccgcgatgaaagatgcgtttcatagccacggcctctgtaccatgatgcgcgcca

SEQ ID NO: 179376 - DNA, 75 bp, Artificial Sequence
  Synthetic
caatgcaggccacgggagacatctgttttttccgatcccgagtttggtatcaaccgcaactacacagtaaagtgt

SEQ ID NO: 179377 - DNA, 75 bp, Artificial Sequence
  Synthetic
ttgtttggctactgctatctgcagcatctttgctacctgcttattttgctttggcctcttaatccgcactggcca

SEQ ID NO: 179378 - DNA, 75 bp, Artificial Sequence
  Synthetic
atctttgctacctgcttattttgctttggcctcttaatccgcactggccacctgtttcgtcctcggcgtggcttc

SEQ ID NO: 179379 - DNA, 75 bp, Artificial Sequence
  Synthetic
atccgcgggtgtcaagatgaggacttttgtagattggtgtcagttttacctgtgattaatacaacgtacgggcct

SEQ ID NO: 179380 - DNA, 75 bp, Artificial Sequence
  Synthetic
tttgtagattggtgtcagttttacctgtgattaatacaacgtacgggcctatttatcctaattttacacgggggc

SEQ ID NO: 179381 - DNA, 75 bp, Artificial Sequence
  Synthetic
ctgctcgctaaccagtcgtgtaccgagatttctctggactctgggaccgcaaacgacaccgccttacgggacctg

SEQ ID NO: 179382 - DNA, 75 bp, Artificial Sequence
  Synthetic
agatttctctggactctgggaccgcaaacgacaccgccttacgggacctgcgtgaagccgtaggcctctggatat

SEQ ID NO: 179383 - DNA, 75 bp, Artificial Sequence
  Synthetic
tttattgacccaaatgaatatggtggcgtagtcgcgcaagtacgaacatttttgaaacccgtgccgtgtgattta

SEQ ID NO: 179384 - DNA, 75 bp, Artificial Sequence
  Synthetic
gcgtagtcgcgcaagtacgaacatttttgaaacccgtgccgtgtgatttaagttgggaggatgtatacaactcaa

SEQ ID NO: 179385 - DNA, 75 bp, Artificial Sequence
  Synthetic
gttacgggtccatgggcgatccgtgtttcatatgttgaaattaaataaattttcccacgctctaaacctgggtga

SEQ ID NO: 179386 - DNA, 75 bp, Artificial Sequence
  Synthetic
tttcatatgttgaaattaaataaattttcccacgctctaaacctgggtgaggtgtgttgaacgtcacttgtggtt

SEQ ID NO: 179387 - DNA, 75 bp, Artificial Sequence
  Synthetic
tgggatatatcgaaacctgtataaaacatatataagttacgcaggtgcgtcgcgggcgatgggtgacctgtggtc

SEQ ID NO: 179388 - DNA, 75 bp, Artificial Sequence
  Synthetic
acatatataagttacgcaggtgcgtcgcgggcgatgggtgacctgtggtcgtagccgcacgcgccgggggctttg

SEQ ID NO: 179389 - DNA, 75 bp, Artificial Sequence
  Synthetic
cggagcaagactcctggctcctgcgcctagccacaaagcctcctgttatgggactgatatttgtggttgtgctta

SEQ ID NO: 179390 - DNA, 75 bp, Artificial Sequence
  Synthetic
cctagccacaaagcctcctgttatgggactgatatttgtggttgtgcttattgtgctggttgcctgtgtgtattg

SEQ ID NO: 179391 - DNA, 75 bp, Artificial Sequence
  Synthetic
ggagggccgttgttgcatatcaggtcttgaactccctaacgtctcgaactagcgcgcgatcttcggagcccgttc

SEQ ID NO: 179392 - DNA, 75 bp, Artificial Sequence
  Synthetic
cttgaactccctaacgtctcgaactagcgcgcgatcttcggagcccgttccagaagctcagcctatttacatgcc

SEQ ID NO: 179393 - DNA, 75 bp, Artificial Sequence
  Synthetic
gtggctcctgctgttgtggctcctgctgctgttgtgaactttggatgctcaacgttttgtttccatcgcccccgt

SEQ ID NO: 179394 - DNA, 75 bp, Artificial Sequence
  Synthetic
aacatagtttattggcgggagaggggtttaaatgcgcatctgtcgcatgtggcgagaaaatgagccatgactacg

SEQ ID NO: 179395 - DNA, 75 bp, Artificial Sequence
  Synthetic
cctcctcgtcctccttcttgtcctcctcctcgtcatcctcctcgtcctcattgtcctcatcatcgtcatcctcct

SEQ ID NO: 179396 - DNA, 75 bp, Artificial Sequence
  Synthetic
gtttaaatgcgcatctgtcgcatgtggcgagaaaatgagccatgactacggcgacaagaagatcgtctgacatgt

SEQ ID NO: 179397 - DNA, 75 bp, Artificial Sequence
  Synthetic
ctcctcgtcatcctcctcgtcctcattgtcctcatcatcgtcatcctcctcctcctcctcctcctcctcctcctc

SEQ ID NO: 179398 - DNA, 75 bp, Artificial Sequence
  Synthetic
ctgattgccttaatttgctcgacgaggtatgtgaccgggtcaaatgtgagtttgattgtattagaaacaattgtt

SEQ ID NO: 179399 - DNA, 75 bp, Artificial Sequence
  Synthetic
ggtatgtgaccgggtcaaatgtgagtttgattgtattagaaacaattgtttggcagattccaagcgtgctggagt

SEQ ID NO: 179400 - DNA, 75 bp, Artificial Sequence
  Synthetic
atgtaaattggccactgcagactgccgcctttctcagtgtagtgcgaaaaggagatgggcaacgagcacagctca

SEQ ID NO: 179401 - DNA, 75 bp, Artificial Sequence
  Synthetic
cgcctttctcagtgtagtgcgaaaaggagatgggcaacgagcacagctcatttaaaacggttgcaatggccacgg

SEQ ID NO: 179402 - DNA, 75 bp, Artificial Sequence
  Synthetic
atttttttttactatttatatgtctacttggatatcttcagtgttgtgtgcgtcagtctagtgaggtacctcctg

SEQ ID NO: 179403 - DNA, 75 bp, Artificial Sequence
  Synthetic
ttggggtggagaacggctattgctttgatcatgcttccggcgcacgatgcaatctcgtatgcggcggtacctgtg

SEQ ID NO: 179404 - DNA, 75 bp, Artificial Sequence
  Synthetic
tgatcatgcttccggcgcacgatgcaatctcgtatgcggcggtacctgtgagttccttcagaaaaaagtgctcca

SEQ ID NO: 179405 - DNA, 75 bp, Artificial Sequence
  Synthetic
cctatgccggttccagatgcctcggtattgttggtgtaggcagggtctatgtatacaaataaatctgtacccatg

SEQ ID NO: 179406 - DNA, 75 bp, Artificial Sequence
  Synthetic
tattgttggtgtaggcagggtctatgtatacaaataaatctgtacccatgcgtgtttggagggctaaagacgtcg

SEQ ID NO: 179407 - DNA, 75 bp, Artificial Sequence
  Synthetic
ctgtgaagcgccgagtccccgatagaggtggcgtctcccatgagctcggtggtgaacacgccctctaaaaagaga

SEQ ID NO: 179408 - DNA, 75 bp, Artificial Sequence
  Synthetic
aggtggcgtctcccatgagctcggtggtgaacacgccctctaaaaagagattggtcgttgatttaatggcactgt

SEQ ID NO: 179409 - DNA, 75 bp, Artificial Sequence
  Synthetic
agcgtttcctgcaaatgaaagtcttcgcggtgatccgagcatacgtaactcactacgtttaacatcttctcctgg

SEQ ID NO: 179410 - DNA, 75 bp, Artificial Sequence
  Synthetic
cgcggtgatccgagcatacgtaactcactacgtttaacatcttctcctgggcattcttgaggtttagaagaaaac

SEQ ID NO: 179411 - DNA, 75 bp, Artificial Sequence
  Synthetic
tccttttggagcataaagcccaggattgccgggagggcgtccttcttaataaaatttgcctcgtccacgtataac

SEQ ID NO: 179412 - DNA, 75 bp, Artificial Sequence
  Synthetic
ttgccgggagggcgtccttcttaataaaatttgcctcgtccacgtataacaggttaaatgtctgaccacgaatgc

SEQ ID NO: 179413 - DNA, 75 bp, Artificial Sequence
  Synthetic
ggtgcttggaggtccggtggtggatgacggcgactttacagactgtatgaggttttttaatcagcctctaaaaac

SEQ ID NO: 179414 - DNA, 75 bp, Artificial Sequence
  Synthetic
gacggcgactttacagactgtatgaggttttttaatcagcctctaaaaacccaagtgatatccagtgtcggggca

SEQ ID NO: 179415 - DNA, 75 bp, Artificial Sequence
  Synthetic
ctgtctgttgctggatctcgtgggtaccgagtgttttgcgcgactatgcaggatcacccccgctgcgacatgaga

SEQ ID NO: 179416 - DNA, 75 bp, Artificial Sequence
  Synthetic
accgagtgttttgcgcgactatgcaggatcacccccgctgcgacatgagactattggactctcccctgtgtcgcc

SEQ ID NO: 179417 - DNA, 75 bp, Artificial Sequence
  Synthetic
gtgtgtgacggaggctctgcctgtgtgctcgttaacactcctgaaaatgtgatttgtgacctaacgggaaactgc

SEQ ID NO: 179418 - DNA, 75 bp, Artificial Sequence
  Synthetic
tgctcgttaacactcctgaaaatgtgatttgtgacctaacgggaaactgcgtggccgataacctccaggaaactc

SEQ ID NO: 179419 - DNA, 75 bp, Artificial Sequence
  Synthetic
gcggcataccatgccgtcttggcctgtttgaaacgggatatcgtatccaatctccggtcctggacagatacctgg

SEQ ID NO: 179420 - DNA, 75 bp, Artificial Sequence
  Synthetic
gtttgaaacgggatatcgtatccaatctccggtcctggacagatacctgggacgtggctgagcaaattgctctgg

SEQ ID NO: 179421 - DNA, 75 bp, Artificial Sequence
  Synthetic
gattgccttccggtactggcggaggcgcgcggcgggtacgcgctcctatgtagcatgtacctacatgttattgta

SEQ ID NO: 179422 - DNA, 75 bp, Artificial Sequence
  Synthetic
cgcgcggcgggtacgcgctcctatgtagcatgtacctacatgttattgtatccatttattcaacaaaaacggtgt

SEQ ID NO: 179423 - DNA, 75 bp, Artificial Sequence
  Synthetic
gccaagcgtgttcgtgcaagatggatgcacatgctctcaacgagaggtatctagggccggctaattctagactag

SEQ ID NO: 179424 - DNA, 75 bp, Artificial Sequence
  Synthetic
tgcacatgctctcaacgagaggtatctagggccggctaattctagactagttcacgtgttacttccccggacctt

SEQ ID NO: 179425 - DNA, 75 bp, Artificial Sequence
  Synthetic
acacgcggtttgtagaaactggtggagcctctcgcggggtgcgcatcagcggcaggtttgttttgcgtgactcca

SEQ ID NO: 179426 - DNA, 75 bp, Artificial Sequence
  Synthetic
agcctctcgcggggtgcgcatcagcggcaggtttgttttgcgtgactccaacaacgcctgtgtatcgcggacggg

SEQ ID NO: 179427 - DNA, 75 bp, Artificial Sequence
  Synthetic
tcgacattgcggtgctgcgaattggctccgctaacgccgaatgtgatgttacaatttgcttcctatatctagagt

SEQ ID NO: 179428 - DNA, 75 bp, Artificial Sequence
  Synthetic
ctccgctaacgccgaatgtgatgttacaatttgcttcctatatctagagttgctgtctggcttgggtctcgaacg

SEQ ID NO: 179429 - DNA, 75 bp, Artificial Sequence
  Synthetic
gtctcgagcgccctttggatgaacttgtggatctggtccatcgccaacagatctcagcagttcgtgttgctggtg

SEQ ID NO: 179430 - DNA, 75 bp, Artificial Sequence
  Synthetic
tgtggatctggtccatcgccaacagatctcagcagttcgtgttgctggtggacccctggaggtgctgactgggct

SEQ ID NO: 179431 - DNA, 75 bp, Artificial Sequence
  Synthetic
aggcgccaggtgtcgttcggggcgaatgtcggcagttgccgcagatcgcagaacgtaggccagtccccgccctcg

SEQ ID NO: 179432 - DNA, 75 bp, Artificial Sequence
  Synthetic
atgtcggcagttgccgcagatcgcagaacgtaggccagtccccgccctcgtcgccttaacgtggcgtcctttgga

SEQ ID NO: 179433 - DNA, 75 bp, Artificial Sequence
  Synthetic
acacctattatgtctggagctacggagagacgtcgcctcgagaacatgcaacgcggacctctcctgtgatctttc

SEQ ID NO: 179434 - DNA, 75 bp, Artificial Sequence
  Synthetic
agagacgtcgcctcgagaacatgcaacgcggacctctcctgtgatctttccagacccgacaaccaccgatattct

SEQ ID NO: 179435 - DNA, 75 bp, Artificial Sequence
  Synthetic
ttgtcaattcgctagaggccgcatgtcgtcggcagaattatactttgcgccaaaaactacccgtgactatcccaa

SEQ ID NO: 179436 - DNA, 75 bp, Artificial Sequence
  Synthetic
tcgtcggcagaattatactttgcgccaaaaactacccgtgactatcccaaacgaccctgggtcagttgacgcgat

SEQ ID NO: 179437 - DNA, 75 bp, Artificial Sequence
  Synthetic
agcaggcggcatgggtgcgggctgtccgtgggaccactgttagtcagcgtcccctgtggctcgacgtgctggggc

SEQ ID NO: 179438 - DNA, 75 bp, Artificial Sequence
  Synthetic
ccgtgggaccactgttagtcagcgtcccctgtggctcgacgtgctggggctgtgggaaacaggacaccattgtct

SEQ ID NO: 179439 - DNA, 75 bp, Artificial Sequence
  Synthetic
cggctgtaataaaacacccttccgtcaagggcaccatatgcggggatctcaccgcttgtgtggtggtgagtgcaa

SEQ ID NO: 179440 - DNA, 75 bp, Artificial Sequence
  Synthetic
caagggcaccatatgcggggatctcaccgcttgtgtggtggtgagtgcaaatctacacgcctggctagtgctccc

SEQ ID NO: 179441 - DNA, 75 bp, Artificial Sequence
  Synthetic
gaaaccggtatgtccaggggtcccacgccagcctgttgggcgatgaggccgttggagcatctgtccatgtgtcgc

SEQ ID NO: 179442 - DNA, 75 bp, Artificial Sequence
  Synthetic
agctcgtgagatctagatatgtctagccggcagcgtaggctgctgcgtgggtttttaaatcgagaatgcatctgg

SEQ ID NO: 179443 - DNA, 75 bp, Artificial Sequence
  Synthetic
gccggcagcgtaggctgctgcgtgggtttttaaatcgagaatgcatctgggttcgcaatccagcctccacgacgc

SEQ ID NO: 179444 - DNA, 75 bp, Artificial Sequence
  Synthetic
atggtggtcacggcacaggggttgtcgtataccgcctttcacgtggcggtggccgtgttgaatcatcgcgtactg

SEQ ID NO: 179445 - DNA, 75 bp, Artificial Sequence
  Synthetic
cgtataccgcctttcacgtggcggtggccgtgttgaatcatcgcgtactgggcccctgtgtggccgttggcttga

SEQ ID NO: 179446 - DNA, 75 bp, Artificial Sequence
  Synthetic
gtgcctggcagatctggtgtctttctgatattctttggaaagttcactgacgaagtggtgggcatgcgctttcca

SEQ ID NO: 179447 - DNA, 75 bp, Artificial Sequence
  Synthetic
tgatattctttggaaagttcactgacgaagtggtgggcatgcgctttccatatctgacggccccgccggcacgag

SEQ ID NO: 179448 - DNA, 75 bp, Artificial Sequence
  Synthetic
aggcctcccattggcccctatccctagaactcccaagctgattggcccacagcgggaaccaatcagcgattagag

SEQ ID NO: 179449 - DNA, 75 bp, Artificial Sequence
  Synthetic
atctcgcgggcagatgtggctaaggccacagaaggcctgcattttgacgttatcaacccctttgtctggtttggg

SEQ ID NO: 179450 - DNA, 75 bp, Artificial Sequence
  Synthetic
ccacagaaggcctgcattttgacgttatcaacccctttgtctggtttgggggcgggtcagtctggctcctgtttt

SEQ ID NO: 179451 - DNA, 75 bp, Artificial Sequence
  Synthetic
cttgcccgtgtgttcaccctccttacccggtgtgatcgtgaaggctgtgactactgtgagggtctaggtggccat

SEQ ID NO: 179452 - DNA, 75 bp, Artificial Sequence
  Synthetic
cccggtgtgatcgtgaaggctgtgactactgtgagggtctaggtggccatgttaacgtgttcaaaggctattgtg

SEQ ID NO: 179453 - DNA, 75 bp, Artificial Sequence
  Synthetic
acactgtcagaaggcgcggtagaaatttctggacatcgtaattttttagggttgctgtttgaccctgccacgcaa

SEQ ID NO: 179454 - DNA, 75 bp, Artificial Sequence
  Synthetic
tttctggacatcgtaattttttagggttgctgtttgaccctgccacgcaagcgcgcataaccgcgctaaatgtta

SEQ ID NO: 179455 - DNA, 75 bp, Artificial Sequence
  Synthetic
gacaatggaaccgaggttgagcccgcccgcgctccctgggttctcctgcgaatgtcagactattttagtcgcgtg

SEQ ID NO: 179456 - DNA, 75 bp, Artificial Sequence
  Synthetic
cccgcgctccctgggttctcctgcgaatgtcagactattttagtcgcgtgctgttaatagggtgtaagcgcatga

SEQ ID NO: 179457 - DNA, 75 bp, Artificial Sequence
  Synthetic
gccccgcccaccgctggcgcgccccagaacatgggtggctaacgcctacatgggcagcttgtcctacggttacgc

SEQ ID NO: 179458 - DNA, 75 bp, Artificial Sequence
  Synthetic
tggatctgccgcccggtcgtgtatagatgatcgtcccgttctccttttttacgttgaggttatgtggcggaaacc

SEQ ID NO: 179459 - DNA, 75 bp, Artificial Sequence
  Synthetic
gatgatcgtcccgttctccttttttacgttgaggttatgtggcggaaaccatcgcgttagcgttttgatgacttc

SEQ ID NO: 179460 - DNA, 75 bp, Artificial Sequence
  Synthetic
gaacgttttcaacagacgcgaggagcatgctgattgtcgctaccacaatccaggtcttaccgtgtctcctgggaa

SEQ ID NO: 179461 - DNA, 75 bp, Artificial Sequence
  Synthetic
catgctgattgtcgctaccacaatccaggtcttaccgtgtctcctgggaatcagaaatatgctagctttctgctt

SEQ ID NO: 179462 - DNA, 75 bp, Artificial Sequence
  Synthetic
cccaggagccccggcagcaccccaggagccccggcagcaccccaggagccccggcagcaccccaggagccccggc

SEQ ID NO: 179463 - DNA, 75 bp, Artificial Sequence
  Synthetic
taaacaagtcaaaaaactgtcgtgttttttgcggggcctttatagtcatcagaaagtaaaaggtatgcataatca

SEQ ID NO: 179464 - DNA, 75 bp, Artificial Sequence
  Synthetic
agcaccccaggagccccggcaggaccccaggagccccggcagcaccccaggagccccggcagcaccccaggagcc

SEQ ID NO: 179465 - DNA, 75 bp, Artificial Sequence
  Synthetic
tttttgcggggcctttatagtcatcagaaagtaaaaggtatgcataatcagctgttgttgaaacggttccagact

SEQ ID NO: 179466 - DNA, 75 bp, Artificial Sequence
  Synthetic
agaatcggcgcagttcatcgtatatggggcatgcctccatagacattctaatggtcctggccgcctcaaactcga

SEQ ID NO: 179467 - DNA, 75 bp, Artificial Sequence
  Synthetic
ggggcatgcctccatagacattctaatggtcctggccgcctcaaactcgatgagttgttcagggtgttgttgtgc

SEQ ID NO: 179468 - DNA, 75 bp, Artificial Sequence
  Synthetic
agggggatcccggcgcgccaccctccccggcaacaacctgttgccatgtatggcgatttgtatcagtcacaagca

SEQ ID NO: 179469 - DNA, 75 bp, Artificial Sequence
  Synthetic
gaagtctgggtaacgcgcgttcctcggggggcctcggacacccaacgtcccctcggagcttggtaggcggggctt

SEQ ID NO: 179470 - DNA, 75 bp, Artificial Sequence
  Synthetic
ggggggcctcggacacccaacgtcccctcggagcttggtaggcggggcttggtagcactgggtacaatatgcgtc

SEQ ID NO: 179471 - DNA, 75 bp, Artificial Sequence
  Synthetic
gtgccattcggattgttttggggcatttggttaaaaagaccggggaggcggcctgccattcggcatcctgcgtcg

SEQ ID NO: 179472 - DNA, 75 bp, Artificial Sequence
  Synthetic
tttggttaaaaagaccggggaggcggcctgccattcggcatcctgcgtcgtggatatttcttggaggcgcgctgc

SEQ ID NO: 179473 - DNA, 75 bp, Artificial Sequence
  Synthetic
cctccgatggcgatccggagctcacaaacagatatgttaaaagcgtaaaactcgcagtggatcttagtgaaagta

SEQ ID NO: 179474 - DNA, 75 bp, Artificial Sequence
  Synthetic
aaacagatatgttaaaagcgtaaaactcgcagtggatcttagtgaaagtacgcccggccagttcaagttaattga

SEQ ID NO: 179475 - DNA, 75 bp, Artificial Sequence
  Synthetic
aacccttgcagcagttttctggtgtggccgatgcagactttagtagtcttcggcttccccgactggaccgcctgg

SEQ ID NO: 179476 - DNA, 75 bp, Artificial Sequence
  Synthetic
ggccgatgcagactttagtagtcttcggcttccccgactggaccgcctggatagggttatgggtcgtgtcttcga

SEQ ID NO: 179477 - DNA, 75 bp, Artificial Sequence
  Synthetic
gttgttcaggatgcgaagctcttgcttaccaaacatatactgccgagcagtggctctgggccttgaccattaaca

SEQ ID NO: 179478 - DNA, 75 bp, Artificial Sequence
  Synthetic
ttaccaaacatatactgccgagcagtggctctgggccttgaccattaacaaagaaaaaatagttgaagaggccat

SEQ ID NO: 179479 - DNA, 75 bp, Artificial Sequence
  Synthetic
cactgcctcttatctggctcctgtttaatggacctgcttctttttgcagttctgagtgttgtatttatgaaaaac

SEQ ID NO: 179480 - DNA, 75 bp, Artificial Sequence
  Synthetic
taatggacctgcttctttttgcagttctgagtgttgtatttatgaaaaacactacggttgtcgggggcctgtgtt

SEQ ID NO: 179481 - DNA, 75 bp, Artificial Sequence
  Synthetic
atcacgccctaaagtataccaagtttctgtacggaaatttttccgggacatggccagaaaagagcttaccattcg

SEQ ID NO: 179482 - DNA, 75 bp, Artificial Sequence
  Synthetic
tctgtacggaaatttttccgggacatggccagaaaagagcttaccattcgactcttcccggatacccagggcggt

SEQ ID NO: 179483 - DNA, 75 bp, Artificial Sequence
  Synthetic
ttaaaaaaaaaaatccaacagtataatgtattaaatgcagcattccagtaacaagagacgccttgttaaaacttt

SEQ ID NO: 179484 - DNA, 75 bp, Artificial Sequence
  Synthetic
gtctgctgtgtcacctgtaccgacaaaacgcggccgtggcctctcggggaacccacgtggggcctatattggtct

SEQ ID NO: 179485 - DNA, 75 bp, Artificial Sequence
  Synthetic
aaacgcggccgtggcctctcggggaacccacgtggggcctatattggtcttaggtggaaagggtgctcagtatat

SEQ ID NO: 179486 - DNA, 75 bp, Artificial Sequence
  Synthetic
tgctaccatcctatgacatttctgctattatcaggatgatacaggaggatggactcgcgaaatactaagcgggat

SEQ ID NO: 179487 - DNA, 75 bp, Artificial Sequence
  Synthetic
tattatcaggatgatacaggaggatggactcgcgaaatactaagcgggattttatcaaatcggccctaacggtgg

SEQ ID NO: 179488 - DNA, 75 bp, Artificial Sequence
  Synthetic
agtgctatttttgaaagacagtttatagacgcccgggcggcggagcggtctcacgggactctgcagagacaaacc

SEQ ID NO: 179489 - DNA, 75 bp, Artificial Sequence
  Synthetic
tagacgcccgggcggcggagcggtctcacgggactctgcagagacaaaccaagctgcgcgatctggcgcgagagg

SEQ ID NO: 179490 - DNA, 75 bp, Artificial Sequence
  Synthetic
cacagagctctgccctccacagaggagatagacgcgctgggggacactgtcgcagacctcaaagagacggtaact

SEQ ID NO: 179491 - DNA, 75 bp, Artificial Sequence
  Synthetic
agatagacgcgctgggggacactgtcgcagacctcaaagagacggtaactgcccgccttgatgcgctggaagagc

SEQ ID NO: 179492 - DNA, 75 bp, Artificial Sequence
  Synthetic
ctccactggcgccttggccgtttgcccccgatgtgccctggaactccctaagaataccggaggggagccgcgacc

SEQ ID NO: 179493 - DNA, 75 bp, Artificial Sequence
  Synthetic
ccccgatgtgccctggaactccctaagaataccggaggggagccgcgaccctgggcctctctgtggcagttaaat

SEQ ID NO: 179494 - DNA, 75 bp, Artificial Sequence
  Synthetic
gccgcgtcaatggtttaagtgcgaccacgaagacgctgactggtctaccagactggggcgcggggcttttggggt

SEQ ID NO: 179495 - DNA, 75 bp, Artificial Sequence
  Synthetic
cacgaagacgctgactggtctaccagactggggcgcggggcttttggggtgatatcaccagtgtcggaggacgtt

SEQ ID NO: 179496 - DNA, 75 bp, Artificial Sequence
  Synthetic
gaacgatctaatgcaggccaccagagagcgccatcctttccacgagggagccgggcggctcttgggttttgttgg

SEQ ID NO: 179497 - DNA, 75 bp, Artificial Sequence
  Synthetic
gagcgccatcctttccacgagggagccgggcggctcttgggttttgttggcgtatgcgtgccctgccgtgcgctt

SEQ ID NO: 179498 - DNA, 75 bp, Artificial Sequence
  Synthetic
aggccgcacgccgggcgcagggcctctctccaggggcgggggacgggggaggggggaggcgggccgcgcgccgcc

SEQ ID NO: 179499 - DNA, 75 bp, Artificial Sequence
  Synthetic
ctctccaggggcgggggacgggggaggggggaggcgggccgcgcgccgccgcaccggagcgcgagcccggggccc

SEQ ID NO: 179500 - DNA, 75 bp, Artificial Sequence
  Synthetic
cgacttgggcgttctaacgacggagtttaccggcctgctctccgggattttgtttctaaacaggtactgtgcgat

SEQ ID NO: 179501 - DNA, 75 bp, Artificial Sequence
  Synthetic
tttaccggcctgctctccgggattttgtttctaaacaggtactgtgcgatgacgcactgtgatgtgagcccagac

SEQ ID NO: 179502 - DNA, 75 bp, Artificial Sequence
  Synthetic
ttcgggcggccccccgaccctctctcggccgcggcccgcgcccgcccccgcggggtggtggcggcgcccgcggcg

SEQ ID NO: 179503 - DNA, 75 bp, Artificial Sequence
  Synthetic
tctatccgatctggggtccgtggtgttacataccgggagcaaatggtccgggctggtcgttacctctaatctggg

SEQ ID NO: 179504 - DNA, 75 bp, Artificial Sequence
  Synthetic
gtcccggctggggccccgccgccgccgcgccccccgccggcgcccgccccccggccggggaagccgccggggcct

SEQ ID NO: 179505 - DNA, 75 bp, Artificial Sequence
  Synthetic
ttacataccgggagcaaatggtccgggctggtcgttacctctaatctgggactgaaacaacactcgtacgaggct

SEQ ID NO: 179506 - DNA, 75 bp, Artificial Sequence
  Synthetic
gccaggcatagtctttttttctggcggcccttgtgtaaacctgtctttcagaccttgttggacatcctgtacaat

SEQ ID NO: 179507 - DNA, 75 bp, Artificial Sequence
  Synthetic
tcttctacagtgctatctttcgtgtctcggtcaggtgcacgctactgtgcttgatcaatcctatcctctgagtcc

SEQ ID NO: 179508 - DNA, 75 bp, Artificial Sequence
  Synthetic
tattaagcctttatgtgctatcgtctccaaatttgtgccctggagtgatttcaacgccttacacgttgacctgtc

SEQ ID NO: 179509 - DNA, 75 bp, Artificial Sequence
  Synthetic
ctcggtcaggtgcacgctactgtgcttgatcaatcctatcctctgagtccgcagtttgccctgacggtggatgtg

SEQ ID NO: 179510 - DNA, 75 bp, Artificial Sequence
  Synthetic
gcccgcccagaaccctctaaaatttctctttcacgccgcaccgggcatgcgtccagaccctgtctattatctggg

SEQ ID NO: 179511 - DNA, 75 bp, Artificial Sequence
  Synthetic
tggcgactgacgaagccaacactcactattgacatcattacctgcaattttacttgtgtggaacaatctgggcat

SEQ ID NO: 179512 - DNA, 75 bp, Artificial Sequence
  Synthetic
ctctttcacgccgcaccgggcatgcgtccagaccctgtctattatctggggttcatgattccaagagtcgtcatg

SEQ ID NO: 179513 - DNA, 75 bp, Artificial Sequence
  Synthetic
ctattgacatcattacctgcaattttacttgtgtggaacaatctgggcatcgacagagcatttggattacatggc

SEQ ID NO: 179514 - DNA, 75 bp, Artificial Sequence
  Synthetic
ctgtaccggcaacgctccgtcccttcctgtgcgccagccccaccgcgaggcgttcgagaggcagtgctatttata

SEQ ID NO: 179515 - DNA, 75 bp, Artificial Sequence
  Synthetic
cctgtgcgccagccccaccgcgaggcgttcgagaggcagtgctatttatataaagccaaccacaaagcggaggcg

SEQ ID NO: 179516 - DNA, 75 bp, Artificial Sequence
  Synthetic
tctaacgggctgtcgtctcgcctgtcaaatcgtatatgtttttgggcgcgttgtgccaatataactccagaaact

SEQ ID NO: 179517 - DNA, 75 bp, Artificial Sequence
  Synthetic
caagagactccttcacagggattatttcagccatggcggacggcaacacaacggtggattttttttctgaagaat

SEQ ID NO: 179518 - DNA, 75 bp, Artificial Sequence
  Synthetic
ttcagccatggcggacggcaacacaacggtggattttttttctgaagaatgtcttgcggatgccctcggtgagct

SEQ ID NO: 179519 - DNA, 75 bp, Artificial Sequence
  Synthetic
caggctttagaacattcagtactaatagcttagtgaacataatccatgcaaccacacataaagtagttgtagtga

SEQ ID NO: 179520 - DNA, 75 bp, Artificial Sequence
  Synthetic
tcctaaagcatcccgatgtgcgtacttggtgcactcgtaccggggtgcgtcccagtatgcccgtccttcgtatga

SEQ ID NO: 179521 - DNA, 75 bp, Artificial Sequence
  Synthetic
atgacactcgtagctctgataggaaccatgtgtggtatcttaggaactattatctttgcccattgtcaaaaacaa

SEQ ID NO: 179522 - DNA, 75 bp, Artificial Sequence
  Synthetic
ttggtgcactcgtaccggggtgcgtcccagtatgcccgtccttcgtatgacgtataactattttctcttccttaa

SEQ ID NO: 179523 - DNA, 75 bp, Artificial Sequence
  Synthetic
gcgtgtttggcggacagcgtctcacggaggttggggccgtatacgatgcgtgtgcgaagatggatccacacgctc

SEQ ID NO: 179524 - DNA, 75 bp, Artificial Sequence
  Synthetic
ggaggttggggccgtatacgatgcgtgtgcgaagatggatccacacgctcgccacgcgatctgttctcttgtcga

SEQ ID NO: 179525 - DNA, 75 bp, Artificial Sequence
  Synthetic
acggaataatctcgtcctctaaatttcactgggcggtgaaacagcaaaatgggtccaaaaaaatttttaacccat

SEQ ID NO: 179526 - DNA, 75 bp, Artificial Sequence
  Synthetic
tcactgggcggtgaaacagcaaaatgggtccaaaaaaatttttaacccatggcccatagcgaacaatcactttgt

SEQ ID NO: 179527 - DNA, 75 bp, Artificial Sequence
  Synthetic
ttctaactgtcctgattcatcctggagaacctgtctgtcctcactacggttttatgcagagtccccaaaacggaa

SEQ ID NO: 179528 - DNA, 75 bp, Artificial Sequence
  Synthetic
agaacctgtctgtcctcactacggttttatgcagagtccccaaaacggaatttttggggcgtctctggattttgc

SEQ ID NO: 179529 - DNA, 75 bp, Artificial Sequence
  Synthetic
gccgcgtgtatgagattaaatgtaggttcaaatacacgttttcaaagattgaatgcgacccgatctacgttgcct

SEQ ID NO: 179530 - DNA, 75 bp, Artificial Sequence
  Synthetic
gttcaaatacacgttttcaaagattgaatgcgacccgatctacgttgcctatcaacagctgtacgataaacctaa

SEQ ID NO: 179531 - DNA, 75 bp, Artificial Sequence
  Synthetic
agtatgtgggtgacggtaggctgccaagcgaagcagactaccttgttgcctacgacaaggagtgggcagtgtgtc

SEQ ID NO: 179532 - DNA, 75 bp, Artificial Sequence
  Synthetic
aagcgaagcagactaccttgttgcctacgacaaggagtgggcagtgtgtcatagaaaaaagagaaaacttacgcc

SEQ ID NO: 179533 - DNA, 75 bp, Artificial Sequence
  Synthetic
cagacgtctatgttttgacggatccccaggagtcccagggtaaaattagtattaaagctcactttaaggctaacc

SEQ ID NO: 179534 - DNA, 75 bp, Artificial Sequence
  Synthetic
ccaggagtcccagggtaaaattagtattaaagctcactttaaggctaacctatttgtgaacgtgcgtcacggcta

SEQ ID NO: 179535 - DNA, 75 bp, Artificial Sequence
  Synthetic
ttgaccggggtacaaagactttaggcactcagaagaactttctggccactggcttttttagaaaacggacgtttc

SEQ ID NO: 179536 - DNA, 75 bp, Artificial Sequence
  Synthetic
cactcagaagaactttctggccactggcttttttagaaaacggacgtttcatgacccgccgtactgtaccatcgg

SEQ ID NO: 179537 - DNA, 75 bp, Artificial Sequence
  Synthetic
taacgcccgtatacttccccaggggagccaaacacctattgttgcaccaggcggcggatttttgggctaaaagtg

SEQ ID NO: 179538 - DNA, 75 bp, Artificial Sequence
  Synthetic
agccaaacacctattgttgcaccaggcggcggatttttgggctaaaagtgccgaagatacctttcctctgatacc

SEQ ID NO: 179539 - DNA, 75 bp, Artificial Sequence
  Synthetic
ggacggagaggctctggacctgacggtggattttggtcccattggagattcggaaaagggcattctgctcctcga

SEQ ID NO: 179540 - DNA, 75 bp, Artificial Sequence
  Synthetic
gtggattttggtcccattggagattcggaaaagggcattctgctcctcgagactaatgggacctcccgcgaaacc

SEQ ID NO: 179541 - DNA, 75 bp, Artificial Sequence
  Synthetic
tgtttatttgtgtccaaagggtctgggcgcttggtgggcggttgcgtttaaagagtctacccctacagagagggc

SEQ ID NO: 179542 - DNA, 75 bp, Artificial Sequence
  Synthetic
ggcgcttggtgggcggttgcgtttaaagagtctacccctacagagagggcaatcacgtgtactttacataggcca

SEQ ID NO: 179543 - DNA, 75 bp, Artificial Sequence
  Synthetic
tacagggcgggatacgtggccgcgtgacgcttccatgcagacacgggtgattgcaaaacatgtccgtcggtttct

SEQ ID NO: 179544 - DNA, 75 bp, Artificial Sequence
  Synthetic
gacgcttccatgcagacacgggtgattgcaaaacatgtccgtcggtttctgagcccttcgaggcgaggggggcgt

SEQ ID NO: 179545 - DNA, 75 bp, Artificial Sequence
  Synthetic
atcacggcgaaaacgcacgcaacgggtacacaagatatattcaaggcaatcaccttgtggagttgcgcctgaaca

SEQ ID NO: 179546 - DNA, 75 bp, Artificial Sequence
  Synthetic
gtacacaagatatattcaaggcaatcaccttgtggagttgcgcctgaacaaatatcctttcgtatcgaatcagag

SEQ ID NO: 179547 - DNA, 75 bp, Artificial Sequence
  Synthetic
tgtctttttacaaactttactagtaacagctctgtgtttaagtaccagatcagggtcagaaccagaaataaattc

SEQ ID NO: 179548 - DNA, 75 bp, Artificial Sequence
  Synthetic
acagctctgtgtttaagtaccagatcagggtcagaaccagaaataaattcacagctcccaaggctgtatctgaca

SEQ ID NO: 179549 - DNA, 75 bp, Artificial Sequence
  Synthetic
actagcatttccagagccaatgtggccaggtacaggttaacgcagacgggtttccagtatgtcagcagggtgtct

SEQ ID NO: 179550 - DNA, 75 bp, Artificial Sequence
  Synthetic
ccaggtacaggttaacgcagacgggtttccagtatgtcagcagggtgtctaacatggtcttttctgggacgtgtt

SEQ ID NO: 179551 - DNA, 75 bp, Artificial Sequence
  Synthetic
tgaatatgggcaaatgaattgcaaaagtgggcacaatacacaaacgcggccaataggacgtgtttgtaggccagg

SEQ ID NO: 179552 - DNA, 75 bp, Artificial Sequence
  Synthetic
agtgggcacaatacacaaacgcggccaataggacgtgtttgtaggccaggacgtgaacaaaaagctgtaggctcc

SEQ ID NO: 179553 - DNA, 75 bp, Artificial Sequence
  Synthetic
atccatgactgcaggctcaccagggtcgtcgcgtgagcccgcttggcgcgatatatggcacaggccgcgagacag

SEQ ID NO: 179554 - DNA, 75 bp, Artificial Sequence
  Synthetic
tcgtcgcgtgagcccgcttggcgcgatatatggcacaggccgcgagacagtaatataccacagccaccccgtcaa

SEQ ID NO: 179555 - DNA, 75 bp, Artificial Sequence
  Synthetic
aatgttggggttaggtgtttggcagagtttctgacggtgagattcagagcgctgtaattgacaagattattgaaa

SEQ ID NO: 179556 - DNA, 75 bp, Artificial Sequence
  Synthetic
agtttctgacggtgagattcagagcgctgtaattgacaagattattgaaataacacggaaatcctaagccctcgt

SEQ ID NO: 179557 - DNA, 75 bp, Artificial Sequence
  Synthetic
agaatcaggagtttaatccaagacgtcaacaaaaagttatcgcttttggagagtttcatgtctgtgcttttattc

SEQ ID NO: 179558 - DNA, 75 bp, Artificial Sequence
  Synthetic
tcaacaaaaagttatcgcttttggagagtttcatgtctgtgcttttattccaataccggtagatggcgcaataga

SEQ ID NO: 179559 - DNA, 75 bp, Artificial Sequence
  Synthetic
ccagacttttaaatacacgttccggtcgcaaggcggcatcaggctaccatgcgagatgggctctatagagtatgt

SEQ ID NO: 179560 - DNA, 75 bp, Artificial Sequence
  Synthetic
tcgcaaggcggcatcaggctaccatgcgagatgggctctatagagtatgttactgatccgggaaaagtcttgggg

SEQ ID NO: 179561 - DNA, 75 bp, Artificial Sequence
  Synthetic
taactttctgcccgttgtcccagaggacggggagacgcaatactattttgtagtggcggacattgatgcaaccga

SEQ ID NO: 179562 - DNA, 75 bp, Artificial Sequence
  Synthetic
gacggggagacgcaatactattttgtagtggcggacattgatgcaaccgaggccgttccagatgtacaggcccaa

SEQ ID NO: 179563 - DNA, 75 bp, Artificial Sequence
  Synthetic
tatgcgtctaaaaaatcctcttctgcagaagcttgaaatgttgtctgctaatttggtgattttacgcgtcaccga

SEQ ID NO: 179564 - DNA, 75 bp, Artificial Sequence
  Synthetic
cagaagcttgaaatgttgtctgctaatttggtgattttacgcgtcaccgaagacaggatagtacgaggggcggag

SEQ ID NO: 179565 - DNA, 75 bp, Artificial Sequence
  Synthetic
ttgtgaggcatcgctcacgtaccagaacgcagctccgacattcgcacagtcgcgggaattctggcatgggaccat

SEQ ID NO: 179566 - DNA, 75 bp, Artificial Sequence
  Synthetic
aacgcagctccgacattcgcacagtcgcgggaattctggcatgggaccatatatcgagaagctcacgttagtgac

SEQ ID NO: 179567 - DNA, 75 bp, Artificial Sequence
  Synthetic
tgcgcgacccgtccctaagaaagaaaaggcccagttggcgatccacgatgtgtttgtgtgtaaagaataccgcgt

SEQ ID NO: 179568 - DNA, 75 bp, Artificial Sequence
  Synthetic
aaggcccagttggcgatccacgatgtgtttgtgtgtaaagaataccgcgtatctgtgcgcggggcgagcgtgctt

SEQ ID NO: 179569 - DNA, 75 bp, Artificial Sequence
  Synthetic
gtgtcagtggaacggggccctgccggagtttttccgcgcgcttcactgcaaactatttgttggccgccacggtgt

SEQ ID NO: 179570 - DNA, 75 bp, Artificial Sequence
  Synthetic
gagtttttccgcgcgcttcactgcaaactatttgttggccgccacggtgtaccgccaacgtggatgtatatattt

SEQ ID NO: 179571 - DNA, 75 bp, Artificial Sequence
  Synthetic
tccctgcctccccatacgttacgggacacccgcccgccttgacaaaacaaagccctggacgccgtccgacccgcg

SEQ ID NO: 179572 - DNA, 75 bp, Artificial Sequence
  Synthetic
acacccgcccgccttgacaaaacaaagccctggacgccgtccgacccgcggattctcttgcattttgatggtcta

SEQ ID NO: 179573 - DNA, 75 bp, Artificial Sequence
  Synthetic
gcctggagggatagatgccccgctggcgtggtcggccccgattaccgacgttaacatcggcatgtgtgagacgca

SEQ ID NO: 179574 - DNA, 75 bp, Artificial Sequence
  Synthetic
gcgtggtcggccccgattaccgacgttaacatcggcatgtgtgagacgcacgaacacaccgtagcgttacgggac

SEQ ID NO: 179575 - DNA, 75 bp, Artificial Sequence
  Synthetic
tttgtggggggctcgcctccattcggcacccttagatgtttgcttaaagctaggatctccacgcctgggcgcgac

SEQ ID NO: 179576 - DNA, 75 bp, Artificial Sequence
  Synthetic
gcacccttagatgtttgcttaaagctaggatctccacgcctgggcgcgacgatcatgggtgcatataatcgagcg

SEQ ID NO: 179577 - DNA, 75 bp, Artificial Sequence
  Synthetic
tatccataggtggcagatttttctaatcatagaattggcagtaagccaggtaagagcagccgcagagccagcggt

SEQ ID NO: 179578 - DNA, 75 bp, Artificial Sequence
  Synthetic
atcatagaattggcagtaagccaggtaagagcagccgcagagccagcggtgtctgtttctggacgggtgggaacc

SEQ ID NO: 179579 - DNA, 75 bp, Artificial Sequence
  Synthetic
gcactgggacccagaattcgcggacctttgcctggcctgtcatctggcgggattccccatcgagggaggggaggc

SEQ ID NO: 179580 - DNA, 75 bp, Artificial Sequence
  Synthetic
ctttgcctggcctgtcatctggcgggattccccatcgagggaggggaggctgccgcggtagaggtcgcgtctctt

SEQ ID NO: 179581 - DNA, 75 bp, Artificial Sequence
  Synthetic
gctggactctgcggtcgtagactgcatcggaccggatgcaacatgggtggacagcttggcgtggtgcgtcagtag

SEQ ID NO: 179582 - DNA, 75 bp, Artificial Sequence
  Synthetic
atcggaccggatgcaacatgggtggacagcttggcgtggtgcgtcagtaggctgctgctgcacccagagcgcacc

SEQ ID NO: 179583 - DNA, 75 bp, Artificial Sequence
  Synthetic
aagacaaacaaagttctggctcgttccacgagagctctgccgcactgagcctgtgtgcccgccccttcccgtaga

SEQ ID NO: 179584 - DNA, 75 bp, Artificial Sequence
  Synthetic
ccacgagagctctgccgcactgagcctgtgtgcccgccccttcccgtagactgtctagaaccaaggtggtttctt

SEQ ID NO: 179585 - DNA, 75 bp, Artificial Sequence
  Synthetic
aaatgtggactacgtgttctatttaggagaggttttgagggttctgttgtctgtggaagcgtcggcccatgcgac

SEQ ID NO: 179586 - DNA, 75 bp, Artificial Sequence
  Synthetic
ggagaggttttgagggttctgttgtctgtggaagcgtcggcccatgcgaccccagacgcgcaagaaacgacgctc

SEQ ID NO: 179587 - DNA, 75 bp, Artificial Sequence
  Synthetic
ctggatttttaaaaaggccacatatttttaagtgttttagaacatctctgttctccagatgctttgtaaacacgg

SEQ ID NO: 179588 - DNA, 75 bp, Artificial Sequence
  Synthetic
ttttaagtgttttagaacatctctgttctccagatgctttgtaaacacggtgtcacaataaaatatgttcatact

SEQ ID NO: 179589 - DNA, 75 bp, Artificial Sequence
  Synthetic
ggcgaaaggactctagatagatgggctttaggagaccccccatggggctctttcgatccccaaattccttataga

SEQ ID NO: 179590 - DNA, 75 bp, Artificial Sequence
  Synthetic
ctttaggagaccccccatggggctctttcgatccccaaattccttatagagcttgaacagcaacaaaggcgtcgc

SEQ ID NO: 179591 - DNA, 75 bp, Artificial Sequence
  Synthetic
ccagggtttcaatgccctgcataaaaaagtcagcatcggtcccctttgtcttctcgtgggttctccgggctcgcg

SEQ ID NO: 179592 - DNA, 75 bp, Artificial Sequence
  Synthetic
aaagtcagcatcggtcccctttgtcttctcgtgggttctccgggctcgcgctaggacggaccacaggtaggcggg

SEQ ID NO: 179593 - DNA, 75 bp, Artificial Sequence
  Synthetic
cggtaccctcagcattgggtttgaagagacaaacacgatctctgaatatatgggggtgtaagtcgatatgagtaa

SEQ ID NO: 179594 - DNA, 75 bp, Artificial Sequence
  Synthetic
gagacaaacacgatctctgaatatatgggggtgtaagtcgatatgagtaaccatatcctcgtgttcgacaagaca

SEQ ID NO: 179595 - DNA, 75 bp, Artificial Sequence
  Synthetic
ccttttcagcatgggggcgtttggatccggtagggcaccgggctgaaatttgggtcccagcagggataccaggtt

SEQ ID NO: 179596 - DNA, 75 bp, Artificial Sequence
  Synthetic
gggcgcttagttctcgtacatccagtcgaccgcctacgtccatacgtggggtgttgctcccgatgagaatattat

SEQ ID NO: 179597 - DNA, 75 bp, Artificial Sequence
  Synthetic
tcgaccgcctacgtccatacgtggggtgttgctcccgatgagaatattatctttgcggtggacttccaggatcat

SEQ ID NO: 179598 - DNA, 75 bp, Artificial Sequence
  Synthetic
cggacgcctgtgcgctaggtgcggttcccgtcaatctcgccagtgctttctccagcgccattttcctgctgtcgc

SEQ ID NO: 179599 - DNA, 75 bp, Artificial Sequence
  Synthetic
tcccgtcaatctcgccagtgctttctccagcgccattttcctgctgtcgcgtatccatgcaatatttctgaccca

SEQ ID NO: 179600 - DNA, 75 bp, Artificial Sequence
  Synthetic
atatcctgtaaacttgttgaaacaaaggagtggctgatgagttccatctctggcatgttcccaatcatgtacgta

SEQ ID NO: 179601 - DNA, 75 bp, Artificial Sequence
  Synthetic
aggagtggctgatgagttccatctctggcatgttcccaatcatgtacgtaaacggacccagcagaatagaaattg

SEQ ID NO: 179602 - DNA, 75 bp, Artificial Sequence
  Synthetic
ggaacaagcttgtatgtttgaaataattcactttcccacaggtttgtgagatcctttgtaagttctctgaagggg

SEQ ID NO: 179603 - DNA, 75 bp, Artificial Sequence
  Synthetic
attcactttcccacaggtttgtgagatcctttgtaagttctctgaaggggggcacgtaggaggaaaaaaaactat

SEQ ID NO: 179604 - DNA, 75 bp, Artificial Sequence
  Synthetic
ggatcctgtagccgacccagagattggaaagtgttagctgtcagcagattcacctccgccgctggacgggaatcc

SEQ ID NO: 179605 - DNA, 75 bp, Artificial Sequence
  Synthetic
ggaaagtgttagctgtcagcagattcacctccgccgctggacgggaatcctgctgggaggctgctgccaattgag

SEQ ID NO: 179606 - DNA, 75 bp, Artificial Sequence
  Synthetic
ttcgatatggtgtcgaactgttcgttaatttgatttgtcaggcacttaaacacggtgttagaaacctgacgcctc

SEQ ID NO: 179607 - DNA, 75 bp, Artificial Sequence
  Synthetic
taatttgatttgtcaggcacttaaacacggtgttagaaacctgacgcctcaggccctgtgttgtggtttcaggac

SEQ ID NO: 179608 - DNA, 75 bp, Artificial Sequence
  Synthetic
acaaaattttcaaccacgtcagtaactccgctcactgtcttgttctccgccagcttcaccaggaggttcaacagt

SEQ ID NO: 179609 - DNA, 75 bp, Artificial Sequence
  Synthetic
ctccgctcactgtcttgttctccgccagcttcaccaggaggttcaacagttctttttttggatcattcttttgcg

SEQ ID NO: 179610 - DNA, 75 bp, Artificial Sequence
  Synthetic
cttccgaccagggctttggtcggggcagtgttcaaaagttggcaaagctttgcgtgctcggcggtcctgtggcac

SEQ ID NO: 179611 - DNA, 75 bp, Artificial Sequence
  Synthetic
cagtgttcaaaagttggcaaagctttgcgtgctcggcggtcctgtggcacgtcatgacagtgttatacagtcgtt

SEQ ID NO: 179612 - DNA, 75 bp, Artificial Sequence
  Synthetic
ataatctcaacatgaacctttttttgtttgtatgaggcagtgaagacgttccgctctgggtcgtattctatgtta

SEQ ID NO: 179613 - DNA, 75 bp, Artificial Sequence
  Synthetic
gtttgtatgaggcagtgaagacgttccgctctgggtcgtattctatgttaacctccgcgtagctggggatgtaaa

SEQ ID NO: 179614 - DNA, 75 bp, Artificial Sequence
  Synthetic
atgacctgaccgatggtcttttctccggacgcggctcgcttgcaactcaggacgagctgctcatggatagaatca

SEQ ID NO: 179615 - DNA, 75 bp, Artificial Sequence
  Synthetic
cggacgcggctcgcttgcaactcaggacgagctgctcatggatagaatcaaccagtttttggtccggaccatggg

SEQ ID NO: 179616 - DNA, 75 bp, Artificial Sequence
  Synthetic
tagaatagggacgtcttggcgtaaagcacacgattgattgcgttcaacagaagctggtccagggtgatacgcatg

SEQ ID NO: 179617 - DNA, 75 bp, Artificial Sequence
  Synthetic
gcacacgattgattgcgttcaacagaagctggtccagggtgatacgcatggtgtgagcccaggagtcaaacgtgg

SEQ ID NO: 179618 - DNA, 75 bp, Artificial Sequence
  Synthetic
atggacgcctcgtatgtccgccagtccgtcagcacgttatcgtaggtacacccacttagggctgtcttgtacagg

SEQ ID NO: 179619 - DNA, 75 bp, Artificial Sequence
  Synthetic
ccgtcagcacgttatcgtaggtacacccacttagggctgtcttgtacaggtgaatgaatacctgcctaaaaaata

SEQ ID NO: 179620 - DNA, 75 bp, Artificial Sequence
  Synthetic
tattttccttgcagaatctcaaaaagtgcaatggatgcggtcgatggatgtacgactatggtggaggcgtgtcct

SEQ ID NO: 179621 - DNA, 75 bp, Artificial Sequence
  Synthetic
gtgcaatggatgcggtcgatggatgtacgactatggtggaggcgtgtcctggattcatcctgaacatgacctctg

SEQ ID NO: 179622 - DNA, 75 bp, Artificial Sequence
  Synthetic
acggcgccaccgccggagatgggatggtacgatttggaatttgatcccctggaggacgagggaccatttttgcct

SEQ ID NO: 179623 - DNA, 75 bp, Artificial Sequence
  Synthetic
ggtacgatttggaatttgatcccctggaggacgagggaccatttttgcctttctcggcatatgtaattacaggca

SEQ ID NO: 179624 - DNA, 75 bp, Artificial Sequence
  Synthetic
aattgtctcgtcacgggagctaccacagtggcatctcagaatctctcccggtgtctgaagacctattgtcccacc

SEQ ID NO: 179625 - DNA, 75 bp, Artificial Sequence
  Synthetic
cagtggcatctcagaatctctcccggtgtctgaagacctattgtcccaccatctatcatgcgtttggctttaaaa

SEQ ID NO: 179626 - DNA, 75 bp, Artificial Sequence
  Synthetic
tcggtggaacagattcagagacaggaacttgccaagtactggcccattattgttgatattatgagagaatgtatg

SEQ ID NO: 179627 - DNA, 75 bp, Artificial Sequence
  Synthetic
aacttgccaagtactggcccattattgttgatattatgagagaatgtatgtctaaaaagcaaaagggccagtacg

SEQ ID NO: 179628 - DNA, 75 bp, Artificial Sequence
  Synthetic
ctgccatagggcaaaacattaaatcatggttggggatcggagaatcatcggcgactgctgtccccgtcaccacgc

SEQ ID NO: 179629 - DNA, 75 bp, Artificial Sequence
  Synthetic
aacatgtggaccagtaatattattcttatagacgaggctggaacgctttcgtcacatatattgactgcagtggtg

SEQ ID NO: 179630 - DNA, 75 bp, Artificial Sequence
  Synthetic
ttatagacgaggctggaacgctttcgtcacatatattgactgcagtggtgttcttttactggttctacaatagct

SEQ ID NO: 179631 - DNA, 75 bp, Artificial Sequence
  Synthetic
gtgggctctcctacgcagacggacgcgtttcaatccgtctacaaccacgcacaacagcggtccgagatttctgcc

SEQ ID NO: 179632 - DNA, 75 bp, Artificial Sequence
  Synthetic
cgtttcaatccgtctacaaccacgcacaacagcggtccgagatttctgcctgtgataacgtccttacgtttctca

SEQ ID NO: 179633 - DNA, 75 bp, Artificial Sequence
  Synthetic
ctgttcattaacaataaaagatgtatagatcctcagtttggacacctgctaaaaacgctggagtataatttagac

SEQ ID NO: 179634 - DNA, 75 bp, Artificial Sequence
  Synthetic
tagatcctcagtttggacacctgctaaaaacgctggagtataatttagacatctcgccagaacttatggcgtata

SEQ ID NO: 179635 - DNA, 75 bp, Artificial Sequence
  Synthetic
gtaggatggacacgattatttctgtctcaccaggaggtgaagaattttttgagtatgcttcacgcctgcctaatg

SEQ ID NO: 179636 - DNA, 75 bp, Artificial Sequence
  Synthetic
ctcaccaggaggtgaagaattttttgagtatgcttcacgcctgcctaatggcacagaccgggactcaaggtgcca

SEQ ID NO: 179637 - DNA, 75 bp, Artificial Sequence
  Synthetic
gagtataagcgagcggtgggtatatctcacctcactcctctggaatgggtgtcaaaaaatctctttagactgagt

SEQ ID NO: 179638 - DNA, 75 bp, Artificial Sequence
  Synthetic
ctcacctcactcctctggaatgggtgtcaaaaaatctctttagactgagtaattattcacagtttgtagaccagg

SEQ ID NO: 179639 - DNA, 75 bp, Artificial Sequence
  Synthetic
tttgcttccaagtttgtgaagcacagctacgcgtcccttaacgggaagacaaaaaaatgtatatgtgggtatcat

SEQ ID NO: 179640 - DNA, 75 bp, Artificial Sequence
  Synthetic
gctacgcgtcccttaacgggaagacaaaaaaatgtatatgtgggtatcatggttcttaccaagatttcaaaaagg

SEQ ID NO: 179641 - DNA, 75 bp, Artificial Sequence
  Synthetic
tatgtatattactttttgagtaccctcctctataatgctatgtattcgttttatgtttatggtcgtgagcgttcc

SEQ ID NO: 179642 - DNA, 75 bp, Artificial Sequence
  Synthetic
tcctctataatgctatgtattcgttttatgtttatggtcgtgagcgttcctgtgaagcgtatctggccgaattaa

SEQ ID NO: 179643 - DNA, 75 bp, Artificial Sequence
  Synthetic
actgaagagacggaggacaactctgtgatgacagatacgttttatctttttgccgcgcctccgcctaccgtctcg

SEQ ID NO: 179644 - DNA, 75 bp, Artificial Sequence
  Synthetic
tgatgacagatacgttttatctttttgccgcgcctccgcctaccgtctcgaatgcttccctaccgaccctggtta

SEQ ID NO: 179645 - DNA, 75 bp, Artificial Sequence
  Synthetic
attaagcattttggacccgacgtagctgtagctgaattctccacatttaccgttaacattgtagtgcgtgacggt

SEQ ID NO: 179646 - DNA, 75 bp, Artificial Sequence
  Synthetic
ctgtagctgaattctccacatttaccgttaacattgtagtgcgtgacggtgtcgattttgtatccacttcgccta

SEQ ID NO: 179647 - DNA, 75 bp, Artificial Sequence
  Synthetic
cagggatacacctttgtgcctgtaaaatttgggcgaagtggatgtcagagtctgagtgatgacctacggaaaaag

SEQ ID NO: 179648 - DNA, 75 bp, Artificial Sequence
  Synthetic
aatttgggcgaagtggatgtcagagtctgagtgatgacctacggaaaaagatgccgtccctggtggttcaggacg

SEQ ID NO: 179649 - DNA, 75 bp, Artificial Sequence
  Synthetic
accctagacgggggtcaggtgtttcacgtttgttctgcgggggattatggagtcagttctaacctcgccatgacg

SEQ ID NO: 179650 - DNA, 75 bp, Artificial Sequence
  Synthetic
acgtttgttctgcgggggattatggagtcagttctaacctcgccatgacggtagtaaaggcacagggcgtttctc

SEQ ID NO: 179651 - DNA, 75 bp, Artificial Sequence
  Synthetic
cacgtctatgtggccatctccagagccatggacgccaggtaccttgtgatggatagtaaccccttaaaactaatg

SEQ ID NO: 179652 - DNA, 75 bp, Artificial Sequence
  Synthetic
ccatggacgccaggtaccttgtgatggatagtaaccccttaaaactaatggagcggggcgatgagcagtcacccg

SEQ ID NO: 179653 - DNA, 75 bp, Artificial Sequence
  Synthetic
tactgatggttgcccaaataaacacaataaatacttttttatattgcaaacatattcgtctttattggttaatca

SEQ ID NO: 179654 - DNA, 75 bp, Artificial Sequence
  Synthetic
aataaatacttttttatattgcaaacatattcgtctttattggttaatcaagccagggccagttgtaattcccgt

SEQ ID NO: 179655 - DNA, 75 bp, Artificial Sequence
  Synthetic
cctgaggatgagtcgctgcttctggacgagagggacgtagcggacgtactttcatcgtctaaattctccggtagg

SEQ ID NO: 179656 - DNA, 75 bp, Artificial Sequence
  Synthetic
acgagagggacgtagcggacgtactttcatcgtctaaattctccggtaggcgctgagcggcgtcggcctgaccag

SEQ ID NO: 179657 - DNA, 75 bp, Artificial Sequence
  Synthetic
tctgacgatatgatgattatggacgtatgacctgatgaccacagacggcggcgactgggtcgccccgatgcctcg

SEQ ID NO: 179658 - DNA, 75 bp, Artificial Sequence
  Synthetic
tatgacctgatgaccacagacggcggcgactgggtcgccccgatgcctcgctggccgacgatgccgtgctttgtc

SEQ ID NO: 179659 - DNA, 75 bp, Artificial Sequence
  Synthetic
ccttcgtcggccgatagtgtctcttccgatgagtgtccgtgagtcccctcggttggcgattcgctgtctgagtcc

SEQ ID NO: 179660 - DNA, 75 bp, Artificial Sequence
  Synthetic
ccgatgagtgtccgtgagtcccctcggttggcgattcgctgtctgagtccgacaataggtcgatggttgcgacta

SEQ ID NO: 179661 - DNA, 75 bp, Artificial Sequence
  Synthetic
aaatgggccccttccgaggtggagtcacgggtgactgacgattcgctcagaaaagtatctgtcgtttcgccgtca

SEQ ID NO: 179662 - DNA, 75 bp, Artificial Sequence
  Synthetic
cacgggtgactgacgattcgctcagaaaagtatctgtcgtttcgccgtcagagaaagactcgccgggagaaaatc

SEQ ID NO: 179663 - DNA, 75 bp, Artificial Sequence
  Synthetic
gagcgaaggggactccgaacgtggcccgtaacaacggcaactggaactgttctgcgcaccgtggacgccagaggg

SEQ ID NO: 179664 - DNA, 75 bp, Artificial Sequence
  Synthetic
ccgtaacaacggcaactggaactgttctgcgcaccgtggacgccagagggcgccccctgtctccagcgagaggag

SEQ ID NO: 179665 - DNA, 75 bp, Artificial Sequence
  Synthetic
atacctagtgccctgtcatcggccggtcccggggatggtaagaggtccagtggcgttgccggtggcgacgtgtcg

SEQ ID NO: 179666 - DNA, 75 bp, Artificial Sequence
  Synthetic
gtcccggggatggtaagaggtccagtggcgttgccggtggcgacgtgtcgtcctctgcaaacacatcgtctgggg

SEQ ID NO: 179667 - DNA, 75 bp, Artificial Sequence
  Synthetic
ggaggaaatataaacctccttggggggacgcgacgcggtgcgccctcgtacggaaatagtcggtcgtcgtccatg

SEQ ID NO: 179668 - DNA, 75 bp, Artificial Sequence
  Synthetic
ggacgcgacgcggtgcgccctcgtacggaaatagtcggtcgtcgtccatggggggcggggagtcgtccaaaaaca

SEQ ID NO: 179669 - DNA, 75 bp, Artificial Sequence
  Synthetic
aggcgtgcacgttccagtcaatggatgcccgcccgtgccgtgtcaaatactcattggcgatgttaaagtgattgc

SEQ ID NO: 179670 - DNA, 75 bp, Artificial Sequence
  Synthetic
tgcccgcccgtgccgtgtcaaatactcattggcgatgttaaagtgattgcatccgagaaacctcggtatcttgga

SEQ ID NO: 179671 - DNA, 75 bp, Artificial Sequence
  Synthetic
ccaggtgcttctgaccgtcaacgaggggggcacgatcaattgcccgcttaccccaaagcagaaaaacgcagtggc

SEQ ID NO: 179672 - DNA, 75 bp, Artificial Sequence
  Synthetic
gggggcacgatcaattgcccgcttaccccaaagcagaaaaacgcagtggcataacctggaggagacactgctgat

SEQ ID NO: 179673 - DNA, 75 bp, Artificial Sequence
  Synthetic
ttcccttctctaccgtgagaatagtgttcaacaaaagcaccccctgtcgcgcccacccatctagacacccgtggc

SEQ ID NO: 179674 - DNA, 75 bp, Artificial Sequence
  Synthetic
gttcaacaaaagcaccccctgtcgcgcccacccatctagacacccgtggctaggtgtagtaaaggagggcacgga

SEQ ID NO: 179675 - DNA, 75 bp, Artificial Sequence
  Synthetic
gacggtctacgctaaatgccagtccggtggcctggccggaataatagggatcctgtccaaggatcacaactttga

SEQ ID NO: 179676 - DNA, 75 bp, Artificial Sequence
  Synthetic
ggtggcctggccggaataatagggatcctgtccaaggatcacaactttgatgtcttccgggtcacagcagtacga

SEQ ID NO: 179677 - DNA, 75 bp, Artificial Sequence
  Synthetic
gttcctggatgtggtgcaaaagtaggtgaagtttacgccgcaggaacggagagaggtctaggaattctgtccatg

SEQ ID NO: 179678 - DNA, 75 bp, Artificial Sequence
  Synthetic
gtgaagtttacgccgcaggaacggagagaggtctaggaattctgtccatgtgtgggctagcggcaattctcggtc

SEQ ID NO: 179679 - DNA, 75 bp, Artificial Sequence
  Synthetic
gccactcttccatggacaaatatgcgagtcctggcccttgtttgtttctcggcgagcacgcccagtacggagctg

SEQ ID NO: 179680 - DNA, 75 bp, Artificial Sequence
  Synthetic
gagtcctggcccttgtttgtttctcggcgagcacgcccagtacggagctgttggcggttgaagcgtttagtgtag

SEQ ID NO: 179681 - DNA, 75 bp, Artificial Sequence
  Synthetic
tccggcgttgcgcgcgagccgattcgccgtaataaagctcccaaaaatgagcgtattgcaaacccgttcacgcac

SEQ ID NO: 179682 - DNA, 75 bp, Artificial Sequence
  Synthetic
gccgtaataaagctcccaaaaatgagcgtattgcaaacccgttcacgcacgtctctgtagtgactgacccgtttc

SEQ ID NO: 179683 - DNA, 75 bp, Artificial Sequence
  Synthetic
aggtgaattgaggacactgaaaaaatagaaggaatgctgcgttctggaagctgatagattgcacaacacggcatg

SEQ ID NO: 179684 - DNA, 75 bp, Artificial Sequence
  Synthetic
tagaaggaatgctgcgttctggaagctgatagattgcacaacacggcatgggaagcacggggcagtgtgcaccta

SEQ ID NO: 179685 - DNA, 75 bp, Artificial Sequence
  Synthetic
atttcagcagcagttagacgcaaactaagggatactcaatttacacccgccatctgggcacagtgccataactta

SEQ ID NO: 179686 - DNA, 75 bp, Artificial Sequence
  Synthetic
taagggatactcaatttacacccgccatctgggcacagtgccataacttatatagttatggcactgtgcttgccc

SEQ ID NO: 179687 - DNA, 75 bp, Artificial Sequence
  Synthetic
gatttgtgtgcgcactgctatacttagttgggcgcggttgcgttccacagatacagagtgtccgtttctatgcct

SEQ ID NO: 179688 - DNA, 75 bp, Artificial Sequence
  Synthetic
agttgggcgcggttgcgttccacagatacagagtgtccgtttctatgccttagggaaatggaattggataaaact

SEQ ID NO: 179689 - DNA, 75 bp, Artificial Sequence
  Synthetic
aggtcagtacagttagcgttagtcactagctttaagttgtttgtcacactttcgaggatatgtggtgtggcataa

SEQ ID NO: 179690 - DNA, 75 bp, Artificial Sequence
  Synthetic
ctagctttaagttgtttgtcacactttcgaggatatgtggtgtggcataaaccctggaaattccattcactcggt

SEQ ID NO: 179691 - DNA, 75 bp, Artificial Sequence
  Synthetic
ctgaaggttctgagtcagggctgctccatgaatcatcagataggtctgaaccgccggccgcaaattcgacttcgg

SEQ ID NO: 179692 - DNA, 75 bp, Artificial Sequence
  Synthetic
ccatgaatcatcagataggtctgaaccgccggccgcaaattcgacttcggaatcaccctcggcctcctcgaaagt

SEQ ID NO: 179693 - DNA, 75 bp, Artificial Sequence
  Synthetic
ccgtggccgtatcatgtaacacgcgactgggaaccgccttcgagggaccagtggtgtcccggctgctcggtaagg

SEQ ID NO: 179694 - DNA, 75 bp, Artificial Sequence
  Synthetic
actgggaaccgccttcgagggaccagtggtgtcccggctgctcggtaaggacgaaaagtcaaaagaatttccggc

SEQ ID NO: 179695 - DNA, 75 bp, Artificial Sequence
  Synthetic
gcgcctccgtgtggcatttggatactatacattcaatcgccgagatttgaatgcctactaggtctatgcgaaaaa

SEQ ID NO: 179696 - DNA, 75 bp, Artificial Sequence
  Synthetic
tatacattcaatcgccgagatttgaatgcctactaggtctatgcgaaaaacatgcctgtcctctggaaaacctgc

SEQ ID NO: 179697 - DNA, 75 bp, Artificial Sequence
  Synthetic
acccaaacgctgcacatagccgacagattagacgttccaacgctcgggcatcatgtactaggaacgatgttagaa

SEQ ID NO: 179698 - DNA, 75 bp, Artificial Sequence
  Synthetic
gattagacgttccaacgctcgggcatcatgtactaggaacgatgttagaattctatacaaccaacatacgtttag

SEQ ID NO: 179699 - DNA, 75 bp, Artificial Sequence
  Synthetic
caaaccgcctaacatcgtggagtaagtctggaatagaaaattctgataccgcaggttgctttccgaccatagcaa

SEQ ID NO: 179700 - DNA, 75 bp, Artificial Sequence
  Synthetic
gtctggaatagaaaattctgataccgcaggttgctttccgaccatagcaagaattctgctgtagtttagcgtttg

SEQ ID NO: 179701 - DNA, 75 bp, Artificial Sequence
  Synthetic
tcacggcggccgcggccagctcgttggtcgctgtcaagcatcgttcacaaccacacccttcttcgagaattacga

SEQ ID NO: 179702 - DNA, 75 bp, Artificial Sequence
  Synthetic
ggtcgctgtcaagcatcgttcacaaccacacccttcttcgagaattacgatgagtctggttttgcagtcgtccca

SEQ ID NO: 179703 - DNA, 75 bp, Artificial Sequence
  Synthetic
gctcctgtgctgcgaaacgtaggctctggattgtagggattagctcaatttgtgaaccgagactgctcggttgaa

SEQ ID NO: 179704 - DNA, 75 bp, Artificial Sequence
  Synthetic
ctggattgtagggattagctcaatttgtgaaccgagactgctcggttgaaccatggtctgtttcagagcgaccac

SEQ ID NO: 179705 - DNA, 75 bp, Artificial Sequence
  Synthetic
tcctttgagctaccatcactccacccgtctcactaaatgcacgtattaagtctacccacgtatcccacttttcat

SEQ ID NO: 179706 - DNA, 75 bp, Artificial Sequence
  Synthetic
cgtctcactaaatgcacgtattaagtctacccacgtatcccacttttcatcggctagacctggaacggggatact

SEQ ID NO: 179707 - DNA, 75 bp, Artificial Sequence
  Synthetic
cgctctccacctggctcgctaaataacaggccccggggcacatgtaaaccacgcccccgagtgcggaggaggggt

SEQ ID NO: 179708 - DNA, 75 bp, Artificial Sequence
  Synthetic
acaggccccggggcacatgtaaaccacgcccccgagtgcggaggaggggtttctgacacctcccctttaaaagac

SEQ ID NO: 179709 - DNA, 75 bp, Artificial Sequence
  Synthetic
aaatggaggccgaagacaaggtaaatattatatagtcatttattctaagtgaaacaatgagtgcttgcagtggtg

SEQ ID NO: 179710 - DNA, 75 bp, Artificial Sequence
  Synthetic
tattatatagtcatttattctaagtgaaacaatgagtgcttgcagtggtgcaggtgggaacatatttcccccagc

SEQ ID NO: 179711 - DNA, 75 bp, Artificial Sequence
  Synthetic
cttcaccagggcctcggaccccaaatttggatcattttgatcgtaccaggcaaaaaactctctagctgtctgttt

SEQ ID NO: 179712 - DNA, 75 bp, Artificial Sequence
  Synthetic
tttggatcattttgatcgtaccaggcaaaaaactctctagctgtctgttttagaaggttgagggccgttcccagg

SEQ ID NO: 179713 - DNA, 75 bp, Artificial Sequence
  Synthetic
ggcggaccatagcagacaaaggttgaattggacgttaaattcagtgtcctgataatcttcgtaaattacattttc

SEQ ID NO: 179714 - DNA, 75 bp, Artificial Sequence
  Synthetic
aattggacgttaaattcagtgtcctgataatcttcgtaaattacattttccaccaagtacaccctctttacaata

SEQ ID NO: 179715 - DNA, 75 bp, Artificial Sequence
  Synthetic
gcagtcttttatctcctgctttatcctgtttgatataccaaccatgtgtgccacgcaccacgcaacatacttcgc

SEQ ID NO: 179716 - DNA, 75 bp, Artificial Sequence
  Synthetic
ctgtttgatataccaaccatgtgtgccacgcaccacgcaacatacttcgccgcggggtccggggcgttagtgggg

SEQ ID NO: 179717 - DNA, 75 bp, Artificial Sequence
  Synthetic
ctcgttctgaatgccgatacagcaggcatccactaggggcagaattccattaatcacgccgcgtatcttatcgca

SEQ ID NO: 179718 - DNA, 75 bp, Artificial Sequence
  Synthetic
gcatccactaggggcagaattccattaatcacgccgcgtatcttatcgcaactgagtttatgcagtcgattgaga

SEQ ID NO: 179719 - DNA, 75 bp, Artificial Sequence
  Synthetic
tcggtgttggaccaatatctggagcgtcttggccagatacagagccttctcgacatgtaaggccggcaggcaaaa

SEQ ID NO: 179720 - DNA, 75 bp, Artificial Sequence
  Synthetic
gtcttggccagatacagagccttctcgacatgtaaggccggcaggcaaaaatccgggttatgtgtggtgacagat

SEQ ID NO: 179721 - DNA, 75 bp, Artificial Sequence
  Synthetic
agtgggcgtggcaatggcttgctatatccaccccggtaaggcagccagccaggcaccatacagcttctacgactg

SEQ ID NO: 179722 - DNA, 75 bp, Artificial Sequence
  Synthetic
gaataggtggttgaaaaggtgatccttgaggggccgaggagggttcattatggatcctaatcagcgtctgttatc

SEQ ID NO: 179723 - DNA, 75 bp, Artificial Sequence
  Synthetic
ttgaggggccgaggagggttcattatggatcctaatcagcgtctgttatctcgtccacaggggaagagactccga

SEQ ID NO: 179724 - DNA, 75 bp, Artificial Sequence
  Synthetic
actgtataagtgcgtgctgctaattagtgaggcgtataccaagatatacgacccatgtgacgtgaaccgagtggt

SEQ ID NO: 179725 - DNA, 75 bp, Artificial Sequence
  Synthetic
agtgaggcgtataccaagatatacgacccatgtgacgtgaaccgagtggtgcatgatgcttgcgttcgcatcatg

SEQ ID NO: 179726 - DNA, 75 bp, Artificial Sequence
  Synthetic
tctgtttaacctattttgtttctttcgttccacccgtatgaggaccaagtgcgctgcgaccttcaatgtgccctg

SEQ ID NO: 179727 - DNA, 75 bp, Artificial Sequence
  Synthetic
cgttccacccgtatgaggaccaagtgcgctgcgaccttcaatgtgccctgtgccgaggcggcccagggtatcatt

SEQ ID NO: 179728 - DNA, 75 bp, Artificial Sequence
  Synthetic
agccgcctgtagcggggtgtcactgcctccaagtctgtgtatgattttatatgagatatacgcagaaatgaagaa

SEQ ID NO: 179729 - DNA, 75 bp, Artificial Sequence
  Synthetic
cctccaagtctgtgtatgattttatatgagatatacgcagaaatgaagaataaatgcataggggcctggcgacgg

SEQ ID NO: 179730 - DNA, 75 bp, Artificial Sequence
  Synthetic
actgtaccagtcccacgatggtgctggcctcatcagtgatcagatgaaagcgctgtttctcctggtgtttcagcc

SEQ ID NO: 179731 - DNA, 75 bp, Artificial Sequence
  Synthetic
ggcctcatcagtgatcagatgaaagcgctgtttctcctggtgtttcagcccgtgtatcttcctagaattatgaca

SEQ ID NO: 179732 - DNA, 75 bp, Artificial Sequence
  Synthetic
catcacgggctcggctgagaagcgccgtcccatgaccaccgggagagtatccactctgggattcccgggtagcaa

SEQ ID NO: 179733 - DNA, 75 bp, Artificial Sequence
  Synthetic
tacgccagctacgttgtcaggggtgccaaccttgtcaccgccgttagctacggaagggctatgagaaactttgaa

SEQ ID NO: 179734 - DNA, 75 bp, Artificial Sequence
  Synthetic
cgtcccatgaccaccgggagagtatccactctgggattcccgggtagcaacataatccctgagtctttgatattg

SEQ ID NO: 179735 - DNA, 75 bp, Artificial Sequence
  Synthetic
tgtcttggccagacctggaccaatcctgaacgcgccacctcttagccagtttgtcatatctaggcctcacccgag

SEQ ID NO: 179736 - DNA, 75 bp, Artificial Sequence
  Synthetic
ctgaacgcgccacctcttagccagtttgtcatatctaggcctcacccgagcctgccacattccatcagtgtcgtc

SEQ ID NO: 179737 - DNA, 75 bp, Artificial Sequence
  Synthetic
ggcatctcaaacgacgggcgagtccccgatggaactgaatacgggagggcagcctacccaaccagcctcgacagc

SEQ ID NO: 179738 - DNA, 75 bp, Artificial Sequence
  Synthetic
cccgctactcgacatccgtctcagtcaggggagtagaatccccggccatccagtcgaccgagacgtgggtggtta

SEQ ID NO: 179739 - DNA, 75 bp, Artificial Sequence
  Synthetic
ccgatggaactgaatacgggagggcagcctacccaaccagcctcgacagcccttcgggcgtcggagagttcggtt

SEQ ID NO: 179740 - DNA, 75 bp, Artificial Sequence
  Synthetic
tgccgacgcggtggcgggaagcaacatcctgcctccggccgccgttgccgcatgtttcgtgcccgctccggcgat

SEQ ID NO: 179741 - DNA, 75 bp, Artificial Sequence
  Synthetic
atcctgcctccggccgccgttgccgcatgtttcgtgcccgctccggcgatgggcacctcaggaacacccttgccc

SEQ ID NO: 179742 - DNA, 75 bp, Artificial Sequence
  Synthetic
gcggtttcagccaacgccgtgccttacattattgcaggtcacgtgcgcgacaccaacgggacctatgccggacac

SEQ ID NO: 179743 - DNA, 75 bp, Artificial Sequence
  Synthetic
acattattgcaggtcacgtgcgcgacaccaacgggacctatgccggacactaaagtgcgtgcccccgtcgcccag

SEQ ID NO: 179744 - DNA, 75 bp, Artificial Sequence
  Synthetic
gacatcagaggacacaggggggcgcgttagcaacggcgggcaggccagtgatgaagaggtccggatcaacgatgc

SEQ ID NO: 179745 - DNA, 75 bp, Artificial Sequence
  Synthetic
gttagcaacggcgggcaggccagtgatgaagaggtccggatcaacgatgcgcagttgacgccaaagcgcaagcag

SEQ ID NO: 179746 - DNA, 75 bp, Artificial Sequence
  Synthetic
tacgtctcctggaaggttagatgccgaggtacctacgacgagcgccgccggatacaccgccactaccccctccgg

SEQ ID NO: 179747 - DNA, 75 bp, Artificial Sequence
  Synthetic
gaggtacctacgacgagcgccgccggatacaccgccactaccccctccggagaggatgcatctcctcctgacgtg

SEQ ID NO: 179748 - DNA, 75 bp, Artificial Sequence
  Synthetic
ggatgccggatccccgtccttgcctgcggatgacgagctcctatctacaattctgcagggcttgtatcaactaga

SEQ ID NO: 179749 - DNA, 75 bp, Artificial Sequence
  Synthetic
gcggatgacgagctcctatctacaattctgcagggcttgtatcaactagacgaacccccgccggtgcgatcaccg

SEQ ID NO: 179750 - DNA, 75 bp, Artificial Sequence
  Synthetic
tcggcgagctttttaaggcagctagtctcattaaatcctattaacccgcagtgatcagtatcgttgatggctggt

SEQ ID NO: 179751 - DNA, 75 bp, Artificial Sequence
  Synthetic
aagcgaacgcctgacgacactacagccagtgtccgccgagccgcccccaggcggtgatcaagacaacagcgccct

SEQ ID NO: 179752 - DNA, 75 bp, Artificial Sequence
  Synthetic
ccagtgtccgccgagccgcccccaggcggtgatcaagacaacagcgccctcgctcagttgcttcagtggcgcaac

SEQ ID NO: 179753 - DNA, 75 bp, Artificial Sequence
  Synthetic
gtcggcagctgacgcggagagtatttttagacagagaaataaatgtcaacttgaccaacaagtatcggactataa

SEQ ID NO: 179754 - DNA, 75 bp, Artificial Sequence
  Synthetic
tttagacagagaaataaatgtcaacttgaccaacaagtatcggactataataactattttcccagccgtgcatcc

SEQ ID NO: 179755 - DNA, 75 bp, Artificial Sequence
  Synthetic
ccacaacttgaaccagcacatggctgctaacgcggcatacactagccggtggtgcccgagcgggagttacgaagt

SEQ ID NO: 179756 - DNA, 75 bp, Artificial Sequence
  Synthetic
taaggctaccgagaacactttacggttgcggacagctttgagtgttgtgctatggaagataacgataaacgcggc

SEQ ID NO: 179757 - DNA, 75 bp, Artificial Sequence
  Synthetic
ttgcggacagctttgagtgttgtgctatggaagataacgataaacgcggctccccgcaaggagccgcccatgacg

SEQ ID NO: 179758 - DNA, 75 bp, Artificial Sequence
  Synthetic
ttttctgacggggctgacagccaggaggtttcaacccagtggcggaccttggcgttagccccgtatgctgagctg

SEQ ID NO: 179759 - DNA, 75 bp, Artificial Sequence
  Synthetic
aggtttcaacccagtggcggaccttggcgttagccccgtatgctgagctggagaccccggctgttcccgtgtgtg

SEQ ID NO: 179760 - DNA, 75 bp, Artificial Sequence
  Synthetic
aacttgagttctcatcgggcgagcgggtcaaatcctgatgggggcgtggcgggctatcagagggttactgacagg

SEQ ID NO: 179761 - DNA, 75 bp, Artificial Sequence
  Synthetic
ggtcaaatcctgatgggggcgtggcgggctatcagagggttactgacaggtctgccgggtcgcaaggagcacacg

SEQ ID NO: 179762 - DNA, 75 bp, Artificial Sequence
  Synthetic
tatttttatgaaactgttgtcggttccaagcgcacgggagcacccacccccaaggtagagacgcggaacgaacgg

SEQ ID NO: 179763 - DNA, 75 bp, Artificial Sequence
  Synthetic
ccaagcgcacgggagcacccacccccaaggtagagacgcggaacgaacggcgggttgggtctgtcttggaaccga

SEQ ID NO: 179764 - DNA, 75 bp, Artificial Sequence
  Synthetic
gagcgaccccaactatcgcatcagaagccaggcaggcacacgagaacttcggccaaggttcacctgagacagctg

SEQ ID NO: 179765 - DNA, 75 bp, Artificial Sequence
  Synthetic
agccaggcaggcacacgagaacttcggccaaggttcacctgagacagctgcagcaggtactatgcgcatcccgtg

SEQ ID NO: 179766 - DNA, 75 bp, Artificial Sequence
  Synthetic
tgtgtaatacgcaggcattggaggagaaagatgttcagatgtgcatacttgcagccaggctggaggcgtgccgag

SEQ ID NO: 179767 - DNA, 75 bp, Artificial Sequence
  Synthetic
gaaagatgttcagatgtgcatacttgcagccaggctggaggcgtgccgagagcaaaccagttttttgcgggagat

SEQ ID NO: 179768 - DNA, 75 bp, Artificial Sequence
  Synthetic
ccacgaattaggcgcacagaatgcgtgctaatacagtaagtgcacaaacagtgcggttctggagccccgccgcaa

SEQ ID NO: 179769 - DNA, 75 bp, Artificial Sequence
  Synthetic
tgctaatacagtaagtgcacaaacagtgcggttctggagccccgccgcaatattaaacccctgtttgataatcca

SEQ ID NO: 179770 - DNA, 75 bp, Artificial Sequence
  Synthetic
ccgtggtctaatttttatgatcgcaacgtcgtatcaggcgggcgttggcataggaacctgtcctaccgcgttcac

SEQ ID NO: 179771 - DNA, 75 bp, Artificial Sequence
  Synthetic
acgtcgtatcaggcgggcgttggcataggaacctgtcctaccgcgttcacgtctcacctgggttattggcaagac

SEQ ID NO: 179772 - DNA, 75 bp, Artificial Sequence
  Synthetic
agctgcccccgcgggcccctcctcgtcctggttatccccacggggaagaatttcctgaagctcgatctcctctac

SEQ ID NO: 179773 - DNA, 75 bp, Artificial Sequence
  Synthetic
gaggctgaacgcctcgttgtcctcaacccggttcaggagaagcgtgacgagcaatgggtctggcacgtctacaca

SEQ ID NO: 179774 - DNA, 75 bp, Artificial Sequence
  Synthetic
acccggttcaggagaagcgtgacgagcaatgggtctggcacgtctacacaaacatttacgagcaatgggtctgtc

SEQ ID NO: 179775 - DNA, 75 bp, Artificial Sequence
  Synthetic
gaccacggatgacgggtcagggtctggcgatgacgggtcgggatctggatctggagattccgaaaccgaagcgtc

SEQ ID NO: 179776 - DNA, 75 bp, Artificial Sequence
  Synthetic
gcatgtacagtccttgtcggcagttcttccacaaggaagacattatgcgctacaatagggggttgtacactttgg

SEQ ID NO: 179777 - DNA, 75 bp, Artificial Sequence
  Synthetic
ggcgatgacgggtcgggatctggatctggagattccgaaaccgaagcgtccacgtctttgcgtccagtgacttcg

SEQ ID NO: 179778 - DNA, 75 bp, Artificial Sequence
  Synthetic
agcgctgcgtggtcacaaactactccaactaatgtatattttctgccttacagggtcttccgtgggtacaaccgc

SEQ ID NO: 179779 - DNA, 75 bp, Artificial Sequence
  Synthetic
gacctccagtacgtcgtggtcaacggtacagacgtgtttttggaccagccttgccatatgctgcaggaggcctat

SEQ ID NO: 179780 - DNA, 75 bp, Artificial Sequence
  Synthetic
caactaatgtatattttctgccttacagggtcttccgtgggtacaaccgcggcgccatttctacagaaacatggt

SEQ ID NO: 179781 - DNA, 75 bp, Artificial Sequence
  Synthetic
cccgctcctcgccaagaacccagacgtacctccagcgaatcgtgaccttcatatcccgcaccacaccgacgcgac

SEQ ID NO: 179782 - DNA, 75 bp, Artificial Sequence
  Synthetic
gtacctccagcgaatcgtgaccttcatatcccgcaccacaccgacgcgaccagctgtcgccccggtgctaaaaac

SEQ ID NO: 179783 - DNA, 75 bp, Artificial Sequence
  Synthetic
ggcgttatcgccagtctacttagtgtggattgttgggcttctgctggggctcgccctcgttacatacctagctct

SEQ ID NO: 179784 - DNA, 75 bp, Artificial Sequence
  Synthetic
tggattgttgggcttctgctggggctcgccctcgttacatacctagctctcccgtgttttcgacaaaaaccatac

SEQ ID NO: 179785 - DNA, 75 bp, Artificial Sequence
  Synthetic
cttgtttgaacactcggtacggagtggtaggtgaaaaaggggggtcccctagtcgtcgtcgcgccgacttcgaga

SEQ ID NO: 179786 - DNA, 75 bp, Artificial Sequence
  Synthetic
ggtaggtgaaaaaggggggtcccctagtcgtcgtcgcgccgacttcgagacgccgcacgtcgccgtcgattgccg

SEQ ID NO: 179787 - DNA, 75 bp, Artificial Sequence
  Synthetic
aaggtcaatccgcatgtgtagattagaaagggcgttttccaactgggataccgtaacgcacttttcaatacacgc

SEQ ID NO: 179788 - DNA, 75 bp, Artificial Sequence
  Synthetic
gtgctcgaatccaacggatttgacatcgtgttccccatggtcgtgcctcagcaactggggcacgctattctgcag

SEQ ID NO: 179789 - DNA, 75 bp, Artificial Sequence
  Synthetic
gaaagggcgttttccaactgggataccgtaacgcacttttcaatacacgccctgacgcgagattctattttttta

SEQ ID NO: 179790 - DNA, 75 bp, Artificial Sequence
  Synthetic
ttccatagatgacacgggacggtctgccgggtcagacgctgcccccaacgctttgcggagctgcttgttttccat

SEQ ID NO: 179791 - DNA, 75 bp, Artificial Sequence
  Synthetic
gccgggtcagacgctgcccccaacgctttgcggagctgcttgttttccatagacagttttgtgatctgggctgtt

SEQ ID NO: 179792 - DNA, 75 bp, Artificial Sequence
  Synthetic
ggctgcacactgaagtcggtaaaaagcaacggctcgttcctactttaaatactgggtggaccaatccgctaccag

SEQ ID NO: 179793 - DNA, 75 bp, Artificial Sequence
  Synthetic
gcaacggctcgttcctactttaaatactgggtggaccaatccgctaccaggtgacgattttggcgaggcttttac

SEQ ID NO: 179794 - DNA, 75 bp, Artificial Sequence
  Synthetic
aaaaaaggtagcgatgagcacaatgagtacattgaccagggcccagatgctagaaaagctagtcagggtggggct

SEQ ID NO: 179795 - DNA, 75 bp, Artificial Sequence
  Synthetic
agtacattgaccagggcccagatgctagaaaagctagtcagggtggggctgaacgcatcagctgtgcagtcagag

SEQ ID NO: 179796 - DNA, 75 bp, Artificial Sequence
  Synthetic
gacaacatgcgtcgatgtgactgtctcggtactcgtcaccgtagtcgtccccgccccacaacctagagccaggac

SEQ ID NO: 179797 - DNA, 75 bp, Artificial Sequence
  Synthetic
tcggtactcgtcaccgtagtcgtccccgccccacaacctagagccaggacgaggcataaaaacaccgggttgccc

SEQ ID NO: 179798 - DNA, 75 bp, Artificial Sequence
  Synthetic
aaacgaacgaacccttatatacacccaatcatggatcccatggctgcctggggtcccaaggtggagtacgtactg

SEQ ID NO: 179799 - DNA, 75 bp, Artificial Sequence
  Synthetic
caatcatggatcccatggctgcctggggtcccaaggtggagtacgtactggagagttccagatttagcttggcct

SEQ ID NO: 179800 - DNA, 75 bp, Artificial Sequence
  Synthetic
gttcgcgcctgtcagcctttaattgtcccccttggactccatctcacccgggtaccttcgtgcgcatttctgtta

SEQ ID NO: 179801 - DNA, 75 bp, Artificial Sequence
  Synthetic
tcccccttggactccatctcacccgggtaccttcgtgcgcatttctgttaaccgtcgagacggaaaacaccatcc

SEQ ID NO: 179802 - DNA, 75 bp, Artificial Sequence
  Synthetic
atcctcgttaacaaagaggagtttccagtgacgctgtacaagggtgaactcaccgtgtatctctcggcactcaac

SEQ ID NO: 179803 - DNA, 75 bp, Artificial Sequence
  Synthetic
cagtgacgctgtacaagggtgaactcaccgtgtatctctcggcactcaactataccgtcccagatcttccccctc

SEQ ID NO: 179804 - DNA, 75 bp, Artificial Sequence
  Synthetic
tctgcaacccatcacctctacatccccccgacagttcggataccctttgaactccgcctcggggccagcgcaccg

SEQ ID NO: 179805 - DNA, 75 bp, Artificial Sequence
  Synthetic
ccccgacagttcggataccctttgaactccgcctcggggccagcgcaccggagattccgacctcgcacattcccg

SEQ ID NO: 179806 - DNA, 75 bp, Artificial Sequence
  Synthetic
agccgctggaaacaggatggcctacggctgaaattctacaattactcaggggactcctgggtcattcggccagga

SEQ ID NO: 179807 - DNA, 75 bp, Artificial Sequence
  Synthetic
ggctgaaattctacaattactcaggggactcctgggtcattcggccaggagatcgaatctgccaaattgtgttca

SEQ ID NO: 179808 - DNA, 75 bp, Artificial Sequence
  Synthetic
aaattagccccaggaatctgcttcaggcccgcaaacgttatgttttacgaggaaggtcctactgacctaaaacaa

SEQ ID NO: 179809 - DNA, 75 bp, Artificial Sequence
  Synthetic
ggcccgcaaacgttatgttttacgaggaaggtcctactgacctaaaacaaaacgatgaagaaagcgggttgataa

SEQ ID NO: 179810 - DNA, 75 bp, Artificial Sequence
  Synthetic
ttaggatcatctggcctgggatgcgatgaggggagggagtcaaatgaacagtctgggtaatcccaaataagttag

SEQ ID NO: 179811 - DNA, 75 bp, Artificial Sequence
  Synthetic
atgaggggagggagtcaaatgaacagtctgggtaatcccaaataagttagcacactctcagataactgtaatagc

SEQ ID NO: 179812 - DNA, 75 bp, Artificial Sequence
  Synthetic
actttctgaaaccacgggtggcaatggcgcaagggcgtccactgggaggttatcagaaattaacgccgtctgccc

SEQ ID NO: 179813 - DNA, 75 bp, Artificial Sequence
  Synthetic
ggcgcaagggcgtccactgggaggttatcagaaattaacgccgtctgcccacgagccggcggttccgcgatgatg

SEQ ID NO: 179814 - DNA, 75 bp, Artificial Sequence
  Synthetic
ggtggcccataacaccgaatcgtcggcggccattgcagttgctaacttctccagttccatgagtgacacgcattc

SEQ ID NO: 179815 - DNA, 75 bp, Artificial Sequence
  Synthetic
gcggccattgcagttgctaacttctccagttccatgagtgacacgcattcgccggctcgtttactaagcagggac

SEQ ID NO: 179816 - DNA, 75 bp, Artificial Sequence
  Synthetic
agtattccagaccacgttctgaatagactgtaatttttttacctgggtccggacggtctcctggcatcccgtggg

SEQ ID NO: 179817 - DNA, 75 bp, Artificial Sequence
  Synthetic
gactgtaatttttttacctgggtccggacggtctcctggcatcccgtgggaactttggagacgtcgaatcgcttc

SEQ ID NO: 179818 - DNA, 75 bp, Artificial Sequence
  Synthetic
taacgcagcggcgcctacgtttgcctgcacgatatctcctagtgtcacaccagacggcaggccgcgatctatttc

SEQ ID NO: 179819 - DNA, 75 bp, Artificial Sequence
  Synthetic
tgcacgatatctcctagtgtcacaccagacggcaggccgcgatctatttcaagtcgccagcgctcggggcagcct

SEQ ID NO: 179820 - DNA, 75 bp, Artificial Sequence
  Synthetic
aattggccactgcagggcgctgctcttgtcagtatagtgtagaaaatgtatggggagcgggcatatttcgttaag

SEQ ID NO: 179821 - DNA, 75 bp, Artificial Sequence
  Synthetic
taggattccgcaacaagaccacgaagaccagggtgatggcatttttgcaaaacactaccgatgttcgagttatat

SEQ ID NO: 179822 - DNA, 75 bp, Artificial Sequence
  Synthetic
gaccagggtgatggcatttttgcaaaacactaccgatgttcgagttatattttcaaccagtggagacacggccga

SEQ ID NO: 179823 - DNA, 75 bp, Artificial Sequence
  Synthetic
cagtcctgcacgactgtttgacagccacaataaatactcggcgaatgaccgtcgggctttgtctacccgtcaagc

SEQ ID NO: 179824 - DNA, 75 bp, Artificial Sequence
  Synthetic
cacaataaatactcggcgaatgaccgtcgggctttgtctacccgtcaagcgacctggcagcgggcccagatgtcg

SEQ ID NO: 179825 - DNA, 75 bp, Artificial Sequence
  Synthetic
gcggtcgcgcgctctccgcgcacgaagtcgagagtatgttgatccctgaatgtactcacaatctcttcgagccta

SEQ ID NO: 179826 - DNA, 75 bp, Artificial Sequence
  Synthetic
agtcgagagtatgttgatccctgaatgtactcacaatctcttcgagcctatgcttgagcttttaggcggagctaa

SEQ ID NO: 179827 - DNA, 75 bp, Artificial Sequence
  Synthetic
tacgtgccaaattcgtaagtgccctgcgaaaactgtttaaagtgacaccgtcgccgtattggatgatatccgcat

SEQ ID NO: 179828 - DNA, 75 bp, Artificial Sequence
  Synthetic
gcgaaaactgtttaaagtgacaccgtcgccgtattggatgatatccgcatttggccaccaggaggcgccgtttgt

SEQ ID NO: 179829 - DNA, 75 bp, Artificial Sequence
  Synthetic
ctctcgggcatctggcccggctgttttcttccaattgcggtcagaccctggcatctattaacagctacgaagaat

SEQ ID NO: 179830 - DNA, 75 bp, Artificial Sequence
  Synthetic
ttcttccaattgcggtcagaccctggcatctattaacagctacgaagaattggggcgcctgtttgacagctccag

SEQ ID NO: 179831 - DNA, 75 bp, Artificial Sequence
  Synthetic
cacgtgatacactagaaatggacgccgttgacaatacaattaacgagatccgtagaggacttttattgtccaatc

SEQ ID NO: 179832 - DNA, 75 bp, Artificial Sequence
  Synthetic
cgttgacaatacaattaacgagatccgtagaggacttttattgtccaatcaagatctggtacattttgtgtatct

SEQ ID NO: 179833 - DNA, 75 bp, Artificial Sequence
  Synthetic
gctctgctccgtccgaattatcaactatgtccacggcgcccatgttgtgtcaatccctcgaaggggaatttcgga

SEQ ID NO: 179834 - DNA, 75 bp, Artificial Sequence
  Synthetic
tatgtccacggcgcccatgttgtgtcaatccctcgaaggggaatttcggactcaggtccaggcatactatgatcg

SEQ ID NO: 179835 - DNA, 75 bp, Artificial Sequence
  Synthetic
tgccacctggctacgaaacccaggttctacgcggtgaaaatggcaggtattggtgtggccagtcacaggacgtta

SEQ ID NO: 179836 - DNA, 75 bp, Artificial Sequence
  Synthetic
tctacgcggtgaaaatggcaggtattggtgtggccagtcacaggacgttagtagtcttattgccgccgtgaatgg

SEQ ID NO: 179837 - DNA, 75 bp, Artificial Sequence
  Synthetic
tggccgccatagccggttccgaaggcggtcagtgcaaagaaggcctactgtccagcaatatggcactccccgtgt

SEQ ID NO: 179838 - DNA, 75 bp, Artificial Sequence
  Synthetic
cggtcagtgcaaagaaggcctactgtccagcaatatggcactccccgtgtaccggtgtgaatttttatctaggca

SEQ ID NO: 179839 - DNA, 75 bp, Artificial Sequence
  Synthetic
ccgtaatacatccacccgaaaacgcatggcgtaccctgacagatgaagatcttacccgtagaatatattactatg

SEQ ID NO: 179840 - DNA, 75 bp, Artificial Sequence
  Synthetic
atggcgtaccctgacagatgaagatcttacccgtagaatatattactatgaggcgagcgtatcgtgccccacttt

SEQ ID NO: 179841 - DNA, 75 bp, Artificial Sequence
  Synthetic
cggtgtacagatgggtcttagattttgacctgcccgtgacagaacccacgcgcacgtttgcggacattcgagacc

SEQ ID NO: 179842 - DNA, 75 bp, Artificial Sequence
  Synthetic
tgacctgcccgtgacagaacccacgcgcacgtttgcggacattcgagacctctgtctggctctgcgttgcgccat

SEQ ID NO: 179843 - DNA, 75 bp, Artificial Sequence
  Synthetic
tgtacttttttaagtcggcgtgtcccccggatgattggtacactgaatccgtcggagacgtgccattctgtaggt

SEQ ID NO: 179844 - DNA, 75 bp, Artificial Sequence
  Synthetic
cccggatgattggtacactgaatccgtcggagacgtgccattctgtaggtgccatccaaaacttgggttacgtat

SEQ ID NO: 179845 - DNA, 75 bp, Artificial Sequence
  Synthetic
tagcactaacagacattctaaatcgtgttgtgaaactagacgcagagctggtaagaaaatatccggctattcacc

SEQ ID NO: 179846 - DNA, 75 bp, Artificial Sequence
  Synthetic
tgttgtgaaactagacgcagagctggtaagaaaatatccggctattcaccacaaccgtggcccgttcgacaccgg

SEQ ID NO: 179847 - DNA, 75 bp, Artificial Sequence
  Synthetic
gtttggtcggtgaacttacacgtcagctcagactggtggtctgtcacccagaacctaccggtcgctggcgctaca

SEQ ID NO: 179848 - DNA, 75 bp, Artificial Sequence
  Synthetic
gctcagactggtggtctgtcacccagaacctaccggtcgctggcgctacatgcgagaggcatttacccttagtaa

SEQ ID NO: 179849 - DNA, 75 bp, Artificial Sequence
  Synthetic
tgtaccgtgttcgggacattaaccagaacttcttggagcacaagacggccagctaccttcccaccacgattccgc

SEQ ID NO: 179850 - DNA, 75 bp, Artificial Sequence
  Synthetic
gaacttcttggagcacaagacggccagctaccttcccaccacgattccgcgcataattaagcggctcccgcacct

SEQ ID NO: 179851 - DNA, 75 bp, Artificial Sequence
  Synthetic
ccatggaggtgatatcaaaattttttccggaggaccgcatcagccaattttctggcgtaacatttgtcgtaggcg

SEQ ID NO: 179852 - DNA, 75 bp, Artificial Sequence
  Synthetic
tccggaggaccgcatcagccaattttctggcgtaacatttgtcgtaggcggcgataatcttattcagcttaaacc

SEQ ID NO: 179853 - DNA, 75 bp, Artificial Sequence
  Synthetic
ctaaaggcgtcaggatatttctcgtcctccacgccattaaagagaccgaggtgatcgtgacgctaatgagtcagt

SEQ ID NO: 179854 - DNA, 75 bp, Artificial Sequence
  Synthetic
cctccacgccattaaagagaccgaggtgatcgtgacgctaatgagtcagtgctttgccaataagtgtaacagcaa

SEQ ID NO: 179855 - DNA, 75 bp, Artificial Sequence
  Synthetic
actcgggtgctccctactatgtgtgtgtatacgaacgcggtggccgtcaggaagacgactggctgccgataccac

SEQ ID NO: 179856 - DNA, 75 bp, Artificial Sequence
  Synthetic
aatcccggtataatagagggtatgccagctagatagagatgttgaatagccgcgccccacctcgttcagtccacc

SEQ ID NO: 179857 - DNA, 75 bp, Artificial Sequence
  Synthetic
cagctagatagagatgttgaatagccgcgccccacctcgttcagtccaccataaaattgcaccatggtgcaagcc

SEQ ID NO: 179858 - DNA, 75 bp, Artificial Sequence
  Synthetic
ggcatttgctttgggtcaggctattagcctgaactaaatcaacgcggtatatactcatatttgttcacatgcact

SEQ ID NO: 179859 - DNA, 75 bp, Artificial Sequence
  Synthetic
agcctgaactaaatcaacgcggtatatactcatatttgttcacatgcactcatgcagactctctctcatcatctg

SEQ ID NO: 179860 - DNA, 75 bp, Artificial Sequence
  Synthetic
cagtctgaacaggcaacgccgctcgtggccatcgatgcccccgcgtcatcggatcacgccgggccaaagatcgac

SEQ ID NO: 179861 - DNA, 75 bp, Artificial Sequence
  Synthetic
tggccatcgatgcccccgcgtcatcggatcacgccgggccaaagatcgacatatcttctatggtaaagataccaa

SEQ ID NO: 179862 - DNA, 75 bp, Artificial Sequence
  Synthetic
ccccttgatcgaggcagcgtcacgcccccagtcgacaggtacagtaagagacgcaaggtctgcaaagagactcaa

SEQ ID NO: 179863 - DNA, 75 bp, Artificial Sequence
  Synthetic
ccccagtcgacaggtacagtaagagacgcaaggtctgcaaagagactcaaccatctcaaacgctcgggcgacgcg

SEQ ID NO: 179864 - DNA, 75 bp, Artificial Sequence
  Synthetic
agatcaccgcgaggtcgagaccgggtcgtgtatcgtcgatccgggcccgaccgtcaagggacgtcgggtcgacat

SEQ ID NO: 179865 - DNA, 75 bp, Artificial Sequence
  Synthetic
tcgtgtatcgtcgatccgggcccgaccgtcaagggacgtcgggtcgacatcatcgtctgcggaccgacgttcatc

SEQ ID NO: 179866 - DNA, 75 bp, Artificial Sequence
  Synthetic
accggcgtcgacggacagcgcctcgaggacgccatcatcccccgtcaccacggtccctgttttagggtgtttacc

SEQ ID NO: 179867 - DNA, 75 bp, Artificial Sequence
  Synthetic
aggacgccatcatcccccgtcaccacggtccctgttttagggtgtttaccccggccccccctccatacttcccag

SEQ ID NO: 179868 - DNA, 75 bp, Artificial Sequence
  Synthetic
aatgatgagctgatcaataagaaggttagtgcaaaaacaatcaatgaaatatacaaacccttgatgatgtttgtt

SEQ ID NO: 179869 - DNA, 75 bp, Artificial Sequence
  Synthetic
ttagtgcaaaaacaatcaatgaaatatacaaacccttgatgatgtttgttacgggacgccacaatcagccttact

SEQ ID NO: 179870 - DNA, 75 bp, Artificial Sequence
  Synthetic
gccgcctttgtggaagagcagctgctgtgggctcagacggcaacacgccagggaggtagctttgatggcaaaaat

SEQ ID NO: 179871 - DNA, 75 bp, Artificial Sequence
  Synthetic
tgtgggctcagacggcaacacgccagggaggtagctttgatggcaaaaatatagacattattctggatactgccg

SEQ ID NO: 179872 - DNA, 75 bp, Artificial Sequence
  Synthetic
tgtttgttggataaacacggggagttggcagtggtaaaacagctatcctatttagtggccatgggaaatcgtctg

SEQ ID NO: 179873 - DNA, 75 bp, Artificial Sequence
  Synthetic
tggcagtggtaaaacagctatcctatttagtggccatgggaaatcgtctgacggaggcctgtaatctgctggggg

SEQ ID NO: 179874 - DNA, 75 bp, Artificial Sequence
  Synthetic
gtaccaggattgcaattacgcaagaacataacattgaaagcccagagactctttcagacgtttctagccgggtat

SEQ ID NO: 179875 - DNA, 75 bp, Artificial Sequence
  Synthetic
acataacattgaaagcccagagactctttcagacgtttctagccgggtataagccgggcgatgttatggggttac

SEQ ID NO: 179876 - DNA, 75 bp, Artificial Sequence
  Synthetic
tcggcggccacgcgtgccgcggtaggttcgcccgcatttaccaaagggttgttcttttatccggtgtcgtaagat

SEQ ID NO: 179877 - DNA, 75 bp, Artificial Sequence
  Synthetic
gttcgcccgcatttaccaaagggttgttcttttatccggtgtcgtaagatgaggtcgcccatgtatctcaataaa

SEQ ID NO: 179878 - DNA, 75 bp, Artificial Sequence
  Synthetic
gcctcaaacgcgcaagttcattccatccgccgaattaatttttctggcgtcataatttatatctgggacccacaa

SEQ ID NO: 179879 - DNA, 75 bp, Artificial Sequence
  Synthetic
tccgccgaattaatttttctggcgtcataatttatatctgggacccacaaacccatgtaaatacctactgcaggt

SEQ ID NO: 179880 - DNA, 75 bp, Artificial Sequence
  Synthetic
ataatatactggttgtacttgcagacggccacacgatggcgcccatgcactcaacataccttacctttaaaaacg

SEQ ID NO: 179881 - DNA, 75 bp, Artificial Sequence
  Synthetic
cggccacacgatggcgcccatgcactcaacataccttacctttaaaaacgtacacagtataataacatgaaagat

SEQ ID NO: 179882 - DNA, 75 bp, Artificial Sequence
  Synthetic
tctaagaaaccccgccaacgcccggaaaccgcatgcgttccagtcggtgcggcctgcgccggcgtcgctgtggcg

SEQ ID NO: 179883 - DNA, 75 bp, Artificial Sequence
  Synthetic
gtagtccaatgtggcttacctcctctatgggaaagcatcactgctaccttccccctggtccacacctcccccgct

SEQ ID NO: 179884 - DNA, 75 bp, Artificial Sequence
  Synthetic
tatgggaaagcatcactgctaccttccccctggtccacacctcccccgcttggacgcgcgtcgaccccacttgcg

SEQ ID NO: 179885 - DNA, 75 bp, Artificial Sequence
  Synthetic
gatcgctgtggtggcttctaaaccggcatcgacgaacccttgccagagtggtcttggcattatttgcaatgttat

SEQ ID NO: 179886 - DNA, 75 bp, Artificial Sequence
  Synthetic
gcatcgacgaacccttgccagagtggtcttggcattatttgcaatgttatggctgccttggcccatggtttgttt

SEQ ID NO: 179887 - DNA, 75 bp, Artificial Sequence
  Synthetic
caaaaggtacaacgtcacgtatggaaggtgtagatgtgacgtggcggtagtgtgtggtggggtcattgccagctg

SEQ ID NO: 179888 - DNA, 75 bp, Artificial Sequence
  Synthetic
aggtgtagatgtgacgtggcggtagtgtgtggtggggtcattgccagctgcataaagtagacgtctgggtcgtat

SEQ ID NO: 179889 - DNA, 75 bp, Artificial Sequence
  Synthetic
gagggtgttgcccctaaaaaatacttgcccgtcattgtggcagacaacacagatgccccgatccgatgccgtaaa

SEQ ID NO: 179890 - DNA, 75 bp, Artificial Sequence
  Synthetic
tgcccgtcattgtggcagacaacacagatgccccgatccgatgccgtaaaacaaagccccttcaccgaggccgcc

SEQ ID NO: 179891 - DNA, 75 bp, Artificial Sequence
  Synthetic
cttcgggaaaaagatctgtccagccgaaccccgtggacatacgtgatccataaggcatgccaatggagctgatgg

SEQ ID NO: 179892 - DNA, 75 bp, Artificial Sequence
  Synthetic
gaaccccgtggacatacgtgatccataaggcatgccaatggagctgatgggggtgcggaaattctggccccaggc

SEQ ID NO: 179893 - DNA, 75 bp, Artificial Sequence
  Synthetic
tacatgcatgagttgccatggagctagagtttgaggattgccggcggagactacctgagaccgggtcttgtccga

SEQ ID NO: 179894 - DNA, 75 bp, Artificial Sequence
  Synthetic
agagtttgaggattgccggcggagactacctgagaccgggtcttgtccgaatagatatccattataaacctctgc

SEQ ID NO: 179895 - DNA, 75 bp, Artificial Sequence
  Synthetic
gttcaactcctcggggcgccgaacgcggaagatcacatactggtgtccatcgcggggatcttttccgcggccaac

SEQ ID NO: 179896 - DNA, 75 bp, Artificial Sequence
  Synthetic
cggaagatcacatactggtgtccatcgcggggatcttttccgcggccaacttcgtgcagacctctagtgcgcctc

SEQ ID NO: 179897 - DNA, 75 bp, Artificial Sequence
  Synthetic
agtcgtcaggcctctttcgcgaagatagacaactcccaattctccctcaaactgatatcgaaactggggactcgt

SEQ ID NO: 179898 - DNA, 75 bp, Artificial Sequence
  Synthetic
tagacaactcccaattctccctcaaactgatatcgaaactggggactcgtatacggggtagcgggaatacgaaat

SEQ ID NO: 179899 - DNA, 75 bp, Artificial Sequence
  Synthetic
tacatggtggactatccagtcgctgagcggcattttagcaaggtcttcgctgctgaggatcccacctacaggtat

SEQ ID NO: 179900 - DNA, 75 bp, Artificial Sequence
  Synthetic
agcggcattttagcaaggtcttcgctgctgaggatcccacctacaggtatctccgacacgtctagctgtgtggcg

SEQ ID NO: 179901 - DNA, 75 bp, Artificial Sequence
  Synthetic
catagacgtcccgatgcctagagtctcttcggagttacctggatccatcccgcgcgtaaaataaggaaaagccat

SEQ ID NO: 179902 - DNA, 75 bp, Artificial Sequence
  Synthetic
tcttcggagttacctggatccatcccgcgcgtaaaataaggaaaagccatcccgaccgaagaggcactcctgcgt

SEQ ID NO: 179903 - DNA, 75 bp, Artificial Sequence
  Synthetic
gttatatatgtcggattcggacgcgtaccaccgcccgcgaatgcctggaaccggttgcgcgtcgtttaattatgt

SEQ ID NO: 179904 - DNA, 75 bp, Artificial Sequence
  Synthetic
taccaccgcccgcgaatgcctggaaccggttgcgcgtcgtttaattatgtaagtgtgttgctatgcgaccatggc

SEQ ID NO: 179905 - DNA, 75 bp, Artificial Sequence
  Synthetic
gccgctccactgtggcccagagtatattgttacatgaaaaccccccatatgttatttcaccgccagggacctgtt

SEQ ID NO: 179906 - DNA, 75 bp, Artificial Sequence
  Synthetic
attgttacatgaaaaccccccatatgttatttcaccgccagggacctgttggtaacttagccaccaagtaggctc

SEQ ID NO: 179907 - DNA, 75 bp, Artificial Sequence
  Synthetic
ccagcttccgtccggtacatgcagatgcgaaactttaccgtgggttggaccgacgtgtacgggatccccgtgcgg

SEQ ID NO: 179908 - DNA, 75 bp, Artificial Sequence
  Synthetic
tgcgaaactttaccgtgggttggaccgacgtgtacgggatccccgtgcggcaccccccatcatgcttattttacg

SEQ ID NO: 179909 - DNA, 75 bp, Artificial Sequence
  Synthetic
ataccataacgtaatgcaacttacaacataaataaaggtcaatgtttaatccatatttcctgacttgtgtcttga

SEQ ID NO: 179910 - DNA, 75 bp, Artificial Sequence
  Synthetic
gtgcaaataccgaaatgtttattgtaaggggaatacgtaatgcttggcatataatcccctacccgatacgttatg

SEQ ID NO: 179911 - DNA, 75 bp, Artificial Sequence
  Synthetic
aaggggaatacgtaatgcttggcatataatcccctacccgatacgttatgccattttactccgtatcacctgaat

SEQ ID NO: 179912 - DNA, 75 bp, Artificial Sequence
  Synthetic
ttgtcaatcaccgtctcagaagtcggcttagagccaaaataaatcgttccgcaatgaattggctcctccttacag

SEQ ID NO: 179913 - DNA, 75 bp, Artificial Sequence
  Synthetic
gcttagagccaaaataaatcgttccgcaatgaattggctcctccttacagagagggtgtggatatttccccatcg

SEQ ID NO: 179914 - DNA, 75 bp, Artificial Sequence
  Synthetic
aattttcttatcacgccgtggaaacgctcgctagggttaccgtggcaccatgcgggcacactggtggaattcctc

SEQ ID NO: 179915 - DNA, 75 bp, Artificial Sequence
  Synthetic
gctcgctagggttaccgtggcaccatgcgggcacactggtggaattcctcgaatatataccggaagtcgtgcaaa

SEQ ID NO: 179916 - DNA, 75 bp, Artificial Sequence
  Synthetic
ttttgctccgggtcatctaccatcatctctggcaacctgaacagttctgggacaaacgtcatacatagatggcca

SEQ ID NO: 179917 - DNA, 75 bp, Artificial Sequence
  Synthetic
tctctggcaacctgaacagttctgggacaaacgtcatacatagatggccaatacgttgctgggtaggtgaactgc

SEQ ID NO: 179918 - DNA, 75 bp, Artificial Sequence
  Synthetic
aaggcatacgtctctactacaaacggcaccaacgtttgttggggttgcttaaaaaattttttggggactcctctg

SEQ ID NO: 179919 - DNA, 75 bp, Artificial Sequence
  Synthetic
gcaccaacgtttgttggggttgcttaaaaaattttttggggactcctctgacgctagagtgctttccagcagtgg

SEQ ID NO: 179920 - DNA, 75 bp, Artificial Sequence
  Synthetic
cgtgagattcctgtgctggtactagcctgttcgctgtcgagcgaggagctccgtgaactgctttccaatcgccct

SEQ ID NO: 179921 - DNA, 75 bp, Artificial Sequence
  Synthetic
cctgttcgctgtcgagcgaggagctccgtgaactgctttccaatcgccctcctacaggcacatatccagtcgcaa

SEQ ID NO: 179922 - DNA, 75 bp, Artificial Sequence
  Synthetic
gtcgcgtgaccggacaatggtccttgtgcatacccagcggaccactcgctgaactgactaacggaaccggcgaag

SEQ ID NO: 179923 - DNA, 75 bp, Artificial Sequence
  Synthetic
gtgcatacccagcggaccactcgctgaactgactaacggaaccggcgaagccctgggcagtcgccgagcttccgg

SEQ ID NO: 179924 - DNA, 75 bp, Artificial Sequence
  Synthetic
cctgcctcactaccggatacgataacggacgctggatcacctgccaaattttctagtgggccactggtaggcccg

SEQ ID NO: 179925 - DNA, 75 bp, Artificial Sequence
  Synthetic
cggacgctggatcacctgccaaattttctagtgggccactggtaggcccgggaacgtctgtccgaggaccaacag

SEQ ID NO: 179926 - DNA, 75 bp, Artificial Sequence
  Synthetic
aggggagtcagaccctgggcccacgagactagatcttgacctgggtcatcgtccgaagataatgcttggctcaga

SEQ ID NO: 179927 - DNA, 75 bp, Artificial Sequence
  Synthetic
agactagatcttgacctgggtcatcgtccgaagataatgcttggctcagagagctaacgctttgcgtctccggta

SEQ ID NO: 179928 - DNA, 75 bp, Artificial Sequence
  Synthetic
aacggctgtgcttcctgcgaaacatcgcgcgcttgtggaggaacggtataacgtccgctcgtctgttccggggag

SEQ ID NO: 179929 - DNA, 75 bp, Artificial Sequence
  Synthetic
cgcgcgcttgtggaggaacggtataacgtccgctcgtctgttccggggagcttcgtgattccccgaagatgtctt

SEQ ID NO: 179930 - DNA, 75 bp, Artificial Sequence
  Synthetic
aattgttctccaaatccgagggatgacagagacgactcctcacttacctgactcgatacaccaagagggccggga

SEQ ID NO: 179931 - DNA, 75 bp, Artificial Sequence
  Synthetic
acagagacgactcctcacttacctgactcgatacaccaagagggccgggagatgcactcgaggctgccaatgttc

SEQ ID NO: 179932 - DNA, 75 bp, Artificial Sequence
  Synthetic
gtgcgaggattccaagagaaagaagaggatggaggggcttcgggactagataccgccgtagaagatcccgtgcca

SEQ ID NO: 179933 - DNA, 75 bp, Artificial Sequence
  Synthetic
aggatggaggggcttcgggactagataccgccgtagaagatcccgtgccaggtggctggtcctgagacgcccagg

SEQ ID NO: 179934 - DNA, 75 bp, Artificial Sequence
  Synthetic
ataattaactgtcctgggactgcttctcctctggggtcgtgctgctggacgactctggacttggtaggacaaggg

SEQ ID NO: 179935 - DNA, 75 bp, Artificial Sequence
  Synthetic
ctcctctggggtcgtgctgctggacgactctggacttggtaggacaagggttcgggtcccctcgcgcccacgcgc

SEQ ID NO: 179936 - DNA, 75 bp, Artificial Sequence
  Synthetic
attaaagataagtgtacaactaatcattccctcacagacctccctccagggtggcacttaccttctcgcgcatcg

SEQ ID NO: 179937 - DNA, 75 bp, Artificial Sequence
  Synthetic
attccctcacagacctccctccagggtggcacttaccttctcgcgcatcgtggctccggaaacgagctgggagac

SEQ ID NO: 179938 - DNA, 75 bp, Artificial Sequence
  Synthetic
gcagcaatacttacactccctaaaggtagcaggaaatagctgccagaccattaaggtccgaccggaatcgtcctg

SEQ ID NO: 179939 - DNA, 75 bp, Artificial Sequence
  Synthetic
gtagcaggaaatagctgccagaccattaaggtccgaccggaatcgtcctgataaagtaaatcccctctaagcatg

SEQ ID NO: 179940 - DNA, 75 bp, Artificial Sequence
  Synthetic
cccggtggacggtgacggaccgtacatgtcgtcgcattttctattaaatgcatcgtagacagcgaaccagtcacc

SEQ ID NO: 179941 - DNA, 75 bp, Artificial Sequence
  Synthetic
atgtcgtcgcattttctattaaatgcatcgtagacagcgaaccagtcaccgggaatttcatcgcccaacgccgat

SEQ ID NO: 179942 - DNA, 75 bp, Artificial Sequence
  Synthetic
tggaaacttctcattttctaacgcatctatcagccaacccgttacccactcgtaactgccggccttaggcattgt

SEQ ID NO: 179943 - DNA, 75 bp, Artificial Sequence
  Synthetic
tctatcagccaacccgttacccactcgtaactgccggccttaggcattgtactacaccgcggaccaccaatgtat

SEQ ID NO: 179944 - DNA, 75 bp, Artificial Sequence
  Synthetic
agtcccgccgccccgttaggcaaatttttatttgctgttcccaccacacacaaccctgtcctgaacagcgaagcc

SEQ ID NO: 179945 - DNA, 75 bp, Artificial Sequence
  Synthetic
ttttatttgctgttcccaccacacacaaccctgtcctgaacagcgaagcctcctgaggcatgtgtggtgccgggg

SEQ ID NO: 179946 - DNA, 75 bp, Artificial Sequence
  Synthetic
attttgccgggcgttatacgacaatgtaaccaccccagtggcaaaccacaagccgatgattactttcactcgcgg

SEQ ID NO: 179947 - DNA, 75 bp, Artificial Sequence
  Synthetic
gtaaccaccccagtggcaaaccacaagccgatgattactttcactcgcggcccagagagtcagtcagatgggggc

SEQ ID NO: 179948 - DNA, 75 bp, Artificial Sequence
  Synthetic
gtatcgcatgggtcaacggacgtgaggcagagccttatggtgagtgggacaaggtcaaactgtgccggatcctcg

SEQ ID NO: 179949 - DNA, 75 bp, Artificial Sequence
  Synthetic
ggcagagccttatggtgagtgggacaaggtcaaactgtgccggatcctcgggtttgtctcccacgtacaccttca

SEQ ID NO: 179950 - DNA, 75 bp, Artificial Sequence
  Synthetic
ataacagctttggggataaagccgcgaaccagtttgtttttgtaccaagggtagtttccatagtagtggagcgga

SEQ ID NO: 179951 - DNA, 75 bp, Artificial Sequence
  Synthetic
gaaccagtttgtttttgtaccaagggtagtttccatagtagtggagcggagaaccgcagagattcttaatgtaaa

SEQ ID NO: 179952 - DNA, 75 bp, Artificial Sequence
  Synthetic
acggccagtaaatgcatcagtgaaccccgacagttctcggatgggacaggcagcatgaatcgtagacctccacgc

SEQ ID NO: 179953 - DNA, 75 bp, Artificial Sequence
  Synthetic
cccgacagttctcggatgggacaggcagcatgaatcgtagacctccacgcgtgtgaagacatgcgtgactaacgt

SEQ ID NO: 179954 - DNA, 75 bp, Artificial Sequence
  Synthetic
acggtagataccaccaactccccatagtaatatgcctgaaggactacaggctgaaagatcatgcgtggtgttttc

SEQ ID NO: 179955 - DNA, 75 bp, Artificial Sequence
  Synthetic
agtaatatgcctgaaggactacaggctgaaagatcatgcgtggtgttttctcaacacgatagtacgttgctctga

SEQ ID NO: 179956 - DNA, 75 bp, Artificial Sequence
  Synthetic
tttgtaggatctataaatggagatccgcgtgggtcagaagcccgcttttgggaccgctggccttcagacgatcta

SEQ ID NO: 179957 - DNA, 75 bp, Artificial Sequence
  Synthetic
cgcgtgggtcagaagcccgcttttgggaccgctggccttcagacgatctacccttccgagatctagatgttggcg

SEQ ID NO: 179958 - DNA, 75 bp, Artificial Sequence
  Synthetic
tctgtggcctgggggacatatccttcctgcatctccgagggaggcgtcgtgtcggcgactggtgcagatgtttcg

SEQ ID NO: 179959 - DNA, 75 bp, Artificial Sequence
  Synthetic
cctgcatctccgagggaggcgtcgtgtcggcgactggtgcagatgtttcggcgtcggcgaccggtgcagatgttt

SEQ ID NO: 179960 - DNA, 75 bp, Artificial Sequence
  Synthetic
gaagagtgcataagccaccagacatctcgcccaacctcctgcataatgtaggctgtatctaatgtggagatcgcc

SEQ ID NO: 179961 - DNA, 75 bp, Artificial Sequence
  Synthetic
ctcgcccaacctcctgcataatgtaggctgtatctaatgtggagatcgccacacaaggctcttgtgtgacgtccc

SEQ ID NO: 179962 - DNA, 75 bp, Artificial Sequence
  Synthetic
cctgccggggcgcccgtatctgtgcctcccgcggcagctccagaatacgcggcaatgcctacaatctgtccgccg

SEQ ID NO: 179963 - DNA, 75 bp, Artificial Sequence
  Synthetic
ctcccgcggcagctccagaatacgcggcaatgcctacaatctgtccgccggttccggtcgaggttccctcgtccg

SEQ ID NO: 179964 - DNA, 75 bp, Artificial Sequence
  Synthetic
ctcccggaggatggaccttcgtctccagatgaatcgctcgacttgtcatcgccacgggtggcaccgacctcgacg

SEQ ID NO: 179965 - DNA, 75 bp, Artificial Sequence
  Synthetic
cagatgaatcgctcgacttgtcatcgccacgggtggcaccgacctcgacgactgcctcgccacccgcctcgccac

SEQ ID NO: 179966 - DNA, 75 bp, Artificial Sequence
  Synthetic
tacatcgttagaaacgcaccaaccactcctccagacaagcccgatcaatcataacttaccttcgcttacgtcgtc

SEQ ID NO: 179967 - DNA, 75 bp, Artificial Sequence
  Synthetic
ctcctccagacaagcccgatcaatcataacttaccttcgcttacgtcgtccgctgtgttcatgctgaaataaaat

SEQ ID NO: 179968 - DNA, 75 bp, Artificial Sequence
  Synthetic
accaacaattcctaaccaacgtgccaagcaactgccacgcgcgacagaacacgccatcgatgaaaatagttttat

SEQ ID NO: 179969 - DNA, 75 bp, Artificial Sequence
  Synthetic
aagcaactgccacgcgcgacagaacacgccatcgatgaaaatagttttatttgtccgcgcgcggcgaatgcgacg

SEQ ID NO: 179970 - DNA, 75 bp, Artificial Sequence
  Synthetic
acgcgcttagatcctgagagatgcaaagttctctaaaatcgttaaaaaattgcaaacacgactccggtaactggg

SEQ ID NO: 179971 - DNA, 75 bp, Artificial Sequence
  Synthetic
aagttctctaaaatcgttaaaaaattgcaaacacgactccggtaactggggttgtccagtacagggggctacaaa

SEQ ID NO: 179972 - DNA, 75 bp, Artificial Sequence
  Synthetic
ccagggcatccacaataaacctcgtaacccagttaaggctccttcgcccagccatgactagggctgtctaatccc

SEQ ID NO: 179973 - DNA, 75 bp, Artificial Sequence
  Synthetic
aacccagttaaggctccttcgcccagccatgactagggctgtctaatccctccgtgcctatattcagacagggcc

SEQ ID NO: 179974 - DNA, 75 bp, Artificial Sequence
  Synthetic
cgtgcatgtgctgccactacgagcgatagtgtcgctccggagcccaggcgccgcctcccaaaacccggttagccc

SEQ ID NO: 179975 - DNA, 75 bp, Artificial Sequence
  Synthetic
atagtgtcgctccggagcccaggcgccgcctcccaaaacccggttagcccttagacatccaacatccgctacgtt

SEQ ID NO: 179976 - DNA, 75 bp, Artificial Sequence
  Synthetic
acgcacccggaattaagccacgtcatccttccgcgccacttaacagttttcctaccctaccacgcacgtccacaa

SEQ ID NO: 179977 - DNA, 75 bp, Artificial Sequence
  Synthetic
tccttccgcgccacttaacagttttcctaccctaccacgcacgtccacaagatggcactacaacccacaaattac

SEQ ID NO: 179978 - DNA, 75 bp, Artificial Sequence
  Synthetic
gcacactgcgcgtggtacacgggtgccaaatacacgcggataatcacaggacagctattcatgggttcctgtctc

SEQ ID NO: 179979 - DNA, 75 bp, Artificial Sequence
  Synthetic
ccaaatacacgcggataatcacaggacagctattcatgggttcctgtctcataaattccttccctaagtaaattg

SEQ ID NO: 179980 - DNA, 75 bp, Artificial Sequence
  Synthetic
aacgcctcctgtacttcatgccgagtagagagacgccgaaaacggtgaacctttcttagagacgcattgccaata

SEQ ID NO: 179981 - DNA, 75 bp, Artificial Sequence
  Synthetic
tagagagacgccgaaaacggtgaacctttcttagagacgcattgccaataaagaaagcggggcatgccagtaaac

SEQ ID NO: 179982 - DNA, 75 bp, Artificial Sequence
  Synthetic
agcatagccagcgtatgcgcgagtcgtctatccagatgttcgcggcatgctccggtaaccggtagcacaagtttg

SEQ ID NO: 179983 - DNA, 75 bp, Artificial Sequence
  Synthetic
gtctatccagatgttcgcggcatgctccggtaaccggtagcacaagtttgtatggtggcatatactgacatacgt

SEQ ID NO: 179984 - DNA, 75 bp, Artificial Sequence
  Synthetic
tcgtcaaacatagtctgtacgagcttcccataataaaatacttctgcgacaagcggtaccagacgagtgccggta

SEQ ID NO: 179985 - DNA, 75 bp, Artificial Sequence
  Synthetic
tcccataataaaatacttctgcgacaagcggtaccagacgagtgccggtacattgaatgtgccttttggttttca

SEQ ID NO: 179986 - DNA, 75 bp, Artificial Sequence
  Synthetic
gactcgccgtaccacgaaaaacgtgatggatcccgaccggccccgcccgtcgaaaccctctcctggttaatgggc

SEQ ID NO: 179987 - DNA, 75 bp, Artificial Sequence
  Synthetic
atggatcccgaccggccccgcccgtcgaaaccctctcctggttaatgggctggatgatgtcacaaatatcatcca

SEQ ID NO: 179988 - DNA, 75 bp, Artificial Sequence
  Synthetic
acaatccccagcgtatcctgcaccgcctggcggatgtatgatctggatgcctcgtccgcctccgtgctggtacct

SEQ ID NO: 179989 - DNA, 75 bp, Artificial Sequence
  Synthetic
cctggcggatgtatgatctggatgcctcgtccgcctccgtgctggtacctgtactgccggctgcggcttggaggg

SEQ ID NO: 179990 - DNA, 75 bp, Artificial Sequence
  Synthetic
gacgtggaacttaacccgggacttagcatatcctgcaaggcctggcgaatgaaaagcctgtgtgcctccccctga

SEQ ID NO: 179991 - DNA, 75 bp, Artificial Sequence
  Synthetic
gcatatcctgcaaggcctggcgaatgaaaagcctgtgtgcctccccctgatctacaccgacacaactatcgtctg

SEQ ID NO: 179992 - DNA, 75 bp, Artificial Sequence
  Synthetic
gcacattttgcacaactgcggctgctggagatgaagggagccctgggtgtcctccctccatggggacagcacgag

SEQ ID NO: 179993 - DNA, 75 bp, Artificial Sequence
  Synthetic
tggagatgaagggagccctgggtgtcctccctccatggggacagcacgaggcccttcacaagaccaccaggccct

SEQ ID NO: 179994 - DNA, 75 bp, Artificial Sequence
  Synthetic
agtaggctgtggggcacactgtccttgtctgagctctgctttccatgggcacacaacaaggagtaaattgtccaa

SEQ ID NO: 179995 - DNA, 75 bp, Artificial Sequence
  Synthetic
tgtctgagctctgctttccatgggcacacaacaaggagtaaattgtccaattccagcgagttccagcggtgcctc

SEQ ID NO: 179996 - DNA, 75 bp, Artificial Sequence
  Synthetic
ggctgtgtggaacaatggataaaccgagggtaacaaccaggttgccggtcgtgcagagcgcaagcaccaattctg

SEQ ID NO: 179997 - DNA, 75 bp, Artificial Sequence
  Synthetic
gagggtaacaaccaggttgccggtcgtgcagagcgcaagcaccaattctggtccattgatggccctgcttaattt

SEQ ID NO: 179998 - DNA, 75 bp, Artificial Sequence
  Synthetic
agaatgagacaaacaagcaagctccaagcgctggagacgacgagctcggtcctagcacgtgaacaagcgcgagca

SEQ ID NO: 179999 - DNA, 75 bp, Artificial Sequence
  Synthetic
aagcgctggagacgacgagctcggtcctagcacgtgaacaagcgcgagcaggacggcggccaggggaacatgaat

SEQ ID NO: 180000 - DNA, 75 bp, Artificial Sequence
  Synthetic
ccacacaaaataaagacagatatttgttcaggcccaccagtgaattcgtcaccagtcctgccgacaacgtgccgg

SEQ ID NO: 180001 - DNA, 75 bp, Artificial Sequence
  Synthetic
gttcaggcccaccagtgaattcgtcaccagtcctgccgacaacgtgccggcaaccacggcagcgaccagcaaggc

SEQ ID NO: 180002 - DNA, 75 bp, Artificial Sequence
  Synthetic
acttcacatgtttacatggcacagtaaatacggcccgccttcgctgtagcccggccatcacagccggatgcgtct

SEQ ID NO: 180003 - DNA, 75 bp, Artificial Sequence
  Synthetic
aaatacggcccgccttcgctgtagcccggccatcacagccggatgcgtctccagatctctaagtgcaaagatgcc

SEQ ID NO: 180004 - DNA, 75 bp, Artificial Sequence
  Synthetic
ttttcctaaaaatgagtacatagtaaaccataaaggccccgcaaaaccccagttcgtagtatctgtgagccacgg

SEQ ID NO: 180005 - DNA, 75 bp, Artificial Sequence
  Synthetic
aaccataaaggccccgcaaaaccccagttcgtagtatctgtgagccacgggtggggcgaggtaggttactcgtgc

SEQ ID NO: 180006 - DNA, 75 bp, Artificial Sequence
  Synthetic
caggaattattggcactggcgcaaatgtcattccagcgaacgtcgcgcagagaacggtgacaatcacagacgcca

SEQ ID NO: 180007 - DNA, 75 bp, Artificial Sequence
  Synthetic
tgtcattccagcgaacgtcgcgcagagaacggtgacaatcacagacgccagacacatccacttgaggttgtcagt

SEQ ID NO: 180008 - DNA, 75 bp, Artificial Sequence
  Synthetic
gaagaggtacaatagaccagtagaaaatggcggtaatctgcgtcgtaaagagggcaaacgagtacagtgacttaa

SEQ ID NO: 180009 - DNA, 75 bp, Artificial Sequence
  Synthetic
aatggcggtaatctgcgtcgtaaagagggcaaacgagtacagtgacttaaaaatgaaccaccacaaaaatggtgt

SEQ ID NO: 180010 - DNA, 75 bp, Artificial Sequence
  Synthetic
tactgcgagagcacataattttaaattaatggattaaacgtagtcttggaaaccttgccgcgctctctaccaatg

SEQ ID NO: 180011 - DNA, 75 bp, Artificial Sequence
  Synthetic
ttaatggattaaacgtagtcttggaaaccttgccgcgctctctaccaatgcccgcggcggatcgtcttttttgcc

SEQ ID NO: 180012 - DNA, 75 bp, Artificial Sequence
  Synthetic
ggctgtttaccctcttttggagaaatcccggcacagaactctcctccaggcgtgaccggcggcgagatgggagac

SEQ ID NO: 180013 - DNA, 75 bp, Artificial Sequence
  Synthetic
tcccggcacagaactctcctccaggcgtgaccggcggcgagatgggagacgggggcctaatctcctcgctaacat

SEQ ID NO: 180014 - DNA, 75 bp, Artificial Sequence
  Synthetic
tgctcgcttatactctgctcgtcaacctttaagagcagtacgctgagcttgacgtcacatgggtgactggcaatc

SEQ ID NO: 180015 - DNA, 75 bp, Artificial Sequence
  Synthetic
cctttaagagcagtacgctgagcttgacgtcacatgggtgactggcaatcgacacgccttcgacttctaatatgt

SEQ ID NO: 180016 - DNA, 75 bp, Artificial Sequence
  Synthetic
agccgcagagccgccagcagagactctagactcacttgggtggcggcatctgtccgcaccacgcccacgtctatc

SEQ ID NO: 180017 - DNA, 75 bp, Artificial Sequence
  Synthetic
ctagactcacttgggtggcggcatctgtccgcaccacgcccacgtctatctgtttttttctcttgagtgtctccc

SEQ ID NO: 180018 - DNA, 75 bp, Artificial Sequence
  Synthetic
cctgcaactgagaacgtaacaacagaaagtgtctcactcgcggccaccgtcactgtctgatcggccctggttttc

SEQ ID NO: 180019 - DNA, 75 bp, Artificial Sequence
  Synthetic
aaagtgtctcactcgcggccaccgtcactgtctgatcggccctggttttctgttgcctcaaccatctagtcaaca

SEQ ID NO: 180020 - DNA, 75 bp, Artificial Sequence
  Synthetic
tccatcctgtcatagaacgctggaaggttgtttggatccaatacgcttttgtgaacggtggtcgtcacgttatcg

SEQ ID NO: 180021 - DNA, 75 bp, Artificial Sequence
  Synthetic
ggttgtttggatccaatacgcttttgtgaacggtggtcgtcacgttatcgctatatgagatggttgtcctcacaa

SEQ ID NO: 180022 - DNA, 75 bp, Artificial Sequence
  Synthetic
atgctggtttcgagaatgttagatccaaaaatctctcgcgtgtgcgtgaatccgttaccgattgaggtgttcctg

SEQ ID NO: 180023 - DNA, 75 bp, Artificial Sequence
  Synthetic
caaaaatctctcgcgtgtgcgtgaatccgttaccgattgaggtgttcctgaaactaaaatttacttctccgtcgg

SEQ ID NO: 180024 - DNA, 75 bp, Artificial Sequence
  Synthetic
aaaacaccggcaggaccgaggctggatagaacgcttaacaccggggcagttcccgggccgtgtatctgaataacg

SEQ ID NO: 180025 - DNA, 75 bp, Artificial Sequence
  Synthetic
atagaacgcttaacaccggggcagttcccgggccgtgtatctgaataacgccgcttttaattgacgtcttaagat

SEQ ID NO: 180026 - DNA, 75 bp, Artificial Sequence
  Synthetic
ccataatgaaaatccacaggcatgatagcagataatgggaaccgttgtaagcaggcactgtctttagcagcactg

SEQ ID NO: 180027 - DNA, 75 bp, Artificial Sequence
  Synthetic
tagcagataatgggaaccgttgtaagcaggcactgtctttagcagcactgagccgcccgggcaagggcaggcctt

SEQ ID NO: 180028 - DNA, 75 bp, Artificial Sequence
  Synthetic
tcacaaatcgtttctcacgcaagttgtgtaatctgaattatcacgctcgaaaaaattcacacactttgcgctgcc

SEQ ID NO: 180029 - DNA, 75 bp, Artificial Sequence
  Synthetic
gtgtaatctgaattatcacgctcgaaaaaattcacacactttgcgctgccggtgtacgacagggggcatgtctcg

SEQ ID NO: 180030 - DNA, 75 bp, Artificial Sequence
  Synthetic
atctgcggtggcctccaggaaacgacggatgtctgccacgtcaacaagcgtcacgtgttccgcctttgcctcaat

SEQ ID NO: 180031 - DNA, 75 bp, Artificial Sequence
  Synthetic
cggatgtctgccacgtcaacaagcgtcacgtgttccgcctttgcctcaataaaccgcgtctcaatgtccactgcc

SEQ ID NO: 180032 - DNA, 75 bp, Artificial Sequence
  Synthetic
tagcagagtgttgtacagcatggccgctgcccgcgtatgcaacaactcgtcgcgagatatataatcgttggccaa

SEQ ID NO: 180033 - DNA, 75 bp, Artificial Sequence
  Synthetic
gctgcccgcgtatgcaacaactcgtcgcgagatatataatcgttggccaaacacaccccaggcataataccgcga

SEQ ID NO: 180034 - DNA, 75 bp, Artificial Sequence
  Synthetic
gatcaacagaaagagcagaattttttgagccctggtggacgccccacgaaccctcttatgcaaccactctagttt

SEQ ID NO: 180035 - DNA, 75 bp, Artificial Sequence
  Synthetic
tgagccctggtggacgccccacgaaccctcttatgcaaccactctagtttctcacaaagcgcggggtccttcacg

SEQ ID NO: 180036 - DNA, 75 bp, Artificial Sequence
  Synthetic
ctgtaaaatgttggcatagactttcccgtgaatattctccatggccatttgctcggcatagtagtgagccgcatc

SEQ ID NO: 180037 - DNA, 75 bp, Artificial Sequence
  Synthetic
ccgtgaatattctccatggccatttgctcggcatagtagtgagccgcatcgtgacactgaaaatttgtcacgagg

SEQ ID NO: 180038 - DNA, 75 bp, Artificial Sequence
  Synthetic
taaaaatttgtaaaattctctatcggcctcgctcaaagtttgaacgtggccaacgtccagatgcaggggaatttg

SEQ ID NO: 180039 - DNA, 75 bp, Artificial Sequence
  Synthetic
gcctcgctcaaagtttgaacgtggccaacgtccagatgcaggggaatttggccaggaaaccaacgattctgccac

SEQ ID NO: 180040 - DNA, 75 bp, Artificial Sequence
  Synthetic
ctggttaatcgaatccattgtgtaaagctgtgctctgtagcgtgactcaacacctactggcaggccaggcacgcg

SEQ ID NO: 180041 - DNA, 75 bp, Artificial Sequence
  Synthetic
agctgtgctctgtagcgtgactcaacacctactggcaggccaggcacgcgtcctctggttcattctgtaaaagcc

SEQ ID NO: 180042 - DNA, 75 bp, Artificial Sequence
  Synthetic
tgagtcggtgaccccggggccatcaaacactgcaaggccgctaagctcgactgcttttgaatgcgacaataatac

SEQ ID NO: 180043 - DNA, 75 bp, Artificial Sequence
  Synthetic
aacactgcaaggccgctaagctcgactgcttttgaatgcgacaataatacatgatggttttgagtcccaggcgat

SEQ ID NO: 180044 - DNA, 75 bp, Artificial Sequence
  Synthetic
tccttgaggaagtaacttaaagactggctttgatctatgaagggagctcttgctctggcacggtccagctgctga

SEQ ID NO: 180045 - DNA, 75 bp, Artificial Sequence
  Synthetic
ggctttgatctatgaagggagctcttgctctggcacggtccagctgctgaaaagggcaataatcaaaagctgata

SEQ ID NO: 180046 - DNA, 75 bp, Artificial Sequence
  Synthetic
cccccgtactgccgaactaggtttaggtcctccgggaggaccctcttaaaaaatgacacattaggcctcaagatc

SEQ ID NO: 180047 - DNA, 75 bp, Artificial Sequence
  Synthetic
ggtcctccgggaggaccctcttaaaaaatgacacattaggcctcaagatctcttctttgttggtcaccctagatg

SEQ ID NO: 180048 - DNA, 75 bp, Artificial Sequence
  Synthetic
gacgtgcccgccgtcggcatcatcgccaaaaactgagagttaaaaattccgtgtttagctatgctctgtccaaga

SEQ ID NO: 180049 - DNA, 75 bp, Artificial Sequence
  Synthetic
ccaaaaactgagagttaaaaattccgtgtttagctatgctctgtccaagagattcccagcgatgcgatggcacaa

SEQ ID NO: 180050 - DNA, 75 bp, Artificial Sequence
  Synthetic
aaattgctggtttcccagcctttaaacggagtgcctttaccttccactactatagagtgactcatttctacagca

SEQ ID NO: 180051 - DNA, 75 bp, Artificial Sequence
  Synthetic
acggagtgcctttaccttccactactatagagtgactcatttctacagcagtatagtacatccattgaaaaatat

SEQ ID NO: 180052 - DNA, 75 bp, Artificial Sequence
  Synthetic
gcaaaaacgtccgccagtccctgcacgccaatccccagagaccgctcctgctgtccaacgcgcacgccaggagtg

SEQ ID NO: 180053 - DNA, 75 bp, Artificial Sequence
  Synthetic
cgccaatccccagagaccgctcctgctgtccaacgcgcacgccaggagtggggtggaatccgcctagaatacacg

SEQ ID NO: 180054 - DNA, 75 bp, Artificial Sequence
  Synthetic
caaaacgacagtttgtccgttcccaccaatcccgcatttgcgcagccatgagcgcggatgcatttgggaagacag

SEQ ID NO: 180055 - DNA, 75 bp, Artificial Sequence
  Synthetic
ccaatcccgcatttgcgcagccatgagcgcggatgcatttgggaagacagatgttagccaagttgcagaccgagg

SEQ ID NO: 180056 - DNA, 75 bp, Artificial Sequence
  Synthetic
atggcttctccctgagtttccgtccagtggtgcacattaagagcctctttcaacaacacaaacggagatcccgtt

SEQ ID NO: 180057 - DNA, 75 bp, Artificial Sequence
  Synthetic
agtggtgcacattaagagcctctttcaacaacacaaacggagatcccgtttttatgatagtatttattaggttaa

SEQ ID NO: 180058 - DNA, 75 bp, Artificial Sequence
  Synthetic
aatgaccagtacgcgtcatcaaaagccgagccgtagaggttaaccaattcaggcgcgtccacagggtcaaataga

SEQ ID NO: 180059 - DNA, 75 bp, Artificial Sequence
  Synthetic
ccgagccgtagaggttaaccaattcaggcgcgtccacagggtcaaatagataccaggtagcatcgggatcgttct

SEQ ID NO: 180060 - DNA, 75 bp, Artificial Sequence
  Synthetic
tggcatcgatcggggttctcgggtagctttgcacttaaaaactcgcagatctgactgtgccacagttccatgtag

SEQ ID NO: 180061 - DNA, 75 bp, Artificial Sequence
  Synthetic
gctttgcacttaaaaactcgcagatctgactgtgccacagttccatgtagacgctggttcccactggtcttatgt

SEQ ID NO: 180062 - DNA, 75 bp, Artificial Sequence
  Synthetic
gcaacgttttttggtttagaaaatgtagtcacgtccaagccaacgcctgatttactggccaagagcggactcatc

SEQ ID NO: 180063 - DNA, 75 bp, Artificial Sequence
  Synthetic
tagtcacgtccaagccaacgcctgatttactggccaagagcggactcatctcgtggtacagggcccgcaacgtgt

SEQ ID NO: 180064 - DNA, 75 bp, Artificial Sequence
  Synthetic
ccttcccgcacgcccgcggcacgcataaccggggtcgcgcagcaaacatgctgagatgcgagatatgaaaacacg

SEQ ID NO: 180065 - DNA, 75 bp, Artificial Sequence
  Synthetic
taaccggggtcgcgcagcaaacatgctgagatgcgagatatgaaaacacgtactcgacaatactcagagtaccaa

SEQ ID NO: 180066 - DNA, 75 bp, Artificial Sequence
  Synthetic
tgtggggaaaagcaagagagatcagattgttactgtgtctgtgtagaaagaagtagacataggagactccatttt

SEQ ID NO: 180067 - DNA, 75 bp, Artificial Sequence
  Synthetic
gttatgtactaagaaaaattcttctgccttgagattctgttaatctatgaccttacccccaaccccgtgctctct

SEQ ID NO: 180068 - DNA, 75 bp, Artificial Sequence
  Synthetic
gatgtctctatcattgctttaaatcagtggccaaaaaattggcctaaacaaaaggctgttataggacttgtcggc

SEQ ID NO: 180069 - DNA, 75 bp, Artificial Sequence
  Synthetic
agtggccaaaaaattggcctaaacaaaaggctgttataggacttgtcggcataggcacagcctcagaagtgtatc

SEQ ID NO: 180070 - DNA, 75 bp, Artificial Sequence
  Synthetic
gttgaatggattaagggcggtgcaggatgtgctttgttaaacagatgcttgaaggcagcatgctccttaagagtc

SEQ ID NO: 180071 - DNA, 75 bp, Artificial Sequence
  Synthetic
atcaccactccctaatctcaagtacccagggacacaaaaactgcggaaggccgcagggacctctgcctaggaaag

SEQ ID NO: 180072 - DNA, 75 bp, Artificial Sequence
  Synthetic
ccaggtattgtccaaggtttctccccatgtgatagtctgaaatatggcctcgtgggaagggaaagacctgaccgt

SEQ ID NO: 180073 - DNA, 75 bp, Artificial Sequence
  Synthetic
ccacgagtcaaaaaatcatgaccaagaggggatatataccaggaaagggactagggaaaaatgaagatggcatta

SEQ ID NO: 180074 - DNA, 75 bp, Artificial Sequence
  Synthetic
tctgtgctgaggaggattagtataagaggaaggaatgcctcttgcagttgagacaagaggaaggcatctgtctcc

SEQ ID NO: 180075 - DNA, 75 bp, Artificial Sequence
  Synthetic
aaattccatttgaggctaaaataaatcaaaaaagagaaggaatagggtatcctttttaggggtggccactataga

SEQ ID NO: 180076 - DNA, 75 bp, Artificial Sequence
  Synthetic
cctttttaggggtggccactatagagcctccgaaacccataccattaacttggaaaacagaaaaactggtgtggg

SEQ ID NO: 180077 - DNA, 75 bp, Artificial Sequence
  Synthetic
tccatctactgagatagggaaaaaccgcctcagggctggaggtgggacctgcgggcagcaatactgctttgtaaa

SEQ ID NO: 180078 - DNA, 75 bp, Artificial Sequence
  Synthetic
taaatcagtggccgctaccaaaacaaaaactggaggctttacatttattagcaaatgaacagttagaaaagggtc

SEQ ID NO: 180079 - DNA, 75 bp, Artificial Sequence
  Synthetic
gcgggcagcaatactgctttgtaaagcactgagatgtttatgtgtatgcatatctaaaagcacagcacttaatcc

SEQ ID NO: 180080 - DNA, 75 bp, Artificial Sequence
  Synthetic
aaaactggaggctttacatttattagcaaatgaacagttagaaaagggtcatattgagccttcgttctcaccttg

SEQ ID NO: 180081 - DNA, 75 bp, Artificial Sequence
  Synthetic
tttacattgtctatgatgccaagacctttgttcacgtgtttgtctgctgaccctctccccacaattgtcttgtga

SEQ ID NO: 180082 - DNA, 75 bp, Artificial Sequence
  Synthetic
ccctgacacatccccctctttgagaaacacccacagatgatcaataaatactaagggaactcagaggctggcggg

SEQ ID NO: 180083 - DNA, 75 bp, Artificial Sequence
  Synthetic
aacacccacagatgatcaataaatactaagggaactcagaggctggcgggatcctccatatgctgaacgctggtt

SEQ ID NO: 180084 - DNA, 75 bp, Artificial Sequence
  Synthetic
ccccggttccccttatttctttctctatactttgtctctgtgtctttttcttttccaaatctctcgtcccacctt

SEQ ID NO: 180085 - DNA, 75 bp, Artificial Sequence
  Synthetic
ttttccaaatctctcgtcccaccttacgagaaacacccacaggtgtgtaggggcaacccacccctacatctggtg

SEQ ID NO: 180086 - DNA, 75 bp, Artificial Sequence
  Synthetic
tacctcagggaatgcttaatagtccaactatttgtcagacttttgtaggtcgagctcttcaaccagttagaaaaa

SEQ ID NO: 180087 - DNA, 75 bp, Artificial Sequence
  Synthetic
cccaacgtggaggcttttctctagggtgaaggtacgctcgagcgtggtcattgaggacaagtcgacgagagatcc

SEQ ID NO: 180088 - DNA, 75 bp, Artificial Sequence
  Synthetic
agttttcagactgttatattattcattatattgatgatattttatgtgctgcagaaacgaaagataaattaattg

SEQ ID NO: 180089 - DNA, 75 bp, Artificial Sequence
  Synthetic
cgagtacgtctacagtcagccttacggtaagcttgtgcgctcggaagaagctagggtgataatggggcaaactaa

SEQ ID NO: 180090 - DNA, 75 bp, Artificial Sequence
  Synthetic
aagtaaaattaaaagtaaatatgcctcttatctcagctttattaaaattcttttaaaaagagggggagttaaagt

SEQ ID NO: 180091 - DNA, 75 bp, Artificial Sequence
  Synthetic
atctacaaaaaatctaatcaagctatttcaaataatagaacaattttgcccatggtttccagaacaaggaacttt

SEQ ID NO: 180092 - DNA, 75 bp, Artificial Sequence
  Synthetic
cattaaaaacactaaatgattttcaaaaattactaggagatattaattggattcagccaactctaggcattccta

SEQ ID NO: 180093 - DNA, 75 bp, Artificial Sequence
  Synthetic
agatctaaaagactggaaaagaattggtaaggaactaaaacaagcaggtaggaagggtaatatcattccacttac

SEQ ID NO: 180094 - DNA, 75 bp, Artificial Sequence
  Synthetic
cttatgccatgtcaaatttgttctctatcttaagaggagactcagacttaaatagtaaaagaatattaaccccag

SEQ ID NO: 180095 - DNA, 75 bp, Artificial Sequence
  Synthetic
agtatggaatgattgggccattattaaagcagctttagaaccatttcaaacagaagaagatagtgtttcagtttc

SEQ ID NO: 180096 - DNA, 75 bp, Artificial Sequence
  Synthetic
tgatgcccctggaagctgtataatagattgtaatgaaaagacaaggaaaaaatcccagaaagaaaccgaaagttt

SEQ ID NO: 180097 - DNA, 75 bp, Artificial Sequence
  Synthetic
cactccaacttttgatttttgccactgcacattctccaacaggtatcattattcaaaatactgatcttgtggagt

SEQ ID NO: 180098 - DNA, 75 bp, Artificial Sequence
  Synthetic
gattgtaatgaaaagacaaggaaaaaatcccagaaagaaaccgaaagtttacattgcgaatatgtagcagagcca

SEQ ID NO: 180099 - DNA, 75 bp, Artificial Sequence
  Synthetic
gtaatggctcagtcaacgcaaaatgctgactataatcaattacaggaggtgatatatcctgaaacgttaaaatta

SEQ ID NO: 180100 - DNA, 75 bp, Artificial Sequence
  Synthetic
gaaggaaaaggtccagaattaatggggccatcagagtctaaaccacgaggcacaagtcctcttccagcaggtcag

SEQ ID NO: 180101 - DNA, 75 bp, Artificial Sequence
  Synthetic
gtgcccgtaacattacaacctcaaaagcaggttaaagaaaataagacccaaccgccagtagcctaccaatactgg

SEQ ID NO: 180102 - DNA, 75 bp, Artificial Sequence
  Synthetic
agcaggttaaagaaaataagacccaaccgccagtagcctaccaatactggccgccggctgaacttcagtatcagc

SEQ ID NO: 180103 - DNA, 75 bp, Artificial Sequence
  Synthetic
cacccccagaaagtcagtatggatatccaggaatgcccccagcaccacagggcagggcgccataccctcagccgc

SEQ ID NO: 180104 - DNA, 75 bp, Artificial Sequence
  Synthetic
ccactaggagacttaatcctacggcaccacctagtagacagggtagtgaattacatgaaattattgataaatcaa

SEQ ID NO: 180105 - DNA, 75 bp, Artificial Sequence
  Synthetic
gaaaggaaggagatactgaggcatggcaattcccagtaacgttagaactgatgccacctggagaaggagcccaag

SEQ ID NO: 180106 - DNA, 75 bp, Artificial Sequence
  Synthetic
agggagagcctcccacagttgaggccagatacaagtctttttcgataaaaatgctaaaagatatgaaagagggag

SEQ ID NO: 180107 - DNA, 75 bp, Artificial Sequence
  Synthetic
taaaacagtatggacccaactccccttatatgaggacattattagattccattgctcatggacatagactcattc

SEQ ID NO: 180108 - DNA, 75 bp, Artificial Sequence
  Synthetic
cttatgattgggagattctggcaaaatcgtctctctcaccctctcaatttttacaatttaagacttggtggattg

SEQ ID NO: 180109 - DNA, 75 bp, Artificial Sequence
  Synthetic
atggggtacaagaacaggtccgaagaaatagggctgccaatcctccagttaacatagatgcagatcaactattag

SEQ ID NO: 180110 - DNA, 75 bp, Artificial Sequence
  Synthetic
gaataggtcaaaattggagtactattagtcaacaagcattaatgcaaaatgaggccattgagcaagttagagcta

SEQ ID NO: 180111 - DNA, 75 bp, Artificial Sequence
  Synthetic
tctgccttagagcctgggaaaaaatccaagacccaggaagtacctgcccctcatttaatacagtaagacaaggtt

SEQ ID NO: 180112 - DNA, 75 bp, Artificial Sequence
  Synthetic
caaaagagccctatcctgattttgtggcaaggctccaagatgttgctcaaaagtcaattgccgatgaaaaagccc

SEQ ID NO: 180113 - DNA, 75 bp, Artificial Sequence
  Synthetic
gtaaggtcatagtggagttaatggcatatgaaaacgccaatcctgagtgtcaatcagccattaagccattaaaag

SEQ ID NO: 180114 - DNA, 75 bp, Artificial Sequence
  Synthetic
gaaaggttcctgcaggatcagatgtaatctcagaatatgtaaaagcctgtgatggaatgggaggagctatgcata

SEQ ID NO: 180115 - DNA, 75 bp, Artificial Sequence
  Synthetic
aagctatgcttatggctcaagcaataacaggagttgttttaggaggacaagttagaacatttggaggaaaatgtt

SEQ ID NO: 180116 - DNA, 75 bp, Artificial Sequence
  Synthetic
ataattgtggtcaaattggtcacttaaaaaagaattgcccagtcttaaacaaacagaatataactattcaagcaa

SEQ ID NO: 180117 - DNA, 75 bp, Artificial Sequence
  Synthetic
ctacaacaggtagagagccacctgacttatgtccaagatgtaaaaaaggaaaacattgggctagtcaatgtcgtt

SEQ ID NO: 180118 - DNA, 75 bp, Artificial Sequence
  Synthetic
ctaaatttgataaaaatgggcaaccattgtcgggaaacgagcaaaggggccagcctcaggccccacaacaaactg

SEQ ID NO: 180119 - DNA, 75 bp, Artificial Sequence
  Synthetic
cagcctcaggccccacaacaaactggggcattcccaattcagccatttgttcctcagggttttcagggacaacaa

SEQ ID NO: 180120 - DNA, 75 bp, Artificial Sequence
  Synthetic
cccccactgtcccaagtgtttcagggaataagccagttaccacaatacaacaattgtcccccgccacaagcggca

SEQ ID NO: 180121 - DNA, 75 bp, Artificial Sequence
  Synthetic
gtgcagcagtagatttatgtactatacaagcagtctctctgcttccaggggagcccccacaaaaaatccctacag

SEQ ID NO: 180122 - DNA, 75 bp, Artificial Sequence
  Synthetic
gactgtaggactaatcttgggaagatcaagtctaaatctaaaaggagttcaaattcatactagtgtggttgattc

SEQ ID NO: 180123 - DNA, 75 bp, Artificial Sequence
  Synthetic
gcagccttgatgattgtatcaatggtggtaagtctccctatgcctgcaggagcagctgtagctaactataccaac

SEQ ID NO: 180124 - DNA, 75 bp, Artificial Sequence
  Synthetic
agactataaaggcgaaattcaattggttattagctcttcaattccttggagtgccagtccaggagacaggattgc

SEQ ID NO: 180125 - DNA, 75 bp, Artificial Sequence
  Synthetic
tgggcctatgtgcctttcccgcccttaattcgggcagtcacatggatggataatcctatagaagtatatgttaat

SEQ ID NO: 180126 - DNA, 75 bp, Artificial Sequence
  Synthetic
tcaattattactcctgccatatattaagggtggaaatagtgaaataaaaagaacaggagggcttggaagcactga

SEQ ID NO: 180127 - DNA, 75 bp, Artificial Sequence
  Synthetic
taatcctatagaagtatatgttaatgatagtgtatgggtacctggccccatagatgatcgctgccctgccaaacc

SEQ ID NO: 180128 - DNA, 75 bp, Artificial Sequence
  Synthetic
tccgacaggaaaggctgcatattgggcaagtcaggtctcagagaacagacctgtgtgtaaggccattattcaagg

SEQ ID NO: 180129 - DNA, 75 bp, Artificial Sequence
  Synthetic
aaaacagtttgaagggttggtagacactggagcagatgtctctatcattgctttaaatcagtggccaaaaaattg

SEQ ID NO: 180130 - DNA, 75 bp, Artificial Sequence
  Synthetic
ctttaaatcagtggccaaaaaattggcctaaacaaaaggctgttacaggacttgtcggcataagcacagcctcag

SEQ ID NO: 180131 - DNA, 75 bp, Artificial Sequence
  Synthetic
aagtgtatcaaagtacggagattttacattgcttagggccagataatcaagaaagtactgttcagccaatgatta

SEQ ID NO: 180132 - DNA, 75 bp, Artificial Sequence
  Synthetic
cttcaattcctcttaatctgtggggtcgagatttattacaacaatggggtgtggaaatcaccatgcccgctccat

SEQ ID NO: 180133 - DNA, 75 bp, Artificial Sequence
  Synthetic
atacagaagttttagtttgggaagaatgtgtggccaatagtgcggtgatattacaaaacaatgaatttggaacta

SEQ ID NO: 180134 - DNA, 75 bp, Artificial Sequence
  Synthetic
tatatagccccacgagtcaaaaaatcatgaccaagatgggatatataccaggaaagggactagggaaaaatgaag

SEQ ID NO: 180135 - DNA, 75 bp, Artificial Sequence
  Synthetic
ttatagattgggcacctcgaggtcaattctaccacaattgctcaggacaaactcagtcgtgtccaagtgcacaag

SEQ ID NO: 180136 - DNA, 75 bp, Artificial Sequence
  Synthetic
atggcattaaagttccagttgaggctaaaataaatcaagaaagagaaggaatagggtatcctttttaggggcggc

SEQ ID NO: 180137 - DNA, 75 bp, Artificial Sequence
  Synthetic
cactgtagagcctcctaaacccataccattaacttggaaaacagaaaaaccagtgtgggtaaatcagtggccgct

SEQ ID NO: 180138 - DNA, 75 bp, Artificial Sequence
  Synthetic
cataaaaaattgcagtctttctacccttgggaatggggagaaaaaagaatctctaccccaagaccaaaaatagta

SEQ ID NO: 180139 - DNA, 75 bp, Artificial Sequence
  Synthetic
accaaaacaaaaactggaggctttacatttattagcaaatgaacagttagaaaagggtcacattgaaccttcgtt

SEQ ID NO: 180140 - DNA, 75 bp, Artificial Sequence
  Synthetic
ctcaccttggaattctcctgtgtttgtaattcagaagaaatcaggcaaatggcgtatgttaactgacttaagggc

SEQ ID NO: 180141 - DNA, 75 bp, Artificial Sequence
  Synthetic
tgtaaacgccgtaattcaacccatggggcctctccaacctgggttgccctctccagccatgatcccaaaagattg

SEQ ID NO: 180142 - DNA, 75 bp, Artificial Sequence
  Synthetic
gcctttaattataattgatctaaaggattgcttttttaccatccctctggcagagcaggattgtgaaaaatttgc

SEQ ID NO: 180143 - DNA, 75 bp, Artificial Sequence
  Synthetic
ctttactataccagccataaataataaagaaccagccaccaggtttcagtggaaagtgttacctcagggaatgct

SEQ ID NO: 180144 - DNA, 75 bp, Artificial Sequence
  Synthetic
ggaaagtgttacctcagggaatgcttaatagtccaactatttgtcagacttttgtaggtcgagctcttcaaccag

SEQ ID NO: 180145 - DNA, 75 bp, Artificial Sequence
  Synthetic
taatagtccaactatttgtcagacttttgtaggtcgagctcttcaaccagttagagacaagttttcagactgtta

SEQ ID NO: 180146 - DNA, 75 bp, Artificial Sequence
  Synthetic
tatcattcattatattgatgatattttatgtgctgcagaaacgaaagataaattaattgactgttatacatttct

SEQ ID NO: 180147 - DNA, 75 bp, Artificial Sequence
  Synthetic
caggagttgcattgcactcttctgttcagtcagtaaactttgttaatgatgggcaaaagaattctacaagattgt

SEQ ID NO: 180148 - DNA, 75 bp, Artificial Sequence
  Synthetic
gcaagcagaggttgccaatgctggactggcaatagcatctgataagatccaaacctctactccttttcattattt

SEQ ID NO: 180149 - DNA, 75 bp, Artificial Sequence
  Synthetic
agggatgcagatagaaaatagaaaaattaagccacaaaaaatagaaataagaaaagacacattaaaaacactaaa

SEQ ID NO: 180150 - DNA, 75 bp, Artificial Sequence
  Synthetic
tcactgggacatggttagacgccatctacagggaagagaagataatctcactttagacatttccaaattaaaaga

SEQ ID NO: 180151 - DNA, 75 bp, Artificial Sequence
  Synthetic
gcattcctacttatgtcatgtcaaatttgttctctatcttaagaggagactcagacttaaatagtaaaagaatgt

SEQ ID NO: 180152 - DNA, 75 bp, Artificial Sequence
  Synthetic
taaccccagagacaacaaaagaaattaaattagtggaagaaaaaattcagtcagcacaaataaatagaatagatc

SEQ ID NO: 180153 - DNA, 75 bp, Artificial Sequence
  Synthetic
taaattagtggaagaaaaaattcagtcagcacaaataaatagaatagatcccttagccccactccgacttttgat

SEQ ID NO: 180154 - DNA, 75 bp, Artificial Sequence
  Synthetic
ccttagccccactccgacttttgatttttgccactgcacattctccaataggcatcattattcaaaatactgatc

SEQ ID NO: 180155 - DNA, 75 bp, Artificial Sequence
  Synthetic
tgggttaagaccattggaagtactacaattataaatctcatattaatccttgtgtgcctgttttgtctgttgtta

SEQ ID NO: 180156 - DNA, 75 bp, Artificial Sequence
  Synthetic
ttgtggagtggtcattccttcctcacagtacagttaagacttttacattgtacttggatcaaatagctacattaa

SEQ ID NO: 180157 - DNA, 75 bp, Artificial Sequence
  Synthetic
tgtgtgcctgttttgtctgttgttagtctgcaggtgtactcaacagctccgaagagacagcgaccatcgagaacg

SEQ ID NO: 180158 - DNA, 75 bp, Artificial Sequence
  Synthetic
tcggtcagacaagattacgaataataaaattatgtgggaatgacccagacaaaatagttgtccctttaaccaagg

SEQ ID NO: 180159 - DNA, 75 bp, Artificial Sequence
  Synthetic
aacaagttagacaagcctttatcaattctggtgcatggcagattggtcttgctaattttgtgggaattattgata

SEQ ID NO: 180160 - DNA, 75 bp, Artificial Sequence
  Synthetic
ttctggtgcatggcagattggtcttgctaattttgtgggaattattgataaccattacccaaaaacaaagatctt

SEQ ID NO: 180161 - DNA, 75 bp, Artificial Sequence
  Synthetic
ccagttcttaaaattgactacttggattctacctaaaattaccagacgtgaacctttagaaaatgctctaacagt

SEQ ID NO: 180162 - DNA, 75 bp, Artificial Sequence
  Synthetic
atttactgatggttccagcaatggaaaagcagcttacacagggctgaaagaacgagtaatcaaaactccatatca

SEQ ID NO: 180163 - DNA, 75 bp, Artificial Sequence
  Synthetic
aacgagtaatcaaaactccatatcaatcggctcaaagagcagagttggttgcagtcattacagtgttacaagatt

SEQ ID NO: 180164 - DNA, 75 bp, Artificial Sequence
  Synthetic
gcagtcattacagtgttacaagattttgaccagcctatcaatattatatcagattctgcatatgtagtacaggct

SEQ ID NO: 180165 - DNA, 75 bp, Artificial Sequence
  Synthetic
acaagggatgttgagacagctctaattaaatatagcatggatgatcagttaaaccagctattcaatttattacaa

SEQ ID NO: 180166 - DNA, 75 bp, Artificial Sequence
  Synthetic
agcccgacacccgtaaagggtctgtgctgaggaggattagtaaaagaggaaggaatgcctcttgcagttgagaca

SEQ ID NO: 180167 - DNA, 75 bp, Artificial Sequence
  Synthetic
caaactgtaagaaaaagaaatttcccattttatattactcatattcgagcacacactaatttaccagggcctttg

SEQ ID NO: 180168 - DNA, 75 bp, Artificial Sequence
  Synthetic
actaaagcaaatgaacaagctgacttactggtatcatctgcactcataaaagcacaagaacttcatgctttgact

SEQ ID NO: 180169 - DNA, 75 bp, Artificial Sequence
  Synthetic
catgtaaatgcagcaggattaaaaaacaaatttgatgtcacatggaaacaggcaaaagatattgtacaacattgc

SEQ ID NO: 180170 - DNA, 75 bp, Artificial Sequence
  Synthetic
acccagtgtcaagtcttacacctgcccactcaagaggcaggagttaatcccagaggtctgtgtcctaatgcatta

SEQ ID NO: 180171 - DNA, 75 bp, Artificial Sequence
  Synthetic
tggcaaatggatgtcacacatgtaccttcatttggaagattatcatatgttcatgtaacagttgatacttattca

SEQ ID NO: 180172 - DNA, 75 bp, Artificial Sequence
  Synthetic
catttcatatgggcaacttgccaaacaggagaaagtacttcccatgttaaaaaacatttattgtcttgttttgct

SEQ ID NO: 180173 - DNA, 75 bp, Artificial Sequence
  Synthetic
gtaatgggagttccagaaaaaatcaaaactgacaatggaccaggatattgtagtaaagctttccaaaaattctta

SEQ ID NO: 180174 - DNA, 75 bp, Artificial Sequence
  Synthetic
agtcagtggaaaatttcacatacaacaggaattccttataattcccaaggacaggccatagttgaaagaactaat

SEQ ID NO: 180175 - DNA, 75 bp, Artificial Sequence
  Synthetic
agaacactcaaaactcaattagttaaacaaaaagaagggggagacagtaaggagtgtaccactcctcagatgcaa

SEQ ID NO: 180176 - DNA, 75 bp, Artificial Sequence
  Synthetic
cttaatctagcaccctatactttaaattttttaaacatttatagaaatcagactactacttctgcagaacaacat

SEQ ID NO: 180177 - DNA, 75 bp, Artificial Sequence
  Synthetic
cttactggtaaaaagaacagcccacatgaaggaaaactaatttggtggaaagataataaaaataagacatgggaa

SEQ ID NO: 180178 - DNA, 75 bp, Artificial Sequence
  Synthetic
atagggaaggtgataacgtgggggagaggttttgcttgtgtttcaccaggagaaaatcagcttcctgtttggatg

SEQ ID NO: 180179 - DNA, 75 bp, Artificial Sequence
  Synthetic
cccactagacatttgaagttctacaatgaacccatcggagatgcaaagaaaagcacctccgcggagacggagaca

SEQ ID NO: 180180 - DNA, 75 bp, Artificial Sequence
  Synthetic
ccgcaatcgagcaccgttgactcacaagatgaacaaaatggtgacgtcagaagaacagatgaagttgccatccac

SEQ ID NO: 180181 - DNA, 75 bp, Artificial Sequence
  Synthetic
caagaaggcagagccgccgacttgggcacaactaaagaagctgacgcagttagctacaaaatatctagagaacac

SEQ ID NO: 180182 - DNA, 75 bp, Artificial Sequence
  Synthetic
aaaggtgacacaaaccccagagagtatgctgcttgcagccttgatgattgtatcaatggtggtaagtctccctat

SEQ ID NO: 180183 - DNA, 75 bp, Artificial Sequence
  Synthetic
atgctgcttgcagccttgatgattgtatcaatggtggtaagtctccctatgcctgcaggagcagctgcagctaac

SEQ ID NO: 180184 - DNA, 75 bp, Artificial Sequence
  Synthetic
tatcaatggtggtaagtctccctatgcctgcaggagcagctgcagctaactatacctactgggcctatgtgcctt

SEQ ID NO: 180185 - DNA, 75 bp, Artificial Sequence
  Synthetic
tcccgcccttaattcgggcagtcacatggatggataatcctatagaaatatatgttaatgatagtgtatgggtac

SEQ ID NO: 180186 - DNA, 75 bp, Artificial Sequence
  Synthetic
atggatggataatcctatagaaatatatgttaatgatagtgtatgggtacctggccccacagatgattgctgccc

SEQ ID NO: 180187 - DNA, 75 bp, Artificial Sequence
  Synthetic
tgccaaacctgaggaagaagggatgatgataaatatttccattgggtatcgttatcctcctatttgcctagggag

SEQ ID NO: 180188 - DNA, 75 bp, Artificial Sequence
  Synthetic
agcaccaggatgtttaatgcctgcagtccaaaattggttggtagaagtacctactgtcagtcccatcagtagatt

SEQ ID NO: 180189 - DNA, 75 bp, Artificial Sequence
  Synthetic
cacttatcacatggtaagcgggatgtcactcaggccacgggtaaattatttacaagacttttcttatcaaagatc

SEQ ID NO: 180190 - DNA, 75 bp, Artificial Sequence
  Synthetic
attaaaatttagacctaaagggaaaccttgccccaaggaaattcccaaagaatcaaaaaatacagaagttttagt

SEQ ID NO: 180191 - DNA, 75 bp, Artificial Sequence
  Synthetic
aatcaaaaaatacagaagttttagtttgggaagaatgtgtggccaatagtgcggtgatattacaaaacaatgaat

SEQ ID NO: 180192 - DNA, 75 bp, Artificial Sequence
  Synthetic
ttgggaagaatgtgtggccaatagtgcggtgatattacaaaacaatgaattcggaactcttatagattgggcacc

SEQ ID NO: 180193 - DNA, 75 bp, Artificial Sequence
  Synthetic
tcgaggtcaattctaccacaattgctcaggacaaactcagtcgtgtccaagtgcacaagtgagtccagctgttga

SEQ ID NO: 180194 - DNA, 75 bp, Artificial Sequence
  Synthetic
tagcgacttaacagaaagtttagacaaacataagcataaaaaattgcagtctttctacccttgggaatggggaga

SEQ ID NO: 180195 - DNA, 75 bp, Artificial Sequence
  Synthetic
aaacataagcataaaaaattgcagtctttctacccttgggaatggggagaaaaaggaatctctaccgcaagacca

SEQ ID NO: 180196 - DNA, 75 bp, Artificial Sequence
  Synthetic
aaaataataagtcctgtttctggtcctgaacatccagaattatggaggcttactgtggcctcacaccacattaga

SEQ ID NO: 180197 - DNA, 75 bp, Artificial Sequence
  Synthetic
atttggtctggaaatcaaactttagaaacaagagatcgtaagccattttatactatcgacctaaattccagtcta

SEQ ID NO: 180198 - DNA, 75 bp, Artificial Sequence
  Synthetic
acagttcctttacaaagttgcgtaaagcccccttatatgctagttgtaggaaatatagttattaaaccagactcc

SEQ ID NO: 180199 - DNA, 75 bp, Artificial Sequence
  Synthetic
cagactataacctgtgaaaattgtagattgcttacttgcattgattcaacttttaattggcaacaccgtattctg

SEQ ID NO: 180200 - DNA, 75 bp, Artificial Sequence
  Synthetic
ctggtgagagcaagagagggcgtgtggatccctgtgtccatggaccgaccgtgggaggcctcaccatccgtccat

SEQ ID NO: 180201 - DNA, 75 bp, Artificial Sequence
  Synthetic
attttgactgaagtattaaaaggtgttttaaatagatccaaaagattcatttttactttaattgcagtgattatg

SEQ ID NO: 180202 - DNA, 75 bp, Artificial Sequence
  Synthetic
ggattaattgcagtcacagctacggctgctgtagcaggagttgcattgcactcttctgttcagtcagtaaacttt

SEQ ID NO: 180203 - DNA, 75 bp, Artificial Sequence
  Synthetic
ctgctgtagcaggagttgcattgcactcttctgttcagtcagtaaactttgttaatgattggcaaaataattcta

SEQ ID NO: 180204 - DNA, 75 bp, Artificial Sequence
  Synthetic
caagattgtggaattcacaatctagtattgatcaaaaattggcaaatcaaattaatgatcttagacaaactgtca

SEQ ID NO: 180205 - DNA, 75 bp, Artificial Sequence
  Synthetic
tattgatcaaaaattggcaaatcaaattaatgatcttagacaaactgtcatttggatgggagacaggctcatgag

SEQ ID NO: 180206 - DNA, 75 bp, Artificial Sequence
  Synthetic
cttagaacatcgtttccagttacaatgtgactggaatacgtcagatttttgtattacaccccaaatttataatga

SEQ ID NO: 180207 - DNA, 75 bp, Artificial Sequence
  Synthetic
tgtgactggaatacgtcagatttttgtattacaccccaaatttataatgagtctgagcatcactgggacatggtt

SEQ ID NO: 180208 - DNA, 75 bp, Artificial Sequence
  Synthetic
ataatctcactttagacatttccaaattaaaagaacaaatttttgaagcatcaaaagcccatttaaatttggtgc

SEQ ID NO: 180209 - DNA, 75 bp, Artificial Sequence
  Synthetic
caggaactgaggcaattgcaggagttgctgatggcctcgcaaatcttaacactgtcacttgggttaagaccattg

SEQ ID NO: 180210 - DNA, 75 bp, Artificial Sequence
  Synthetic
attaatccttgtgtgcctgttttgtctgttgttagtctacaggtgtacccaacagctccgacgagacagcgacca

SEQ ID NO: 180211 - DNA, 75 bp, Artificial Sequence
  Synthetic
tcgagaacgggccatgatgacgatggtggttttgtcgaaaagaaaagggggaaatgtggggaaaagcaagagaga

SEQ ID NO: 180212 - DNA, 75 bp, Artificial Sequence
  Synthetic
ttctgccttgagattctgttaatctatgaccttacccccaaccccgtgctctctgaaacatgtgctgtgtcaact

SEQ ID NO: 180213 - DNA, 75 bp, Artificial Sequence
  Synthetic
cagagttgaatggattaagggcggtgcaggatgtgctttgttaaacagatgcttgaaggcagcatgctccttaag

SEQ ID NO: 180214 - DNA, 75 bp, Artificial Sequence
  Synthetic
ctttttcttttccaaatctctcgtcccaccttacgagaaacacccacaggtgtgtaggggcaacccacccctaca

SEQ ID NO: 180215 - DNA, 75 bp, Artificial Sequence
  Synthetic
gttatgtactaagaaaaattcttctgccttgagattctgtgaccttacccccaaccccgtgctctctgaaatgtg

SEQ ID NO: 180216 - DNA, 75 bp, Artificial Sequence
  Synthetic
tgctgtgtcaactcagagttaaatggattaagggcggtgcaggatgtgctttgttaaacagatgcttgaaggcag

SEQ ID NO: 180217 - DNA, 75 bp, Artificial Sequence
  Synthetic
tgtccaaggtttctccccatgtgatagtctgaaatatggcctcgtgggaagggaaagacatgaccgtcccccagc

SEQ ID NO: 180218 - DNA, 75 bp, Artificial Sequence
  Synthetic
ggaaggcatctgtctcctgcctgtccctgggcaatggaatgtctcggtataaaacccgattgtatgctccatcta

SEQ ID NO: 180219 - DNA, 75 bp, Artificial Sequence
  Synthetic
aatatcattccacttacagtatggaatgattgggccattattaaagcagctttagaaccatttcaaacagaagaa

SEQ ID NO: 180220 - DNA, 75 bp, Artificial Sequence
  Synthetic
gatagcatttcagtttctgatgcccctggaagctgtttaatagattgtaatgaaaacacaaggaaaaaatcccag

SEQ ID NO: 180221 - DNA, 75 bp, Artificial Sequence
  Synthetic
tgaaaacacaaggaaaaaatcccagaaagaaacggaaagtttacattgcgaatatgtagcagagccggtaatggc

SEQ ID NO: 180222 - DNA, 75 bp, Artificial Sequence
  Synthetic
aaagaaaataagacccaaccgccagtagcctatcaatactggcctccggctgaacttcagtatcggccaccccca

SEQ ID NO: 180223 - DNA, 75 bp, Artificial Sequence
  Synthetic
gaaacgagcaaaggggccagcctcaggccccacaacaaactggggcattcccaattcagccatttgttcctcagg

SEQ ID NO: 180224 - DNA, 75 bp, Artificial Sequence
  Synthetic
ggccccacaacaaactggggcattcccaattcagccatttgttcctcagggttttcaggacaacaacccccactg

SEQ ID NO: 180225 - DNA, 75 bp, Artificial Sequence
  Synthetic
tagatttatgtactatacaagcagtctctctgcttccaggggagcccccacaaaaaatccctacaggggtatatg

SEQ ID NO: 180226 - DNA, 75 bp, Artificial Sequence
  Synthetic
gcccactgcctgaggggactgtaggactaatcttgggaagatcaagtctaaatctaaaaggagttcaaattcata

SEQ ID NO: 180227 - DNA, 75 bp, Artificial Sequence
  Synthetic
aacaggaacagaaagacaaggaactgtatcctttaacctccctcaaatcactctttgggagcgaccccttgtcac

SEQ ID NO: 180228 - DNA, 75 bp, Artificial Sequence
  Synthetic
acgcacgggctcggctcagcggagtgcacctgctgagaggcgagaggagagctcacagcggtgagtacattttgt

SEQ ID NO: 180229 - DNA, 75 bp, Artificial Sequence
  Synthetic
ccagtagtatcaactcaactgctgttaaatggcagtctagcagaagaagagatagtaattagatctgaaaatttc

SEQ ID NO: 180230 - DNA, 75 bp, Artificial Sequence
  Synthetic
taaatggcagtctagcagaagaagagatagtaattagatctgaaaatttcacgaacaatgctaaaaccataatag

SEQ ID NO: 180231 - DNA, 75 bp, Artificial Sequence
  Synthetic
gaattaggcttaagccaggaagtaagaaaaaatatatgctaaaacatatagtatgggcaagcagagagctggaaa

SEQ ID NO: 180232 - DNA, 75 bp, Artificial Sequence
  Synthetic
tcaaagtcagacagtatgatcaaatacccctacaaatctgtgggcataaagctaaaggtacagtactcgttgggg

SEQ ID NO: 180233 - DNA, 75 bp, Artificial Sequence
  Synthetic
acaagaagaggtatacatataggactagggagaacgttttatgcaacaggagaaatagtaggaaatataagacaa

SEQ ID NO: 180234 - DNA, 75 bp, Artificial Sequence
  Synthetic
gcaaaagaaatagtggccagctgtgataaatgtcaactaaaaggggaagccatgcatggacaagtagactgtagt

SEQ ID NO: 180235 - DNA, 75 bp, Artificial Sequence
  Synthetic
gtctctttggaacaccctagtagttttatggtgtgttcacagaagagtagatataagtgacacacagcaggccat

SEQ ID NO: 180236 - DNA, 75 bp, Artificial Sequence
  Synthetic
gtctctttggaacaccctagtagttttatggtgtgttcacagaagagttgatataagtgacacacagcaggccat

SEQ ID NO: 180237 - DNA, 75 bp, Artificial Sequence
  Synthetic
gtctctttggaacaccctagtagttttatggtgtgttcacagaagagtcgatataagtgacacacagcaggccat

SEQ ID NO: 180238 - DNA, 75 bp, Artificial Sequence
  Synthetic
gtctctttggaacaccctagtagttttatggtgtgttcacagaagagtggatataagtgacacacagcaggccat

SEQ ID NO: 180239 - DNA, 75 bp, Artificial Sequence
  Synthetic
gatgatggaagaaggagaaataaaaaactgcaccttcaatgtcaccaccaacataaaagaaaagaagaaagaata

SEQ ID NO: 180240 - DNA, 75 bp, Artificial Sequence
  Synthetic
tatggaaaacagatggcaggtgctgattgtgtggcaggtagacaggatgaggattagaacatggaatagtttagt

SEQ ID NO: 180241 - DNA, 75 bp, Artificial Sequence
  Synthetic
gggcaaatgacccatctgccgctgtctcccaggacgctgaatgcctgggtgaaggcagtagaagagaaggccttc

SEQ ID NO: 180242 - DNA, 75 bp, Artificial Sequence
  Synthetic
tacaggtgttgaaagaagtgattaatgaagaggctgcagaatgggatagaacacatcctgttccagtcggaccgt

SEQ ID NO: 180243 - DNA, 75 bp, Artificial Sequence
  Synthetic
tacaggtgttgaaagaagtgattaatgaagaggctgcagaatgggatagaacacatcctgttcctgtcggaccgt

SEQ ID NO: 180244 - DNA, 75 bp, Artificial Sequence
  Synthetic
tacaggtgttgaaagaagtgattaatgaagaggctgcagaatgggatagaacacatcctgttcccgtcggaccgt

SEQ ID NO: 180245 - DNA, 75 bp, Artificial Sequence
  Synthetic
tacaggtgttgaaagaagtgattaatgaagaggctgcagaatgggatagaacacatcctgttccggtcggaccgt

SEQ ID NO: 180246 - DNA, 75 bp, Artificial Sequence
  Synthetic
tacaggtgttgaaagatgtgattaatgaagaggctgcagaatgggatagaacacatcctgttccagtcggaccgt

SEQ ID NO: 180247 - DNA, 75 bp, Artificial Sequence
  Synthetic
tacaggtgttgaaagatgtgattaatgaagaggctgcagaatgggatagaacacatcctgttcctgtcggaccgt

SEQ ID NO: 180248 - DNA, 75 bp, Artificial Sequence
  Synthetic
tacaggtgttgaaagatgtgattaatgaagaggctgcagaatgggatagaacacatcctgttcccgtcggaccgt

SEQ ID NO: 180249 - DNA, 75 bp, Artificial Sequence
  Synthetic
tacaggtgttgaaagatgtgattaatgaagaggctgcagaatgggatagaacacatcctgttccggtcggaccgt

SEQ ID NO: 180250 - DNA, 75 bp, Artificial Sequence
  Synthetic
tacaggtgttgaaagacgtgattaatgaagaggctgcagaatgggatagaacacatcctgttccagtcggaccgt

SEQ ID NO: 180251 - DNA, 75 bp, Artificial Sequence
  Synthetic
tacaggtgttgaaagacgtgattaatgaagaggctgcagaatgggatagaacacatcctgttcctgtcggaccgt

SEQ ID NO: 180252 - DNA, 75 bp, Artificial Sequence
  Synthetic
tacaggtgttgaaagacgtgattaatgaagaggctgcagaatgggatagaacacatcctgttcccgtcggaccgt

SEQ ID NO: 180253 - DNA, 75 bp, Artificial Sequence
  Synthetic
tacaggtgttgaaagacgtgattaatgaagaggctgcagaatgggatagaacacatcctgttccggtcggaccgt

SEQ ID NO: 180254 - DNA, 75 bp, Artificial Sequence
  Synthetic
tacaggtgttgaaagaggtgattaatgaagaggctgcagaatgggatagaacacatcctgttccagtcggaccgt

SEQ ID NO: 180255 - DNA, 75 bp, Artificial Sequence
  Synthetic
tacaggtgttgaaagaggtgattaatgaagaggctgcagaatgggatagaacacatcctgttcctgtcggaccgt

SEQ ID NO: 180256 - DNA, 75 bp, Artificial Sequence
  Synthetic
tacaggtgttgaaagaggtgattaatgaagaggctgcagaatgggatagaacacatcctgttcccgtcggaccgt

SEQ ID NO: 180257 - DNA, 75 bp, Artificial Sequence
  Synthetic
tacaggtgttgaaagaggtgattaatgaagaggctgcagaatgggatagaacacatcctgttccggtcggaccgt

SEQ ID NO: 180258 - DNA, 75 bp, Artificial Sequence
  Synthetic
ttcaggtgttgaaagaagtgattaatgaagaggctgcagaatgggatagaacacatcctgttccagtcggaccgt

SEQ ID NO: 180259 - DNA, 75 bp, Artificial Sequence
  Synthetic
ttcaggtgttgaaagaagtgattaatgaagaggctgcagaatgggatagaacacatcctgttcctgtcggaccgt

SEQ ID NO: 180260 - DNA, 75 bp, Artificial Sequence
  Synthetic
ttcaggtgttgaaagaagtgattaatgaagaggctgcagaatgggatagaacacatcctgttcccgtcggaccgt

SEQ ID NO: 180261 - DNA, 75 bp, Artificial Sequence
  Synthetic
ttcaggtgttgaaagaagtgattaatgaagaggctgcagaatgggatagaacacatcctgttccggtcggaccgt

SEQ ID NO: 180262 - DNA, 75 bp, Artificial Sequence
  Synthetic
ttcaggtgttgaaagatgtgattaatgaagaggctgcagaatgggatagaacacatcctgttccagtcggaccgt

SEQ ID NO: 180263 - DNA, 75 bp, Artificial Sequence
  Synthetic
ttcaggtgttgaaagatgtgattaatgaagaggctgcagaatgggatagaacacatcctgttcctgtcggaccgt

SEQ ID NO: 180264 - DNA, 75 bp, Artificial Sequence
  Synthetic
ttcaggtgttgaaagatgtgattaatgaagaggctgcagaatgggatagaacacatcctgttcccgtcggaccgt

SEQ ID NO: 180265 - DNA, 75 bp, Artificial Sequence
  Synthetic
ttcaggtgttgaaagatgtgattaatgaagaggctgcagaatgggatagaacacatcctgttccggtcggaccgt

SEQ ID NO: 180266 - DNA, 75 bp, Artificial Sequence
  Synthetic
ttcaggtgttgaaagacgtgattaatgaagaggctgcagaatgggatagaacacatcctgttccagtcggaccgt

SEQ ID NO: 180267 - DNA, 75 bp, Artificial Sequence
  Synthetic
ttcaggtgttgaaagacgtgattaatgaagaggctgcagaatgggatagaacacatcctgttcctgtcggaccgt

SEQ ID NO: 180268 - DNA, 75 bp, Artificial Sequence
  Synthetic
ttcaggtgttgaaagacgtgattaatgaagaggctgcagaatgggatagaacacatcctgttcccgtcggaccgt

SEQ ID NO: 180269 - DNA, 75 bp, Artificial Sequence
  Synthetic
ttcaggtgttgaaagacgtgattaatgaagaggctgcagaatgggatagaacacatcctgttccggtcggaccgt

SEQ ID NO: 180270 - DNA, 75 bp, Artificial Sequence
  Synthetic
ttcaggtgttgaaagaggtgattaatgaagaggctgcagaatgggatagaacacatcctgttccagtcggaccgt

SEQ ID NO: 180271 - DNA, 75 bp, Artificial Sequence
  Synthetic
ttcaggtgttgaaagaggtgattaatgaagaggctgcagaatgggatagaacacatcctgttcctgtcggaccgt

SEQ ID NO: 180272 - DNA, 75 bp, Artificial Sequence
  Synthetic
ttcaggtgttgaaagaggtgattaatgaagaggctgcagaatgggatagaacacatcctgttcccgtcggaccgt

SEQ ID NO: 180273 - DNA, 75 bp, Artificial Sequence
  Synthetic
ttcaggtgttgaaagaggtgattaatgaagaggctgcagaatgggatagaacacatcctgttccggtcggaccgt

SEQ ID NO: 180274 - DNA, 75 bp, Artificial Sequence
  Synthetic
tccaggtgttgaaagaagtgattaatgaagaggctgcagaatgggatagaacacatcctgttccagtcggaccgt

SEQ ID NO: 180275 - DNA, 75 bp, Artificial Sequence
  Synthetic
tccaggtgttgaaagaagtgattaatgaagaggctgcagaatgggatagaacacatcctgttcctgtcggaccgt

SEQ ID NO: 180276 - DNA, 75 bp, Artificial Sequence
  Synthetic
tccaggtgttgaaagaagtgattaatgaagaggctgcagaatgggatagaacacatcctgttcccgtcggaccgt

SEQ ID NO: 180277 - DNA, 75 bp, Artificial Sequence
  Synthetic
tccaggtgttgaaagaagtgattaatgaagaggctgcagaatgggatagaacacatcctgttccggtcggaccgt

SEQ ID NO: 180278 - DNA, 75 bp, Artificial Sequence
  Synthetic
tccaggtgttgaaagatgtgattaatgaagaggctgcagaatgggatagaacacatcctgttccagtcggaccgt

SEQ ID NO: 180279 - DNA, 75 bp, Artificial Sequence
  Synthetic
tccaggtgttgaaagatgtgattaatgaagaggctgcagaatgggatagaacacatcctgttcctgtcggaccgt

SEQ ID NO: 180280 - DNA, 75 bp, Artificial Sequence
  Synthetic
tccaggtgttgaaagatgtgattaatgaagaggctgcagaatgggatagaacacatcctgttcccgtcggaccgt

SEQ ID NO: 180281 - DNA, 75 bp, Artificial Sequence
  Synthetic
tccaggtgttgaaagatgtgattaatgaagaggctgcagaatgggatagaacacatcctgttccggtcggaccgt

SEQ ID NO: 180282 - DNA, 75 bp, Artificial Sequence
  Synthetic
tccaggtgttgaaagacgtgattaatgaagaggctgcagaatgggatagaacacatcctgttccagtcggaccgt

SEQ ID NO: 180283 - DNA, 75 bp, Artificial Sequence
  Synthetic
tccaggtgttgaaagacgtgattaatgaagaggctgcagaatgggatagaacacatcctgttcctgtcggaccgt

SEQ ID NO: 180284 - DNA, 75 bp, Artificial Sequence
  Synthetic
tccaggtgttgaaagacgtgattaatgaagaggctgcagaatgggatagaacacatcctgttcccgtcggaccgt

SEQ ID NO: 180285 - DNA, 75 bp, Artificial Sequence
  Synthetic
tccaggtgttgaaagacgtgattaatgaagaggctgcagaatgggatagaacacatcctgttccggtcggaccgt

SEQ ID NO: 180286 - DNA, 75 bp, Artificial Sequence
  Synthetic
tccaggtgttgaaagaggtgattaatgaagaggctgcagaatgggatagaacacatcctgttccagtcggaccgt

SEQ ID NO: 180287 - DNA, 75 bp, Artificial Sequence
  Synthetic
tccaggtgttgaaagaggtgattaatgaagaggctgcagaatgggatagaacacatcctgttcctgtcggaccgt

SEQ ID NO: 180288 - DNA, 75 bp, Artificial Sequence
  Synthetic
tccaggtgttgaaagaggtgattaatgaagaggctgcagaatgggatagaacacatcctgttcccgtcggaccgt

SEQ ID NO: 180289 - DNA, 75 bp, Artificial Sequence
  Synthetic
tccaggtgttgaaagaggtgattaatgaagaggctgcagaatgggatagaacacatcctgttccggtcggaccgt

SEQ ID NO: 180290 - DNA, 75 bp, Artificial Sequence
  Synthetic
tgcaggtgttgaaagaagtgattaatgaagaggctgcagaatgggatagaacacatcctgttccagtcggaccgt

SEQ ID NO: 180291 - DNA, 75 bp, Artificial Sequence
  Synthetic
tgcaggtgttgaaagaagtgattaatgaagaggctgcagaatgggatagaacacatcctgttcctgtcggaccgt

SEQ ID NO: 180292 - DNA, 75 bp, Artificial Sequence
  Synthetic
tgcaggtgttgaaagaagtgattaatgaagaggctgcagaatgggatagaacacatcctgttcccgtcggaccgt

SEQ ID NO: 180293 - DNA, 75 bp, Artificial Sequence
  Synthetic
tgcaggtgttgaaagaagtgattaatgaagaggctgcagaatgggatagaacacatcctgttccggtcggaccgt

SEQ ID NO: 180294 - DNA, 75 bp, Artificial Sequence
  Synthetic
tgcaggtgttgaaagatgtgattaatgaagaggctgcagaatgggatagaacacatcctgttccagtcggaccgt

SEQ ID NO: 180295 - DNA, 75 bp, Artificial Sequence
  Synthetic
tgcaggtgttgaaagatgtgattaatgaagaggctgcagaatgggatagaacacatcctgttcctgtcggaccgt

SEQ ID NO: 180296 - DNA, 75 bp, Artificial Sequence
  Synthetic
tgcaggtgttgaaagatgtgattaatgaagaggctgcagaatgggatagaacacatcctgttcccgtcggaccgt

SEQ ID NO: 180297 - DNA, 75 bp, Artificial Sequence
  Synthetic
tgcaggtgttgaaagatgtgattaatgaagaggctgcagaatgggatagaacacatcctgttccggtcggaccgt

SEQ ID NO: 180298 - DNA, 75 bp, Artificial Sequence
  Synthetic
tgcaggtgttgaaagacgtgattaatgaagaggctgcagaatgggatagaacacatcctgttccagtcggaccgt

SEQ ID NO: 180299 - DNA, 75 bp, Artificial Sequence
  Synthetic
tgcaggtgttgaaagacgtgattaatgaagaggctgcagaatgggatagaacacatcctgttcctgtcggaccgt

SEQ ID NO: 180300 - DNA, 75 bp, Artificial Sequence
  Synthetic
tgcaggtgttgaaagacgtgattaatgaagaggctgcagaatgggatagaacacatcctgttcccgtcggaccgt

SEQ ID NO: 180301 - DNA, 75 bp, Artificial Sequence
  Synthetic
tgcaggtgttgaaagacgtgattaatgaagaggctgcagaatgggatagaacacatcctgttccggtcggaccgt

SEQ ID NO: 180302 - DNA, 75 bp, Artificial Sequence
  Synthetic
tgcaggtgttgaaagaggtgattaatgaagaggctgcagaatgggatagaacacatcctgttccagtcggaccgt

SEQ ID NO: 180303 - DNA, 75 bp, Artificial Sequence
  Synthetic
tgcaggtgttgaaagaggtgattaatgaagaggctgcagaatgggatagaacacatcctgttcctgtcggaccgt

SEQ ID NO: 180304 - DNA, 75 bp, Artificial Sequence
  Synthetic
tgcaggtgttgaaagaggtgattaatgaagaggctgcagaatgggatagaacacatcctgttcccgtcggaccgt

SEQ ID NO: 180305 - DNA, 75 bp, Artificial Sequence
  Synthetic
tgcaggtgttgaaagaggtgattaatgaagaggctgcagaatgggatagaacacatcctgttccggtcggaccgt

SEQ ID NO: 180306 - DNA, 75 bp, Artificial Sequence
  Synthetic
tataccagtaggagatatctatagaaagtggatagtgttggggctcaataaagtggtaaaaatgtatagccccat

SEQ ID NO: 180307 - DNA, 75 bp, Artificial Sequence
  Synthetic
tttatgcaacaggagacataataggagatataagacaagcatattgtaccattaatggaacaaaatggaataaca

SEQ ID NO: 180308 - DNA, 75 bp, Artificial Sequence
  Synthetic
gggaattggaggttttatcaaagtaagacaatatgatcaaatacctatagaaatttgtggaaaaaaggctatagg

SEQ ID NO: 180309 - DNA, 75 bp, Artificial Sequence
  Synthetic
catccaagaataagttcagaagtacacatcccactaggggatgctagattggtagtaacaacatattggggtctg

SEQ ID NO: 180310 - DNA, 75 bp, Artificial Sequence
  Synthetic
agtacaagcctatactctgccagacaaagaaagctggactgtcaatgatattcagaagttagtagggaaattagt

SEQ ID NO: 180311 - DNA, 75 bp, Artificial Sequence
  Synthetic
aagagttggatgacagacacattattaatacaaaatgctaatccagattgtaagcagattttgaaagctctggga

SEQ ID NO: 180312 - DNA, 75 bp, Artificial Sequence
  Synthetic
aagctaaccaagatttaaaaggagggtatacaactgttttcatgcagagtggacagagaaagccagttaagtgct

SEQ ID NO: 180313 - DNA, 75 bp, Artificial Sequence
  Synthetic
aagctaaccaagatttaaaaggagggtatacaactgttttcatgcagagtggacagagatagccagttaagtgct

SEQ ID NO: 180314 - DNA, 75 bp, Artificial Sequence
  Synthetic
aagctaaccaagatttaaaaggagggtatacaactgttttcatgcagagtggacagagacagccagttaagtgct

SEQ ID NO: 180315 - DNA, 75 bp, Artificial Sequence
  Synthetic
aagctaaccaagatttaaaaggagggtatacaactgttttcatgcagagtggacagagagagccagttaagtgct

SEQ ID NO: 180316 - DNA, 75 bp, Artificial Sequence
  Synthetic
aatcagtttatgggatcaaagtctacagccatgtgtaaagttaactcctctctgtgttactttaaattgtaccaa

SEQ ID NO: 180317 - DNA, 75 bp, Artificial Sequence
  Synthetic
caaatcaggaagacaggcaaattttttaggaaagatctggcctcctgggggcaagaggccaggcaactatgtaca

SEQ ID NO: 180318 - DNA, 75 bp, Artificial Sequence
  Synthetic
tttcagaattgggtgtcgacatagcagaataggcattactcgacagaggagagcaagaaatggagccagtagatc

SEQ ID NO: 180319 - DNA, 75 bp, Artificial Sequence
  Synthetic
tccctcagatcactctttgggacagaccagtaataccagtaagagtaggggggcatatttgtgaggctttattag

SEQ ID NO: 180320 - DNA, 75 bp, Artificial Sequence
  Synthetic
aagacaaagaaaaatagacaggttaattaaaagaattagggaaagagcagaagacagtggcaatgagagtgaggg

SEQ ID NO: 180321 - DNA, 75 bp, Artificial Sequence
  Synthetic
atttgaagaagttaaggtagaaatagaaggaagagaagtttacggaactgtattagtaggcccaaccccagtaaa

SEQ ID NO: 180322 - DNA, 75 bp, Artificial Sequence
  Synthetic
atttgaagaagttaaggtagaaatagaaggaagagaagtttacggaactgtattagttggcccaaccccagtaaa

SEQ ID NO: 180323 - DNA, 75 bp, Artificial Sequence
  Synthetic
atttgaagaagttaaggtagaaatagaaggaagagaagtttacggaactgtattagtcggcccaaccccagtaaa

SEQ ID NO: 180324 - DNA, 75 bp, Artificial Sequence
  Synthetic
atttgaagaagttaaggtagaaatagaaggaagagaagtttacggaactgtattagtgggcccaaccccagtaaa

SEQ ID NO: 180325 - DNA, 75 bp, Artificial Sequence
  Synthetic
atttgaagtagttaaggtagaaatagaaggaagagaagtttacggaactgtattagtaggcccaaccccagtaaa

SEQ ID NO: 180326 - DNA, 75 bp, Artificial Sequence
  Synthetic
atttgaagtagttaaggtagaaatagaaggaagagaagtttacggaactgtattagttggcccaaccccagtaaa

SEQ ID NO: 180327 - DNA, 75 bp, Artificial Sequence
  Synthetic
atttgaagtagttaaggtagaaatagaaggaagagaagtttacggaactgtattagtcggcccaaccccagtaaa

SEQ ID NO: 180328 - DNA, 75 bp, Artificial Sequence
  Synthetic
atttgaagtagttaaggtagaaatagaaggaagagaagtttacggaactgtattagtgggcccaaccccagtaaa

SEQ ID NO: 180329 - DNA, 75 bp, Artificial Sequence
  Synthetic
atttgaagcagttaaggtagaaatagaaggaagagaagtttacggaactgtattagtaggcccaaccccagtaaa

SEQ ID NO: 180330 - DNA, 75 bp, Artificial Sequence
  Synthetic
atttgaagcagttaaggtagaaatagaaggaagagaagtttacggaactgtattagttggcccaaccccagtaaa

SEQ ID NO: 180331 - DNA, 75 bp, Artificial Sequence
  Synthetic
atttgaagcagttaaggtagaaatagaaggaagagaagtttacggaactgtattagtcggcccaaccccagtaaa

SEQ ID NO: 180332 - DNA, 75 bp, Artificial Sequence
  Synthetic
atttgaagcagttaaggtagaaatagaaggaagagaagtttacggaactgtattagtgggcccaaccccagtaaa

SEQ ID NO: 180333 - DNA, 75 bp, Artificial Sequence
  Synthetic
atttgaaggagttaaggtagaaatagaaggaagagaagtttacggaactgtattagtaggcccaaccccagtaaa

SEQ ID NO: 180334 - DNA, 75 bp, Artificial Sequence
  Synthetic
atttgaaggagttaaggtagaaatagaaggaagagaagtttacggaactgtattagttggcccaaccccagtaaa

SEQ ID NO: 180335 - DNA, 75 bp, Artificial Sequence
  Synthetic
atttgaaggagttaaggtagaaatagaaggaagagaagtttacggaactgtattagtcggcccaaccccagtaaa

SEQ ID NO: 180336 - DNA, 75 bp, Artificial Sequence
  Synthetic
atttgaaggagttaaggtagaaatagaaggaagagaagtttacggaactgtattagtgggcccaaccccagtaaa

SEQ ID NO: 180337 - DNA, 75 bp, Artificial Sequence
  Synthetic
caatatgtatttggaatcattcaagcacaaccagataaaagtgaaccagagtttgtcagtcaaatattataccag

SEQ ID NO: 180338 - DNA, 75 bp, Artificial Sequence
  Synthetic
cattgtcaagtttgctttttaaacaaaggcttaggcatctcctatggcaggaagaagcggagaccccgacgagga

SEQ ID NO: 180339 - DNA, 75 bp, Artificial Sequence
  Synthetic
aaggcttaggcatctcctatggcaggaagaagcggagaccccgacgaggaactcctcagggcagtaaggatcatc

SEQ ID NO: 180340 - DNA, 75 bp, Artificial Sequence
  Synthetic
gggcctaaggtaaagcaatggcccttgtcaaaagaaaaaatagaagctttaagagatatttgtcaagagatggaa

SEQ ID NO: 180341 - DNA, 75 bp, Artificial Sequence
  Synthetic
gggcctaaggtaaagcaatggcccttgtcaaaagaaaaaatagaagctttaagagttatttgtcaagagatggaa

SEQ ID NO: 180342 - DNA, 75 bp, Artificial Sequence
  Synthetic
gggcctaaggtaaagcaatggcccttgtcaaaagaaaaaatagaagctttaagagctatttgtcaagagatggaa

SEQ ID NO: 180343 - DNA, 75 bp, Artificial Sequence
  Synthetic
gggcctaaggtaaagcaatggcccttgtcaaaagaaaaaatagaagctttaagaggtatttgtcaagagatggaa

SEQ ID NO: 180344 - DNA, 75 bp, Artificial Sequence
  Synthetic
gggcctaaggtaaagcaatggcccttgtcaaatgaaaaaatagaagctttaagagatatttgtcaagagatggaa

SEQ ID NO: 180345 - DNA, 75 bp, Artificial Sequence
  Synthetic
gggcctaaggtaaagcaatggcccttgtcaaatgaaaaaatagaagctttaagagttatttgtcaagagatggaa

SEQ ID NO: 180346 - DNA, 75 bp, Artificial Sequence
  Synthetic
gggcctaaggtaaagcaatggcccttgtcaaatgaaaaaatagaagctttaagagctatttgtcaagagatggaa

SEQ ID NO: 180347 - DNA, 75 bp, Artificial Sequence
  Synthetic
gggcctaaggtaaagcaatggcccttgtcaaatgaaaaaatagaagctttaagaggtatttgtcaagagatggaa

SEQ ID NO: 180348 - DNA, 75 bp, Artificial Sequence
  Synthetic
gggcctaaggtaaagcaatggcccttgtcaaacgaaaaaatagaagctttaagagatatttgtcaagagatggaa

SEQ ID NO: 180349 - DNA, 75 bp, Artificial Sequence
  Synthetic
gggcctaaggtaaagcaatggcccttgtcaaacgaaaaaatagaagctttaagagttatttgtcaagagatggaa

SEQ ID NO: 180350 - DNA, 75 bp, Artificial Sequence
  Synthetic
gggcctaaggtaaagcaatggcccttgtcaaacgaaaaaatagaagctttaagagctatttgtcaagagatggaa

SEQ ID NO: 180351 - DNA, 75 bp, Artificial Sequence
  Synthetic
gggcctaaggtaaagcaatggcccttgtcaaacgaaaaaatagaagctttaagaggtatttgtcaagagatggaa

SEQ ID NO: 180352 - DNA, 75 bp, Artificial Sequence
  Synthetic
gggcctaaggtaaagcaatggcccttgtcaaaggaaaaaatagaagctttaagagatatttgtcaagagatggaa

SEQ ID NO: 180353 - DNA, 75 bp, Artificial Sequence
  Synthetic
gggcctaaggtaaagcaatggcccttgtcaaaggaaaaaatagaagctttaagagttatttgtcaagagatggaa

SEQ ID NO: 180354 - DNA, 75 bp, Artificial Sequence
  Synthetic
gggcctaaggtaaagcaatggcccttgtcaaaggaaaaaatagaagctttaagagctatttgtcaagagatggaa

SEQ ID NO: 180355 - DNA, 75 bp, Artificial Sequence
  Synthetic
gggcctaaggtaaagcaatggcccttgtcaaaggaaaaaatagaagctttaagaggtatttgtcaagagatggaa

SEQ ID NO: 180356 - DNA, 75 bp, Artificial Sequence
  Synthetic
gggcctaaggtaaagctatggcccttgtcaaaagaaaaaatagaagctttaagagatatttgtcaagagatggaa

SEQ ID NO: 180357 - DNA, 75 bp, Artificial Sequence
  Synthetic
gggcctaaggtaaagctatggcccttgtcaaaagaaaaaatagaagctttaagagttatttgtcaagagatggaa

SEQ ID NO: 180358 - DNA, 75 bp, Artificial Sequence
  Synthetic
gggcctaaggtaaagctatggcccttgtcaaaagaaaaaatagaagctttaagagctatttgtcaagagatggaa

SEQ ID NO: 180359 - DNA, 75 bp, Artificial Sequence
  Synthetic
gggcctaaggtaaagctatggcccttgtcaaaagaaaaaatagaagctttaagaggtatttgtcaagagatggaa

SEQ ID NO: 180360 - DNA, 75 bp, Artificial Sequence
  Synthetic
gggcctaaggtaaagctatggcccttgtcaaatgaaaaaatagaagctttaagagatatttgtcaagagatggaa

SEQ ID NO: 180361 - DNA, 75 bp, Artificial Sequence
  Synthetic
gggcctaaggtaaagctatggcccttgtcaaatgaaaaaatagaagctttaagagttatttgtcaagagatggaa

SEQ ID NO: 180362 - DNA, 75 bp, Artificial Sequence
  Synthetic
gggcctaaggtaaagctatggcccttgtcaaatgaaaaaatagaagctttaagagctatttgtcaagagatggaa

SEQ ID NO: 180363 - DNA, 75 bp, Artificial Sequence
  Synthetic
gggcctaaggtaaagctatggcccttgtcaaatgaaaaaatagaagctttaagaggtatttgtcaagagatggaa

SEQ ID NO: 180364 - DNA, 75 bp, Artificial Sequence
  Synthetic
gggcctaaggtaaagctatggcccttgtcaaacgaaaaaatagaagctttaagagatatttgtcaagagatggaa

SEQ ID NO: 180365 - DNA, 75 bp, Artificial Sequence
  Synthetic
gggcctaaggtaaagctatggcccttgtcaaacgaaaaaatagaagctttaagagttatttgtcaagagatggaa

SEQ ID NO: 180366 - DNA, 75 bp, Artificial Sequence
  Synthetic
gggcctaaggtaaagctatggcccttgtcaaacgaaaaaatagaagctttaagagctatttgtcaagagatggaa

SEQ ID NO: 180367 - DNA, 75 bp, Artificial Sequence
  Synthetic
gggcctaaggtaaagctatggcccttgtcaaacgaaaaaatagaagctttaagaggtatttgtcaagagatggaa

SEQ ID NO: 180368 - DNA, 75 bp, Artificial Sequence
  Synthetic
gggcctaaggtaaagctatggcccttgtcaaaggaaaaaatagaagctttaagagatatttgtcaagagatggaa

SEQ ID NO: 180369 - DNA, 75 bp, Artificial Sequence
  Synthetic
gggcctaaggtaaagctatggcccttgtcaaaggaaaaaatagaagctttaagagttatttgtcaagagatggaa

SEQ ID NO: 180370 - DNA, 75 bp, Artificial Sequence
  Synthetic
gggcctaaggtaaagctatggcccttgtcaaaggaaaaaatagaagctttaagagctatttgtcaagagatggaa

SEQ ID NO: 180371 - DNA, 75 bp, Artificial Sequence
  Synthetic
gggcctaaggtaaagctatggcccttgtcaaaggaaaaaatagaagctttaagaggtatttgtcaagagatggaa

SEQ ID NO: 180372 - DNA, 75 bp, Artificial Sequence
  Synthetic
gggcctaaggtaaagccatggcccttgtcaaaagaaaaaatagaagctttaagagatatttgtcaagagatggaa

SEQ ID NO: 180373 - DNA, 75 bp, Artificial Sequence
  Synthetic
gggcctaaggtaaagccatggcccttgtcaaaagaaaaaatagaagctttaagagttatttgtcaagagatggaa

SEQ ID NO: 180374 - DNA, 75 bp, Artificial Sequence
  Synthetic
gggcctaaggtaaagccatggcccttgtcaaaagaaaaaatagaagctttaagagctatttgtcaagagatggaa

SEQ ID NO: 180375 - DNA, 75 bp, Artificial Sequence
  Synthetic
gggcctaaggtaaagccatggcccttgtcaaaagaaaaaatagaagctttaagaggtatttgtcaagagatggaa

SEQ ID NO: 180376 - DNA, 75 bp, Artificial Sequence
  Synthetic
gggcctaaggtaaagccatggcccttgtcaaatgaaaaaatagaagctttaagagatatttgtcaagagatggaa

SEQ ID NO: 180377 - DNA, 75 bp, Artificial Sequence
  Synthetic
gggcctaaggtaaagccatggcccttgtcaaatgaaaaaatagaagctttaagagttatttgtcaagagatggaa

SEQ ID NO: 180378 - DNA, 75 bp, Artificial Sequence
  Synthetic
gggcctaaggtaaagccatggcccttgtcaaatgaaaaaatagaagctttaagagctatttgtcaagagatggaa

SEQ ID NO: 180379 - DNA, 75 bp, Artificial Sequence
  Synthetic
gggcctaaggtaaagccatggcccttgtcaaatgaaaaaatagaagctttaagaggtatttgtcaagagatggaa

SEQ ID NO: 180380 - DNA, 75 bp, Artificial Sequence
  Synthetic
gggcctaaggtaaagccatggcccttgtcaaacgaaaaaatagaagctttaagagatatttgtcaagagatggaa

SEQ ID NO: 180381 - DNA, 75 bp, Artificial Sequence
  Synthetic
gggcctaaggtaaagccatggcccttgtcaaacgaaaaaatagaagctttaagagttatttgtcaagagatggaa

SEQ ID NO: 180382 - DNA, 75 bp, Artificial Sequence
  Synthetic
gggcctaaggtaaagccatggcccttgtcaaacgaaaaaatagaagctttaagagctatttgtcaagagatggaa

SEQ ID NO: 180383 - DNA, 75 bp, Artificial Sequence
  Synthetic
gggcctaaggtaaagccatggcccttgtcaaacgaaaaaatagaagctttaagaggtatttgtcaagagatggaa

SEQ ID NO: 180384 - DNA, 75 bp, Artificial Sequence
  Synthetic
gggcctaaggtaaagccatggcccttgtcaaaggaaaaaatagaagctttaagagatatttgtcaagagatggaa

SEQ ID NO: 180385 - DNA, 75 bp, Artificial Sequence
  Synthetic
gggcctaaggtaaagccatggcccttgtcaaaggaaaaaatagaagctttaagagttatttgtcaagagatggaa

SEQ ID NO: 180386 - DNA, 75 bp, Artificial Sequence
  Synthetic
gggcctaaggtaaagccatggcccttgtcaaaggaaaaaatagaagctttaagagctatttgtcaagagatggaa

SEQ ID NO: 180387 - DNA, 75 bp, Artificial Sequence
  Synthetic
gggcctaaggtaaagccatggcccttgtcaaaggaaaaaatagaagctttaagaggtatttgtcaagagatggaa

SEQ ID NO: 180388 - DNA, 75 bp, Artificial Sequence
  Synthetic
gggcctaaggtaaagcgatggcccttgtcaaaagaaaaaatagaagctttaagagatatttgtcaagagatggaa

SEQ ID NO: 180389 - DNA, 75 bp, Artificial Sequence
  Synthetic
gggcctaaggtaaagcgatggcccttgtcaaaagaaaaaatagaagctttaagagttatttgtcaagagatggaa

SEQ ID NO: 180390 - DNA, 75 bp, Artificial Sequence
  Synthetic
gggcctaaggtaaagcgatggcccttgtcaaaagaaaaaatagaagctttaagagctatttgtcaagagatggaa

SEQ ID NO: 180391 - DNA, 75 bp, Artificial Sequence
  Synthetic
gggcctaaggtaaagcgatggcccttgtcaaaagaaaaaatagaagctttaagaggtatttgtcaagagatggaa

SEQ ID NO: 180392 - DNA, 75 bp, Artificial Sequence
  Synthetic
gggcctaaggtaaagcgatggcccttgtcaaatgaaaaaatagaagctttaagagatatttgtcaagagatggaa

SEQ ID NO: 180393 - DNA, 75 bp, Artificial Sequence
  Synthetic
gggcctaaggtaaagcgatggcccttgtcaaatgaaaaaatagaagctttaagagttatttgtcaagagatggaa

SEQ ID NO: 180394 - DNA, 75 bp, Artificial Sequence
  Synthetic
gggcctaaggtaaagcgatggcccttgtcaaatgaaaaaatagaagctttaagagctatttgtcaagagatggaa

SEQ ID NO: 180395 - DNA, 75 bp, Artificial Sequence
  Synthetic
gggcctaaggtaaagcgatggcccttgtcaaatgaaaaaatagaagctttaagaggtatttgtcaagagatggaa

SEQ ID NO: 180396 - DNA, 75 bp, Artificial Sequence
  Synthetic
gggcctaaggtaaagcgatggcccttgtcaaacgaaaaaatagaagctttaagagatatttgtcaagagatggaa

SEQ ID NO: 180397 - DNA, 75 bp, Artificial Sequence
  Synthetic
gggcctaaggtaaagcgatggcccttgtcaaacgaaaaaatagaagctttaagagttatttgtcaagagatggaa

SEQ ID NO: 180398 - DNA, 75 bp, Artificial Sequence
  Synthetic
gggcctaaggtaaagcgatggcccttgtcaaacgaaaaaatagaagctttaagagctatttgtcaagagatggaa

SEQ ID NO: 180399 - DNA, 75 bp, Artificial Sequence
  Synthetic
gggcctaaggtaaagcgatggcccttgtcaaacgaaaaaatagaagctttaagaggtatttgtcaagagatggaa

SEQ ID NO: 180400 - DNA, 75 bp, Artificial Sequence
  Synthetic
gggcctaaggtaaagcgatggcccttgtcaaaggaaaaaatagaagctttaagagatatttgtcaagagatggaa

SEQ ID NO: 180401 - DNA, 75 bp, Artificial Sequence
  Synthetic
gggcctaaggtaaagcgatggcccttgtcaaaggaaaaaatagaagctttaagagttatttgtcaagagatggaa

SEQ ID NO: 180402 - DNA, 75 bp, Artificial Sequence
  Synthetic
gggcctaaggtaaagcgatggcccttgtcaaaggaaaaaatagaagctttaagagctatttgtcaagagatggaa

SEQ ID NO: 180403 - DNA, 75 bp, Artificial Sequence
  Synthetic
gggcctaaggtaaagcgatggcccttgtcaaaggaaaaaatagaagctttaagaggtatttgtcaagagatggaa

SEQ ID NO: 180404 - DNA, 75 bp, Artificial Sequence
  Synthetic
acttcagagaactaaataagagaacacaagatttttgggaagtacagatgggaatccctcatccaggaggtctta

SEQ ID NO: 180405 - DNA, 75 bp, Artificial Sequence
  Synthetic
acttcagagaactaaataagagaacacaagatttttgggaagtacagttgggaatccctcatccaggaggtctta

SEQ ID NO: 180406 - DNA, 75 bp, Artificial Sequence
  Synthetic
acttcagagaactaaataagagaacacaagatttttgggaagtacagctgggaatccctcatccaggaggtctta

SEQ ID NO: 180407 - DNA, 75 bp, Artificial Sequence
  Synthetic
acttcagagaactaaataagagaacacaagatttttgggaagtacaggtgggaatccctcatccaggaggtctta

SEQ ID NO: 180408 - DNA, 75 bp, Artificial Sequence
  Synthetic
tgcatcagatgctaaagcatatgatacagaggtacataatgtttgggccacacatgcctgtgtacccacagaccc

SEQ ID NO: 180409 - DNA, 75 bp, Artificial Sequence
  Synthetic
aaatgaaaaattgctctttcaatacaaccacagaaataagagataagaatcggaaagaatatgcacttttttata

SEQ ID NO: 180410 - DNA, 75 bp, Artificial Sequence
  Synthetic
aggacaaagtctacctgtcatgggtaccagcacacaaagggattggaggaaatgaacaagtagataaattagtca

SEQ ID NO: 180411 - DNA, 75 bp, Artificial Sequence
  Synthetic
tgtaaataatgagacaccaggaattagatatcagtataatgttctgcctcagggatggaaaggatcgccagccat

SEQ ID NO: 180412 - DNA, 75 bp, Artificial Sequence
  Synthetic
taaagtgtaataatgagacattcaatgggacaggaccatgcaataatgtcagcacagtacaatgtacacatggaa

SEQ ID NO: 180413 - DNA, 75 bp, Artificial Sequence
  Synthetic
ttgcctttgtctgaacatagacagcgggtagagaaacttagggaacacctctatgtatgggggtttacaactcct

SEQ ID NO: 180414 - DNA, 75 bp, Artificial Sequence
  Synthetic
tagaaggaaaagttatcctggtagcagtccatgtagccagtggctatatagaagcagaagttatcccagcagaaa

SEQ ID NO: 180415 - DNA, 75 bp, Artificial Sequence
  Synthetic
ctttcaatatcgacacagacatgggtgccaaggcgcagaaacactctgcagtttttaataaacttgatgtagtat

SEQ ID NO: 180416 - DNA, 75 bp, Artificial Sequence
  Synthetic
cactttaaactgtactaatgtaaacagtgctaatcatactgaggccaataacactgtagaaaacaaagaagaaat

SEQ ID NO: 180417 - DNA, 75 bp, Artificial Sequence
  Synthetic
tcagaagactgagttacaagcaattcatttagctttgcaggattcaggatcagaagtaaacatagtaacagactc

SEQ ID NO: 180418 - DNA, 75 bp, Artificial Sequence
  Synthetic
agtgctaatcatactgaggccaataacactgtagaaaacaaagaagaaataaaaaactgctctttcaagataacc

SEQ ID NO: 180419 - DNA, 75 bp, Artificial Sequence
  Synthetic
cttggacagtaaatgacatccagaagctagtaggaaagttaaattgggcaagtcagatttatccaggaataaggg

SEQ ID NO: 180420 - DNA, 75 bp, Artificial Sequence
  Synthetic
ggcttgtccaaaggtaaattttgacccaattcccatacattattgtgctccagctggttttgcgattttaaagtg

SEQ ID NO: 180421 - DNA, 75 bp, Artificial Sequence
  Synthetic
tcagcacagtacagtgtacacatggaattaggccagtagtatcaactcaactactgttaaatggcagtctagcag

SEQ ID NO: 180422 - DNA, 75 bp, Artificial Sequence
  Synthetic
catctgcaccactgctgtgccctggaactccacttggagtaataaatcttatgaagagatttggaacaacatgac

SEQ ID NO: 180423 - DNA, 75 bp, Artificial Sequence
  Synthetic
tttaaaagaaccagtgcatggagtttattaccaaccagaaaaggaattaatagtagacatacagaaacagggaga

SEQ ID NO: 180424 - DNA, 75 bp, Artificial Sequence
  Synthetic
aaattaattgtacaagacccaacaacaatacaagaaaaagtatacatataggaccagggagagcattttatgcaa

SEQ ID NO: 180425 - DNA, 75 bp, Artificial Sequence
  Synthetic
caacaatacaagaaaaagtatgactctaggaccaggaaaggtattctatacaacaggaataacaggagatataag

SEQ ID NO: 180426 - DNA, 75 bp, Artificial Sequence
  Synthetic
ctggcagaagtaatacagaagacatcacaagaaagcatagtaatatggggaaaattacccaagtttagactacca

SEQ ID NO: 180427 - DNA, 75 bp, Artificial Sequence
  Synthetic
ggtatcagctagaaaaagaccccataccaggaatagaaaccttttatgtagatggggcagcaaacagagagacta

SEQ ID NO: 180428 - DNA, 75 bp, Artificial Sequence
  Synthetic
gatcctgacctagcagaccaactgattcacctgcattattttgactgtttttcagactctgccataaggaaagcc

SEQ ID NO: 180429 - DNA, 75 bp, Artificial Sequence
  Synthetic
agaaatgaatttgccaggaaaatggaaaccaaaaataatagggggaattggaggctttatcaaagtaagacagta

SEQ ID NO: 180430 - DNA, 75 bp, Artificial Sequence
  Synthetic
agccttaaaagaatcaggaaaacaggctaacatagtaacagactcccaatatgtattagggatcatctcagcaac

SEQ ID NO: 180431 - DNA, 75 bp, Artificial Sequence
  Synthetic
agccttaaaagaatcaggaaaacaggctaacatagtaacagactcccaatatgttttagggatcatctcagcaac

SEQ ID NO: 180432 - DNA, 75 bp, Artificial Sequence
  Synthetic
agccttaaaagaatcaggaaaacaggctaacatagtaacagactcccaatatgtcttagggatcatctcagcaac

SEQ ID NO: 180433 - DNA, 75 bp, Artificial Sequence
  Synthetic
agccttaaaagaatcaggaaaacaggctaacatagtaacagactcccaatatgtgttagggatcatctcagcaac

SEQ ID NO: 180434 - DNA, 75 bp, Artificial Sequence
  Synthetic
gatggggatacagaggaattgtcaacaatggtggatatggggaatcttaggcttttggatgctaatgatttgtaa

SEQ ID NO: 180435 - DNA, 75 bp, Artificial Sequence
  Synthetic
gggggtaatgaagatatagagaaaatagtcagtaaagacattagaagagtgttattcctagaaggcatagaacaa

SEQ ID NO: 180436 - DNA, 75 bp, Artificial Sequence
  Synthetic
gggggtaatgaagatatagagaaaatagtcagtaaagacattagaagagtgttattcctagaaggcatagatcaa

SEQ ID NO: 180437 - DNA, 75 bp, Artificial Sequence
  Synthetic
gggggtaatgaagatatagagaaaatagtcagtaaagacattagaagagtgttattcctagaaggcatagaccaa

SEQ ID NO: 180438 - DNA, 75 bp, Artificial Sequence
  Synthetic
gggggtaatgaagatatagagaaaatagtcagtaaagacattagaagagtgttattcctagaaggcatagagcaa

SEQ ID NO: 180439 - DNA, 75 bp, Artificial Sequence
  Synthetic
gggggtaatgaagatatagagaaaatagtcagtaaagacattagaagtgtgttattcctagaaggcatagaacaa

SEQ ID NO: 180440 - DNA, 75 bp, Artificial Sequence
  Synthetic
gggggtaatgaagatatagagaaaatagtcagtaaagacattagaagtgtgttattcctagaaggcatagatcaa

SEQ ID NO: 180441 - DNA, 75 bp, Artificial Sequence
  Synthetic
gggggtaatgaagatatagagaaaatagtcagtaaagacattagaagtgtgttattcctagaaggcatagaccaa

SEQ ID NO: 180442 - DNA, 75 bp, Artificial Sequence
  Synthetic
gggggtaatgaagatatagagaaaatagtcagtaaagacattagaagtgtgttattcctagaaggcatagagcaa

SEQ ID NO: 180443 - DNA, 75 bp, Artificial Sequence
  Synthetic
gggggtaatgaagatatagagaaaatagtcagtaaagacattagaagcgtgttattcctagaaggcatagaacaa

SEQ ID NO: 180444 - DNA, 75 bp, Artificial Sequence
  Synthetic
gggggtaatgaagatatagagaaaatagtcagtaaagacattagaagcgtgttattcctagaaggcatagatcaa

SEQ ID NO: 180445 - DNA, 75 bp, Artificial Sequence
  Synthetic
gggggtaatgaagatatagagaaaatagtcagtaaagacattagaagcgtgttattcctagaaggcatagaccaa

SEQ ID NO: 180446 - DNA, 75 bp, Artificial Sequence
  Synthetic
gggggtaatgaagatatagagaaaatagtcagtaaagacattagaagcgtgttattcctagaaggcatagagcaa

SEQ ID NO: 180447 - DNA, 75 bp, Artificial Sequence
  Synthetic
gggggtaatgaagatatagagaaaatagtcagtaaagacattagaagggtgttattcctagaaggcatagaacaa

SEQ ID NO: 180448 - DNA, 75 bp, Artificial Sequence
  Synthetic
gggggtaatgaagatatagagaaaatagtcagtaaagacattagaagggtgttattcctagaaggcatagatcaa

SEQ ID NO: 180449 - DNA, 75 bp, Artificial Sequence
  Synthetic
gggggtaatgaagatatagagaaaatagtcagtaaagacattagaagggtgttattcctagaaggcatagaccaa

SEQ ID NO: 180450 - DNA, 75 bp, Artificial Sequence
  Synthetic
gggggtaatgaagatatagagaaaatagtcagtaaagacattagaagggtgttattcctagaaggcatagagcaa

SEQ ID NO: 180451 - DNA, 75 bp, Artificial Sequence
  Synthetic
gggggtaatgaagatatagagaaattagtcagtaaagacattagaagagtgttattcctagaaggcatagaacaa

SEQ ID NO: 180452 - DNA, 75 bp, Artificial Sequence
  Synthetic
gggggtaatgaagatatagagaaattagtcagtaaagacattagaagagtgttattcctagaaggcatagatcaa

SEQ ID NO: 180453 - DNA, 75 bp, Artificial Sequence
  Synthetic
gggggtaatgaagatatagagaaattagtcagtaaagacattagaagagtgttattcctagaaggcatagaccaa

SEQ ID NO: 180454 - DNA, 75 bp, Artificial Sequence
  Synthetic
gggggtaatgaagatatagagaaattagtcagtaaagacattagaagagtgttattcctagaaggcatagagcaa

SEQ ID NO: 180455 - DNA, 75 bp, Artificial Sequence
  Synthetic
gggggtaatgaagatatagagaaattagtcagtaaagacattagaagtgtgttattcctagaaggcatagaacaa

SEQ ID NO: 180456 - DNA, 75 bp, Artificial Sequence
  Synthetic
gggggtaatgaagatatagagaaattagtcagtaaagacattagaagtgtgttattcctagaaggcatagatcaa

SEQ ID NO: 180457 - DNA, 75 bp, Artificial Sequence
  Synthetic
gggggtaatgaagatatagagaaattagtcagtaaagacattagaagtgtgttattcctagaaggcatagaccaa

SEQ ID NO: 180458 - DNA, 75 bp, Artificial Sequence
  Synthetic
gggggtaatgaagatatagagaaattagtcagtaaagacattagaagtgtgttattcctagaaggcatagagcaa

SEQ ID NO: 180459 - DNA, 75 bp, Artificial Sequence
  Synthetic
gggggtaatgaagatatagagaaattagtcagtaaagacattagaagcgtgttattcctagaaggcatagaacaa

SEQ ID NO: 180460 - DNA, 75 bp, Artificial Sequence
  Synthetic
gggggtaatgaagatatagagaaattagtcagtaaagacattagaagcgtgttattcctagaaggcatagatcaa

SEQ ID NO: 180461 - DNA, 75 bp, Artificial Sequence
  Synthetic
gggggtaatgaagatatagagaaattagtcagtaaagacattagaagcgtgttattcctagaaggcatagaccaa

SEQ ID NO: 180462 - DNA, 75 bp, Artificial Sequence
  Synthetic
gggggtaatgaagatatagagaaattagtcagtaaagacattagaagcgtgttattcctagaaggcatagagcaa

SEQ ID NO: 180463 - DNA, 75 bp, Artificial Sequence
  Synthetic
gggggtaatgaagatatagagaaattagtcagtaaagacattagaagggtgttattcctagaaggcatagaacaa

SEQ ID NO: 180464 - DNA, 75 bp, Artificial Sequence
  Synthetic
gggggtaatgaagatatagagaaattagtcagtaaagacattagaagggtgttattcctagaaggcatagatcaa

SEQ ID NO: 180465 - DNA, 75 bp, Artificial Sequence
  Synthetic
gggggtaatgaagatatagagaaattagtcagtaaagacattagaagggtgttattcctagaaggcatagaccaa

SEQ ID NO: 180466 - DNA, 75 bp, Artificial Sequence
  Synthetic
gggggtaatgaagatatagagaaattagtcagtaaagacattagaagggtgttattcctagaaggcatagagcaa

SEQ ID NO: 180467 - DNA, 75 bp, Artificial Sequence
  Synthetic
gggggtaatgaagatatagagaaactagtcagtaaagacattagaagagtgttattcctagaaggcatagaacaa

SEQ ID NO: 180468 - DNA, 75 bp, Artificial Sequence
  Synthetic
gggggtaatgaagatatagagaaactagtcagtaaagacattagaagagtgttattcctagaaggcatagatcaa

SEQ ID NO: 180469 - DNA, 75 bp, Artificial Sequence
  Synthetic
gggggtaatgaagatatagagaaactagtcagtaaagacattagaagagtgttattcctagaaggcatagaccaa

SEQ ID NO: 180470 - DNA, 75 bp, Artificial Sequence
  Synthetic
gggggtaatgaagatatagagaaactagtcagtaaagacattagaagagtgttattcctagaaggcatagagcaa

SEQ ID NO: 180471 - DNA, 75 bp, Artificial Sequence
  Synthetic
gggggtaatgaagatatagagaaactagtcagtaaagacattagaagtgtgttattcctagaaggcatagaacaa

SEQ ID NO: 180472 - DNA, 75 bp, Artificial Sequence
  Synthetic
gggggtaatgaagatatagagaaactagtcagtaaagacattagaagtgtgttattcctagaaggcatagatcaa

SEQ ID NO: 180473 - DNA, 75 bp, Artificial Sequence
  Synthetic
gggggtaatgaagatatagagaaactagtcagtaaagacattagaagtgtgttattcctagaaggcatagaccaa

SEQ ID NO: 180474 - DNA, 75 bp, Artificial Sequence
  Synthetic
gggggtaatgaagatatagagaaactagtcagtaaagacattagaagtgtgttattcctagaaggcatagagcaa

SEQ ID NO: 180475 - DNA, 75 bp, Artificial Sequence
  Synthetic
gggggtaatgaagatatagagaaactagtcagtaaagacattagaagcgtgttattcctagaaggcatagaacaa

SEQ ID NO: 180476 - DNA, 75 bp, Artificial Sequence
  Synthetic
gggggtaatgaagatatagagaaactagtcagtaaagacattagaagcgtgttattcctagaaggcatagatcaa

SEQ ID NO: 180477 - DNA, 75 bp, Artificial Sequence
  Synthetic
gggggtaatgaagatatagagaaactagtcagtaaagacattagaagcgtgttattcctagaaggcatagaccaa

SEQ ID NO: 180478 - DNA, 75 bp, Artificial Sequence
  Synthetic
gggggtaatgaagatatagagaaactagtcagtaaagacattagaagcgtgttattcctagaaggcatagagcaa

SEQ ID NO: 180479 - DNA, 75 bp, Artificial Sequence
  Synthetic
gggggtaatgaagatatagagaaactagtcagtaaagacattagaagggtgttattcctagaaggcatagaacaa

SEQ ID NO: 180480 - DNA, 75 bp, Artificial Sequence
  Synthetic
gggggtaatgaagatatagagaaactagtcagtaaagacattagaagggtgttattcctagaaggcatagatcaa

SEQ ID NO: 180481 - DNA, 75 bp, Artificial Sequence
  Synthetic
gggggtaatgaagatatagagaaactagtcagtaaagacattagaagggtgttattcctagaaggcatagaccaa

SEQ ID NO: 180482 - DNA, 75 bp, Artificial Sequence
  Synthetic
gggggtaatgaagatatagagaaactagtcagtaaagacattagaagggtgttattcctagaaggcatagagcaa

SEQ ID NO: 180483 - DNA, 75 bp, Artificial Sequence
  Synthetic
gggggtaatgaagatatagagaaagtagtcagtaaagacattagaagagtgttattcctagaaggcatagaacaa

SEQ ID NO: 180484 - DNA, 75 bp, Artificial Sequence
  Synthetic
gggggtaatgaagatatagagaaagtagtcagtaaagacattagaagagtgttattcctagaaggcatagatcaa

SEQ ID NO: 180485 - DNA, 75 bp, Artificial Sequence
  Synthetic
gggggtaatgaagatatagagaaagtagtcagtaaagacattagaagagtgttattcctagaaggcatagaccaa

SEQ ID NO: 180486 - DNA, 75 bp, Artificial Sequence
  Synthetic
gggggtaatgaagatatagagaaagtagtcagtaaagacattagaagagtgttattcctagaaggcatagagcaa

SEQ ID NO: 180487 - DNA, 75 bp, Artificial Sequence
  Synthetic
gggggtaatgaagatatagagaaagtagtcagtaaagacattagaagtgtgttattcctagaaggcatagaacaa

SEQ ID NO: 180488 - DNA, 75 bp, Artificial Sequence
  Synthetic
gggggtaatgaagatatagagaaagtagtcagtaaagacattagaagtgtgttattcctagaaggcatagatcaa

SEQ ID NO: 180489 - DNA, 75 bp, Artificial Sequence
  Synthetic
gggggtaatgaagatatagagaaagtagtcagtaaagacattagaagtgtgttattcctagaaggcatagaccaa

SEQ ID NO: 180490 - DNA, 75 bp, Artificial Sequence
  Synthetic
gggggtaatgaagatatagagaaagtagtcagtaaagacattagaagtgtgttattcctagaaggcatagagcaa

SEQ ID NO: 180491 - DNA, 75 bp, Artificial Sequence
  Synthetic
gggggtaatgaagatatagagaaagtagtcagtaaagacattagaagcgtgttattcctagaaggcatagaacaa

SEQ ID NO: 180492 - DNA, 75 bp, Artificial Sequence
  Synthetic
gggggtaatgaagatatagagaaagtagtcagtaaagacattagaagcgtgttattcctagaaggcatagatcaa

SEQ ID NO: 180493 - DNA, 75 bp, Artificial Sequence
  Synthetic
gggggtaatgaagatatagagaaagtagtcagtaaagacattagaagcgtgttattcctagaaggcatagaccaa

SEQ ID NO: 180494 - DNA, 75 bp, Artificial Sequence
  Synthetic
gggggtaatgaagatatagagaaagtagtcagtaaagacattagaagcgtgttattcctagaaggcatagagcaa

SEQ ID NO: 180495 - DNA, 75 bp, Artificial Sequence
  Synthetic
gggggtaatgaagatatagagaaagtagtcagtaaagacattagaagggtgttattcctagaaggcatagaacaa

SEQ ID NO: 180496 - DNA, 75 bp, Artificial Sequence
  Synthetic
gggggtaatgaagatatagagaaagtagtcagtaaagacattagaagggtgttattcctagaaggcatagatcaa

SEQ ID NO: 180497 - DNA, 75 bp, Artificial Sequence
  Synthetic
gggggtaatgaagatatagagaaagtagtcagtaaagacattagaagggtgttattcctagaaggcatagaccaa

SEQ ID NO: 180498 - DNA, 75 bp, Artificial Sequence
  Synthetic
gggggtaatgaagatatagagaaagtagtcagtaaagacattagaagggtgttattcctagaaggcatagagcaa

SEQ ID NO: 180499 - DNA, 75 bp, Artificial Sequence
  Synthetic
tccctcaaatcactctttggcaacgacccctcgtcacaataaagataggggggcaactaaaggaagctctattag

SEQ ID NO: 180500 - DNA, 75 bp, Artificial Sequence
  Synthetic
attgggggttgcaaacaggagaaagggattggcatttgggtcatggagtctccatagaatggagattgagaagat

SEQ ID NO: 180501 - DNA, 75 bp, Artificial Sequence
  Synthetic
ccaaatgtcatgtaaaaggggaagccatgcatggacaggtagactgcagtccaggaatttggcaactggactgta

SEQ ID NO: 180502 - DNA, 75 bp, Artificial Sequence
  Synthetic
ccaaatgtcatgtaaaaggggaagccatgcatggacaggtagactgcagtccaggaatttggcatctggactgta

SEQ ID NO: 180503 - DNA, 75 bp, Artificial Sequence
  Synthetic
ccaaatgtcatgtaaaaggggaagccatgcatggacaggtagactgcagtccaggaatttggcacctggactgta

SEQ ID NO: 180504 - DNA, 75 bp, Artificial Sequence
  Synthetic
ccaaatgtcatgtaaaaggggaagccatgcatggacaggtagactgcagtccaggaatttggcagctggactgta

SEQ ID NO: 180505 - DNA, 75 bp, Artificial Sequence
  Synthetic
tttggcatctcctatggcaggaagaagcggagacagcgacgaaaacctcctcacggcgatcaggctcatcaagtt

SEQ ID NO: 180506 - DNA, 75 bp, Artificial Sequence
  Synthetic
cgtggtccatagtattaatagaatataggaaaatattaagacaaaggaaaatagacaggttaattgatagaataa

SEQ ID NO: 180507 - DNA, 75 bp, Artificial Sequence
  Synthetic
acccaagtgacaaggaaataccttaccaaaatgacacagggataagaaattgctctttcaatgcaaccacagaaa

SEQ ID NO: 180508 - DNA, 75 bp, Artificial Sequence
  Synthetic
atttgtgctcaaattggcagcaagatggcctgtaaaagtgatacacacagacaatgggcctaacttaactagagc

SEQ ID NO: 180509 - DNA, 75 bp, Artificial Sequence
  Synthetic
atttgtgctcaaattggcagcaagatggcctgtaaaagtgatacacacagacaatgggcctaacttaactagtgc

SEQ ID NO: 180510 - DNA, 75 bp, Artificial Sequence
  Synthetic
atttgtgctcaaattggcagcaagatggcctgtaaaagtgatacacacagacaatgggcctaacttaactagcgc

SEQ ID NO: 180511 - DNA, 75 bp, Artificial Sequence
  Synthetic
atttgtgctcaaattggcagcaagatggcctgtaaaagtgatacacacagacaatgggcctaacttaactagggc

SEQ ID NO: 180512 - DNA, 75 bp, Artificial Sequence
  Synthetic
atttgtgctcaaattggcagcaagatggcctgtaaaagtgatacacacagacaatgggcctaactttactagagc

SEQ ID NO: 180513 - DNA, 75 bp, Artificial Sequence
  Synthetic
atttgtgctcaaattggcagcaagatggcctgtaaaagtgatacacacagacaatgggcctaactttactagtgc

SEQ ID NO: 180514 - DNA, 75 bp, Artificial Sequence
  Synthetic
atttgtgctcaaattggcagcaagatggcctgtaaaagtgatacacacagacaatgggcctaactttactagcgc

SEQ ID NO: 180515 - DNA, 75 bp, Artificial Sequence
  Synthetic
atttgtgctcaaattggcagcaagatggcctgtaaaagtgatacacacagacaatgggcctaactttactagggc

SEQ ID NO: 180516 - DNA, 75 bp, Artificial Sequence
  Synthetic
atttgtgctcaaattggcagcaagatggcctgtaaaagtgatacacacagacaatgggcctaacttcactagagc

SEQ ID NO: 180517 - DNA, 75 bp, Artificial Sequence
  Synthetic
atttgtgctcaaattggcagcaagatggcctgtaaaagtgatacacacagacaatgggcctaacttcactagtgc

SEQ ID NO: 180518 - DNA, 75 bp, Artificial Sequence
  Synthetic
atttgtgctcaaattggcagcaagatggcctgtaaaagtgatacacacagacaatgggcctaacttcactagcgc

SEQ ID NO: 180519 - DNA, 75 bp, Artificial Sequence
  Synthetic
atttgtgctcaaattggcagcaagatggcctgtaaaagtgatacacacagacaatgggcctaacttcactagggc

SEQ ID NO: 180520 - DNA, 75 bp, Artificial Sequence
  Synthetic
atttgtgctcaaattggcagcaagatggcctgtaaaagtgatacacacagacaatgggcctaacttgactagagc

SEQ ID NO: 180521 - DNA, 75 bp, Artificial Sequence
  Synthetic
atttgtgctcaaattggcagcaagatggcctgtaaaagtgatacacacagacaatgggcctaacttgactagtgc

SEQ ID NO: 180522 - DNA, 75 bp, Artificial Sequence
  Synthetic
atttgtgctcaaattggcagcaagatggcctgtaaaagtgatacacacagacaatgggcctaacttgactagcgc

SEQ ID NO: 180523 - DNA, 75 bp, Artificial Sequence
  Synthetic
atttgtgctcaaattggcagcaagatggcctgtaaaagtgatacacacagacaatgggcctaacttgactagggc

SEQ ID NO: 180524 - DNA, 75 bp, Artificial Sequence
  Synthetic
ttttgtgctcaaattggcagcaagatggcctgtaaaagtgatacacacagacaatgggcctaacttaactagagc

SEQ ID NO: 180525 - DNA, 75 bp, Artificial Sequence
  Synthetic
ttttgtgctcaaattggcagcaagatggcctgtaaaagtgatacacacagacaatgggcctaacttaactagtgc

SEQ ID NO: 180526 - DNA, 75 bp, Artificial Sequence
  Synthetic
ttttgtgctcaaattggcagcaagatggcctgtaaaagtgatacacacagacaatgggcctaacttaactagcgc

SEQ ID NO: 180527 - DNA, 75 bp, Artificial Sequence
  Synthetic
ttttgtgctcaaattggcagcaagatggcctgtaaaagtgatacacacagacaatgggcctaacttaactagggc

SEQ ID NO: 180528 - DNA, 75 bp, Artificial Sequence
  Synthetic
ttttgtgctcaaattggcagcaagatggcctgtaaaagtgatacacacagacaatgggcctaactttactagagc

SEQ ID NO: 180529 - DNA, 75 bp, Artificial Sequence
  Synthetic
ttttgtgctcaaattggcagcaagatggcctgtaaaagtgatacacacagacaatgggcctaactttactagtgc

SEQ ID NO: 180530 - DNA, 75 bp, Artificial Sequence
  Synthetic
ttttgtgctcaaattggcagcaagatggcctgtaaaagtgatacacacagacaatgggcctaactttactagcgc

SEQ ID NO: 180531 - DNA, 75 bp, Artificial Sequence
  Synthetic
ttttgtgctcaaattggcagcaagatggcctgtaaaagtgatacacacagacaatgggcctaactttactagggc

SEQ ID NO: 180532 - DNA, 75 bp, Artificial Sequence
  Synthetic
ttttgtgctcaaattggcagcaagatggcctgtaaaagtgatacacacagacaatgggcctaacttcactagagc

SEQ ID NO: 180533 - DNA, 75 bp, Artificial Sequence
  Synthetic
ttttgtgctcaaattggcagcaagatggcctgtaaaagtgatacacacagacaatgggcctaacttcactagtgc

SEQ ID NO: 180534 - DNA, 75 bp, Artificial Sequence
  Synthetic
ttttgtgctcaaattggcagcaagatggcctgtaaaagtgatacacacagacaatgggcctaacttcactagcgc

SEQ ID NO: 180535 - DNA, 75 bp, Artificial Sequence
  Synthetic
ttttgtgctcaaattggcagcaagatggcctgtaaaagtgatacacacagacaatgggcctaacttcactagggc

SEQ ID NO: 180536 - DNA, 75 bp, Artificial Sequence
  Synthetic
ttttgtgctcaaattggcagcaagatggcctgtaaaagtgatacacacagacaatgggcctaacttgactagagc

SEQ ID NO: 180537 - DNA, 75 bp, Artificial Sequence
  Synthetic
ttttgtgctcaaattggcagcaagatggcctgtaaaagtgatacacacagacaatgggcctaacttgactagtgc

SEQ ID NO: 180538 - DNA, 75 bp, Artificial Sequence
  Synthetic
ttttgtgctcaaattggcagcaagatggcctgtaaaagtgatacacacagacaatgggcctaacttgactagcgc

SEQ ID NO: 180539 - DNA, 75 bp, Artificial Sequence
  Synthetic
ttttgtgctcaaattggcagcaagatggcctgtaaaagtgatacacacagacaatgggcctaacttgactagggc

SEQ ID NO: 180540 - DNA, 75 bp, Artificial Sequence
  Synthetic
ctttgtgctcaaattggcagcaagatggcctgtaaaagtgatacacacagacaatgggcctaacttaactagagc

SEQ ID NO: 180541 - DNA, 75 bp, Artificial Sequence
  Synthetic
ctttgtgctcaaattggcagcaagatggcctgtaaaagtgatacacacagacaatgggcctaacttaactagtgc

SEQ ID NO: 180542 - DNA, 75 bp, Artificial Sequence
  Synthetic
ctttgtgctcaaattggcagcaagatggcctgtaaaagtgatacacacagacaatgggcctaacttaactagcgc

SEQ ID NO: 180543 - DNA, 75 bp, Artificial Sequence
  Synthetic
ctttgtgctcaaattggcagcaagatggcctgtaaaagtgatacacacagacaatgggcctaacttaactagggc

SEQ ID NO: 180544 - DNA, 75 bp, Artificial Sequence
  Synthetic
ctttgtgctcaaattggcagcaagatggcctgtaaaagtgatacacacagacaatgggcctaactttactagagc

SEQ ID NO: 180545 - DNA, 75 bp, Artificial Sequence
  Synthetic
ctttgtgctcaaattggcagcaagatggcctgtaaaagtgatacacacagacaatgggcctaactttactagtgc

SEQ ID NO: 180546 - DNA, 75 bp, Artificial Sequence
  Synthetic
ctttgtgctcaaattggcagcaagatggcctgtaaaagtgatacacacagacaatgggcctaactttactagcgc

SEQ ID NO: 180547 - DNA, 75 bp, Artificial Sequence
  Synthetic
ctttgtgctcaaattggcagcaagatggcctgtaaaagtgatacacacagacaatgggcctaactttactagggc

SEQ ID NO: 180548 - DNA, 75 bp, Artificial Sequence
  Synthetic
ctttgtgctcaaattggcagcaagatggcctgtaaaagtgatacacacagacaatgggcctaacttcactagagc

SEQ ID NO: 180549 - DNA, 75 bp, Artificial Sequence
  Synthetic
ctttgtgctcaaattggcagcaagatggcctgtaaaagtgatacacacagacaatgggcctaacttcactagtgc

SEQ ID NO: 180550 - DNA, 75 bp, Artificial Sequence
  Synthetic
ctttgtgctcaaattggcagcaagatggcctgtaaaagtgatacacacagacaatgggcctaacttcactagcgc

SEQ ID NO: 180551 - DNA, 75 bp, Artificial Sequence
  Synthetic
ctttgtgctcaaattggcagcaagatggcctgtaaaagtgatacacacagacaatgggcctaacttcactagggc

SEQ ID NO: 180552 - DNA, 75 bp, Artificial Sequence
  Synthetic
ctttgtgctcaaattggcagcaagatggcctgtaaaagtgatacacacagacaatgggcctaacttgactagagc

SEQ ID NO: 180553 - DNA, 75 bp, Artificial Sequence
  Synthetic
ctttgtgctcaaattggcagcaagatggcctgtaaaagtgatacacacagacaatgggcctaacttgactagtgc

SEQ ID NO: 180554 - DNA, 75 bp, Artificial Sequence
  Synthetic
ctttgtgctcaaattggcagcaagatggcctgtaaaagtgatacacacagacaatgggcctaacttgactagcgc

SEQ ID NO: 180555 - DNA, 75 bp, Artificial Sequence
  Synthetic
ctttgtgctcaaattggcagcaagatggcctgtaaaagtgatacacacagacaatgggcctaacttgactagggc

SEQ ID NO: 180556 - DNA, 75 bp, Artificial Sequence
  Synthetic
gtttgtgctcaaattggcagcaagatggcctgtaaaagtgatacacacagacaatgggcctaacttaactagagc

SEQ ID NO: 180557 - DNA, 75 bp, Artificial Sequence
  Synthetic
gtttgtgctcaaattggcagcaagatggcctgtaaaagtgatacacacagacaatgggcctaacttaactagtgc

SEQ ID NO: 180558 - DNA, 75 bp, Artificial Sequence
  Synthetic
gtttgtgctcaaattggcagcaagatggcctgtaaaagtgatacacacagacaatgggcctaacttaactagcgc

SEQ ID NO: 180559 - DNA, 75 bp, Artificial Sequence
  Synthetic
gtttgtgctcaaattggcagcaagatggcctgtaaaagtgatacacacagacaatgggcctaacttaactagggc

SEQ ID NO: 180560 - DNA, 75 bp, Artificial Sequence
  Synthetic
gtttgtgctcaaattggcagcaagatggcctgtaaaagtgatacacacagacaatgggcctaactttactagagc

SEQ ID NO: 180561 - DNA, 75 bp, Artificial Sequence
  Synthetic
gtttgtgctcaaattggcagcaagatggcctgtaaaagtgatacacacagacaatgggcctaactttactagtgc

SEQ ID NO: 180562 - DNA, 75 bp, Artificial Sequence
  Synthetic
gtttgtgctcaaattggcagcaagatggcctgtaaaagtgatacacacagacaatgggcctaactttactagcgc

SEQ ID NO: 180563 - DNA, 75 bp, Artificial Sequence
  Synthetic
gtttgtgctcaaattggcagcaagatggcctgtaaaagtgatacacacagacaatgggcctaactttactagggc

SEQ ID NO: 180564 - DNA, 75 bp, Artificial Sequence
  Synthetic
gtttgtgctcaaattggcagcaagatggcctgtaaaagtgatacacacagacaatgggcctaacttcactagagc

SEQ ID NO: 180565 - DNA, 75 bp, Artificial Sequence
  Synthetic
gtttgtgctcaaattggcagcaagatggcctgtaaaagtgatacacacagacaatgggcctaacttcactagtgc

SEQ ID NO: 180566 - DNA, 75 bp, Artificial Sequence
  Synthetic
gtttgtgctcaaattggcagcaagatggcctgtaaaagtgatacacacagacaatgggcctaacttcactagcgc

SEQ ID NO: 180567 - DNA, 75 bp, Artificial Sequence
  Synthetic
gtttgtgctcaaattggcagcaagatggcctgtaaaagtgatacacacagacaatgggcctaacttcactagggc

SEQ ID NO: 180568 - DNA, 75 bp, Artificial Sequence
  Synthetic
gtttgtgctcaaattggcagcaagatggcctgtaaaagtgatacacacagacaatgggcctaacttgactagagc

SEQ ID NO: 180569 - DNA, 75 bp, Artificial Sequence
  Synthetic
gtttgtgctcaaattggcagcaagatggcctgtaaaagtgatacacacagacaatgggcctaacttgactagtgc

SEQ ID NO: 180570 - DNA, 75 bp, Artificial Sequence
  Synthetic
gtttgtgctcaaattggcagcaagatggcctgtaaaagtgatacacacagacaatgggcctaacttgactagcgc

SEQ ID NO: 180571 - DNA, 75 bp, Artificial Sequence
  Synthetic
gtttgtgctcaaattggcagcaagatggcctgtaaaagtgatacacacagacaatgggcctaacttgactagggc

SEQ ID NO: 180572 - DNA, 75 bp, Artificial Sequence
  Synthetic
agctggagtaatagtagtaagatacattctctagaagagatttgggggaacatgacctggatgcagtgggaaaaa

SEQ ID NO: 180573 - DNA, 75 bp, Artificial Sequence
  Synthetic
aatagctgcaatagtaggactagtagtagcattcatagcagccatagttgtgtggaccatagtatttatagaata

SEQ ID NO: 180574 - DNA, 75 bp, Artificial Sequence
  Synthetic
gtagcattcatagcagccatagttgtgtggaccatagtatttatagaatataggaaaataaggaaacagaagaaa

SEQ ID NO: 180575 - DNA, 75 bp, Artificial Sequence
  Synthetic
cgaggggataccagaggaattgtccaccaacttggtggacatggggcatcatgctccttgggatgttgacgatct

SEQ ID NO: 180576 - DNA, 75 bp, Artificial Sequence
  Synthetic
taggaaaataaggaaacagaagaaaatagacaggatacttgatagaataagagaaagagcagaagatagtggcaa

SEQ ID NO: 180577 - DNA, 75 bp, Artificial Sequence
  Synthetic
tgcagtaaaagcagcctgttggtggcttaatataactcatgagtttgggataccctacaatccccagagtcaggg

SEQ ID NO: 180578 - DNA, 75 bp, Artificial Sequence
  Synthetic
tgcagtaaatgcagcctgttggtggcttaatataactcatgagtttgggataccctacaatccccagagtcaggg

SEQ ID NO: 180579 - DNA, 75 bp, Artificial Sequence
  Synthetic
tgcagtaaacgcagcctgttggtggcttaatataactcatgagtttgggataccctacaatccccagagtcaggg

SEQ ID NO: 180580 - DNA, 75 bp, Artificial Sequence
  Synthetic
tgcagtaaaggcagcctgttggtggcttaatataactcatgagtttgggataccctacaatccccagagtcaggg

SEQ ID NO: 180581 - DNA, 75 bp, Artificial Sequence
  Synthetic
atagtaggtatagaatataagaaattgctaaagcaaagaaaaatagacaggttaattgagagaataagagaaaga

SEQ ID NO: 180582 - DNA, 75 bp, Artificial Sequence
  Synthetic
aatatttgggctacacatgcctgtgtacccacggaccccagcccacaagaaatataactggaaaatgtggccgaa

SEQ ID NO: 180583 - DNA, 75 bp, Artificial Sequence
  Synthetic
atacaaacaacagaattacaaaaacaaattttaaaaattcaaaattttcgggtctattacagagacagcagagac

SEQ ID NO: 180584 - DNA, 75 bp, Artificial Sequence
  Synthetic
tgggagaccagatgcatgaggatagaatcagtttatgggatcaaagccctaaagccatgtgtaaaattaacccca

SEQ ID NO: 180585 - DNA, 75 bp, Artificial Sequence
  Synthetic
tatggcaggaagaagcggagacaacgacgaagcgctcctccaagcagtgaggatcatcaaaatcttatatcaaag

SEQ ID NO: 180586 - DNA, 75 bp, Artificial Sequence
  Synthetic
tatagtaccactgactgaagaagcagaattagaattggcagagaacagggagattctaaaaacccctgtgcatgg

SEQ ID NO: 180587 - DNA, 75 bp, Artificial Sequence
  Synthetic
aaataatcagagattatggaaaacagatggcaggtgatgattgtgtggcagatatccagagagaaagtgaaagcc

SEQ ID NO: 180588 - DNA, 75 bp, Artificial Sequence
  Synthetic
gtgcctggctgcaagcacaagaggaggaagaagaagtaggctttccagtcagacctcaggtgcctttaagaccaa

SEQ ID NO: 180589 - DNA, 75 bp, Artificial Sequence
  Synthetic
tagtaataaaacccttaataataacaccattgaaatgaaagaagaagtgaggaactgctcttacaacgtgaccac

SEQ ID NO: 180590 - DNA, 75 bp, Artificial Sequence
  Synthetic
cacctctagcggcaacaatataaaagaagaaacaaaaaactgctctttcaatatgaccacagacttaagagacaa

SEQ ID NO: 180591 - DNA, 75 bp, Artificial Sequence
  Synthetic
gagtttacattccagtaggagcagcaaccattgttgtgactacttattgggggcttatgcctggggaaagagaag

SEQ ID NO: 180592 - DNA, 75 bp, Artificial Sequence
  Synthetic
caaagagtttatagagctattctccacatacctagaaggataagacagggcctagaaatggctttgctataaatg

SEQ ID NO: 180593 - DNA, 75 bp, Artificial Sequence
  Synthetic
ggtggatgctgattgtgcctggctaaaagcacaaaagaaggaagaagcgggctttccaatcaaacctcaggtagt

SEQ ID NO: 180594 - DNA, 75 bp, Artificial Sequence
  Synthetic
tcaatgtttttcagattcggctgtgaggagggcaatactaggggacagggtattgaacaagtgtgaatactcagc

SEQ ID NO: 180595 - DNA, 75 bp, Artificial Sequence
  Synthetic
gttgaatggcagtctagcagaagaagagatcataattagatctgaaaatctcacaaacaatgctaaaaacataat

SEQ ID NO: 180596 - DNA, 75 bp, Artificial Sequence
  Synthetic
aacagggccatgcaagaatgtcagcacagtacaatgcacacatggaatcaggccagtagtatcaactcaactgct

SEQ ID NO: 180597 - DNA, 75 bp, Artificial Sequence
  Synthetic
acaagggcaaacattacatacaagcaagaggataataggagacataagacaagcacattgtaacattagtggaag

SEQ ID NO: 180598 - DNA, 75 bp, Artificial Sequence
  Synthetic
caagatatatggagcaagccccagaggaccaagggccgccaagagagccattcaatgagtggatgctacaaacct

SEQ ID NO: 180599 - DNA, 75 bp, Artificial Sequence
  Synthetic
caagatatatggagcaagccccagaggaccatgggccgccaagagagccattcaatgagtggatgctacaaacct

SEQ ID NO: 180600 - DNA, 75 bp, Artificial Sequence
  Synthetic
caagatatatggagcaagccccagaggaccacgggccgccaagagagccattcaatgagtggatgctacaaacct

SEQ ID NO: 180601 - DNA, 75 bp, Artificial Sequence
  Synthetic
caagatatatggagcaagccccagaggaccaggggccgccaagagagccattcaatgagtggatgctacaaacct

SEQ ID NO: 180602 - DNA, 75 bp, Artificial Sequence
  Synthetic
caagatatatggagcatgccccagaggaccaagggccgccaagagagccattcaatgagtggatgctacaaacct

SEQ ID NO: 180603 - DNA, 75 bp, Artificial Sequence
  Synthetic
caagatatatggagcatgccccagaggaccatgggccgccaagagagccattcaatgagtggatgctacaaacct

SEQ ID NO: 180604 - DNA, 75 bp, Artificial Sequence
  Synthetic
caagatatatggagcatgccccagaggaccacgggccgccaagagagccattcaatgagtggatgctacaaacct

SEQ ID NO: 180605 - DNA, 75 bp, Artificial Sequence
  Synthetic
caagatatatggagcatgccccagaggaccaggggccgccaagagagccattcaatgagtggatgctacaaacct

SEQ ID NO: 180606 - DNA, 75 bp, Artificial Sequence
  Synthetic
caagatatatggagcacgccccagaggaccaagggccgccaagagagccattcaatgagtggatgctacaaacct

SEQ ID NO: 180607 - DNA, 75 bp, Artificial Sequence
  Synthetic
caagatatatggagcacgccccagaggaccatgggccgccaagagagccattcaatgagtggatgctacaaacct

SEQ ID NO: 180608 - DNA, 75 bp, Artificial Sequence
  Synthetic
caagatatatggagcacgccccagaggaccacgggccgccaagagagccattcaatgagtggatgctacaaacct

SEQ ID NO: 180609 - DNA, 75 bp, Artificial Sequence
  Synthetic
caagatatatggagcacgccccagaggaccaggggccgccaagagagccattcaatgagtggatgctacaaacct

SEQ ID NO: 180610 - DNA, 75 bp, Artificial Sequence
  Synthetic
caagatatatggagcaggccccagaggaccaagggccgccaagagagccattcaatgagtggatgctacaaacct

SEQ ID NO: 180611 - DNA, 75 bp, Artificial Sequence
  Synthetic
caagatatatggagcaggccccagaggaccatgggccgccaagagagccattcaatgagtggatgctacaaacct

SEQ ID NO: 180612 - DNA, 75 bp, Artificial Sequence
  Synthetic
caagatatatggagcaggccccagaggaccacgggccgccaagagagccattcaatgagtggatgctacaaacct

SEQ ID NO: 180613 - DNA, 75 bp, Artificial Sequence
  Synthetic
caagatatatggagcaggccccagaggaccaggggccgccaagagagccattcaatgagtggatgctacaaacct

SEQ ID NO: 180614 - DNA, 75 bp, Artificial Sequence
  Synthetic
gaagtgaattatataaatataaagtggtagaaattaagccattgggaatagcacccactacagcaaaaaggagag

SEQ ID NO: 180615 - DNA, 75 bp, Artificial Sequence
  Synthetic
ggtagaaattaagccattgggaatagcacccactacagcaaaaaggagagtggtggagagagaaaaaagagcagt

SEQ ID NO: 180616 - DNA, 75 bp, Artificial Sequence
  Synthetic
agtaactgcaattattaggatcctacaacaattaatttttatccattatagaattggatgtcaacatagtagaat

SEQ ID NO: 180617 - DNA, 75 bp, Artificial Sequence
  Synthetic
agtaactgcaattattaggatcctacaacaattaatttttatccattatagaattggatgtcatcatagtagaat

SEQ ID NO: 180618 - DNA, 75 bp, Artificial Sequence
  Synthetic
agtaactgcaattattaggatcctacaacaattaatttttatccattatagaattggatgtcaccatagtagaat

SEQ ID NO: 180619 - DNA, 75 bp, Artificial Sequence
  Synthetic
agtaactgcaattattaggatcctacaacaattaatttttatccattatagaattggatgtcagcatagtagaat

SEQ ID NO: 180620 - DNA, 75 bp, Artificial Sequence
  Synthetic
agtaactgcaattattaggatcctactacaattaatttttatccattatagaattggatgtcaacatagtagaat

SEQ ID NO: 180621 - DNA, 75 bp, Artificial Sequence
  Synthetic
agtaactgcaattattaggatcctactacaattaatttttatccattatagaattggatgtcatcatagtagaat

SEQ ID NO: 180622 - DNA, 75 bp, Artificial Sequence
  Synthetic
agtaactgcaattattaggatcctactacaattaatttttatccattatagaattggatgtcaccatagtagaat

SEQ ID NO: 180623 - DNA, 75 bp, Artificial Sequence
  Synthetic
agtaactgcaattattaggatcctactacaattaatttttatccattatagaattggatgtcagcatagtagaat

SEQ ID NO: 180624 - DNA, 75 bp, Artificial Sequence
  Synthetic
agtaactgcaattattaggatcctaccacaattaatttttatccattatagaattggatgtcaacatagtagaat

SEQ ID NO: 180625 - DNA, 75 bp, Artificial Sequence
  Synthetic
agtaactgcaattattaggatcctaccacaattaatttttatccattatagaattggatgtcatcatagtagaat

SEQ ID NO: 180626 - DNA, 75 bp, Artificial Sequence
  Synthetic
agtaactgcaattattaggatcctaccacaattaatttttatccattatagaattggatgtcaccatagtagaat

SEQ ID NO: 180627 - DNA, 75 bp, Artificial Sequence
  Synthetic
agtaactgcaattattaggatcctaccacaattaatttttatccattatagaattggatgtcagcatagtagaat

SEQ ID NO: 180628 - DNA, 75 bp, Artificial Sequence
  Synthetic
agtaactgcaattattaggatcctacgacaattaatttttatccattatagaattggatgtcaacatagtagaat

SEQ ID NO: 180629 - DNA, 75 bp, Artificial Sequence
  Synthetic
agtaactgcaattattaggatcctacgacaattaatttttatccattatagaattggatgtcatcatagtagaat

SEQ ID NO: 180630 - DNA, 75 bp, Artificial Sequence
  Synthetic
agtaactgcaattattaggatcctacgacaattaatttttatccattatagaattggatgtcaccatagtagaat

SEQ ID NO: 180631 - DNA, 75 bp, Artificial Sequence
  Synthetic
agtaactgcaattattaggatcctacgacaattaatttttatccattatagaattggatgtcagcatagtagaat

SEQ ID NO: 180632 - DNA, 75 bp, Artificial Sequence
  Synthetic
ccacagaactaagagataagaagcagaaagtgtatgcacttttttatagacttgatatagtaccacttgataatg

SEQ ID NO: 180633 - DNA, 75 bp, Artificial Sequence
  Synthetic
caacaattaatttttatccattatagaattggatgtcaacatagtagaataggtatattgccaccctctcgaaga

SEQ ID NO: 180634 - DNA, 75 bp, Artificial Sequence
  Synthetic
caacaattaatttttatccattatagaattggatgtcatcatagtagaataggtatattgccaccctctcgaaga

SEQ ID NO: 180635 - DNA, 75 bp, Artificial Sequence
  Synthetic
caacaattaatttttatccattatagaattggatgtcaccatagtagaataggtatattgccaccctctcgaaga

SEQ ID NO: 180636 - DNA, 75 bp, Artificial Sequence
  Synthetic
caacaattaatttttatccattatagaattggatgtcagcatagtagaataggtatattgccaccctctcgaaga

SEQ ID NO: 180637 - DNA, 75 bp, Artificial Sequence
  Synthetic
ctacaattaatttttatccattatagaattggatgtcaacatagtagaataggtatattgccaccctctcgaaga

SEQ ID NO: 180638 - DNA, 75 bp, Artificial Sequence
  Synthetic
ctacaattaatttttatccattatagaattggatgtcatcatagtagaataggtatattgccaccctctcgaaga

SEQ ID NO: 180639 - DNA, 75 bp, Artificial Sequence
  Synthetic
ctacaattaatttttatccattatagaattggatgtcaccatagtagaataggtatattgccaccctctcgaaga

SEQ ID NO: 180640 - DNA, 75 bp, Artificial Sequence
  Synthetic
ctacaattaatttttatccattatagaattggatgtcagcatagtagaataggtatattgccaccctctcgaaga

SEQ ID NO: 180641 - DNA, 75 bp, Artificial Sequence
  Synthetic
ccacaattaatttttatccattatagaattggatgtcaacatagtagaataggtatattgccaccctctcgaaga

SEQ ID NO: 180642 - DNA, 75 bp, Artificial Sequence
  Synthetic
ccacaattaatttttatccattatagaattggatgtcatcatagtagaataggtatattgccaccctctcgaaga

SEQ ID NO: 180643 - DNA, 75 bp, Artificial Sequence
  Synthetic
ccacaattaatttttatccattatagaattggatgtcaccatagtagaataggtatattgccaccctctcgaaga

SEQ ID NO: 180644 - DNA, 75 bp, Artificial Sequence
  Synthetic
ccacaattaatttttatccattatagaattggatgtcagcatagtagaataggtatattgccaccctctcgaaga

SEQ ID NO: 180645 - DNA, 75 bp, Artificial Sequence
  Synthetic
cgacaattaatttttatccattatagaattggatgtcaacatagtagaataggtatattgccaccctctcgaaga

SEQ ID NO: 180646 - DNA, 75 bp, Artificial Sequence
  Synthetic
cgacaattaatttttatccattatagaattggatgtcatcatagtagaataggtatattgccaccctctcgaaga

SEQ ID NO: 180647 - DNA, 75 bp, Artificial Sequence
  Synthetic
cgacaattaatttttatccattatagaattggatgtcaccatagtagaataggtatattgccaccctctcgaaga

SEQ ID NO: 180648 - DNA, 75 bp, Artificial Sequence
  Synthetic
cgacaattaatttttatccattatagaattggatgtcagcatagtagaataggtatattgccaccctctcgaaga

SEQ ID NO: 180649 - DNA, 75 bp, Artificial Sequence
  Synthetic
acaaaacaataagctttactaaccattcaggaggggatccagaagttacaacacatagttttaattgtggaggag

SEQ ID NO: 180650 - DNA, 75 bp, Artificial Sequence
  Synthetic
cgacaggctcggaagaatcgaagaagaaggtggagagcaagacaaagacagatcaattcgattagtgagcggatt

SEQ ID NO: 180651 - DNA, 75 bp, Artificial Sequence
  Synthetic
tgctatcattgctatgtttgtttcacaaagaagggtttggggatctcctatggcaggaagaagcgacgaagacct

SEQ ID NO: 180652 - DNA, 75 bp, Artificial Sequence
  Synthetic
ttaataatagctggggtattactaatttgcattatagtagtttgggggaaggtcctgctatttgtgctaaaagag

SEQ ID NO: 180653 - DNA, 75 bp, Artificial Sequence
  Synthetic
aatgccaaaaccataatagtgcaccttaataaatctgtagaaatcaattgtaccagaccctccaacaatacaaga

SEQ ID NO: 180654 - DNA, 75 bp, Artificial Sequence
  Synthetic
aacttgggaatttgcttggctttggtaatatactttaatgctattagctgtgctagtggaatacactatgttact

SEQ ID NO: 180655 - DNA, 75 bp, Artificial Sequence
  Synthetic
ggagtaataaatctcaggaggaaatttggaataacatgacctggatgcagtgggaaaaagagattagcaattact

SEQ ID NO: 180656 - DNA, 75 bp, Artificial Sequence
  Synthetic
aatgaacaagaattattggcattggacaaatgggcaagtctgtggaattggtttgacatatcaaaatggctgtgg

SEQ ID NO: 180657 - DNA, 75 bp, Artificial Sequence
  Synthetic
cacatttgcaccactactgtgccctggaactctagttggagtaataaatcaagatgcgatttgcataccatgacc

SEQ ID NO: 180658 - DNA, 75 bp, Artificial Sequence
  Synthetic
cccaggcctgtgtgcccaccgaccctacaccaatagagatcccgataaatgtaacagagtcttttaatatttgga

SEQ ID NO: 180659 - DNA, 75 bp, Artificial Sequence
  Synthetic
ttgtagtgaatgccacagggaggctagctgtaataataacagtagctcctctgtgaataacaccgccgacaatcc

SEQ ID NO: 180660 - DNA, 75 bp, Artificial Sequence
  Synthetic
ttgtagtgaatgccacagggaggctagctgtaataataacagtagctcctctgtgaatatcaccgccgacaatcc

SEQ ID NO: 180661 - DNA, 75 bp, Artificial Sequence
  Synthetic
ttgtagtgaatgccacagggaggctagctgtaataataacagtagctcctctgtgaataccaccgccgacaatcc

SEQ ID NO: 180662 - DNA, 75 bp, Artificial Sequence
  Synthetic
ttgtagtgaatgccacagggaggctagctgtaataataacagtagctcctctgtgaatagcaccgccgacaatcc

SEQ ID NO: 180663 - DNA, 75 bp, Artificial Sequence
  Synthetic
actactccagcagcagagggagtaggagcagcgtctcaagacttagataaacatggggcacttacaatcaacaac

SEQ ID NO: 180664 - DNA, 75 bp, Artificial Sequence
  Synthetic
aatgagacagcaaataatacactatatagattaattaattgcaacaccactaccattacacaagcatgcccaaaa

SEQ ID NO: 180665 - DNA, 75 bp, Artificial Sequence
  Synthetic
cagcatctgttgcaactcacagtctggggcattaaacagctccaggcaagagtcctggctgtggaaagataccta

SEQ ID NO: 180666 - DNA, 75 bp, Artificial Sequence
  Synthetic
agacagtcataacacactgtacacatggaattaagccaacagtatcaacacaattgatactaaatggaactctag

SEQ ID NO: 180667 - DNA, 75 bp, Artificial Sequence
  Synthetic
atcctcctgcagtattggagtcaggaatgacgaaatagagctattaacttgcttgatacaatatcaatacttaca

SEQ ID NO: 180668 - DNA, 75 bp, Artificial Sequence
  Synthetic
attagacacaggagcagatgacacagtattagaagaaataaatttaccaggaagatggaaaccaaaaatgatagg

SEQ ID NO: 180669 - DNA, 75 bp, Artificial Sequence
  Synthetic
aggtaataacacaagaggacaagtgcaaataggacccatgacctggtataatatgaaattctacacaggtgatat

SEQ ID NO: 180670 - DNA, 75 bp, Artificial Sequence
  Synthetic
gggaaagaataagaagaactgatccagcagcagatggggtgggagcagtatctcgagacctggaaaaacatgggg

SEQ ID NO: 180671 - DNA, 75 bp, Artificial Sequence
  Synthetic
tagtgcaaggaattggtagagctatcctcaacatacctagaagaatcagacagggcctcgaaaggtctttgctat

SEQ ID NO: 180672 - DNA, 75 bp, Artificial Sequence
  Synthetic
ctaaaagaattgttaaatgtttcaactgtggcaaggaagggcacatagccagaaattgcagggcccctaggaaaa

SEQ ID NO: 180673 - DNA, 75 bp, Artificial Sequence
  Synthetic
aataggacaaggaatttgtagagctattttaaacatacctagaagaatcagacagggcctcgaaagagctttgct

SEQ ID NO: 180674 - DNA, 75 bp, Artificial Sequence
  Synthetic
aaccatacatttgtctttcgaaacagtacagggggagacccagaggtttcttttctgcactacaattgtcatggg

SEQ ID NO: 180675 - DNA, 75 bp, Artificial Sequence
  Synthetic
aaccatacatttgtctttcgaaacagtacagggggagacccagaggtttcttttctgcacttcaattgtcatggg

SEQ ID NO: 180676 - DNA, 75 bp, Artificial Sequence
  Synthetic
aaccatacatttgtctttcgaaacagtacagggggagacccagaggtttcttttctgcactccaattgtcatggg

SEQ ID NO: 180677 - DNA, 75 bp, Artificial Sequence
  Synthetic
aaccatacatttgtctttcgaaacagtacagggggagacccagaggtttcttttctgcactgcaattgtcatggg

SEQ ID NO: 180678 - DNA, 75 bp, Artificial Sequence
  Synthetic
taacactgccttgtagactaaagcaagtagttaattcatggatgaaagtgggatcaggcttgtttgcgccaccta

SEQ ID NO: 180679 - DNA, 75 bp, Artificial Sequence
  Synthetic
catatagtatgggcaagcagggagctagaacgatttgcacttaatcctggccttttagaaacatcagaaggctgt

SEQ ID NO: 180680 - DNA, 75 bp, Artificial Sequence
  Synthetic
gccttttagaaacatcagaaggctgtcgaaaaataataggacagctacaaccatcccttcagacaggatcagaag

SEQ ID NO: 180681 - DNA, 75 bp, Artificial Sequence
  Synthetic
gtggcgcccgaacagggacttgaagataatagggactcgaaagcgaaagttccagggagctctctcgacgcagag

SEQ ID NO: 180682 - DNA, 75 bp, Artificial Sequence
  Synthetic
agggggagaaatgagaaatatctggagaagtgagttatatccctacaaggtagttcaagtaaaggctctggctgt

SEQ ID NO: 180683 - DNA, 75 bp, Artificial Sequence
  Synthetic
agaagtgagttatatccctacaaggtagttcaagtaaaggctctggctgtggcacctacaagagtctccagacct

SEQ ID NO: 180684 - DNA, 75 bp, Artificial Sequence
  Synthetic
tagtaccgatgatagtagtgggggaggagtgatggagaaaggagaaatgaaaaactgctctttcaatgttaccac

SEQ ID NO: 180685 - DNA, 75 bp, Artificial Sequence
  Synthetic
cggcagttacgctgacggtacaggccaggcaattattgcatggtatagtgcagcagcagaacaatatgctacgag

SEQ ID NO: 180686 - DNA, 75 bp, Artificial Sequence
  Synthetic
actcctaggactgtggggatgctcaggacaaacagtatgttatactaatgtgccatggaataggagctggaccaa

SEQ ID NO: 180687 - DNA, 75 bp, Artificial Sequence
  Synthetic
tggcagtctagcagaaggagaggtaataattagatctgaaaatttcacagacaatgctaaaaccataatagtaca

SEQ ID NO: 180688 - DNA, 75 bp, Artificial Sequence
  Synthetic
caacgagcacaagatcaacaaaaggctaatgaaaaaaagttattagagttagaccaatgggcacaattgtggaac

SEQ ID NO: 180689 - DNA, 75 bp, Artificial Sequence
  Synthetic
caacgagcacaagatcatcaaaaggctaatgaaaaaaagttattagagttagaccaatgggcacaattgtggaac

SEQ ID NO: 180690 - DNA, 75 bp, Artificial Sequence
  Synthetic
caacgagcacaagatcaccaaaaggctaatgaaaaaaagttattagagttagaccaatgggcacaattgtggaac

SEQ ID NO: 180691 - DNA, 75 bp, Artificial Sequence
  Synthetic
caacgagcacaagatcagcaaaaggctaatgaaaaaaagttattagagttagaccaatgggcacaattgtggaac

SEQ ID NO: 180692 - DNA, 75 bp, Artificial Sequence
  Synthetic
tcaggagaatcaggcagggatactcacctgtatcgttacagacccttggcctgaacggggatccagcaggaatag

SEQ ID NO: 180693 - DNA, 75 bp, Artificial Sequence
  Synthetic
ggtggtgcagatctaccagatcttagtcggctgcatattggggatcaaggacctcctaacaatcctgtggataca

SEQ ID NO: 180694 - DNA, 75 bp, Artificial Sequence
  Synthetic
aagcaatgtatgcccctcccatcagaggacaaattaaatgttcatcaaatattacagggttgctattaacaagag

SEQ ID NO: 180695 - DNA, 75 bp, Artificial Sequence
  Synthetic
ttggacactgttgctatatcagttgcagggtggactgatcaagtaataatagtagggcaacaaataggaagaggc

SEQ ID NO: 180696 - DNA, 75 bp, Artificial Sequence
  Synthetic
cagagaaagaatgaatcagactgccccagaaacacctgcatctggggttggggagatttccaaagaattagcaca

SEQ ID NO: 180697 - DNA, 75 bp, Artificial Sequence
  Synthetic
ccttcttagaagctcatgaagatgaagaagtaggattcccagtcaggcctcaagtacccgtaagacccatgacat

SEQ ID NO: 180698 - DNA, 75 bp, Artificial Sequence
  Synthetic
ggaaccgagggacaagggactatatcctcctttaacttccctcaaatcactctttggcaacgacccttagtcaca

SEQ ID NO: 180699 - DNA, 75 bp, Artificial Sequence
  Synthetic
ggctgagtgaaggcagtaagggcggcaggaaccaaccacgacggagtgctcctataaaggcgcgggtcggtacca

SEQ ID NO: 180700 - DNA, 75 bp, Artificial Sequence
  Synthetic
gacaggatgaggattagaacatggaatagtttagtaaagcaccatatgtatatttcaaagagagctagtggatgg

SEQ ID NO: 180701 - DNA, 75 bp, Artificial Sequence
  Synthetic
gagtgggagatgggcgtgagaaactccgtcttgtcagggaagaaagcagatgaattagaaaaaattaggctacga

SEQ ID NO: 180702 - DNA, 75 bp, Artificial Sequence
  Synthetic
gccacagagggagccatacaatgaatgggcactagagcttttagaggagcttaagagtgaagctgttagacattt

SEQ ID NO: 180703 - DNA, 75 bp, Artificial Sequence
  Synthetic
gatgtcaaaaaatactttcggtcttagctccattagtgccaacaggctcagaaaatttaaaaagcctttataata

SEQ ID NO: 180704 - DNA, 75 bp, Artificial Sequence
  Synthetic
tgcattcaccatacccagcataaacaatgagacaccagggattagatatcaatacaatgtgcttccacagggatg

SEQ ID NO: 180705 - DNA, 75 bp, Artificial Sequence
  Synthetic
aacagaaactatgccaaaaacaagtagaccaacagcaccatctagcggcagaggaggaaattacccagtacaaca

SEQ ID NO: 180706 - DNA, 75 bp, Artificial Sequence
  Synthetic
ctgacagaggaagacaaaaagctgtctccctaactgagaccacaaatcagaaggctgagttacaagcaattcagt

SEQ ID NO: 180707 - DNA, 75 bp, Artificial Sequence
  Synthetic
ggatttcaggcactgtcagaaggttgcaccccctatgacattaatcagatgttaaattgtgtgggagaccatcaa

SEQ ID NO: 180708 - DNA, 75 bp, Artificial Sequence
  Synthetic
ctatacaactgccagaaaaagaagactggactgtcaatgctatacagaagttattacggaaattatactgggcaa

SEQ ID NO: 180709 - DNA, 75 bp, Artificial Sequence
  Synthetic
tagatgtaagagacaccaaggaagctctagataaaatagaggaaatacaaaataagagcaagcagaagacacaac

SEQ ID NO: 180710 - DNA, 75 bp, Artificial Sequence
  Synthetic
cgtcaggatcagatattgcaggaacaactagttcagtagatgaacaaatccagtggatgtacagacaacagaacc

SEQ ID NO: 180711 - DNA, 75 bp, Artificial Sequence
  Synthetic
gctgtttattcatttcagaattgggtgccgacatagcagaataggcattactccacagaggagagcaagaaatgg

SEQ ID NO: 180712 - DNA, 75 bp, Artificial Sequence
  Synthetic
attatagagtaggagtaggagcactgataatagcattaatcatagcaataattgtgtggatctgggtatatatag

SEQ ID NO: 180713 - DNA, 75 bp, Artificial Sequence
  Synthetic
gccaaaagagccatttcagagctatgtagacaggttctacaaaagtttaagagcagaacagacagatgcagcagt

SEQ ID NO: 180714 - DNA, 75 bp, Artificial Sequence
  Synthetic
atcagaaggagccaccccacaagatttaaatatgatgctaaacatagtggggggacaccaggcagctatgcaaat

SEQ ID NO: 180715 - DNA, 75 bp, Artificial Sequence
  Synthetic
cccacaagaaatagtattaacaaatgtgacagaaaattttgacatgtggaaaaataacatggtagaacagatgca

SEQ ID NO: 180716 - DNA, 75 bp, Artificial Sequence
  Synthetic
ctgacggcttgtcaaggagtaggggggccgggacagaaggctagattaatggcagaagccctgaaagaggccctc

SEQ ID NO: 180717 - DNA, 75 bp, Artificial Sequence
  Synthetic
tgcaaaaagtggctacagaaagcatagtaatatggggaaagacccctaaatttagactacccatacaaagagaaa

SEQ ID NO: 180718 - DNA, 75 bp, Artificial Sequence
  Synthetic
gcagagccccaagaagacagggatgctggaaatgtggaaaaatggaccatgttatggccaaatgcccagacagac

SEQ ID NO: 180719 - DNA, 75 bp, Artificial Sequence
  Synthetic
ttggcaggctacctggattcctgaatgggagtttgtcaatacccctcctctagtaaaattatggtaccagttaga

SEQ ID NO: 180720 - DNA, 75 bp, Artificial Sequence
  Synthetic
tagtaggattaatagtagcattcatagcagccatagttgtgtggaccatagtatttatagaatatagggaaataa

SEQ ID NO: 180721 - DNA, 75 bp, Artificial Sequence
  Synthetic
gtcagcacagtacaatgtacacatggaattaagccagtggtatcaactcaactgctgttaaatggcagtctagca

SEQ ID NO: 180722 - DNA, 75 bp, Artificial Sequence
  Synthetic
cccagctgtggatctgctaaagaactacatgcagttgggcaagcagcagagagaaaagcagagagaaagcagaga

SEQ ID NO: 180723 - DNA, 75 bp, Artificial Sequence
  Synthetic
aagggctgttggaaatgtggaaaggagggacaccaaatgaaagactgcactgaaagacaggctaattttttaggg

SEQ ID NO: 180724 - DNA, 75 bp, Artificial Sequence
  Synthetic
taataatactatcgacaacagtgacatgaagggagaaataaaaaattgttctttcaatacaaccacagaaataat

SEQ ID NO: 180725 - DNA, 75 bp, Artificial Sequence
  Synthetic
tctaggaccagggagagtatattatacaacaggacaaataataggagatataagacaagcacattgtaccattag

SEQ ID NO: 180726 - DNA, 75 bp, Artificial Sequence
  Synthetic
tattactggatacaggggctgatgattctattgtaacaggaatagagttaggtccacattataccccaaaaatag

SEQ ID NO: 180727 - DNA, 75 bp, Artificial Sequence
  Synthetic
ctgattatgtcaagaatgttactaatgccactagtactaatgccactagtagcgagggaggagaaatgaaaaact

SEQ ID NO: 180728 - DNA, 75 bp, Artificial Sequence
  Synthetic
cccgattaacatttttggtagaaatttgctaacagctctggggatgtctctaaattttcccatagctaaagtaga

SEQ ID NO: 180729 - DNA, 75 bp, Artificial Sequence
  Synthetic
tagcactgaaaccaacaatagcactgtggataacccaggagaaataaaaaactgctctttcaatgtaaccacaga

SEQ ID NO: 180730 - DNA, 75 bp, Artificial Sequence
  Synthetic
aagatggaaaaggatggtcagttggaggaagctcccccgaccaatccatacaacacccccacatttgctataaag

SEQ ID NO: 180731 - DNA, 75 bp, Artificial Sequence
  Synthetic
ctaataaaacaatagtctttaagtcatcctcaggaggggacctagaaattacaacacatagttttaattgtagag

SEQ ID NO: 180732 - DNA, 75 bp, Artificial Sequence
  Synthetic
caggactagcaaaaaggaaaagaattacagtactggatataggtgatgcatatttctccatacctctagatgaag

SEQ ID NO: 180733 - DNA, 75 bp, Artificial Sequence
  Synthetic
catggaattaagccagtggtatcaactcaactactactgaatggcagtttagcagaaggaaaaataaaagttaga

SEQ ID NO: 180734 - DNA, 75 bp, Artificial Sequence
  Synthetic
accagccatcttccaatacactatgagacatgtgctagaacccttcaggaaggcaaatccagatgtgaccttagt

SEQ ID NO: 180735 - DNA, 75 bp, Artificial Sequence
  Synthetic
taagaatgggaattggaccaggacaaacgttctatgcaacaggtgccataataggagacataagacaagcacatt

SEQ ID NO: 180736 - DNA, 75 bp, Artificial Sequence
  Synthetic
tctaccccagaagagaaattccaaaaagatcccccatttcaatggatggggtacgaattgtggccaacaaaatgg

SEQ ID NO: 180737 - DNA, 75 bp, Artificial Sequence
  Synthetic
gtataaaaaccaaacatctctgtaggttaattagaggaaaaatgactctaacagaggaagttcagtggactgaga

SEQ ID NO: 180738 - DNA, 75 bp, Artificial Sequence
  Synthetic
taaggctacccacaatcccatggagggagaaataaaaaattgctctttcaatgcaaccacagaaataaaagatag

SEQ ID NO: 180739 - DNA, 75 bp, Artificial Sequence
  Synthetic
gagtcaggacaatcagtggtcttataaaattcaccaagaagacaaaatactgaaagtaggaaaatttgcaaagat

SEQ ID NO: 180740 - DNA, 75 bp, Artificial Sequence
  Synthetic
gtaggatcgctacaatatttggcactgaaagcattagtaacaccaacaaggacaaagccacctttacctagtgtt

SEQ ID NO: 180741 - DNA, 75 bp, Artificial Sequence
  Synthetic
aagcatagtaatatggggaaaaactcctaaatttaaactacccatacaaaaggaaacatgggaagcatggtggac

SEQ ID NO: 180742 - DNA, 75 bp, Artificial Sequence
  Synthetic
ttaccagttgagaaggatgtatgggaacagtggtggacagactattggcaggtaacctggataccggaatgggat

SEQ ID NO: 180743 - DNA, 75 bp, Artificial Sequence
  Synthetic
agacccaacaataatacaagaacaagtataaggataggaccaggacatagcttctttgcaacaaatggcataata

SEQ ID NO: 180744 - DNA, 75 bp, Artificial Sequence
  Synthetic
agtcaaaagaagggaaagcaggatatatcacagataggggcaaagacaaagtaaaagtgttagaacagactacta

SEQ ID NO: 180745 - DNA, 75 bp, Artificial Sequence
  Synthetic
gtataaggataggaccaggacatagcttctttgcaacaaatggcataataggagacataagacaagcacattgta

SEQ ID NO: 180746 - DNA, 75 bp, Artificial Sequence
  Synthetic
aggaccaggacgagcattttatacaacaggagaaataataggagacatcagaaaggcacattgtaatgttagtgg

SEQ ID NO: 180747 - DNA, 75 bp, Artificial Sequence
  Synthetic
tgtgagattaatggaacaaaatggaatgaaactttaaaacaggtagctggaaaattaaaagagcactttaataat

SEQ ID NO: 180748 - DNA, 75 bp, Artificial Sequence
  Synthetic
aacaatgctgcttgtgcctggctagaagcacaagaggaggaggaggtgggttttccagtcagacctcaggtacct

SEQ ID NO: 180749 - DNA, 75 bp, Artificial Sequence
  Synthetic
aggatgccctacagaatcagagagcaggctagttaatcaaataatagaagaaatgattaaaaagtcagaaattta

SEQ ID NO: 180750 - DNA, 75 bp, Artificial Sequence
  Synthetic
tgtgcagtattggggtctagagctaaaaaagagtgctattagtctgcttgataccataacaatagcagtagctga

SEQ ID NO: 180751 - DNA, 75 bp, Artificial Sequence
  Synthetic
gagccagcacaagaagaacatgataaataccatagtaatgtaaaagaattggtattcaaatttggattacccaga

SEQ ID NO: 180752 - DNA, 75 bp, Artificial Sequence
  Synthetic
tggagaaataaaaaattgctctttcaatacaaccacagaaataagagataagaaacagaatgtgtatgcactttt

SEQ ID NO: 180753 - DNA, 75 bp, Artificial Sequence
  Synthetic
tcagacccttacccaccaccagagggaacccgacaggcccgaaggaatcgaagaaggaggtggcgagcaaggcag

SEQ ID NO: 180754 - DNA, 75 bp, Artificial Sequence
  Synthetic
atattcagacctggaggaggagatatgagggacaattggagaagtgaattatataaatataaagtagtagaaatt

SEQ ID NO: 180755 - DNA, 75 bp, Artificial Sequence
  Synthetic
attgtacccatctagagggaaaaataatcatagttgcagtacatgtagctagtggattcatagaagcagaggtaa

SEQ ID NO: 180756 - DNA, 75 bp, Artificial Sequence
  Synthetic
atatattaataaattgtaatacctcagccataacacaagcctgtccaaaggtcacttttgatccaattcctatac

SEQ ID NO: 180757 - DNA, 75 bp, Artificial Sequence
  Synthetic
gaataatgctgcttgtgcctggctgcaagcacaagaggaggaggaagaagtaggctttccagtcagacctcaggt

SEQ ID NO: 180758 - DNA, 75 bp, Artificial Sequence
  Synthetic
atatgacctggatgcagtgggataaagaaattagtaattacacaaacacaatatacaagttgcttgaagaatcgc

SEQ ID NO: 180759 - DNA, 75 bp, Artificial Sequence
  Synthetic
agagagatgggtgcgagagcgtcaatattaagaggaggcgaattagataaatgggaaaaaattaggttaaggcca

SEQ ID NO: 180760 - DNA, 75 bp, Artificial Sequence
  Synthetic
ttcgcaagaagtaaagatggttgcatggtgggcagggatagagcacacctttggggtaccatacaatccacagag

SEQ ID NO: 180761 - DNA, 75 bp, Artificial Sequence
  Synthetic
tggagccaaaactggaggtgaaaaactgctctttcaggaaaactacagaaggaagagagaagaaaaagaaagcaa

SEQ ID NO: 180762 - DNA, 75 bp, Artificial Sequence
  Synthetic
cattgcatgaattttaaaagaaggggaggaataggggatatgactccagcagaaagattaattaacatgatcact

SEQ ID NO: 180763 - DNA, 75 bp, Artificial Sequence
  Synthetic
aggataggaccaggacaaacattttatgcaacaggaataataggaaacataagacaagcacattgtaatgttagc

SEQ ID NO: 180764 - DNA, 75 bp, Artificial Sequence
  Synthetic
gactcctaccaataatagtagtatgggggaagaggtgatggaaaaaggagaaataaaaaactgcactttcaatat

SEQ ID NO: 180765 - DNA, 75 bp, Artificial Sequence
  Synthetic
gtgagctattgtggaaaggggaaggagcagtcatcttaaaggtagggacagacattaaggtagtacccagaagaa

SEQ ID NO: 180766 - DNA, 75 bp, Artificial Sequence
  Synthetic
agcacagtacaatgtacacatggaatcaagccagtagtatcaactcaactgctgttaaatggcagtctagcagaa

SEQ ID NO: 180767 - DNA, 75 bp, Artificial Sequence
  Synthetic
aatatctgaaatataaaactaaagatctacaaaaggtttgctatgtgccccattttaaggtcggatgggcatggt

SEQ ID NO: 180768 - DNA, 75 bp, Artificial Sequence
  Synthetic
tctcacaaacaatgctaaaaacatattattacagtttaatgcatctgaagaaattaattgtacaaggccctacca

SEQ ID NO: 180769 - DNA, 75 bp, Artificial Sequence
  Synthetic
tgcagtgaggataacctggtactcaaagaacttttggacagatgtaacaccaaactatgcagacattttactgca

SEQ ID NO: 180770 - DNA, 75 bp, Artificial Sequence
  Synthetic
caggtaccaagcctacagtacttagcactgaaagtagtaagcgatgtcagatcccagggagagaatcccacctgg

SEQ ID NO: 180771 - DNA, 75 bp, Artificial Sequence
  Synthetic
aataagacagggcttggaaagggctttactataaaatgggtggcaagtggtcaaaaagtagtatagttggatggc

SEQ ID NO: 180772 - DNA, 75 bp, Artificial Sequence
  Synthetic
tttggggctgctctggaaaactcatctgcaccactaatgtgccttggaactccagttggagtaataaatctcaaa

SEQ ID NO: 180773 - DNA, 75 bp, Artificial Sequence
  Synthetic
ggagaatttggccttccagcaaagggaggccaggaaattttcctcagagcagaccagagccatcagccccaccag

SEQ ID NO: 180774 - DNA, 75 bp, Artificial Sequence
  Synthetic
gagagacaggctaattttttagggaaaatttggccttccaacaagggaaggccagggaatttccttcagaacagg

SEQ ID NO: 180775 - DNA, 75 bp, Artificial Sequence
  Synthetic
gagggagtaggagcagcatctcaagacttagataaacatggggcacttacaagcagcaacacagccaccaataat

SEQ ID NO: 180776 - DNA, 75 bp, Artificial Sequence
  Synthetic
attttccaggtttggcaaaggtcttgggaatactggcatgatgaacaagggatgtcaccaagctatgtaaaatac

SEQ ID NO: 180777 - DNA, 75 bp, Artificial Sequence
  Synthetic
accttcagacctggcggaggagatatgagggacaattggagaagtgaattatataaatacaaagtaatacaaatt

SEQ ID NO: 180778 - DNA, 75 bp, Artificial Sequence
  Synthetic
agaagtacgagacaccaaagaagccttagacaagatagaggaagaacaaaacaaaattcagcaaaaaacacagca

SEQ ID NO: 180779 - DNA, 75 bp, Artificial Sequence
  Synthetic
gaaattaattgtacaagacccaacaacaatacaagaaaaagtatacctataggaccagggagagcattttataca

SEQ ID NO: 180780 - DNA, 75 bp, Artificial Sequence
  Synthetic
aggaggaagtaggctttccagtcagacctcaggtacctttaagaccaatgacttataaaggagctttagatctca

SEQ ID NO: 180781 - DNA, 75 bp, Artificial Sequence
  Synthetic
aggaccagggagagcattttatacaacaggagaaataataggagatataagacaagcacattgtaacattagtaa

SEQ ID NO: 180782 - DNA, 75 bp, Artificial Sequence
  Synthetic
ctcctcctcctccccctccaggactagcataaatggaagaaagacctccagaaaatgaaggaccacaaagggaac

SEQ ID NO: 180783 - DNA, 75 bp, Artificial Sequence
  Synthetic
atgggaaaaaattaggttaaggccagggggaaagaaaaaatataggctaaaacacttagtatgggcaagcaggga

SEQ ID NO: 180784 - DNA, 75 bp, Artificial Sequence
  Synthetic
taatcgtcacggagacactctagagggagcaggagaactcattagaatcctccaacgagcgctcttcatgcattt

SEQ ID NO: 180785 - DNA, 75 bp, Artificial Sequence
  Synthetic
accagcttttcagacagggacagaggaaattagatcattatacaactcaatagcagttctttattgtgtacatag

SEQ ID NO: 180786 - DNA, 75 bp, Artificial Sequence
  Synthetic
gccctggaactcttcttggagtaataaatccttagatgagatttggcaaaacttgccctggaagaaagtgggaag

SEQ ID NO: 180787 - DNA, 75 bp, Artificial Sequence
  Synthetic
gcatacagatataatcagtctatgggaccaaagcctaaagccatgtgtaaagttaacccctctctgtgttacttt

SEQ ID NO: 180788 - DNA, 75 bp, Artificial Sequence
  Synthetic
aatactaataccaataatagtagtgggggagtgatggaggaaggagaaatgaaaaactgctctttcaatgtttcc

SEQ ID NO: 180789 - DNA, 75 bp, Artificial Sequence
  Synthetic
acttctgggacgccgggggtgggaagccctcaagtatctgtggaatttcctgcagtattggagtcaggaactcag

SEQ ID NO: 180790 - DNA, 75 bp, Artificial Sequence
  Synthetic
cagtctcaagggactgagactggggtgggaagccctcaaatatctgtggaatcttctatcatactggggtcagga

SEQ ID NO: 180791 - DNA, 75 bp, Artificial Sequence
  Synthetic
tgggaagccctcaaatatctgtggaatcttctatcatactggggtcaggaactaaagaatagtgctattaatttg

SEQ ID NO: 180792 - DNA, 75 bp, Artificial Sequence
  Synthetic
actaaagaatagtgctattaatttgcttgatacaatagcaatagcagtagctaactggacagatagagttataga

SEQ ID NO: 180793 - DNA, 75 bp, Artificial Sequence
  Synthetic
ctaaaagaattattaaatgtttcaactgtggcaaggaaggacacatagccaaaaattgcagggcccctaggaaaa

SEQ ID NO: 180794 - DNA, 75 bp, Artificial Sequence
  Synthetic
caacacaagaagaagtgtgtctataggaccaggacaagcattctatgcaatgggtgacgtaataggggatataag

SEQ ID NO: 180795 - DNA, 75 bp, Artificial Sequence
  Synthetic
atgaggatataatcagtttatgggatgaaagcctaaagccatgtgtaaaattaaccccactctgtgttactttaa

SEQ ID NO: 180796 - DNA, 75 bp, Artificial Sequence
  Synthetic
aaatcacaacacatagttttaattgtggaggagaattcttctattgtaatacatcaggcctgtttaatcacactt

SEQ ID NO: 180797 - DNA, 75 bp, Artificial Sequence
  Synthetic
aaccaacagccccaccagcagagagctttgggttcggagaggagataaccccctctccgaagcaggagcagaaag

SEQ ID NO: 180798 - DNA, 75 bp, Artificial Sequence
  Synthetic
gaggagacaacccctgctccgaagcaggagctgaaagacagggaagccttaacttccctcaaatcactctttggc

SEQ ID NO: 180799 - DNA, 75 bp, Artificial Sequence
  Synthetic
cagcatctcgagaccaggaaagagcagcagatggagtaggagcagcatctagagacctagaaaaacatggagcat

SEQ ID NO: 180800 - DNA, 75 bp, Artificial Sequence
  Synthetic
tcctaggaatttggggctgctctggaaaactcatctgcaccactaatgtgccctggaactctagttggagtaata

SEQ ID NO: 180801 - DNA, 75 bp, Artificial Sequence
  Synthetic
cacctaggactttaaatgcatgggtaaaggtagtagaagaaaaggctttcagcccagaagtaatacccatgtttt

SEQ ID NO: 180802 - DNA, 75 bp, Artificial Sequence
  Synthetic
cctagcagaccaactaattcatctgtattattttgattgtttttcagaatctgctataagaaatgccatattagg

SEQ ID NO: 180803 - DNA, 75 bp, Artificial Sequence
  Synthetic
aaaacatattggggtttgcaaacaggagaaagagattggcatttgggtcatggagtctccatagaatggagattg

SEQ ID NO: 180804 - DNA, 75 bp, Artificial Sequence
  Synthetic
gatgtgggtgatgcatatttctcagttcccttagataaagacttcaggaagtatactgcatttaccatacctagt

SEQ ID NO: 180805 - DNA, 75 bp, Artificial Sequence
  Synthetic
tagtacaaggagcttgtagagctattcgccacatacctagaagaataagacagggcttggaaaggattttgctat

SEQ ID NO: 180806 - DNA, 75 bp, Artificial Sequence
  Synthetic
gactcttgcgggcgcgtggggagacttatgggagactcttaggagaggtggaagatggatactcgcaatccccag

SEQ ID NO: 180807 - DNA, 75 bp, Artificial Sequence
  Synthetic
gaagatggatactcgcaatccccaggaggattagacaagggcttgagctcactctcttgtgagggacagaaatac

SEQ ID NO: 180808 - DNA, 75 bp, Artificial Sequence
  Synthetic
tagaatataggaaaatattaagacaaaggaaaatagacaggttaattgatagaataagagaaagagcagaagaca

SEQ ID NO: 180809 - DNA, 75 bp, Artificial Sequence
  Synthetic
gggccgcagagggaaccatacaatgaatggacattagagattctagaggaactcaagcaggaagctgtcagacat

SEQ ID NO: 180810 - DNA, 75 bp, Artificial Sequence
  Synthetic
atgatgacttggtaggggtatcagtgaggccaaaagttcccctaagaacaatgagttacaaattggcaatagaca

SEQ ID NO: 180811 - DNA, 75 bp, Artificial Sequence
  Synthetic
gaaagagcagaagacagtggcaatgagagtgagggggatacagaggaattggccacaatggtggatatggggcat

SEQ ID NO: 180812 - DNA, 75 bp, Artificial Sequence
  Synthetic
cagatgcatgaggatataatcagtttatgggatcaaagcctaaagccatgtgtaaagttaaccccactctgtgtt

SEQ ID NO: 180813 - DNA, 75 bp, Artificial Sequence
  Synthetic
tatgggatcaaagcctaaagccatgtgtaaagttaaccccactctgtgttactttaaattgcactgacttgaaga

SEQ ID NO: 180814 - DNA, 75 bp, Artificial Sequence
  Synthetic
ctgagccagcagcagagccagcagcagagggggtgggagcagtatctcgagacctggaaaaacatggagcaatca

SEQ ID NO: 180815 - DNA, 75 bp, Artificial Sequence
  Synthetic
atatgcactcttttatgaacttgatgtagtacaaataaataatgatagctataggttgataagttgtaatacctc

SEQ ID NO: 180816 - DNA, 75 bp, Artificial Sequence
  Synthetic
attgctctttcaatacaaccacagaaataagagataagaaacagaatgtgtatgcacttttttataaacctgata

SEQ ID NO: 180817 - DNA, 75 bp, Artificial Sequence
  Synthetic
tgtggtccatagtattcatagaatataggaaaataagaagacaaagaaaaatagacaggttaattgatagaataa

SEQ ID NO: 180818 - DNA, 75 bp, Artificial Sequence
  Synthetic
catatgggaccagggagagcattttatgcaacaggagacataataggagacataagacaagcacattgtaacatt

SEQ ID NO: 180819 - DNA, 75 bp, Artificial Sequence
  Synthetic
ggaaatgtcactttaagagataagacttgcaatgggaccatgacggaaatgaaaaattgctctttcaatgccacc

SEQ ID NO: 180820 - DNA, 75 bp, Artificial Sequence
  Synthetic
acactcccatgcagaataaaacaaattataaacatgtggcaggaagtaggaaaagcaatgtatgcccctcccatc

SEQ ID NO: 180821 - DNA, 75 bp, Artificial Sequence
  Synthetic
ttataaacatgtggcaggaagtaggaaaagcaatgtatgcccctcccatcgcaggacaaattagatgttcatcaa

SEQ ID NO: 180822 - DNA, 75 bp, Artificial Sequence
  Synthetic
actgtgagccctgtggttggcaataaagaactaaaaaactgctctttcaatataaccacagaattgagagataag

SEQ ID NO: 180823 - DNA, 75 bp, Artificial Sequence
  Synthetic
ttaggccagtagtatcaactcaattgctgctaaatggcagtttagcagaaggagaaataatggttagatctgaaa

SEQ ID NO: 180824 - DNA, 75 bp, Artificial Sequence
  Synthetic
aagcttcgcaccaggacaagcgatctatgcaacaggtgatataataggagatataagacaagcacattgtaatgt

SEQ ID NO: 180825 - DNA, 75 bp, Artificial Sequence
  Synthetic
ataacaaattggctgtggtatataaaaatattcataatgatagtaggaggcttaataggtttaagaataattttt

SEQ ID NO: 180826 - DNA, 75 bp, Artificial Sequence
  Synthetic
ataaaacaaattgtgagaatgtggcagagagtgggacaagcaatgtatgcccctcccatagcaggaaacattaca

SEQ ID NO: 180827 - DNA, 75 bp, Artificial Sequence
  Synthetic
taacagtagctgaaggaacagataggattattggagtaatacaaagcatctttagagctatctgcaatataccta

SEQ ID NO: 180828 - DNA, 75 bp, Artificial Sequence
  Synthetic
gttgaagctataataagaattctgcaacaactactgtttattcatttcagaattgggtgtcaacatagcagaata

SEQ ID NO: 180829 - DNA, 75 bp, Artificial Sequence
  Synthetic
ctgctccagcagcaagaggagtaggaccagtatctcaagatttggataagtatggagcagtcacaagcagtaata

SEQ ID NO: 180830 - DNA, 75 bp, Artificial Sequence
  Synthetic
tgttattgtaaaaagtgttgctatcattgccaagtttgcttcataacgaaaggcttaggcatctcctatggcagg

SEQ ID NO: 180831 - DNA, 75 bp, Artificial Sequence
  Synthetic
ggggtgggaagcccttaaatatctgggaaatattgtgcagtattggggtctggaactaaaaaagagtgctattaa

SEQ ID NO: 180832 - DNA, 75 bp, Artificial Sequence
  Synthetic
agactggttaattgatagaataagagaaagagaagaagacagtggcaatgagagtgaaggggataaagaggaact

SEQ ID NO: 180833 - DNA, 75 bp, Artificial Sequence
  Synthetic
tttggaagaacctaacctgggtacaatgggaaagggaaattagcaattatacacaagaaatatacaacctacttg

SEQ ID NO: 180834 - DNA, 75 bp, Artificial Sequence
  Synthetic
ctattttgtgcatcagatgctaaatcatataaaacagaggcacataatatctgggctacacatgcctgtgtaccc

SEQ ID NO: 180835 - DNA, 75 bp, Artificial Sequence
  Synthetic
accactgctgtgccttggaactccagttggagtaataaatctcaagaagagatttggaataacatgacctggatg

SEQ ID NO: 180836 - DNA, 75 bp, Artificial Sequence
  Synthetic
gtttttgctgtactttctatagtaaatagagttaggcagggatattcaccattgtcattgcagacccacctccca

SEQ ID NO: 180837 - DNA, 75 bp, Artificial Sequence
  Synthetic
gacaggttacttgatagaataagagaaagagcagaagatagtggcaatgagagtgatggggatacagaagaatta

SEQ ID NO: 180838 - DNA, 75 bp, Artificial Sequence
  Synthetic
cattctccacatacctagaagaataagacagggcttggaaagggctttactataagatgggtggcaagtggtcaa

SEQ ID NO: 180839 - DNA, 75 bp, Artificial Sequence
  Synthetic
cacactgccaacggtgaagccaggagaaatgaaaaactgctctttcaatataaccacagtagtaacggataagag

SEQ ID NO: 180840 - DNA, 75 bp, Artificial Sequence
  Synthetic
tatatagaagcagaagttattccagcagagacagggcaggaaacagcatactttctcttaaaattagcaggaaga

SEQ ID NO: 180841 - DNA, 75 bp, Artificial Sequence
  Synthetic
tactaataccaatagtagtagcgggagaatgataatggagaaaggagagataaaaaactgctctttcaatatcag

SEQ ID NO: 180842 - DNA, 75 bp, Artificial Sequence
  Synthetic
gtaggacaaagagtaggtagagcttttcttaacatacctgtaagaataagacaaggcttagaaagagctttgcta

SEQ ID NO: 180843 - DNA, 75 bp, Artificial Sequence
  Synthetic
gtgggaagcccttaagtatctgggaagtcttgtgcagtattggggtctggaactaaaaaagagtgctattagtct

SEQ ID NO: 180844 - DNA, 75 bp, Artificial Sequence
  Synthetic
aaagacaaaggacacctataggacaagggcaagcgctctatacaacaaggtatacaacaaggataataggacaag

SEQ ID NO: 180845 - DNA, 75 bp, Artificial Sequence
  Synthetic
ccctatagtacagaatcttcagggacaaatggtacatcagtctatatcacctagaactttaaatgcatgggtaaa

SEQ ID NO: 180846 - DNA, 75 bp, Artificial Sequence
  Synthetic
agttcaatggaacagggccatgcaagaatgtcagcacagtacaatgcacacatggaatcaagccagtagtatcaa

SEQ ID NO: 180847 - DNA, 75 bp, Artificial Sequence
  Synthetic
atcctcaggaggggatccagaaattacaacacacagttttaattgtggaggggaatttttctactgcaatacatc

SEQ ID NO: 180848 - DNA, 75 bp, Artificial Sequence
  Synthetic
gtgccgcccgaacagggacttaaaagcgaaattagacccagagaagctctctcgacgcaggactcggcttgctga

SEQ ID NO: 180849 - DNA, 75 bp, Artificial Sequence
  Synthetic
tacgtataggaccagggcaaacattctatgcaacaggtgacataataggggatataagacaagcacattgtaatg

SEQ ID NO: 180850 - DNA, 75 bp, Artificial Sequence
  Synthetic
ccatcccttcagacaggatcagaagaacttagatcattatataatacagtagcagtcctctattgtgtacatcaa

SEQ ID NO: 180851 - DNA, 75 bp, Artificial Sequence
  Synthetic
agcagtcctctattgtgtacatcaaaagatagaggtaaaagacaccaaggaagctttagacaaaatagaggaaga

SEQ ID NO: 180852 - DNA, 75 bp, Artificial Sequence
  Synthetic
actatggggtacctgtgtggaaagatgcagagaccaccttattttgtgcatcagatgctaaagcatatgagacag

SEQ ID NO: 180853 - DNA, 75 bp, Artificial Sequence
  Synthetic
catatggggccagggagaacatattatgcaacaggggccataataggaaatataagacaagcacattgcaacatt

SEQ ID NO: 180854 - DNA, 75 bp, Artificial Sequence
  Synthetic
gaaataaaaaattgctctttcaatatcaccacaagcataagagataaggtgcagaaagaatatgcacttttttat

SEQ ID NO: 180855 - DNA, 75 bp, Artificial Sequence
  Synthetic
gaactccatcctgacaaatggacagtacagcctatacagctgccagaaaaagatagctggactgtcaatgatata

SEQ ID NO: 180856 - DNA, 75 bp, Artificial Sequence
  Synthetic
gaaagggctttgctataaaatgggtggcaaatggtcaaaaagtagtatagttggatggcctgctataagggaaag

SEQ ID NO: 180857 - DNA, 75 bp, Artificial Sequence
  Synthetic
ggacagctaatagaagctctattagacacaggagcagatgatacagtattagaagaaataaatttaccaggaaaa

SEQ ID NO: 180858 - DNA, 75 bp, Artificial Sequence
  Synthetic
cctagcagaccaactaattcatctgtattattttgattgtttttcagactctgctataagaaatgccatattagg

SEQ ID NO: 180859 - DNA, 75 bp, Artificial Sequence
  Synthetic
ccagtcagacctcaggtacctttaagaccaatgacttacaaggcagctgtagatcttagccactttttaagaaaa

SEQ ID NO: 180860 - DNA, 75 bp, Artificial Sequence
  Synthetic
gtaggaaaagcaatgtatgcccctcccatcaaaggacaaattagatgttcatcaaatattacagggctgatatta

SEQ ID NO: 180861 - DNA, 75 bp, Artificial Sequence
  Synthetic
ataatatataacctaattgaagaatcacagaaccagcaggagaaaaatgaacaagaattattggcattggataag

SEQ ID NO: 180862 - DNA, 75 bp, Artificial Sequence
  Synthetic
tagaatataggaaaatattaagacaaagaaaaatagacaggttaattgatagaataagagaaagagcagaagaca

SEQ ID NO: 180863 - DNA, 75 bp, Artificial Sequence
  Synthetic
atttgcaccactgctgtgccttggaatactagttggagtaataaatctctgaatcagatttgggataacatgacc

SEQ ID NO: 180864 - DNA, 75 bp, Artificial Sequence
  Synthetic
ctttgatccttgggttggtgataatgtgtagtgcctcagacaacttgtgggttacagtttattatggggttcctg

SEQ ID NO: 180865 - DNA, 75 bp, Artificial Sequence
  Synthetic
ctatagcaatagcagtagctggctggacagatagggttatagaattaggacaaagactttgtagagctattctcc

SEQ ID NO: 180866 - DNA, 75 bp, Artificial Sequence
  Synthetic
tgtacacatggaattaggccagtagtatcaactcaactgctgttaaatggcagtctagcagaagaagaggtagta

SEQ ID NO: 180867 - DNA, 75 bp, Artificial Sequence
  Synthetic
ttagcaattatctgggtcgacctgcggagcctgtgcctcttcagctaccaccgcttgagagacttactcttgatt

SEQ ID NO: 180868 - DNA, 75 bp, Artificial Sequence
  Synthetic
tctataaaagatggataatcctgggattaaataaaatagtaagaatgtatagccctgtcagcattttggacataa

SEQ ID NO: 180869 - DNA, 75 bp, Artificial Sequence
  Synthetic
aacaataggaaatataacagatgaagtaagaaactgttcttttaatatgaccacagtagtaagagataggacgca

SEQ ID NO: 180870 - DNA, 75 bp, Artificial Sequence
  Synthetic
ggtggacagaatattggcaagccacctggattcctgattgggagtttgtcaatacccctcctctagtaaaattat

SEQ ID NO: 180871 - DNA, 75 bp, Artificial Sequence
  Synthetic
agccctgtcagcattttggacataagacaagggccaaaagaaccctttagagactatgtagataggttctttaaa

SEQ ID NO: 180872 - DNA, 75 bp, Artificial Sequence
  Synthetic
ggaccagggagagcattttatgcaacaggagacataataggagatataagacaagcatattgtaacattagtaga

SEQ ID NO: 180873 - DNA, 75 bp, Artificial Sequence
  Synthetic
tcagacctggaggaggaaatatgaaggacaattggagaaatgaattatataaatataaagtagtacaaattgaac

SEQ ID NO: 180874 - DNA, 75 bp, Artificial Sequence
  Synthetic
aatataggaaattggtaaaacaaagaaaaatagaccagttaattaaaagaattagggaaagagcagaagacagtg

SEQ ID NO: 180875 - DNA, 75 bp, Artificial Sequence
  Synthetic
gacatggtggatcagatgcatgaggatgtaatcagtttatgggatcaaagcctaaagccatgtgtaaagttgacc

SEQ ID NO: 180876 - DNA, 75 bp, Artificial Sequence
  Synthetic
aaaaattgctctttcaatacaaccacagaattaagagatagacggaagaaagagtatgcacttttttatagactt

SEQ ID NO: 180877 - DNA, 75 bp, Artificial Sequence
  Synthetic
accatagcaatagcagtagctgggtggacagatagggttatagaaataggacaaagattttgtagagctattcgt

SEQ ID NO: 180878 - DNA, 75 bp, Artificial Sequence
  Synthetic
gcacagtacaatgtacacatggaattaaaccagtggtatcaactcaactactgttaaatggtagcctagcagaaa

SEQ ID NO: 180879 - DNA, 75 bp, Artificial Sequence
  Synthetic
acacatggaattaagccagtggtatcaactcaactactgttaaatggtagtctagcagaaggagagataataatt

SEQ ID NO: 180880 - DNA, 75 bp, Artificial Sequence
  Synthetic
gtcacagtctattatggggtacctgtgtggaaagaagcaaaccctactctattttgtgcatcagatgctaaagca

SEQ ID NO: 180881 - DNA, 75 bp, Artificial Sequence
  Synthetic
gtataaggataggaccaggacaaacattctatgcaacaggagacataataggagacataagagaagcacattgta

SEQ ID NO: 180882 - DNA, 75 bp, Artificial Sequence
  Synthetic
ataccaccaccagtaccaacaacaccccggagaaacgagaactaaaaaactgctctttcaatgtcaccacaccca

SEQ ID NO: 180883 - DNA, 75 bp, Artificial Sequence
  Synthetic
gcaccaatagcactcaaagtaaccccctgaaggaagagctaggggaaataaaaaactgttctttcaagatgacca

SEQ ID NO: 180884 - DNA, 75 bp, Artificial Sequence
  Synthetic
gcaccaatagcactcaaagtatccccctgaaggaagagctaggggaaataaaaaactgttctttcaagatgacca

SEQ ID NO: 180885 - DNA, 75 bp, Artificial Sequence
  Synthetic
gcaccaatagcactcaaagtacccccctgaaggaagagctaggggaaataaaaaactgttctttcaagatgacca

SEQ ID NO: 180886 - DNA, 75 bp, Artificial Sequence
  Synthetic
gcaccaatagcactcaaagtagccccctgaaggaagagctaggggaaataaaaaactgttctttcaagatgacca

SEQ ID NO: 180887 - DNA, 75 bp, Artificial Sequence
  Synthetic
tagcaatagttgtgtggaccatagcatatatagaatataggaaattgttaagacaaagaaaaatagactggttag

SEQ ID NO: 180888 - DNA, 75 bp, Artificial Sequence
  Synthetic
ctggactgtcaatgacatacagaagttagtgggaaaactaaattgggcaagtcagatttatccagggattaaagt

SEQ ID NO: 180889 - DNA, 75 bp, Artificial Sequence
  Synthetic
gggtagttaccaaattaggaaaacaatttaaggaaataatttttaatcagttttaaggaggcggcttggagatta

SEQ ID NO: 180890 - DNA, 75 bp, Artificial Sequence
  Synthetic
gggtagttaccaaattaggaaaacaatttaaggaaataatttttaatcagtttttaggaggcggcttggagatta

SEQ ID NO: 180891 - DNA, 75 bp, Artificial Sequence
  Synthetic
gggtagttaccaaattaggaaaacaatttaaggaaataatttttaatcagttttcaggaggcggcttggagatta

SEQ ID NO: 180892 - DNA, 75 bp, Artificial Sequence
  Synthetic
gggtagttaccaaattaggaaaacaatttaaggaaataatttttaatcagttttgaggaggcggcttggagatta

SEQ ID NO: 180893 - DNA, 75 bp, Artificial Sequence
  Synthetic
aatacaagaaaaagtatacatttaggaccaggacaagcattttatgcaacaggagatataataggagacatcaga

SEQ ID NO: 180894 - DNA, 75 bp, Artificial Sequence
  Synthetic
aacacagctgaattttactgaggggagcgacacaatcacactcccatgcagaagaagacaaattgtaaataggtg

SEQ ID NO: 180895 - DNA, 75 bp, Artificial Sequence
  Synthetic
gtggcgcccgaacagggacttgaaaacgaaagtagaaccggaggctgaatctctcgacgcaggactcggctcgtt

SEQ ID NO: 180896 - DNA, 75 bp, Artificial Sequence
  Synthetic
ggtgcacacagcgagaggcgaggcggcggaagtgtgagtacgcaattttgactggcggtggccagaaagtaggag

SEQ ID NO: 180897 - DNA, 75 bp, Artificial Sequence
  Synthetic
acatttagtatgggcaagcagggagctggaaagattcgcttgtaacccaggtctcatggacacagcggacggctg

SEQ ID NO: 180898 - DNA, 75 bp, Artificial Sequence
  Synthetic
ctctttcaatgcaaccacagaaataaaagataagaaacagaaaatgtatgcacttttttatagacttgatatagt

SEQ ID NO: 180899 - DNA, 75 bp, Artificial Sequence
  Synthetic
gacaggctaattttttagggagaatttggccttccagcaaagggaggccaggaaattttcctcagagcagaccag

SEQ ID NO: 180900 - DNA, 75 bp, Artificial Sequence
  Synthetic
aactgcgctctttatataacgctctagcagttctttattgtgtccatagtaggatacagatacacaacacacagg

SEQ ID NO: 180901 - DNA, 75 bp, Artificial Sequence
  Synthetic
ttcttagcgcttgcctgggacgacctacggaacctgtgcctcttcctctaccgccgcttgagagacttcatatca

SEQ ID NO: 180902 - DNA, 75 bp, Artificial Sequence
  Synthetic
ggaggggacgtagaaattacaacacatagttttaattgtagaggagaatttttctattgtaatacatcagaactg

SEQ ID NO: 180903 - DNA, 75 bp, Artificial Sequence
  Synthetic
atcaagcaggacataacaaggtaggatccttacagtatttggcactagcagcattaatagcaccaaaaaagataa

SEQ ID NO: 180904 - DNA, 75 bp, Artificial Sequence
  Synthetic
ggtgaaagtgatagaggagaaggcctttagtccagaagtaataccaatgtttatggccttgtcagaaggggcaac

SEQ ID NO: 180905 - DNA, 75 bp, Artificial Sequence
  Synthetic
tttagtccagaagtaataccaatgtttatggccttgtcagaaggggcaacgccctcagatctaaatactatgtta

SEQ ID NO: 180906 - DNA, 75 bp, Artificial Sequence
  Synthetic
acttccatgtaggataaaacaaattgtgagaatgtggcagagagtgggacaagcaatgtatgcccctcccatcgc

SEQ ID NO: 180907 - DNA, 75 bp, Artificial Sequence
  Synthetic
aggacacatccagtccctgtgggaccactacccccagggcaactgagagaccctagaggaagtgatatagcagga

SEQ ID NO: 180908 - DNA, 75 bp, Artificial Sequence
  Synthetic
aaggatagaggtacgagacaccaaggaagccttagacaagatagaggaagaacaaaacaaatgtcagcaaaaaac

SEQ ID NO: 180909 - DNA, 75 bp, Artificial Sequence
  Synthetic
agatggatagtcctggggttaaacagaattgtgagaatgtatagtcctgtcagcattctagagatcaaacaagga

SEQ ID NO: 180910 - DNA, 75 bp, Artificial Sequence
  Synthetic
taagaatagtttttgctgtgctttctatagtaaatagagttaggaagggatactcacctttgtcattacagaccc

SEQ ID NO: 180911 - DNA, 75 bp, Artificial Sequence
  Synthetic
aagaattggatgacagaaacactcttagtacaaaatgcaaacccagattgtaaacagctcctaaaagcattaggg

SEQ ID NO: 180912 - DNA, 75 bp, Artificial Sequence
  Synthetic
tacctagaagaataagacagggctttgaaagggctttgctataaaatgggtggcaagtggtcaaaacgcagtatg

SEQ ID NO: 180913 - DNA, 75 bp, Artificial Sequence
  Synthetic
tgacggcctgccagggagtggggggaccagcacataaggcaagagtgctagcagaggctatgtcacaggtgcagc

SEQ ID NO: 180914 - DNA, 75 bp, Artificial Sequence
  Synthetic
tggcaagtggtcaaaacgcagtatgagggaatggcctactgtaagggacagaataagaagagagccagcagcgga

SEQ ID NO: 180915 - DNA, 75 bp, Artificial Sequence
  Synthetic
ctgtaaggcccctagaagaggaggctgttggaagtgtgggcaagaaggacatcaaatgaaagattgtaaaaatga

SEQ ID NO: 180916 - DNA, 75 bp, Artificial Sequence
  Synthetic
ggctttgctataaaatgggtggcaagtggtcaaaaagtagtatagttggatggcctgctataagggaaagaatga

SEQ ID NO: 180917 - DNA, 75 bp, Artificial Sequence
  Synthetic
aacaaggaaagagcccacagccccgccactagagagttatgggtttcaggaggagaagagcacacaggggaagga

SEQ ID NO: 180918 - DNA, 75 bp, Artificial Sequence
  Synthetic
gaagaatcgaagaaggaggtggagagcaagacaacgacagatccatacgattagtcagcggattcttgacacttg

SEQ ID NO: 180919 - DNA, 75 bp, Artificial Sequence
  Synthetic
gaagaatcgatgaaggaggtggagagcaagacaacgacagatccatacgattagtcagcggattcttgacacttg

SEQ ID NO: 180920 - DNA, 75 bp, Artificial Sequence
  Synthetic
gaagaatcgacgaaggaggtggagagcaagacaacgacagatccatacgattagtcagcggattcttgacacttg

SEQ ID NO: 180921 - DNA, 75 bp, Artificial Sequence
  Synthetic
gaagaatcgaggaaggaggtggagagcaagacaacgacagatccatacgattagtcagcggattcttgacacttg

SEQ ID NO: 180922 - DNA, 75 bp, Artificial Sequence
  Synthetic
agacagagacagatccattcgattagtgaacggattcttagcgcttgcctgggacgacctgcggagcctgtgcct

SEQ ID NO: 180923 - DNA, 75 bp, Artificial Sequence
  Synthetic
gggaaggtagaagaggaggaaaaaaggaaaaactgctctttcaatgtaagggataagagggagcaagtatatgca

SEQ ID NO: 180924 - DNA, 75 bp, Artificial Sequence
  Synthetic
caatacccctcccttagtaaaattatggtaccagttagagaaagaacccatagtaggagcagaaactttctatgt

SEQ ID NO: 180925 - DNA, 75 bp, Artificial Sequence
  Synthetic
actggacagatagagttatagaaatagtacaaagaggtggtagggctatacttcacatacctacaagaataagac

SEQ ID NO: 180926 - DNA, 75 bp, Artificial Sequence
  Synthetic
tccaataagtcctattgaaactgtaccagtaaaattaaaaccaggaatggatggcccaaaggtaaaacaatggcc

SEQ ID NO: 180927 - DNA, 75 bp, Artificial Sequence
  Synthetic
ttagagactatgttgaccagttcttttatacttttagagctgaacaagctacacaagatgtataacattggatga

SEQ ID NO: 180928 - DNA, 75 bp, Artificial Sequence
  Synthetic
tgtacaaggccctacaaatatacaaggcaaaggacatcgataggactaaggcaatcactctatacaataacagga

SEQ ID NO: 180929 - DNA, 75 bp, Artificial Sequence
  Synthetic
ttcttaacaaaacaacaataacttttaagccatcctcaggaggggacccagaaattacatcacacatgcttaatt

SEQ ID NO: 180930 - DNA, 75 bp, Artificial Sequence
  Synthetic
tggaccatagtactcatagaatataggaaaatattaaaacaaagaaaaatagataggttaattgatagaataaga

SEQ ID NO: 180931 - DNA, 75 bp, Artificial Sequence
  Synthetic
gaggaattggcaacacttattgagatggggaactatgatcttgggaatgataataatctgtagtgctgtagaaaa

SEQ ID NO: 180932 - DNA, 75 bp, Artificial Sequence
  Synthetic
tccagagataatcatttaccagtacatggatgacctctatgtgggatctgacttagaactagcacaacatagaga

SEQ ID NO: 180933 - DNA, 75 bp, Artificial Sequence
  Synthetic
gatttgcactcaaccctgaccttttagaaacagcagaaggttgtcaacaaataatgggacagttgcaaccatctc

SEQ ID NO: 180934 - DNA, 75 bp, Artificial Sequence
  Synthetic
atcattatttaatacagtagcaacactctattgtgtacatcaaaagatagaggtaaaagacaccaaagaagctct

SEQ ID NO: 180935 - DNA, 75 bp, Artificial Sequence
  Synthetic
atcaggacataacaaggtaggatccctacaatatttggcactgaaagcattaacaacaccaaaaaggataaagcc

SEQ ID NO: 180936 - DNA, 75 bp, Artificial Sequence
  Synthetic
tgtatggactgtcaatgatatacagaaattagtaggaaagttaaattgggcaagtcagatctatccaggaatcag

SEQ ID NO: 180937 - DNA, 75 bp, Artificial Sequence
  Synthetic
actctccaatgcagaataaagcaaattgtaaatatgtggcagaaagtaggacgagcaatgtatgcccctcccatc

SEQ ID NO: 180938 - DNA, 75 bp, Artificial Sequence
  Synthetic
agaggaaccaaagctttgacagaagtagtcaactttacagaagaagcagaattagaactagcagaaaacagggag

SEQ ID NO: 180939 - DNA, 75 bp, Artificial Sequence
  Synthetic
tgtcactgacaagagtggcaatgtcactgtcaatggcacggatgaaatgaaaaactgctctttcaacatgaccac

SEQ ID NO: 180940 - DNA, 75 bp, Artificial Sequence
  Synthetic
caaggtcagtggacatatcagatttatcaggagttacataaaaatttaaaaacaggaaagtatgcaaaaatgaga

SEQ ID NO: 180941 - DNA, 75 bp, Artificial Sequence
  Synthetic
actagtaatgtagaggaaggagaaatgaaaaactgctctttcaatgttaccaccaccataagagataagatgaag

SEQ ID NO: 180942 - DNA, 75 bp, Artificial Sequence
  Synthetic
atgacctggatggagtgggaaagagaaattgacaattacacaggcttaatatacagcttaattgaagaatcgcag

SEQ ID NO: 180943 - DNA, 75 bp, Artificial Sequence
  Synthetic
agggactgtaccctcccttagcttccctcaaatcactctttggcaacgacccttagtcacaataaaagtaggggg

SEQ ID NO: 180944 - DNA, 75 bp, Artificial Sequence
  Synthetic
acttggattcctgagtgggaatttgtcaacactcctccccttgtaaaattatggtatcagttagaaacagagcca

SEQ ID NO: 180945 - DNA, 75 bp, Artificial Sequence
  Synthetic
gggataacatgacctggctgcaatgggataaagaaattagcaattacacagacataatatataatctaattgaag

SEQ ID NO: 180946 - DNA, 75 bp, Artificial Sequence
  Synthetic
tgccaggaagatggacaccaaaattaatagggggaattgggggctttgtcagagtaagacagtatgaacaggtac

SEQ ID NO: 180947 - DNA, 75 bp, Artificial Sequence
  Synthetic
acatataggaccaggaaaagtattctatgcaagtgacataataggggatataagaaaagcacattgtattgtcaa

SEQ ID NO: 180948 - DNA, 75 bp, Artificial Sequence
  Synthetic
tgtacaagacccaacaacaatacaagaagaagtataagaataggaccagggagcgcattttatacaacaggagaa

SEQ ID NO: 180949 - DNA, 75 bp, Artificial Sequence
  Synthetic
gaagaagtataagaataggaccagggagcgcattttatacaacaggagaagtaataggaaatataagactagcat

SEQ ID NO: 180950 - DNA, 75 bp, Artificial Sequence
  Synthetic
cataaaaaaggaaagagtttatctctcttgggtacctgcacataaaggtattggaggaaatgagcaggtagacaa

SEQ ID NO: 180951 - DNA, 75 bp, Artificial Sequence
  Synthetic
aactctcccatgcaaaataaagcaaattataaatatgtggcagagagtaggacaagcaatatatgcccctcccat

SEQ ID NO: 180952 - DNA, 75 bp, Artificial Sequence
  Synthetic
agtgattttaacttaccccccatagtggcaaaagaaatagtagccagctgtgacaaatgccagctaaaaggggaa

SEQ ID NO: 180953 - DNA, 75 bp, Artificial Sequence
  Synthetic
tgtcaatgctaccaatgtcagtaacacaaccgaagccccaaacatagtaggaacagatgaagtaaagaactgttc

SEQ ID NO: 180954 - DNA, 75 bp, Artificial Sequence
  Synthetic
tcatactcccatccaggataaaacaaattattatcagctggcaggaagtaggaacagcaacgtatgcccctccca

SEQ ID NO: 180955 - DNA, 75 bp, Artificial Sequence
  Synthetic
cgtacccagaagaataagacagggcttggaaaggcttttgctataaaatgggtggcaaatggtcaaaaagtagtt

SEQ ID NO: 180956 - DNA, 75 bp, Artificial Sequence
  Synthetic
aataacaacatattggggtctacatacaggagaaagagactggcatttgggtcaaggagtctccatagaatggag

SEQ ID NO: 180957 - DNA, 75 bp, Artificial Sequence
  Synthetic
gctacttagaagcagaagttattcctgcagagacaggacaggaaacagcatattttattttaaagttagctggaa

SEQ ID NO: 180958 - DNA, 75 bp, Artificial Sequence
  Synthetic
ggaggaattggaggttttatcaaagtaagacagtatgatcaaatacctatagaaatttgtggaaaaagggctata

SEQ ID NO: 180959 - DNA, 75 bp, Artificial Sequence
  Synthetic
cagtcattaagcaggcttgtccaaaagtatcctttgatccaattcctatacattattgtactccagctggttatg

SEQ ID NO: 180960 - DNA, 75 bp, Artificial Sequence
  Synthetic
gggcaaatatcaaacaggaatttgggataccctacaatcctcaaagtcagggagcagtagagtccatgaataaag

SEQ ID NO: 180961 - DNA, 75 bp, Artificial Sequence
  Synthetic
tgggaaaaaattcggttacggccaggaggaaagaaaaaatatagactaaaacatatagtatgggcaagcagggag

SEQ ID NO: 180962 - DNA, 75 bp, Artificial Sequence
  Synthetic
tagtgggaaaattgaattgggcaagtcagatttacccagggattaaagtaaagcaattatgtaaactccttaggg

SEQ ID NO: 180963 - DNA, 75 bp, Artificial Sequence
  Synthetic
aaaaataattagggattatggaaaacagatggcaggtgatggttgtgtggcaagtggacaggatgaaaatcagga

SEQ ID NO: 180964 - DNA, 75 bp, Artificial Sequence
  Synthetic
agtatactgcattcactatacctagtacaaataatgagacaccagggattagatatcagtacaatgtgcttccac

SEQ ID NO: 180965 - DNA, 75 bp, Artificial Sequence
  Synthetic
ttggcatctaggacatggagtatccatagaatggagactaagaaaatacaagacacaagttgatcctgaaatggc

SEQ ID NO: 180966 - DNA, 75 bp, Artificial Sequence
  Synthetic
ccacttcccaagcccgaggggacccgacaggccaggaggaatcgaaggagaaggtggagaaggagacagagatgg

SEQ ID NO: 180967 - DNA, 75 bp, Artificial Sequence
  Synthetic
cctataatgaatgggcactagaattattagaagaattaaaaaatgaagctgtgcgccattttccaaggatttggc

SEQ ID NO: 180968 - DNA, 75 bp, Artificial Sequence
  Synthetic
aggatgaagattagaacatggaatagtttagtaatacatgatttgtatgtctaaacgagagctaatcgatggtct

SEQ ID NO: 180969 - DNA, 75 bp, Artificial Sequence
  Synthetic
ggggtagaggcaattatcaggatactacaacaattactgtttatccattataggattggctgccagcacagcaga

SEQ ID NO: 180970 - DNA, 75 bp, Artificial Sequence
  Synthetic
taaaattgcaggaaaaaataaaacacataagacagagaataagagaaagagaagaagatagtggcaatgaaagtg

SEQ ID NO: 180971 - DNA, 75 bp, Artificial Sequence
  Synthetic
gaagaagatagtggcaatgaaagtgatggggatgcagagtggttggatggggatgaagagtggttggttactctt

SEQ ID NO: 180972 - DNA, 75 bp, Artificial Sequence
  Synthetic
ttctgtgcttcagatgctaaagcccatagtacagaggctcacaacatctgggccacacaagcatgtgttcctact

SEQ ID NO: 180973 - DNA, 75 bp, Artificial Sequence
  Synthetic
ccttagttacagtaaaaatagggggacagctaatagaagccctattagacacaggagcagatgatacagtattag

SEQ ID NO: 180974 - DNA, 75 bp, Artificial Sequence
  Synthetic
cctcaggaggggacccagaaattgtaatgcacagttttaattgtggaggggaatttttctactgtaattcaacac

SEQ ID NO: 180975 - DNA, 75 bp, Artificial Sequence
  Synthetic
accagtgctgcagttaaggcagcctgttggtgggcaggcatccaacaggaatttggaattccctacaatccccaa

SEQ ID NO: 180976 - DNA, 75 bp, Artificial Sequence
  Synthetic
gacaacaagagaaccagacataggatacaaacaaatgaaaaattgctcattcaatgcaaccactgagctaacaga

SEQ ID NO: 180977 - DNA, 75 bp, Artificial Sequence
  Synthetic
gtgacacaagcttgtcctaagacttcctttgagccaattccaatacattactgtgcaccaccaggctttgccatt

SEQ ID NO: 180978 - DNA, 75 bp, Artificial Sequence
  Synthetic
ggcgcagcgtcaatgacgctgacggtacaggccagacaattattgtctggtatagtgcaacagcagaacaatttg

SEQ ID NO: 180979 - DNA, 75 bp, Artificial Sequence
  Synthetic
ctgtactattttgattgctttgcagactctgccataagaaatgcctcattaggacatatagttagccctaggtgt

SEQ ID NO: 180980 - DNA, 75 bp, Artificial Sequence
  Synthetic
tacaaggccaggaaataatacaggaggacaggtgcagataggacctgctatgacattttataacatagaaaaaat

SEQ ID NO: 180981 - DNA, 75 bp, Artificial Sequence
  Synthetic
caagccccagaagaccaagggccacagagggagccatatggagagtggacactagagcttctagaggagcttaag

SEQ ID NO: 180982 - DNA, 75 bp, Artificial Sequence
  Synthetic
attaagggtacctacaagatcgacaatgagacctccagtgggataaaaaattgctctttcaatgcaaccacatta

SEQ ID NO: 180983 - DNA, 75 bp, Artificial Sequence
  Synthetic
ggaaataaagaaaatcctggggaaaaacaacataaccttcagggctcgagagaggaatgaaggagacctagaagt

SEQ ID NO: 180984 - DNA, 75 bp, Artificial Sequence
  Synthetic
ttgttactactgctttgaaaaaaagggcttaggcatctcctatggcaggaagaagcggagacagcgacgaaaaac

SEQ ID NO: 180985 - DNA, 75 bp, Artificial Sequence
  Synthetic
ctgccttgtagaataagacagattgtaaatttgtggacaagggtaggaaaaggaatttatgcaccaccaattcgg

SEQ ID NO: 180986 - DNA, 75 bp, Artificial Sequence
  Synthetic
tgctatggcaggaagaagcggagacagcgacgacgacctcctcaagaccgtcagactcatcaagcgtctctacca

SEQ ID NO: 180987 - DNA, 75 bp, Artificial Sequence
  Synthetic
aggataggaccaggacaagtattctatgccacaggtaaaataataggagacataagagaagcacactgtaacatt

SEQ ID NO: 180988 - DNA, 75 bp, Artificial Sequence
  Synthetic
atagtatatccctcaggaggaaacatggttaatctctggagacaagagttgtataagtacaaagtagttagcata

SEQ ID NO: 180989 - DNA, 75 bp, Artificial Sequence
  Synthetic
gtataagtacaaagtagttagcatagaacccataggagtagcaccaggtaaagctaaaagacgcacagtgagtag

SEQ ID NO: 180990 - DNA, 75 bp, Artificial Sequence
  Synthetic
ggtgcgctgtttcttgggtttcttggagcagcagggagcactatgggcgcagcgtcaataacgctgacggtacag

SEQ ID NO: 180991 - DNA, 75 bp, Artificial Sequence
  Synthetic
ttgcaactctcaatctggggcattaaacagctccaggcaaaagtccttgctatagaaagataccttagggatcag

SEQ ID NO: 180992 - DNA, 75 bp, Artificial Sequence
  Synthetic
tataataagaatactgcaacaactactgtttattcatttcagaattgggtgccaacatagcagaataggcatttt

SEQ ID NO: 180993 - DNA, 75 bp, Artificial Sequence
  Synthetic
attatagattaggagtaggagcattgatagtagcactaatcatagcaataatagtgtggaccatagtatatatag

SEQ ID NO: 180994 - DNA, 75 bp, Artificial Sequence
  Synthetic
atgtatgcccctcccattgcaggaaacataacatgtaaatcaaatatcacaggactactattggtacgtgatgga

SEQ ID NO: 180995 - DNA, 75 bp, Artificial Sequence
  Synthetic
ggtgtcatttttggacttatagaacaggcacaagaacaacagaacacaaatgagaaatcactcttggaattggat

SEQ ID NO: 180996 - DNA, 75 bp, Artificial Sequence
  Synthetic
caaaattgacaataacatgcgagaacaaataaaaaactgctctttcaatgtcaccacaacaatgggaaataagaa

SEQ ID NO: 180997 - DNA, 75 bp, Artificial Sequence
  Synthetic
tatagaaaattgttaagacaaagaaaaatagactggttaattaaaagaattagggaaagagcagaagacagtggc

SEQ ID NO: 180998 - DNA, 75 bp, Artificial Sequence
  Synthetic
aatagtactactaatagtagtagctggggagaaatgaaaaactgctctttcaatgtcacctcaatcacaagagat

SEQ ID NO: 180999 - DNA, 75 bp, Artificial Sequence
  Synthetic
ggaattaggccagtagcatccactcaactgctgttaaatggcagtctagcagaaagtgaggtagtaattaggtat

SEQ ID NO: 181000 - DNA, 75 bp, Artificial Sequence
  Synthetic
caataatgctacccacaataatgctacccacaataatagtgaagagatgaaaaattgttctttcaatgcaaccac

SEQ ID NO: 181001 - DNA, 75 bp, Artificial Sequence
  Synthetic
gcacaaagaataggaaggggaatattacacatacctagaagaatcagacaaggcctagaaagagcactgatataa

SEQ ID NO: 181002 - DNA, 75 bp, Artificial Sequence
  Synthetic
tgcaacaggagacataataggagatataagacaagcacattgtaacattagtagaacagaatggaataacacttt

SEQ ID NO: 181003 - DNA, 75 bp, Artificial Sequence
  Synthetic
acctataataatacaagggaagaaataaaaaattgcactttcaatataaccacagaaataagaaataggaaaaag

SEQ ID NO: 181004 - DNA, 75 bp, Artificial Sequence
  Synthetic
agcctagtaggatggccagaaatcagagaaagaatgagaagacaaacgcaagaaccagcagtagagccagcagta

SEQ ID NO: 181005 - DNA, 75 bp, Artificial Sequence
  Synthetic
aagaagaagaggaagtaggctttccagtacgccctcaggtaccattaaggccaataacctataaacaggcttttg

SEQ ID NO: 181006 - DNA, 75 bp, Artificial Sequence
  Synthetic
aataagctttaacaaatcctcaggaggggacccagaaattgtaatgcacacttttaattgtggaggagaattttt

SEQ ID NO: 181007 - DNA, 75 bp, Artificial Sequence
  Synthetic
aagtcagggctttggagcagcttcgcaatagaatcgggggcaaggggtcaaaaagtagcatagtgggatggcctg

SEQ ID NO: 181008 - DNA, 75 bp, Artificial Sequence
  Synthetic
taaaaagtgttgctatcattgcccagtttgcttcttaaacaaaggcttaggcatctcctatggcaggaagaagcg

SEQ ID NO: 181009 - DNA, 75 bp, Artificial Sequence
  Synthetic
caatagaatcgggggcaaggggtcaaaaagtagcatagtgggatggcctgctataagagatagaataagacgaac

SEQ ID NO: 181010 - DNA, 75 bp, Artificial Sequence
  Synthetic
agttaaagcagcctgttggtgggcaggtatccaacaggaatttgggattccctacaatccccaaagtcaaggagt

SEQ ID NO: 181011 - DNA, 75 bp, Artificial Sequence
  Synthetic
ttagcaattacacaagcctaatatataacttaattacagaatcaacactccaacaagaaaagaatgaacaagaat

SEQ ID NO: 181012 - DNA, 75 bp, Artificial Sequence
  Synthetic
gaatgggacaggacgcatccaatccctgagggaccattacccccaggacaactgagagaacctagaggaagtgat

SEQ ID NO: 181013 - DNA, 75 bp, Artificial Sequence
  Synthetic
gaatgggacaggacgcatccaatccctgtgggaccattacccccaggacaactgagagaacctagaggaagtgat

SEQ ID NO: 181014 - DNA, 75 bp, Artificial Sequence
  Synthetic
gaatgggacaggacgcatccaatccctgcgggaccattacccccaggacaactgagagaacctagaggaagtgat

SEQ ID NO: 181015 - DNA, 75 bp, Artificial Sequence
  Synthetic
gaatgggacaggacgcatccaatccctgggggaccattacccccaggacaactgagagaacctagaggaagtgat

SEQ ID NO: 181016 - DNA, 75 bp, Artificial Sequence
  Synthetic
gaatgggacaggacgcatccattccctgagggaccattacccccaggacaactgagagaacctagaggaagtgat

SEQ ID NO: 181017 - DNA, 75 bp, Artificial Sequence
  Synthetic
gaatgggacaggacgcatccattccctgtgggaccattacccccaggacaactgagagaacctagaggaagtgat

SEQ ID NO: 181018 - DNA, 75 bp, Artificial Sequence
  Synthetic
gaatgggacaggacgcatccattccctgcgggaccattacccccaggacaactgagagaacctagaggaagtgat

SEQ ID NO: 181019 - DNA, 75 bp, Artificial Sequence
  Synthetic
gaatgggacaggacgcatccattccctgggggaccattacccccaggacaactgagagaacctagaggaagtgat

SEQ ID NO: 181020 - DNA, 75 bp, Artificial Sequence
  Synthetic
gaatgggacaggacgcatccactccctgagggaccattacccccaggacaactgagagaacctagaggaagtgat

SEQ ID NO: 181021 - DNA, 75 bp, Artificial Sequence
  Synthetic
gaatgggacaggacgcatccactccctgtgggaccattacccccaggacaactgagagaacctagaggaagtgat

SEQ ID NO: 181022 - DNA, 75 bp, Artificial Sequence
  Synthetic
gaatgggacaggacgcatccactccctgcgggaccattacccccaggacaactgagagaacctagaggaagtgat

SEQ ID NO: 181023 - DNA, 75 bp, Artificial Sequence
  Synthetic
gaatgggacaggacgcatccactccctgggggaccattacccccaggacaactgagagaacctagaggaagtgat

SEQ ID NO: 181024 - DNA, 75 bp, Artificial Sequence
  Synthetic
gaatgggacaggacgcatccagtccctgagggaccattacccccaggacaactgagagaacctagaggaagtgat

SEQ ID NO: 181025 - DNA, 75 bp, Artificial Sequence
  Synthetic
gaatgggacaggacgcatccagtccctgtgggaccattacccccaggacaactgagagaacctagaggaagtgat

SEQ ID NO: 181026 - DNA, 75 bp, Artificial Sequence
  Synthetic
gaatgggacaggacgcatccagtccctgcgggaccattacccccaggacaactgagagaacctagaggaagtgat

SEQ ID NO: 181027 - DNA, 75 bp, Artificial Sequence
  Synthetic
gaatgggacaggacgcatccagtccctgggggaccattacccccaggacaactgagagaacctagaggaagtgat

SEQ ID NO: 181028 - DNA, 75 bp, Artificial Sequence
  Synthetic
ttaataattacacagccacaatatatgatttgcttgaagaatcgtataaccagcaggaaaagaatgaaaaggacc

SEQ ID NO: 181029 - DNA, 75 bp, Artificial Sequence
  Synthetic
caaagcctaaaaccatgtgtaaaattaaccccactctgtgtcactttaaactgtagtgatgaattgaggaacaat

SEQ ID NO: 181030 - DNA, 75 bp, Artificial Sequence
  Synthetic
cataggattatagaattagcacaaagagtttttagagctatcctcaacatacctagaaggacaagacagggctta

SEQ ID NO: 181031 - DNA, 75 bp, Artificial Sequence
  Synthetic
cagtctcaagggactgagactggggtgggagggcctcaaatatctgtggaatcttctgttgtattggggtcagga

SEQ ID NO: 181032 - DNA, 75 bp, Artificial Sequence
  Synthetic
tttgatataatagcaatagcagtagctaactggacagatagagctatagaaatagtgcaaagaattggtagggct

SEQ ID NO: 181033 - DNA, 75 bp, Artificial Sequence
  Synthetic
tttgatataatagcaatagcagtagctaactggacagattgagctatagaaatagtgcaaagaattggtagggct

SEQ ID NO: 181034 - DNA, 75 bp, Artificial Sequence
  Synthetic
tttgatataatagcaatagcagtagctaactggacagatcgagctatagaaatagtgcaaagaattggtagggct

SEQ ID NO: 181035 - DNA, 75 bp, Artificial Sequence
  Synthetic
tttgatataatagcaatagcagtagctaactggacagatggagctatagaaatagtgcaaagaattggtagggct

SEQ ID NO: 181036 - DNA, 75 bp, Artificial Sequence
  Synthetic
gaagcggagacagcgacgaagaactcctcaaagcagtaaggatcatcaaaatcctgtaccaaagcagtaagtatt

SEQ ID NO: 181037 - DNA, 75 bp, Artificial Sequence
  Synthetic
gagaactctctatacccacccttaacttccctcagatcactctttggcaacgacctgtcatcacagtaaaaatag

SEQ ID NO: 181038 - DNA, 75 bp, Artificial Sequence
  Synthetic
aagacaaagaacacctataggactagggcaatcactctatactacaagatcaagatcaataataggacaagcaca

SEQ ID NO: 181039 - DNA, 75 bp, Artificial Sequence
  Synthetic
ctaggcctgaacctgaaccagcagcagagggagtaggagcagcatctcaggacttagataaacatggagcgctta

SEQ ID NO: 181040 - DNA, 75 bp, Artificial Sequence
  Synthetic
tgcaagaggaaataaaaaactgctctttcaatatgaccacagaactaagagataagaaacagaaagtgtctgcac

SEQ ID NO: 181041 - DNA, 75 bp, Artificial Sequence
  Synthetic
aaataatagcacaaacacaaacatcacactccaatgcagaataaaacaaattataaagatggtggcaggcaggaa

SEQ ID NO: 181042 - DNA, 75 bp, Artificial Sequence
  Synthetic
tcagtcaaaattaccctatagtacagaatcttcagggacaaatggtacaccaggctttatcacctagaactttaa

SEQ ID NO: 181043 - DNA, 75 bp, Artificial Sequence
  Synthetic
caatgccacgttcacaaatgccaatgtcacaaatgccaccgaagaaataaaaaactgctcttttagtatgaccac

SEQ ID NO: 181044 - DNA, 75 bp, Artificial Sequence
  Synthetic
ctttgctaactcctcaggaggggatatagaaattacaacacatagttttaattgtggaggagaatttttctattg

SEQ ID NO: 181045 - DNA, 75 bp, Artificial Sequence
  Synthetic
ttttagaaccatttagaaagaaacatccagagataatcatttatcagtacatggatgacctctatgtgggatctg

SEQ ID NO: 181046 - DNA, 75 bp, Artificial Sequence
  Synthetic
ctggaaaacacatttgcaccactaatgtgccctggaactctagttggagtaatagatctctaaatgagatttggc

SEQ ID NO: 181047 - DNA, 75 bp, Artificial Sequence
  Synthetic
cttttgaagtggggctttacgacccctgacaaaaaacatcaaaaggagccaccgttcctctggatgggatatgag

SEQ ID NO: 181048 - DNA, 75 bp, Artificial Sequence
  Synthetic
ggggcatcaagcagctatgcaaatgctaaaggatactatcaatgaggaagctgcagagtgggacaggatacatcc

SEQ ID NO: 181049 - DNA, 75 bp, Artificial Sequence
  Synthetic
caagaacaagtataccgatgggaccaggaaaagcattctacgcaataggcgacataataggggatataagacaag

SEQ ID NO: 181050 - DNA, 75 bp, Artificial Sequence
  Synthetic
tcgtttcagaccctcctcccagccccgaggggacccgacaggcccgaaggaacagaagaagaaggtggagagcga

SEQ ID NO: 181051 - DNA, 75 bp, Artificial Sequence
  Synthetic
ttgggttcggggaggagataaccccctctccgaagcagaagcaggagcagaagcaggaacagagagacgagggac

SEQ ID NO: 181052 - DNA, 75 bp, Artificial Sequence
  Synthetic
ctggaactctagttggagtaataaaacttataatgacatatgggataacatgacctggctgcaatgggataaaga

SEQ ID NO: 181053 - DNA, 75 bp, Artificial Sequence
  Synthetic
gccagaaattgcaaggcccctaggaaaaaaggctgttggaaatgtggaaaggaaggacaccaaatgaaagattgt

SEQ ID NO: 181054 - DNA, 75 bp, Artificial Sequence
  Synthetic
atggagaaaagtagtagatttcagagaacttaataagagaactcaagacttctgggaagttcaattaggaatacc

SEQ ID NO: 181055 - DNA, 75 bp, Artificial Sequence
  Synthetic
ctggggtcaggaactaaagaatagtgctattaatttgcttgatacaatagcattagcagtagctaattggacaga

SEQ ID NO: 181056 - DNA, 75 bp, Artificial Sequence
  Synthetic
caagtggtcaaaaagcagcatagtgggatggcctaaggttagggaaagaataagacagacccctccagcagcaac

SEQ ID NO: 181057 - DNA, 75 bp, Artificial Sequence
  Synthetic
ggatggcctaaggttagggaaagaataagacagacccctccagcagcaacaggagtaggagcagcatctcaagat

SEQ ID NO: 181058 - DNA, 75 bp, Artificial Sequence
  Synthetic
gtaataacaacatattggggtctgcaaacaggagaaagagaatggcatttgggtcatggagtctccatagaatgg

SEQ ID NO: 181059 - DNA, 75 bp, Artificial Sequence
  Synthetic
tcagtagtactaatggtagtaccgctaatgttactatgagagaagaaatgaaaaattgctcttttaatactacca

SEQ ID NO: 181060 - DNA, 75 bp, Artificial Sequence
  Synthetic
caggatcagaagaacttaaatcattatataatacaatagcaaccctttggtgcgtacatcaaaggatagacataa

SEQ ID NO: 181061 - DNA, 75 bp, Artificial Sequence
  Synthetic
agacacaagttgatcctgaaatggcagacaagctaatacatctttattattttaattgttttacagcctctgcca

SEQ ID NO: 181062 - DNA, 75 bp, Artificial Sequence
  Synthetic
agcagaattggaattggcagagaacagggagattctgaaagaacctgtacatggagtctattatgacccatcaaa

SEQ ID NO: 181063 - DNA, 75 bp, Artificial Sequence
  Synthetic
attatagattaggagtaggagcactgataatagcattaatcatagcaatagttgtgtggatcatagcatatctag

SEQ ID NO: 181064 - DNA, 75 bp, Artificial Sequence
  Synthetic
ggtgggagtaaagaagagaaagccacccttacctagtgtgactaagttaacagaagatagatggaacaagcacca

SEQ ID NO: 181065 - DNA, 75 bp, Artificial Sequence
  Synthetic
tagaggtaaaagacaccaaggaagctctagataaaatagaagaaatacaaaataagaacaagcaaaagacacagc

SEQ ID NO: 181066 - DNA, 75 bp, Artificial Sequence
  Synthetic
ggctgcactttaaattttccaattagtcctattgaaactgtaccagtaaaattaaagccaggaatggatggccca

SEQ ID NO: 181067 - DNA, 75 bp, Artificial Sequence
  Synthetic
tgtgggtcacagtctattatggggtgcctgtgtggagagaagcaaaaactactctattctgtgcatcagatgcta

SEQ ID NO: 181068 - DNA, 75 bp, Artificial Sequence
  Synthetic
aatgctaccagtaatggtaatgctactagtaatggggaagaaatacaacagtgttttttcaatgtaaccacagaa

SEQ ID NO: 181069 - DNA, 75 bp, Artificial Sequence
  Synthetic
aagaagcggagtcaacgacgaagaactcctaagagcagtaagaatcatcaagatcctataccagagcagtaagta

SEQ ID NO: 181070 - DNA, 75 bp, Artificial Sequence
  Synthetic
gtaaggatgtatagccctaccagcattctggacataaaacaaggaccaaaggaaccctttagagactatgtagac

SEQ ID NO: 181071 - DNA, 75 bp, Artificial Sequence
  Synthetic
tcactttaaagtgtacaaatgtaacagttaataatggtactacctgtgataataacacatgtgaagagataagaa

SEQ ID NO: 181072 - DNA, 75 bp, Artificial Sequence
  Synthetic
ccctttagaaaacaaaatccagaaatagttatctatcaatacatggatgatttgtatgtaggatctgacttagaa

SEQ ID NO: 181073 - DNA, 75 bp, Artificial Sequence
  Synthetic
aataagacaaagaataagagatagaacagaagatagtggcagtgagaatgatggggatgcagattggttggccat

SEQ ID NO: 181074 - DNA, 75 bp, Artificial Sequence
  Synthetic
ataaggataggaccaggacaaacattctatgcaacaggagaaataataggagacataagacaagcacattgtaac

SEQ ID NO: 181075 - DNA, 75 bp, Artificial Sequence
  Synthetic
catgacctggatgcagtgggaaagagaaattgacaattacacaggcttcatatacaccttaattgaagaatcgca

SEQ ID NO: 181076 - DNA, 75 bp, Artificial Sequence
  Synthetic
agcaagacacatgaaaaattgctcattcaatataaccactgaaatacatgacaaaaagaagcaagcttactctct

SEQ ID NO: 181077 - DNA, 75 bp, Artificial Sequence
  Synthetic
tcattgttactggtgcttcacaacaaaaggcttaggcatctcctatggcaggaagaagcggagacagcgacgaag

SEQ ID NO: 181078 - DNA, 75 bp, Artificial Sequence
  Synthetic
atgtgagtactgtacaatgcacacatggaataaagccagtgatatccactcagttaatcctaaatgggagcttag

SEQ ID NO: 181079 - DNA, 75 bp, Artificial Sequence
  Synthetic
aaagaatgagaagagctgagcctgagccagcagcagttggggtgggagcagtatctcgagacctagaaagacatg

SEQ ID NO: 181080 - DNA, 75 bp, Artificial Sequence
  Synthetic
agaaatagttagtcctaggtgtgaatatcaagcaggacatactaaggtaggatctctacaatatttggcactgaa

SEQ ID NO: 181081 - DNA, 75 bp, Artificial Sequence
  Synthetic
aaataaagagcctcctgggaaacaacataacattcaaggctcaggaaaagaatggaggagacccagaagtaacac

SEQ ID NO: 181082 - DNA, 75 bp, Artificial Sequence
  Synthetic
agcatatgacacagaggcacataatgtttgggccacacatgcctgtgtacccacagaccctaacccacaagaagt

SEQ ID NO: 181083 - DNA, 75 bp, Artificial Sequence
  Synthetic
gtaaaaagtgttgctatcattgctaccggtgctttataacaaaaggcttaggcatctcctatggcaggaagaagc

SEQ ID NO: 181084 - DNA, 75 bp, Artificial Sequence
  Synthetic
aatttgtggacaagagtaggaaaaggaatttatgcaccgccaattcggggaaatcttacctgtaactccactatt

SEQ ID NO: 181085 - DNA, 75 bp, Artificial Sequence
  Synthetic
gagcaagaaatggagccagtagatcctaacctagagccctggaaccatccaggaagtcagcctaaaactgcttgt

SEQ ID NO: 181086 - DNA, 75 bp, Artificial Sequence
  Synthetic
attactggaatcaataataatggttgggaaaacatgaagggagaaataaaaaactgctctttcaatgtcaccaca

SEQ ID NO: 181087 - DNA, 75 bp, Artificial Sequence
  Synthetic
attactggaatcaataatattggttgggaaaacatgaagggagaaataaaaaactgctctttcaatgtcaccaca

SEQ ID NO: 181088 - DNA, 75 bp, Artificial Sequence
  Synthetic
attactggaatcaataatactggttgggaaaacatgaagggagaaataaaaaactgctctttcaatgtcaccaca

SEQ ID NO: 181089 - DNA, 75 bp, Artificial Sequence
  Synthetic
attactggaatcaataatagtggttgggaaaacatgaagggagaaataaaaaactgctctttcaatgtcaccaca

SEQ ID NO: 181090 - DNA, 75 bp, Artificial Sequence
  Synthetic
gaagagtaagggatggacccggtagatcctaacctagagccctggaatcatccagggagtcagcctaaaactgct

SEQ ID NO: 181091 - DNA, 75 bp, Artificial Sequence
  Synthetic
agaccccatagtaggagcagagactttctatgtagatggggcagccagtagggagactaagctaggaaaagcagg

SEQ ID NO: 181092 - DNA, 75 bp, Artificial Sequence
  Synthetic
gaataatttttggtgtgctctctatagtaagaagagttaggcagggatactcacctttgtcgtttcagaccctta

SEQ ID NO: 181093 - DNA, 75 bp, Artificial Sequence
  Synthetic
gacgaggacctcctcagagcagtaaggatcatcaaaatcctgtaccaaagcagtaagtagtaataattagtatat

SEQ ID NO: 181094 - DNA, 75 bp, Artificial Sequence
  Synthetic
tctatggggctgctcaggaaaaactatatgctataccactgtgccttggaatgagacttggagcaataatacctc

SEQ ID NO: 181095 - DNA, 75 bp, Artificial Sequence
  Synthetic
tgtgcctggctgagagcgcaagaggaggaagaagaagtaggctttccagtcagacctcaggtgcctttaagacca

SEQ ID NO: 181096 - DNA, 75 bp, Artificial Sequence
  Synthetic
tggaggaaatgaacaagtagataaattagtcagtactggaatcaggaaagtactatttttagatggaatagataa

SEQ ID NO: 181097 - DNA, 75 bp, Artificial Sequence
  Synthetic
taacaccacggacagtctgaaggaaactccaggagcaatacaaaactgtactttcaatatgagcacagaaataag

SEQ ID NO: 181098 - DNA, 75 bp, Artificial Sequence
  Synthetic
aggagcagcgtctcaagacttagataaacatggggcacttacaagcagcaacacagcccacaataatgctgattg

SEQ ID NO: 181099 - DNA, 75 bp, Artificial Sequence
  Synthetic
aggcataagaatcataagtgtaataataactataatagcaagagttaggcagggatattctcccctctcgttgca

SEQ ID NO: 181100 - DNA, 75 bp, Artificial Sequence
  Synthetic
acagcacctgtaagggtaacacaagtgaaataaaaaattgctctttcgacacaacctcagaaatggaagataaga

SEQ ID NO: 181101 - DNA, 75 bp, Artificial Sequence
  Synthetic
cagaagaaggcgttggaggacaaggcagagacagatccgtgagattagtcagcggattcttgacacttgtctggg

SEQ ID NO: 181102 - DNA, 75 bp, Artificial Sequence
  Synthetic
tttcaatgcaaccacagaaataagagataagacaaagaaagagtatgcacttttttataaactagatatagtaca

SEQ ID NO: 181103 - DNA, 75 bp, Artificial Sequence
  Synthetic
ctactaataccactaatagtagcctagaaatgatggagaaaggagaaataaaaaactgctctttcaatatcacca

SEQ ID NO: 181104 - DNA, 75 bp, Artificial Sequence
  Synthetic
aacaaaacaaaagtcagcaaaaaacacagcaggcagcagcggctgacggaaaggtcagtcaaaattatcctatag

SEQ ID NO: 181105 - DNA, 75 bp, Artificial Sequence
  Synthetic
gaaaaatttggtcaaagagcagcatagtaggatggccagaaatcagagaaagaatgagaagacaacgacctcacg

SEQ ID NO: 181106 - DNA, 75 bp, Artificial Sequence
  Synthetic
tgtagcttgggtagaagcacaagaagaagaaggggaagtaggctttccagtacgccctcaggtaccattgaggcc

SEQ ID NO: 181107 - DNA, 75 bp, Artificial Sequence
  Synthetic
atggcgcccgaacagggacttgaaaacgaaagtagaaccggaggctgaatctctcgacgcaaggactcggctcgt

SEQ ID NO: 181108 - DNA, 75 bp, Artificial Sequence
  Synthetic
ttggcgcccgaacagggacttgaaaacgaaagtagaaccggaggctgaatctctcgacgcaaggactcggctcgt

SEQ ID NO: 181109 - DNA, 75 bp, Artificial Sequence
  Synthetic
ctggcgcccgaacagggacttgaaaacgaaagtagaaccggaggctgaatctctcgacgcaaggactcggctcgt

SEQ ID NO: 181110 - DNA, 75 bp, Artificial Sequence
  Synthetic
gtggcgcccgaacagggacttgaaaacgaaagtagaaccggaggctgaatctctcgacgcaaggactcggctcgt

SEQ ID NO: 181111 - DNA, 75 bp, Artificial Sequence
  Synthetic
tggcagaccaactaattcatctgcattattttgactgtttttcagaatctgccataaggaaagccatattaggac

SEQ ID NO: 181112 - DNA, 75 bp, Artificial Sequence
  Synthetic
aataagaattttgcaacaactactgtttgttcatttcagaattgggtgtcaacatagcagaataggcattattcg

SEQ ID NO: 181113 - DNA, 75 bp, Artificial Sequence
  Synthetic
acgccgacgaggaactcctcagagtcgtcaggatcatcaaaatcctgtaccaaagcagtgagtagtaataattag

SEQ ID NO: 181114 - DNA, 75 bp, Artificial Sequence
  Synthetic
gcaggaagaagcggagacagcgacgaagagctcctcaagacagtcagactcatcaagtttctctatcaaagcagt

SEQ ID NO: 181115 - DNA, 75 bp, Artificial Sequence
  Synthetic
tggcagttctttattgtgtccatagtaacataccggtacacaatacacaagaggctttagacaagataaaagaga

SEQ ID NO: 181116 - DNA, 75 bp, Artificial Sequence
  Synthetic
gatcaaagcctaaaaccatgtgtaaaattaaccccactctgtgtcactttaaactgcatagatgaagtgatggag

SEQ ID NO: 181117 - DNA, 75 bp, Artificial Sequence
  Synthetic
ggaattatcctctagtccagaatgctcaaggacaaatggtacatcagccgctgacacctagaactttaaatgctt

SEQ ID NO: 181118 - DNA, 75 bp, Artificial Sequence
  Synthetic
taagacagggcttcgaaagggctttgctataaaatgggtggcaagtggtcaaaaagtagtatagttggatggcct

SEQ ID NO: 181119 - DNA, 75 bp, Artificial Sequence
  Synthetic
atgcacttttttatagacttgatatagtacccatagacaatgataatagtaccaatagtaccaattatagattaa

SEQ ID NO: 181120 - DNA, 75 bp, Artificial Sequence
  Synthetic
acaggcttgtccaaaggtgtcctttgagccaattcccatacattattgtgccccagctggttttgcaattctaaa

SEQ ID NO: 181121 - DNA, 75 bp, Artificial Sequence
  Synthetic
tagtagtaatggtactactcctactactagtactagtagtggtaaagtgaaggaggaaggagaaatgaaaaactg

SEQ ID NO: 181122 - DNA, 75 bp, Artificial Sequence
  Synthetic
gtacagctcaatgagtctgtagcaattaactgtacaaggccctacagaaatataagacaaaggacatctatagga

SEQ ID NO: 181123 - DNA, 75 bp, Artificial Sequence
  Synthetic
gaaaagcataatgtctgggctacacatgcctgtgtacccacagaccccaacccacaagaaataaatttggaaaat

SEQ ID NO: 181124 - DNA, 75 bp, Artificial Sequence
  Synthetic
ctataaaattaggaaaccttcttaacaaaacaacaataatttttaaaccatcctcaggaggggacccagaaatta

SEQ ID NO: 181125 - DNA, 75 bp, Artificial Sequence
  Synthetic
gtagtaattagatctgaaaatttcacaaacaatgctaaaaccataatagtacagctgaacgcatctgtagaaatt

SEQ ID NO: 181126 - DNA, 75 bp, Artificial Sequence
  Synthetic
tcctcaggaggggacccagaaattacaacacacagttttaattgtggaggggaattcttctactgtaatacatca

SEQ ID NO: 181127 - DNA, 75 bp, Artificial Sequence
  Synthetic
caaacaatgctaaaaccataatagtacagctgaacgcatctgtagaaattaattgtacaaggcccaacaacaata

SEQ ID NO: 181128 - DNA, 75 bp, Artificial Sequence
  Synthetic
aagtggtcaaaaagtagtatagtgggatggcctaacataagggaaagaatgagacgagctgagccagcagcagaa

SEQ ID NO: 181129 - DNA, 75 bp, Artificial Sequence
  Synthetic
agtaccaatatcactgctgaagaaagagaagagataaaaaactgctcttacaatgtgaccacagaaataagggat

SEQ ID NO: 181130 - DNA, 75 bp, Artificial Sequence
  Synthetic
tggctggaagcacaagaagaggaaggagaagtaggctttccagtcagacctcaggtgcctttaagaccaatgact

SEQ ID NO: 181131 - DNA, 75 bp, Artificial Sequence
  Synthetic
aaatgacacaatcacactcccatgcagaataaaacaaattataaacatgtggcaggaagtaggaaaagcaatgta

SEQ ID NO: 181132 - DNA, 75 bp, Artificial Sequence
  Synthetic
caacagctcctaggaatttggggttgctctggaaaactcatttgcaccactactgtgccctggaactctagttgg

SEQ ID NO: 181133 - DNA, 75 bp, Artificial Sequence
  Synthetic
taggaacagaacaataagatttgctaactcctcaggaggggatttggaaatcacaacacatagttttaactgtag

SEQ ID NO: 181134 - DNA, 75 bp, Artificial Sequence
  Synthetic
ggcctgaaaatccatataacactccaatttttgctataaaaaagaaagatagcactaaatggagaaaattagtag

SEQ ID NO: 181135 - DNA, 75 bp, Artificial Sequence
  Synthetic
tttttgctgtgctttctttagtaaatagagttaggcagggatattcacctctgtcatttcagaccctcctcccag

SEQ ID NO: 181136 - DNA, 75 bp, Artificial Sequence
  Synthetic
agatgtaggagatgcttatttttcatgtcccttagataaagattttagaaagtatacagcttttaccatacctag

SEQ ID NO: 181137 - DNA, 75 bp, Artificial Sequence
  Synthetic
ctgggacgatctgaggaacctgtgcctcttcagctaccaccgcttgagagacttaatcttaattgcagcgaggat

SEQ ID NO: 181138 - DNA, 75 bp, Artificial Sequence
  Synthetic
ccactaggagtagcacccaccagggcaaggagaagagtggtgcagagagaaaaaagagcagttggaataggagct

SEQ ID NO: 181139 - DNA, 75 bp, Artificial Sequence
  Synthetic
ccgaggggacccgacaggccagaaggaatcgaaggagaaggtggagaaagagacagagatggatccggtcgatta

SEQ ID NO: 181140 - DNA, 75 bp, Artificial Sequence
  Synthetic
cagagggaaccatacaatgaatggacactagagcttctagaggaactcaagcaggaagctgtcagacactttcct

SEQ ID NO: 181141 - DNA, 75 bp, Artificial Sequence
  Synthetic
tattatgacccaggaaaagaattaatagcagaaattcaaaaacaaggacaaggtcagtggacatatcagatttat

SEQ ID NO: 181142 - DNA, 75 bp, Artificial Sequence
  Synthetic
attaaaagaacccctacatggagtctattatgacccaggaaaagaattaatagcagaaattcaaaaacaaggaca

SEQ ID NO: 181143 - DNA, 75 bp, Artificial Sequence
  Synthetic
gctagaagcacaagaagagagcgaggaggtgggctttccagtcagacctcaggtacctttaagaccaatgactta

SEQ ID NO: 181144 - DNA, 75 bp, Artificial Sequence
  Synthetic
ctcgagacctggaacaacgtggagcaatcacaactagtaatacagcaagtaacaatgctgcttgtgcctggctag

SEQ ID NO: 181145 - DNA, 75 bp, Artificial Sequence
  Synthetic
caacagaaagtatagtaatttggggaaagactcctaagtttaaattaccagtacaaaaggaagtgtgggagacat

SEQ ID NO: 181146 - DNA, 75 bp, Artificial Sequence
  Synthetic
acctatacagctgccagacaaagaaagctggactgtcaatgatatacaaaagttagtgggaaaactaaattgggc

SEQ ID NO: 181147 - DNA, 75 bp, Artificial Sequence
  Synthetic
tggaatagcttagtaaaacaccatatgtatgtgtcaaaaaaggcaaaagggtggtattatagacatcattatgaa

SEQ ID NO: 181148 - DNA, 75 bp, Artificial Sequence
  Synthetic
caggaggggatctagaaattacaacacatagctttaattgtagaggagagtttttctattgcaatacaacaaaac

SEQ ID NO: 181149 - DNA, 75 bp, Artificial Sequence
  Synthetic
accaaagcctaaaaccatgtgtaaagttgaccccactttgtgtcactttaaaatgtacaaatttaaatgttacta

SEQ ID NO: 181150 - DNA, 75 bp, Artificial Sequence
  Synthetic
agggattactccccaaaggagaaggaatggagccagtagatcctagattagagccctggaatcatccaggaagcc

SEQ ID NO: 181151 - DNA, 75 bp, Artificial Sequence
  Synthetic
aatggagccagtagatcctagattagagccctggaatcatccaggaagccaacccaagacagcttgcaataagtg

SEQ ID NO: 181152 - DNA, 75 bp, Artificial Sequence
  Synthetic
tgaaggacaattggagaagtgaattatataaatataaagtagtaaaaattgaaccattaggaatagcacccacca

SEQ ID NO: 181153 - DNA, 75 bp, Artificial Sequence
  Synthetic
taacaaaacaataatctttgctaactcctcaggaggggatatagaaattacaacacatagttttaattgtggagg

SEQ ID NO: 181154 - DNA, 75 bp, Artificial Sequence
  Synthetic
ctatataaagaatataagaaaataaaattgcaggaaaaaatagaacaaataagacagaaaataagagatagaaca

SEQ ID NO: 181155 - DNA, 75 bp, Artificial Sequence
  Synthetic
attgtgtgtacaagacccaacaataatacaagaaaaagtataaggataggaccaggacaaacattctatgcaaca

SEQ ID NO: 181156 - DNA, 75 bp, Artificial Sequence
  Synthetic
tatgcccctcccattgcaggaaacataacatgtaactcaagtatcacaggactactattgacacgtgatggagga

SEQ ID NO: 181157 - DNA, 75 bp, Artificial Sequence
  Synthetic
gcaagaggacattatcagtttatgggaacagagcttaaagccctgtgttaaattaaccccattatgtgtaactat

SEQ ID NO: 181158 - DNA, 75 bp, Artificial Sequence
  Synthetic
ggacagaggatctagaagacagacaaatgaaaaattgctcattcaatataaccactgagataagagatagaaaga

SEQ ID NO: 181159 - DNA, 75 bp, Artificial Sequence
  Synthetic
agtttatgggatcaaagcctaaagccatgtgtaaaattaaccccactctgtgttactttaaattgcactgattat

SEQ ID NO: 181160 - DNA, 75 bp, Artificial Sequence
  Synthetic
atactaacaccaatagtagtgactggggaagaatggagaaaggagaaatgaaaaattgctctttcaatatcacca

SEQ ID NO: 181161 - DNA, 75 bp, Artificial Sequence
  Synthetic
tccaagcagcgaggatcatcagaatcctctatcaaagcagtaagtacttaatagtaggtgtaatggtagatttca

SEQ ID NO: 181162 - DNA, 75 bp, Artificial Sequence
  Synthetic
ctacaatgaatggacattagaactgttagaagagcttaaaaatgaagctgttagacattttcctaggccctggct

SEQ ID NO: 181163 - DNA, 75 bp, Artificial Sequence
  Synthetic
tagatcagacaatttctcggacaatgctaaagtcataatagtacatctgaatgaatctgtagaaattaattgtac

SEQ ID NO: 181164 - DNA, 75 bp, Artificial Sequence
  Synthetic
atgtacacatggaattaggccagtagtatcaactcagctgctgttaaatggcagtctagcagaagaagaggtaat

SEQ ID NO: 181165 - DNA, 75 bp, Artificial Sequence
  Synthetic
aaagactcctgggaaacaacacaactttcaaagctcaggataaaaatggaggagacctagaagtaacacacttaa

SEQ ID NO: 181166 - DNA, 75 bp, Artificial Sequence
  Synthetic
acaactaatgaaatgaagaattgctctttcaatgtaaccacagaagtaagagataaggaaaaggaacaatatgca

SEQ ID NO: 181167 - DNA, 75 bp, Artificial Sequence
  Synthetic
gtaaagtgaacaatgccactaatagtaatgggacagtggtaggggaaacagaagtaaaaaactgcaccttcaatg

SEQ ID NO: 181168 - DNA, 75 bp, Artificial Sequence
  Synthetic
gattatggaaaacagatggcaggtgttgtttgtgtggcaagtatacaggatggggattaacacatggaaaagcct

SEQ ID NO: 181169 - DNA, 75 bp, Artificial Sequence
  Synthetic
caccctgctgaaggaagagacaggggcaatacaaaactgttctttcaatatgaccacagaaataagagacaagca

SEQ ID NO: 181170 - DNA, 75 bp, Artificial Sequence
  Synthetic
accactgtgccttggaatgatacatggagcagtaatacctcctatgatacaatctggagtaatctcacctggcaa

SEQ ID NO: 181171 - DNA, 75 bp, Artificial Sequence
  Synthetic
accactgtgccttggaatgatacatggagcagtaatacctcctatgatacaatctggtgtaatctcacctggcaa

SEQ ID NO: 181172 - DNA, 75 bp, Artificial Sequence
  Synthetic
accactgtgccttggaatgatacatggagcagtaatacctcctatgatacaatctggcgtaatctcacctggcaa

SEQ ID NO: 181173 - DNA, 75 bp, Artificial Sequence
  Synthetic
accactgtgccttggaatgatacatggagcagtaatacctcctatgatacaatctggggtaatctcacctggcaa

SEQ ID NO: 181174 - DNA, 75 bp, Artificial Sequence
  Synthetic
accactgtgccttggaatgatacttggagcagtaatacctcctatgatacaatctggagtaatctcacctggcaa

SEQ ID NO: 181175 - DNA, 75 bp, Artificial Sequence
  Synthetic
accactgtgccttggaatgatacttggagcagtaatacctcctatgatacaatctggtgtaatctcacctggcaa

SEQ ID NO: 181176 - DNA, 75 bp, Artificial Sequence
  Synthetic
accactgtgccttggaatgatacttggagcagtaatacctcctatgatacaatctggcgtaatctcacctggcaa

SEQ ID NO: 181177 - DNA, 75 bp, Artificial Sequence
  Synthetic
accactgtgccttggaatgatacttggagcagtaatacctcctatgatacaatctggggtaatctcacctggcaa

SEQ ID NO: 181178 - DNA, 75 bp, Artificial Sequence
  Synthetic
accactgtgccttggaatgatacctggagcagtaatacctcctatgatacaatctggagtaatctcacctggcaa

SEQ ID NO: 181179 - DNA, 75 bp, Artificial Sequence
  Synthetic
accactgtgccttggaatgatacctggagcagtaatacctcctatgatacaatctggtgtaatctcacctggcaa

SEQ ID NO: 181180 - DNA, 75 bp, Artificial Sequence
  Synthetic
accactgtgccttggaatgatacctggagcagtaatacctcctatgatacaatctggcgtaatctcacctggcaa

SEQ ID NO: 181181 - DNA, 75 bp, Artificial Sequence
  Synthetic
accactgtgccttggaatgatacctggagcagtaatacctcctatgatacaatctggggtaatctcacctggcaa

SEQ ID NO: 181182 - DNA, 75 bp, Artificial Sequence
  Synthetic
accactgtgccttggaatgatacgtggagcagtaatacctcctatgatacaatctggagtaatctcacctggcaa

SEQ ID NO: 181183 - DNA, 75 bp, Artificial Sequence
  Synthetic
accactgtgccttggaatgatacgtggagcagtaatacctcctatgatacaatctggtgtaatctcacctggcaa

SEQ ID NO: 181184 - DNA, 75 bp, Artificial Sequence
  Synthetic
accactgtgccttggaatgatacgtggagcagtaatacctcctatgatacaatctggcgtaatctcacctggcaa

SEQ ID NO: 181185 - DNA, 75 bp, Artificial Sequence
  Synthetic
accactgtgccttggaatgatacgtggagcagtaatacctcctatgatacaatctggggtaatctcacctggcaa

SEQ ID NO: 181186 - DNA, 75 bp, Artificial Sequence
  Synthetic
taatactgatgttaataagactaatactaataatgatataataggagggatggagagaggagaaataaaaaactg

SEQ ID NO: 181187 - DNA, 75 bp, Artificial Sequence
  Synthetic
tggatcaatgggcaagtctgtggaactggtttgatattacaaaatggctgtggtacataaaaatagctataatgg

SEQ ID NO: 181188 - DNA, 75 bp, Artificial Sequence
  Synthetic
ctaattcatatatattattttgattgtttttcagactctgctataagaaaagccatattaggacatatagttaga

SEQ ID NO: 181189 - DNA, 75 bp, Artificial Sequence
  Synthetic
aggccagaagaaacagaagaaggcgttggagggcaagacagaggcagatccgtgcgattagtgagcggattcttg

SEQ ID NO: 181190 - DNA, 75 bp, Artificial Sequence
  Synthetic
agcacagtacaatgcacacatggaattaggccagtagtatcaactcaactgctgttaaatggcagtctagcagaa

SEQ ID NO: 181191 - DNA, 75 bp, Artificial Sequence
  Synthetic
aagggccacagaggaagccacacaacgaatggacattagaacttttggaagagcttcagaaggaagctgttacac

SEQ ID NO: 181192 - DNA, 75 bp, Artificial Sequence
  Synthetic
agagtctcagcaggggactgcaactactgaatgaactcagaatacgcttgtggggaataatagcatattggggaa

SEQ ID NO: 181193 - DNA, 75 bp, Artificial Sequence
  Synthetic
actgaatgaactcagaatacgcttgtggggaataatagcatattggggaaaagagttaaaagatagtgctatcag

SEQ ID NO: 181194 - DNA, 75 bp, Artificial Sequence
  Synthetic
gggaccaggaagagtattgtatacaacaggaaaaataataggagatataagaaaagcacattgtaacattagcaa

SEQ ID NO: 181195 - DNA, 75 bp, Artificial Sequence
  Synthetic
gggaccaggaagagtattgtatacaacaggaaaaataataggagatttaagaaaagcacattgtaacattagcaa

SEQ ID NO: 181196 - DNA, 75 bp, Artificial Sequence
  Synthetic
gggaccaggaagagtattgtatacaacaggaaaaataataggagatctaagaaaagcacattgtaacattagcaa

SEQ ID NO: 181197 - DNA, 75 bp, Artificial Sequence
  Synthetic
gggaccaggaagagtattgtatacaacaggaaaaataataggagatgtaagaaaagcacattgtaacattagcaa

SEQ ID NO: 181198 - DNA, 75 bp, Artificial Sequence
  Synthetic
gggaccaggaagagtattgtatacaacaggataaataataggagatataagaaaagcacattgtaacattagcaa

SEQ ID NO: 181199 - DNA, 75 bp, Artificial Sequence
  Synthetic
gggaccaggaagagtattgtatacaacaggataaataataggagatttaagaaaagcacattgtaacattagcaa

SEQ ID NO: 181200 - DNA, 75 bp, Artificial Sequence
  Synthetic
gggaccaggaagagtattgtatacaacaggataaataataggagatctaagaaaagcacattgtaacattagcaa

SEQ ID NO: 181201 - DNA, 75 bp, Artificial Sequence
  Synthetic
gggaccaggaagagtattgtatacaacaggataaataataggagatgtaagaaaagcacattgtaacattagcaa

SEQ ID NO: 181202 - DNA, 75 bp, Artificial Sequence
  Synthetic
gggaccaggaagagtattgtatacaacaggacaaataataggagatataagaaaagcacattgtaacattagcaa

SEQ ID NO: 181203 - DNA, 75 bp, Artificial Sequence
  Synthetic
gggaccaggaagagtattgtatacaacaggacaaataataggagatttaagaaaagcacattgtaacattagcaa

SEQ ID NO: 181204 - DNA, 75 bp, Artificial Sequence
  Synthetic
gggaccaggaagagtattgtatacaacaggacaaataataggagatctaagaaaagcacattgtaacattagcaa

SEQ ID NO: 181205 - DNA, 75 bp, Artificial Sequence
  Synthetic
gggaccaggaagagtattgtatacaacaggacaaataataggagatgtaagaaaagcacattgtaacattagcaa

SEQ ID NO: 181206 - DNA, 75 bp, Artificial Sequence
  Synthetic
gggaccaggaagagtattgtatacaacaggagaaataataggagatataagaaaagcacattgtaacattagcaa

SEQ ID NO: 181207 - DNA, 75 bp, Artificial Sequence
  Synthetic
gggaccaggaagagtattgtatacaacaggagaaataataggagatttaagaaaagcacattgtaacattagcaa

SEQ ID NO: 181208 - DNA, 75 bp, Artificial Sequence
  Synthetic
gggaccaggaagagtattgtatacaacaggagaaataataggagatctaagaaaagcacattgtaacattagcaa

SEQ ID NO: 181209 - DNA, 75 bp, Artificial Sequence
  Synthetic
gggaccaggaagagtattgtatacaacaggagaaataataggagatgtaagaaaagcacattgtaacattagcaa

SEQ ID NO: 181210 - DNA, 75 bp, Artificial Sequence
  Synthetic
gtagcagagggaacagataggtttatagaattagcacaaagaataggaaggggaatattacacatacctagaaga

SEQ ID NO: 181211 - DNA, 75 bp, Artificial Sequence
  Synthetic
ggaggaaatatgaaggacaattggagaagtgaattatataaatataaagtagtaaaaattgagccattaggaata

SEQ ID NO: 181212 - DNA, 75 bp, Artificial Sequence
  Synthetic
agtaaaaattgagccattaggaatagcacccaccaaggcaaggagaagagtggtgcagagagaaaaaagagcagt

SEQ ID NO: 181213 - DNA, 75 bp, Artificial Sequence
  Synthetic
cacactcccatgcagaataaaacaagttataaacctgtggcaggaagtaggaaaagcaatgtatgcccctcccat

SEQ ID NO: 181214 - DNA, 75 bp, Artificial Sequence
  Synthetic
cctcaagtaccgctgaggccaatgacctataaagcggcttttgatctttccttctttttaaaagaaaagggggga

SEQ ID NO: 181215 - DNA, 75 bp, Artificial Sequence
  Synthetic
attgatagaataagagaaagagcagaagacagtggcaatgagagcgagggggatagagaggaattgtcaaaactt

SEQ ID NO: 181216 - DNA, 75 bp, Artificial Sequence
  Synthetic
gtggcgcccgaacagggacttgaaaacgaaagtagaaccggaggctgaaatctctcgacgcaggactcggctcgt

SEQ ID NO: 181217 - DNA, 75 bp, Artificial Sequence
  Synthetic
tgtaaccagttactaaaccaattagaaccagctctcaatacagggtcagaaggactgcgctccttatataaaacc

SEQ ID NO: 181218 - DNA, 75 bp, Artificial Sequence
  Synthetic
tgtaaccagttactaaaccaattagaaccagctctcaatacagggtcagaaggactgcgctccttatataatacc

SEQ ID NO: 181219 - DNA, 75 bp, Artificial Sequence
  Synthetic
tgtaaccagttactaaaccaattagaaccagctctcaatacagggtcagaaggactgcgctccttatataacacc

SEQ ID NO: 181220 - DNA, 75 bp, Artificial Sequence
  Synthetic
tgtaaccagttactaaaccaattagaaccagctctcaatacagggtcagaaggactgcgctccttatataagacc

SEQ ID NO: 181221 - DNA, 75 bp, Artificial Sequence
  Synthetic
agctaatggatggttttacagacatcattatgaaagcagacatccaaaagtaagttcagaagtacacatcccatt

SEQ ID NO: 181222 - DNA, 75 bp, Artificial Sequence
  Synthetic
tgggagcaacgccctatgggagccaacaaaggaggtgaaaaactgctctttcaatgtaactacagtagtaagaga

SEQ ID NO: 181223 - DNA, 75 bp, Artificial Sequence
  Synthetic
agtattaataattagtatatgtaatgactcctttggaaatctgggcaataacaggactggtagtggtgctaataa

SEQ ID NO: 181224 - DNA, 75 bp, Artificial Sequence
  Synthetic
aaaaaggaacagcacaagtctgaggcaaaaaatccagaagcaggggcagcggcagcagctgataacaatatcagt

SEQ ID NO: 181225 - DNA, 75 bp, Artificial Sequence
  Synthetic
tcttgtgcagtattggggttcagagctaaaaaagagtgctattaatctgcttgataccatagcaatagcagtagc

SEQ ID NO: 181226 - DNA, 75 bp, Artificial Sequence
  Synthetic
ctaaaaaagagtgctattaatctgcttgataccatagcaatagcagtagctgaaggaacagataggcttatagaa

SEQ ID NO: 181227 - DNA, 75 bp, Artificial Sequence
  Synthetic
gtcaccggcaatatttcaggcaagcatgacaaaaatcttagagccctttagaacaaaaaatccagagatagtgat

SEQ ID NO: 181228 - DNA, 75 bp, Artificial Sequence
  Synthetic
tctgaaaatctcacaaacaatgctaaaaacattatactacagtttaatgcatctgttaaaattaattgtacaagg

SEQ ID NO: 181229 - DNA, 75 bp, Artificial Sequence
  Synthetic
tagagctattctcaacatacctagaagaataagacagggcttggaaagggctttgctataagatgggtggcaagt

SEQ ID NO: 181230 - DNA, 75 bp, Artificial Sequence
  Synthetic
agacaaggaactgtatccttcagcttccctcaaatcactctttggcaacgaccccttgttacaataaagataggg

SEQ ID NO: 181231 - DNA, 75 bp, Artificial Sequence
  Synthetic
ttagtggagaaaaatggaataaaactttacaacaggcagctatacaattgggaaaccttcttaacaaaacaacaa

SEQ ID NO: 181232 - DNA, 75 bp, Artificial Sequence
  Synthetic
ttagtgagcggattcttagcacttgcctgggacgatctacggagcctgtgcctcttcagctaccaccgcttgaga

SEQ ID NO: 181233 - DNA, 75 bp, Artificial Sequence
  Synthetic
taataatgccactgccaccaatattaccaggattgacaaggacatggaaggagaaataaagaactgctctttcaa

SEQ ID NO: 181234 - DNA, 75 bp, Artificial Sequence
  Synthetic
gatgacggcctgccaaggagtggggggaccagggcataaggcaagagtgctagcagaggctatggcacaggcaca

SEQ ID NO: 181235 - DNA, 75 bp, Artificial Sequence
  Synthetic
caaatcagacagtcacactcccatgcagaatacgacaaattatatacatgtggcagaaagttggaaaagcaatgt

SEQ ID NO: 181236 - DNA, 75 bp, Artificial Sequence
  Synthetic
ggtggacagatagggttatagaagtagcacaaggagcttggagagccattctccacatacctagaagaatcagac

SEQ ID NO: 181237 - DNA, 75 bp, Artificial Sequence
  Synthetic
agcgcgcacggcaagaggcgaggggcggcgactggtgagtacgccaaaaattttttgactagcggaggctagaag

SEQ ID NO: 181238 - DNA, 75 bp, Artificial Sequence
  Synthetic
ctccacatacctagaagaatcagacagggcttcgaaagggctttgctataacatgggaggcaagtggtcaaaaag

SEQ ID NO: 181239 - DNA, 75 bp, Artificial Sequence
  Synthetic
cggcgactggtgagtacgccaaaaattttttgactagcggaggctagaaggagagagatgggtgcgagagcgtca

SEQ ID NO: 181240 - DNA, 75 bp, Artificial Sequence
  Synthetic
aaagcatatgagacagaagtgcataatgtctgggctacacatgcctgtgtacccacagaccccaacccacaagaa

SEQ ID NO: 181241 - DNA, 75 bp, Artificial Sequence
  Synthetic
aattgtaccagacctggcaacaatacaagaaaaagtgtacatataggaccaggacaagctttctatgcaacaggt

SEQ ID NO: 181242 - DNA, 75 bp, Artificial Sequence
  Synthetic
atggaaaccaaaaatgataggaggaattggaggatttatcaaagtaagacaatatgataatataacaatagacat

SEQ ID NO: 181243 - DNA, 75 bp, Artificial Sequence
  Synthetic
acgttttagaatattttttgctgtgctttctgtattatacagagttaggcagggatactcacctctgtcgggtgg

SEQ ID NO: 181244 - DNA, 75 bp, Artificial Sequence
  Synthetic
atgtggaaaaataacatggtagaacagatgcatgaggatataatcagtttatgggatcaaagcctaaagccatgt

SEQ ID NO: 181245 - DNA, 75 bp, Artificial Sequence
  Synthetic
cagcagccaggtcagccaaaattatcctatagtgcagaacctacaggggcaaatggtacatcaggccatatcacc

SEQ ID NO: 181246 - DNA, 75 bp, Artificial Sequence
  Synthetic
gtagatcctagcctagagccctggaaccacccgggaagtcagcctacaactgcttgtagcaagtgttactgtaaa

SEQ ID NO: 181247 - DNA, 75 bp, Artificial Sequence
  Synthetic
agagaaagaataagacaaaccccttcagcagcagatggagtaggagcagtatctcaagatttagataaatatgga

SEQ ID NO: 181248 - DNA, 75 bp, Artificial Sequence
  Synthetic
aaattgggaaaagcaggttttgtgacagatagaggaagacagaaagtggtctctcttgaaaacaccaccaatcaa

SEQ ID NO: 181249 - DNA, 75 bp, Artificial Sequence
  Synthetic
ccatacccagtataaacaatgagacaccagggattagatatcagtacaatgtgcttccacagggatggaaaggat

SEQ ID NO: 181250 - DNA, 75 bp, Artificial Sequence
  Synthetic
aggggactacagagggggtgggaagcccttaaatatctgggaagtcttgtgcagtattggggtctggagctaaaa

SEQ ID NO: 181251 - DNA, 75 bp, Artificial Sequence
  Synthetic
tatgctatgggaataattcactcacaaccagataagagtgaatcagaattggtgagccaaataatagaagaactc

SEQ ID NO: 181252 - DNA, 75 bp, Artificial Sequence
  Synthetic
acgagctgagccagcagcagatggggtgggagcagtatctcgagacctggaaaaacatggagcaatcacaagtag

SEQ ID NO: 181253 - DNA, 75 bp, Artificial Sequence
  Synthetic
ataataatagtagtggaaacatcacactcccatgcaagataaagcaatttataaacatgtggcaacaagtgggac

SEQ ID NO: 181254 - DNA, 75 bp, Artificial Sequence
  Synthetic
ttaagtgtttcaactgtggcaaagaagggcacatagcaaaaaattgcagggcccctaggaaaaagggctgttgga

SEQ ID NO: 181255 - DNA, 75 bp, Artificial Sequence
  Synthetic
gattgtcataatttcaacaacagctacagcaacagtagcaacctaactagtgacatgaatggggaaataaaaaac

SEQ ID NO: 181256 - DNA, 75 bp, Artificial Sequence
  Synthetic
ggagcagaaactttctatgtagatggggcagctaatagggaaactaaattaggaaaagcaggatatgttactgac

SEQ ID NO: 181257 - DNA, 75 bp, Artificial Sequence
  Synthetic
attcagacctacaggaggaaatatgaaggacaattggagaaatgaattatataaatataaagtagtagaaattaa

SEQ ID NO: 181258 - DNA, 75 bp, Artificial Sequence
  Synthetic
atattaccactaatgttaccaatgatgttaataataccatgacgggagaaataaaaaattgctctttcaatgcaa

SEQ ID NO: 181259 - DNA, 75 bp, Artificial Sequence
  Synthetic
ccattgatagtactaccagtaataataataatgatactgctgacaccctccaggacgaaataagaaactgctctt

SEQ ID NO: 181260 - DNA, 75 bp, Artificial Sequence
  Synthetic
acctgtagtagcaaaagaaatagtagctagctgtgataagtgtcagctaaaaggggaagccatgcatggacaagt

SEQ ID NO: 181261 - DNA, 75 bp, Artificial Sequence
  Synthetic
aaactgtatatatgctgtcattgggattctcagcgctcggggtggcaattataatagcagtcataatctgggtat

SEQ ID NO: 181262 - DNA, 75 bp, Artificial Sequence
  Synthetic
tataataaatagagttaggcagggatactcacctttgtcgttccagacccttacccaccaccagagggaacccga

SEQ ID NO: 181263 - DNA, 75 bp, Artificial Sequence
  Synthetic
agaaagtatactgcattcaccatacctagtacaaacaatgagacaccaggaatcaggtatcagtacaatgtgctt

SEQ ID NO: 181264 - DNA, 75 bp, Artificial Sequence
  Synthetic
tggggatgcagagtggttggccattcttctgtctcctgataagctcgataattgggtctgaacaacattgggtaa

SEQ ID NO: 181265 - DNA, 75 bp, Artificial Sequence
  Synthetic
cagaagtacacatcccattaggagatgctacactagtagtaagaacatattggggtctgcatacaggagaaaaag

SEQ ID NO: 181266 - DNA, 75 bp, Artificial Sequence
  Synthetic
aaaagcaggatatgttactgacagaggaagacagaaagttgtccctttaactgacacaacaaatcagaagactga

SEQ ID NO: 181267 - DNA, 75 bp, Artificial Sequence
  Synthetic
attagatataggatacaaacaaatgaaaaattgttcattcaatgtaaccactgagagaaaagataaaaagaagct

SEQ ID NO: 181268 - DNA, 75 bp, Artificial Sequence
  Synthetic
aggctacttgaagaatcacaaagccagcaggagaaaaatgaaaaagatttattagcattggaccagtggaacaat

SEQ ID NO: 181269 - DNA, 75 bp, Artificial Sequence
  Synthetic
aatcagacagggcttcgaaagggctttgctataacatgggtggcaagtggtcaaaaagcagcatagtgggatggc

SEQ ID NO: 181270 - DNA, 75 bp, Artificial Sequence
  Synthetic
ttggatggaatagataaggctcaagaagaacatgagaaatatcacaacaattggagagcaatggctagtgatttt

SEQ ID NO: 181271 - DNA, 75 bp, Artificial Sequence
  Synthetic
cctgtccaaaggtatcctttgaaccaattcccatacattattgtgccccggctggttttgcgattctaaagtgta

SEQ ID NO: 181272 - DNA, 75 bp, Artificial Sequence
  Synthetic
gaaaaggggaatgtaaaaatgtgagtactgtacaatgcacacatggaataaagccaacgatatctactcagttaa

SEQ ID NO: 181273 - DNA, 75 bp, Artificial Sequence
  Synthetic
aggcatagtagcattaatagtagcactaataatagcaatagttgtgtggactatagtatatatagaatataggaa

SEQ ID NO: 181274 - DNA, 75 bp, Artificial Sequence
  Synthetic
atggaactaataatatcactagtagtagtgggaaagggatggaggaaggagagataaaaaactgctcattcaata

SEQ ID NO: 181275 - DNA, 75 bp, Artificial Sequence
  Synthetic
gagacccagaagtaagacacttcatgttcaattgtggaggagagtttttcctttgtaacacttccagattatttg

SEQ ID NO: 181276 - DNA, 75 bp, Artificial Sequence
  Synthetic
gagaacactttatgcaacaggagaaataataggaaatataagacaagcatattgtaccattaatataacaaaatg

SEQ ID NO: 181277 - DNA, 75 bp, Artificial Sequence
  Synthetic
tattattctgccctgtagaataaaacaaattgtaaatttgtggacaagagtaggaaaaggaatttatgcaccacc

SEQ ID NO: 181278 - DNA, 75 bp, Artificial Sequence
  Synthetic
aaactaacacaataatctttgatcaaccctcaggaggggacctagaagttcaaatgcacacgtttaattgtggag

SEQ ID NO: 181279 - DNA, 75 bp, Artificial Sequence
  Synthetic
ataggaccggggcaagcattctatgcacatgatataataggggacataagacaagcacattgtaacattagtaga

SEQ ID NO: 181280 - DNA, 75 bp, Artificial Sequence
  Synthetic
attgtagtgatgccagtgcccctaaaaccactgatagcaccctggaagagaaaggggcaataaaaaactgtactt

SEQ ID NO: 181281 - DNA, 75 bp, Artificial Sequence
  Synthetic
gctccaggcaaaagtcctggctgtagaaagatacctaagagatcaacagctcctaaggatttaaagttgctctgg

SEQ ID NO: 181282 - DNA, 75 bp, Artificial Sequence
  Synthetic
ataataactataatagcaagagttaggcagggatattctcccctctcgttgcagacccttatcccaacaaccagg

SEQ ID NO: 181283 - DNA, 75 bp, Artificial Sequence
  Synthetic
ataagcaattacacagaccaaatatacagcttactcgaagaagcgcagaaccagcaagaaaaaatgaacaagaat

SEQ ID NO: 181284 - DNA, 75 bp, Artificial Sequence
  Synthetic
acagcttactcgaagaagcgcagaaccagcaagaaaaaatgaacaagaattgttagaattagataagtgggcaag

SEQ ID NO: 181285 - DNA, 75 bp, Artificial Sequence
  Synthetic
taaaatttaactcatcctcaggaggggacctagaaattacaatgcatagttttaattgtagaggagaatttttct

SEQ ID NO: 181286 - DNA, 75 bp, Artificial Sequence
  Synthetic
actgcaggaacctggtgaccctcctctaccaccgcttgagagacttactcttgataacacagaggactctggaga

SEQ ID NO: 181287 - DNA, 75 bp, Artificial Sequence
  Synthetic
gaaattgcagggcccctaggaaaaaaggctgttggaaatgtgggaaagaaggacaccaaatgaaagactgcacag

SEQ ID NO: 181288 - DNA, 75 bp, Artificial Sequence
  Synthetic
ctttctataatgaatacagttaggcagagatactcaccattgtcattccagacccgcctcccaacccacggggga

SEQ ID NO: 181289 - DNA, 75 bp, Artificial Sequence
  Synthetic
tacagagcctgagccttttcagttaccgccacttaagagactttctcttaattgtagcgaggattgtagaacttt

SEQ ID NO: 181290 - DNA, 75 bp, Artificial Sequence
  Synthetic
agcagaggatagatggaacaagccccagaagaccaggggccccagagggagccatacaatgaatggatgttagaa

SEQ ID NO: 181291 - DNA, 75 bp, Artificial Sequence
  Synthetic
agccatagcagtagctaagaggacagatagaatcatagacatattacaaaaattttttagagctatcatccatat

SEQ ID NO: 181292 - DNA, 75 bp, Artificial Sequence
  Synthetic
taactgaaacaacaaatcagaagactgaattacaagcaattcagctagctttgcaagattcaggatcagaagtaa

SEQ ID NO: 181293 - DNA, 75 bp, Artificial Sequence
  Synthetic
ggcaagtggtcaaaacatagtatgaatagatggactgctataaaagaaagaataagacgagttaggcccgagcca

SEQ ID NO: 181294 - DNA, 75 bp, Artificial Sequence
  Synthetic
gaataggcatcattcgagggagaagagtcagggatggatccagtagatcctaacctagagccctggaaccatcca

SEQ ID NO: 181295 - DNA, 75 bp, Artificial Sequence
  Synthetic
tggaataacatgacctggatggagtgggaaagagaaattgacaattacacaggcttaatatacaccttaattgaa

SEQ ID NO: 181296 - DNA, 75 bp, Artificial Sequence
  Synthetic
tcagaactggaggtaaaaaactgctctttcaatataactacagtagtaagagataagagaatgcaagtacgtgcg

SEQ ID NO: 181297 - DNA, 75 bp, Artificial Sequence
  Synthetic
gcaggaagaagcggaaacagcgccagcgacgaggaactcctcaaagcaataaggatcatcaaaatcctctacaaa

SEQ ID NO: 181298 - DNA, 75 bp, Artificial Sequence
  Synthetic
taaaatgggaggcaagtggtcaaaaagcaagagatggcctgaaataagagaaagaatgagacaaactaggccaga

SEQ ID NO: 181299 - DNA, 75 bp, Artificial Sequence
  Synthetic
tctcgacgcaggactcggcttgctgagcgcgcacagcaagaggcgaggggcggcgaacggtgagtacgccaattt

SEQ ID NO: 181300 - DNA, 75 bp, Artificial Sequence
  Synthetic
aagacaagcacattgtaacattagtagagcaaaatggaataacactttaaaacagatagttacaaaattaagaga

SEQ ID NO: 181301 - DNA, 75 bp, Artificial Sequence
  Synthetic
cggcgaacggtgagtacgccaattttttgactagcggaggctagaaggagagagatgggtgcgagagcgtcagta

SEQ ID NO: 181302 - DNA, 75 bp, Artificial Sequence
  Synthetic
gggtggcaagtggtcaaaacgtagtgtgcctggatggaatactataagggaaagaatgagacgagctgagccagc

SEQ ID NO: 181303 - DNA, 75 bp, Artificial Sequence
  Synthetic
attgctaaaacaaaggaaaatagacaggttaattaagagaataagagaaagagcagaagacagtggcaatgagag

SEQ ID NO: 181304 - DNA, 75 bp, Artificial Sequence
  Synthetic
acttaagtcattatacaatacagtagcaaccctctattgtgtacatcagaagatagatataaaagacaccaaaga

SEQ ID NO: 181305 - DNA, 75 bp, Artificial Sequence
  Synthetic
tgagtcttatagattaataaattgtaatacctcagccgtaacacaagcctgtccaaaggtcacttttgatccaat

SEQ ID NO: 181306 - DNA, 75 bp, Artificial Sequence
  Synthetic
gaaatggaaaaggaaggaaaaattacaaaaattgggcctgaaaatccatataacactccagtatttgccataaaa

SEQ ID NO: 181307 - DNA, 75 bp, Artificial Sequence
  Synthetic
cctcctgcaatattggattcaggaactaaagaatagtgctattagcttgtttaacaccacagcaatagtagtagc

SEQ ID NO: 181308 - DNA, 75 bp, Artificial Sequence
  Synthetic
aaagaatagtgccattaatttgcttgatacaatagcaatagcagtagctaactggacagatagagctatagaagt

SEQ ID NO: 181309 - DNA, 75 bp, Artificial Sequence
  Synthetic
ctcaacatacctagaagaataagacaaggcttggaaagagctttgctataacatggggggcaagtggtcaaaacg

SEQ ID NO: 181310 - DNA, 75 bp, Artificial Sequence
  Synthetic
aatacctcagccattacacaggcttgtccaaaggtatcctttgagccaattcccatacattattgtgccccagct

SEQ ID NO: 181311 - DNA, 75 bp, Artificial Sequence
  Synthetic
ggcgactggtgagtacgccaatttttgactagcggaggctagaaggagaggatgggtgcgagagcgtcagtatta

SEQ ID NO: 181312 - DNA, 75 bp, Artificial Sequence
  Synthetic
aggaggggacctagaaattacaacacatagctttaattgtagaggagaatttttctattgtaatacatcaaaact

SEQ ID NO: 181313 - DNA, 75 bp, Artificial Sequence
  Synthetic
gcccaccagggcaaagagaagagtggtggaaagggaaaaaagaggggttttcttgggagcagcaggaagcacgat

SEQ ID NO: 181314 - DNA, 75 bp, Artificial Sequence
  Synthetic
caagcttcacaggatgtaaaaaattggatgacagaaaccttgttggtccaaaatgcgaacccagattgtaagact

SEQ ID NO: 181315 - DNA, 75 bp, Artificial Sequence
  Synthetic
ggggaaactttaaaggcacaaggagaaccattaaatgtttcaattgtggcaaagagggccatttggcaaggaact

SEQ ID NO: 181316 - DNA, 75 bp, Artificial Sequence
  Synthetic
aaaaaattcggttaaggccagggggaaagaaaaaatatagaatgaagcatctagtatgggcaagcagggagttag

SEQ ID NO: 181317 - DNA, 75 bp, Artificial Sequence
  Synthetic
atatgagggacaattggagaagtgaattatataaatataaagtggtagaaattaagccattgggagtagcaccca

SEQ ID NO: 181318 - DNA, 75 bp, Artificial Sequence
  Synthetic
gattgtggaacttctgggacgcagggggtgggaagccctcaagtatctgtggaatctcctgcagtattggagtca

SEQ ID NO: 181319 - DNA, 75 bp, Artificial Sequence
  Synthetic
ctacctgtcatgggtaccagcacacaaaggaattggaggaaatgaacaagtagataaattagtaagtagtggaat

SEQ ID NO: 181320 - DNA, 75 bp, Artificial Sequence
  Synthetic
tggctgtggtatataaaaatatttataatgatagtaggaggcttaataggattaagaatagtttttgctgtgctt

SEQ ID NO: 181321 - DNA, 75 bp, Artificial Sequence
  Synthetic
gtctctcgcgcaggactcggcttgctgaagcgcgcgcggcaagaggcgaggggcagcgactggtgagtacgctaa

SEQ ID NO: 181322 - DNA, 75 bp, Artificial Sequence
  Synthetic
tacaaccatctattcagacaggatcagaagaacttagatcattatataatacagtagcaaccctctattgtgtac

SEQ ID NO: 181323 - DNA, 75 bp, Artificial Sequence
  Synthetic
taaggataggaccaggacaaacattctatgcaacaaatgaaataataggagacataagacaagcacattgtaaca

SEQ ID NO: 181324 - DNA, 75 bp, Artificial Sequence
  Synthetic
gcctcaggttagggaaagaatgagacaaactcctccagcagcagaaggagtaggagcagtatctcaagatttaga

SEQ ID NO: 181325 - DNA, 75 bp, Artificial Sequence
  Synthetic
cccagtagatcctaacctagagccctggaaccatccaggaagtcagcctaaaactgcttgtaataattgttattg

SEQ ID NO: 181326 - DNA, 75 bp, Artificial Sequence
  Synthetic
cattgccaattatgctttctgaacaagggcttaggcatctcctatggcaggaagaagcggaagcgccgacgagga

SEQ ID NO: 181327 - DNA, 75 bp, Artificial Sequence
  Synthetic
cataaggaaagccatattaggacaagtagttagatgtaggtgtgaatatccatcaggacataacaaggtaggatc

SEQ ID NO: 181328 - DNA, 75 bp, Artificial Sequence
  Synthetic
gaaatggggctttactacaccagacaaaaaacatcagaaagaacctccattcctttggatggggtatgaactcca

SEQ ID NO: 181329 - DNA, 75 bp, Artificial Sequence
  Synthetic
tgcagggcccctaggaaaaagggctgttggaaatgtggaagggaaggacaccaaatgaaagactgcactgaaaga

SEQ ID NO: 181330 - DNA, 75 bp, Artificial Sequence
  Synthetic
tatgacccatcaaaagatttaatagcagaaatacagaaacaagggcaagggcaatggacatatcagatttatcaa

SEQ ID NO: 181331 - DNA, 75 bp, Artificial Sequence
  Synthetic
aagaaacaaattgctctaaagatgaaagtgttacccataatggtgccacatgtgaagaaatgagaaattgctctt

SEQ ID NO: 181332 - DNA, 75 bp, Artificial Sequence
  Synthetic
atggtattatagacatcattatgaaacaaggcatccaaaaataagttcagaagtacatatcccagtaggtcaggc

SEQ ID NO: 181333 - DNA, 75 bp, Artificial Sequence
  Synthetic
aatacaaccacagaaataagagataagaaacagcaagggtatgcacttttttatagacctgatatagtactactt

SEQ ID NO: 181334 - DNA, 75 bp, Artificial Sequence
  Synthetic
taattgatagaataagagaaagagcagaagacagtggcaatgagagtgaaggggatcaggaagaattatcagcac

SEQ ID NO: 181335 - DNA, 75 bp, Artificial Sequence
  Synthetic
gatataatcagtttatgggatcaaagcctaaaaccatgtgtaaagttgaccccactctgtgtcactttaaactgt

SEQ ID NO: 181336 - DNA, 75 bp, Artificial Sequence
  Synthetic
tggtgaaggaataaaaaattgctctttcaatacaaccacagaaataagggacaagaaacagaaagtctatgcgct

SEQ ID NO: 181337 - DNA, 75 bp, Artificial Sequence
  Synthetic
tgctgtttatccatttcagaattgggtgtcaacatagcagaataggcatttctccacagagaagagcaagaaatg

SEQ ID NO: 181338 - DNA, 75 bp, Artificial Sequence
  Synthetic
cctaacagcagtaagaattatcaagatcctataccagagcagtaagtaaaaactgtatatatgcttgaattggga

SEQ ID NO: 181339 - DNA, 75 bp, Artificial Sequence
  Synthetic
atgaaaaactgctctttcaatgttaccacaaacataagagataaggtgcagaaagaatatgctcttttctataaa

SEQ ID NO: 181340 - DNA, 75 bp, Artificial Sequence
  Synthetic
aattaagccagtggtatcaactcaactactgttaaatggtagcctagcagaagaagagataataattagatctga

SEQ ID NO: 181341 - DNA, 75 bp, Artificial Sequence
  Synthetic
taatagcagtaataatctgggtgttactatataaagaatataaggaaataaaactgcaagaaaaaatagaaaaga

SEQ ID NO: 181342 - DNA, 75 bp, Artificial Sequence
  Synthetic
aataaaacaataaaatttgcaccatcctcaggaggagacctagaaattacaacacatagctttaattgtagagga

SEQ ID NO: 181343 - DNA, 75 bp, Artificial Sequence
  Synthetic
taaaggatcaacagctcctagggatttggggctgctctggaaaactcatctgcaccactgctgtgccttggaaca

SEQ ID NO: 181344 - DNA, 75 bp, Artificial Sequence
  Synthetic
gcacgatgctccttgggatgttaatgatctgtaaagctgcagaaaatttgtgggtcacagtctattatggggtac

SEQ ID NO: 181345 - DNA, 75 bp, Artificial Sequence
  Synthetic
caataagacaagaaaaagtgtaagaataggaccaggacaagtattctatgcaacaggagaagtaacagaagatat

SEQ ID NO: 181346 - DNA, 75 bp, Artificial Sequence
  Synthetic
gagaataatttttgctgtgctttctatagtgaatagagttaggcagggatactcacctttgtcgtttcagaccct

SEQ ID NO: 181347 - DNA, 75 bp, Artificial Sequence
  Synthetic
cattttatgcaacaggagccataataggagatataagacaagcacattgtaacattagtagagaaaaatggaatg

SEQ ID NO: 181348 - DNA, 75 bp, Artificial Sequence
  Synthetic
gtaccagcacacaaaggaattggaggaaatgaacaagtagataagttagtcagtcagggaatcaggaaagtacta

SEQ ID NO: 181349 - DNA, 75 bp, Artificial Sequence
  Synthetic
cattacacaggcctgtccaaaggtatcctttgagccaattcccatacattattgtgccccggctggttttgcgat

SEQ ID NO: 181350 - DNA, 75 bp, Artificial Sequence
  Synthetic
caaacaaatgaaaaattgctcattcaatgtaaccactgagagagaagatagaaagaagaaagcttactctctgtt

SEQ ID NO: 181351 - DNA, 75 bp, Artificial Sequence
  Synthetic
gtgccctggaactccacttggagtaataaatcttatgaagagatttggaacaacatgacatggacagaatgggag

SEQ ID NO: 181352 - DNA, 75 bp, Artificial Sequence
  Synthetic
acattttcctaggccatggctccatggcttaggacaacatatctataacacctatggggatacttgggagggagt

SEQ ID NO: 181353 - DNA, 75 bp, Artificial Sequence
  Synthetic
gaaatgaaaagctgctctttcaatgtcaccacaaatataggaggtaaagtaaagaaggaaaatgcacttttttat

SEQ ID NO: 181354 - DNA, 75 bp, Artificial Sequence
  Synthetic
tttagaaggaaaagttatcatagtagcagttcatgtagccagtggctatatagaagcagaagttattccagcaga

SEQ ID NO: 181355 - DNA, 75 bp, Artificial Sequence
  Synthetic
cagcagaaacaggacaagaaacagcatactttatattaaaattagcaggaagatggccagtcaaagtaatacata

SEQ ID NO: 181356 - DNA, 75 bp, Artificial Sequence
  Synthetic
ttgtggagttggtttgacatatcaaattggctgtggtatataaaaatattcatcatgatagtaggaggcttaata

SEQ ID NO: 181357 - DNA, 75 bp, Artificial Sequence
  Synthetic
aagagaacaatttaagaataaaacaatagtctttaatcaatcctcaggaggggacccagaaattgtaatgcacag

SEQ ID NO: 181358 - DNA, 75 bp, Artificial Sequence
  Synthetic
cagataggacctgctatgacattttataacatagagaaaataataggggacattagacaagcacactgtaatgtc

SEQ ID NO: 181359 - DNA, 75 bp, Artificial Sequence
  Synthetic
ttaatagtagcactaataatagcaataattgtgtggactatagcatatatagaatataggaaattggtaaggcaa

SEQ ID NO: 181360 - DNA, 75 bp, Artificial Sequence
  Synthetic
attgtgggttacagtttattatggggtacctgtgtggaaggaagcgaccactactctattttgtgcctcagatgc

SEQ ID NO: 181361 - DNA, 75 bp, Artificial Sequence
  Synthetic
aacaatttcctaataagacaatagtctttaagcagccaccctcaggaggggatccagaaattacaactcacagct

SEQ ID NO: 181362 - DNA, 75 bp, Artificial Sequence
  Synthetic
ctttaagcagccaccctcaggaggggatccagaaattacaactcacagctttaattgtggaggggaattcttcta

SEQ ID NO: 181363 - DNA, 75 bp, Artificial Sequence
  Synthetic
agtaggagcagcgtctcgagacttagataaacatggggcacttacaagcagcaacacagcccataataatgctga

SEQ ID NO: 181364 - DNA, 75 bp, Artificial Sequence
  Synthetic
tgtttttcagaatctgctataagaaaagccatattaggacatagagttagtcctaggtgtgaatatcaagcagga

SEQ ID NO: 181365 - DNA, 75 bp, Artificial Sequence
  Synthetic
ccaccccaaacgacaccctgaaggaagacacaggggcaatacaaaactgctctttcaatataaccacagaagtag

SEQ ID NO: 181366 - DNA, 75 bp, Artificial Sequence
  Synthetic
tcagacctcaggtgcctttaagaccaatgacttataaggcagcaatcgatctcagcttctttttaaaagaaaagg

SEQ ID NO: 181367 - DNA, 75 bp, Artificial Sequence
  Synthetic
agcatcaaaaaagacaaagccacctttgcctagtgttaggaagctaacagaagatagatggaacaagccccagaa

SEQ ID NO: 181368 - DNA, 75 bp, Artificial Sequence
  Synthetic
ttgcctagtgttaggaagctaacagaagatagatggaacaagccccagaagaccaggggccacagagggagccat

SEQ ID NO: 181369 - DNA, 75 bp, Artificial Sequence
  Synthetic
gaatgagacgagctaggccagtaacagcagcagaaggagtaggaacagcgtctcaggacttagataaacatgggg

SEQ ID NO: 181370 - DNA, 75 bp, Artificial Sequence
  Synthetic
ggctgctcaggaaaaactatatgctataccactgtgccttggaatgagacttggagcaataatacctcatatgaa

SEQ ID NO: 181371 - DNA, 75 bp, Artificial Sequence
  Synthetic
ggctgctcaggaaaaactatatgctataccactgtgccttggaatgagacttggagcaataatacctcatatgat

SEQ ID NO: 181372 - DNA, 75 bp, Artificial Sequence
  Synthetic
ggctgctcaggaaaaactatatgctataccactgtgccttggaatgagacttggagcaataatacctcatatgac

SEQ ID NO: 181373 - DNA, 75 bp, Artificial Sequence
  Synthetic
ggctgctcaggaaaaactatatgctataccactgtgccttggaatgagacttggagcaataatacctcatatgag

SEQ ID NO: 181374 - DNA, 75 bp, Artificial Sequence
  Synthetic
ggctgctcaggaaaaactatatgctataccactgtgccttggaatgagacttggagcaataatacctcttatgaa

SEQ ID NO: 181375 - DNA, 75 bp, Artificial Sequence
  Synthetic
ggctgctcaggaaaaactatatgctataccactgtgccttggaatgagacttggagcaataatacctcttatgat

SEQ ID NO: 181376 - DNA, 75 bp, Artificial Sequence
  Synthetic
ggctgctcaggaaaaactatatgctataccactgtgccttggaatgagacttggagcaataatacctcttatgac

SEQ ID NO: 181377 - DNA, 75 bp, Artificial Sequence
  Synthetic
ggctgctcaggaaaaactatatgctataccactgtgccttggaatgagacttggagcaataatacctcttatgag

SEQ ID NO: 181378 - DNA, 75 bp, Artificial Sequence
  Synthetic
ggctgctcaggaaaaactatatgctataccactgtgccttggaatgagacttggagcaataatacctcctatgaa

SEQ ID NO: 181379 - DNA, 75 bp, Artificial Sequence
  Synthetic
ggctgctcaggaaaaactatatgctataccactgtgccttggaatgagacttggagcaataatacctcctatgat

SEQ ID NO: 181380 - DNA, 75 bp, Artificial Sequence
  Synthetic
ggctgctcaggaaaaactatatgctataccactgtgccttggaatgagacttggagcaataatacctcctatgac

SEQ ID NO: 181381 - DNA, 75 bp, Artificial Sequence
  Synthetic
ggctgctcaggaaaaactatatgctataccactgtgccttggaatgagacttggagcaataatacctcctatgag

SEQ ID NO: 181382 - DNA, 75 bp, Artificial Sequence
  Synthetic
ggctgctcaggaaaaactatatgctataccactgtgccttggaatgagacttggagcaataatacctcgtatgaa

SEQ ID NO: 181383 - DNA, 75 bp, Artificial Sequence
  Synthetic
ggctgctcaggaaaaactatatgctataccactgtgccttggaatgagacttggagcaataatacctcgtatgat

SEQ ID NO: 181384 - DNA, 75 bp, Artificial Sequence
  Synthetic
ggctgctcaggaaaaactatatgctataccactgtgccttggaatgagacttggagcaataatacctcgtatgac

SEQ ID NO: 181385 - DNA, 75 bp, Artificial Sequence
  Synthetic
ggctgctcaggaaaaactatatgctataccactgtgccttggaatgagacttggagcaataatacctcgtatgag

SEQ ID NO: 181386 - DNA, 75 bp, Artificial Sequence
  Synthetic
ggctgctcaggaaaaactatatgctataccactgtgccttggaatgagacttggagcattaatacctcatatgaa

SEQ ID NO: 181387 - DNA, 75 bp, Artificial Sequence
  Synthetic
ggctgctcaggaaaaactatatgctataccactgtgccttggaatgagacttggagcattaatacctcatatgat

SEQ ID NO: 181388 - DNA, 75 bp, Artificial Sequence
  Synthetic
ggctgctcaggaaaaactatatgctataccactgtgccttggaatgagacttggagcattaatacctcatatgac

SEQ ID NO: 181389 - DNA, 75 bp, Artificial Sequence
  Synthetic
ggctgctcaggaaaaactatatgctataccactgtgccttggaatgagacttggagcattaatacctcatatgag

SEQ ID NO: 181390 - DNA, 75 bp, Artificial Sequence
  Synthetic
ggctgctcaggaaaaactatatgctataccactgtgccttggaatgagacttggagcattaatacctcttatgaa

SEQ ID NO: 181391 - DNA, 75 bp, Artificial Sequence
  Synthetic
ggctgctcaggaaaaactatatgctataccactgtgccttggaatgagacttggagcattaatacctcttatgat

SEQ ID NO: 181392 - DNA, 75 bp, Artificial Sequence
  Synthetic
ggctgctcaggaaaaactatatgctataccactgtgccttggaatgagacttggagcattaatacctcttatgac

SEQ ID NO: 181393 - DNA, 75 bp, Artificial Sequence
  Synthetic
ggctgctcaggaaaaactatatgctataccactgtgccttggaatgagacttggagcattaatacctcttatgag

SEQ ID NO: 181394 - DNA, 75 bp, Artificial Sequence
  Synthetic
ggctgctcaggaaaaactatatgctataccactgtgccttggaatgagacttggagcattaatacctcctatgaa

SEQ ID NO: 181395 - DNA, 75 bp, Artificial Sequence
  Synthetic
ggctgctcaggaaaaactatatgctataccactgtgccttggaatgagacttggagcattaatacctcctatgat

SEQ ID NO: 181396 - DNA, 75 bp, Artificial Sequence
  Synthetic
ggctgctcaggaaaaactatatgctataccactgtgccttggaatgagacttggagcattaatacctcctatgac

SEQ ID NO: 181397 - DNA, 75 bp, Artificial Sequence
  Synthetic
ggctgctcaggaaaaactatatgctataccactgtgccttggaatgagacttggagcattaatacctcctatgag

SEQ ID NO: 181398 - DNA, 75 bp, Artificial Sequence
  Synthetic
ggctgctcaggaaaaactatatgctataccactgtgccttggaatgagacttggagcattaatacctcgtatgaa

SEQ ID NO: 181399 - DNA, 75 bp, Artificial Sequence
  Synthetic
ggctgctcaggaaaaactatatgctataccactgtgccttggaatgagacttggagcattaatacctcgtatgat

SEQ ID NO: 181400 - DNA, 75 bp, Artificial Sequence
  Synthetic
ggctgctcaggaaaaactatatgctataccactgtgccttggaatgagacttggagcattaatacctcgtatgac

SEQ ID NO: 181401 - DNA, 75 bp, Artificial Sequence
  Synthetic
ggctgctcaggaaaaactatatgctataccactgtgccttggaatgagacttggagcattaatacctcgtatgag

SEQ ID NO: 181402 - DNA, 75 bp, Artificial Sequence
  Synthetic
ggctgctcaggaaaaactatatgctataccactgtgccttggaatgagacttggagcactaatacctcatatgaa

SEQ ID NO: 181403 - DNA, 75 bp, Artificial Sequence
  Synthetic
ggctgctcaggaaaaactatatgctataccactgtgccttggaatgagacttggagcactaatacctcatatgat

SEQ ID NO: 181404 - DNA, 75 bp, Artificial Sequence
  Synthetic
ggctgctcaggaaaaactatatgctataccactgtgccttggaatgagacttggagcactaatacctcatatgac

SEQ ID NO: 181405 - DNA, 75 bp, Artificial Sequence
  Synthetic
ggctgctcaggaaaaactatatgctataccactgtgccttggaatgagacttggagcactaatacctcatatgag

SEQ ID NO: 181406 - DNA, 75 bp, Artificial Sequence
  Synthetic
ggctgctcaggaaaaactatatgctataccactgtgccttggaatgagacttggagcactaatacctcttatgaa

SEQ ID NO: 181407 - DNA, 75 bp, Artificial Sequence
  Synthetic
ggctgctcaggaaaaactatatgctataccactgtgccttggaatgagacttggagcactaatacctcttatgat

SEQ ID NO: 181408 - DNA, 75 bp, Artificial Sequence
  Synthetic
ggctgctcaggaaaaactatatgctataccactgtgccttggaatgagacttggagcactaatacctcttatgac

SEQ ID NO: 181409 - DNA, 75 bp, Artificial Sequence
  Synthetic
ggctgctcaggaaaaactatatgctataccactgtgccttggaatgagacttggagcactaatacctcttatgag

SEQ ID NO: 181410 - DNA, 75 bp, Artificial Sequence
  Synthetic
ggctgctcaggaaaaactatatgctataccactgtgccttggaatgagacttggagcactaatacctcctatgaa

SEQ ID NO: 181411 - DNA, 75 bp, Artificial Sequence
  Synthetic
ggctgctcaggaaaaactatatgctataccactgtgccttggaatgagacttggagcactaatacctcctatgat

SEQ ID NO: 181412 - DNA, 75 bp, Artificial Sequence
  Synthetic
ggctgctcaggaaaaactatatgctataccactgtgccttggaatgagacttggagcactaatacctcctatgac

SEQ ID NO: 181413 - DNA, 75 bp, Artificial Sequence
  Synthetic
ggctgctcaggaaaaactatatgctataccactgtgccttggaatgagacttggagcactaatacctcctatgag

SEQ ID NO: 181414 - DNA, 75 bp, Artificial Sequence
  Synthetic
ggctgctcaggaaaaactatatgctataccactgtgccttggaatgagacttggagcactaatacctcgtatgaa

SEQ ID NO: 181415 - DNA, 75 bp, Artificial Sequence
  Synthetic
ggctgctcaggaaaaactatatgctataccactgtgccttggaatgagacttggagcactaatacctcgtatgat

SEQ ID NO: 181416 - DNA, 75 bp, Artificial Sequence
  Synthetic
ggctgctcaggaaaaactatatgctataccactgtgccttggaatgagacttggagcactaatacctcgtatgac

SEQ ID NO: 181417 - DNA, 75 bp, Artificial Sequence
  Synthetic
ggctgctcaggaaaaactatatgctataccactgtgccttggaatgagacttggagcactaatacctcgtatgag

SEQ ID NO: 181418 - DNA, 75 bp, Artificial Sequence
  Synthetic
ggctgctcaggaaaaactatatgctataccactgtgccttggaatgagacttggagcagtaatacctcatatgaa

SEQ ID NO: 181419 - DNA, 75 bp, Artificial Sequence
  Synthetic
ggctgctcaggaaaaactatatgctataccactgtgccttggaatgagacttggagcagtaatacctcatatgat

SEQ ID NO: 181420 - DNA, 75 bp, Artificial Sequence
  Synthetic
ggctgctcaggaaaaactatatgctataccactgtgccttggaatgagacttggagcagtaatacctcatatgac

SEQ ID NO: 181421 - DNA, 75 bp, Artificial Sequence
  Synthetic
ggctgctcaggaaaaactatatgctataccactgtgccttggaatgagacttggagcagtaatacctcatatgag

SEQ ID NO: 181422 - DNA, 75 bp, Artificial Sequence
  Synthetic
ggctgctcaggaaaaactatatgctataccactgtgccttggaatgagacttggagcagtaatacctcttatgaa

SEQ ID NO: 181423 - DNA, 75 bp, Artificial Sequence
  Synthetic
ggctgctcaggaaaaactatatgctataccactgtgccttggaatgagacttggagcagtaatacctcttatgat

SEQ ID NO: 181424 - DNA, 75 bp, Artificial Sequence
  Synthetic
ggctgctcaggaaaaactatatgctataccactgtgccttggaatgagacttggagcagtaatacctcttatgac

SEQ ID NO: 181425 - DNA, 75 bp, Artificial Sequence
  Synthetic
ggctgctcaggaaaaactatatgctataccactgtgccttggaatgagacttggagcagtaatacctcttatgag

SEQ ID NO: 181426 - DNA, 75 bp, Artificial Sequence
  Synthetic
ggctgctcaggaaaaactatatgctataccactgtgccttggaatgagacttggagcagtaatacctcctatgaa

SEQ ID NO: 181427 - DNA, 75 bp, Artificial Sequence
  Synthetic
ggctgctcaggaaaaactatatgctataccactgtgccttggaatgagacttggagcagtaatacctcctatgat

SEQ ID NO: 181428 - DNA, 75 bp, Artificial Sequence
  Synthetic
ggctgctcaggaaaaactatatgctataccactgtgccttggaatgagacttggagcagtaatacctcctatgac

SEQ ID NO: 181429 - DNA, 75 bp, Artificial Sequence
  Synthetic
ggctgctcaggaaaaactatatgctataccactgtgccttggaatgagacttggagcagtaatacctcctatgag

SEQ ID NO: 181430 - DNA, 75 bp, Artificial Sequence
  Synthetic
ggctgctcaggaaaaactatatgctataccactgtgccttggaatgagacttggagcagtaatacctcgtatgaa

SEQ ID NO: 181431 - DNA, 75 bp, Artificial Sequence
  Synthetic
ggctgctcaggaaaaactatatgctataccactgtgccttggaatgagacttggagcagtaatacctcgtatgat

SEQ ID NO: 181432 - DNA, 75 bp, Artificial Sequence
  Synthetic
ggctgctcaggaaaaactatatgctataccactgtgccttggaatgagacttggagcagtaatacctcgtatgac

SEQ ID NO: 181433 - DNA, 75 bp, Artificial Sequence
  Synthetic
ggctgctcaggaaaaactatatgctataccactgtgccttggaatgagacttggagcagtaatacctcgtatgag

SEQ ID NO: 181434 - DNA, 75 bp, Artificial Sequence
  Synthetic
acacaaatgagaaatcactcttggaattggatcaatgggcaaatctgtggaactggtttgatattacaagctggc

SEQ ID NO: 181435 - DNA, 75 bp, Artificial Sequence
  Synthetic
acacaaatgagaaatcactcttggaattggatcaatgggcaattctgtggaactggtttgatattacaagctggc

SEQ ID NO: 181436 - DNA, 75 bp, Artificial Sequence
  Synthetic
acacaaatgagaaatcactcttggaattggatcaatgggcaactctgtggaactggtttgatattacaagctggc

SEQ ID NO: 181437 - DNA, 75 bp, Artificial Sequence
  Synthetic
acacaaatgagaaatcactcttggaattggatcaatgggcaagtctgtggaactggtttgatattacaagctggc

SEQ ID NO: 181438 - DNA, 75 bp, Artificial Sequence
  Synthetic
gaaattgcagggcccctagaaaaaagggttgttggaaatgtgggaaggaaggacatcaaatgaaagattgcactg

SEQ ID NO: 181439 - DNA, 75 bp, Artificial Sequence
  Synthetic
ctagggatttggggttgctctggaaaactcatctgcaccactaatgtgccttggaatactagttggagtaataaa

SEQ ID NO: 181440 - DNA, 75 bp, Artificial Sequence
  Synthetic
aacaatacaaggagaagtatatatttaggaccaggacacgcattccatacaacagacaggataataggagatata

SEQ ID NO: 181441 - DNA, 75 bp, Artificial Sequence
  Synthetic
ataatcctgggattaaataaaatagtaagaatgtatagccctaccagcattttggacataagacaaggaccaaag

SEQ ID NO: 181442 - DNA, 75 bp, Artificial Sequence
  Synthetic
ttgaaagacttactcttgataatacagaggactctggagctcctgggacagagtctcagcaggggactgcaacta

SEQ ID NO: 181443 - DNA, 75 bp, Artificial Sequence
  Synthetic
ttgaaagacttactcttgatattacagaggactctggagctcctgggacagagtctcagcaggggactgcaacta

SEQ ID NO: 181444 - DNA, 75 bp, Artificial Sequence
  Synthetic
ttgaaagacttactcttgatactacagaggactctggagctcctgggacagagtctcagcaggggactgcaacta

SEQ ID NO: 181445 - DNA, 75 bp, Artificial Sequence
  Synthetic
ttgaaagacttactcttgatagtacagaggactctggagctcctgggacagagtctcagcaggggactgcaacta

SEQ ID NO: 181446 - DNA, 75 bp, Artificial Sequence
  Synthetic
ttgatagacttactcttgataatacagaggactctggagctcctgggacagagtctcagcaggggactgcaacta

SEQ ID NO: 181447 - DNA, 75 bp, Artificial Sequence
  Synthetic
ttgatagacttactcttgatattacagaggactctggagctcctgggacagagtctcagcaggggactgcaacta

SEQ ID NO: 181448 - DNA, 75 bp, Artificial Sequence
  Synthetic
ttgatagacttactcttgatactacagaggactctggagctcctgggacagagtctcagcaggggactgcaacta

SEQ ID NO: 181449 - DNA, 75 bp, Artificial Sequence
  Synthetic
ttgatagacttactcttgatagtacagaggactctggagctcctgggacagagtctcagcaggggactgcaacta

SEQ ID NO: 181450 - DNA, 75 bp, Artificial Sequence
  Synthetic
ttgacagacttactcttgataatacagaggactctggagctcctgggacagagtctcagcaggggactgcaacta

SEQ ID NO: 181451 - DNA, 75 bp, Artificial Sequence
  Synthetic
ttgacagacttactcttgatattacagaggactctggagctcctgggacagagtctcagcaggggactgcaacta

SEQ ID NO: 181452 - DNA, 75 bp, Artificial Sequence
  Synthetic
ttgacagacttactcttgatactacagaggactctggagctcctgggacagagtctcagcaggggactgcaacta

SEQ ID NO: 181453 - DNA, 75 bp, Artificial Sequence
  Synthetic
ttgacagacttactcttgatagtacagaggactctggagctcctgggacagagtctcagcaggggactgcaacta

SEQ ID NO: 181454 - DNA, 75 bp, Artificial Sequence
  Synthetic
ttgagagacttactcttgataatacagaggactctggagctcctgggacagagtctcagcaggggactgcaacta

SEQ ID NO: 181455 - DNA, 75 bp, Artificial Sequence
  Synthetic
ttgagagacttactcttgatattacagaggactctggagctcctgggacagagtctcagcaggggactgcaacta

SEQ ID NO: 181456 - DNA, 75 bp, Artificial Sequence
  Synthetic
ttgagagacttactcttgatactacagaggactctggagctcctgggacagagtctcagcaggggactgcaacta

SEQ ID NO: 181457 - DNA, 75 bp, Artificial Sequence
  Synthetic
ttgagagacttactcttgatagtacagaggactctggagctcctgggacagagtctcagcaggggactgcaacta

SEQ ID NO: 181458 - DNA, 75 bp, Artificial Sequence
  Synthetic
agaattagcacaaagaataggaaggggaatattacacgtccctagaagaattagacagggcctagaaaggacact

SEQ ID NO: 181459 - DNA, 75 bp, Artificial Sequence
  Synthetic
atcagtttatgggatcaaagcctaaagccatgtgtaaagttgaccccactctgtgtcactttaaaatgtagaaat

SEQ ID NO: 181460 - DNA, 75 bp, Artificial Sequence
  Synthetic
agcagcagtaggagtaggagcagcttctcaagacctagctaatcgaggggccatcaccacaagcaatactagaga

SEQ ID NO: 181461 - DNA, 75 bp, Artificial Sequence
  Synthetic
cgggagcaccaccactgagaagccaacactagaggtgcaaaactgctctttcaatgtagctacagtagtaagaga

SEQ ID NO: 181462 - DNA, 75 bp, Artificial Sequence
  Synthetic
tggaaaggcttttgctataaaatgggtggcaagtggtcaaaacctaagattggatggcctgctataagggacagg

SEQ ID NO: 181463 - DNA, 75 bp, Artificial Sequence
  Synthetic
acgcaacaggctcggcttagcggagtgcacccgctaagaggcgagaggaactcacgagaaggtgagtaaatttgc

SEQ ID NO: 181464 - DNA, 75 bp, Artificial Sequence
  Synthetic
aatcccaggatcagatttgggacaacatgacctggatggaatgggacaaagagattagcaattactcaaacataa

SEQ ID NO: 181465 - DNA, 75 bp, Artificial Sequence
  Synthetic
aaattaggttaaggtcaggatcaaaaaagaaatatcaactaaaacatttagtatgggcaagcaaggagctagaaa

SEQ ID NO: 181466 - DNA, 75 bp, Artificial Sequence
  Synthetic
agcgaaagtaaaaccagaggagatctctcggcgcaggactcggcttgctgcagcgcgcgcggcaagaggcgaggg

SEQ ID NO: 181467 - DNA, 75 bp, Artificial Sequence
  Synthetic
ctgtgtcttttcagctaccaccgcttgagagacttcatcttgattgcagcgaggacagtggaactcttgggacgc

SEQ ID NO: 181468 - DNA, 75 bp, Artificial Sequence
  Synthetic
cagactctgccataagaaaagccatattaggacacatagttattcctaggtgtgactatcaagcaggacataata

SEQ ID NO: 181469 - DNA, 75 bp, Artificial Sequence
  Synthetic
gtcactctagaacgcaatagtagtacttaggtgtgttcacaaaagatatagagttaaagacacacagcaggcaat

SEQ ID NO: 181470 - DNA, 75 bp, Artificial Sequence
  Synthetic
gcttaatgcatctgtagaaattaattgtacaaggccctacaacaatacaagacaaaatacacaaataggaccagg

SEQ ID NO: 181471 - DNA, 75 bp, Artificial Sequence
  Synthetic
catatagtatgggcaagcagggaactagaacgatttgcagttaatcctggccttttagagacatcagagggctgt

SEQ ID NO: 181472 - DNA, 75 bp, Artificial Sequence
  Synthetic
agcaagaagtctgcggacaataaagaagacacaaacacaaagcagacaagtcaaaattaccctatagtgacaaat

SEQ ID NO: 181473 - DNA, 75 bp, Artificial Sequence
  Synthetic
agcaagaagtctgcggacaataaagaagacacaatcacaaagcagacaagtcaaaattaccctatagtgacaaat

SEQ ID NO: 181474 - DNA, 75 bp, Artificial Sequence
  Synthetic
agcaagaagtctgcggacaataaagaagacacaaccacaaagcagacaagtcaaaattaccctatagtgacaaat

SEQ ID NO: 181475 - DNA, 75 bp, Artificial Sequence
  Synthetic
agcaagaagtctgcggacaataaagaagacacaagcacaaagcagacaagtcaaaattaccctatagtgacaaat

SEQ ID NO: 181476 - DNA, 75 bp, Artificial Sequence
  Synthetic
agcaagaagtctgcggacaataatgaagacacaaacacaaagcagacaagtcaaaattaccctatagtgacaaat

SEQ ID NO: 181477 - DNA, 75 bp, Artificial Sequence
  Synthetic
agcaagaagtctgcggacaataatgaagacacaatcacaaagcagacaagtcaaaattaccctatagtgacaaat

SEQ ID NO: 181478 - DNA, 75 bp, Artificial Sequence
  Synthetic
agcaagaagtctgcggacaataatgaagacacaaccacaaagcagacaagtcaaaattaccctatagtgacaaat

SEQ ID NO: 181479 - DNA, 75 bp, Artificial Sequence
  Synthetic
agcaagaagtctgcggacaataatgaagacacaagcacaaagcagacaagtcaaaattaccctatagtgacaaat

SEQ ID NO: 181480 - DNA, 75 bp, Artificial Sequence
  Synthetic
agcaagaagtctgcggacaataacgaagacacaaacacaaagcagacaagtcaaaattaccctatagtgacaaat

SEQ ID NO: 181481 - DNA, 75 bp, Artificial Sequence
  Synthetic
agcaagaagtctgcggacaataacgaagacacaatcacaaagcagacaagtcaaaattaccctatagtgacaaat

SEQ ID NO: 181482 - DNA, 75 bp, Artificial Sequence
  Synthetic
agcaagaagtctgcggacaataacgaagacacaaccacaaagcagacaagtcaaaattaccctatagtgacaaat

SEQ ID NO: 181483 - DNA, 75 bp, Artificial Sequence
  Synthetic
agcaagaagtctgcggacaataacgaagacacaagcacaaagcagacaagtcaaaattaccctatagtgacaaat

SEQ ID NO: 181484 - DNA, 75 bp, Artificial Sequence
  Synthetic
agcaagaagtctgcggacaataaggaagacacaaacacaaagcagacaagtcaaaattaccctatagtgacaaat

SEQ ID NO: 181485 - DNA, 75 bp, Artificial Sequence
  Synthetic
agcaagaagtctgcggacaataaggaagacacaatcacaaagcagacaagtcaaaattaccctatagtgacaaat

SEQ ID NO: 181486 - DNA, 75 bp, Artificial Sequence
  Synthetic
agcaagaagtctgcggacaataaggaagacacaaccacaaagcagacaagtcaaaattaccctatagtgacaaat

SEQ ID NO: 181487 - DNA, 75 bp, Artificial Sequence
  Synthetic
agcaagaagtctgcggacaataaggaagacacaagcacaaagcagacaagtcaaaattaccctatagtgacaaat

SEQ ID NO: 181488 - DNA, 75 bp, Artificial Sequence
  Synthetic
agcatgaagtctgcggacaataaagaagacacaaacacaaagcagacaagtcaaaattaccctatagtgacaaat

SEQ ID NO: 181489 - DNA, 75 bp, Artificial Sequence
  Synthetic
agcatgaagtctgcggacaataaagaagacacaatcacaaagcagacaagtcaaaattaccctatagtgacaaat

SEQ ID NO: 181490 - DNA, 75 bp, Artificial Sequence
  Synthetic
agcatgaagtctgcggacaataaagaagacacaaccacaaagcagacaagtcaaaattaccctatagtgacaaat

SEQ ID NO: 181491 - DNA, 75 bp, Artificial Sequence
  Synthetic
agcatgaagtctgcggacaataaagaagacacaagcacaaagcagacaagtcaaaattaccctatagtgacaaat

SEQ ID NO: 181492 - DNA, 75 bp, Artificial Sequence
  Synthetic
agcatgaagtctgcggacaataatgaagacacaaacacaaagcagacaagtcaaaattaccctatagtgacaaat

SEQ ID NO: 181493 - DNA, 75 bp, Artificial Sequence
  Synthetic
agcatgaagtctgcggacaataatgaagacacaatcacaaagcagacaagtcaaaattaccctatagtgacaaat

SEQ ID NO: 181494 - DNA, 75 bp, Artificial Sequence
  Synthetic
agcatgaagtctgcggacaataatgaagacacaaccacaaagcagacaagtcaaaattaccctatagtgacaaat

SEQ ID NO: 181495 - DNA, 75 bp, Artificial Sequence
  Synthetic
agcatgaagtctgcggacaataatgaagacacaagcacaaagcagacaagtcaaaattaccctatagtgacaaat

SEQ ID NO: 181496 - DNA, 75 bp, Artificial Sequence
  Synthetic
agcatgaagtctgcggacaataacgaagacacaaacacaaagcagacaagtcaaaattaccctatagtgacaaat

SEQ ID NO: 181497 - DNA, 75 bp, Artificial Sequence
  Synthetic
agcatgaagtctgcggacaataacgaagacacaatcacaaagcagacaagtcaaaattaccctatagtgacaaat

SEQ ID NO: 181498 - DNA, 75 bp, Artificial Sequence
  Synthetic
agcatgaagtctgcggacaataacgaagacacaaccacaaagcagacaagtcaaaattaccctatagtgacaaat

SEQ ID NO: 181499 - DNA, 75 bp, Artificial Sequence
  Synthetic
agcatgaagtctgcggacaataacgaagacacaagcacaaagcagacaagtcaaaattaccctatagtgacaaat

SEQ ID NO: 181500 - DNA, 75 bp, Artificial Sequence
  Synthetic
agcatgaagtctgcggacaataaggaagacacaaacacaaagcagacaagtcaaaattaccctatagtgacaaat

SEQ ID NO: 181501 - DNA, 75 bp, Artificial Sequence
  Synthetic
agcatgaagtctgcggacaataaggaagacacaatcacaaagcagacaagtcaaaattaccctatagtgacaaat

SEQ ID NO: 181502 - DNA, 75 bp, Artificial Sequence
  Synthetic
agcatgaagtctgcggacaataaggaagacacaaccacaaagcagacaagtcaaaattaccctatagtgacaaat

SEQ ID NO: 181503 - DNA, 75 bp, Artificial Sequence
  Synthetic
agcatgaagtctgcggacaataaggaagacacaagcacaaagcagacaagtcaaaattaccctatagtgacaaat

SEQ ID NO: 181504 - DNA, 75 bp, Artificial Sequence
  Synthetic
agcacgaagtctgcggacaataaagaagacacaaacacaaagcagacaagtcaaaattaccctatagtgacaaat

SEQ ID NO: 181505 - DNA, 75 bp, Artificial Sequence
  Synthetic
agcacgaagtctgcggacaataaagaagacacaatcacaaagcagacaagtcaaaattaccctatagtgacaaat

SEQ ID NO: 181506 - DNA, 75 bp, Artificial Sequence
  Synthetic
agcacgaagtctgcggacaataaagaagacacaaccacaaagcagacaagtcaaaattaccctatagtgacaaat

SEQ ID NO: 181507 - DNA, 75 bp, Artificial Sequence
  Synthetic
agcacgaagtctgcggacaataaagaagacacaagcacaaagcagacaagtcaaaattaccctatagtgacaaat

SEQ ID NO: 181508 - DNA, 75 bp, Artificial Sequence
  Synthetic
agcacgaagtctgcggacaataatgaagacacaaacacaaagcagacaagtcaaaattaccctatagtgacaaat

SEQ ID NO: 181509 - DNA, 75 bp, Artificial Sequence
  Synthetic
agcacgaagtctgcggacaataatgaagacacaatcacaaagcagacaagtcaaaattaccctatagtgacaaat

SEQ ID NO: 181510 - DNA, 75 bp, Artificial Sequence
  Synthetic
agcacgaagtctgcggacaataatgaagacacaaccacaaagcagacaagtcaaaattaccctatagtgacaaat

SEQ ID NO: 181511 - DNA, 75 bp, Artificial Sequence
  Synthetic
agcacgaagtctgcggacaataatgaagacacaagcacaaagcagacaagtcaaaattaccctatagtgacaaat

SEQ ID NO: 181512 - DNA, 75 bp, Artificial Sequence
  Synthetic
agcacgaagtctgcggacaataacgaagacacaaacacaaagcagacaagtcaaaattaccctatagtgacaaat

SEQ ID NO: 181513 - DNA, 75 bp, Artificial Sequence
  Synthetic
agcacgaagtctgcggacaataacgaagacacaatcacaaagcagacaagtcaaaattaccctatagtgacaaat

SEQ ID NO: 181514 - DNA, 75 bp, Artificial Sequence
  Synthetic
agcacgaagtctgcggacaataacgaagacacaaccacaaagcagacaagtcaaaattaccctatagtgacaaat

SEQ ID NO: 181515 - DNA, 75 bp, Artificial Sequence
  Synthetic
agcacgaagtctgcggacaataacgaagacacaagcacaaagcagacaagtcaaaattaccctatagtgacaaat

SEQ ID NO: 181516 - DNA, 75 bp, Artificial Sequence
  Synthetic
agcacgaagtctgcggacaataaggaagacacaaacacaaagcagacaagtcaaaattaccctatagtgacaaat

SEQ ID NO: 181517 - DNA, 75 bp, Artificial Sequence
  Synthetic
agcacgaagtctgcggacaataaggaagacacaatcacaaagcagacaagtcaaaattaccctatagtgacaaat

SEQ ID NO: 181518 - DNA, 75 bp, Artificial Sequence
  Synthetic
agcacgaagtctgcggacaataaggaagacacaaccacaaagcagacaagtcaaaattaccctatagtgacaaat

SEQ ID NO: 181519 - DNA, 75 bp, Artificial Sequence
  Synthetic
agcacgaagtctgcggacaataaggaagacacaagcacaaagcagacaagtcaaaattaccctatagtgacaaat

SEQ ID NO: 181520 - DNA, 75 bp, Artificial Sequence
  Synthetic
agcaggaagtctgcggacaataaagaagacacaaacacaaagcagacaagtcaaaattaccctatagtgacaaat

SEQ ID NO: 181521 - DNA, 75 bp, Artificial Sequence
  Synthetic
agcaggaagtctgcggacaataaagaagacacaatcacaaagcagacaagtcaaaattaccctatagtgacaaat

SEQ ID NO: 181522 - DNA, 75 bp, Artificial Sequence
  Synthetic
agcaggaagtctgcggacaataaagaagacacaaccacaaagcagacaagtcaaaattaccctatagtgacaaat

SEQ ID NO: 181523 - DNA, 75 bp, Artificial Sequence
  Synthetic
agcaggaagtctgcggacaataaagaagacacaagcacaaagcagacaagtcaaaattaccctatagtgacaaat

SEQ ID NO: 181524 - DNA, 75 bp, Artificial Sequence
  Synthetic
agcaggaagtctgcggacaataatgaagacacaaacacaaagcagacaagtcaaaattaccctatagtgacaaat

SEQ ID NO: 181525 - DNA, 75 bp, Artificial Sequence
  Synthetic
agcaggaagtctgcggacaataatgaagacacaatcacaaagcagacaagtcaaaattaccctatagtgacaaat

SEQ ID NO: 181526 - DNA, 75 bp, Artificial Sequence
  Synthetic
agcaggaagtctgcggacaataatgaagacacaaccacaaagcagacaagtcaaaattaccctatagtgacaaat

SEQ ID NO: 181527 - DNA, 75 bp, Artificial Sequence
  Synthetic
agcaggaagtctgcggacaataatgaagacacaagcacaaagcagacaagtcaaaattaccctatagtgacaaat

SEQ ID NO: 181528 - DNA, 75 bp, Artificial Sequence
  Synthetic
agcaggaagtctgcggacaataacgaagacacaaacacaaagcagacaagtcaaaattaccctatagtgacaaat

SEQ ID NO: 181529 - DNA, 75 bp, Artificial Sequence
  Synthetic
agcaggaagtctgcggacaataacgaagacacaatcacaaagcagacaagtcaaaattaccctatagtgacaaat

SEQ ID NO: 181530 - DNA, 75 bp, Artificial Sequence
  Synthetic
agcaggaagtctgcggacaataacgaagacacaaccacaaagcagacaagtcaaaattaccctatagtgacaaat

SEQ ID NO: 181531 - DNA, 75 bp, Artificial Sequence
  Synthetic
agcaggaagtctgcggacaataacgaagacacaagcacaaagcagacaagtcaaaattaccctatagtgacaaat

SEQ ID NO: 181532 - DNA, 75 bp, Artificial Sequence
  Synthetic
agcaggaagtctgcggacaataaggaagacacaaacacaaagcagacaagtcaaaattaccctatagtgacaaat

SEQ ID NO: 181533 - DNA, 75 bp, Artificial Sequence
  Synthetic
agcaggaagtctgcggacaataaggaagacacaatcacaaagcagacaagtcaaaattaccctatagtgacaaat

SEQ ID NO: 181534 - DNA, 75 bp, Artificial Sequence
  Synthetic
agcaggaagtctgcggacaataaggaagacacaaccacaaagcagacaagtcaaaattaccctatagtgacaaat

SEQ ID NO: 181535 - DNA, 75 bp, Artificial Sequence
  Synthetic
agcaggaagtctgcggacaataaggaagacacaagcacaaagcagacaagtcaaaattaccctatagtgacaaat

SEQ ID NO: 181536 - DNA, 75 bp, Artificial Sequence
  Synthetic
agctaactggacagatagagctatagaagtagtgcaaagagttagtagggctattctcaacatacctgtaagaat

SEQ ID NO: 181537 - DNA, 75 bp, Artificial Sequence
  Synthetic
cggattcttagctcttgtctgggacgacctgcggaacctgtgcctcttcagctaccgccacttgagagacttcat

SEQ ID NO: 181538 - DNA, 75 bp, Artificial Sequence
  Synthetic
tagaagaaatgatgacagcatgtcagggagtaggaggacccggccataaggcaagagttttggctgaagcaatga

SEQ ID NO: 181539 - DNA, 75 bp, Artificial Sequence
  Synthetic
aatgagagtgagggggacacagatgaattggccaaacttgtggaaatgggggactttgatccttgggttggtgat

SEQ ID NO: 181540 - DNA, 75 bp, Artificial Sequence
  Synthetic
gatagaactcacccaccaccgataggaccgttaccaccagggcagataagggaaccaacaggaagtgacattgct

SEQ ID NO: 181541 - DNA, 75 bp, Artificial Sequence
  Synthetic
aatagtgctattagcttgcttaataccatagcaatagtagtagctgaggggacagatagagttatagaagcttta

SEQ ID NO: 181542 - DNA, 75 bp, Artificial Sequence
  Synthetic
cagtgaggatcatcaaaatcctatatcaaagcagtaagtatatgtaatgttagatttactagcaagagtagatta

SEQ ID NO: 181543 - DNA, 75 bp, Artificial Sequence
  Synthetic
tcaaagcagtaagtatatgtaatgttagatttactagcaagagtagattatagattaggagtaggagcattgata

SEQ ID NO: 181544 - DNA, 75 bp, Artificial Sequence
  Synthetic
agtttatgggatcaaagtctaaagccatgtgtaaagttaactcctctctgcgttactttaaattgtaccaatgct

SEQ ID NO: 181545 - DNA, 75 bp, Artificial Sequence
  Synthetic
atagaaggggggcaattacaagcagcaatactggagctactaatcctgacttggcctgggtggaagcacaagagg

SEQ ID NO: 181546 - DNA, 75 bp, Artificial Sequence
  Synthetic
aggatggggaagtaggctttccagtcagacctcaggtaccgccgagaccaatgacttataagggagctctagatc

SEQ ID NO: 181547 - DNA, 75 bp, Artificial Sequence
  Synthetic
acatatcaaattggctgtggtatataagaatattcataatgatagtaggaggcttgataggtttaagaataattt

SEQ ID NO: 181548 - DNA, 75 bp, Artificial Sequence
  Synthetic
caatttaagaataaaacaatagtctttaatcaatcctcaggaggggacccagaaattgtaatgcacagttttaat

SEQ ID NO: 181549 - DNA, 75 bp, Artificial Sequence
  Synthetic
gaaggattgcaggaatggaagacaggcaaattttttagggaagtactggcctccggggggcgagaggccaggcaa

SEQ ID NO: 181550 - DNA, 75 bp, Artificial Sequence
  Synthetic
caaaaatgatagggggtataggaggctttataaaggtaaaagaatataaagatgtgacagtagaaatagaaggaa

SEQ ID NO: 181551 - DNA, 75 bp, Artificial Sequence
  Synthetic
caaaaatgatagggggtataggaggctttataaaggtaaaagaatataatgatgtgacagtagaaatagaaggaa

SEQ ID NO: 181552 - DNA, 75 bp, Artificial Sequence
  Synthetic
caaaaatgatagggggtataggaggctttataaaggtaaaagaatataacgatgtgacagtagaaatagaaggaa

SEQ ID NO: 181553 - DNA, 75 bp, Artificial Sequence
  Synthetic
caaaaatgatagggggtataggaggctttataaaggtaaaagaatataaggatgtgacagtagaaatagaaggaa

SEQ ID NO: 181554 - DNA, 75 bp, Artificial Sequence
  Synthetic
aagaaaaagtgtacatataggaccagggcaagctttctatgcaacagatgacataataggagatataagacaagc

SEQ ID NO: 181555 - DNA, 75 bp, Artificial Sequence
  Synthetic
atatgtcaggaaatagagcaagaaggaaaaatttcaagaatagggcctaaaaatccttataatacacctatcttt

SEQ ID NO: 181556 - DNA, 75 bp, Artificial Sequence
  Synthetic
atatgtcaggaaatagagcaagaaggaaaaatttcaagaatagggccttaaaatccttataatacacctatcttt

SEQ ID NO: 181557 - DNA, 75 bp, Artificial Sequence
  Synthetic
atatgtcaggaaatagagcaagaaggaaaaatttcaagaatagggcctcaaaatccttataatacacctatcttt

SEQ ID NO: 181558 - DNA, 75 bp, Artificial Sequence
  Synthetic
atatgtcaggaaatagagcaagaaggaaaaatttcaagaatagggcctgaaaatccttataatacacctatcttt

SEQ ID NO: 181559 - DNA, 75 bp, Artificial Sequence
  Synthetic
atatgtcaggaaattgagcaagaaggaaaaatttcaagaatagggcctaaaaatccttataatacacctatcttt

SEQ ID NO: 181560 - DNA, 75 bp, Artificial Sequence
  Synthetic
atatgtcaggaaattgagcaagaaggaaaaatttcaagaatagggccttaaaatccttataatacacctatcttt

SEQ ID NO: 181561 - DNA, 75 bp, Artificial Sequence
  Synthetic
atatgtcaggaaattgagcaagaaggaaaaatttcaagaatagggcctcaaaatccttataatacacctatcttt

SEQ ID NO: 181562 - DNA, 75 bp, Artificial Sequence
  Synthetic
atatgtcaggaaattgagcaagaaggaaaaatttcaagaatagggcctgaaaatccttataatacacctatcttt

SEQ ID NO: 181563 - DNA, 75 bp, Artificial Sequence
  Synthetic
atatgtcaggaaatcgagcaagaaggaaaaatttcaagaatagggcctaaaaatccttataatacacctatcttt

SEQ ID NO: 181564 - DNA, 75 bp, Artificial Sequence
  Synthetic
atatgtcaggaaatcgagcaagaaggaaaaatttcaagaatagggccttaaaatccttataatacacctatcttt

SEQ ID NO: 181565 - DNA, 75 bp, Artificial Sequence
  Synthetic
atatgtcaggaaatcgagcaagaaggaaaaatttcaagaatagggcctcaaaatccttataatacacctatcttt

SEQ ID NO: 181566 - DNA, 75 bp, Artificial Sequence
  Synthetic
atatgtcaggaaatcgagcaagaaggaaaaatttcaagaatagggcctgaaaatccttataatacacctatcttt

SEQ ID NO: 181567 - DNA, 75 bp, Artificial Sequence
  Synthetic
atatgtcaggaaatggagcaagaaggaaaaatttcaagaatagggcctaaaaatccttataatacacctatcttt

SEQ ID NO: 181568 - DNA, 75 bp, Artificial Sequence
  Synthetic
atatgtcaggaaatggagcaagaaggaaaaatttcaagaatagggccttaaaatccttataatacacctatcttt

SEQ ID NO: 181569 - DNA, 75 bp, Artificial Sequence
  Synthetic
atatgtcaggaaatggagcaagaaggaaaaatttcaagaatagggcctcaaaatccttataatacacctatcttt

SEQ ID NO: 181570 - DNA, 75 bp, Artificial Sequence
  Synthetic
atatgtcaggaaatggagcaagaaggaaaaatttcaagaatagggcctgaaaatccttataatacacctatcttt

SEQ ID NO: 181571 - DNA, 75 bp, Artificial Sequence
  Synthetic
atgggtggcaaatggtcaaaaagtagtatagttggatggcctgctataagggaaagaataagaagaactgatcca

SEQ ID NO: 181572 - DNA, 75 bp, Artificial Sequence
  Synthetic
gtggatggggtatgagctccacccagacaagtggacagtacagccgatccaattgccaaacaaagaagtgtggac

SEQ ID NO: 181573 - DNA, 75 bp, Artificial Sequence
  Synthetic
gtggatggggtatgagctccacccagacaagtggacagtacagccgatccaattgcctaacaaagaagtgtggac

SEQ ID NO: 181574 - DNA, 75 bp, Artificial Sequence
  Synthetic
gtggatggggtatgagctccacccagacaagtggacagtacagccgatccaattgcccaacaaagaagtgtggac

SEQ ID NO: 181575 - DNA, 75 bp, Artificial Sequence
  Synthetic
gtggatggggtatgagctccacccagacaagtggacagtacagccgatccaattgccgaacaaagaagtgtggac

SEQ ID NO: 181576 - DNA, 75 bp, Artificial Sequence
  Synthetic
ggaaaattaaattgggcaagtcaaatctatcaaggaattagagtaaaagaattgtgtaaattaatcagaggaacc

SEQ ID NO: 181577 - DNA, 75 bp, Artificial Sequence
  Synthetic
ggaaaattaaattgggcaagtcaaatctatcaaggaattagagtaaatgaattgtgtaaattaatcagaggaacc

SEQ ID NO: 181578 - DNA, 75 bp, Artificial Sequence
  Synthetic
ggaaaattaaattgggcaagtcaaatctatcaaggaattagagtaaacgaattgtgtaaattaatcagaggaacc

SEQ ID NO: 181579 - DNA, 75 bp, Artificial Sequence
  Synthetic
ggaaaattaaattgggcaagtcaaatctatcaaggaattagagtaaaggaattgtgtaaattaatcagaggaacc

SEQ ID NO: 181580 - DNA, 75 bp, Artificial Sequence
  Synthetic
attcaaaattttcgggtttattacagagacagcagagatcctatttggaaaggaccagccaaactactctggaaa

SEQ ID NO: 181581 - DNA, 75 bp, Artificial Sequence
  Synthetic
atggaaaggatcaccagcaatattccaaagtagcatgacaaaaatcttagagccttttagaaaacaaaatccaga

SEQ ID NO: 181582 - DNA, 75 bp, Artificial Sequence
  Synthetic
atatcaaagcagtaagtatatgtaatgttagagttaacagcaagagtagattatagattaggagtaggagcattg

SEQ ID NO: 181583 - DNA, 75 bp, Artificial Sequence
  Synthetic
aacctgacaaagacttatgggttaacatacagaagcaaggagaagggcaatggtcttaccaggtataccaggatg

SEQ ID NO: 181584 - DNA, 75 bp, Artificial Sequence
  Synthetic
aacctgacaaagacttatgggttaacattcagaagcaaggagaagggcaatggtcttaccaggtataccaggatg

SEQ ID NO: 181585 - DNA, 75 bp, Artificial Sequence
  Synthetic
aacctgacaaagacttatgggttaacatccagaagcaaggagaagggcaatggtcttaccaggtataccaggatg

SEQ ID NO: 181586 - DNA, 75 bp, Artificial Sequence
  Synthetic
aacctgacaaagacttatgggttaacatgcagaagcaaggagaagggcaatggtcttaccaggtataccaggatg

SEQ ID NO: 181587 - DNA, 75 bp, Artificial Sequence
  Synthetic
ggggacagctaagggaagctctattagatacaggagcagatgatacagtattagaagacataaatttgccaggaa

SEQ ID NO: 181588 - DNA, 75 bp, Artificial Sequence
  Synthetic
cctaaatttaagctgccagtcactagagaaacttgggaaacatggtgggcagattattggcaagccacctggatt

SEQ ID NO: 181589 - DNA, 75 bp, Artificial Sequence
  Synthetic
gagaaacttgggaaacatggtgggcagattattggcaagccacctggattcctgaatgggaatttgtcagcacac

SEQ ID NO: 181590 - DNA, 75 bp, Artificial Sequence
  Synthetic
agattattggcaagccacctggattcctgaatgggaatttgtcagcacacccccattgatcaaattatggtatca

SEQ ID NO: 181591 - DNA, 75 bp, Artificial Sequence
  Synthetic
gttactgatactactacaggaataaaaaattgctctttcaatgcaaccacagaagtaaatgataggaaagagaaa

SEQ ID NO: 181592 - DNA, 75 bp, Artificial Sequence
  Synthetic
tagtaacagattcacaatatgtattaggcatcatatcctcccaacctacacagagtgactcccctatagttcaac

SEQ ID NO: 181593 - DNA, 75 bp, Artificial Sequence
  Synthetic
tagtaacagattcacaatatgtatttggcatcatatcctcccaacctacacagagtgactcccctatagttcaac

SEQ ID NO: 181594 - DNA, 75 bp, Artificial Sequence
  Synthetic
tagtaacagattcacaatatgtattcggcatcatatcctcccaacctacacagagtgactcccctatagttcaac

SEQ ID NO: 181595 - DNA, 75 bp, Artificial Sequence
  Synthetic
tagtaacagattcacaatatgtattgggcatcatatcctcccaacctacacagagtgactcccctatagttcaac

SEQ ID NO: 181596 - DNA, 75 bp, Artificial Sequence
  Synthetic
gcctaattttacaagtgcaaccatgaaagctgcatgttggtggacaggcatacaacatgagtttagaataccata

SEQ ID NO: 181597 - DNA, 75 bp, Artificial Sequence
  Synthetic
gcctaattttacaagtgcaaccatgaaagctgcatgttggtggacaggcatacaacatgagttttgaataccata

SEQ ID NO: 181598 - DNA, 75 bp, Artificial Sequence
  Synthetic
gcctaattttacaagtgcaaccatgaaagctgcatgttggtggacaggcatacaacatgagtttcgaataccata

SEQ ID NO: 181599 - DNA, 75 bp, Artificial Sequence
  Synthetic
gcctaattttacaagtgcaaccatgaaagctgcatgttggtggacaggcatacaacatgagtttggaataccata

SEQ ID NO: 181600 - DNA, 75 bp, Artificial Sequence
  Synthetic
caacagaactacaaaaacaaattttaaaaattcaaaattttcgggtctattacagagacagcagagaccctattt

SEQ ID NO: 181601 - DNA, 75 bp, Artificial Sequence
  Synthetic
tgtgtaaagttgaccccactctgtgtcactttaaattgtacaaatgtaacagtagttaatgctacacatactaat

SEQ ID NO: 181602 - DNA, 75 bp, Artificial Sequence
  Synthetic
ctgtaaaaattaattgtacaagacccaacaacatatcaaaaagaagaagtatgcatataggaacagggagagtat

SEQ ID NO: 181603 - DNA, 75 bp, Artificial Sequence
  Synthetic
ttttttatagacctgatatagtaccacttagtaaggaaagctctgagtatatattaataagttgcaatacctcaa

SEQ ID NO: 181604 - DNA, 75 bp, Artificial Sequence
  Synthetic
cttcagtttccctcaaatcactctttggcaacgacccattgtcacagtaaaaataggaggacagctgatagaagc

SEQ ID NO: 181605 - DNA, 75 bp, Artificial Sequence
  Synthetic
gtctaagaaggccaaggactggtattatagacatcattatgaaactagaaatccaagaatcagttcaggtgtcta

SEQ ID NO: 181606 - DNA, 75 bp, Artificial Sequence
  Synthetic
gcaggtgatgattgtgtggcaggtagacaggatgaggattagaacatggaacagtttagtaaaacatcatatgta

SEQ ID NO: 181607 - DNA, 75 bp, Artificial Sequence
  Synthetic
agaaatgatgacagcatgtcaaggagtgggaggacctggccacaaagcaagagtgttggctgaggcaatgagcca

SEQ ID NO: 181608 - DNA, 75 bp, Artificial Sequence
  Synthetic
aaaaacaagtagacctccagtacccagtgtccagaagttaacaggagataggtggaacaggtgtcagaagatcaa

SEQ ID NO: 181609 - DNA, 75 bp, Artificial Sequence
  Synthetic
tagtaacaccaacaaaggcaaagccacctttgcctagtgttaggaaattaacagaagatagatggaacaagcccc

SEQ ID NO: 181610 - DNA, 75 bp, Artificial Sequence
  Synthetic
aaatatggaaggagaaatacaaaactgttctttcaatataaccacagaattgggagataagagacggaaagaaaa

SEQ ID NO: 181611 - DNA, 75 bp, Artificial Sequence
  Synthetic
gctaaaaacagaagcagtaaggcattttcccaggccttggttacatggattgggacaatacatttatgaaactta

SEQ ID NO: 181612 - DNA, 75 bp, Artificial Sequence
  Synthetic
gacagagaacaatagacagattaattgatagaataagagaaagagcagaagatagtgaaaatgaaagtgaagggg

SEQ ID NO: 181613 - DNA, 75 bp, Artificial Sequence
  Synthetic
ggtacaggccagacaattattgtctggtatagtgcaacagcagaacaatctgctgagagctattgaggcgcaaca

SEQ ID NO: 181614 - DNA, 75 bp, Artificial Sequence
  Synthetic
ttcctatacattattgtgctccagctggttttgcgattctaaagtgtaataataagacattcaatggaacaggac

SEQ ID NO: 181615 - DNA, 75 bp, Artificial Sequence
  Synthetic
aatgccaaaacaataatagtacatcttaatgaatctgtagagattgtgtgtataagacccaacaataatacaaga

SEQ ID NO: 181616 - DNA, 75 bp, Artificial Sequence
  Synthetic
gctatcattgcattgtttgtttcacaaagaagggtttgggaatctcctatggcaggaagaagcggcgaagaccaa

SEQ ID NO: 181617 - DNA, 75 bp, Artificial Sequence
  Synthetic
agtaggagcagaaactttctatgtagatggggcagctaatagggaaactaagctaggaaaagcagggtatgtcac

SEQ ID NO: 181618 - DNA, 75 bp, Artificial Sequence
  Synthetic
agtgggaaagagaaattgacaattacacagaccacatatacaacttacttgaaaaatcgcaaaaccagcaggaaa

SEQ ID NO: 181619 - DNA, 75 bp, Artificial Sequence
  Synthetic
tttgtttcttacaaccgcgcttatatggatgtttgtgcttaaactttgcttagaacaaaagagacaaggaaaaag

SEQ ID NO: 181620 - DNA, 75 bp, Artificial Sequence
  Synthetic
aaacacaaaaaaatacaaaggatacttgatagaaaaaaaaaaagataagaaaacagtgcaaatggaagtgaaggg

SEQ ID NO: 181621 - DNA, 75 bp, Artificial Sequence
  Synthetic
aaacacaaaaaaatacaaaggatacttgatagaaaaaaaaaaagataagaaaactgtgcaaatggaagtgaaggg

SEQ ID NO: 181622 - DNA, 75 bp, Artificial Sequence
  Synthetic
aaacacaaaaaaatacaaaggatacttgatagaaaaaaaaaaagataagaaaaccgtgcaaatggaagtgaaggg

SEQ ID NO: 181623 - DNA, 75 bp, Artificial Sequence
  Synthetic
aaacacaaaaaaatacaaaggatacttgatagaaaaaaaaaaagataagaaaacggtgcaaatggaagtgaaggg

SEQ ID NO: 181624 - DNA, 75 bp, Artificial Sequence
  Synthetic
aaacacaaaaaaatacaaaggatacttgatagaaaaaaaaaaagataagaatacagtgcaaatggaagtgaaggg

SEQ ID NO: 181625 - DNA, 75 bp, Artificial Sequence
  Synthetic
aaacacaaaaaaatacaaaggatacttgatagaaaaaaaaaaagataagaatactgtgcaaatggaagtgaaggg

SEQ ID NO: 181626 - DNA, 75 bp, Artificial Sequence
  Synthetic
aaacacaaaaaaatacaaaggatacttgatagaaaaaaaaaaagataagaataccgtgcaaatggaagtgaaggg

SEQ ID NO: 181627 - DNA, 75 bp, Artificial Sequence
  Synthetic
aaacacaaaaaaatacaaaggatacttgatagaaaaaaaaaaagataagaatacggtgcaaatggaagtgaaggg

SEQ ID NO: 181628 - DNA, 75 bp, Artificial Sequence
  Synthetic
aaacacaaaaaaatacaaaggatacttgatagaaaaaaaaaaagataagaacacagtgcaaatggaagtgaaggg

SEQ ID NO: 181629 - DNA, 75 bp, Artificial Sequence
  Synthetic
aaacacaaaaaaatacaaaggatacttgatagaaaaaaaaaaagataagaacactgtgcaaatggaagtgaaggg

SEQ ID NO: 181630 - DNA, 75 bp, Artificial Sequence
  Synthetic
aaacacaaaaaaatacaaaggatacttgatagaaaaaaaaaaagataagaacaccgtgcaaatggaagtgaaggg

SEQ ID NO: 181631 - DNA, 75 bp, Artificial Sequence
  Synthetic
aaacacaaaaaaatacaaaggatacttgatagaaaaaaaaaaagataagaacacggtgcaaatggaagtgaaggg

SEQ ID NO: 181632 - DNA, 75 bp, Artificial Sequence
  Synthetic
aaacacaaaaaaatacaaaggatacttgatagaaaaaaaaaaagataagaagacagtgcaaatggaagtgaaggg

SEQ ID NO: 181633 - DNA, 75 bp, Artificial Sequence
  Synthetic
aaacacaaaaaaatacaaaggatacttgatagaaaaaaaaaaagataagaagactgtgcaaatggaagtgaaggg

SEQ ID NO: 181634 - DNA, 75 bp, Artificial Sequence
  Synthetic
aaacacaaaaaaatacaaaggatacttgatagaaaaaaaaaaagataagaagaccgtgcaaatggaagtgaaggg

SEQ ID NO: 181635 - DNA, 75 bp, Artificial Sequence
  Synthetic
aaacacaaaaaaatacaaaggatacttgatagaaaaaaaaaaagataagaagacggtgcaaatggaagtgaaggg

SEQ ID NO: 181636 - DNA, 75 bp, Artificial Sequence
  Synthetic
aaacacaaaaaaatacaaaggatacttgatagaaaaaaataaagataagaaaacagtgcaaatggaagtgaaggg

SEQ ID NO: 181637 - DNA, 75 bp, Artificial Sequence
  Synthetic
aaacacaaaaaaatacaaaggatacttgatagaaaaaaataaagataagaaaactgtgcaaatggaagtgaaggg

SEQ ID NO: 181638 - DNA, 75 bp, Artificial Sequence
  Synthetic
aaacacaaaaaaatacaaaggatacttgatagaaaaaaataaagataagaaaaccgtgcaaatggaagtgaaggg

SEQ ID NO: 181639 - DNA, 75 bp, Artificial Sequence
  Synthetic
aaacacaaaaaaatacaaaggatacttgatagaaaaaaataaagataagaaaacggtgcaaatggaagtgaaggg

SEQ ID NO: 181640 - DNA, 75 bp, Artificial Sequence
  Synthetic
aaacacaaaaaaatacaaaggatacttgatagaaaaaaataaagataagaatacagtgcaaatggaagtgaaggg

SEQ ID NO: 181641 - DNA, 75 bp, Artificial Sequence
  Synthetic
aaacacaaaaaaatacaaaggatacttgatagaaaaaaataaagataagaatactgtgcaaatggaagtgaaggg

SEQ ID NO: 181642 - DNA, 75 bp, Artificial Sequence
  Synthetic
aaacacaaaaaaatacaaaggatacttgatagaaaaaaataaagataagaataccgtgcaaatggaagtgaaggg

SEQ ID NO: 181643 - DNA, 75 bp, Artificial Sequence
  Synthetic
aaacacaaaaaaatacaaaggatacttgatagaaaaaaataaagataagaatacggtgcaaatggaagtgaaggg

SEQ ID NO: 181644 - DNA, 75 bp, Artificial Sequence
  Synthetic
aaacacaaaaaaatacaaaggatacttgatagaaaaaaataaagataagaacacagtgcaaatggaagtgaaggg

SEQ ID NO: 181645 - DNA, 75 bp, Artificial Sequence
  Synthetic
aaacacaaaaaaatacaaaggatacttgatagaaaaaaataaagataagaacactgtgcaaatggaagtgaaggg

SEQ ID NO: 181646 - DNA, 75 bp, Artificial Sequence
  Synthetic
aaacacaaaaaaatacaaaggatacttgatagaaaaaaataaagataagaacaccgtgcaaatggaagtgaaggg

SEQ ID NO: 181647 - DNA, 75 bp, Artificial Sequence
  Synthetic
aaacacaaaaaaatacaaaggatacttgatagaaaaaaataaagataagaacacggtgcaaatggaagtgaaggg

SEQ ID NO: 181648 - DNA, 75 bp, Artificial Sequence
  Synthetic
aaacacaaaaaaatacaaaggatacttgatagaaaaaaataaagataagaagacagtgcaaatggaagtgaaggg

SEQ ID NO: 181649 - DNA, 75 bp, Artificial Sequence
  Synthetic
aaacacaaaaaaatacaaaggatacttgatagaaaaaaataaagataagaagactgtgcaaatggaagtgaaggg

SEQ ID NO: 181650 - DNA, 75 bp, Artificial Sequence
  Synthetic
aaacacaaaaaaatacaaaggatacttgatagaaaaaaataaagataagaagaccgtgcaaatggaagtgaaggg

SEQ ID NO: 181651 - DNA, 75 bp, Artificial Sequence
  Synthetic
aaacacaaaaaaatacaaaggatacttgatagaaaaaaataaagataagaagacggtgcaaatggaagtgaaggg

SEQ ID NO: 181652 - DNA, 75 bp, Artificial Sequence
  Synthetic
aaacacaaaaaaatacaaaggatacttgatagaaaaaaacaaagataagaaaacagtgcaaatggaagtgaaggg

SEQ ID NO: 181653 - DNA, 75 bp, Artificial Sequence
  Synthetic
aaacacaaaaaaatacaaaggatacttgatagaaaaaaacaaagataagaaaactgtgcaaatggaagtgaaggg

SEQ ID NO: 181654 - DNA, 75 bp, Artificial Sequence
  Synthetic
aaacacaaaaaaatacaaaggatacttgatagaaaaaaacaaagataagaaaaccgtgcaaatggaagtgaaggg

SEQ ID NO: 181655 - DNA, 75 bp, Artificial Sequence
  Synthetic
aaacacaaaaaaatacaaaggatacttgatagaaaaaaacaaagataagaaaacggtgcaaatggaagtgaaggg

SEQ ID NO: 181656 - DNA, 75 bp, Artificial Sequence
  Synthetic
aaacacaaaaaaatacaaaggatacttgatagaaaaaaacaaagataagaatacagtgcaaatggaagtgaaggg

SEQ ID NO: 181657 - DNA, 75 bp, Artificial Sequence
  Synthetic
aaacacaaaaaaatacaaaggatacttgatagaaaaaaacaaagataagaatactgtgcaaatggaagtgaaggg

SEQ ID NO: 181658 - DNA, 75 bp, Artificial Sequence
  Synthetic
aaacacaaaaaaatacaaaggatacttgatagaaaaaaacaaagataagaataccgtgcaaatggaagtgaaggg

SEQ ID NO: 181659 - DNA, 75 bp, Artificial Sequence
  Synthetic
aaacacaaaaaaatacaaaggatacttgatagaaaaaaacaaagataagaatacggtgcaaatggaagtgaaggg

SEQ ID NO: 181660 - DNA, 75 bp, Artificial Sequence
  Synthetic
aaacacaaaaaaatacaaaggatacttgatagaaaaaaacaaagataagaacacagtgcaaatggaagtgaaggg

SEQ ID NO: 181661 - DNA, 75 bp, Artificial Sequence
  Synthetic
aaacacaaaaaaatacaaaggatacttgatagaaaaaaacaaagataagaacactgtgcaaatggaagtgaaggg

SEQ ID NO: 181662 - DNA, 75 bp, Artificial Sequence
  Synthetic
aaacacaaaaaaatacaaaggatacttgatagaaaaaaacaaagataagaacaccgtgcaaatggaagtgaaggg

SEQ ID NO: 181663 - DNA, 75 bp, Artificial Sequence
  Synthetic
aaacacaaaaaaatacaaaggatacttgatagaaaaaaacaaagataagaacacggtgcaaatggaagtgaaggg

SEQ ID NO: 181664 - DNA, 75 bp, Artificial Sequence
  Synthetic
aaacacaaaaaaatacaaaggatacttgatagaaaaaaacaaagataagaagacagtgcaaatggaagtgaaggg

SEQ ID NO: 181665 - DNA, 75 bp, Artificial Sequence
  Synthetic
aaacacaaaaaaatacaaaggatacttgatagaaaaaaacaaagataagaagactgtgcaaatggaagtgaaggg

SEQ ID NO: 181666 - DNA, 75 bp, Artificial Sequence
  Synthetic
aaacacaaaaaaatacaaaggatacttgatagaaaaaaacaaagataagaagaccgtgcaaatggaagtgaaggg

SEQ ID NO: 181667 - DNA, 75 bp, Artificial Sequence
  Synthetic
aaacacaaaaaaatacaaaggatacttgatagaaaaaaacaaagataagaagacggtgcaaatggaagtgaaggg

SEQ ID NO: 181668 - DNA, 75 bp, Artificial Sequence
  Synthetic
aaacacaaaaaaatacaaaggatacttgatagaaaaaaagaaagataagaaaacagtgcaaatggaagtgaaggg

SEQ ID NO: 181669 - DNA, 75 bp, Artificial Sequence
  Synthetic
aaacacaaaaaaatacaaaggatacttgatagaaaaaaagaaagataagaaaactgtgcaaatggaagtgaaggg

SEQ ID NO: 181670 - DNA, 75 bp, Artificial Sequence
  Synthetic
aaacacaaaaaaatacaaaggatacttgatagaaaaaaagaaagataagaaaaccgtgcaaatggaagtgaaggg

SEQ ID NO: 181671 - DNA, 75 bp, Artificial Sequence
  Synthetic
aaacacaaaaaaatacaaaggatacttgatagaaaaaaagaaagataagaaaacggtgcaaatggaagtgaaggg

SEQ ID NO: 181672 - DNA, 75 bp, Artificial Sequence
  Synthetic
aaacacaaaaaaatacaaaggatacttgatagaaaaaaagaaagataagaatacagtgcaaatggaagtgaaggg

SEQ ID NO: 181673 - DNA, 75 bp, Artificial Sequence
  Synthetic
aaacacaaaaaaatacaaaggatacttgatagaaaaaaagaaagataagaatactgtgcaaatggaagtgaaggg

SEQ ID NO: 181674 - DNA, 75 bp, Artificial Sequence
  Synthetic
aaacacaaaaaaatacaaaggatacttgatagaaaaaaagaaagataagaataccgtgcaaatggaagtgaaggg

SEQ ID NO: 181675 - DNA, 75 bp, Artificial Sequence
  Synthetic
aaacacaaaaaaatacaaaggatacttgatagaaaaaaagaaagataagaatacggtgcaaatggaagtgaaggg

SEQ ID NO: 181676 - DNA, 75 bp, Artificial Sequence
  Synthetic
aaacacaaaaaaatacaaaggatacttgatagaaaaaaagaaagataagaacacagtgcaaatggaagtgaaggg

SEQ ID NO: 181677 - DNA, 75 bp, Artificial Sequence
  Synthetic
aaacacaaaaaaatacaaaggatacttgatagaaaaaaagaaagataagaacactgtgcaaatggaagtgaaggg

SEQ ID NO: 181678 - DNA, 75 bp, Artificial Sequence
  Synthetic
aaacacaaaaaaatacaaaggatacttgatagaaaaaaagaaagataagaacaccgtgcaaatggaagtgaaggg

SEQ ID NO: 181679 - DNA, 75 bp, Artificial Sequence
  Synthetic
aaacacaaaaaaatacaaaggatacttgatagaaaaaaagaaagataagaacacggtgcaaatggaagtgaaggg

SEQ ID NO: 181680 - DNA, 75 bp, Artificial Sequence
  Synthetic
aaacacaaaaaaatacaaaggatacttgatagaaaaaaagaaagataagaagacagtgcaaatggaagtgaaggg

SEQ ID NO: 181681 - DNA, 75 bp, Artificial Sequence
  Synthetic
aaacacaaaaaaatacaaaggatacttgatagaaaaaaagaaagataagaagactgtgcaaatggaagtgaaggg

SEQ ID NO: 181682 - DNA, 75 bp, Artificial Sequence
  Synthetic
aaacacaaaaaaatacaaaggatacttgatagaaaaaaagaaagataagaagaccgtgcaaatggaagtgaaggg

SEQ ID NO: 181683 - DNA, 75 bp, Artificial Sequence
  Synthetic
aaacacaaaaaaatacaaaggatacttgatagaaaaaaagaaagataagaagacggtgcaaatggaagtgaaggg

SEQ ID NO: 181684 - DNA, 75 bp, Artificial Sequence
  Synthetic
tagaacaaaagagacaaggaaaaagggaaagagaaatacttgatagattaagaagaataagagaaatcagggatg

SEQ ID NO: 181685 - DNA, 75 bp, Artificial Sequence
  Synthetic
tagaacaaaagagacaaggaaaaagggaaagagaaatacttgatagattaagaagaataagagatatcagggatg

SEQ ID NO: 181686 - DNA, 75 bp, Artificial Sequence
  Synthetic
tagaacaaaagagacaaggaaaaagggaaagagaaatacttgatagattaagaagaataagagacatcagggatg

SEQ ID NO: 181687 - DNA, 75 bp, Artificial Sequence
  Synthetic
tagaacaaaagagacaaggaaaaagggaaagagaaatacttgatagattaagaagaataagagagatcagggatg

SEQ ID NO: 181688 - DNA, 75 bp, Artificial Sequence
  Synthetic
tagaacaaaagagacaaggaaaaagggaaagagaaatacttgatagattaagaagaataagtgaaatcagggatg

SEQ ID NO: 181689 - DNA, 75 bp, Artificial Sequence
  Synthetic
tagaacaaaagagacaaggaaaaagggaaagagaaatacttgatagattaagaagaataagtgatatcagggatg

SEQ ID NO: 181690 - DNA, 75 bp, Artificial Sequence
  Synthetic
tagaacaaaagagacaaggaaaaagggaaagagaaatacttgatagattaagaagaataagtgacatcagggatg

SEQ ID NO: 181691 - DNA, 75 bp, Artificial Sequence
  Synthetic
tagaacaaaagagacaaggaaaaagggaaagagaaatacttgatagattaagaagaataagtgagatcagggatg

SEQ ID NO: 181692 - DNA, 75 bp, Artificial Sequence
  Synthetic
tagaacaaaagagacaaggaaaaagggaaagagaaatacttgatagattaagaagaataagcgaaatcagggatg

SEQ ID NO: 181693 - DNA, 75 bp, Artificial Sequence
  Synthetic
tagaacaaaagagacaaggaaaaagggaaagagaaatacttgatagattaagaagaataagcgatatcagggatg

SEQ ID NO: 181694 - DNA, 75 bp, Artificial Sequence
  Synthetic
tagaacaaaagagacaaggaaaaagggaaagagaaatacttgatagattaagaagaataagcgacatcagggatg

SEQ ID NO: 181695 - DNA, 75 bp, Artificial Sequence
  Synthetic
tagaacaaaagagacaaggaaaaagggaaagagaaatacttgatagattaagaagaataagcgagatcagggatg

SEQ ID NO: 181696 - DNA, 75 bp, Artificial Sequence
  Synthetic
tagaacaaaagagacaaggaaaaagggaaagagaaatacttgatagattaagaagaataagggaaatcagggatg

SEQ ID NO: 181697 - DNA, 75 bp, Artificial Sequence
  Synthetic
tagaacaaaagagacaaggaaaaagggaaagagaaatacttgatagattaagaagaataagggatatcagggatg

SEQ ID NO: 181698 - DNA, 75 bp, Artificial Sequence
  Synthetic
tagaacaaaagagacaaggaaaaagggaaagagaaatacttgatagattaagaagaataagggacatcagggatg

SEQ ID NO: 181699 - DNA, 75 bp, Artificial Sequence
  Synthetic
tagaacaaaagagacaaggaaaaagggaaagagaaatacttgatagattaagaagaataagggagatcagggatg

SEQ ID NO: 181700 - DNA, 75 bp, Artificial Sequence
  Synthetic
acttagataaacatggagcacttacaagcagcaacacagcccacaataatgctgattgtgcctggctggaagcac

SEQ ID NO: 181701 - DNA, 75 bp, Artificial Sequence
  Synthetic
ttataaacatgtggcagaaggtaggacgagcaatgtatgcccctcccattgcaggaaacataacatgtagatcaa

SEQ ID NO: 181702 - DNA, 75 bp, Artificial Sequence
  Synthetic
taacaagcactgagcagcataatatttgggcatcacaagcctgcgttcccacagatcccagtccaaatgagtatg

SEQ ID NO: 181703 - DNA, 75 bp, Artificial Sequence
  Synthetic
agtaacaatactgctaatgccaatagtagtagcctagaaatgatgatagagaaaggagaaataaaaaactgctct

SEQ ID NO: 181704 - DNA, 75 bp, Artificial Sequence
  Synthetic
ttgtgtgcaaatgactttcttatgtgtgcaaatgaactgtacagatgtaaaagacaatacaacaaacacaacaac

SEQ ID NO: 181705 - DNA, 75 bp, Artificial Sequence
  Synthetic
aagacaatacaacaaacacaacaaccgcaaagacaacaaacccagaggaagagaccaatccggtaaaaaaatgtg

SEQ ID NO: 181706 - DNA, 75 bp, Artificial Sequence
  Synthetic
agaagaaaatagacaggttacttgatagaataagagaaagagcagaagatagtggcaatgagagtgatggggata

SEQ ID NO: 181707 - DNA, 75 bp, Artificial Sequence
  Synthetic
tacattaattaattgtaattcctcaaccatcaagcaagcctgtccaaaggtaacttttgagcccattcccataca

SEQ ID NO: 181708 - DNA, 75 bp, Artificial Sequence
  Synthetic
tgctgtgtcttggaactctagttggagtaataaaactcaggatgacatttggaagaaaatgacctggatgcaatg

SEQ ID NO: 181709 - DNA, 75 bp, Artificial Sequence
  Synthetic
gacgcagcagtctcaggggactacagagggggtgggaagcccttaagtatctgggaagtcttgtgcagtattggg

SEQ ID NO: 181710 - DNA, 75 bp, Artificial Sequence
  Synthetic
ctactggaaccaataataatactgaagccagtaataatactagtttaaggatggaacaaggagaactaaaaaact

SEQ ID NO: 181711 - DNA, 75 bp, Artificial Sequence
  Synthetic
ggcatcaagccaacagtaagcactcacctaatatttaatgggacaatctctaaaggaaaaataagaattatggca

SEQ ID NO: 181712 - DNA, 75 bp, Artificial Sequence
  Synthetic
aaaagacaccaaggaagctttagacaaaatagaggaggagcaaagcaaaagtaagaaaaaggcacagcaagcagc

SEQ ID NO: 181713 - DNA, 75 bp, Artificial Sequence
  Synthetic
gaataggtccaatggcttggtacagtatgggacttgggaacgggtatacaaatagatcaagaatagctttttgta

SEQ ID NO: 181714 - DNA, 75 bp, Artificial Sequence
  Synthetic
gaagggcttaggcatctcctatggcaggaagaagcggagacagcgacacagacacagaactcctcaagacagtaa

SEQ ID NO: 181715 - DNA, 75 bp, Artificial Sequence
  Synthetic
cagcactgatggagatatcgaagtaacccatttgcattttaactgtcatggagaattcttttattgtaacacaaa

SEQ ID NO: 181716 - DNA, 75 bp, Artificial Sequence
  Synthetic
cacatcccactaggagaagctagactggtagtaaaaacatattggggtctgcatacaggagaaagagaatggcat

SEQ ID NO: 181717 - DNA, 75 bp, Artificial Sequence
  Synthetic
tggtagtaaaaacatattggggtctgcatacaggagaaagagaatggcatctgggtcagggagtctccatagaat

SEQ ID NO: 181718 - DNA, 75 bp, Artificial Sequence
  Synthetic
ttgagacaggtagtaaggtcatggatgaggggagggtcaggcctctatgcacctcctatcaaaggtagtctaacc

SEQ ID NO: 181719 - DNA, 75 bp, Artificial Sequence
  Synthetic
aggaacagataggattatagaaataatacaaagaatttgtagagctatctgcaacatacctacaagaataagaca

SEQ ID NO: 181720 - DNA, 75 bp, Artificial Sequence
  Synthetic
atatgaaggacaattggagaagtgaattatataaatataaagtagtaaaaattgaaccattaggggtagcaccca

SEQ ID NO: 181721 - DNA, 75 bp, Artificial Sequence
  Synthetic
gcaacatacctacaagaataagacagggctttgaagcagctttgcaataaaatggggggcaagtggtcaaaaagc

SEQ ID NO: 181722 - DNA, 75 bp, Artificial Sequence
  Synthetic
gaaagaaatgaaaaggatttattagcattggacagttggaaaaatctatggaattggtttaacatatcaaattgg

SEQ ID NO: 181723 - DNA, 75 bp, Artificial Sequence
  Synthetic
aagaaactccagcaaccccaacatcacatttagaccaacaggaggagatatgaaagatatatggagaacccaatt

SEQ ID NO: 181724 - DNA, 75 bp, Artificial Sequence
  Synthetic
aagaaactccagcaaccccaacatcacatttagaccaacaggaggagatatgaatgatatatggagaacccaatt

SEQ ID NO: 181725 - DNA, 75 bp, Artificial Sequence
  Synthetic
aagaaactccagcaaccccaacatcacatttagaccaacaggaggagatatgaacgatatatggagaacccaatt

SEQ ID NO: 181726 - DNA, 75 bp, Artificial Sequence
  Synthetic
aagaaactccagcaaccccaacatcacatttagaccaacaggaggagatatgaaggatatatggagaacccaatt

SEQ ID NO: 181727 - DNA, 75 bp, Artificial Sequence
  Synthetic
aagaatctccagcaaccccaacatcacatttagaccaacaggaggagatatgaaagatatatggagaacccaatt

SEQ ID NO: 181728 - DNA, 75 bp, Artificial Sequence
  Synthetic
aagaatctccagcaaccccaacatcacatttagaccaacaggaggagatatgaatgatatatggagaacccaatt

SEQ ID NO: 181729 - DNA, 75 bp, Artificial Sequence
  Synthetic
aagaatctccagcaaccccaacatcacatttagaccaacaggaggagatatgaacgatatatggagaacccaatt

SEQ ID NO: 181730 - DNA, 75 bp, Artificial Sequence
  Synthetic
aagaatctccagcaaccccaacatcacatttagaccaacaggaggagatatgaaggatatatggagaacccaatt

SEQ ID NO: 181731 - DNA, 75 bp, Artificial Sequence
  Synthetic
aagaacctccagcaaccccaacatcacatttagaccaacaggaggagatatgaaagatatatggagaacccaatt

SEQ ID NO: 181732 - DNA, 75 bp, Artificial Sequence
  Synthetic
aagaacctccagcaaccccaacatcacatttagaccaacaggaggagatatgaatgatatatggagaacccaatt

SEQ ID NO: 181733 - DNA, 75 bp, Artificial Sequence
  Synthetic
aagaacctccagcaaccccaacatcacatttagaccaacaggaggagatatgaacgatatatggagaacccaatt

SEQ ID NO: 181734 - DNA, 75 bp, Artificial Sequence
  Synthetic
aagaacctccagcaaccccaacatcacatttagaccaacaggaggagatatgaaggatatatggagaacccaatt

SEQ ID NO: 181735 - DNA, 75 bp, Artificial Sequence
  Synthetic
aagaagctccagcaaccccaacatcacatttagaccaacaggaggagatatgaaagatatatggagaacccaatt

SEQ ID NO: 181736 - DNA, 75 bp, Artificial Sequence
  Synthetic
aagaagctccagcaaccccaacatcacatttagaccaacaggaggagatatgaatgatatatggagaacccaatt

SEQ ID NO: 181737 - DNA, 75 bp, Artificial Sequence
  Synthetic
aagaagctccagcaaccccaacatcacatttagaccaacaggaggagatatgaacgatatatggagaacccaatt

SEQ ID NO: 181738 - DNA, 75 bp, Artificial Sequence
  Synthetic
aagaagctccagcaaccccaacatcacatttagaccaacaggaggagatatgaaggatatatggagaacccaatt

SEQ ID NO: 181739 - DNA, 75 bp, Artificial Sequence
  Synthetic
tagaaactccagcaaccccaacatcacatttagaccaacaggaggagatatgaaagatatatggagaacccaatt

SEQ ID NO: 181740 - DNA, 75 bp, Artificial Sequence
  Synthetic
tagaaactccagcaaccccaacatcacatttagaccaacaggaggagatatgaatgatatatggagaacccaatt

SEQ ID NO: 181741 - DNA, 75 bp, Artificial Sequence
  Synthetic
tagaaactccagcaaccccaacatcacatttagaccaacaggaggagatatgaacgatatatggagaacccaatt

SEQ ID NO: 181742 - DNA, 75 bp, Artificial Sequence
  Synthetic
tagaaactccagcaaccccaacatcacatttagaccaacaggaggagatatgaaggatatatggagaacccaatt

SEQ ID NO: 181743 - DNA, 75 bp, Artificial Sequence
  Synthetic
tagaatctccagcaaccccaacatcacatttagaccaacaggaggagatatgaaagatatatggagaacccaatt

SEQ ID NO: 181744 - DNA, 75 bp, Artificial Sequence
  Synthetic
tagaatctccagcaaccccaacatcacatttagaccaacaggaggagatatgaatgatatatggagaacccaatt

SEQ ID NO: 181745 - DNA, 75 bp, Artificial Sequence
  Synthetic
tagaatctccagcaaccccaacatcacatttagaccaacaggaggagatatgaacgatatatggagaacccaatt

SEQ ID NO: 181746 - DNA, 75 bp, Artificial Sequence
  Synthetic
tagaatctccagcaaccccaacatcacatttagaccaacaggaggagatatgaaggatatatggagaacccaatt

SEQ ID NO: 181747 - DNA, 75 bp, Artificial Sequence
  Synthetic
tagaacctccagcaaccccaacatcacatttagaccaacaggaggagatatgaaagatatatggagaacccaatt

SEQ ID NO: 181748 - DNA, 75 bp, Artificial Sequence
  Synthetic
tagaacctccagcaaccccaacatcacatttagaccaacaggaggagatatgaatgatatatggagaacccaatt

SEQ ID NO: 181749 - DNA, 75 bp, Artificial Sequence
  Synthetic
tagaacctccagcaaccccaacatcacatttagaccaacaggaggagatatgaacgatatatggagaacccaatt

SEQ ID NO: 181750 - DNA, 75 bp, Artificial Sequence
  Synthetic
tagaacctccagcaaccccaacatcacatttagaccaacaggaggagatatgaaggatatatggagaacccaatt

SEQ ID NO: 181751 - DNA, 75 bp, Artificial Sequence
  Synthetic
tagaagctccagcaaccccaacatcacatttagaccaacaggaggagatatgaaagatatatggagaacccaatt

SEQ ID NO: 181752 - DNA, 75 bp, Artificial Sequence
  Synthetic
tagaagctccagcaaccccaacatcacatttagaccaacaggaggagatatgaatgatatatggagaacccaatt

SEQ ID NO: 181753 - DNA, 75 bp, Artificial Sequence
  Synthetic
tagaagctccagcaaccccaacatcacatttagaccaacaggaggagatatgaacgatatatggagaacccaatt

SEQ ID NO: 181754 - DNA, 75 bp, Artificial Sequence
  Synthetic
tagaagctccagcaaccccaacatcacatttagaccaacaggaggagatatgaaggatatatggagaacccaatt

SEQ ID NO: 181755 - DNA, 75 bp, Artificial Sequence
  Synthetic
cagaaactccagcaaccccaacatcacatttagaccaacaggaggagatatgaaagatatatggagaacccaatt

SEQ ID NO: 181756 - DNA, 75 bp, Artificial Sequence
  Synthetic
cagaaactccagcaaccccaacatcacatttagaccaacaggaggagatatgaatgatatatggagaacccaatt

SEQ ID NO: 181757 - DNA, 75 bp, Artificial Sequence
  Synthetic
cagaaactccagcaaccccaacatcacatttagaccaacaggaggagatatgaacgatatatggagaacccaatt

SEQ ID NO: 181758 - DNA, 75 bp, Artificial Sequence
  Synthetic
cagaaactccagcaaccccaacatcacatttagaccaacaggaggagatatgaaggatatatggagaacccaatt

SEQ ID NO: 181759 - DNA, 75 bp, Artificial Sequence
  Synthetic
cagaatctccagcaaccccaacatcacatttagaccaacaggaggagatatgaaagatatatggagaacccaatt

SEQ ID NO: 181760 - DNA, 75 bp, Artificial Sequence
  Synthetic
cagaatctccagcaaccccaacatcacatttagaccaacaggaggagatatgaatgatatatggagaacccaatt

SEQ ID NO: 181761 - DNA, 75 bp, Artificial Sequence
  Synthetic
cagaatctccagcaaccccaacatcacatttagaccaacaggaggagatatgaacgatatatggagaacccaatt

SEQ ID NO: 181762 - DNA, 75 bp, Artificial Sequence
  Synthetic
cagaatctccagcaaccccaacatcacatttagaccaacaggaggagatatgaaggatatatggagaacccaatt

SEQ ID NO: 181763 - DNA, 75 bp, Artificial Sequence
  Synthetic
cagaacctccagcaaccccaacatcacatttagaccaacaggaggagatatgaaagatatatggagaacccaatt

SEQ ID NO: 181764 - DNA, 75 bp, Artificial Sequence
  Synthetic
cagaacctccagcaaccccaacatcacatttagaccaacaggaggagatatgaatgatatatggagaacccaatt

SEQ ID NO: 181765 - DNA, 75 bp, Artificial Sequence
  Synthetic
cagaacctccagcaaccccaacatcacatttagaccaacaggaggagatatgaacgatatatggagaacccaatt

SEQ ID NO: 181766 - DNA, 75 bp, Artificial Sequence
  Synthetic
cagaacctccagcaaccccaacatcacatttagaccaacaggaggagatatgaaggatatatggagaacccaatt

SEQ ID NO: 181767 - DNA, 75 bp, Artificial Sequence
  Synthetic
cagaagctccagcaaccccaacatcacatttagaccaacaggaggagatatgaaagatatatggagaacccaatt

SEQ ID NO: 181768 - DNA, 75 bp, Artificial Sequence
  Synthetic
cagaagctccagcaaccccaacatcacatttagaccaacaggaggagatatgaatgatatatggagaacccaatt

SEQ ID NO: 181769 - DNA, 75 bp, Artificial Sequence
  Synthetic
cagaagctccagcaaccccaacatcacatttagaccaacaggaggagatatgaacgatatatggagaacccaatt

SEQ ID NO: 181770 - DNA, 75 bp, Artificial Sequence
  Synthetic
cagaagctccagcaaccccaacatcacatttagaccaacaggaggagatatgaaggatatatggagaacccaatt

SEQ ID NO: 181771 - DNA, 75 bp, Artificial Sequence
  Synthetic
gagaaactccagcaaccccaacatcacatttagaccaacaggaggagatatgaaagatatatggagaacccaatt

SEQ ID NO: 181772 - DNA, 75 bp, Artificial Sequence
  Synthetic
gagaaactccagcaaccccaacatcacatttagaccaacaggaggagatatgaatgatatatggagaacccaatt

SEQ ID NO: 181773 - DNA, 75 bp, Artificial Sequence
  Synthetic
gagaaactccagcaaccccaacatcacatttagaccaacaggaggagatatgaacgatatatggagaacccaatt

SEQ ID NO: 181774 - DNA, 75 bp, Artificial Sequence
  Synthetic
gagaaactccagcaaccccaacatcacatttagaccaacaggaggagatatgaaggatatatggagaacccaatt

SEQ ID NO: 181775 - DNA, 75 bp, Artificial Sequence
  Synthetic
gagaatctccagcaaccccaacatcacatttagaccaacaggaggagatatgaaagatatatggagaacccaatt

SEQ ID NO: 181776 - DNA, 75 bp, Artificial Sequence
  Synthetic
gagaatctccagcaaccccaacatcacatttagaccaacaggaggagatatgaatgatatatggagaacccaatt

SEQ ID NO: 181777 - DNA, 75 bp, Artificial Sequence
  Synthetic
gagaatctccagcaaccccaacatcacatttagaccaacaggaggagatatgaacgatatatggagaacccaatt

SEQ ID NO: 181778 - DNA, 75 bp, Artificial Sequence
  Synthetic
gagaatctccagcaaccccaacatcacatttagaccaacaggaggagatatgaaggatatatggagaacccaatt

SEQ ID NO: 181779 - DNA, 75 bp, Artificial Sequence
  Synthetic
gagaacctccagcaaccccaacatcacatttagaccaacaggaggagatatgaaagatatatggagaacccaatt

SEQ ID NO: 181780 - DNA, 75 bp, Artificial Sequence
  Synthetic
gagaacctccagcaaccccaacatcacatttagaccaacaggaggagatatgaatgatatatggagaacccaatt

SEQ ID NO: 181781 - DNA, 75 bp, Artificial Sequence
  Synthetic
gagaacctccagcaaccccaacatcacatttagaccaacaggaggagatatgaacgatatatggagaacccaatt

SEQ ID NO: 181782 - DNA, 75 bp, Artificial Sequence
  Synthetic
gagaacctccagcaaccccaacatcacatttagaccaacaggaggagatatgaaggatatatggagaacccaatt

SEQ ID NO: 181783 - DNA, 75 bp, Artificial Sequence
  Synthetic
gagaagctccagcaaccccaacatcacatttagaccaacaggaggagatatgaaagatatatggagaacccaatt

SEQ ID NO: 181784 - DNA, 75 bp, Artificial Sequence
  Synthetic
gagaagctccagcaaccccaacatcacatttagaccaacaggaggagatatgaatgatatatggagaacccaatt

SEQ ID NO: 181785 - DNA, 75 bp, Artificial Sequence
  Synthetic
gagaagctccagcaaccccaacatcacatttagaccaacaggaggagatatgaacgatatatggagaacccaatt

SEQ ID NO: 181786 - DNA, 75 bp, Artificial Sequence
  Synthetic
gagaagctccagcaaccccaacatcacatttagaccaacaggaggagatatgaaggatatatggagaacccaatt

SEQ ID NO: 181787 - DNA, 75 bp, Artificial Sequence
  Synthetic
caggcctaatatacactttacttgaaaaatcgcaaaaccaacaagaaaaaaatgaacaagacttattggcattgg

SEQ ID NO: 181788 - DNA, 75 bp, Artificial Sequence
  Synthetic
tgatcatactcccatgcagaataagacaaattataaacaggtggcagggagtaggaaaagtaatgtatgctcctc

SEQ ID NO: 181789 - DNA, 75 bp, Artificial Sequence
  Synthetic
tcaggaggggatttagaaattacaacacatagttttaattgtggaggagaatttttctattgcaatacatcaaaa

SEQ ID NO: 181790 - DNA, 75 bp, Artificial Sequence
  Synthetic
gaaaggtcagtcaaaattatcctatagtgcagaatctccaagggcaaatggtacatcaagccatatcacctagaa

SEQ ID NO: 181791 - DNA, 75 bp, Artificial Sequence
  Synthetic
atatgaccacagtagtaaatgacaagaagttaaaagtacagtcacttttttatagacttgatatcgtaccactca

SEQ ID NO: 181792 - DNA, 75 bp, Artificial Sequence
  Synthetic
ggggtattagacaactccgagctcgcctgcaagccttagaaacccttatgcagaatcagcaactcctaaacctat

SEQ ID NO: 181793 - DNA, 75 bp, Artificial Sequence
  Synthetic
cagaatcagcaactcctaaacctatggggctgtaaaggaaaatcaatctgctacacatcagtaaaatggaatgaa

SEQ ID NO: 181794 - DNA, 75 bp, Artificial Sequence
  Synthetic
ctacacatcagtaaaatggaatgaaacatggggaggaaatctctcaatttgggacagcttaacatggcagcaatg

SEQ ID NO: 181795 - DNA, 75 bp, Artificial Sequence
  Synthetic
ttgatataactaaatggttgtggtatataaaaatagctataatcatagtaggagcactaataggtgtaagaattg

SEQ ID NO: 181796 - DNA, 75 bp, Artificial Sequence
  Synthetic
attaaaaaggcaaagaaaaatagactggttaattgatagaataagagaaagagcagaagatagtggcaatgagag

SEQ ID NO: 181797 - DNA, 75 bp, Artificial Sequence
  Synthetic
accagcaggaagtaggaacgccagaaagaacaggagaaggaggtggagaagaaggcaggcgcaggtggatagcct

SEQ ID NO: 181798 - DNA, 75 bp, Artificial Sequence
  Synthetic
ccaggacaagcattctatgcaacaggtgatataataggagatataagaaaggcacattgtaacgttagtggagca

SEQ ID NO: 181799 - DNA, 75 bp, Artificial Sequence
  Synthetic
ctgtgtacccacagaccccaacccacaagaaatacacctggaaaatgtaacagaaaattttaacatgtggaaaaa

SEQ ID NO: 181800 - DNA, 75 bp, Artificial Sequence
  Synthetic
gatcagcctgctgggacttggactgtgcactctatggcaaaggataactgaagcctgcagactttgtgcagctgt

SEQ ID NO: 181801 - DNA, 75 bp, Artificial Sequence
  Synthetic
gtgcaaaggataggaagaggaattcttaacatcccaaggagaattagacagggtgcagaaagaatcttaatataa

SEQ ID NO: 181802 - DNA, 75 bp, Artificial Sequence
  Synthetic
gtgcaaaggataggaagaggaattcttaacatcccaaggagaattagacagggtgcagaaagaatcttattataa

SEQ ID NO: 181803 - DNA, 75 bp, Artificial Sequence
  Synthetic
gtgcaaaggataggaagaggaattcttaacatcccaaggagaattagacagggtgcagaaagaatcttactataa

SEQ ID NO: 181804 - DNA, 75 bp, Artificial Sequence
  Synthetic
gtgcaaaggataggaagaggaattcttaacatcccaaggagaattagacagggtgcagaaagaatcttagtataa

SEQ ID NO: 181805 - DNA, 75 bp, Artificial Sequence
  Synthetic
gtaggagaggtatccagggcattggcaggtagaggagggataccaaattcctatactccccagaacaatgcagcc

SEQ ID NO: 181806 - DNA, 75 bp, Artificial Sequence
  Synthetic
cttttaagatgggtggcaagtggtcagaacgtagtagagagagagaatggactgctgtaaaggaaaaaatggaaa

SEQ ID NO: 181807 - DNA, 75 bp, Artificial Sequence
  Synthetic
atgaggacgtaggtttcccagtaagacctcaagtgcctctacagccaatgacctttaaagcagcacatgatctca

SEQ ID NO: 181808 - DNA, 75 bp, Artificial Sequence
  Synthetic
gggattaggccagtagtgtcaactcagctgctgttgaatggcagtctagcagaagaagagataataattagatct

SEQ ID NO: 181809 - DNA, 75 bp, Artificial Sequence
  Synthetic
atagcatgggtggcaagtggtcaaaaagcagcatagtgggatggcctaaggttagggaaagaataagacagaccc

SEQ ID NO: 181810 - DNA, 75 bp, Artificial Sequence
  Synthetic
ctccagcagcaataggagtaggagcagcatctcaagatttagatagacatggagcaatcacaagcagtaatacag

SEQ ID NO: 181811 - DNA, 75 bp, Artificial Sequence
  Synthetic
aacaacaatactgtacaaagtatacacatgggaccagggcgagcactctttacaacaaaaataataggaaagata

SEQ ID NO: 181812 - DNA, 75 bp, Artificial Sequence
  Synthetic
taataaaacctatgaccagatttgggacaacatgacctggatggaatgggaaaaagagattggtaattactcaaa

SEQ ID NO: 181813 - DNA, 75 bp, Artificial Sequence
  Synthetic
tcacactcccatgcagaataaaacaaattataaacatgtggcagggagtaggaaaagcaatgtatgcccctccca

SEQ ID NO: 181814 - DNA, 75 bp, Artificial Sequence
  Synthetic
gatttgaggttcaaaacacacagcaggcaatacaaaagctaaaagaagtaatggaaaacaggaagtctgcagatg

SEQ ID NO: 181815 - DNA, 75 bp, Artificial Sequence
  Synthetic
cacaggaagtaaaaggctggatgacagacaccttgttggtccaaaatgcgaacccagattgtaagaccatcttaa

SEQ ID NO: 181816 - DNA, 75 bp, Artificial Sequence
  Synthetic
agaatgagaccttcagacctggaggaggagatatgagagacaattggagaagtgaattatacaaatataaagtag

SEQ ID NO: 181817 - DNA, 75 bp, Artificial Sequence
  Synthetic
gaagaaaaggcctttaaccctgaaattattcctatgtttatggcattatcagaaggagctgttccctatgatatc

SEQ ID NO: 181818 - DNA, 75 bp, Artificial Sequence
  Synthetic
cctcaggaggggacctagaagttacaacacatagttttaattgtagaggagaatttttctattgcaatacaacaa

SEQ ID NO: 181819 - DNA, 75 bp, Artificial Sequence
  Synthetic
gtctagctgggtggcctgctgtaagggaaagaataagacggacccctccaacagcagaaagggtggagagaagac

SEQ ID NO: 181820 - DNA, 75 bp, Artificial Sequence
  Synthetic
ggaaagaataagacggacccctccaacagcagaaagggtggagagaagacagaaccctccagcagcagaaggggt

SEQ ID NO: 181821 - DNA, 75 bp, Artificial Sequence
  Synthetic
aaagcactaacagacatagtaccactgactgaagaagcagaattagaattggcagaaaacagggaaattctaaaa

SEQ ID NO: 181822 - DNA, 75 bp, Artificial Sequence
  Synthetic
aatttctctcgacgcaggactcggcttgctgtaagtgccacggcaagaggcgagagcggcggctggtgagtacgc

SEQ ID NO: 181823 - DNA, 75 bp, Artificial Sequence
  Synthetic
tcaaggagtaggaggaccaactcacaaggcaaaaatactagcagaagcaatggttactgcccagcaagaattaaa

SEQ ID NO: 181824 - DNA, 75 bp, Artificial Sequence
  Synthetic
tgaagcatctagtatgggcaagcagggaactagaacgatttgcacttgatcctggccttctagaaacagcagaag

SEQ ID NO: 181825 - DNA, 75 bp, Artificial Sequence
  Synthetic
gttgctggaaatgtggacaggaaggtcaccaaatgaaagattgcaaaaatggaagacaggcaaattttttaggga

SEQ ID NO: 181826 - DNA, 75 bp, Artificial Sequence
  Synthetic
gaactgtacccgtttgcctccctcaaatccctctttgggacagaccaatagtcacagcaaaggttgggggtcatc

SEQ ID NO: 181827 - DNA, 75 bp, Artificial Sequence
  Synthetic
tctctatagtgaaaagagttaggcagggatactcacctttgtcgtttcagacccttaccccaaacccgagggaac

SEQ ID NO: 181828 - DNA, 75 bp, Artificial Sequence
  Synthetic
agatccattcgattagtgaacggattcttagcacttacctgggacgatctacggagcctgtgcctcttcagctac

SEQ ID NO: 181829 - DNA, 75 bp, Artificial Sequence
  Synthetic
ttgtgcatcagatgctaaagcatatgatacagaagtgcataatgtctgggctacacatgcctgtgtacccacaga

SEQ ID NO: 181830 - DNA, 75 bp, Artificial Sequence
  Synthetic
atggggcaatcacaagtagcaatacagcacaaaccaatcctgactgtgcctggctagaagcacaagaacaggacg

SEQ ID NO: 181831 - DNA, 75 bp, Artificial Sequence
  Synthetic
agcacaaaccaatcctgactgtgcctggctagaagcacaagaacaggacgaggaagtgggttttccagtcagacc

SEQ ID NO: 181832 - DNA, 75 bp, Artificial Sequence
  Synthetic
gctgttagacattttcctaggccgtggctccatagcttaggacaatatatctatgaaacttatggggatacttgg

SEQ ID NO: 181833 - DNA, 75 bp, Artificial Sequence
  Synthetic
aatgaaaaactgctctttcaatgtgaccacagaattaagggacaaaagaagaaaagaatattcacttttttataa

SEQ ID NO: 181834 - DNA, 75 bp, Artificial Sequence
  Synthetic
agtacaatgtcctcccgcaagggtggaaaggctcaccagccatatttcagagttcaatgataaagattctagagc

SEQ ID NO: 181835 - DNA, 75 bp, Artificial Sequence
  Synthetic
aacaatacaagaaaaggtatacatctaggaccaggacaagcattctttggaacagaaaaaataacagggaatata

SEQ ID NO: 181836 - DNA, 75 bp, Artificial Sequence
  Synthetic
agggatagaggtacaagacaccaaggaagccttagacaagatagaggaagaacaaaacaaaagtcagcaaaaaac

SEQ ID NO: 181837 - DNA, 75 bp, Artificial Sequence
  Synthetic
taagtaaagaggcagaactagaattagaagagaacagagaaaggctaaaagagccagtacatggagtatactacc

SEQ ID NO: 181838 - DNA, 75 bp, Artificial Sequence
  Synthetic
gtagaacagatgcataaggatatagttgatttatgggatcaaagcctaaagccatgtgtaaaattaaccccactc

SEQ ID NO: 181839 - DNA, 75 bp, Artificial Sequence
  Synthetic
agattatagattaggagtaggagcatttataatagcactaatcatagcaatagttgtgtggatcatagcatatat

SEQ ID NO: 181840 - DNA, 75 bp, Artificial Sequence
  Synthetic
gtatacatataggaccagggagagcattttatacaacaggacaagtaataggagatataagacaagcacattgta

SEQ ID NO: 181841 - DNA, 75 bp, Artificial Sequence
  Synthetic
aagatcatgaaaaatatcatagcaattggagagcattagctagtgactttggactaccaccagtagtagccaagg

SEQ ID NO: 181842 - DNA, 75 bp, Artificial Sequence
  Synthetic
ttggagagcattagctagtgactttggactaccaccagtagtagccaaggaaatcattgctagttgtcctaaatg

SEQ ID NO: 181843 - DNA, 75 bp, Artificial Sequence
  Synthetic
acctacacctgtcaacataattggaagaaatttgttgactcagattggctgcactttaaattttccaattagtcc

SEQ ID NO: 181844 - DNA, 75 bp, Artificial Sequence
  Synthetic
tgtacaagacccggcaataatacaagaagaagtataaggataggaccaggacaaacattctatgcaacaggagac

SEQ ID NO: 181845 - DNA, 75 bp, Artificial Sequence
  Synthetic
agcaatgcaaaatttaatggtacccagggtgcaaatgctactggagaaatgaaaaattgcactttcaatataacc

SEQ ID NO: 181846 - DNA, 75 bp, Artificial Sequence
  Synthetic
tgttaatagtactagcaatgataatagtactgctaacgccactatagatgaagaaatgaagggagaaataaagaa

SEQ ID NO: 181847 - DNA, 75 bp, Artificial Sequence
  Synthetic
acagcagtctcaaggggttgagactggggtgggaaggcctcaaacatctgtggaatctcctgttgtattggggga

SEQ ID NO: 181848 - DNA, 75 bp, Artificial Sequence
  Synthetic
agctcttcttcacatacctagaagaatcagacagggcttagaaaggtttttgctataacaataacatgggtggca

SEQ ID NO: 181849 - DNA, 75 bp, Artificial Sequence
  Synthetic
gacgaggaactcctcagagcagtaaggatcatcaaaatcctctaccagagcagtaagtaataagtatatgtaatg

SEQ ID NO: 181850 - DNA, 75 bp, Artificial Sequence
  Synthetic
cagaattgggtgccaacatagcagaataggcattattccacggagaagagtaagggatggacccggtagatccta

SEQ ID NO: 181851 - DNA, 75 bp, Artificial Sequence
  Synthetic
aaggataggaccaggaccagggcaaacattctatgcaacagacatagtaggagacataagaaaagcacattgtaa

SEQ ID NO: 181852 - DNA, 75 bp, Artificial Sequence
  Synthetic
agaccacaagtacctctaagaccaatgacttacaaggcagctgtggatctcagccactttttaaaagaaaagggg

SEQ ID NO: 181853 - DNA, 75 bp, Artificial Sequence
  Synthetic
gtcaaaaagcagtctggttggatggcctgatataagagaaaggatgagaagagctcaaccagcagcagagggagt

SEQ ID NO: 181854 - DNA, 75 bp, Artificial Sequence
  Synthetic
tattccagtagcagaagctgatataatggttaccacatattggggattaatgccaggggaaagagaggaacattt

SEQ ID NO: 181855 - DNA, 75 bp, Artificial Sequence
  Synthetic
ttgatcctgaaacagcagacaggatgatacatctgcattatttcaactgttttacagagtcagcaatcaggaggg

SEQ ID NO: 181856 - DNA, 75 bp, Artificial Sequence
  Synthetic
accaatgccaatttaaccaatagcaataacataaccagtgactatacaacaataggaaatataacagatgaagta

SEQ ID NO: 181857 - DNA, 75 bp, Artificial Sequence
  Synthetic
taaaagaaacaaacctcccctacccagtgtccagaagttaacagaaaatcgatggaacaagccccagaagatcag

SEQ ID NO: 181858 - DNA, 75 bp, Artificial Sequence
  Synthetic
aactgctctttcaatgtcaccacaagcataagagataaggtgaagaaagaatatgcacttttctataaccttgat

SEQ ID NO: 181859 - DNA, 75 bp, Artificial Sequence
  Synthetic
gtgggcaatacatttatgagacttatggagacacttgggagggagttatggcaatcataagaatcttacaacaac

SEQ ID NO: 181860 - DNA, 75 bp, Artificial Sequence
  Synthetic
gaagaagaaatggatccagtagatcctgaaatacctccttggcatcaccctgggagcaaaccccaaaccccttgt

SEQ ID NO: 181861 - DNA, 75 bp, Artificial Sequence
  Synthetic
acatcccactagaggatgctaaattagtaataacaacatattggggtctacatacaggagaaagagaatggcatt

SEQ ID NO: 181862 - DNA, 75 bp, Artificial Sequence
  Synthetic
actcgcaaaaccagcaggaaagaaatgaaaaggatttactagcattggacagttggaacaatctatggaattggt

SEQ ID NO: 181863 - DNA, 75 bp, Artificial Sequence
  Synthetic
catataggaccagggagagcattttatgcaacaggagacataataggagatataagacaagcacattgtaacatt

SEQ ID NO: 181864 - DNA, 75 bp, Artificial Sequence
  Synthetic
tagagcaaagaaaacaagatagaagggagcaggaaatacttgaaagattaagaagagtaagggaaatcaaggatg

SEQ ID NO: 181865 - DNA, 75 bp, Artificial Sequence
  Synthetic
gggatttagatcgttatataacacagtagcagttctctattgggtacataaaaacatacaggtatcagacaccaa

SEQ ID NO: 181866 - DNA, 75 bp, Artificial Sequence
  Synthetic
ttatcctggtagcagttcatgtagccagtgggtatatagaagcagaagttattccagcagaaacagggcaggaaa

SEQ ID NO: 181867 - DNA, 75 bp, Artificial Sequence
  Synthetic
aaaaagagtgctattagtctgcttgataccatagccatagcagtagctgaaggaacagataggattatagaatta

SEQ ID NO: 181868 - DNA, 75 bp, Artificial Sequence
  Synthetic
tggggatacttgggcaggagttgaagctctaataagaatactgcaacaactactgtttattcatttcagaattgg

SEQ ID NO: 181869 - DNA, 75 bp, Artificial Sequence
  Synthetic
tgatatatggaaaaattacatggtggaccaaatgcatgaagacattattagtttatgggatcaaagtttaaagcc

SEQ ID NO: 181870 - DNA, 75 bp, Artificial Sequence
  Synthetic
gtttatgggatcaaagtttaaagccttgtgtgcaaatgactttcttatgtgtacaaatgaactgtacagagctga

SEQ ID NO: 181871 - DNA, 75 bp, Artificial Sequence
  Synthetic
agaaaaggcttttagcccagaagtaatacccatgtttacagcattatcagaaggagccaccccacaagatttaaa

SEQ ID NO: 181872 - DNA, 75 bp, Artificial Sequence
  Synthetic
gcggagacagcgacgaagacctcctcaaggcagtccgactcatcaagttcctctatcaaagcagtgagtagtaca

SEQ ID NO: 181873 - DNA, 75 bp, Artificial Sequence
  Synthetic
aatgacacaatcacactcccatgcagaataaaacaaattgtaaacatgtggcaggaagtaggaaaagcaatgtat

SEQ ID NO: 181874 - DNA, 75 bp, Artificial Sequence
  Synthetic
cagaaaggagaaaaggcaggctctattctatgtatcagatttggttaagattgacaacagctcaacaatatatag

SEQ ID NO: 181875 - DNA, 75 bp, Artificial Sequence
  Synthetic
cggagacagcgacgaagcactcctccaagcagtgaggatcatcaaaatcttatatcaaagcagtaagtattgaag

SEQ ID NO: 181876 - DNA, 75 bp, Artificial Sequence
  Synthetic
tgttgctttcattgctgctggtgctttacaacgaagggcttaggcatctcatatggcaggaagaagcggagaaag

SEQ ID NO: 181877 - DNA, 75 bp, Artificial Sequence
  Synthetic
atggaacaggcctatgtcccaatatttcagtggttacatgtacacatggcatcaagccaacagtaagtactcaat

SEQ ID NO: 181878 - DNA, 75 bp, Artificial Sequence
  Synthetic
ttcagtggttacatgtacacatggcatcaagccaacagtaagtactcaattaataatgaatgggacactctctag

SEQ ID NO: 181879 - DNA, 75 bp, Artificial Sequence
  Synthetic
aaacatgacatgtacgagaaaaggaagaggtaaaatacaaaggatagcgacaggtccactgcgatgggtcagtat

SEQ ID NO: 181880 - DNA, 75 bp, Artificial Sequence
  Synthetic
tatttagaactagtaaacaagacaagaaatttaagcaagacaagaaattttagcataatattcaaccacagtata

SEQ ID NO: 181881 - DNA, 75 bp, Artificial Sequence
  Synthetic
caggaactaaaaattattgctatttctttgcttgaggctacagcaatgtcactagcggggtggacagatagggtt

SEQ ID NO: 181882 - DNA, 75 bp, Artificial Sequence
  Synthetic
ataccaatgccactgataccaatggtaccaatagtagtagttgggaaaagatggagggagaaataaaaaactgct

SEQ ID NO: 181883 - DNA, 75 bp, Artificial Sequence
  Synthetic
agtggtggagacatagaagcaagctctttacattttaactgtcatggagaattcttttattgtgacacatctcgg

SEQ ID NO: 181884 - DNA, 75 bp, Artificial Sequence
  Synthetic
actagcggggtggacagatagggttatccaagtaatacaaagagcttggaaagcctttctccacatacccacact

SEQ ID NO: 181885 - DNA, 75 bp, Artificial Sequence
  Synthetic
ggaacaagccccagaggaccaagggccacagagggagccatacaatgaatggacattagagcttttagaggagct

SEQ ID NO: 181886 - DNA, 75 bp, Artificial Sequence
  Synthetic
gatactataataccttgcaagataagacaggtagtaagatcatggataaagggagagttaggactctatgcacct

SEQ ID NO: 181887 - DNA, 75 bp, Artificial Sequence
  Synthetic
acccaaaacgacaacatgacggaagaacgaggggtactaaaaaactgttctttcaatatgaccacagaagtaaaa

SEQ ID NO: 181888 - DNA, 75 bp, Artificial Sequence
  Synthetic
ggtcaggaactaaagaatagtgccattaatttgtttgatactttagcaatagcagtagctaactggacagataga

SEQ ID NO: 181889 - DNA, 75 bp, Artificial Sequence
  Synthetic
gagccagcagcggctggggtgggagcagtatctcgagacctggcacaacgtggagcaatcacaagtagcaaccaa

SEQ ID NO: 181890 - DNA, 75 bp, Artificial Sequence
  Synthetic
taggctttccagtcagaccacaggtacctctgagaccaatgacttataaggctgcttttgatctcagcttctttt

SEQ ID NO: 181891 - DNA, 75 bp, Artificial Sequence
  Synthetic
gaaactggactgacagtgcttggaacaacttgacatggcagcaatgggaccaacaaatagatgaatatagcacca

SEQ ID NO: 181892 - DNA, 75 bp, Artificial Sequence
  Synthetic
tatacatttaggaccaggacaagcattctatgcaacaagaagaataacaggaaacataagaaaggcatattgtaa

SEQ ID NO: 181893 - DNA, 75 bp, Artificial Sequence
  Synthetic
tggggatgataataatttgtagtgctgcagaaaacttgtgggttactgtctactatggggtacctgtgtggaaag

SEQ ID NO: 181894 - DNA, 75 bp, Artificial Sequence
  Synthetic
taaagacttatttcaataaaacaataacatttaactcagcctcaggaggagacctagaagttacaatgcatagtt

SEQ ID NO: 181895 - DNA, 75 bp, Artificial Sequence
  Synthetic
ggaaaatttggccttcccacaaggggaggccagggaatttccttcagaacagaccagagccaacagccccaccag

SEQ ID NO: 181896 - DNA, 75 bp, Artificial Sequence
  Synthetic
ggtctccatagaatggaggctaaaaagatatagcacacaagtagatcctgaccaggcagaccaactaattcatct

SEQ ID NO: 181897 - DNA, 75 bp, Artificial Sequence
  Synthetic
aaaataacatggtggagcagatgcatgaggatataatcagtttatgggatcaaagcttaaaaccatgtgtaaaat

SEQ ID NO: 181898 - DNA, 75 bp, Artificial Sequence
  Synthetic
attaggcagggatatcaacccctctcgttgcagatccccatcccacaccaggaggaagcagaaacgccaggaaga

SEQ ID NO: 181899 - DNA, 75 bp, Artificial Sequence
  Synthetic
caaagcttaaaaccatgtgtaaaattaaccccgctctgtgtcactttaaactgcactgatgcgaatgccactaat

SEQ ID NO: 181900 - DNA, 75 bp, Artificial Sequence
  Synthetic
ggaaagatttgcacttaaccctggccttttagaaacagcagaaggttgtcaacaaataatgggacagttgcaacc

SEQ ID NO: 181901 - DNA, 75 bp, Artificial Sequence
  Synthetic
ctagcaccactactagtagcggggaaaagatggagccaggagagatacaaaattgctctttccatgtcacctcag

SEQ ID NO: 181902 - DNA, 75 bp, Artificial Sequence
  Synthetic
aattatcaacatgtggcagggagtaggacaagcaatgtatgcttctcccattgcaggaagcattacctgtaactc

SEQ ID NO: 181903 - DNA, 75 bp, Artificial Sequence
  Synthetic
agcagctgacacaggaaacagcagccaggtcagccaaaattaccctatagtacagaacatgcaggggcaaatggt

SEQ ID NO: 181904 - DNA, 75 bp, Artificial Sequence
  Synthetic
acggatctcaggacaataatcttgtggacttaccacctcttgagcaacttagcatcagggatccagaggttgatc

SEQ ID NO: 181905 - DNA, 75 bp, Artificial Sequence
  Synthetic
caggagttgcacctctttctgatcttgttgcggcgccactggttaatggtaataataatactgctgccttttgtt

SEQ ID NO: 181906 - DNA, 75 bp, Artificial Sequence
  Synthetic
tattgcagtggcagttggcaattggactgacagcatcatcttaggtatacaaagaatagggcgaggattcctcaa

SEQ ID NO: 181907 - DNA, 75 bp, Artificial Sequence
  Synthetic
aaaatgtaacgacaagaattttagtggggggggtggatgctgcaacatcagcacaatacatcgtacacatggtgg

SEQ ID NO: 181908 - DNA, 75 bp, Artificial Sequence
  Synthetic
actgacagcatcatcttaggtatacaaagaatagggcgaggattcctcaacatcccaagaagaattagacaaggt

SEQ ID NO: 181909 - DNA, 75 bp, Artificial Sequence
  Synthetic
atagtacagcttaagcagtctgtaccaattacttgcacaaggcccaacaacaatacaagaaaaagtgtacatata

SEQ ID NO: 181910 - DNA, 75 bp, Artificial Sequence
  Synthetic
ggatacatatgggaccaggcagagcatattttacaacagaaataacaggagatataagaaacgcacattgtaccc

SEQ ID NO: 181911 - DNA, 75 bp, Artificial Sequence
  Synthetic
caatacaagaaaaagtgtacatataggaccaggacgagcactctatacaatagaattagtaggagatataagaca

SEQ ID NO: 181912 - DNA, 75 bp, Artificial Sequence
  Synthetic
agattgctaaaacaaaggaaaatagacaggttaattgaaagaataagtgaaagagcagaagacagtggcaatgag

SEQ ID NO: 181913 - DNA, 75 bp, Artificial Sequence
  Synthetic
tcgcaaaaccaacaagaaaagaatgaacaagaattattggaattggataaatgggcaagtttgtggagttggttt

SEQ ID NO: 181914 - DNA, 75 bp, Artificial Sequence
  Synthetic
taattcatatgcattattttgattgttttgcagactctgccataaggaaagccatattaggacacatagttattc

SEQ ID NO: 181915 - DNA, 75 bp, Artificial Sequence
  Synthetic
aggaagtaggctttccagtcagacctcaggtgcctttaaggccaatgacttataagggagctttagatctcagtc

SEQ ID NO: 181916 - DNA, 75 bp, Artificial Sequence
  Synthetic
ctgtgataaatgtcaactaaaaggggaagctatgcatggacaagtagactgtagtccaggaatatggcaattaga

SEQ ID NO: 181917 - DNA, 75 bp, Artificial Sequence
  Synthetic
agtgcacacggcaagaggcgagagcggcgactggtaattacgcctaatttttgactagcggaggctagaaggaga

SEQ ID NO: 181918 - DNA, 75 bp, Artificial Sequence
  Synthetic
acaataaaatttaatagctcctcaggaggggatctagaaatcacaacacatagttttaattgtggaggagaattt

SEQ ID NO: 181919 - DNA, 75 bp, Artificial Sequence
  Synthetic
tgacagaacatagaaagaaggtagaattgcttagagaacatttatatcagtggggattcactacccctgataaaa

SEQ ID NO: 181920 - DNA, 75 bp, Artificial Sequence
  Synthetic
cttaggtcattatataacacaatagtggtcctgtattatgtacatcaaaggatagatataaaggacaccaaagat

SEQ ID NO: 181921 - DNA, 75 bp, Artificial Sequence
  Synthetic
ggtactgatagtgtggcaagtagacagacagagagtgaaaacgtggaacagcctggtgaaataccataagtacag

SEQ ID NO: 181922 - DNA, 75 bp, Artificial Sequence
  Synthetic
ttcaatataaccacagaaataagaggtaaaaagaagaatgaatatgcacttttttatagacttgatatagtacca

SEQ ID NO: 181923 - DNA, 75 bp, Artificial Sequence
  Synthetic
tggaggctttatcaaagtaaaacagtatgataacatactcatagaaatttgtggacacaaggctataggtacagt

SEQ ID NO: 181924 - DNA, 75 bp, Artificial Sequence
  Synthetic
ttgtgctccagcaggatatgccatctttaagtgtaataacacagactttaatggaacaggcctatgccccaatat

SEQ ID NO: 181925 - DNA, 75 bp, Artificial Sequence
  Synthetic
tgaaaaatatcacagtaattggagagcaatggctaatgattttaatctgccacctataatagcaaaagaaatagt

SEQ ID NO: 181926 - DNA, 75 bp, Artificial Sequence
  Synthetic
gcagcagcagcaggagtaggagcagtatctcaagatttagataaacatggagcaatcacaagtagtaatgtaaat

SEQ ID NO: 181927 - DNA, 75 bp, Artificial Sequence
  Synthetic
ttagaaggaaaaattatcctggtagcagttcatgtagccagtggatatatagaagcagaagttattccagcagag

SEQ ID NO: 181928 - DNA, 75 bp, Artificial Sequence
  Synthetic
atgtcacagatattgataatagcacaattggagaaataaagaactgcactttcaatgtaactacagaattaagag

SEQ ID NO: 181929 - DNA, 75 bp, Artificial Sequence
  Synthetic
gataatcctggggttaaataaaatagtaagaatgtatagtcctgtcagcattttggacataagacaaggtccaaa

SEQ ID NO: 181930 - DNA, 75 bp, Artificial Sequence
  Synthetic
gactgctgacaatagtagtagtagtggggaaaatctgaaggaagaaataaaaaactgctctttcaatatcaccac

SEQ ID NO: 181931 - DNA, 75 bp, Artificial Sequence
  Synthetic
gaccaacagggggagatatgagagatatatggagaactgaattgtacaactacaaagtagtacaggtaaaacctt

SEQ ID NO: 181932 - DNA, 75 bp, Artificial Sequence
  Synthetic
tatatggagaactgaattgtacaactacaaagtagtacaggtaaaaccttttagtgtagcacctacaaaaatttc

SEQ ID NO: 181933 - DNA, 75 bp, Artificial Sequence
  Synthetic
gattgggaatgctattcttaggggttctaagtgcagcaggtagcactatgggcgcagcggcaacaacgctggcgg

SEQ ID NO: 181934 - DNA, 75 bp, Artificial Sequence
  Synthetic
cctatagtgcaaaatgcacaagggcagatgatacaccagtccatatcacctaggactttgaatgcatgggtaaaa

SEQ ID NO: 181935 - DNA, 75 bp, Artificial Sequence
  Synthetic
tggtaatgccattttaaatagtacagacataactaaagaaataagaaattgctctttcgagataaccacagaaat

SEQ ID NO: 181936 - DNA, 75 bp, Artificial Sequence
  Synthetic
ggagagcaagacagagacagatcaattcgattagtgagcggattcttagcacttgcctgggacgacctgcggagc

SEQ ID NO: 181937 - DNA, 75 bp, Artificial Sequence
  Synthetic
tgggcaagtctgtggaattggtttaacatatcaaattggctgtggtatataaaaatatttataatgatagtagga

SEQ ID NO: 181938 - DNA, 75 bp, Artificial Sequence
  Synthetic
ggagaagagtaagggatggacccggtagatcctaatctagagccctggaatcatccagggagtcagcctaaaact

SEQ ID NO: 181939 - DNA, 75 bp, Artificial Sequence
  Synthetic
ctatgcaacaaaggccatcataggagacataagaaaagcacattgtaacattactgaaggaaaatggaacataac

SEQ ID NO: 181940 - DNA, 75 bp, Artificial Sequence
  Synthetic
aatgttgctggcattgccaagtttgctttctgaacaaaggcttaggcatctcctatggcaggaagaagcggaagc

SEQ ID NO: 181941 - DNA, 75 bp, Artificial Sequence
  Synthetic
agctgaaggaacagatagaattatagaaggaatacaaaggctttgtggagcataagacagggctttgaagcagta

SEQ ID NO: 181942 - DNA, 75 bp, Artificial Sequence
  Synthetic
tactctttaactcatcctcaggaggggacctagaagtcacaacacatagttttaactgtagaggagaattcttct

SEQ ID NO: 181943 - DNA, 75 bp, Artificial Sequence
  Synthetic
tcaggccgcaggtacctctaagaccaatgacttttaagggagctgttgatcttagcttctttttaaaagaaaagg

SEQ ID NO: 181944 - DNA, 75 bp, Artificial Sequence
  Synthetic
tatgcaaaaatgaggagtgcccacactaatgatgtaaaacaattaacagaggcagtgcaaaaaatagcccaagaa

SEQ ID NO: 181945 - DNA, 75 bp, Artificial Sequence
  Synthetic
cagctctcaagacagggtcagaggacctgaaatctctctggaacgcaatagcagtactctggtgcgttcacaaca

SEQ ID NO: 181946 - DNA, 75 bp, Artificial Sequence
  Synthetic
cctgaaatctctctggaacgcaatagcagtactctggtgcgttcacaacagatttgacatccgagatacacagca

SEQ ID NO: 181947 - DNA, 75 bp, Artificial Sequence
  Synthetic
acaaagaaaaatagactggttaattaaaagaattagggaaagagcagaagacagtggcaatgagagtgaggggga

SEQ ID NO: 181948 - DNA, 75 bp, Artificial Sequence
  Synthetic
cagcaatggggccgttaccaccagggcagataagggaaccaacaggaagtgacattgctggaacaactagcacac

SEQ ID NO: 181949 - DNA, 75 bp, Artificial Sequence
  Synthetic
ggagacatctatagaaaatggatagtgctaggactaaacaaaatggtaaaaatgtacagtccagtgagcatctta

SEQ ID NO: 181950 - DNA, 75 bp, Artificial Sequence
  Synthetic
agctcatctattgagctgggggtttactacaccagacaaaaagcatcagaaagaacctccatttctttggatggg

SEQ ID NO: 181951 - DNA, 75 bp, Artificial Sequence
  Synthetic
cggagcctgtgcctcttcagctaccacctattgagagacttcatattggtgacagcgagagcagtggaacttctg

SEQ ID NO: 181952 - DNA, 75 bp, Artificial Sequence
  Synthetic
tggatggaatagataaggctcaagaagaacatgagaaataccacaacaattggagagcaatggctagtgatttta

SEQ ID NO: 181953 - DNA, 75 bp, Artificial Sequence
  Synthetic
tgggaccagggagagtatggtatacaacaggagaaataataggagatgtaagaaaagcacattgtaacattagca

SEQ ID NO: 181954 - DNA, 75 bp, Artificial Sequence
  Synthetic
ggaaaatattaagacaaagaaaaatagataggttaattgatagaataagagacagagcagaagacagtggcaatg

SEQ ID NO: 181955 - DNA, 75 bp, Artificial Sequence
  Synthetic
atacaagaaaaagtataaatataggaccagggagagcattttatgcaacaggagacataataggagatataagac

SEQ ID NO: 181956 - DNA, 75 bp, Artificial Sequence
  Synthetic
taggttgataaattgtaacacctcagtcattacacaggcctgtccaaaggtatcctttgagccaattcccataca

SEQ ID NO: 181957 - DNA, 75 bp, Artificial Sequence
  Synthetic
ctttagaagaaatgatggtagcctgtcaaggagtaggagggccaactcacaaggcaaaaatactagcagaagcaa

SEQ ID NO: 181958 - DNA, 75 bp, Artificial Sequence
  Synthetic
tgctctttcaatacaaccacagaactaagagataagaaacagaaaacgtatgcacttttttatagacctgatata

SEQ ID NO: 181959 - DNA, 75 bp, Artificial Sequence
  Synthetic
aagacgagctgagccagcagcagagggagtaggggcagcatctcaagacttagatagacatggagcacttacaac

SEQ ID NO: 181960 - DNA, 75 bp, Artificial Sequence
  Synthetic
gccccagaagaccaagggccacagagggagccacacaatgaatggacactagaacttttagaggagcttaagaat

SEQ ID NO: 181961 - DNA, 75 bp, Artificial Sequence
  Synthetic
ggaagacaggcaaattttttagggaagtactggcctccggggggcacgaggccaggcaattatgtgcagaaacaa

SEQ ID NO: 181962 - DNA, 75 bp, Artificial Sequence
  Synthetic
ccatgctaaacacagtggggggacatcaagcagccatgcagatgttaaaagagaccatcaatgaggaagctgcag

SEQ ID NO: 181963 - DNA, 75 bp, Artificial Sequence
  Synthetic
tagcaccaatagtagtagtttggaagagatgaaaaactgctctttcaatatcacctcaagcataagaaatgcagt

SEQ ID NO: 181964 - DNA, 75 bp, Artificial Sequence
  Synthetic
gtaggacgagcaatgtatgcccctcccattgaaggaaacataacatgtaaatcaaatatcacaggactactattg

SEQ ID NO: 181965 - DNA, 75 bp, Artificial Sequence
  Synthetic
gttgctttcattgtcaatggtgctttacaacgaagggcttaggcatctcctatggcaggaagaagcggagacagc

SEQ ID NO: 181966 - DNA, 75 bp, Artificial Sequence
  Synthetic
aattaattgtacaagacccaacaacaatacaagaaaaaggataactatgggaccagggagagtattgtatacaac

SEQ ID NO: 181967 - DNA, 75 bp, Artificial Sequence
  Synthetic
gaccagggagagtattgtatacaacaggagaaataataggagatataagacgagcacattgtaaccttagtagag

SEQ ID NO: 181968 - DNA, 75 bp, Artificial Sequence
  Synthetic
gattaagataaagcaactgtgtaaactccttaggggagctaaagcactaacagacatagtaccactgactgaaga

SEQ ID NO: 181969 - DNA, 75 bp, Artificial Sequence
  Synthetic
tgccttcactattcctagtgtgaacaatgagaccccaggagtaagataccagtacaatgtcctcccgcaagggtg

SEQ ID NO: 181970 - DNA, 75 bp, Artificial Sequence
  Synthetic
atgaacaagacttattggcattggataaatgggcaagtttatggaattggtttgacataacaaactggctgtggt

SEQ ID NO: 181971 - DNA, 75 bp, Artificial Sequence
  Synthetic
tgtgggtcacagtctattatggggtacctgtgtggagagaagcaaacaccactctattttgtgcatcagatgcta

SEQ ID NO: 181972 - DNA, 75 bp, Artificial Sequence
  Synthetic
agaaatttatcagtacatagatgacttatatgtaggatcagatttaccattggcagaacatagaaagagggtcga

SEQ ID NO: 181973 - DNA, 75 bp, Artificial Sequence
  Synthetic
gacaagtggacagtacagcccatccaattgcctgacaaagaagtgtggacagtaaatgatatacaaaaattagta

SEQ ID NO: 181974 - DNA, 75 bp, Artificial Sequence
  Synthetic
agtaaatgatatacaaaaattagtaggaaaattaaattgggcaagtcaaatctatcaaggaattagagtaaaaga

SEQ ID NO: 181975 - DNA, 75 bp, Artificial Sequence
  Synthetic
tattctcaatatacctgtaagaataagacaaggcttggaaagagctcttttataacatggggggcaagtggtcaa

SEQ ID NO: 181976 - DNA, 75 bp, Artificial Sequence
  Synthetic
aggaaaatagcaccctgaaggaagacccaggggaaatacaagactgtactttcaatgtgaccacagaaataagag

SEQ ID NO: 181977 - DNA, 75 bp, Artificial Sequence
  Synthetic
gtgaattatataaatataaagtagtaaaaattgaaccattaggagtagcacccaccaaggcaaagagaagagtgg

SEQ ID NO: 181978 - DNA, 75 bp, Artificial Sequence
  Synthetic
aaatcattgacagaggtagtacctttaagtaaagaggcagaactagaattagaagaaaacagagaaaagctaaaa

SEQ ID NO: 181979 - DNA, 75 bp, Artificial Sequence
  Synthetic
cctccagcagcagtaggagtaggagcagtatctcaagatttagctaagcatggagcaattacaagcagcaacaca

SEQ ID NO: 181980 - DNA, 75 bp, Artificial Sequence
  Synthetic
agctaaaaaagagtgctattagtctgtttgataccatagcaatagcagtagctgaaggaacagataggattatag

SEQ ID NO: 181981 - DNA, 75 bp, Artificial Sequence
  Synthetic
gcagaaaccttttatgtagatggagcagctaataggaatacaaaactaggaaaggcgggatatgttacagaacaa

SEQ ID NO: 181982 - DNA, 75 bp, Artificial Sequence
  Synthetic
ggtatatatttaggaccaggacgagcaatttatacagcagataaaataataggagacataagaaaggcacattgt

SEQ ID NO: 181983 - DNA, 75 bp, Artificial Sequence
  Synthetic
aaaaaggctataggtacagtattagtaggacctacacctgtcaacataattggaagaaatatgttgactcagctt

SEQ ID NO: 181984 - DNA, 75 bp, Artificial Sequence
  Synthetic
aaaggcgggatatgttacagaacaaggaaaacagaacataataaagttagaagagacaaccaatcaaaaggctga

SEQ ID NO: 181985 - DNA, 75 bp, Artificial Sequence
  Synthetic
tggaagaaatatgttgactcagcttggatgcacactaaattttccaattagtcccattgaaactgtaccagtaaa

SEQ ID NO: 181986 - DNA, 75 bp, Artificial Sequence
  Synthetic
tagtaacagactcacaatatgtattgggcatcatatcctcccaaccaacacagagtgactcccctatagttcagc

SEQ ID NO: 181987 - DNA, 75 bp, Artificial Sequence
  Synthetic
gaggggacctagaaattacaatgcatagttttaattgtagaggagaatttttctactgcaatacatcaaaactgt

SEQ ID NO: 181988 - DNA, 75 bp, Artificial Sequence
  Synthetic
gactaggaataatattacaggaatggaaaacaatgatcaaatagaaatgaaaaactgctctttcaatataaccac

SEQ ID NO: 181989 - DNA, 75 bp, Artificial Sequence
  Synthetic
tcatctgggacgacctgcggagcctgttcctcttcagctaccaccgcttgagagacttactcttgattgtaacga

SEQ ID NO: 181990 - DNA, 75 bp, Artificial Sequence
  Synthetic
ggaaaaaattcggttaaggccagggggaaagaaaaaatatagattaaaacatatagtatgggcaagcagggaact

SEQ ID NO: 181991 - DNA, 75 bp, Artificial Sequence
  Synthetic
caaaaagtagtgggggtaatggaggtggatggactgctgtaagggaaagaatgaggcgagctaagccagcagcgc

SEQ ID NO: 181992 - DNA, 75 bp, Artificial Sequence
  Synthetic
atctataggacaagggcaagcactctatacaacaagagtaacgggagatataagaaaagcatattgcaatattag

SEQ ID NO: 181993 - DNA, 75 bp, Artificial Sequence
  Synthetic
gcagcagtgacatcagcataaatgccaccagcatgaatgtggatgaaataaaaaactgctcttacaatataacca

SEQ ID NO: 181994 - DNA, 75 bp, Artificial Sequence
  Synthetic
gtggtcaccacatattggggattaatgccaggggaaagagaggaacacttgggacatggggttagtatagaatgg

SEQ ID NO: 181995 - DNA, 75 bp, Artificial Sequence
  Synthetic
gatgaagtaagaaactgttcttttaatatgaccacagatctaagagataagaagcagaaggtctatgcacttttt

SEQ ID NO: 181996 - DNA, 75 bp, Artificial Sequence
  Synthetic
ataaaaaattgctctttcaatgcaaccacattattaagagataaaaagaagacagtgtatgcacttttttataga

SEQ ID NO: 181997 - DNA, 75 bp, Artificial Sequence
  Synthetic
aaaaagaaataagcctcccctacccagtgtccagagattaacagaagatagatggaacaagccctggaaaatcag

SEQ ID NO: 181998 - DNA, 75 bp, Artificial Sequence
  Synthetic
gcaattataagaatcttacaacaactactgtttacccattatagaattggatgccaacatagtagaataggaatt

SEQ ID NO: 181999 - DNA, 75 bp, Artificial Sequence
  Synthetic
aaaacaataagttttactaaatcctcaggaggagatttagaaattacaacacatagttttaattgtggaggagaa

SEQ ID NO: 182000 - DNA, 75 bp, Artificial Sequence
  Synthetic
aaccaccctcaggaggagatctagaaattacaatgcatcattttaattgtagaggggaatttttctattgcaata

SEQ ID NO: 182001 - DNA, 75 bp, Artificial Sequence
  Synthetic
taagcggcggaaaattagatgcgtgggaaagaattcggttaaggccggggggaaagaaaaaatataaaatgaagc

SEQ ID NO: 182002 - DNA, 75 bp, Artificial Sequence
  Synthetic
catgcagaataaagcaagttataaatatgtggcagagagcaggacaagcaatgtatgcccctcccatccaaggag

SEQ ID NO: 182003 - DNA, 75 bp, Artificial Sequence
  Synthetic
tagaatataggaaattgttaagacaaaggaaaatagactggttaattaaaagaattagggaaagagcagaagaca

SEQ ID NO: 182004 - DNA, 75 bp, Artificial Sequence
  Synthetic
tagtgcaaagaaaacaagatagaagggagcaggaaatacttgaaagattaaggagaataaaggaaatcagggatg

SEQ ID NO: 182005 - DNA, 75 bp, Artificial Sequence
  Synthetic
agcaggaagcactatgggcgcggcgtcaataacgctgacggtacaggccagacaattattgtctggcatagtgca

SEQ ID NO: 182006 - DNA, 75 bp, Artificial Sequence
  Synthetic
gtggaccaaatgcatgaagacatcattagtttgtgggaacagagtttaaagccttgtgagaaaatgactttctta

SEQ ID NO: 182007 - DNA, 75 bp, Artificial Sequence
  Synthetic
tcctcacagacaaaaaggagcaaaaacaggctctattctatgtatcagatctgagtaaggttaatgactcaaatg

SEQ ID NO: 182008 - DNA, 75 bp, Artificial Sequence
  Synthetic
cgctcctccaagcagtaaggatcatcaaaatcctctaccaaagcagtaagtacccaatagtagatgtaatgttaa

SEQ ID NO: 182009 - DNA, 75 bp, Artificial Sequence
  Synthetic
caaaatcctctaccaaagcagtaagtacccaatagtagatgtaatgttaaatctatatgcaagagtggattatag

SEQ ID NO: 182010 - DNA, 75 bp, Artificial Sequence
  Synthetic
aaacagaagaaaatacaaaggatacttgatagaataaaagaaagagcagaagacagtggaaatgaaagcgaaggg

SEQ ID NO: 182011 - DNA, 75 bp, Artificial Sequence
  Synthetic
agtgaacggattcttagcacttgcctgggacgacctgcggaacctgtgcctcttcagttaccaccgcttgagaga

SEQ ID NO: 182012 - DNA, 75 bp, Artificial Sequence
  Synthetic
catgacctgcataagagaaggaattgcagaggtacaagatatatatacaggtccaatgagatggcgcagtatgac

SEQ ID NO: 182013 - DNA, 75 bp, Artificial Sequence
  Synthetic
tatttaaatcttgtaaaccaaacagagaatgttaccataatattcagcagaactagtggtggagatgcagaagta

SEQ ID NO: 182014 - DNA, 75 bp, Artificial Sequence
  Synthetic
taaactgtagcaatgctaccgtcaataatagcataaaggaagaaatgaaaaattgctctttcaatataaccacag

SEQ ID NO: 182015 - DNA, 75 bp, Artificial Sequence
  Synthetic
agatcaaagggagcaatgagaccaataaaaatggtactataccttgcaagttaagacagctagtaagatcatgga

SEQ ID NO: 182016 - DNA, 75 bp, Artificial Sequence
  Synthetic
ttaagacagctagtaagatcatggatgaagggagagtcgagaatctatgcacctcccatccccggcaacttaaca

SEQ ID NO: 182017 - DNA, 75 bp, Artificial Sequence
  Synthetic
atgcacttttttataaacttgatatggtaccaatagatgatgataagactaatagcagccctactacaactacta

SEQ ID NO: 182018 - DNA, 75 bp, Artificial Sequence
  Synthetic
gaaattaattgtacaagacccaacaacaatacaagaaaaagtatacctatgggaccagggagagcattgtatgca

SEQ ID NO: 182019 - DNA, 75 bp, Artificial Sequence
  Synthetic
gggaccagggagagcattgtatgcaacaggacaaataataggagatataagacaagcacattgtaacattagcaa

SEQ ID NO: 182020 - DNA, 75 bp, Artificial Sequence
  Synthetic
aaataaaaaattgctctttcaatacaaccacagaaataagggataagaaacagaaagtgtatgcactttttcata

SEQ ID NO: 182021 - DNA, 75 bp, Artificial Sequence
  Synthetic
acaccaaaaaagataaggccacctttgcctagtgttacaaaactgacagaggatagatggaacaagccccagaag

SEQ ID NO: 182022 - DNA, 75 bp, Artificial Sequence
  Synthetic
cagacctaacaacaataccaggaaaagtatacgtataggaccaggacaagcattctatgcaacaggtgacataat

SEQ ID NO: 182023 - DNA, 75 bp, Artificial Sequence
  Synthetic
agtatacgtataggaccaggacaagcattctatgcaacaggtgacataataggggatataagacaagcatattgt

SEQ ID NO: 182024 - DNA, 75 bp, Artificial Sequence
  Synthetic
ttgaagcttgtagactttgtggagctgtaatgcaatattggctacaagaattgaaaaatagtgctacaaacctgc

SEQ ID NO: 182025 - DNA, 75 bp, Artificial Sequence
  Synthetic
cactcccatgcagaataaaacaaattataaatatgtggcagggagtaggacgagcaatgtatgcccctcccattg

SEQ ID NO: 182026 - DNA, 75 bp, Artificial Sequence
  Synthetic
ctctgatcctcaacaaccatgtgcacctggagtaggagctgtctccagggagttagcaactagagggggaatatc

SEQ ID NO: 182027 - DNA, 75 bp, Artificial Sequence
  Synthetic
gacaggttaattgatagaataacagaaagagcagaagacagtggcaatgagagtgatggagatcaggaggaatta

SEQ ID NO: 182028 - DNA, 75 bp, Artificial Sequence
  Synthetic
ttacaagcaattcagttagctttacaggattcaggatcagaagtgaacatagtaacagactcacagtatgcatta

SEQ ID NO: 182029 - DNA, 75 bp, Artificial Sequence
  Synthetic
agtaagacctcaagtgcctctaaggccaatgacctttaaagcagcctttgacctcagcttctttttaaaagaaaa

SEQ ID NO: 182030 - DNA, 75 bp, Artificial Sequence
  Synthetic
gaacttaaatcattatacaacacagtagcaactctctattgtgtacataaaaggatagatgtaagagacaccaag

SEQ ID NO: 182031 - DNA, 75 bp, Artificial Sequence
  Synthetic
ctgcggagcctgtgcctcttcagctaccaccgattgagagacttcatattaattgcagtgagagcagtggaactt

SEQ ID NO: 182032 - DNA, 75 bp, Artificial Sequence
  Synthetic
agtagtgatagcaatactactaattgggaaaaagtaaaggaagaaatgacaatctgctctttcaatgtcaccaca

SEQ ID NO: 182033 - DNA, 75 bp, Artificial Sequence
  Synthetic
cttgaaatctctctggaacttattagcagtactctggtgtgttcatagcagaattgacattcaggatacacagca

SEQ ID NO: 182034 - DNA, 75 bp, Artificial Sequence
  Synthetic
aagtatacatataggattcggaagagcaatttatgcaacaggagaaataataggaaatccaagacaagcacattg

SEQ ID NO: 182035 - DNA, 75 bp, Artificial Sequence
  Synthetic
tttggccttcccacaaggggaggccagggaatttccttcagaacaggccagagccaacagccccaccagcagaga

SEQ ID NO: 182036 - DNA, 75 bp, Artificial Sequence
  Synthetic
cagttttaattgtggaggggaatttttctactgtaattcaacacaactgtttaatagtacttggaatgttactga

SEQ ID NO: 182037 - DNA, 75 bp, Artificial Sequence
  Synthetic
acactctattgtgtacatcaaaggatagatgtaaaagacaccaaagaagctctagaggaagtggaaaaggcacag

SEQ ID NO: 182038 - DNA, 75 bp, Artificial Sequence
  Synthetic
gcagaattaaacaaattatcacatgtgttgagaagtaggcaaaagcaatgtatgcccctcccatcagcggacaaa

SEQ ID NO: 182039 - DNA, 75 bp, Artificial Sequence
  Synthetic
gcgacgaagacctcctccggacaatcagactcatcaagtttctctatcaaagcagtaagtaatatatgtaatgca

SEQ ID NO: 182040 - DNA, 75 bp, Artificial Sequence
  Synthetic
aaggcaaaaatactagcagaggcaatggtttctgcccagcaagatttaaagggaggatacacatcaatattcatg

SEQ ID NO: 182041 - DNA, 75 bp, Artificial Sequence
  Synthetic
aaggcaaaaatactagcagaggcaatggtttctgcccagcatgatttaaagggaggatacacatcaatattcatg

SEQ ID NO: 182042 - DNA, 75 bp, Artificial Sequence
  Synthetic
aaggcaaaaatactagcagaggcaatggtttctgcccagcacgatttaaagggaggatacacatcaatattcatg

SEQ ID NO: 182043 - DNA, 75 bp, Artificial Sequence
  Synthetic
aaggcaaaaatactagcagaggcaatggtttctgcccagcaggatttaaagggaggatacacatcaatattcatg

SEQ ID NO: 182044 - DNA, 75 bp, Artificial Sequence
  Synthetic
caaaaaagaatagacaggttaattcagagaataagtgaaagagcagaagacagtggcaatgagagtgaaggagat

SEQ ID NO: 182045 - DNA, 75 bp, Artificial Sequence
  Synthetic
tttggggttgctctggaaaactcatctgcaccactgctgtgccttggaatgctagttggagtaataaatctctga

SEQ ID NO: 182046 - DNA, 75 bp, Artificial Sequence
  Synthetic
accttaattgaagaatcgcagaaccaacaggaaaagaatgaacaagagttattggaattggatcagtgggcaagt

SEQ ID NO: 182047 - DNA, 75 bp, Artificial Sequence
  Synthetic
aaaactgctcttttaatgttaccacagagataagagataaggtaaagaacgaatatgcatatttttataaacttg

SEQ ID NO: 182048 - DNA, 75 bp, Artificial Sequence
  Synthetic
tcaactgtggcaaggaaggacacatagccagaaattgcagggcccctaggaaaaaaggctgttggaaatgtggaa

SEQ ID NO: 182049 - DNA, 75 bp, Artificial Sequence
  Synthetic
agtagcactaataatagcaatagttgtgtggactatagtatatatagaatataggaaactagtaaggcaaagaaa

SEQ ID NO: 182050 - DNA, 75 bp, Artificial Sequence
  Synthetic
gccatattaggacaaatagttactcctaggtgtaattatcaagcaggacataacaaggtaggatctttacaatat

SEQ ID NO: 182051 - DNA, 75 bp, Artificial Sequence
  Synthetic
aggaaatataacagatgaagtaagaaactgtacttttaatatgaccacagaactaaaagataagaagcagaaggt

SEQ ID NO: 182052 - DNA, 75 bp, Artificial Sequence
  Synthetic
cacatccagggggtttaaagcaaaggcaatctgttacagtcttagatgtaggagatgcttatttctcatgtcctt

SEQ ID NO: 182053 - DNA, 75 bp, Artificial Sequence
  Synthetic
tgaatctgtacaaattaattgtacaagacccaacaacaatacaagaaaaagtatacgtatacatagaggaccagg

SEQ ID NO: 182054 - DNA, 75 bp, Artificial Sequence
  Synthetic
gagagcatttgttacatcaggcataccaggagatataagacaagcacattgtaaccttagtagagcagaatggaa

SEQ ID NO: 182055 - DNA, 75 bp, Artificial Sequence
  Synthetic
gaacaataaaatttcaaccatcctcaggaggggacccagaaattgtaactcacagttttaattgtggcggggaat

SEQ ID NO: 182056 - DNA, 75 bp, Artificial Sequence
  Synthetic
caaatgcatacagatataatcagtctatgggatcaaagcctaaagccatgtgtaaagttaaccccactctgtgtt

SEQ ID NO: 182057 - DNA, 75 bp, Artificial Sequence
  Synthetic
gggaaaaaattcggttacggccagggggaaagaaaaaatataaattaaaacatatagtatgggcaagcagggagc

SEQ ID NO: 182058 - DNA, 75 bp, Artificial Sequence
  Synthetic
ataaacatgtggcaggaagtaggaaaagcaatgtatgcccctcccatcgagggactaattagatgtacatcaaat

SEQ ID NO: 182059 - DNA, 75 bp, Artificial Sequence
  Synthetic
gcggagacagcgacgaagaactcctcaagacgatcaggctcatcaagatcctatatcagagcagtaagtagtgca

SEQ ID NO: 182060 - DNA, 75 bp, Artificial Sequence
  Synthetic
cagccatcccttcagacaggatcagaagaacttaaatcattatataatacagtagcaaccctctattgtgtacat

SEQ ID NO: 182061 - DNA, 75 bp, Artificial Sequence
  Synthetic
aatgtaacagaaaattttaacatgtggaaaaatgacatggtggatcagatgcatgaggatataatcagtttatgg

SEQ ID NO: 182062 - DNA, 75 bp, Artificial Sequence
  Synthetic
cacaaacttaatatacaccttacttgaagaatcgcagaaccagcaagaaaagaatgaacaggaattattggaatt

SEQ ID NO: 182063 - DNA, 75 bp, Artificial Sequence
  Synthetic
gaagttacaatgcataattttaattgtagaggagaattcttttactgcaatacatcaggactgtttaataataat

SEQ ID NO: 182064 - DNA, 75 bp, Artificial Sequence
  Synthetic
gggcatcatatcctcccaaccaacacaaagtgactcccctatagttcagcagataatagaagaactaacaaaaaa

SEQ ID NO: 182065 - DNA, 75 bp, Artificial Sequence
  Synthetic
cagctgaccctaatgatggcagaggagaaatgcaaaattgctctttcaatgtaaccacagaagtaagagataaag

SEQ ID NO: 182066 - DNA, 75 bp, Artificial Sequence
  Synthetic
tgcaaatgttaaaagataccatcaatgaggaagctgcagaatgggacagattacatccagtgcatgcagggccta

SEQ ID NO: 182067 - DNA, 75 bp, Artificial Sequence
  Synthetic
aaatgttagcagtaatggcactgagaccgacaatgaggagataaaaaattgctctttcaatgcaaccacagtatt

SEQ ID NO: 182068 - DNA, 75 bp, Artificial Sequence
  Synthetic
cgattagtgcatggattcttagcactcgtctgggacgacctgaggagcctgtgcctcttcagctaccaccgcttg

SEQ ID NO: 182069 - DNA, 75 bp, Artificial Sequence
  Synthetic
tatggcagatggattgtacacatttagaaggcaaaatcataatagttgctgtccatgtagcaagtggcttcatag

SEQ ID NO: 182070 - DNA, 75 bp, Artificial Sequence
  Synthetic
gtggaacttctgggacacagcagtctcaagggactgagactggggtgggaaggcctcaaatatctggggaatctt

SEQ ID NO: 182071 - DNA, 75 bp, Artificial Sequence
  Synthetic
aggatatgttactgacagaggaagacaaaaagttgtctccctaactgacacaacaaatcagaagactgagttaca

SEQ ID NO: 182072 - DNA, 75 bp, Artificial Sequence
  Synthetic
aaggtctgctcacactaatgatgtaaaacaattagcagaagtggtgcaaaaggtggtcctggaaagcatagtaat

SEQ ID NO: 182073 - DNA, 75 bp, Artificial Sequence
  Synthetic
caaaaagaatggagagaggctggcaggcggtaagggaaaggatgcgacgagctgagccacgagctgagccagcag

SEQ ID NO: 182074 - DNA, 75 bp, Artificial Sequence
  Synthetic
ccacatacctagaagaatcagacagggcttagaaagggctttgctataacatgggaggcaaatggtcaaaaagta

SEQ ID NO: 182075 - DNA, 75 bp, Artificial Sequence
  Synthetic
acaagaggaggaggaggaagtgggttttccagtcagacctcaggtacctttaagaccaatgacttacaagggagc

SEQ ID NO: 182076 - DNA, 75 bp, Artificial Sequence
  Synthetic
ggtaatgatagtatggcaagtagacagacagaaagtgagaacatggaccagcttggtgaaacaccataagtacat

SEQ ID NO: 182077 - DNA, 75 bp, Artificial Sequence
  Synthetic
aattagcagaacacttccctaataaaacaataacatttgcaccatcctcaggaggggacctagaaattacaacac

SEQ ID NO: 182078 - DNA, 75 bp, Artificial Sequence
  Synthetic
ccattctaggacagagagtgctgactaagtgtgaataccctgcaggacatagtcaggtagggacactacaatttt

SEQ ID NO: 182079 - DNA, 75 bp, Artificial Sequence
  Synthetic
gatggaacaagcaccagaaaaccagggaccagctagggagccattcaatgagtggacattagagcttctagaaga

SEQ ID NO: 182080 - DNA, 75 bp, Artificial Sequence
  Synthetic
ccagcaagaaaagaatgaacaagaactattgcaattggacaaatgggcaagtttgtggaattggtttagcataac

SEQ ID NO: 182081 - DNA, 75 bp, Artificial Sequence
  Synthetic
tagagcatagaaaacaagataaaagagagcgggaaatacttgaaagattaaggagagtaagggaaatcagggatg

SEQ ID NO: 182082 - DNA, 75 bp, Artificial Sequence
  Synthetic
agcagaagaagggataataattagatctgaaaatctgacagacaatgccaaaacaataatagtacatcttaataa

SEQ ID NO: 182083 - DNA, 75 bp, Artificial Sequence
  Synthetic
tgtatgccacagtctattctggggtacctgtatgggaagaggcaaaaccagtactattctgtgcttcagatgcta

SEQ ID NO: 182084 - DNA, 75 bp, Artificial Sequence
  Synthetic
cagacactttcctagaccatggcttcatagcttaggacaatatatctatgaaacctatggggatacttggacagg

SEQ ID NO: 182085 - DNA, 75 bp, Artificial Sequence
  Synthetic
atgttaaacacagtggggggacatcaggcagccatgcaaatgttaaaagacaccatcaatgaggaagctgcagaa

SEQ ID NO: 182086 - DNA, 75 bp, Artificial Sequence
  Synthetic
aatagtacagtagatagcacgacagaaccaggaacacctatgaaaaactgtagttttaatataactacattcctc

SEQ ID NO: 182087 - DNA, 75 bp, Artificial Sequence
  Synthetic
aggagaagagtcagggatggatccggtagatcctaacctagagccctggaaccatccgggaagtcagcctgcaac

SEQ ID NO: 182088 - DNA, 75 bp, Artificial Sequence
  Synthetic
tagggttaatggaactaatggaacaaatgacacaatatatacattaattaattgtaactccacaactatcaagca

SEQ ID NO: 182089 - DNA, 75 bp, Artificial Sequence
  Synthetic
attggaattggataaatgggcaagtttgtggaattggtttagcataacaaaatggctgtggtatataaaaatatt

SEQ ID NO: 182090 - DNA, 75 bp, Artificial Sequence
  Synthetic
aaatgatgacagcatgtcagggagtgggaggacctagccataaagcaagagttttggctgaggcaatgagccaag

SEQ ID NO: 182091 - DNA, 75 bp, Artificial Sequence
  Synthetic
cctgcacgagagaagaaagaaaaattcaagagatacacgtaggcccaatgagatggcgcagtatggcaagtgtgc

SEQ ID NO: 182092 - DNA, 75 bp, Artificial Sequence
  Synthetic
aagctgtagcaatgcaactgccactggtaaaaatacaactgtcgatgagagcatgaaaggagaaatacagaattg

SEQ ID NO: 182093 - DNA, 75 bp, Artificial Sequence
  Synthetic
aagcaagacaggaaatggtgcaggagatgttaccataatatttaacaaaactagtggtggagatgaagaaataag

SEQ ID NO: 182094 - DNA, 75 bp, Artificial Sequence
  Synthetic
ctaataccactagtagtagcgaggaagcgatggagagaggagaaataaaaaactgctcttgcaatgtcaccacaa

SEQ ID NO: 182095 - DNA, 75 bp, Artificial Sequence
  Synthetic
agacccggatacaacggaaccaatggaaatgagactataccttgcaggttaagacaggtagtaagatcatggata

SEQ ID NO: 182096 - DNA, 75 bp, Artificial Sequence
  Synthetic
aagacaggtagtaagatcatggataaagggagagtcgggactctatgcacctcccatccctggcaacctaacatg

SEQ ID NO: 182097 - DNA, 75 bp, Artificial Sequence
  Synthetic
ggtagggctattctaaatatacctgtaagaataagacaaggctttgaaagagctcttttataacatggggagcaa

SEQ ID NO: 182098 - DNA, 75 bp, Artificial Sequence
  Synthetic
aaaaaactgctctttcaatatgaccacagaattaagggataagaaacagaaagtatattcacttttttatagact

SEQ ID NO: 182099 - DNA, 75 bp, Artificial Sequence
  Synthetic
atgtgacagaaaattttaacatgtggaagaataacatggtagaacaaatgcatgaggatataatcagtttatggg

SEQ ID NO: 182100 - DNA, 75 bp, Artificial Sequence
  Synthetic
atggcagtctagcagaagaagaggtagtaattagatctgacaatttcacagacaatgctaaaaccataatagtac

SEQ ID NO: 182101 - DNA, 75 bp, Artificial Sequence
  Synthetic
agtaggagcagtatctcaagatttagctaagcatggagcaattacaagcagcaacacagcagccaataatcctga

SEQ ID NO: 182102 - DNA, 75 bp, Artificial Sequence
  Synthetic
agctgagagaccctgtacaaattaattgtacaagacccgccaacaatacaagagaaagtatacacataggaccag

SEQ ID NO: 182103 - DNA, 75 bp, Artificial Sequence
  Synthetic
caatacaaccacagaaataagagataagaaacagaaagtgtatgcacttttttataaacctgatgtagtaccact

SEQ ID NO: 182104 - DNA, 75 bp, Artificial Sequence
  Synthetic
caactcacatggcagcaatgggaccaacaaataaacaatgtaagctccattatatatgatgaaatacaagcagca

SEQ ID NO: 182105 - DNA, 75 bp, Artificial Sequence
  Synthetic
gaaattgtgtgtacaagacccaacaataatacaaggaaaagtataaggataggaccaggacaagcattctatgca

SEQ ID NO: 182106 - DNA, 75 bp, Artificial Sequence
  Synthetic
cctgggacaaaagataattgaagcttgcagactttgtggagctgtaatacaatactggctacaagaattgcagaa

SEQ ID NO: 182107 - DNA, 75 bp, Artificial Sequence
  Synthetic
atcccaagaagaattagacaaggagcagaaagaatcttaatgtaacatggggaatgcatggagcaaaagcaaatt

SEQ ID NO: 182108 - DNA, 75 bp, Artificial Sequence
  Synthetic
atcccaagaagaattagacaaggagcagaaagaatcttattgtaacatggggaatgcatggagcaaaagcaaatt

SEQ ID NO: 182109 - DNA, 75 bp, Artificial Sequence
  Synthetic
atcccaagaagaattagacaaggagcagaaagaatcttactgtaacatggggaatgcatggagcaaaagcaaatt

SEQ ID NO: 182110 - DNA, 75 bp, Artificial Sequence
  Synthetic
atcccaagaagaattagacaaggagcagaaagaatcttagtgtaacatggggaatgcatggagcaaaagcaaatt

SEQ ID NO: 182111 - DNA, 75 bp, Artificial Sequence
  Synthetic
atcccaagaagaattagacaaggagcagaaagattcttaatgtaacatggggaatgcatggagcaaaagcaaatt

SEQ ID NO: 182112 - DNA, 75 bp, Artificial Sequence
  Synthetic
atcccaagaagaattagacaaggagcagaaagattcttattgtaacatggggaatgcatggagcaaaagcaaatt

SEQ ID NO: 182113 - DNA, 75 bp, Artificial Sequence
  Synthetic
atcccaagaagaattagacaaggagcagaaagattcttactgtaacatggggaatgcatggagcaaaagcaaatt

SEQ ID NO: 182114 - DNA, 75 bp, Artificial Sequence
  Synthetic
atcccaagaagaattagacaaggagcagaaagattcttagtgtaacatggggaatgcatggagcaaaagcaaatt

SEQ ID NO: 182115 - DNA, 75 bp, Artificial Sequence
  Synthetic
atcccaagaagaattagacaaggagcagaaagactcttaatgtaacatggggaatgcatggagcaaaagcaaatt

SEQ ID NO: 182116 - DNA, 75 bp, Artificial Sequence
  Synthetic
atcccaagaagaattagacaaggagcagaaagactcttattgtaacatggggaatgcatggagcaaaagcaaatt

SEQ ID NO: 182117 - DNA, 75 bp, Artificial Sequence
  Synthetic
atcccaagaagaattagacaaggagcagaaagactcttactgtaacatggggaatgcatggagcaaaagcaaatt

SEQ ID NO: 182118 - DNA, 75 bp, Artificial Sequence
  Synthetic
atcccaagaagaattagacaaggagcagaaagactcttagtgtaacatggggaatgcatggagcaaaagcaaatt

SEQ ID NO: 182119 - DNA, 75 bp, Artificial Sequence
  Synthetic
atcccaagaagaattagacaaggagcagaaagagtcttaatgtaacatggggaatgcatggagcaaaagcaaatt

SEQ ID NO: 182120 - DNA, 75 bp, Artificial Sequence
  Synthetic
atcccaagaagaattagacaaggagcagaaagagtcttattgtaacatggggaatgcatggagcaaaagcaaatt

SEQ ID NO: 182121 - DNA, 75 bp, Artificial Sequence
  Synthetic
atcccaagaagaattagacaaggagcagaaagagtcttactgtaacatggggaatgcatggagcaaaagcaaatt

SEQ ID NO: 182122 - DNA, 75 bp, Artificial Sequence
  Synthetic
atcccaagaagaattagacaaggagcagaaagagtcttagtgtaacatggggaatgcatggagcaaaagcaaatt

SEQ ID NO: 182123 - DNA, 75 bp, Artificial Sequence
  Synthetic
atcccaagaagaattagacaaggtgcagaaagaatcttaatgtaacatggggaatgcatggagcaaaagcaaatt

SEQ ID NO: 182124 - DNA, 75 bp, Artificial Sequence
  Synthetic
atcccaagaagaattagacaaggtgcagaaagaatcttattgtaacatggggaatgcatggagcaaaagcaaatt

SEQ ID NO: 182125 - DNA, 75 bp, Artificial Sequence
  Synthetic
atcccaagaagaattagacaaggtgcagaaagaatcttactgtaacatggggaatgcatggagcaaaagcaaatt

SEQ ID NO: 182126 - DNA, 75 bp, Artificial Sequence
  Synthetic
atcccaagaagaattagacaaggtgcagaaagaatcttagtgtaacatggggaatgcatggagcaaaagcaaatt

SEQ ID NO: 182127 - DNA, 75 bp, Artificial Sequence
  Synthetic
atcccaagaagaattagacaaggtgcagaaagattcttaatgtaacatggggaatgcatggagcaaaagcaaatt

SEQ ID NO: 182128 - DNA, 75 bp, Artificial Sequence
  Synthetic
atcccaagaagaattagacaaggtgcagaaagattcttattgtaacatggggaatgcatggagcaaaagcaaatt

SEQ ID NO: 182129 - DNA, 75 bp, Artificial Sequence
  Synthetic
atcccaagaagaattagacaaggtgcagaaagattcttactgtaacatggggaatgcatggagcaaaagcaaatt

SEQ ID NO: 182130 - DNA, 75 bp, Artificial Sequence
  Synthetic
atcccaagaagaattagacaaggtgcagaaagattcttagtgtaacatggggaatgcatggagcaaaagcaaatt

SEQ ID NO: 182131 - DNA, 75 bp, Artificial Sequence
  Synthetic
atcccaagaagaattagacaaggtgcagaaagactcttaatgtaacatggggaatgcatggagcaaaagcaaatt

SEQ ID NO: 182132 - DNA, 75 bp, Artificial Sequence
  Synthetic
atcccaagaagaattagacaaggtgcagaaagactcttattgtaacatggggaatgcatggagcaaaagcaaatt

SEQ ID NO: 182133 - DNA, 75 bp, Artificial Sequence
  Synthetic
atcccaagaagaattagacaaggtgcagaaagactcttactgtaacatggggaatgcatggagcaaaagcaaatt

SEQ ID NO: 182134 - DNA, 75 bp, Artificial Sequence
  Synthetic
atcccaagaagaattagacaaggtgcagaaagactcttagtgtaacatggggaatgcatggagcaaaagcaaatt

SEQ ID NO: 182135 - DNA, 75 bp, Artificial Sequence
  Synthetic
atcccaagaagaattagacaaggtgcagaaagagtcttaatgtaacatggggaatgcatggagcaaaagcaaatt

SEQ ID NO: 182136 - DNA, 75 bp, Artificial Sequence
  Synthetic
atcccaagaagaattagacaaggtgcagaaagagtcttattgtaacatggggaatgcatggagcaaaagcaaatt

SEQ ID NO: 182137 - DNA, 75 bp, Artificial Sequence
  Synthetic
atcccaagaagaattagacaaggtgcagaaagagtcttactgtaacatggggaatgcatggagcaaaagcaaatt

SEQ ID NO: 182138 - DNA, 75 bp, Artificial Sequence
  Synthetic
atcccaagaagaattagacaaggtgcagaaagagtcttagtgtaacatggggaatgcatggagcaaaagcaaatt

SEQ ID NO: 182139 - DNA, 75 bp, Artificial Sequence
  Synthetic
atcccaagaagaattagacaaggcgcagaaagaatcttaatgtaacatggggaatgcatggagcaaaagcaaatt

SEQ ID NO: 182140 - DNA, 75 bp, Artificial Sequence
  Synthetic
atcccaagaagaattagacaaggcgcagaaagaatcttattgtaacatggggaatgcatggagcaaaagcaaatt

SEQ ID NO: 182141 - DNA, 75 bp, Artificial Sequence
  Synthetic
atcccaagaagaattagacaaggcgcagaaagaatcttactgtaacatggggaatgcatggagcaaaagcaaatt

SEQ ID NO: 182142 - DNA, 75 bp, Artificial Sequence
  Synthetic
atcccaagaagaattagacaaggcgcagaaagaatcttagtgtaacatggggaatgcatggagcaaaagcaaatt

SEQ ID NO: 182143 - DNA, 75 bp, Artificial Sequence
  Synthetic
atcccaagaagaattagacaaggcgcagaaagattcttaatgtaacatggggaatgcatggagcaaaagcaaatt

SEQ ID NO: 182144 - DNA, 75 bp, Artificial Sequence
  Synthetic
atcccaagaagaattagacaaggcgcagaaagattcttattgtaacatggggaatgcatggagcaaaagcaaatt

SEQ ID NO: 182145 - DNA, 75 bp, Artificial Sequence
  Synthetic
atcccaagaagaattagacaaggcgcagaaagattcttactgtaacatggggaatgcatggagcaaaagcaaatt

SEQ ID NO: 182146 - DNA, 75 bp, Artificial Sequence
  Synthetic
atcccaagaagaattagacaaggcgcagaaagattcttagtgtaacatggggaatgcatggagcaaaagcaaatt

SEQ ID NO: 182147 - DNA, 75 bp, Artificial Sequence
  Synthetic
atcccaagaagaattagacaaggcgcagaaagactcttaatgtaacatggggaatgcatggagcaaaagcaaatt

SEQ ID NO: 182148 - DNA, 75 bp, Artificial Sequence
  Synthetic
atcccaagaagaattagacaaggcgcagaaagactcttattgtaacatggggaatgcatggagcaaaagcaaatt

SEQ ID NO: 182149 - DNA, 75 bp, Artificial Sequence
  Synthetic
atcccaagaagaattagacaaggcgcagaaagactcttactgtaacatggggaatgcatggagcaaaagcaaatt

SEQ ID NO: 182150 - DNA, 75 bp, Artificial Sequence
  Synthetic
atcccaagaagaattagacaaggcgcagaaagactcttagtgtaacatggggaatgcatggagcaaaagcaaatt

SEQ ID NO: 182151 - DNA, 75 bp, Artificial Sequence
  Synthetic
atcccaagaagaattagacaaggcgcagaaagagtcttaatgtaacatggggaatgcatggagcaaaagcaaatt

SEQ ID NO: 182152 - DNA, 75 bp, Artificial Sequence
  Synthetic
atcccaagaagaattagacaaggcgcagaaagagtcttattgtaacatggggaatgcatggagcaaaagcaaatt

SEQ ID NO: 182153 - DNA, 75 bp, Artificial Sequence
  Synthetic
atcccaagaagaattagacaaggcgcagaaagagtcttactgtaacatggggaatgcatggagcaaaagcaaatt

SEQ ID NO: 182154 - DNA, 75 bp, Artificial Sequence
  Synthetic
atcccaagaagaattagacaaggcgcagaaagagtcttagtgtaacatggggaatgcatggagcaaaagcaaatt

SEQ ID NO: 182155 - DNA, 75 bp, Artificial Sequence
  Synthetic
atcccaagaagaattagacaaggggcagaaagaatcttaatgtaacatggggaatgcatggagcaaaagcaaatt

SEQ ID NO: 182156 - DNA, 75 bp, Artificial Sequence
  Synthetic
atcccaagaagaattagacaaggggcagaaagaatcttattgtaacatggggaatgcatggagcaaaagcaaatt

SEQ ID NO: 182157 - DNA, 75 bp, Artificial Sequence
  Synthetic
atcccaagaagaattagacaaggggcagaaagaatcttactgtaacatggggaatgcatggagcaaaagcaaatt

SEQ ID NO: 182158 - DNA, 75 bp, Artificial Sequence
  Synthetic
atcccaagaagaattagacaaggggcagaaagaatcttagtgtaacatggggaatgcatggagcaaaagcaaatt

SEQ ID NO: 182159 - DNA, 75 bp, Artificial Sequence
  Synthetic
atcccaagaagaattagacaaggggcagaaagattcttaatgtaacatggggaatgcatggagcaaaagcaaatt

SEQ ID NO: 182160 - DNA, 75 bp, Artificial Sequence
  Synthetic
atcccaagaagaattagacaaggggcagaaagattcttattgtaacatggggaatgcatggagcaaaagcaaatt

SEQ ID NO: 182161 - DNA, 75 bp, Artificial Sequence
  Synthetic
atcccaagaagaattagacaaggggcagaaagattcttactgtaacatggggaatgcatggagcaaaagcaaatt

SEQ ID NO: 182162 - DNA, 75 bp, Artificial Sequence
  Synthetic
atcccaagaagaattagacaaggggcagaaagattcttagtgtaacatggggaatgcatggagcaaaagcaaatt

SEQ ID NO: 182163 - DNA, 75 bp, Artificial Sequence
  Synthetic
atcccaagaagaattagacaaggggcagaaagactcttaatgtaacatggggaatgcatggagcaaaagcaaatt

SEQ ID NO: 182164 - DNA, 75 bp, Artificial Sequence
  Synthetic
atcccaagaagaattagacaaggggcagaaagactcttattgtaacatggggaatgcatggagcaaaagcaaatt

SEQ ID NO: 182165 - DNA, 75 bp, Artificial Sequence
  Synthetic
atcccaagaagaattagacaaggggcagaaagactcttactgtaacatggggaatgcatggagcaaaagcaaatt

SEQ ID NO: 182166 - DNA, 75 bp, Artificial Sequence
  Synthetic
atcccaagaagaattagacaaggggcagaaagactcttagtgtaacatggggaatgcatggagcaaaagcaaatt

SEQ ID NO: 182167 - DNA, 75 bp, Artificial Sequence
  Synthetic
atcccaagaagaattagacaaggggcagaaagagtcttaatgtaacatggggaatgcatggagcaaaagcaaatt

SEQ ID NO: 182168 - DNA, 75 bp, Artificial Sequence
  Synthetic
atcccaagaagaattagacaaggggcagaaagagtcttattgtaacatggggaatgcatggagcaaaagcaaatt

SEQ ID NO: 182169 - DNA, 75 bp, Artificial Sequence
  Synthetic
atcccaagaagaattagacaaggggcagaaagagtcttactgtaacatggggaatgcatggagcaaaagcaaatt

SEQ ID NO: 182170 - DNA, 75 bp, Artificial Sequence
  Synthetic
atcccaagaagaattagacaaggggcagaaagagtcttagtgtaacatggggaatgcatggagcaaaagcaaatt

SEQ ID NO: 182171 - DNA, 75 bp, Artificial Sequence
  Synthetic
agaatgagacaatcctcccctgaccctcaaccatgtgcacctggagtaggagcagtctccagagagttagcagat

SEQ ID NO: 182172 - DNA, 75 bp, Artificial Sequence
  Synthetic
taaaaacatattgggggttgcaaacaggagaaagagattggcatttgggtcatggagcctccatagaatggagat

SEQ ID NO: 182173 - DNA, 75 bp, Artificial Sequence
  Synthetic
aagaaatgatgacagcatgtcagggagtgggaggacccagtcacaaagcaagagttttagctgaggcaatgagcc

SEQ ID NO: 182174 - DNA, 75 bp, Artificial Sequence
  Synthetic
ataaggtaggatctctacaatatttggcactgacagcactgataaaaccaaaaaggataaagccacctctgccta

SEQ ID NO: 182175 - DNA, 75 bp, Artificial Sequence
  Synthetic
aaaaaagagtgctattagtctgcttgataccatagcaatagcagtagctgagggaacagataggattatagaatt

SEQ ID NO: 182176 - DNA, 75 bp, Artificial Sequence
  Synthetic
ctgtcctccacgtacctagaagaataagacagggcttcgaaagggctatgctataaaatgggtggcaagtggtta

SEQ ID NO: 182177 - DNA, 75 bp, Artificial Sequence
  Synthetic
cctggatgcagtgggaaaaagaaattgataattacacagacttaatatacaacttaattgaaaaatcgcaaaacc

SEQ ID NO: 182178 - DNA, 75 bp, Artificial Sequence
  Synthetic
tgttgccaataccaataatagtagtgggttagaagggataacgggagaactaagaaactgctctttcaatgtcac

SEQ ID NO: 182179 - DNA, 75 bp, Artificial Sequence
  Synthetic
ctgtaagggaaaaaatcacacaagctgacgcccggcagcagaagggtggagcagtatctcgagatctcgaacaac

SEQ ID NO: 182180 - DNA, 75 bp, Artificial Sequence
  Synthetic
cctgcaatcactctggaacacaatagcagtactctggtgtgttcacaaacgatacaaagttgaagacacacagca

SEQ ID NO: 182181 - DNA, 75 bp, Artificial Sequence
  Synthetic
gcagtactctggtgtgttcacaaacgatacaaagttgaagacacacagcaggcaatacaaaaacttaaggaagta

SEQ ID NO: 182182 - DNA, 75 bp, Artificial Sequence
  Synthetic
tgggtggacagatagggttatagaaataggacaaaggctttgtagagctatcctcaacgtacctgtcagaatcag

SEQ ID NO: 182183 - DNA, 75 bp, Artificial Sequence
  Synthetic
atgggtaaaggcagtagaagaaaaggcctttaaccctgaaattattcctatgtttatggcattgtcagagggagc

SEQ ID NO: 182184 - DNA, 75 bp, Artificial Sequence
  Synthetic
gcctttaaccctgaaattattcctatgtttatggcattgtcagagggagctatttcccatgatgtcaataccatg

SEQ ID NO: 182185 - DNA, 75 bp, Artificial Sequence
  Synthetic
agcaatagcagtagctgaaggaacagataggattattgaagtaatacaaagaatttgtagagctatccgcaacat

SEQ ID NO: 182186 - DNA, 75 bp, Artificial Sequence
  Synthetic
gcaaccctctattgtgtgcatcaaaggatagatgtaaaagacaccaaggaagctttagacaagatagaggaagag

SEQ ID NO: 182187 - DNA, 75 bp, Artificial Sequence
  Synthetic
gtatacatgtaggatgggggagagcattatatacaacaggacaaataataggagatataagaaaggcacattgta

SEQ ID NO: 182188 - DNA, 75 bp, Artificial Sequence
  Synthetic
agcaggaggggacctagaagttacaacacatagctttaattgtagaggagaatttttctattgcaatacatcaaa

SEQ ID NO: 182189 - DNA, 75 bp, Artificial Sequence
  Synthetic
atacgaaaagaaacatgggaagtatggtggacagaatattggcaagccacctggattcctgactgggaatttgtc

SEQ ID NO: 182190 - DNA, 75 bp, Artificial Sequence
  Synthetic
ttagccctaggtgtaactaccaagcaggacataacaaggtaggatctctacaatatctggcactaacagcattaa

SEQ ID NO: 182191 - DNA, 75 bp, Artificial Sequence
  Synthetic
gaaagattgtaaacatcaggcaaattttttagggagatactggcctccagggggcacgaggccaggcaattattt

SEQ ID NO: 182192 - DNA, 75 bp, Artificial Sequence
  Synthetic
gatagaggtaaaagacaccaaggaagccttagataaaatagaggaagcacaaaataagagcaagcaaaagacaca

SEQ ID NO: 182193 - DNA, 75 bp, Artificial Sequence
  Synthetic
gagagcaatggctagtgattttaacctgccacctgtagtagcaaaagaaatagtagccagctgtgataaatgtca

SEQ ID NO: 182194 - DNA, 75 bp, Artificial Sequence
  Synthetic
attctagatccatttaggaaagataacccagaaatagaaatttgccagtacatggatgacttatatgtaggatca

SEQ ID NO: 182195 - DNA, 75 bp, Artificial Sequence
  Synthetic
atggcctgctgtaagggaaagaatgagaagaactgagccaggggaaagaaggagacgaaatgagccagcagtaga

SEQ ID NO: 182196 - DNA, 75 bp, Artificial Sequence
  Synthetic
cacaagaggaggacgaggaagtaggctttccagtcagacctcaggtgccttaagaccaatgacttttaaagaagc

SEQ ID NO: 182197 - DNA, 75 bp, Artificial Sequence
  Synthetic
gcgagtcaaatctatcaaggaattagagtaagagaattgtgcaaattgattaggggaaccaaatcactgacagaa

SEQ ID NO: 182198 - DNA, 75 bp, Artificial Sequence
  Synthetic
aaaatcctgtaccaaagcagtaagtagtaataattagtatatgtaatgcaatcattagaaatatctgcaatagta

SEQ ID NO: 182199 - DNA, 75 bp, Artificial Sequence
  Synthetic
atgctacaaatgccacagatgccaccgctgaccctactgatggcggaggagaaatgcaaaattgctctttcaatg

SEQ ID NO: 182200 - DNA, 75 bp, Artificial Sequence
  Synthetic
ttgtacaagacccaacaacaatacaagaaagggtatacatataggaccaggacaagcattttatgcaacaggaga

SEQ ID NO: 182201 - DNA, 75 bp, Artificial Sequence
  Synthetic
gaaatgcaaaattgctctttcaatgtcgccaccgatgtaagagatgaagagaaaaatgtacatgcgcttgttcat

SEQ ID NO: 182202 - DNA, 75 bp, Artificial Sequence
  Synthetic
tcgacatagcagaataggcattactccacagaggagagcaaggaatggagccagtagatcctagactagagccct

SEQ ID NO: 182203 - DNA, 75 bp, Artificial Sequence
  Synthetic
aatatgcattgggcatcatatcctcccaacctacacagagtgactcccctatagttcagcagataatagaagaaa

SEQ ID NO: 182204 - DNA, 75 bp, Artificial Sequence
  Synthetic
ataagaaaagcacattgtaatattagtagagcagaatggaataaaactatacaacaggtaactgaaaaattagaa

SEQ ID NO: 182205 - DNA, 75 bp, Artificial Sequence
  Synthetic
gtagccaaagaaattattgctagctgtcctaaatgtcatataagaggggaagcaatacatggccaggtagactgc

SEQ ID NO: 182206 - DNA, 75 bp, Artificial Sequence
  Synthetic
gaagcggagacagcgacgaagcactcctccaagcagtgaggatcatcaaaatcttatatcaaagcagtaagtata

SEQ ID NO: 182207 - DNA, 75 bp, Artificial Sequence
  Synthetic
atactaaaattagcaggaagatggccagtcaaagtaatacatacagacaatggcagcaatttcaccagtgctgca

SEQ ID NO: 182208 - DNA, 75 bp, Artificial Sequence
  Synthetic
gtacatcatcacagctgtttaatacgtgcgtgcttcttcattattatactggatgcaccaccaacgtacaacaga

SEQ ID NO: 182209 - DNA, 75 bp, Artificial Sequence
  Synthetic
ctatttcctgttaaaattagcagcaagatggcctgttaaaataatacatacagacaatgggcctaattttacaag

SEQ ID NO: 182210 - DNA, 75 bp, Artificial Sequence
  Synthetic
aaacaatgcttcccatcagactacaactcataataagtaatgtatgcccttgtccatggcaaggagtgtcagcag

SEQ ID NO: 182211 - DNA, 75 bp, Artificial Sequence
  Synthetic
ctggtactaataatagccgttgcgaagaaatgaaaaactgcacttttaatatcaccacaggcataggaggtaaga

SEQ ID NO: 182212 - DNA, 75 bp, Artificial Sequence
  Synthetic
gcgttcctcaggaggagacccagaaattgtaatgcacagtttcaattgtggaggagaatttttttactgtaatac

SEQ ID NO: 182213 - DNA, 75 bp, Artificial Sequence
  Synthetic
tattaattgctgcgaggattgtgggcaagggactgacgagggggtgggaagccctcaaatatctggggaatctca

SEQ ID NO: 182214 - DNA, 75 bp, Artificial Sequence
  Synthetic
tggggattaatgccaggggaaagagatgagcacttgggacatggggttagtatagaatggcaatacaaaaggtat

SEQ ID NO: 182215 - DNA, 75 bp, Artificial Sequence
  Synthetic
aggggtgggagcagcgtctcgtgacttagaaagacggggggcaattacaagcagcaataccaaagataataatcc

SEQ ID NO: 182216 - DNA, 75 bp, Artificial Sequence
  Synthetic
gagtgctgaccaggtgtgaatacgcagcaggacatagtcaggtagggacattgcaactcctagccttgagagtaa

SEQ ID NO: 182217 - DNA, 75 bp, Artificial Sequence
  Synthetic
ttgcaactcctagccttgagagtaatagtaaagggaaacaaaaacaagcctcccctacctagtgtccagaagtta

SEQ ID NO: 182218 - DNA, 75 bp, Artificial Sequence
  Synthetic
tcgattggtgaacggattctcagcacttatctgggacgatctgaggaacctgtgcctcttcagctaccaccgctt

SEQ ID NO: 182219 - DNA, 75 bp, Artificial Sequence
  Synthetic
catccctccagacaggatcagaagagcttagatcattatataatacagtagtagtcctctattttgtacatcaaa

SEQ ID NO: 182220 - DNA, 75 bp, Artificial Sequence
  Synthetic
gagctattcttaacatacccagaagaataagacagggctttgaaagggctttactataaaatgggtggcaaatgg

SEQ ID NO: 182221 - DNA, 75 bp, Artificial Sequence
  Synthetic
agaggaagaggaagaagaaatggatccagtagatcctgaattgcccccttggcatcaccctggaagcaagcccca

SEQ ID NO: 182222 - DNA, 75 bp, Artificial Sequence
  Synthetic
atacaacttaattgaaaaatcgcaaaaccaacaagaaaagaatgaacaagaattattggaattagataaatgggc

SEQ ID NO: 182223 - DNA, 75 bp, Artificial Sequence
  Synthetic
cgaagaccagcagttgctgcaggcgtgccgaataatacaaatcctgtaccaaagcagtaagtaacgctaatgtat

SEQ ID NO: 182224 - DNA, 75 bp, Artificial Sequence
  Synthetic
gcctggcttgaagcacaagaagaggaagaggaggttggcttttcagtcagacctcaggttcctccaagaccaatg

SEQ ID NO: 182225 - DNA, 75 bp, Artificial Sequence
  Synthetic
aagaggaggttggcttttcagtcagacctcaggttcctccaagaccaatgacttataatgcagcatcggttctca

SEQ ID NO: 182226 - DNA, 75 bp, Artificial Sequence
  Synthetic
aagatagaagggaaaaagaattacttagaagattgcaaagaataatagaaataagagatgatagtgactatgaaa

SEQ ID NO: 182227 - DNA, 75 bp, Artificial Sequence
  Synthetic
cagaaaattttaacatgtggaaaaataacatggtagaacaaatgcatgaagatataatcagtttatgggatcaaa

SEQ ID NO: 182228 - DNA, 75 bp, Artificial Sequence
  Synthetic
tcaatataaccacagaattaagagataagaaaaagaaagaatatgcactcttttatagacttgatatagtaccac

SEQ ID NO: 182229 - DNA, 75 bp, Artificial Sequence
  Synthetic
ctggggtgcctgtgtgggaagatgcaaaacctgtacttttctgtgcatcagatgttaacctgacaagcactgagc

SEQ ID NO: 182230 - DNA, 75 bp, Artificial Sequence
  Synthetic
actgctctttccaggtcaccacaggcataggagatagaacaaagaaagaatatgcacttttttataagcatgatg

SEQ ID NO: 182231 - DNA, 75 bp, Artificial Sequence
  Synthetic
ttacatggtagaccaaatgcaagaagacatcattagcttatgggatcagagtttaaaaccttgtgttaagatgac

SEQ ID NO: 182232 - DNA, 75 bp, Artificial Sequence
  Synthetic
acagatgtcacaaataacaaagctacaaactcatcagaggaggaaacactcgtaaagaagtgtgactttaatgta

SEQ ID NO: 182233 - DNA, 75 bp, Artificial Sequence
  Synthetic
taaagtgtaaagataagaagttcaatggaacaggaccatgcaaaaatgtcagcacagtacaatgtacacatggaa

SEQ ID NO: 182234 - DNA, 75 bp, Artificial Sequence
  Synthetic
caagcaagcctgtccaaaggtatcttttgagcccattccaatacattattgtgctccagcaggatatgccatctt

SEQ ID NO: 182235 - DNA, 75 bp, Artificial Sequence
  Synthetic
aggacgagggagagcaatttatgcaacagatagaataataggagatataagacaagcatattgtaacattagtag

SEQ ID NO: 182236 - DNA, 75 bp, Artificial Sequence
  Synthetic
ggcgcagaaagggctttgcagtaagatgggtggcaagtggtcaaaaagtagtctggtaggatggcctgcagtaag

SEQ ID NO: 182237 - DNA, 75 bp, Artificial Sequence
  Synthetic
atattaaatggaacactttctgaagacaaaataagaattatgggaaaagatattaaagataataccaagaatatc

SEQ ID NO: 182238 - DNA, 75 bp, Artificial Sequence
  Synthetic
aggagcagcgtctcgagacttagataaacatggagcacttacaaccagtaacacagccagcaataatgctgattg

SEQ ID NO: 182239 - DNA, 75 bp, Artificial Sequence
  Synthetic
tcaagccatgtgtaaagttaacccctctctgtgttactttaaattgtgacgatccgtctgccaacatcacggggg

SEQ ID NO: 182240 - DNA, 75 bp, Artificial Sequence
  Synthetic
taataattagatctgaaaatctgacagacaatgccaaaacaataatagtacaccttaatgaatctatagaaattg

SEQ ID NO: 182241 - DNA, 75 bp, Artificial Sequence
  Synthetic
gaattgaggaaggcaacaagtcaaggatagcttattgtaattatagtcgcactaattgggaaagagccttacaac

SEQ ID NO: 182242 - DNA, 75 bp, Artificial Sequence
  Synthetic
agaaattaatgaaagacagggtaatgaaagtcagagtaatagtagtagtaagtatagattaataaactgtaatac

SEQ ID NO: 182243 - DNA, 75 bp, Artificial Sequence
  Synthetic
tttcagctgtcatggagaattcttttattgcaacacaagtcagctgtttaaatacaccttggactgtaacaattc

SEQ ID NO: 182244 - DNA, 75 bp, Artificial Sequence
  Synthetic
ttcagacctggaggaggaaatatgaaggacaattggagaagtgaattatataaatataaagtagtagaaattgaa

SEQ ID NO: 182245 - DNA, 75 bp, Artificial Sequence
  Synthetic
aaggccagggaacttccttcagagcagaccagagccaacagccccaccagcagagagcttcgggtttggggagga

SEQ ID NO: 182246 - DNA, 75 bp, Artificial Sequence
  Synthetic
agaccagagccaacagccccaccagcagagagcttcgggtttggggaggagataaccccctctcagaaacaggag

SEQ ID NO: 182247 - DNA, 75 bp, Artificial Sequence
  Synthetic
ataatcagtttatgggatcaaagcctaaagccatgtgtgaagttaaccccactctgtgttactttaaattgtact

SEQ ID NO: 182248 - DNA, 75 bp, Artificial Sequence
  Synthetic
tatgcacctcctatcagcggtagcttaacctgtaggtcaaacataactggtttaattctacaaatagacaagtca

SEQ ID NO: 182249 - DNA, 75 bp, Artificial Sequence
  Synthetic
catttagaccaatagggggagacatgaaagatatatggaggactaaattgtacaaatacaaggtaataaagataa

SEQ ID NO: 182250 - DNA, 75 bp, Artificial Sequence
  Synthetic
catttagaccaatagggggagacatgaaagatatatggaggactaaattgtacaattacaaggtaataaagataa

SEQ ID NO: 182251 - DNA, 75 bp, Artificial Sequence
  Synthetic
catttagaccaatagggggagacatgaaagatatatggaggactaaattgtacaactacaaggtaataaagataa

SEQ ID NO: 182252 - DNA, 75 bp, Artificial Sequence
  Synthetic
catttagaccaatagggggagacatgaaagatatatggaggactaaattgtacaagtacaaggtaataaagataa

SEQ ID NO: 182253 - DNA, 75 bp, Artificial Sequence
  Synthetic
ctgcaagccttagaaacctttatgcagaatcagcaactcctaaacctgtggggctgtagaggaaggcaaatctgt

SEQ ID NO: 182254 - DNA, 75 bp, Artificial Sequence
  Synthetic
tacacatcagtaaaatggaatacctcatggggaggaaatgactcaatttggaatgacctaacatggcaggaatgg

SEQ ID NO: 182255 - DNA, 75 bp, Artificial Sequence
  Synthetic
tacacatcagtaaaatggaatacctcatggggaggaaatgactcaatttggattgacctaacatggcaggaatgg

SEQ ID NO: 182256 - DNA, 75 bp, Artificial Sequence
  Synthetic
tacacatcagtaaaatggaatacctcatggggaggaaatgactcaatttggactgacctaacatggcaggaatgg

SEQ ID NO: 182257 - DNA, 75 bp, Artificial Sequence
  Synthetic
tacacatcagtaaaatggaatacctcatggggaggaaatgactcaatttggagtgacctaacatggcaggaatgg

SEQ ID NO: 182258 - DNA, 75 bp, Artificial Sequence
  Synthetic
gagaagagtggtggagagagaaaaaagagcagttggactaggagctgtcttccttgggttcttaggagcagcagg

SEQ ID NO: 182259 - DNA, 75 bp, Artificial Sequence
  Synthetic
catggtagtacttaatctagtgaagaacattaggcagggatatcaacccctctcgttacagatccctacccaacg

SEQ ID NO: 182260 - DNA, 75 bp, Artificial Sequence
  Synthetic
tacacggacagcaggacaatcatcttgtggatttaccacctcttgagcaacttaatatcagggatccagaagctg

SEQ ID NO: 182261 - DNA, 75 bp, Artificial Sequence
  Synthetic
gaaatagtgctacaaatctactagataccattgcagtggcaactgccaattggactgacagcattatcttaggtg

SEQ ID NO: 182262 - DNA, 75 bp, Artificial Sequence
  Synthetic
gaaatagtgctacaaatctactagattccattgcagtggcaactgccaattggactgacagcattatcttaggtg

SEQ ID NO: 182263 - DNA, 75 bp, Artificial Sequence
  Synthetic
gaaatagtgctacaaatctactagatcccattgcagtggcaactgccaattggactgacagcattatcttaggtg

SEQ ID NO: 182264 - DNA, 75 bp, Artificial Sequence
  Synthetic
gaaatagtgctacaaatctactagatgccattgcagtggcaactgccaattggactgacagcattatcttaggtg

SEQ ID NO: 182265 - DNA, 75 bp, Artificial Sequence
  Synthetic
ggactaatagtagcaggcatagcagccataattgtgtggaccatagtttttatacaatataaggaaataagaaaa

SEQ ID NO: 182266 - DNA, 75 bp, Artificial Sequence
  Synthetic
taacatcccaaggagaattagacaagggttagaaagaagcttattgtaacatgggaaatatactaacaaaaagta

SEQ ID NO: 182267 - DNA, 75 bp, Artificial Sequence
  Synthetic
gacatatcaaatttatcaagagccatttaaaaatctgaaaacaggaaaatatgcaagaacgaggggtgcccacac

SEQ ID NO: 182268 - DNA, 75 bp, Artificial Sequence
  Synthetic
agaggacgaagtaggtttcccagtaagacctcaagtgcctctacgtccaatgacctataaaggcgcttttgacct

SEQ ID NO: 182269 - DNA, 75 bp, Artificial Sequence
  Synthetic
cagtaacacagcccacaataatgctgattgtgcctggctgcaagcacaggaggaggaagaagaagtaggctttcc

SEQ ID NO: 182270 - DNA, 75 bp, Artificial Sequence
  Synthetic
tgattttaataataatgctactaataccattaatagtctcctagaaatgttggagaaaggagaaataaaaagctg

SEQ ID NO: 182271 - DNA, 75 bp, Artificial Sequence
  Synthetic
tgattttaataataatgctactaataccattaattgtctcctagaaatgttggagaaaggagaaataaaaagctg

SEQ ID NO: 182272 - DNA, 75 bp, Artificial Sequence
  Synthetic
tgattttaataataatgctactaataccattaatcgtctcctagaaatgttggagaaaggagaaataaaaagctg

SEQ ID NO: 182273 - DNA, 75 bp, Artificial Sequence
  Synthetic
tgattttaataataatgctactaataccattaatggtctcctagaaatgttggagaaaggagaaataaaaagctg

SEQ ID NO: 182274 - DNA, 75 bp, Artificial Sequence
  Synthetic
tgattttaataataatgctactaattccattaatagtctcctagaaatgttggagaaaggagaaataaaaagctg

SEQ ID NO: 182275 - DNA, 75 bp, Artificial Sequence
  Synthetic
tgattttaataataatgctactaattccattaattgtctcctagaaatgttggagaaaggagaaataaaaagctg

SEQ ID NO: 182276 - DNA, 75 bp, Artificial Sequence
  Synthetic
tgattttaataataatgctactaattccattaatcgtctcctagaaatgttggagaaaggagaaataaaaagctg

SEQ ID NO: 182277 - DNA, 75 bp, Artificial Sequence
  Synthetic
tgattttaataataatgctactaattccattaatggtctcctagaaatgttggagaaaggagaaataaaaagctg

SEQ ID NO: 182278 - DNA, 75 bp, Artificial Sequence
  Synthetic
tgattttaataataatgctactaatcccattaatagtctcctagaaatgttggagaaaggagaaataaaaagctg

SEQ ID NO: 182279 - DNA, 75 bp, Artificial Sequence
  Synthetic
tgattttaataataatgctactaatcccattaattgtctcctagaaatgttggagaaaggagaaataaaaagctg

SEQ ID NO: 182280 - DNA, 75 bp, Artificial Sequence
  Synthetic
tgattttaataataatgctactaatcccattaatcgtctcctagaaatgttggagaaaggagaaataaaaagctg

SEQ ID NO: 182281 - DNA, 75 bp, Artificial Sequence
  Synthetic
tgattttaataataatgctactaatcccattaatggtctcctagaaatgttggagaaaggagaaataaaaagctg

SEQ ID NO: 182282 - DNA, 75 bp, Artificial Sequence
  Synthetic
tgattttaataataatgctactaatgccattaatagtctcctagaaatgttggagaaaggagaaataaaaagctg

SEQ ID NO: 182283 - DNA, 75 bp, Artificial Sequence
  Synthetic
tgattttaataataatgctactaatgccattaattgtctcctagaaatgttggagaaaggagaaataaaaagctg

SEQ ID NO: 182284 - DNA, 75 bp, Artificial Sequence
  Synthetic
tgattttaataataatgctactaatgccattaatcgtctcctagaaatgttggagaaaggagaaataaaaagctg

SEQ ID NO: 182285 - DNA, 75 bp, Artificial Sequence
  Synthetic
tgattttaataataatgctactaatgccattaatggtctcctagaaatgttggagaaaggagaaataaaaagctg

SEQ ID NO: 182286 - DNA, 75 bp, Artificial Sequence
  Synthetic
tgattttaatattaatgctactaataccattaatagtctcctagaaatgttggagaaaggagaaataaaaagctg

SEQ ID NO: 182287 - DNA, 75 bp, Artificial Sequence
  Synthetic
tgattttaatattaatgctactaataccattaattgtctcctagaaatgttggagaaaggagaaataaaaagctg

SEQ ID NO: 182288 - DNA, 75 bp, Artificial Sequence
  Synthetic
tgattttaatattaatgctactaataccattaatcgtctcctagaaatgttggagaaaggagaaataaaaagctg

SEQ ID NO: 182289 - DNA, 75 bp, Artificial Sequence
  Synthetic
tgattttaatattaatgctactaataccattaatggtctcctagaaatgttggagaaaggagaaataaaaagctg

SEQ ID NO: 182290 - DNA, 75 bp, Artificial Sequence
  Synthetic
tgattttaatattaatgctactaattccattaatagtctcctagaaatgttggagaaaggagaaataaaaagctg

SEQ ID NO: 182291 - DNA, 75 bp, Artificial Sequence
  Synthetic
tgattttaatattaatgctactaattccattaattgtctcctagaaatgttggagaaaggagaaataaaaagctg

SEQ ID NO: 182292 - DNA, 75 bp, Artificial Sequence
  Synthetic
tgattttaatattaatgctactaattccattaatcgtctcctagaaatgttggagaaaggagaaataaaaagctg

SEQ ID NO: 182293 - DNA, 75 bp, Artificial Sequence
  Synthetic
tgattttaatattaatgctactaattccattaatggtctcctagaaatgttggagaaaggagaaataaaaagctg

SEQ ID NO: 182294 - DNA, 75 bp, Artificial Sequence
  Synthetic
tgattttaatattaatgctactaatcccattaatagtctcctagaaatgttggagaaaggagaaataaaaagctg

SEQ ID NO: 182295 - DNA, 75 bp, Artificial Sequence
  Synthetic
tgattttaatattaatgctactaatcccattaattgtctcctagaaatgttggagaaaggagaaataaaaagctg

SEQ ID NO: 182296 - DNA, 75 bp, Artificial Sequence
  Synthetic
tgattttaatattaatgctactaatcccattaatcgtctcctagaaatgttggagaaaggagaaataaaaagctg

SEQ ID NO: 182297 - DNA, 75 bp, Artificial Sequence
  Synthetic
tgattttaatattaatgctactaatcccattaatggtctcctagaaatgttggagaaaggagaaataaaaagctg

SEQ ID NO: 182298 - DNA, 75 bp, Artificial Sequence
  Synthetic
tgattttaatattaatgctactaatgccattaatagtctcctagaaatgttggagaaaggagaaataaaaagctg

SEQ ID NO: 182299 - DNA, 75 bp, Artificial Sequence
  Synthetic
tgattttaatattaatgctactaatgccattaattgtctcctagaaatgttggagaaaggagaaataaaaagctg

SEQ ID NO: 182300 - DNA, 75 bp, Artificial Sequence
  Synthetic
tgattttaatattaatgctactaatgccattaatcgtctcctagaaatgttggagaaaggagaaataaaaagctg

SEQ ID NO: 182301 - DNA, 75 bp, Artificial Sequence
  Synthetic
tgattttaatattaatgctactaatgccattaatggtctcctagaaatgttggagaaaggagaaataaaaagctg

SEQ ID NO: 182302 - DNA, 75 bp, Artificial Sequence
  Synthetic
tgattttaatactaatgctactaataccattaatagtctcctagaaatgttggagaaaggagaaataaaaagctg

SEQ ID NO: 182303 - DNA, 75 bp, Artificial Sequence
  Synthetic
tgattttaatactaatgctactaataccattaattgtctcctagaaatgttggagaaaggagaaataaaaagctg

SEQ ID NO: 182304 - DNA, 75 bp, Artificial Sequence
  Synthetic
tgattttaatactaatgctactaataccattaatcgtctcctagaaatgttggagaaaggagaaataaaaagctg

SEQ ID NO: 182305 - DNA, 75 bp, Artificial Sequence
  Synthetic
tgattttaatactaatgctactaataccattaatggtctcctagaaatgttggagaaaggagaaataaaaagctg

SEQ ID NO: 182306 - DNA, 75 bp, Artificial Sequence
  Synthetic
tgattttaatactaatgctactaattccattaatagtctcctagaaatgttggagaaaggagaaataaaaagctg

SEQ ID NO: 182307 - DNA, 75 bp, Artificial Sequence
  Synthetic
tgattttaatactaatgctactaattccattaattgtctcctagaaatgttggagaaaggagaaataaaaagctg

SEQ ID NO: 182308 - DNA, 75 bp, Artificial Sequence
  Synthetic
tgattttaatactaatgctactaattccattaatcgtctcctagaaatgttggagaaaggagaaataaaaagctg

SEQ ID NO: 182309 - DNA, 75 bp, Artificial Sequence
  Synthetic
tgattttaatactaatgctactaattccattaatggtctcctagaaatgttggagaaaggagaaataaaaagctg

SEQ ID NO: 182310 - DNA, 75 bp, Artificial Sequence
  Synthetic
tgattttaatactaatgctactaatcccattaatagtctcctagaaatgttggagaaaggagaaataaaaagctg

SEQ ID NO: 182311 - DNA, 75 bp, Artificial Sequence
  Synthetic
tgattttaatactaatgctactaatcccattaattgtctcctagaaatgttggagaaaggagaaataaaaagctg

SEQ ID NO: 182312 - DNA, 75 bp, Artificial Sequence
  Synthetic
tgattttaatactaatgctactaatcccattaatcgtctcctagaaatgttggagaaaggagaaataaaaagctg

SEQ ID NO: 182313 - DNA, 75 bp, Artificial Sequence
  Synthetic
tgattttaatactaatgctactaatcccattaatggtctcctagaaatgttggagaaaggagaaataaaaagctg

SEQ ID NO: 182314 - DNA, 75 bp, Artificial Sequence
  Synthetic
tgattttaatactaatgctactaatgccattaatagtctcctagaaatgttggagaaaggagaaataaaaagctg

SEQ ID NO: 182315 - DNA, 75 bp, Artificial Sequence
  Synthetic
tgattttaatactaatgctactaatgccattaattgtctcctagaaatgttggagaaaggagaaataaaaagctg

SEQ ID NO: 182316 - DNA, 75 bp, Artificial Sequence
  Synthetic
tgattttaatactaatgctactaatgccattaatcgtctcctagaaatgttggagaaaggagaaataaaaagctg

SEQ ID NO: 182317 - DNA, 75 bp, Artificial Sequence
  Synthetic
tgattttaatactaatgctactaatgccattaatggtctcctagaaatgttggagaaaggagaaataaaaagctg

SEQ ID NO: 182318 - DNA, 75 bp, Artificial Sequence
  Synthetic
tgattttaatagtaatgctactaataccattaatagtctcctagaaatgttggagaaaggagaaataaaaagctg

SEQ ID NO: 182319 - DNA, 75 bp, Artificial Sequence
  Synthetic
tgattttaatagtaatgctactaataccattaattgtctcctagaaatgttggagaaaggagaaataaaaagctg

SEQ ID NO: 182320 - DNA, 75 bp, Artificial Sequence
  Synthetic
tgattttaatagtaatgctactaataccattaatcgtctcctagaaatgttggagaaaggagaaataaaaagctg

SEQ ID NO: 182321 - DNA, 75 bp, Artificial Sequence
  Synthetic
tgattttaatagtaatgctactaataccattaatggtctcctagaaatgttggagaaaggagaaataaaaagctg

SEQ ID NO: 182322 - DNA, 75 bp, Artificial Sequence
  Synthetic
tgattttaatagtaatgctactaattccattaatagtctcctagaaatgttggagaaaggagaaataaaaagctg

SEQ ID NO: 182323 - DNA, 75 bp, Artificial Sequence
  Synthetic
tgattttaatagtaatgctactaattccattaattgtctcctagaaatgttggagaaaggagaaataaaaagctg

SEQ ID NO: 182324 - DNA, 75 bp, Artificial Sequence
  Synthetic
tgattttaatagtaatgctactaattccattaatcgtctcctagaaatgttggagaaaggagaaataaaaagctg

SEQ ID NO: 182325 - DNA, 75 bp, Artificial Sequence
  Synthetic
tgattttaatagtaatgctactaattccattaatggtctcctagaaatgttggagaaaggagaaataaaaagctg

SEQ ID NO: 182326 - DNA, 75 bp, Artificial Sequence
  Synthetic
tgattttaatagtaatgctactaatcccattaatagtctcctagaaatgttggagaaaggagaaataaaaagctg

SEQ ID NO: 182327 - DNA, 75 bp, Artificial Sequence
  Synthetic
tgattttaatagtaatgctactaatcccattaattgtctcctagaaatgttggagaaaggagaaataaaaagctg

SEQ ID NO: 182328 - DNA, 75 bp, Artificial Sequence
  Synthetic
tgattttaatagtaatgctactaatcccattaatcgtctcctagaaatgttggagaaaggagaaataaaaagctg

SEQ ID NO: 182329 - DNA, 75 bp, Artificial Sequence
  Synthetic
tgattttaatagtaatgctactaatcccattaatggtctcctagaaatgttggagaaaggagaaataaaaagctg

SEQ ID NO: 182330 - DNA, 75 bp, Artificial Sequence
  Synthetic
tgattttaatagtaatgctactaatgccattaatagtctcctagaaatgttggagaaaggagaaataaaaagctg

SEQ ID NO: 182331 - DNA, 75 bp, Artificial Sequence
  Synthetic
tgattttaatagtaatgctactaatgccattaattgtctcctagaaatgttggagaaaggagaaataaaaagctg

SEQ ID NO: 182332 - DNA, 75 bp, Artificial Sequence
  Synthetic
tgattttaatagtaatgctactaatgccattaatcgtctcctagaaatgttggagaaaggagaaataaaaagctg

SEQ ID NO: 182333 - DNA, 75 bp, Artificial Sequence
  Synthetic
tgattttaatagtaatgctactaatgccattaatggtctcctagaaatgttggagaaaggagaaataaaaagctg

SEQ ID NO: 182334 - DNA, 75 bp, Artificial Sequence
  Synthetic
agctataggttgacaagttgtaacacctcaatcattaaacaggcctgtccaaaagtatcctttacgccaattccc

SEQ ID NO: 182335 - DNA, 75 bp, Artificial Sequence
  Synthetic
agtgcgagagcgtctgtgttgacaaagactaaattaaatgcatagaaacaaattaagttaaagccaggatctaaa

SEQ ID NO: 182336 - DNA, 75 bp, Artificial Sequence
  Synthetic
aatactaataatacccatagtaatagtagtttgggaagaatagatgcaggagaagtaaaaaactgttctttcaat

SEQ ID NO: 182337 - DNA, 75 bp, Artificial Sequence
  Synthetic
agttaaagatacacagcaggcagtaagaaaattaaaggaagaaatggagaaaaaaaagcctgtcagtagtactaa

SEQ ID NO: 182338 - DNA, 75 bp, Artificial Sequence
  Synthetic
aagaagtatatcttttacaccagggagtgcatttgttgcaacagaaaacataataggagatataagacaagcaca

SEQ ID NO: 182339 - DNA, 75 bp, Artificial Sequence
  Synthetic
gtaatcaatgataaggcagcagactaagatagaactcatccaccagtagtaggaccattaccaccagggcagata

SEQ ID NO: 182340 - DNA, 75 bp, Artificial Sequence
  Synthetic
aaccagcctatcccagttaagaatatctatagaaagtagatagtaataagactaaacaaaatggtgaaaatgtac

SEQ ID NO: 182341 - DNA, 75 bp, Artificial Sequence
  Synthetic
gagtcctagcagaagcaatggcttcagcccagcaagatctaaaaagaagatacacatcagtattcatgcaaaaaa

SEQ ID NO: 182342 - DNA, 75 bp, Artificial Sequence
  Synthetic
aaaatttggccttccagcaaggggaggccaggaaattttcctcagaacagactggaaccaacagccccaccagca

SEQ ID NO: 182343 - DNA, 75 bp, Artificial Sequence
  Synthetic
gaaatgtggacaggaaagtcatcaaatgaaagattgcaaaaatagaagacagacaaattttttaaagaaatactg

SEQ ID NO: 182344 - DNA, 75 bp, Artificial Sequence
  Synthetic
atgaaagattgcaaaaatagaagacagacaaattttttaaagaaatactggcctccaaaaggcacgaggccaggc

SEQ ID NO: 182345 - DNA, 75 bp, Artificial Sequence
  Synthetic
atgaaaaatatcacaataattggagagcaatggctagtgattttaacataccacctgtggtagcaaaagaaatag

SEQ ID NO: 182346 - DNA, 75 bp, Artificial Sequence
  Synthetic
accaatgctaacttgaccaatgctaacttgaccaatggcaataacataaccgaagaagtaagatcctgttatatt

SEQ ID NO: 182347 - DNA, 75 bp, Artificial Sequence
  Synthetic
tctatccgtttgcctccctcagatccctctttaagacagaccaatagtcacagcaagagttgggggccagctatg

SEQ ID NO: 182348 - DNA, 75 bp, Artificial Sequence
  Synthetic
aattaaaaaaaaaataggcaccaaaaatgatagggggtataagaagttttataaaggtaaaaaaatattataatg

SEQ ID NO: 182349 - DNA, 75 bp, Artificial Sequence
  Synthetic
ggaccaggacaagtattctatagaacaggagacataacaggagatataagaaaagcatattgtgagattaatgga

SEQ ID NO: 182350 - DNA, 75 bp, Artificial Sequence
  Synthetic
ataaagaattagaacaggaaaaaaaaatttcaaaaataagacctaaaaatccttataatacacctatctttacta

SEQ ID NO: 182351 - DNA, 75 bp, Artificial Sequence
  Synthetic
tagtgatattagcaatagtagcattagtagtagcattaataatagcaatagttgtgtggactatagtattcatag

SEQ ID NO: 182352 - DNA, 75 bp, Artificial Sequence
  Synthetic
tccaagaagtttaaagcaaaaacaatctgttacagtcttagatgtaaaagatgcatatttctcatgccccctaga

SEQ ID NO: 182353 - DNA, 75 bp, Artificial Sequence
  Synthetic
gtatgctcctcccatcagaggaagaattaattgtgtatcaaatattacaggaatactattgacaagagatggtgg

SEQ ID NO: 182354 - DNA, 75 bp, Artificial Sequence
  Synthetic
ccaatagtaatagcggggaaataatggggaacgaagagataaaaaattgctctttcaatgtcagcacaggcgcac

SEQ ID NO: 182355 - DNA, 75 bp, Artificial Sequence
  Synthetic
taagaaaaacaacccagaattagaaatttatcaatacatagatgacttatatgtaagatcagatttaccactggc

SEQ ID NO: 182356 - DNA, 75 bp, Artificial Sequence
  Synthetic
agcacaagaggatgaggaagtgggttttccagtcagacctcaggtacctttaagaccaatgactttcaagggagc

SEQ ID NO: 182357 - DNA, 75 bp, Artificial Sequence
  Synthetic
atttatcaatacatagatgacttatatgtaagatcagatttaccactggcagaacataagaaaaaagttaaacta

SEQ ID NO: 182358 - DNA, 75 bp, Artificial Sequence
  Synthetic
ggagattctaaaagaccctgtgcatggggtatattatgacccatcaaaagacttaatagcagaaatacagaaaca

SEQ ID NO: 182359 - DNA, 75 bp, Artificial Sequence
  Synthetic
ttagactgcaataatacaaattatgtcaatgcctcttatgtcaatgccactgtcactgaggaaacagaaatgaaa

SEQ ID NO: 182360 - DNA, 75 bp, Artificial Sequence
  Synthetic
tgtaagttaattagaagaactaagtcattgacagaagtagtaccattaagcaaagaggcagaactagaattaaaa

SEQ ID NO: 182361 - DNA, 75 bp, Artificial Sequence
  Synthetic
atgtcagcacagtacagtgtacacatgggattaagccagtagtgtcaactcaactgttgttgaatggcagtctag

SEQ ID NO: 182362 - DNA, 75 bp, Artificial Sequence
  Synthetic
agtataagaaacatagtaggcagattattggcaagccacctagattcctaaataaaaatttgtcagcacacctcc

SEQ ID NO: 182363 - DNA, 75 bp, Artificial Sequence
  Synthetic
accataatagtacagcttaatgagtctgtaccaattacttgcataaggcccaacaacaatacaagacaaagtaca

SEQ ID NO: 182364 - DNA, 75 bp, Artificial Sequence
  Synthetic
aaaccttttatgtagatagagcagctaatagagacacaaaactaagaaaggcaggatatattacagaacaaaaga

SEQ ID NO: 182365 - DNA, 75 bp, Artificial Sequence
  Synthetic
cttatagaatataggaaaatattaagacaaagaaaaatagacaggataattgatagaataagagaaagagcagaa

SEQ ID NO: 182366 - DNA, 75 bp, Artificial Sequence
  Synthetic
acagagggggtgggaagcccttaaatatctgggaagtcttgtgcagtattggggtctggaactaaaaaagagtac

SEQ ID NO: 182367 - DNA, 75 bp, Artificial Sequence
  Synthetic
aatattaaaaaagtcctattcctaaaaaaaataaatcaaacacaaaaagatcataaaaaatatcataataattaa

SEQ ID NO: 182368 - DNA, 75 bp, Artificial Sequence
  Synthetic
aagcaggagccgaaagacagggaacccttaacttccctcaaatcactctttggcagcgaccccttgtctcaataa

SEQ ID NO: 182369 - DNA, 75 bp, Artificial Sequence
  Synthetic
tcactttaaactgcacagataccaagaatggtaccactcatgataataaaaccataggtgcagaaatgaaaaatt

SEQ ID NO: 182370 - DNA, 75 bp, Artificial Sequence
  Synthetic
ataaaaaaaaaagcaatgcatagccaagtagactacagtccaaaaatatggcaaataaattgcacacatttaaaa

SEQ ID NO: 182371 - DNA, 75 bp, Artificial Sequence
  Synthetic
agaatagtactaataccagtagtactaataccactagctggggagggatagtcagaggagagataaaaaactgct

SEQ ID NO: 182372 - DNA, 75 bp, Artificial Sequence
  Synthetic
tagttataggttgataagttgtaatacctcagtcgttacacaggcctgtccaaagatatcctttgagccaattcc

SEQ ID NO: 182373 - DNA, 75 bp, Artificial Sequence
  Synthetic
aattagcagcaaaatggcctattaaaatactacatacagacaataggcctaactttacaagtgcagccataaaag

SEQ ID NO: 182374 - DNA, 75 bp, Artificial Sequence
  Synthetic
aactttacaagtgcagccataaaagctgcatgttagtagacaaacatacaacataagtttaaaataccatataat

SEQ ID NO: 182375 - DNA, 75 bp, Artificial Sequence
  Synthetic
caaatgctattgtaaaatatgttgctggcattgtcaagtttgctttctgaacaaaggcttaggcatctcctatgg

SEQ ID NO: 182376 - DNA, 75 bp, Artificial Sequence
  Synthetic
agacccaacaacaatacaagaagacgcataactatgggaccaggcagagcatattatacaacaggagacataata

SEQ ID NO: 182377 - DNA, 75 bp, Artificial Sequence
  Synthetic
aggaccggcacagctcctgtggaaaggtgagggagcagtagtcatacaagataaaggagacattaaagtagtacc

SEQ ID NO: 182378 - DNA, 75 bp, Artificial Sequence
  Synthetic
tagaatttgcaccaccttcaggaggggacctagaaattatgacacatagctttaattgtgggggagaatttttct

SEQ ID NO: 182379 - DNA, 75 bp, Artificial Sequence
  Synthetic
agaaggtgaaagcgtggaacagcctagtgaaataccataaatacaggtctaaaaaggccaaagattagtattata

SEQ ID NO: 182380 - DNA, 75 bp, Artificial Sequence
  Synthetic
aggagaaagagaggagcagttaggacatggagttagtatagaatggcagtgcaggaagtatataacacagattga

SEQ ID NO: 182381 - DNA, 75 bp, Artificial Sequence
  Synthetic
catggagttagtatagaatggcagtgcaggaagtatataacacagattgaccctgaaacagcagacaagctaata

SEQ ID NO: 182382 - DNA, 75 bp, Artificial Sequence
  Synthetic
ctaaagaatagtgctattagcttgcttaataccacagcaatagcagtagctgaagggacagataggattatagaa

SEQ ID NO: 182383 - DNA, 75 bp, Artificial Sequence
  Synthetic
aaggcagaagcagtaagacattttcctagaaactggctgcaagccttaggacaatacatttatgagacttatgga

SEQ ID NO: 182384 - DNA, 75 bp, Artificial Sequence
  Synthetic
aagaaaaagaataactatgggaccagggagagtattgtatacaacaggacaaataataggagatataagaaaagc

SEQ ID NO: 182385 - DNA, 75 bp, Artificial Sequence
  Synthetic
catctaacgcaagaagaaaaagaagaaaagatagatcccatagatcctgaaatgcccccttggcatcaccctgga

SEQ ID NO: 182386 - DNA, 75 bp, Artificial Sequence
  Synthetic
agacatttggaataacatgacctggatggagtgggagagagaaattgacaattacacaggattaatatacaactt

SEQ ID NO: 182387 - DNA, 75 bp, Artificial Sequence
  Synthetic
tcattgctatctttgtttcacaaagaagggtttggggatctcccatggcaggaagaagcgaagaagaccagcagc

SEQ ID NO: 182388 - DNA, 75 bp, Artificial Sequence
  Synthetic
acactcccatgcagaataaaacaaattgtaaacatgtggcagaaagtaggaaaagcaatgtatgcccctcccatc

SEQ ID NO: 182389 - DNA, 75 bp, Artificial Sequence
  Synthetic
ggaagaagcgaagaagaccagcagctgctgcaagctatccagataataaagatcctgtaccagagcagtaagtaa

SEQ ID NO: 182390 - DNA, 75 bp, Artificial Sequence
  Synthetic
agtattaatagtcattattgctttgcttcttataaatgtacttctatagatgtttaaacttagaacatatttaga

SEQ ID NO: 182391 - DNA, 75 bp, Artificial Sequence
  Synthetic
cttcttataaatgtacttctatagatgtttaaacttagaacatatttagaacaaaagaaacaagataaaacagca

SEQ ID NO: 182392 - DNA, 75 bp, Artificial Sequence
  Synthetic
agcagaagacagtggcaatgagagtgagggggatgcagaggaattggcagcacttggggaagtggggccttttat

SEQ ID NO: 182393 - DNA, 75 bp, Artificial Sequence
  Synthetic
ttaattttagctttgataatcccatgtttgagctgtaaccaactatatgccacagtctattctaaggtacctgta

SEQ ID NO: 182394 - DNA, 75 bp, Artificial Sequence
  Synthetic
accccagtccaaatgaatataagctaaaaaatgtgacagataaattcaatatataagaaaattatatagtagacc

SEQ ID NO: 182395 - DNA, 75 bp, Artificial Sequence
  Synthetic
tgctactaatgctactgctattaatgctacagggggggaagaaataaaaaattgcactttcaatacaaccacaga

SEQ ID NO: 182396 - DNA, 75 bp, Artificial Sequence
  Synthetic
tagtattactaccacaaacagtcccttaaactcaaacaatacaaaagaagtaaaacagtgtgactttaatgtaac

SEQ ID NO: 182397 - DNA, 75 bp, Artificial Sequence
  Synthetic
attaattgtaactccacaaccatcaagcaggcctgtccaaaagtatcttttgagcccattcccatacactattgt

SEQ ID NO: 182398 - DNA, 75 bp, Artificial Sequence
  Synthetic
aacaagtctctgtaaaaacgttacagtagttacttgtacacatagcatcaaaccaacagtaagtacccaactaat

SEQ ID NO: 182399 - DNA, 75 bp, Artificial Sequence
  Synthetic
actaaataagacactctctaaaagaaatataacaatcataagaaagaatatttcagacagtaaggagaacatcct

SEQ ID NO: 182400 - DNA, 75 bp, Artificial Sequence
  Synthetic
gtataaggataggaccaggacaagcattctttgcaaatgccataataggagacataaggcaagcacattgtaaca

SEQ ID NO: 182401 - DNA, 75 bp, Artificial Sequence
  Synthetic
aatacaagaacaagtataactataggaccaggacaaatgttctatagaacaggagacataataggagatataaga

SEQ ID NO: 182402 - DNA, 75 bp, Artificial Sequence
  Synthetic
cttagtaatacaaaggaggatacaaaggcagcttattgtaattatagtgccactgactagaacaaagccttaaaa

SEQ ID NO: 182403 - DNA, 75 bp, Artificial Sequence
  Synthetic
aatttgaaccacactcaggaggggatctagaagttacaacacatagttttaattgtagaggagaatttttctatt

SEQ ID NO: 182404 - DNA, 75 bp, Artificial Sequence
  Synthetic
tcttttttaactgtcataaagaattcttttattataacacaaatcagctgtttaatcataccttttcctgcaaga

SEQ ID NO: 182405 - DNA, 75 bp, Artificial Sequence
  Synthetic
aaaatatgaccaataacaagatcaattgtactaatattagcaataataacaatggcactcaggcaataccttgca

SEQ ID NO: 182406 - DNA, 75 bp, Artificial Sequence
  Synthetic
gattctacaattagacacgccataaaataaaacacatcctaacagcaccacccttagaccaggagggggaaatat

SEQ ID NO: 182407 - DNA, 75 bp, Artificial Sequence
  Synthetic
attatcctatagtgcagaacctccaagggcaaatggtacaccagcccctatcaccaagaactttgaatgcatggg

SEQ ID NO: 182408 - DNA, 75 bp, Artificial Sequence
  Synthetic
ttcaaatataaagtagtaaaagtaaaaccttttagtgtagcaccaacaaaaattgcaaggccaactataaaaact

SEQ ID NO: 182409 - DNA, 75 bp, Artificial Sequence
  Synthetic
tttttcagaatctgccataagaaaagccatactaggacatatagttaggcctagttgtgaatatctggcaggaca

SEQ ID NO: 182410 - DNA, 75 bp, Artificial Sequence
  Synthetic
ggcactcataaaaagaaaaaagcagcaggtttagcaatgctattcttgaagattctaagtgcagcaagaagcact

SEQ ID NO: 182411 - DNA, 75 bp, Artificial Sequence
  Synthetic
agctcatctgcaccactaatgtgccctggaattatagttggagtaataaatcgcaagatgagatttgggggaaca

SEQ ID NO: 182412 - DNA, 75 bp, Artificial Sequence
  Synthetic
aacacttgctgaagctatctgtataaagtattagacaactccaagctcgcctgctagccttaaaaacctttatac

SEQ ID NO: 182413 - DNA, 75 bp, Artificial Sequence
  Synthetic
caatatacaggttgcttgaaaattcgcaaacccagcaggagcagaatgaaaaagatttattggcattggacagct

SEQ ID NO: 182414 - DNA, 75 bp, Artificial Sequence
  Synthetic
ttaagataagttaacatagcagcagtaagatcaacagataaacaacgtaagctccttcatatataaaaaaataca

SEQ ID NO: 182415 - DNA, 75 bp, Artificial Sequence
  Synthetic
aagccacctctgcctagtattaagaaattagtagaggatagatggaacaacccccagaagatcaggggccgcaga

SEQ ID NO: 182416 - DNA, 75 bp, Artificial Sequence
  Synthetic
gctccttcatatataaaaaaatacaagaagcacaaaaacaacaaaagaaaaataaaaaaaaattactaaagttag

SEQ ID NO: 182417 - DNA, 75 bp, Artificial Sequence
  Synthetic
agttatattagtacttaatctagtaaagaacattaagcagagatatcaacccctctcgttacagatccccatcca

SEQ ID NO: 182418 - DNA, 75 bp, Artificial Sequence
  Synthetic
atgtggaaaagaaggacaccaaatgaaagactgtactgagaggcaggctaattttttagggaaaatttggccttc

SEQ ID NO: 182419 - DNA, 75 bp, Artificial Sequence
  Synthetic
gcatagttagatggcctgctgtaagagaaagaataaggcgcactgagccagtagcagagggagtaagaacagcat

SEQ ID NO: 182420 - DNA, 75 bp, Artificial Sequence
  Synthetic
tgcaaactagtgctacaaatctactagatactgttgcagtagcagttactaattaaactgacagcatcatcctag

SEQ ID NO: 182421 - DNA, 75 bp, Artificial Sequence
  Synthetic
gtaaatagacaaaatagccagaagtaaaaaaaaaaataagacaaacttcccctgacccccagtcctctgacaccc

SEQ ID NO: 182422 - DNA, 75 bp, Artificial Sequence
  Synthetic
gttataaatgctactgtcaatgctactagtagtagcggggaactaatggggatgaaaaactgctctttcaatgtt

SEQ ID NO: 182423 - DNA, 75 bp, Artificial Sequence
  Synthetic
agaaaaccaccaagataaagaaataaagttcccagtaagaccccaagtgcctctaaggccgataacctataaaag

SEQ ID NO: 182424 - DNA, 75 bp, Artificial Sequence
  Synthetic
gtttatgggatcaaagcctaaagccatgtgtaaagttgaccccactctgtgtcactttagaatgtagaaatgtta

SEQ ID NO: 182425 - DNA, 75 bp, Artificial Sequence
  Synthetic
tgaaaccagggaagaaaacctccgacgcaacgggctcggcttagcggagtgcacccgctaagaggcgagaggaac

SEQ ID NO: 182426 - DNA, 75 bp, Artificial Sequence
  Synthetic
gagataaaaaattgctctttcaatgcaaccacattattaagagataggaagaagacagtgtatgcacttttttat

SEQ ID NO: 182427 - DNA, 75 bp, Artificial Sequence
  Synthetic
aattaggttaaagccaggatctaaaaagaaatataagctaaaacatttaatatgggcaagcagggggctggacag

SEQ ID NO: 182428 - DNA, 75 bp, Artificial Sequence
  Synthetic
ttagatacaggagcagatgatacagtattagaagatataaatttgccagggaaatggaaaccaaaaatgataggg

SEQ ID NO: 182429 - DNA, 75 bp, Artificial Sequence
  Synthetic
catgcagggcctgttgcaccaggccaaatgagagaaccaaggggaagtgacatagcaggaactactagtaccctt

SEQ ID NO: 182430 - DNA, 75 bp, Artificial Sequence
  Synthetic
gcatgggtaaaggcagtagaaaaaaaagcctttaaccctgagatcattcctatgtttatggcattgtcagaggga

SEQ ID NO: 182431 - DNA, 75 bp, Artificial Sequence
  Synthetic
gcaaattcactggactaccagggctaaccagcctatcccagttggggatatctatagaaagtggatagtaatagg

SEQ ID NO: 182432 - DNA, 75 bp, Artificial Sequence
  Synthetic
catttgcaccacttctgtacggtggaataccagttggagtaatagaactctggatgacatatggggtaacatgac

SEQ ID NO: 182433 - DNA, 75 bp, Artificial Sequence
  Synthetic
ccgcatccagcgggactaaaaaagaaaaaatcagtaacagtactagatgtgggggacgcatatttttcagttcct

SEQ ID NO: 182434 - DNA, 75 bp, Artificial Sequence
  Synthetic
tacacatcagtattcatgcaaagagggcaaaaaccaattagaaaaggacctataaaatgtttcaattgtggaaaa

SEQ ID NO: 182435 - DNA, 75 bp, Artificial Sequence
  Synthetic
aagacagggctttgaagcagctttgctataaaatggggggcaagtggtcaaagagcagcatagttggatggcctg

SEQ ID NO: 182436 - DNA, 75 bp, Artificial Sequence
  Synthetic
tgtgccttggaatgctagttggagtaataaatctctggatgacatttggaataacatgacctggatggagtggga

SEQ ID NO: 182437 - DNA, 75 bp, Artificial Sequence
  Synthetic
gatatggaagatcatttgttacagtaagaaaattgggagataggaaacaagcacattgtaccatgaatagaacga

SEQ ID NO: 182438 - DNA, 75 bp, Artificial Sequence
  Synthetic
agtattagaagatataaatttgccaggaagatggaaaccaaaaatgatagggggaattggaggttttatcaaagt

SEQ ID NO: 182439 - DNA, 75 bp, Artificial Sequence
  Synthetic
atgaaagattgcaaaaataggagacagacaaattttttaaagaaatattggcctccgagaggcacgaggccaggc

SEQ ID NO: 182440 - DNA, 75 bp, Artificial Sequence
  Synthetic
taggaaattagtagaggatagatggaacaacccccagaagaccaggggccgcagagggaaccatacaatgaatgg

SEQ ID NO: 182441 - DNA, 75 bp, Artificial Sequence
  Synthetic
ataagagaaagagcagaagatagtggtaatgagagtgaaggggacacagaagaattatcagcacttgtggagatg

SEQ ID NO: 182442 - DNA, 75 bp, Artificial Sequence
  Synthetic
tacactaaatttccctataagccccataaccccagtaccagtaaaactaaaaccaggaatggatggaccaaaagt

SEQ ID NO: 182443 - DNA, 75 bp, Artificial Sequence
  Synthetic
caagtggtcaaagagtagtctggttggatggcctgctataagggaaagaatggaaaaaactgagccagctgaacc

SEQ ID NO: 182444 - DNA, 75 bp, Artificial Sequence
  Synthetic
taataagaattctgcaacaactgctgtttattcatttcagaattgggtgtcgacatagcagaataggcattattc

SEQ ID NO: 182445 - DNA, 75 bp, Artificial Sequence
  Synthetic
ggttctccagctatattccaaagttcaatgacaaaaattctagatccatttaggaaaaacaacccagaattagaa

SEQ ID NO: 182446 - DNA, 75 bp, Artificial Sequence
  Synthetic
cctacaacaatacaagaagaagtacacgtataggaccagggcaagcattatatacaacaggagaaataataggac

SEQ ID NO: 182447 - DNA, 75 bp, Artificial Sequence
  Synthetic
gcaaccaccactctattttgtgcatcagatgctaaagcatatgatacagaggtacataatgtttgggccacacat

SEQ ID NO: 182448 - DNA, 75 bp, Artificial Sequence
  Synthetic
gaaacaacaaatcagaaaactgaattacaagcaattcatctagctttgcaagattcaggatcagaagtaaacata

SEQ ID NO: 182449 - DNA, 75 bp, Artificial Sequence
  Synthetic
cttaccagatatatcaggatgaacataagaacctcaaaacagggaaatatgctaggcaaaaagcctcccacacaa

SEQ ID NO: 182450 - DNA, 75 bp, Artificial Sequence
  Synthetic
caatgccaaaacaataatagtacaccttaatgaatctgtagaaattgtatgtacaagacccggcaataatacaag

SEQ ID NO: 182451 - DNA, 75 bp, Artificial Sequence
  Synthetic
gcactgaattacggactaatggtactaataccacttattccaataatgaggaaatgaaaggagaaataaaaaact

SEQ ID NO: 182452 - DNA, 75 bp, Artificial Sequence
  Synthetic
gaagagtggtggaaagagaaaaaagagcaataggactgggagctatgttccttgggttcttgggagcagcaggaa

SEQ ID NO: 182453 - DNA, 75 bp, Artificial Sequence
  Synthetic
aacagattcacaatatgtactgggcatcatatcttcccaacctacacagagtgactcccctatagttcagcagat

SEQ ID NO: 182454 - DNA, 75 bp, Artificial Sequence
  Synthetic
aaatgtcagcacagtacaatgtacacatggaattaggccagtagtatcaacacaattgctgttaaatggcagtct

SEQ ID NO: 182455 - DNA, 75 bp, Artificial Sequence
  Synthetic
gttaaatgttttaattgtggcaaagaaggacacatagccaaaaattgcagggcccctagaaaaaagggctgttgg

SEQ ID NO: 182456 - DNA, 75 bp, Artificial Sequence
  Synthetic
aatatacaggttgcttgaagactcgcaaaaccagcaggaaagaaatgaaaaagatttattagcattggacagttg

SEQ ID NO: 182457 - DNA, 75 bp, Artificial Sequence
  Synthetic
cctaaaggatcaacagctcctaggaatttggggttgctctggaagacacatttgcaccactactgtgccttggaa

SEQ ID NO: 182458 - DNA, 75 bp, Artificial Sequence
  Synthetic
aagaagaaaggcaaaaataatcagggattatggaaaacagatggcaggtgctgatagtgtggcaagtggacagac

SEQ ID NO: 182459 - DNA, 75 bp, Artificial Sequence
  Synthetic
atatttgccataaagaaaaaagacagtactaaatggagaaaattagtagatttcagagagctcaataaaagaact

SEQ ID NO: 182460 - DNA, 75 bp, Artificial Sequence
  Synthetic
aggtagggacactacagctcctagccttaagagcagtagtaaaagcaaagagaaataggcctcctctacccagtg

SEQ ID NO: 182461 - DNA, 75 bp, Artificial Sequence
  Synthetic
gcgagagcgtcagtattaagcgggggaaaattagatgaatgggaaaaaattcagttacggccagggggaagcaaa

SEQ ID NO: 182462 - DNA, 75 bp, Artificial Sequence
  Synthetic
aaatataaactaaaacatatagtatgggcaagcagggagctagaacgatttgcacttaatcctggccttttagaa

SEQ ID NO: 182463 - DNA, 75 bp, Artificial Sequence
  Synthetic
cttcttataaatgtacttctatggatgtttaatcttagagcatatttagaacaaaagaaacaagatagaacagca

SEQ ID NO: 182464 - DNA, 75 bp, Artificial Sequence
  Synthetic
tgtatcagacctaacaacaatacaagaaaaagtatacgtataggaccaggacaagcattctatgcaacaggtgac

SEQ ID NO: 182465 - DNA, 75 bp, Artificial Sequence
  Synthetic
ccttttcagctaccaccgattgagagacttcatattggtgacagcgagagcagtggaacttctgggacgcagcag

SEQ ID NO: 182466 - DNA, 75 bp, Artificial Sequence
  Synthetic
ggaagctttagataagatagaggaagaacaaaacaaaagtaagaaaaaggcacagcaagcagcagcagctgatga

SEQ ID NO: 182467 - DNA, 75 bp, Artificial Sequence
  Synthetic
agtatagaagaaaggctttcagcccagaagtaatacccatgttttcagcattatcagaaggagccaccccacaag

SEQ ID NO: 182468 - DNA, 75 bp, Artificial Sequence
  Synthetic
ccagaggagatctctcgacgcaggactcggcttgctgaagcgcgcacagcaagaggcgaggggcggcgactggtg

SEQ ID NO: 182469 - DNA, 75 bp, Artificial Sequence
  Synthetic
taatgaaaccttcagacctggaggaggagatatgagggacaattggagaagtgaattatataaatataaagtagt

SEQ ID NO: 182470 - DNA, 75 bp, Artificial Sequence
  Synthetic
cgcaacgtacctagaaggataagacagggctttgaagcagctttgctataaatggggggcaagtggtcaaagagc

SEQ ID NO: 182471 - DNA, 75 bp, Artificial Sequence
  Synthetic
atgactccctgaaagaagatgtaggggcaataaaaaattgttctttcaaaataaccacagaagtaagagataaga

SEQ ID NO: 182472 - DNA, 75 bp, Artificial Sequence
  Synthetic
cttaaatcattatttaatacagtagcaaccctctggtgcgtacatcaaaggatagaggtaagagacaccaaggaa

SEQ ID NO: 182473 - DNA, 75 bp, Artificial Sequence
  Synthetic
tgtagccagtggatatatagaagcagaagttattccagcagagacagggcaggaaacagcatactttatcttaaa

SEQ ID NO: 182474 - DNA, 75 bp, Artificial Sequence
  Synthetic
actaaatggggcactctctaaggggaatataacaatcatggggaaggatatttcagacagtggggagaacatcct

SEQ ID NO: 182475 - DNA, 75 bp, Artificial Sequence
  Synthetic
taacctccctcaaatcactctttggcaacgaccccttgtcacagtaaagatagggggacagctaaaggaagctct

SEQ ID NO: 182476 - DNA, 75 bp, Artificial Sequence
  Synthetic
atataatcagtttatgggatcaaagcctaaagccatgtgtaaaattaaccccactctgtgttactttaaattgta

SEQ ID NO: 182477 - DNA, 75 bp, Artificial Sequence
  Synthetic
atatatttaggaccagggcatgcatttcatgcaacagaaaatataataggagacatcagaaaggcacattgtaac

SEQ ID NO: 182478 - DNA, 75 bp, Artificial Sequence
  Synthetic
gtggcaggaggtaggacgagcaatgtatgcccctcccattgcaggaaacataacatgtaaatcaaatatcacagg

SEQ ID NO: 182479 - DNA, 75 bp, Artificial Sequence
  Synthetic
ggatgacaaataatccacctatcccagtaggagaaatctataaaagatggataatcctgggattaaataaaatag

SEQ ID NO: 182480 - DNA, 75 bp, Artificial Sequence
  Synthetic
tactgctactgtcaataatagcatgcctggagaaataaaaaattgctctttcaatgtaaccacagaaagaagaga

SEQ ID NO: 182481 - DNA, 75 bp, Artificial Sequence
  Synthetic
tatcactctcccatgtcgaataagacaaattatagggatggggcgggaagaaggacgagcaacgtatgcccctcc

SEQ ID NO: 182482 - DNA, 75 bp, Artificial Sequence
  Synthetic
gggctgcaagaatagactaatctgctacacatcagtaaagtggaataaaacatggggaggagataatgaatcaat

SEQ ID NO: 182483 - DNA, 75 bp, Artificial Sequence
  Synthetic
agaagattcggttaaggccagggggaaagaaaaaatacagaatgaaacatctagtatgggcaagcagggagctgg

SEQ ID NO: 182484 - DNA, 75 bp, Artificial Sequence
  Synthetic
ttgtacacggacctcaggacaataatcttgtggatttaccacctcttgagcaacttagcctcagagatccagaag

SEQ ID NO: 182485 - DNA, 75 bp, Artificial Sequence
  Synthetic
catagttggatggcctgctgtaagagaaagaatgagacaaactgagccagcagcagtgggaagagaaagaatgag

SEQ ID NO: 182486 - DNA, 75 bp, Artificial Sequence
  Synthetic
gtaaatgggcaggatggtcagaagtaagaagaagaatgagacaaacttcccctgacccccagtcctctgacaccc

SEQ ID NO: 182487 - DNA, 75 bp, Artificial Sequence
  Synthetic
taccattctattttgtgcatctgatgctaaagcatatagtactgaaagccataatgtctgggctacacatgcctg

SEQ ID NO: 182488 - DNA, 75 bp, Artificial Sequence
  Synthetic
cctgacccccagtcctctgacacccaacctgcacctggggtaagagcagtatccagggcattagcagacagaaga

SEQ ID NO: 182489 - DNA, 75 bp, Artificial Sequence
  Synthetic
ttcaataccaccacaagcataagagataagatgcaggaacaatatgcacttttttataaacttgatgtattacca

SEQ ID NO: 182490 - DNA, 75 bp, Artificial Sequence
  Synthetic
cagtcagacctcaagtacctttaagaccaatgacttataaggcagcttttgatctcggcttctttttaaaagaaa

SEQ ID NO: 182491 - DNA, 75 bp, Artificial Sequence
  Synthetic
ttgctggcggtggccagacctaggggaaggacgaagtctctaggggaggaagatgggtgcgagagcgtctgtgtt

SEQ ID NO: 182492 - DNA, 75 bp, Artificial Sequence
  Synthetic
tttaaaaatctgaaaacaggaaagtatgcaagaatgaggggtgcccacactaatgatgtaaaacaattaacagag

SEQ ID NO: 182493 - DNA, 75 bp, Artificial Sequence
  Synthetic
aatggctagtgattttaatctgccacccatagtagcaaaagaaatagtagctagctgtgataaatgtcagctaaa

SEQ ID NO: 182494 - DNA, 75 bp, Artificial Sequence
  Synthetic
caacaatacaagaaacaggatatcaataggaccagggagagcatttcatacaacaaaacaaataataggagatat

SEQ ID NO: 182495 - DNA, 75 bp, Artificial Sequence
  Synthetic
gaagcagctttgctataaaatggggggcaaatggtcaaaaagcagcatagttggatggcctgaagtaagagaaag

SEQ ID NO: 182496 - DNA, 75 bp, Artificial Sequence
  Synthetic
gctctcaagacagggtcagaagacctgaagtcactctggaacgcaatagcagtactctggtgcgttcataacaga

SEQ ID NO: 182497 - DNA, 75 bp, Artificial Sequence
  Synthetic
cctcaggtacccttacggccaatgacttacaaggcagctgtagatctcagccactttttaaaagaagagggggga

SEQ ID NO: 182498 - DNA, 75 bp, Artificial Sequence
  Synthetic
gagccagcagcagagggagtaggagcagcatcccaagacttagataaatatggagcacttacaagcagcaacaca

SEQ ID NO: 182499 - DNA, 75 bp, Artificial Sequence
  Synthetic
gtggcaggaagtaggaaaagcaatgtatgcccctcccatcagaggacaaattagatgttcatcaaatattacagg

SEQ ID NO: 182500 - DNA, 75 bp, Artificial Sequence
  Synthetic
cagaaattgtaatgcacagttttaattgtggaggggaatttttctactgtaatacatcacaactgtttaatagta

SEQ ID NO: 182501 - DNA, 75 bp, Artificial Sequence
  Synthetic
agtagtggtagtaatggtacctacattgggaactacactgagataaaaaattgctctttcaatacaaccacagtt

SEQ ID NO: 182502 - DNA, 75 bp, Artificial Sequence
  Synthetic
aacaacaatacaagaaaaagtataccaatcggaccaggacaagcgttctatgcaacaggtgacataataggagat

SEQ ID NO: 182503 - DNA, 75 bp, Artificial Sequence
  Synthetic
agacaagtcaaaattacccagtagtagcaaacatgcaagggcaaatgatacatcagcccctctcccccaggactt

SEQ ID NO: 182504 - DNA, 75 bp, Artificial Sequence
  Synthetic
cttagaaattacaacacatagttttaattgtagaggagagtttttctattgtaatacatcagaactgtttaatag

SEQ ID NO: 182505 - DNA, 75 bp, Artificial Sequence
  Synthetic
agccatacaatgaatggacattagagcttttagaggagcttaagagtgaagctgttagacactttcctaggatat

SEQ ID NO: 182506 - DNA, 75 bp, Artificial Sequence
  Synthetic
ttagaagaaatgatggtagcatgtcagggagtaggagggccaactcataaggcaaaaatactagcagaagcaatg

SEQ ID NO: 182507 - DNA, 75 bp, Artificial Sequence
  Synthetic
ccgacagccccaccagcagagagcttcaggttcgaggagacaacccccgctccgaagcaggagtcgaaagacagg

SEQ ID NO: 182508 - DNA, 75 bp, Artificial Sequence
  Synthetic
gacctacggagcctgttcctcttcagctaccaccgcttgagagacttactcttgattgtaacgaggattgtggaa

SEQ ID NO: 182509 - DNA, 75 bp, Artificial Sequence
  Synthetic
cttctgggacgcagggggtgggaaatcctcaaatattggtggaatctcctgcagtattggagtcaggaactaaag

SEQ ID NO: 182510 - DNA, 75 bp, Artificial Sequence
  Synthetic
acagtctggggcattaagcagctccaggcaagagtcctggctatagaaagatacctaaaggatcaacagctccta

SEQ ID NO: 182511 - DNA, 75 bp, Artificial Sequence
  Synthetic
accatgtgtaaaattaaccccactctgtgtcactttaaactgcactgaatggaaagatgcaaaggccactaatga

SEQ ID NO: 182512 - DNA, 75 bp, Artificial Sequence
  Synthetic
atgggtgcgagagcgtcggtattaagcgggggacaattagatagatgggagaaaattcggttaaggccaggggga

SEQ ID NO: 182513 - DNA, 75 bp, Artificial Sequence
  Synthetic
gtagggctttgcgcaacgtgcctagaagaataagacaaggcgccgaaaggcttttgctataaaatggggggcaaa

SEQ ID NO: 182514 - DNA, 75 bp, Artificial Sequence
  Synthetic
gcgtgtccaaaggtaacctttgagccaattcccatacattattgtgccccagctggatttgcaattctaaaatgt

SEQ ID NO: 182515 - DNA, 75 bp, Artificial Sequence
  Synthetic
gtccatgcaaaaatgtcagcacagtacagtgtacacatgggattaggccagtagtgtcaactcaactgttgttga

SEQ ID NO: 182516 - DNA, 75 bp, Artificial Sequence
  Synthetic
acatctagtatgggcaagcagggagctagaacgattcgcagttaatcccggcctgttagaaacagcagaaggctg

SEQ ID NO: 182517 - DNA, 75 bp, Artificial Sequence
  Synthetic
agaggtaaaagatactaaggaagctttagacaaggtagaggaagagcaaaacaaaagaaagaaaaaagcacagca

SEQ ID NO: 182518 - DNA, 75 bp, Artificial Sequence
  Synthetic
agaggtaaaagatactaaggaagctttagacaaggtagaggaagagcaaaacaaaagaaagaaaaatgcacagca

SEQ ID NO: 182519 - DNA, 75 bp, Artificial Sequence
  Synthetic
agaggtaaaagatactaaggaagctttagacaaggtagaggaagagcaaaacaaaagaaagaaaaacgcacagca

SEQ ID NO: 182520 - DNA, 75 bp, Artificial Sequence
  Synthetic
agaggtaaaagatactaaggaagctttagacaaggtagaggaagagcaaaacaaaagaaagaaaaaggcacagca

SEQ ID NO: 182521 - DNA, 75 bp, Artificial Sequence
  Synthetic
atggcagtctagcagaagaagaaataataattagatctgaaaatctcacaaataatgctaaaaccataatagtac

SEQ ID NO: 182522 - DNA, 75 bp, Artificial Sequence
  Synthetic
tgtaggagatgcttatttctcatgtcctttagatgagaatttcagaaaatatactgctttcactattcctagtat

SEQ ID NO: 182523 - DNA, 75 bp, Artificial Sequence
  Synthetic
ttataaacatgtggcagggagtaggacaagcaatgtatgctcctcccatcagtggaacaattaattgtatatcaa

SEQ ID NO: 182524 - DNA, 75 bp, Artificial Sequence
  Synthetic
acaagcaatgtatgctcctcccatcagtggaacaattaattgtatatcaaatattacaggaatactattgacaag

SEQ ID NO: 182525 - DNA, 75 bp, Artificial Sequence
  Synthetic
agacaaggtacacatataggaccagggcgaacactcttcacaacaaggataataggaaatataagaaaggcatat

SEQ ID NO: 182526 - DNA, 75 bp, Artificial Sequence
  Synthetic
gatccattcagaaaaaacaatccagaaatagaaatttgtcagtacatggatgacttatatgtagggtcagatttg

SEQ ID NO: 182527 - DNA, 75 bp, Artificial Sequence
  Synthetic
aaccaagtcattgacagaagtggtacctttgagtaaagaggcagaactagaactggaagaaaacagggaaaggct

SEQ ID NO: 182528 - DNA, 75 bp, Artificial Sequence
  Synthetic
actaatgagaccatttctagggataacatcactattatgaaagagggagaaataaaaaactgctctttcaatgtc

SEQ ID NO: 182529 - DNA, 75 bp, Artificial Sequence
  Synthetic
ttatgggatcaaagtctaaagccatgtgtaaagctgaccccactctgtgtcactttaaactgtacaaactgtaca

SEQ ID NO: 182530 - DNA, 75 bp, Artificial Sequence
  Synthetic
ttcccacaagggaaggccagggaattttcttcagaacagaccagagccaacagccccaccagaagagagcttcag

SEQ ID NO: 182531 - DNA, 75 bp, Artificial Sequence
  Synthetic
tcaatataaccacagaactaagagataaaaagcagacaagaaatgcacttttttataaccttgatatagtaccac

SEQ ID NO: 182532 - DNA, 75 bp, Artificial Sequence
  Synthetic
agtagtgtcaactcaactgctgctaaatggcagtctagcagaagaagaggtagtaattagatctgaaaatatcac

SEQ ID NO: 182533 - DNA, 75 bp, Artificial Sequence
  Synthetic
attcctggaaggaatagatcaggcacaagaagatcatgaaaaatatcacagcaattggagagcattagctagtga

SEQ ID NO: 182534 - DNA, 75 bp, Artificial Sequence
  Synthetic
ctggaagcacaagaggaagaggaggtaggctttccagtcaggccgcaggtacctctaagaccaatgacttataag

SEQ ID NO: 182535 - DNA, 75 bp, Artificial Sequence
  Synthetic
cctattaaaatattacatacagataatgggcctaattttacaagtgcaaccatgaaggctgcatgttggtgggca

SEQ ID NO: 182536 - DNA, 75 bp, Artificial Sequence
  Synthetic
cctattaaaatattacatacagataatgggcctaattttacaagtgcaaccatgaaggctgcatgttggtgggct

SEQ ID NO: 182537 - DNA, 75 bp, Artificial Sequence
  Synthetic
cctattaaaatattacatacagataatgggcctaattttacaagtgcaaccatgaaggctgcatgttggtgggcc

SEQ ID NO: 182538 - DNA, 75 bp, Artificial Sequence
  Synthetic
cctattaaaatattacatacagataatgggcctaattttacaagtgcaaccatgaaggctgcatgttggtgggcg

SEQ ID NO: 182539 - DNA, 75 bp, Artificial Sequence
  Synthetic
gaatgagaagaactgttccagcagcagcaggggtgggagcagtatctcgggatctggaaaagcatggggcagtca

SEQ ID NO: 182540 - DNA, 75 bp, Artificial Sequence
  Synthetic
caacagacatacaaactaaagaattacaaaaacaaattataaaaattcaaaattttcgggtttattacagagaca

SEQ ID NO: 182541 - DNA, 75 bp, Artificial Sequence
  Synthetic
gcattatagacatcattatgaaaccagaaatccaagaattagctcaggtgtatatattccagtaggtacagctaa

SEQ ID NO: 182542 - DNA, 75 bp, Artificial Sequence
  Synthetic
ttaatgccaggggaaagagatgagcatttaggacatggagtcagtatagaatggcaatacaaaaaatatagtaca

SEQ ID NO: 182543 - DNA, 75 bp, Artificial Sequence
  Synthetic
caatgaatgggcactagagcttttagaggagcttaagagtgaagctgttagacattttcctaggccatggctcca

SEQ ID NO: 182544 - DNA, 75 bp, Artificial Sequence
  Synthetic
tgatcaggtgtgaataccctgcaggacatagccaggtagggacactgcaactcctagcattaagagcagtggtaa

SEQ ID NO: 182545 - DNA, 75 bp, Artificial Sequence
  Synthetic
aatgaatgggcattagagaccctggaagaactaaaagcagaagcagtaagacactttcctaggccttggctacaa

SEQ ID NO: 182546 - DNA, 75 bp, Artificial Sequence
  Synthetic
aagaactaaaagcagaagcagtaagacactttcctaggccttggctacaaaacttaggacaatacatctatgata

SEQ ID NO: 182547 - DNA, 75 bp, Artificial Sequence
  Synthetic
agtgggtggcctgctgtaagggaaaaaatgagacgagctgaaccagcagagggaaggggagctgagccagcagca

SEQ ID NO: 182548 - DNA, 75 bp, Artificial Sequence
  Synthetic
cttagatgatggcatgaagggagaaatacaaaattgctctttcaatgcaaccacagaaataagagataaggagcg

SEQ ID NO: 182549 - DNA, 75 bp, Artificial Sequence
  Synthetic
gtgctttgcttcttataaatatagtgatatggacatttattcttaagaaatatttagagcaaaagaaacaagata

SEQ ID NO: 182550 - DNA, 75 bp, Artificial Sequence
  Synthetic
aatatataaactaattgaagaatcgcagaaccagcaggaaaaaaatgaacaagacttattggcattggacaagtg

SEQ ID NO: 182551 - DNA, 75 bp, Artificial Sequence
  Synthetic
tatttagagcaaaagaaacaagatagaagggaaagagaactacttaacagaataaaaagaataagagaagtcagg

SEQ ID NO: 182552 - DNA, 75 bp, Artificial Sequence
  Synthetic
tagggggacagctaaaggaagctctattagatacaggagcagatgatacagtattagaagaaataaatttgccag

SEQ ID NO: 182553 - DNA, 75 bp, Artificial Sequence
  Synthetic
ctggctggaagcggagcaggaggaagaagatgtaggctttccagtcagacctcaggtaccctgtaagaccaatga

SEQ ID NO: 182554 - DNA, 75 bp, Artificial Sequence
  Synthetic
ctggctggaagcggagcaggaggatgaagatgtaggctttccagtcagacctcaggtaccctgtaagaccaatga

SEQ ID NO: 182555 - DNA, 75 bp, Artificial Sequence
  Synthetic
ctggctggaagcggagcaggaggacgaagatgtaggctttccagtcagacctcaggtaccctgtaagaccaatga

SEQ ID NO: 182556 - DNA, 75 bp, Artificial Sequence
  Synthetic
ctggctggaagcggagcaggaggaggaagatgtaggctttccagtcagacctcaggtaccctgtaagaccaatga

SEQ ID NO: 182557 - DNA, 75 bp, Artificial Sequence
  Synthetic
ctatatgcaacagtctattctggggtgcctgtgtgggaagatgcaaacccaacattattctgtgcttcagatgtt

SEQ ID NO: 182558 - DNA, 75 bp, Artificial Sequence
  Synthetic
ctatatgcaacagtctattctggggtgcctgtgtgggaagatgcaatcccaacattattctgtgcttcagatgtt

SEQ ID NO: 182559 - DNA, 75 bp, Artificial Sequence
  Synthetic
ctatatgcaacagtctattctggggtgcctgtgtgggaagatgcaaccccaacattattctgtgcttcagatgtt

SEQ ID NO: 182560 - DNA, 75 bp, Artificial Sequence
  Synthetic
ctatatgcaacagtctattctggggtgcctgtgtgggaagatgcaagcccaacattattctgtgcttcagatgtt

SEQ ID NO: 182561 - DNA, 75 bp, Artificial Sequence
  Synthetic
aaccttactagcactgagagccataatatttgggcatcacaggcctgcgtccccacagacccctcaccacatgag

SEQ ID NO: 182562 - DNA, 75 bp, Artificial Sequence
  Synthetic
tattgctcaaaacagcaccctgaaggaagatgaaggggcaataaaaaactgttctttcaatatgaccacagaatt

SEQ ID NO: 182563 - DNA, 75 bp, Artificial Sequence
  Synthetic
aattgtaatacctcaaccattacacaggcttgtccaaaggtatcttgggatccaattcccatacattattgtgct

SEQ ID NO: 182564 - DNA, 75 bp, Artificial Sequence
  Synthetic
catcctcaggaggagaccaagaaatcgtaatgcatagctttaattgtggaggggaatttttccactgtaattcaa

SEQ ID NO: 182565 - DNA, 75 bp, Artificial Sequence
  Synthetic
tgaatttaatgtaactacagttttaaaagacaaaaaggaaaagaaacaggctctattctatgtatcagatttggc

SEQ ID NO: 182566 - DNA, 75 bp, Artificial Sequence
  Synthetic
attccacaaccatcaagcaagcctgcccaaaggtttcttttgagcccatcccaatacattattgtgctccagcag

SEQ ID NO: 182567 - DNA, 75 bp, Artificial Sequence
  Synthetic
aattgcacaagacccaacaacaatacaagaaaaaggataacaatgggaccaggacgagtatattatgcaacagga

SEQ ID NO: 182568 - DNA, 75 bp, Artificial Sequence
  Synthetic
caagaaaaaggataacaatgggaccaggacgagtatattatgcaacaggagacatagtaggagacatcagaaagg

SEQ ID NO: 182569 - DNA, 75 bp, Artificial Sequence
  Synthetic
gtacacatggtatcaagccaacagtaagtactcaactaatactaaatggaacaatctctgaaggaaacataagaa

SEQ ID NO: 182570 - DNA, 75 bp, Artificial Sequence
  Synthetic
tgtgcttccacagggatggaaaggatcaccagcaatattccaaagtagcatgacaaaaatcttagagccctttag

SEQ ID NO: 182571 - DNA, 75 bp, Artificial Sequence
  Synthetic
aattaattgtacaagacccaacaataattcaagaaaaagtataaggatagggccagggcaaacattctatgcaac

SEQ ID NO: 182572 - DNA, 75 bp, Artificial Sequence
  Synthetic
gttaaggataggtccaatggcttggtacagcatgacattagaacaaaacaaaacaggcagtaacataaggacagc

SEQ ID NO: 182573 - DNA, 75 bp, Artificial Sequence
  Synthetic
ttcagtaatagtacgggtggagatccagagataagctttttgcattttaactgtcatggagaattcttttattgt

SEQ ID NO: 182574 - DNA, 75 bp, Artificial Sequence
  Synthetic
tagaggtaaaagataccaaggaagctctagataaaatagaggaaatacaaaataagagcaagcaaaagacacaac

SEQ ID NO: 182575 - DNA, 75 bp, Artificial Sequence
  Synthetic
ctactaataccactagtactaatacccctagtggtagctggaaaaagatggaaagaggagaaataaagaactgct

SEQ ID NO: 182576 - DNA, 75 bp, Artificial Sequence
  Synthetic
gcagaataaaacaggtagtaaggtcatggataaggggagagtcgggactctatgcaccccccattaaaggtaatt

SEQ ID NO: 182577 - DNA, 75 bp, Artificial Sequence
  Synthetic
tatggggtacctgtgtgggaagatgcagatacccctctattttgtgcatctgatgctaaagcatatagtactgaa

SEQ ID NO: 182578 - DNA, 75 bp, Artificial Sequence
  Synthetic
gaattatataaatataaagtggtagaaattaagccattaggggtagcacccactggggcaaaaaggagagtggtg

SEQ ID NO: 182579 - DNA, 75 bp, Artificial Sequence
  Synthetic
ccatagtaatcatagaatatagaaaaatattaagacaaagaaaaatagacaagctaattagtagaatagcagaaa

SEQ ID NO: 182580 - DNA, 75 bp, Artificial Sequence
  Synthetic
tctggaaaactcatctgcaccactaatgtgccctggaactctagttggagtaataaatctcatgatgacatttgg

SEQ ID NO: 182581 - DNA, 75 bp, Artificial Sequence
  Synthetic
agtagcaaggtaggtgacacaggcctaaaaaactgctctttctatacaaccacagaaataagagataagaaaaag

SEQ ID NO: 182582 - DNA, 75 bp, Artificial Sequence
  Synthetic
ggttatctgtatggggtatcagacaactccgagctcgcctgcaagccttagaaacctttatacagaatcagcaac

SEQ ID NO: 182583 - DNA, 75 bp, Artificial Sequence
  Synthetic
cacagtttattatggggtacctgtatggaaagaagcaaccaccactctattttgtgcatcagatgctaaagcata

SEQ ID NO: 182584 - DNA, 75 bp, Artificial Sequence
  Synthetic
acataatatatagcttgcttgaagactcgcaaaaccagcaggagaaaaatgaaaaagatttattagcattggaca

SEQ ID NO: 182585 - DNA, 75 bp, Artificial Sequence
  Synthetic
atggcagcagtgggatcagcagatagagaatgtaagctccatcatatatgaagaaatacaaaaggcacaagaaca

SEQ ID NO: 182586 - DNA, 75 bp, Artificial Sequence
  Synthetic
gggacgacctgcggaacctgtgcctcttcagctaccgcctcttgagagacttcatattaattgcagcgaggattg

SEQ ID NO: 182587 - DNA, 75 bp, Artificial Sequence
  Synthetic
aaataaaagaaataaaaaactgctctttcaatatcaccacaaacataagagataagatgcagagagaatatgcac

SEQ ID NO: 182588 - DNA, 75 bp, Artificial Sequence
  Synthetic
gacctagaaattacaacacatagctttaattgtagaggagaatttttctattgcaatacatcaggcctgtttaat

SEQ ID NO: 182589 - DNA, 75 bp, Artificial Sequence
  Synthetic
aggaccaggacaggcgatctatgcaacaggtgccataataggagatataagacaagcacattgtaatattagtaa

SEQ ID NO: 182590 - DNA, 75 bp, Artificial Sequence
  Synthetic
ccctcaaccagcaccaaccggaagaagaaacgccaggaggaacaagagaagaaggtggagaagaagacaggcaca

SEQ ID NO: 182591 - DNA, 75 bp, Artificial Sequence
  Synthetic
ccctcaaccagcaccaaccggaagtagaaacgccaggaggaacaagagaagaaggtggagaagaagacaggcaca

SEQ ID NO: 182592 - DNA, 75 bp, Artificial Sequence
  Synthetic
ccctcaaccagcaccaaccggaagcagaaacgccaggaggaacaagagaagaaggtggagaagaagacaggcaca

SEQ ID NO: 182593 - DNA, 75 bp, Artificial Sequence
  Synthetic
ccctcaaccagcaccaaccggaaggagaaacgccaggaggaacaagagaagaaggtggagaagaagacaggcaca

SEQ ID NO: 182594 - DNA, 75 bp, Artificial Sequence
  Synthetic
gatctggagagtgaacagttacctgggacttggactggggattctgggacagaggacaattgaagcctgcagaca

SEQ ID NO: 182595 - DNA, 75 bp, Artificial Sequence
  Synthetic
gtaaacaaataataaaacaactacacccagctcttcagacaggatcagaagaacttaaatcattatataacacag

SEQ ID NO: 182596 - DNA, 75 bp, Artificial Sequence
  Synthetic
atcatcttaggactacaaagaataggaaggggaattcttaacatcccaagaagaattagacagggccttgaacgc

SEQ ID NO: 182597 - DNA, 75 bp, Artificial Sequence
  Synthetic
taagaagagcatattgtaccattaaaaaaacaaaatgggaaaacatgctaaaacaagtagttgaaaaattaagag

SEQ ID NO: 182598 - DNA, 75 bp, Artificial Sequence
  Synthetic
taagaagagcatattgtaccattaataaaacaaaatgggaaaacatgctaaaacaagtagttgaaaaattaagag

SEQ ID NO: 182599 - DNA, 75 bp, Artificial Sequence
  Synthetic
taagaagagcatattgtaccattaacaaaacaaaatgggaaaacatgctaaaacaagtagttgaaaaattaagag

SEQ ID NO: 182600 - DNA, 75 bp, Artificial Sequence
  Synthetic
taagaagagcatattgtaccattaagaaaacaaaatgggaaaacatgctaaaacaagtagttgaaaaattaagag

SEQ ID NO: 182601 - DNA, 75 bp, Artificial Sequence
  Synthetic
acaaacctcccctaatcctgagccatgtgcacctggggtaggagaaatttcaagacagttatcagaaagaggggg

SEQ ID NO: 182602 - DNA, 75 bp, Artificial Sequence
  Synthetic
acaaacctcccctaatcctgagccatgtgcacctggggtaggagaaatttctagacagttatcagaaagaggggg

SEQ ID NO: 182603 - DNA, 75 bp, Artificial Sequence
  Synthetic
acaaacctcccctaatcctgagccatgtgcacctggggtaggagaaatttccagacagttatcagaaagaggggg

SEQ ID NO: 182604 - DNA, 75 bp, Artificial Sequence
  Synthetic
acaaacctcccctaatcctgagccatgtgcacctggggtaggagaaatttcgagacagttatcagaaagaggggg

SEQ ID NO: 182605 - DNA, 75 bp, Artificial Sequence
  Synthetic
acaaacctcccctaatcctgagccttgtgcacctggggtaggagaaatttcaagacagttatcagaaagaggggg

SEQ ID NO: 182606 - DNA, 75 bp, Artificial Sequence
  Synthetic
acaaacctcccctaatcctgagccttgtgcacctggggtaggagaaatttctagacagttatcagaaagaggggg

SEQ ID NO: 182607 - DNA, 75 bp, Artificial Sequence
  Synthetic
acaaacctcccctaatcctgagccttgtgcacctggggtaggagaaatttccagacagttatcagaaagaggggg

SEQ ID NO: 182608 - DNA, 75 bp, Artificial Sequence
  Synthetic
acaaacctcccctaatcctgagccttgtgcacctggggtaggagaaatttcgagacagttatcagaaagaggggg

SEQ ID NO: 182609 - DNA, 75 bp, Artificial Sequence
  Synthetic
acaaacctcccctaatcctgagccctgtgcacctggggtaggagaaatttcaagacagttatcagaaagaggggg

SEQ ID NO: 182610 - DNA, 75 bp, Artificial Sequence
  Synthetic
acaaacctcccctaatcctgagccctgtgcacctggggtaggagaaatttctagacagttatcagaaagaggggg

SEQ ID NO: 182611 - DNA, 75 bp, Artificial Sequence
  Synthetic
acaaacctcccctaatcctgagccctgtgcacctggggtaggagaaatttccagacagttatcagaaagaggggg

SEQ ID NO: 182612 - DNA, 75 bp, Artificial Sequence
  Synthetic
acaaacctcccctaatcctgagccctgtgcacctggggtaggagaaatttcgagacagttatcagaaagaggggg

SEQ ID NO: 182613 - DNA, 75 bp, Artificial Sequence
  Synthetic
acaaacctcccctaatcctgagccgtgtgcacctggggtaggagaaatttcaagacagttatcagaaagaggggg

SEQ ID NO: 182614 - DNA, 75 bp, Artificial Sequence
  Synthetic
acaaacctcccctaatcctgagccgtgtgcacctggggtaggagaaatttctagacagttatcagaaagaggggg

SEQ ID NO: 182615 - DNA, 75 bp, Artificial Sequence
  Synthetic
acaaacctcccctaatcctgagccgtgtgcacctggggtaggagaaatttccagacagttatcagaaagaggggg

SEQ ID NO: 182616 - DNA, 75 bp, Artificial Sequence
  Synthetic
acaaacctcccctaatcctgagccgtgtgcacctggggtaggagaaatttcgagacagttatcagaaagaggggg

SEQ ID NO: 182617 - DNA, 75 bp, Artificial Sequence
  Synthetic
caacagctcctagggatttggggctgctctggaaaactcatctgcaccactgctgtaccttggaactctagttgg

SEQ ID NO: 182618 - DNA, 75 bp, Artificial Sequence
  Synthetic
gggataacatgacctggatgcagtgggatagagaaattaataattacacaaacacaatatacaggttgcttgaag

SEQ ID NO: 182619 - DNA, 75 bp, Artificial Sequence
  Synthetic
ctcaagtgcctctaaggccaatgacctataaaggagcatttgacctcggcttctttttaaaagaaaagggaggac

SEQ ID NO: 182620 - DNA, 75 bp, Artificial Sequence
  Synthetic
agtcctctactttgtacatcaaaaggtagatgtaaaagataccaaggaagctttagagaagctagagcaagaaca

SEQ ID NO: 182621 - DNA, 75 bp, Artificial Sequence
  Synthetic
aataataggagatataagacaagcatattgtaacattagtagagtaaaatggaataacactttaaaccagatagt

SEQ ID NO: 182622 - DNA, 75 bp, Artificial Sequence
  Synthetic
tcactctggaacacaatagcggtactctggtgcgttcataacagatttaaagttgaagatacgcagcaggcaata

SEQ ID NO: 182623 - DNA, 75 bp, Artificial Sequence
  Synthetic
gttgtgtggactatagtattcatagagtgtagaagattaagaaggcaaagaaaaatagactggttaattgataga

SEQ ID NO: 182624 - DNA, 75 bp, Artificial Sequence
  Synthetic
ttgcaccaggccaaatgagagaaccaaggggaagtgacatagcaggaactactagtacccttcaggaacaaatag

SEQ ID NO: 182625 - DNA, 75 bp, Artificial Sequence
  Synthetic
agcggattcttagcacttgcctgggacgatctacggagcctgtgcctcttcctctaccaccgcttgagagacttc

SEQ ID NO: 182626 - DNA, 75 bp, Artificial Sequence
  Synthetic
ggaagaataatgccactaataatgccactaataatgaggacatagcaatgagaaactgctctttcaatgtaacca

SEQ ID NO: 182627 - DNA, 75 bp, Artificial Sequence
  Synthetic
atagggttatagaagtagtacagagaacttggagagctattatccacatacctagaagaataagacagggcttgg

SEQ ID NO: 182628 - DNA, 75 bp, Artificial Sequence
  Synthetic
ccagggaatttccttcagaacaggctagagccaacagccccaccagcagaggaggagatagccccctctctgaag

SEQ ID NO: 182629 - DNA, 75 bp, Artificial Sequence
  Synthetic
cggcagagggagtgggagcagtatctcgagacctggaaaaacatggagcaatcacaagcagcaatgctaatcatc

SEQ ID NO: 182630 - DNA, 75 bp, Artificial Sequence
  Synthetic
cggcagagggtgtgggagcagtatctcgagacctggaaaaacatggagcaatcacaagcagcaatgctaatcatc

SEQ ID NO: 182631 - DNA, 75 bp, Artificial Sequence
  Synthetic
cggcagagggcgtgggagcagtatctcgagacctggaaaaacatggagcaatcacaagcagcaatgctaatcatc

SEQ ID NO: 182632 - DNA, 75 bp, Artificial Sequence
  Synthetic
cggcagagggggtgggagcagtatctcgagacctggaaaaacatggagcaatcacaagcagcaatgctaatcatc

SEQ ID NO: 182633 - DNA, 75 bp, Artificial Sequence
  Synthetic
gaagtaagagataagaagcgcagagagtatgcgcttttttataggctagatatagtaccacttgatgggaataag

SEQ ID NO: 182634 - DNA, 75 bp, Artificial Sequence
  Synthetic
atcattatttaatacagtagtaaccctctggtgtgtacaccaaaggatagaggtaaaagacaccaaggaagcttt

SEQ ID NO: 182635 - DNA, 75 bp, Artificial Sequence
  Synthetic
cccaggtacctttaagaccaatgacttacaaagcagcttttgatcttaacttctttttaaaagaaaaggggggac

SEQ ID NO: 182636 - DNA, 75 bp, Artificial Sequence
  Synthetic
cccaggtacctttaagaccaatgacttacaaagcagcttttgatcttatcttctttttaaaagaaaaggggggac

SEQ ID NO: 182637 - DNA, 75 bp, Artificial Sequence
  Synthetic
cccaggtacctttaagaccaatgacttacaaagcagcttttgatcttaccttctttttaaaagaaaaggggggac

SEQ ID NO: 182638 - DNA, 75 bp, Artificial Sequence
  Synthetic
cccaggtacctttaagaccaatgacttacaaagcagcttttgatcttagcttctttttaaaagaaaaggggggac

SEQ ID NO: 182639 - DNA, 75 bp, Artificial Sequence
  Synthetic
ctcacaaataatgctaaagtcataatagtacagcttaatgcgactgtaaacattacttgcataaggccctacaac

SEQ ID NO: 182640 - DNA, 75 bp, Artificial Sequence
  Synthetic
cagccccaccaatggaggaggtagtgaaggggcaagagaatcagaatcagaaccaagggggggaccaggacgagc

SEQ ID NO: 182641 - DNA, 75 bp, Artificial Sequence
  Synthetic
ggcatcaagcagctatgcaaatgctaaaggatactatcaatgaggaagctgcagagtgggacaggatgcatccac

SEQ ID NO: 182642 - DNA, 75 bp, Artificial Sequence
  Synthetic
caacaactgctgtttattcatttcagaattgggtgtcaacatagcagaataggcattactcgacagaggagagca

SEQ ID NO: 182643 - DNA, 75 bp, Artificial Sequence
  Synthetic
tgtgggtcacagtctattatggggtacctgtgtggaaagaagcaaaaaccactttattttgtgcatcagatgcta

SEQ ID NO: 182644 - DNA, 75 bp, Artificial Sequence
  Synthetic
gggtcaccagctatattccaaagttcaatgacaaaaattctagaaccattcaggaaaaacaatccagaaatagaa

SEQ ID NO: 182645 - DNA, 75 bp, Artificial Sequence
  Synthetic
gattcactacccctgataaaaagcatcaaaaggaacctccctttctgtggatggggtatgagctccacccagaca

SEQ ID NO: 182646 - DNA, 75 bp, Artificial Sequence
  Synthetic
gaacaaaatgaaaaagatttattagcattggacaagtggcaaaatctgtggagttggtttgacataacaaattgg

SEQ ID NO: 182647 - DNA, 75 bp, Artificial Sequence
  Synthetic
ccacttctgcccctaacaccactgctcaaggggaactgatgggagatggaataaaaaactgctctttcaatgtta

SEQ ID NO: 182648 - DNA, 75 bp, Artificial Sequence
  Synthetic
tatagattaataaattgtaatacctcagccataacacaagcctgtccaaaggtctcttttgacccaattcctata

SEQ ID NO: 182649 - DNA, 75 bp, Artificial Sequence
  Synthetic
cttatcagatatatcaggatgaacataaaaacctcaaaacaggaaaatatgctaggcaaaaggcctcccacacaa

SEQ ID NO: 182650 - DNA, 75 bp, Artificial Sequence
  Synthetic
caagcaattcagctagctttacaggattcaggatcagaagtaaacatagtaacagactcacagtatgcattagga

SEQ ID NO: 182651 - DNA, 75 bp, Artificial Sequence
  Synthetic
tagcgacttcaagaccaataacaccataggcaatgttaccacagaaataaaaaattgctctttcaatatgaccac

SEQ ID NO: 182652 - DNA, 75 bp, Artificial Sequence
  Synthetic
aaaatttgaaccaccctcaggaggggacctagaaattacaacacatagctttaattgtagaggagaatttttcta

SEQ ID NO: 182653 - DNA, 75 bp, Artificial Sequence
  Synthetic
gcaaatggattgcacacatttagaaggcaaagtcataatagttgctgtccatgtggcaagtggattcatagaagc

SEQ ID NO: 182654 - DNA, 75 bp, Artificial Sequence
  Synthetic
atgtggcaagtggattcatagaagcagaagtgataccagcagaaacaggacaagaaactgcctatttcctgttaa

SEQ ID NO: 182655 - DNA, 75 bp, Artificial Sequence
  Synthetic
ggcatttgggtcatggggtctccatagaatggaggcagagaagatatagcacacaaatagatcctgacctagcag

SEQ ID NO: 182656 - DNA, 75 bp, Artificial Sequence
  Synthetic
atgattgtgtggcaagtagacaggatgaggattaacacatggaaaagtttagtaaaataccatatgtatgtttca

SEQ ID NO: 182657 - DNA, 75 bp, Artificial Sequence
  Synthetic
catacagcaggtgagggaccaagcagagcatttaaaaacagcagtacaaatggcagtatttgttcacaattttaa

SEQ ID NO: 182658 - DNA, 75 bp, Artificial Sequence
  Synthetic
acaagaaaagaatgaaaaggacttattggaattggatcaatgggcaagtttgtggaattggtttagtataacaaa

SEQ ID NO: 182659 - DNA, 75 bp, Artificial Sequence
  Synthetic
tgactacatattggggattaatgccaggggaaagagatgaacatttaggacatggagtcagcatagaatggcaat

SEQ ID NO: 182660 - DNA, 75 bp, Artificial Sequence
  Synthetic
ccacagaccccaacccacaagaaatggttttggaaaatgtaacagaaaattttaacatgtggaaaaatgacatgg

SEQ ID NO: 182661 - DNA, 75 bp, Artificial Sequence
  Synthetic
aaatttggccttcccacaagggggggaggccagggaatttccttcagagcagaccagagccaacagccccaccag

SEQ ID NO: 182662 - DNA, 75 bp, Artificial Sequence
  Synthetic
aatatatgatctacttgaaaaatcacagaaccagcaggaaaagaatgaacaagacttattggcattggacaagtg

SEQ ID NO: 182663 - DNA, 75 bp, Artificial Sequence
  Synthetic
gagccagcagcagagggagtaggagcagcgtctcaagacttagataaacatggggcacttacaacaaacaacaca

SEQ ID NO: 182664 - DNA, 75 bp, Artificial Sequence
  Synthetic
tgaagggagaactaaaaaattgctctttcaatgtaaccacagtaataagagataagacaaagaaggaatatgcac

SEQ ID NO: 182665 - DNA, 75 bp, Artificial Sequence
  Synthetic
aaggcttttgctataagatgggtggcaagtggtcaaaatgcagtatgggtggatggcctgatgtaagagaaagaa

SEQ ID NO: 182666 - DNA, 75 bp, Artificial Sequence
  Synthetic
ttcaatacaaccacagaaataagaggtaggaagcagaaagtgtatgcactcttttataaacttgatatagtacca

SEQ ID NO: 182667 - DNA, 75 bp, Artificial Sequence
  Synthetic
cttagatcattatttaatacagtagtagtcctctattgtgtacatcaaagaatacaggtaaaagacaccaaagaa

SEQ ID NO: 182668 - DNA, 75 bp, Artificial Sequence
  Synthetic
cttcttgcagctatagtgatatggatgtttattcttaagaaatatttagaacagaaggaacaagatagaagggaa

SEQ ID NO: 182669 - DNA, 75 bp, Artificial Sequence
  Synthetic
tgactatgaaagtaatggagatgaagaacaagaagttatgcatcttgtgcatactcatggctttgctaatcccat

SEQ ID NO: 182670 - DNA, 75 bp, Artificial Sequence
  Synthetic
caaaaacataatagtgcagcttaaggaagctatagacattatatgtaccagacccaacaacaatacaagaaaaag

SEQ ID NO: 182671 - DNA, 75 bp, Artificial Sequence
  Synthetic
tataagcttaggaccaggacaagcgttctacacaacaggtgctataataggagatataagacaagcacattgtaa

SEQ ID NO: 182672 - DNA, 75 bp, Artificial Sequence
  Synthetic
tataagcttaggaccaggacaagcgttctactcaacaggtgctataataggagatataagacaagcacattgtaa

SEQ ID NO: 182673 - DNA, 75 bp, Artificial Sequence
  Synthetic
tataagcttaggaccaggacaagcgttctacccaacaggtgctataataggagatataagacaagcacattgtaa

SEQ ID NO: 182674 - DNA, 75 bp, Artificial Sequence
  Synthetic
tataagcttaggaccaggacaagcgttctacgcaacaggtgctataataggagatataagacaagcacattgtaa

SEQ ID NO: 182675 - DNA, 75 bp, Artificial Sequence
  Synthetic
acacttccctaataaaacaataaaatttgcaccatcctcaggaggggacctagaaattacaacacatagctttaa

SEQ ID NO: 182676 - DNA, 75 bp, Artificial Sequence
  Synthetic
attagcattggacagttggaataatctgtggaattggtttagcataacaaaatggctgtggtatataaaaatatt

SEQ ID NO: 182677 - DNA, 75 bp, Artificial Sequence
  Synthetic
ttgcaagattcaggatcagaagtaaacatagtaacagattcacagtatgcattaggaatcattcaagcacaacca

SEQ ID NO: 182678 - DNA, 75 bp, Artificial Sequence
  Synthetic
acatagtaacagattcacagtatgcattaggaatcattcaagcacaaccagataagagtgaatcagagttagtca

SEQ ID NO: 182679 - DNA, 75 bp, Artificial Sequence
  Synthetic
tttctatagtaaatagagttaggcagggatactcacctttgtcattccagacccttatcccaaacccgaggggac

SEQ ID NO: 182680 - DNA, 75 bp, Artificial Sequence
  Synthetic
tatcaagccaacagtaagtactcaactaatactaaatggaacaatctctgaaggaaaaataagaatgctgggaaa

SEQ ID NO: 182681 - DNA, 75 bp, Artificial Sequence
  Synthetic
ggtcctatggcttggtacagcatggaagtagaacgaaacaagacagccgccactcccaggacagcttattgcaca

SEQ ID NO: 182682 - DNA, 75 bp, Artificial Sequence
  Synthetic
gtgaagctgttagacattttcctaggctatggctacatggcttaggacagcatatctatgaaacttatggggata

SEQ ID NO: 182683 - DNA, 75 bp, Artificial Sequence
  Synthetic
cagcgtcactaacgctgacggtacaggccagacaactgttgtctggtatagtgcaacagcaaagcaatttgctga

SEQ ID NO: 182684 - DNA, 75 bp, Artificial Sequence
  Synthetic
gtactggtggagatccagaggtaagttatttgcattttaactgtcatggagaattcttttattgtaacacaagtg

SEQ ID NO: 182685 - DNA, 75 bp, Artificial Sequence
  Synthetic
atagtacacttaggcgaataccttgcaagataaaacaggtagtaaggtcatggataaagggagagtcgggactct

SEQ ID NO: 182686 - DNA, 75 bp, Artificial Sequence
  Synthetic
gggagaaatgaaagatatatggagaactgaattagccaattacaaagtagtaaaaataaaaccttttagtgtagc

SEQ ID NO: 182687 - DNA, 75 bp, Artificial Sequence
  Synthetic
gggagatatgaaagatatatggagaactgaattagccaattacaaagtagtaaaaataaaaccttttagtgtagc

SEQ ID NO: 182688 - DNA, 75 bp, Artificial Sequence
  Synthetic
gggagacatgaaagatatatggagaactgaattagccaattacaaagtagtaaaaataaaaccttttagtgtagc

SEQ ID NO: 182689 - DNA, 75 bp, Artificial Sequence
  Synthetic
gggagagatgaaagatatatggagaactgaattagccaattacaaagtagtaaaaataaaaccttttagtgtagc

SEQ ID NO: 182690 - DNA, 75 bp, Artificial Sequence
  Synthetic
accaacaagaaaagaatgaacaagaattattggaattagataaatgggcaagtttgtggaattggtttgacataa

SEQ ID NO: 182691 - DNA, 75 bp, Artificial Sequence
  Synthetic
gcttttttcaacatacctgtaagaataagacaaggattagaaagaattttactataacatggggggcaagtggtc

SEQ ID NO: 182692 - DNA, 75 bp, Artificial Sequence
  Synthetic
gtaagggaacgaataagacgaacccctccagcagcagtaggagtaggagcagtatctcaagatttagctaggcat

SEQ ID NO: 182693 - DNA, 75 bp, Artificial Sequence
  Synthetic
ctccagcagcagtaggagtaggagcagtatctcaagatttagctaggcatggagcaattacaagcagcaatacag

SEQ ID NO: 182694 - DNA, 75 bp, Artificial Sequence
  Synthetic
cacaggtacctctgagaccaatgacttataagggtgcttttgatctcagcttctttttaaaagaaaaggggggac

SEQ ID NO: 182695 - DNA, 75 bp, Artificial Sequence
  Synthetic
gatatcaacccctctcgttacagaccctcaaccagcaccaaccggaagcagaaacgccaggaggaacaggaggag

SEQ ID NO: 182696 - DNA, 75 bp, Artificial Sequence
  Synthetic
cctcttgagcagcttagcatcagggatccggaacgtgaccagttacctgggacttggactggagatcctagggca

SEQ ID NO: 182697 - DNA, 75 bp, Artificial Sequence
  Synthetic
gaggaagaggaagtaggctttccagtcagacctcaggtacctttaaggccaatgacttataaggcagcttttgat

SEQ ID NO: 182698 - DNA, 75 bp, Artificial Sequence
  Synthetic
gcagttggcaattggactgatagcatcatcttaggaatacaaagaataggaaggggaattcttaatataccacga

SEQ ID NO: 182699 - DNA, 75 bp, Artificial Sequence
  Synthetic
gcagttggcaattggactgatagcatcatcttaggaatacaaagaataggaaggggaattcttaatattccacga

SEQ ID NO: 182700 - DNA, 75 bp, Artificial Sequence
  Synthetic
gcagttggcaattggactgatagcatcatcttaggaatacaaagaataggaaggggaattcttaatatcccacga

SEQ ID NO: 182701 - DNA, 75 bp, Artificial Sequence
  Synthetic
gcagttggcaattggactgatagcatcatcttaggaatacaaagaataggaaggggaattcttaatatgccacga

SEQ ID NO: 182702 - DNA, 75 bp, Artificial Sequence
  Synthetic
aacgaaaggcttaggcatctcctatggcaggaagaagcggagaccgcgacgaagaactcctccaggcggtcaggc

SEQ ID NO: 182703 - DNA, 75 bp, Artificial Sequence
  Synthetic
agaaccagaacctccagaacctcccctaattctgaaccatgtgcacctggggtaggagaaatctccagacagtta

SEQ ID NO: 182704 - DNA, 75 bp, Artificial Sequence
  Synthetic
tagagatattagcaatagtagcattagtagtagcactaatactagcaatagttgtgtggactatagtattcatag

SEQ ID NO: 182705 - DNA, 75 bp, Artificial Sequence
  Synthetic
ttgaatgcatgggtaaaagtaatagaggaaaaggcttttagcccagaagtaatacccatgtttacagcattatca

SEQ ID NO: 182706 - DNA, 75 bp, Artificial Sequence
  Synthetic
attgcagggcccctaggaaaaaaggctgttggaaatgtggaaaggaaggacaccaaatgaaagactgtactgaga

SEQ ID NO: 182707 - DNA, 75 bp, Artificial Sequence
  Synthetic
tggaaaaataacatggtagaacaaatgcatacagatataattagtttatgggatcaaagcctaaagccatgtgtg

SEQ ID NO: 182708 - DNA, 75 bp, Artificial Sequence
  Synthetic
cgtgggtcacagtttattatggggtgcctgtgtggaaagaagcaaccactactctattttgtgcatcagatgcta

SEQ ID NO: 182709 - DNA, 75 bp, Artificial Sequence
  Synthetic
aactgttacaacagttagagccagctctcaagacagggtcagacagcctgcagtcactctggaacacaatagcag

SEQ ID NO: 182710 - DNA, 75 bp, Artificial Sequence
  Synthetic
tagaattaatgacacacagcaggcaatacaaaaattaaaggaagtaatgaacaaaaagtctgcgagtgccgctaa

SEQ ID NO: 182711 - DNA, 75 bp, Artificial Sequence
  Synthetic
aaaggaaaagatagaagattgggaagaaacaaaaaattgctctttcaatacaaccactgagttaagagataagat

SEQ ID NO: 182712 - DNA, 75 bp, Artificial Sequence
  Synthetic
acaaaaagaagaggaggaagtgggttttccagtcagaccccaggtacctgtaagaccaatgacttacaaagcagc

SEQ ID NO: 182713 - DNA, 75 bp, Artificial Sequence
  Synthetic
gacccaataacaatacaagaaaaagtatacatataggaccaggacgtgcatttcatacaacagacagaatagtag

SEQ ID NO: 182714 - DNA, 75 bp, Artificial Sequence
  Synthetic
acatgacctggatgcagtgggaaagagaaattgacaattacacaggcataatatatgacctacttgaaaaatcgc

SEQ ID NO: 182715 - DNA, 75 bp, Artificial Sequence
  Synthetic
gtaatcaatgaggaagcatcagattgggatagaactcacccaccagcagcagggccatatccagcagggcagata

SEQ ID NO: 182716 - DNA, 75 bp, Artificial Sequence
  Synthetic
aacaataaaatttaactcatcctcaggaggggacccagaagttacaatgcatatgtttaattgtagaggagaatt

SEQ ID NO: 182717 - DNA, 75 bp, Artificial Sequence
  Synthetic
ctagcagaagaagagataataatcagatctgaaaatctcacaaacaatgccaaaaccataatagtgcaccttaat

SEQ ID NO: 182718 - DNA, 75 bp, Artificial Sequence
  Synthetic
acttctgggacgcagggggtgggaagccctcaagtattggtggaatctcctgcagtattggagtcaggaactaaa

SEQ ID NO: 182719 - DNA, 75 bp, Artificial Sequence
  Synthetic
tttaaaccatcctcgggaggggacccagaaattacaacacacagctttaattgtggaggggaatttttctactgc

SEQ ID NO: 182720 - DNA, 75 bp, Artificial Sequence
  Synthetic
tgtaaactccttaggggggccaaagcactaacagacatagtaccactaactgaagaagcagaattagaattggca

SEQ ID NO: 182721 - DNA, 75 bp, Artificial Sequence
  Synthetic
gccctcaagtattggtggaatctcctgcagtattggagtcaggaactaaagaatagtgccattagtttgctcaac

SEQ ID NO: 182722 - DNA, 75 bp, Artificial Sequence
  Synthetic
atccgtttgcctccctcaaatccctctttgggacagaccagtagttacagcaagggttgggggccatctatgtga

SEQ ID NO: 182723 - DNA, 75 bp, Artificial Sequence
  Synthetic
gccacctttgcctagtgttaggaaattaacagaggacagatggaacaagccccagaagaccaggggccacagagg

SEQ ID NO: 182724 - DNA, 75 bp, Artificial Sequence
  Synthetic
agttttgctggacacaggggcagatgacacagtactaaacaatatacaattggagggggaatggacaccaaaaat

SEQ ID NO: 182725 - DNA, 75 bp, Artificial Sequence
  Synthetic
catagcaaaataggcattaatctacagaggagagcaagaaatggagccagtaaaccctagtctagagccctggga

SEQ ID NO: 182726 - DNA, 75 bp, Artificial Sequence
  Synthetic
cgcagggggtgggaagccatcaaatatctgtggaatctcctgcagtattggattcaggaactaaagaatagtgct

SEQ ID NO: 182727 - DNA, 75 bp, Artificial Sequence
  Synthetic
aaagtgcaggcacttttttataaacttgatatagtaccacttaactctacggggagtaataccagctctatgggg

SEQ ID NO: 182728 - DNA, 75 bp, Artificial Sequence
  Synthetic
gcacaaataccactagcgaatggggggaaaagatggaggaaggagaaataaaaaactgctctttcaagaccaacc

SEQ ID NO: 182729 - DNA, 75 bp, Artificial Sequence
  Synthetic
aaacatggagcgcttacaagcagcaacacagtcaccaataatgctgcttgtgcctggctgcaagcgcaagaggag

SEQ ID NO: 182730 - DNA, 75 bp, Artificial Sequence
  Synthetic
gtcaacgttagcaccactgacatgcaagaagtaaaaaactgctcttacaatataaccacagaattaagggataag

SEQ ID NO: 182731 - DNA, 75 bp, Artificial Sequence
  Synthetic
tgacagaagtagtacctctaagtaaagaagcagagttagaattagaggagaacagagaaaggctaaaagaaccag

SEQ ID NO: 182732 - DNA, 75 bp, Artificial Sequence
  Synthetic
ataggaccaggacaaacattctttgcaacaaatataataggagacataagagaagcacattgtaacattagtgaa

SEQ ID NO: 182733 - DNA, 75 bp, Artificial Sequence
  Synthetic
gaaagctaaaggatggttttatagacatcactatgaaagcactcatccaagaataagttcagaagtacacatccc

SEQ ID NO: 182734 - DNA, 75 bp, Artificial Sequence
  Synthetic
ggacctcctcagagcaataaggatcatcaaaatcctgtaccaaagcagtaagtagtaataattagtatatgtaat

SEQ ID NO: 182735 - DNA, 75 bp, Artificial Sequence
  Synthetic
actcaagcaggaagctgtcagacactttcctagaccatggctccataacttaggacagcatatctatgaaaccta

SEQ ID NO: 182736 - DNA, 75 bp, Artificial Sequence
  Synthetic
taggacagcatatctatgaaacctatggggatacttggacaggagttgaagctctaataagaatattgcaacaac

SEQ ID NO: 182737 - DNA, 75 bp, Artificial Sequence
  Synthetic
aaggaaaagtgtacatataggaccaggacaagcattctatgcaacaggtgccataataggggatataagacaagc

SEQ ID NO: 182738 - DNA, 75 bp, Artificial Sequence
  Synthetic
caggaggggacccagaaattgtaatgcatagttttaattgtggaggggaatttttctactgtaatacaacaaaac

SEQ ID NO: 182739 - DNA, 75 bp, Artificial Sequence
  Synthetic
cagagatacaaaactagggaaggcagggtatgttacagaacaaggaaaacagaaaatagtaaaattggaggagac

SEQ ID NO: 182740 - DNA, 75 bp, Artificial Sequence
  Synthetic
ggacaagcattctatgcaacaggtgccataataggggatataagacaagcatattgtaatgttagtgaagtagaa

SEQ ID NO: 182741 - DNA, 75 bp, Artificial Sequence
  Synthetic
caacgcatacttttaattgtgggggagaatttttctattgtaacacatcaggcctgtttaacagcacttggcata

SEQ ID NO: 182742 - DNA, 75 bp, Artificial Sequence
  Synthetic
agaatttttctattgtaacacatcaggcctgtttaacagcacttggcatagcaatgccagcatacaagagccaaa

SEQ ID NO: 182743 - DNA, 75 bp, Artificial Sequence
  Synthetic
gtggcgcccgaacagggacttgaaagcgaaagttaatagggactcgaaaacgaaagttccagagaagttctctcg

SEQ ID NO: 182744 - DNA, 75 bp, Artificial Sequence
  Synthetic
ctctttcaatataaccacagaaataagagataagaagaagcaagagtatgcgcttttctatagacttgatatagt

SEQ ID NO: 182745 - DNA, 75 bp, Artificial Sequence
  Synthetic
cctggctgtggaaagatacctaagggatcaacagctcctaggaatttggggctgctctggaagactcatctgcac

SEQ ID NO: 182746 - DNA, 75 bp, Artificial Sequence
  Synthetic
tatagattaataaattgtaatacctcaaccttaacacaagcctgtccaaaggtcacttttgacccaattcctata

SEQ ID NO: 182747 - DNA, 75 bp, Artificial Sequence
  Synthetic
atagtgtggcaagtggacagacagaaagtgaaaacatggaacagcctggtgaaatatcataagtacaggtctagg

SEQ ID NO: 182748 - DNA, 75 bp, Artificial Sequence
  Synthetic
tctatagtgaatagagttaggcagggatactcacctttgtcgtttcagacccctaccccgaacccagggggaccc

SEQ ID NO: 182749 - DNA, 75 bp, Artificial Sequence
  Synthetic
ccacatattggggattgatgccaggggaaagagatgaacatttgggacatggggttagtatagaatggcagtaca

SEQ ID NO: 182750 - DNA, 75 bp, Artificial Sequence
  Synthetic
ggcagagagtgggacaagcaatgtatgcccctcccatcgcaggaaacattacatgtaggtcaaacattacaggac

SEQ ID NO: 182751 - DNA, 75 bp, Artificial Sequence
  Synthetic
ggggttagtatagaatggcagtacaagaagtataaaacacagattgaccctgaaacagcagacaggatgatacat

SEQ ID NO: 182752 - DNA, 75 bp, Artificial Sequence
  Synthetic
tacttcacatacctactagaataagacagggcttggaaagggctttactataaaatgggtggcaaatggtcaaaa

SEQ ID NO: 182753 - DNA, 75 bp, Artificial Sequence
  Synthetic
ccctttagagcaaaaaatccagacctagttatctaccaatacatggatgatttgtatgtagggtctgacttagaa

SEQ ID NO: 182754 - DNA, 75 bp, Artificial Sequence
  Synthetic
caaattaattgtacaagacccaactacattaaaagaaaaaggatacatataggaccagggagagcattttataca

SEQ ID NO: 182755 - DNA, 75 bp, Artificial Sequence
  Synthetic
aacacttccctaataaaaatataagctttaaaccatcctcaggaggggacccagagattacaacacatagtttta

SEQ ID NO: 182756 - DNA, 75 bp, Artificial Sequence
  Synthetic
taacatggggggcaagtggtcaaaaagtagcatagtgggatggcctgagattagggaaagaatgagacgaactcc

SEQ ID NO: 182757 - DNA, 75 bp, Artificial Sequence
  Synthetic
gtggcgcccgaacagggacttgaaagcgaaagtaatagggactcgaaaacgaaagttccagagaagaagctctct

SEQ ID NO: 182758 - DNA, 75 bp, Artificial Sequence
  Synthetic
ttgctatgtttgtttcacaagcaagggtttggggatctcctatggcaggaagaagcgacgccgacgaccagcagt

SEQ ID NO: 182759 - DNA, 75 bp, Artificial Sequence
  Synthetic
atggcaggtgatgattgtgtggcaagtagacaggatgaggattagaacatggaaaagtctagtaaaacaccatat

SEQ ID NO: 182760 - DNA, 75 bp, Artificial Sequence
  Synthetic
ctatttctaaatgtactaatatggacctttgtacttaaacaatgtttagatcataagaaacaagacagaagggaa

SEQ ID NO: 182761 - DNA, 75 bp, Artificial Sequence
  Synthetic
atagtcatgggttttataaccccatgtttgagctctaaccaacagctgtatgcaacagtctatgctggagtgcct

SEQ ID NO: 182762 - DNA, 75 bp, Artificial Sequence
  Synthetic
tagaagaaaaggctttcagcccagaagtaatacccatgttctcagcattatcagaaggagccaccccacaagatt

SEQ ID NO: 182763 - DNA, 75 bp, Artificial Sequence
  Synthetic
cagatcctactccacaagagtacccattaaaaaatgtgacagataaatttgatatatggaaaaattatatggtag

SEQ ID NO: 182764 - DNA, 75 bp, Artificial Sequence
  Synthetic
ttcagctaccaccaattgagagacttcatattgattgtagcgagagcagtggaacttctgggacgcagcagtctc

SEQ ID NO: 182765 - DNA, 75 bp, Artificial Sequence
  Synthetic
aacaccaaaaaagagaaagccacctttgcctagtgttaagaagctaacagaggatagatggaacaagccccagaa

SEQ ID NO: 182766 - DNA, 75 bp, Artificial Sequence
  Synthetic
atagtagtattagaggactgatagagacaggagacataaaaaactgcactttcaatgtcaccacaaacatacaag

SEQ ID NO: 182767 - DNA, 75 bp, Artificial Sequence
  Synthetic
atagtagtattagaggactgattgagacaggagacataaaaaactgcactttcaatgtcaccacaaacatacaag

SEQ ID NO: 182768 - DNA, 75 bp, Artificial Sequence
  Synthetic
atagtagtattagaggactgatcgagacaggagacataaaaaactgcactttcaatgtcaccacaaacatacaag

SEQ ID NO: 182769 - DNA, 75 bp, Artificial Sequence
  Synthetic
atagtagtattagaggactgatggagacaggagacataaaaaactgcactttcaatgtcaccacaaacatacaag

SEQ ID NO: 182770 - DNA, 75 bp, Artificial Sequence
  Synthetic
atagtagtattagtggactgatagagacaggagacataaaaaactgcactttcaatgtcaccacaaacatacaag

SEQ ID NO: 182771 - DNA, 75 bp, Artificial Sequence
  Synthetic
atagtagtattagtggactgattgagacaggagacataaaaaactgcactttcaatgtcaccacaaacatacaag

SEQ ID NO: 182772 - DNA, 75 bp, Artificial Sequence
  Synthetic
atagtagtattagtggactgatcgagacaggagacataaaaaactgcactttcaatgtcaccacaaacatacaag

SEQ ID NO: 182773 - DNA, 75 bp, Artificial Sequence
  Synthetic
atagtagtattagtggactgatggagacaggagacataaaaaactgcactttcaatgtcaccacaaacatacaag

SEQ ID NO: 182774 - DNA, 75 bp, Artificial Sequence
  Synthetic
atagtagtattagcggactgatagagacaggagacataaaaaactgcactttcaatgtcaccacaaacatacaag

SEQ ID NO: 182775 - DNA, 75 bp, Artificial Sequence
  Synthetic
atagtagtattagcggactgattgagacaggagacataaaaaactgcactttcaatgtcaccacaaacatacaag

SEQ ID NO: 182776 - DNA, 75 bp, Artificial Sequence
  Synthetic
atagtagtattagcggactgatcgagacaggagacataaaaaactgcactttcaatgtcaccacaaacatacaag

SEQ ID NO: 182777 - DNA, 75 bp, Artificial Sequence
  Synthetic
atagtagtattagcggactgatggagacaggagacataaaaaactgcactttcaatgtcaccacaaacatacaag

SEQ ID NO: 182778 - DNA, 75 bp, Artificial Sequence
  Synthetic
atagtagtattaggggactgatagagacaggagacataaaaaactgcactttcaatgtcaccacaaacatacaag

SEQ ID NO: 182779 - DNA, 75 bp, Artificial Sequence
  Synthetic
atagtagtattaggggactgattgagacaggagacataaaaaactgcactttcaatgtcaccacaaacatacaag

SEQ ID NO: 182780 - DNA, 75 bp, Artificial Sequence
  Synthetic
atagtagtattaggggactgatcgagacaggagacataaaaaactgcactttcaatgtcaccacaaacatacaag

SEQ ID NO: 182781 - DNA, 75 bp, Artificial Sequence
  Synthetic
atagtagtattaggggactgatggagacaggagacataaaaaactgcactttcaatgtcaccacaaacatacaag

SEQ ID NO: 182782 - DNA, 75 bp, Artificial Sequence
  Synthetic
atagtagtatttgaggactgatagagacaggagacataaaaaactgcactttcaatgtcaccacaaacatacaag

SEQ ID NO: 182783 - DNA, 75 bp, Artificial Sequence
  Synthetic
atagtagtatttgaggactgattgagacaggagacataaaaaactgcactttcaatgtcaccacaaacatacaag

SEQ ID NO: 182784 - DNA, 75 bp, Artificial Sequence
  Synthetic
atagtagtatttgaggactgatcgagacaggagacataaaaaactgcactttcaatgtcaccacaaacatacaag

SEQ ID NO: 182785 - DNA, 75 bp, Artificial Sequence
  Synthetic
atagtagtatttgaggactgatggagacaggagacataaaaaactgcactttcaatgtcaccacaaacatacaag

SEQ ID NO: 182786 - DNA, 75 bp, Artificial Sequence
  Synthetic
atagtagtatttgtggactgatagagacaggagacataaaaaactgcactttcaatgtcaccacaaacatacaag

SEQ ID NO: 182787 - DNA, 75 bp, Artificial Sequence
  Synthetic
atagtagtatttgtggactgattgagacaggagacataaaaaactgcactttcaatgtcaccacaaacatacaag

SEQ ID NO: 182788 - DNA, 75 bp, Artificial Sequence
  Synthetic
atagtagtatttgtggactgatcgagacaggagacataaaaaactgcactttcaatgtcaccacaaacatacaag

SEQ ID NO: 182789 - DNA, 75 bp, Artificial Sequence
  Synthetic
atagtagtatttgtggactgatggagacaggagacataaaaaactgcactttcaatgtcaccacaaacatacaag

SEQ ID NO: 182790 - DNA, 75 bp, Artificial Sequence
  Synthetic
atagtagtatttgcggactgatagagacaggagacataaaaaactgcactttcaatgtcaccacaaacatacaag

SEQ ID NO: 182791 - DNA, 75 bp, Artificial Sequence
  Synthetic
atagtagtatttgcggactgattgagacaggagacataaaaaactgcactttcaatgtcaccacaaacatacaag

SEQ ID NO: 182792 - DNA, 75 bp, Artificial Sequence
  Synthetic
atagtagtatttgcggactgatcgagacaggagacataaaaaactgcactttcaatgtcaccacaaacatacaag

SEQ ID NO: 182793 - DNA, 75 bp, Artificial Sequence
  Synthetic
atagtagtatttgcggactgatggagacaggagacataaaaaactgcactttcaatgtcaccacaaacatacaag

SEQ ID NO: 182794 - DNA, 75 bp, Artificial Sequence
  Synthetic
atagtagtatttggggactgatagagacaggagacataaaaaactgcactttcaatgtcaccacaaacatacaag

SEQ ID NO: 182795 - DNA, 75 bp, Artificial Sequence
  Synthetic
atagtagtatttggggactgattgagacaggagacataaaaaactgcactttcaatgtcaccacaaacatacaag

SEQ ID NO: 182796 - DNA, 75 bp, Artificial Sequence
  Synthetic
atagtagtatttggggactgatcgagacaggagacataaaaaactgcactttcaatgtcaccacaaacatacaag

SEQ ID NO: 182797 - DNA, 75 bp, Artificial Sequence
  Synthetic
atagtagtatttggggactgatggagacaggagacataaaaaactgcactttcaatgtcaccacaaacatacaag

SEQ ID NO: 182798 - DNA, 75 bp, Artificial Sequence
  Synthetic
atagtagtattcgaggactgatagagacaggagacataaaaaactgcactttcaatgtcaccacaaacatacaag

SEQ ID NO: 182799 - DNA, 75 bp, Artificial Sequence
  Synthetic
atagtagtattcgaggactgattgagacaggagacataaaaaactgcactttcaatgtcaccacaaacatacaag

SEQ ID NO: 182800 - DNA, 75 bp, Artificial Sequence
  Synthetic
atagtagtattcgaggactgatcgagacaggagacataaaaaactgcactttcaatgtcaccacaaacatacaag

SEQ ID NO: 182801 - DNA, 75 bp, Artificial Sequence
  Synthetic
atagtagtattcgaggactgatggagacaggagacataaaaaactgcactttcaatgtcaccacaaacatacaag

SEQ ID NO: 182802 - DNA, 75 bp, Artificial Sequence
  Synthetic
atagtagtattcgtggactgatagagacaggagacataaaaaactgcactttcaatgtcaccacaaacatacaag

SEQ ID NO: 182803 - DNA, 75 bp, Artificial Sequence
  Synthetic
atagtagtattcgtggactgattgagacaggagacataaaaaactgcactttcaatgtcaccacaaacatacaag

SEQ ID NO: 182804 - DNA, 75 bp, Artificial Sequence
  Synthetic
atagtagtattcgtggactgatcgagacaggagacataaaaaactgcactttcaatgtcaccacaaacatacaag

SEQ ID NO: 182805 - DNA, 75 bp, Artificial Sequence
  Synthetic
atagtagtattcgtggactgatggagacaggagacataaaaaactgcactttcaatgtcaccacaaacatacaag

SEQ ID NO: 182806 - DNA, 75 bp, Artificial Sequence
  Synthetic
atagtagtattcgcggactgatagagacaggagacataaaaaactgcactttcaatgtcaccacaaacatacaag

SEQ ID NO: 182807 - DNA, 75 bp, Artificial Sequence
  Synthetic
atagtagtattcgcggactgattgagacaggagacataaaaaactgcactttcaatgtcaccacaaacatacaag

SEQ ID NO: 182808 - DNA, 75 bp, Artificial Sequence
  Synthetic
atagtagtattcgcggactgatcgagacaggagacataaaaaactgcactttcaatgtcaccacaaacatacaag

SEQ ID NO: 182809 - DNA, 75 bp, Artificial Sequence
  Synthetic
atagtagtattcgcggactgatggagacaggagacataaaaaactgcactttcaatgtcaccacaaacatacaag

SEQ ID NO: 182810 - DNA, 75 bp, Artificial Sequence
  Synthetic
atagtagtattcggggactgatagagacaggagacataaaaaactgcactttcaatgtcaccacaaacatacaag

SEQ ID NO: 182811 - DNA, 75 bp, Artificial Sequence
  Synthetic
atagtagtattcggggactgattgagacaggagacataaaaaactgcactttcaatgtcaccacaaacatacaag

SEQ ID NO: 182812 - DNA, 75 bp, Artificial Sequence
  Synthetic
atagtagtattcggggactgatcgagacaggagacataaaaaactgcactttcaatgtcaccacaaacatacaag

SEQ ID NO: 182813 - DNA, 75 bp, Artificial Sequence
  Synthetic
atagtagtattcggggactgatggagacaggagacataaaaaactgcactttcaatgtcaccacaaacatacaag

SEQ ID NO: 182814 - DNA, 75 bp, Artificial Sequence
  Synthetic
atagtagtattggaggactgatagagacaggagacataaaaaactgcactttcaatgtcaccacaaacatacaag

SEQ ID NO: 182815 - DNA, 75 bp, Artificial Sequence
  Synthetic
atagtagtattggaggactgattgagacaggagacataaaaaactgcactttcaatgtcaccacaaacatacaag

SEQ ID NO: 182816 - DNA, 75 bp, Artificial Sequence
  Synthetic
atagtagtattggaggactgatcgagacaggagacataaaaaactgcactttcaatgtcaccacaaacatacaag

SEQ ID NO: 182817 - DNA, 75 bp, Artificial Sequence
  Synthetic
atagtagtattggaggactgatggagacaggagacataaaaaactgcactttcaatgtcaccacaaacatacaag

SEQ ID NO: 182818 - DNA, 75 bp, Artificial Sequence
  Synthetic
atagtagtattggtggactgatagagacaggagacataaaaaactgcactttcaatgtcaccacaaacatacaag

SEQ ID NO: 182819 - DNA, 75 bp, Artificial Sequence
  Synthetic
atagtagtattggtggactgattgagacaggagacataaaaaactgcactttcaatgtcaccacaaacatacaag

SEQ ID NO: 182820 - DNA, 75 bp, Artificial Sequence
  Synthetic
atagtagtattggtggactgatcgagacaggagacataaaaaactgcactttcaatgtcaccacaaacatacaag

SEQ ID NO: 182821 - DNA, 75 bp, Artificial Sequence
  Synthetic
atagtagtattggtggactgatggagacaggagacataaaaaactgcactttcaatgtcaccacaaacatacaag

SEQ ID NO: 182822 - DNA, 75 bp, Artificial Sequence
  Synthetic
atagtagtattggcggactgatagagacaggagacataaaaaactgcactttcaatgtcaccacaaacatacaag

SEQ ID NO: 182823 - DNA, 75 bp, Artificial Sequence
  Synthetic
atagtagtattggcggactgattgagacaggagacataaaaaactgcactttcaatgtcaccacaaacatacaag

SEQ ID NO: 182824 - DNA, 75 bp, Artificial Sequence
  Synthetic
atagtagtattggcggactgatcgagacaggagacataaaaaactgcactttcaatgtcaccacaaacatacaag

SEQ ID NO: 182825 - DNA, 75 bp, Artificial Sequence
  Synthetic
atagtagtattggcggactgatggagacaggagacataaaaaactgcactttcaatgtcaccacaaacatacaag

SEQ ID NO: 182826 - DNA, 75 bp, Artificial Sequence
  Synthetic
atagtagtattgggggactgatagagacaggagacataaaaaactgcactttcaatgtcaccacaaacatacaag

SEQ ID NO: 182827 - DNA, 75 bp, Artificial Sequence
  Synthetic
atagtagtattgggggactgattgagacaggagacataaaaaactgcactttcaatgtcaccacaaacatacaag

SEQ ID NO: 182828 - DNA, 75 bp, Artificial Sequence
  Synthetic
atagtagtattgggggactgatcgagacaggagacataaaaaactgcactttcaatgtcaccacaaacatacaag

SEQ ID NO: 182829 - DNA, 75 bp, Artificial Sequence
  Synthetic
atagtagtattgggggactgatggagacaggagacataaaaaactgcactttcaatgtcaccacaaacatacaag

SEQ ID NO: 182830 - DNA, 75 bp, Artificial Sequence
  Synthetic
taataataccagcaaaagcaatataacagagaacgatggtgaaacccctatgaaagtgtgtgaatttaatgtaac

SEQ ID NO: 182831 - DNA, 75 bp, Artificial Sequence
  Synthetic
attacagtagttacttgtacacatggcattaagccaacagtaagtactcatctaatattaaatggaacaatatct

SEQ ID NO: 182832 - DNA, 75 bp, Artificial Sequence
  Synthetic
gaataccacacccagcagggttaaaaaagaaaaaatcagtaacagtactggatgtgggggatgcatatttttcag

SEQ ID NO: 182833 - DNA, 75 bp, Artificial Sequence
  Synthetic
gtatatgtaatgaatgctttacaaatatcagcaataatagcattagtaatagtagcaatactagcaatagttgtg

SEQ ID NO: 182834 - DNA, 75 bp, Artificial Sequence
  Synthetic
ccatcagccccgccagcagagagcttcgggttcgggggggagataaccccttccccgaagcaggagcagaaagac

SEQ ID NO: 182835 - DNA, 75 bp, Artificial Sequence
  Synthetic
gggacaacgtgacagtaggacaggtgggcccaggtccaatggctgtgatcagcatgaacctggcagcagagggca

SEQ ID NO: 182836 - DNA, 75 bp, Artificial Sequence
  Synthetic
gaataagagaaagagcagaagacagtggaaatgagagtgaaggagacacagatgaattggccaaacttgtggaaa

SEQ ID NO: 182837 - DNA, 75 bp, Artificial Sequence
  Synthetic
tttaaccaatcctctggaggggatccagaaattgtaaagcacagttttaattgtggaggggagtttttctactgc

SEQ ID NO: 182838 - DNA, 75 bp, Artificial Sequence
  Synthetic
tttaaccaatcctctggaggggatccagaaattgtaatgcacagttttaattgtggaggggagtttttctactgc

SEQ ID NO: 182839 - DNA, 75 bp, Artificial Sequence
  Synthetic
tttaaccaatcctctggaggggatccagaaattgtaacgcacagttttaattgtggaggggagtttttctactgc

SEQ ID NO: 182840 - DNA, 75 bp, Artificial Sequence
  Synthetic
tttaaccaatcctctggaggggatccagaaattgtaaggcacagttttaattgtggaggggagtttttctactgc

SEQ ID NO: 182841 - DNA, 75 bp, Artificial Sequence
  Synthetic
tagtcagttagttacagtgcagttcaatagaagcactgatggtgatgcagagataaccactttacattttaactg

SEQ ID NO: 182842 - DNA, 75 bp, Artificial Sequence
  Synthetic
aaaagcaatgtatgcccctcccatccgaggagtaattaactgttaatcaaatattacagggctactattaatgag

SEQ ID NO: 182843 - DNA, 75 bp, Artificial Sequence
  Synthetic
aaaagcaatgtatgcccctcccatccgaggagtaattaactgtttatcaaatattacagggctactattaatgag

SEQ ID NO: 182844 - DNA, 75 bp, Artificial Sequence
  Synthetic
aaaagcaatgtatgcccctcccatccgaggagtaattaactgttcatcaaatattacagggctactattaatgag

SEQ ID NO: 182845 - DNA, 75 bp, Artificial Sequence
  Synthetic
aaaagcaatgtatgcccctcccatccgaggagtaattaactgttgatcaaatattacagggctactattaatgag

SEQ ID NO: 182846 - DNA, 75 bp, Artificial Sequence
  Synthetic
attaatagtactagtaatagtacgagtgagataccttgcaggttgagacaggtggtaagatcatggatgggggga

SEQ ID NO: 182847 - DNA, 75 bp, Artificial Sequence
  Synthetic
ggtggtaagatcatggatggggggacagtcaggactctatgctcctcccatcaaaggtaatctaacatgtatatc

SEQ ID NO: 182848 - DNA, 75 bp, Artificial Sequence
  Synthetic
tttttcagaatctgccataaggaaagccatattaggacatagagttagccctaggtgtaactatcaagcaggaca

SEQ ID NO: 182849 - DNA, 75 bp, Artificial Sequence
  Synthetic
tgcaacaactactgtttattcatttcagaattgggtgccaacatagcagaataggcattttgcgacagagaagag

SEQ ID NO: 182850 - DNA, 75 bp, Artificial Sequence
  Synthetic
taacaaggtaggatctctacaatatttggcactaacagcattaatagctccaaagaaggcaaagccgcctttgcc

SEQ ID NO: 182851 - DNA, 75 bp, Artificial Sequence
  Synthetic
cacatggaattaggccagtagtatcaactcaactgctgttgaatggcagtctagcagaagaagatgtaatgatta

SEQ ID NO: 182852 - DNA, 75 bp, Artificial Sequence
  Synthetic
actaatcctagcaatagttgtgtggatcatagcatatatagaatataggaaattgttaagacaaagaaaaataga

SEQ ID NO: 182853 - DNA, 75 bp, Artificial Sequence
  Synthetic
aggctaatctgctacacctcagttcagtggaacaagacatgggtaaacaaaacaaatactgacctggagaatatt

SEQ ID NO: 182854 - DNA, 75 bp, Artificial Sequence
  Synthetic
gtattctatagaacaggagacataataggagatataagaaaagcatattgtgagattaatggaacaaaatggaat

SEQ ID NO: 182855 - DNA, 75 bp, Artificial Sequence
  Synthetic
ggagatctagaaattacaatgcatcattttaattgtagaggggaatttttctattgcaatacaacacaactgttt

SEQ ID NO: 182856 - DNA, 75 bp, Artificial Sequence
  Synthetic
cacacttccatgcaagataaagcaaattataaacatgtggcagggaacaggacaagcaatgtatgctcctcccat

SEQ ID NO: 182857 - DNA, 75 bp, Artificial Sequence
  Synthetic
atgcatgaggatgtaatcagtttatgggaccaaagcctaaagccatgtgtaaaattgaccccactctgtgtcact

SEQ ID NO: 182858 - DNA, 75 bp, Artificial Sequence
  Synthetic
caccgatcggaagcagaaacgccaggaagaacaggagaaggaggtggagaagaaggcaggtccagattgacagcc

SEQ ID NO: 182859 - DNA, 75 bp, Artificial Sequence
  Synthetic
ctgctgcaaatgttactgctaccactaatggtagtatagctgaagaaatgagaaattgctcttttaatgcaacca

SEQ ID NO: 182860 - DNA, 75 bp, Artificial Sequence
  Synthetic
cgatcagccatctgagacttggactgtggatcctaggagagaagataattagtgcttgcagaatttgtacagctg

SEQ ID NO: 182861 - DNA, 75 bp, Artificial Sequence
  Synthetic
gatacaaagaataggaagaggaattctcaacatcccaacaagaattagacagggcttggagagaagtttactgta

SEQ ID NO: 182862 - DNA, 75 bp, Artificial Sequence
  Synthetic
cctctcttgacaccctgaaggaagagtcaggagcaatacaaaactgttcttttaacatgaccacagatgtaggtg

SEQ ID NO: 182863 - DNA, 75 bp, Artificial Sequence
  Synthetic
agctggagtaggagcagtctccagggcaatagcagagaaaggaggaataccaaattcttatactcctcaaaacaa

SEQ ID NO: 182864 - DNA, 75 bp, Artificial Sequence
  Synthetic
gcagacatccaaaagtaagttcagaagtacacataccattaggggaggctagattagtaataaaaacatattggg

SEQ ID NO: 182865 - DNA, 75 bp, Artificial Sequence
  Synthetic
catcaagaggaagaggtaggcttcccagtaagacctcaagtgcccctgaggccaatgacctttaaaggagcgcat

SEQ ID NO: 182866 - DNA, 75 bp, Artificial Sequence
  Synthetic
cccctctgagggtgccactaatgaggtaggaatgaaaaactgctctttcaatataaccacagaattaagagatag

SEQ ID NO: 182867 - DNA, 75 bp, Artificial Sequence
  Synthetic
agcttgtagagctattcttcacatacctagaagaataagacagggcttggaaaggcttttgctgtaagatgggtg

SEQ ID NO: 182868 - DNA, 75 bp, Artificial Sequence
  Synthetic
agacactttcctagaccatggctccataacttaggacagcatatctatgaaacctatggggatacttgggcagga

SEQ ID NO: 182869 - DNA, 75 bp, Artificial Sequence
  Synthetic
agacttaatagctgaaatacagaaacaggggtatgatcaatggacatatcaaatttaccaagaaccattcaagaa

SEQ ID NO: 182870 - DNA, 75 bp, Artificial Sequence
  Synthetic
tgtttattcatttcagaattgggtgccagcatagcagaataggcattttgcgacagagaagagcaagaaatggag

SEQ ID NO: 182871 - DNA, 75 bp, Artificial Sequence
  Synthetic
ataataattagatctgaaaatctcacaaataatgctaaaatcataatagtacagcttaatgagtctgtaacaatt

SEQ ID NO: 182872 - DNA, 75 bp, Artificial Sequence
  Synthetic
caaataatgctaaaatcataatagtacagcttaatgagtctgtaacaattaattgcacaaggccctaccaaaata

SEQ ID NO: 182873 - DNA, 75 bp, Artificial Sequence
  Synthetic
aaatatcactctcccatgtagaataaaacaagttataaacatgtggcaggaagtaggacgagcaatgtatgccgc

SEQ ID NO: 182874 - DNA, 75 bp, Artificial Sequence
  Synthetic
agctggatggaataaaactttacaacaggtagctaaaaaattaggagaccttcttaacaagacaacaataatttt

SEQ ID NO: 182875 - DNA, 75 bp, Artificial Sequence
  Synthetic
aagaagcggagacagcgacgaagcgctcctccaagcagtgaggatcatcaaaatcctatatcaaagcagtaagta

SEQ ID NO: 182876 - DNA, 75 bp, Artificial Sequence
  Synthetic
taggagcattgatagtagcactaatcatagcaatagttgtgtggaccatagtatatatagaatataggaaattgg

SEQ ID NO: 182877 - DNA, 75 bp, Artificial Sequence
  Synthetic
gctaaaggttggttttatagacatcactatgaaagcaggcatccaaaagtaagttcagaagtacacatcccaata

SEQ ID NO: 182878 - DNA, 75 bp, Artificial Sequence
  Synthetic
gtctcatgattatatttggggtaacatgacctggatgcagtgggatagagaaatcagtaactacacagacataat

SEQ ID NO: 182879 - DNA, 75 bp, Artificial Sequence
  Synthetic
cttagaagaaatgatgatagcctgtcaaggagtaggagggccaacacataaggccaaaatactagcagaagcaat

SEQ ID NO: 182880 - DNA, 75 bp, Artificial Sequence
  Synthetic
gcagttataatacctacaatgggagcgtggaggaaataaaaaattgctctttcaatgcaaccccagaagtaagag

SEQ ID NO: 182881 - DNA, 75 bp, Artificial Sequence
  Synthetic
aacctcagaaataagagataagaaaaagaaagtgtatgcacttttttataaacttgatatagtaccacttgagga

SEQ ID NO: 182882 - DNA, 75 bp, Artificial Sequence
  Synthetic
ggagaagagtcagggatggatccggtagatcctagcctagagccctggaaccatccgggaagtcagcctaaaact

SEQ ID NO: 182883 - DNA, 75 bp, Artificial Sequence
  Synthetic
aagagaaattgacaattacacaggtttaatatacaacttaattgaagaatcgcaaatccagcaagaaaagaatga

SEQ ID NO: 182884 - DNA, 75 bp, Artificial Sequence
  Synthetic
atccctctttgggacagaccagtagtcacagcaagggttgggggccatctatgtgaagttttactggatacaggg

SEQ ID NO: 182885 - DNA, 75 bp, Artificial Sequence
  Synthetic
gcagatgatacagtactaaacaacatacaattggaaggaaaatggacaccaaaaatgatagggggtataggaggc

SEQ ID NO: 182886 - DNA, 75 bp, Artificial Sequence
  Synthetic
ttaagacaaaggaaaatagacaggctaattaagagaatagcagaaagagcagaagacagtggcaatgaaagtgaa

SEQ ID NO: 182887 - DNA, 75 bp, Artificial Sequence
  Synthetic
atgcatacagatataatcagtctatgggaccaaagcctaaaaccatgtgtacagttaacccctctctgcgttact

SEQ ID NO: 182888 - DNA, 75 bp, Artificial Sequence
  Synthetic
catttcagaattgggtgtcgacatagcagaataggcattattcgacagaggagagcaagaaatggagccagtaga

SEQ ID NO: 182889 - DNA, 75 bp, Artificial Sequence
  Synthetic
gagagcaagaaatggagccagtagatcctagactagagccctggaagcatccaggaagtcagcctaagactgctt

SEQ ID NO: 182890 - DNA, 75 bp, Artificial Sequence
  Synthetic
taatatgaccacagaactaagagataagcagcagaaggtccatgcacttttttataggcttgatatagtaccaat

SEQ ID NO: 182891 - DNA, 75 bp, Artificial Sequence
  Synthetic
aaatgaaaaactgctctttcaatgtcaccacaagcaaaagaaataagatgaataaagaatatgcacttttttata

SEQ ID NO: 182892 - DNA, 75 bp, Artificial Sequence
  Synthetic
actgctctttcaatataaccacagaaataagagataaaaagaagcaagaatacgcgcttttctataaacttgata

SEQ ID NO: 182893 - DNA, 75 bp, Artificial Sequence
  Synthetic
ataaattgtaatgtctcaaccattaagcaggcttgtccaaaggtgtcatttgaaccaattcccatacattattgt

SEQ ID NO: 182894 - DNA, 75 bp, Artificial Sequence
  Synthetic
acagtacaatgtacacatggaattaagccagtgatatcaactcaattgctgctaaacggcagtgtggcagaaaag

SEQ ID NO: 182895 - DNA, 75 bp, Artificial Sequence
  Synthetic
ataccaggaaaagtatacatctaggatgggggagaacattgtatgcaacaggagatataataggagacccaagac

SEQ ID NO: 182896 - DNA, 75 bp, Artificial Sequence
  Synthetic
agaaattacaacacatagttttaattgtggaggagaatttttctattgtaatacatcaggcctgtttaatagtac

SEQ ID NO: 182897 - DNA, 75 bp, Artificial Sequence
  Synthetic
tcctatagtacaaaacctacaggggcaaatggtacaccaggccatatcacctagaactttgaacgcatgggtaaa

SEQ ID NO: 182898 - DNA, 75 bp, Artificial Sequence
  Synthetic
ctttaacccatccgcaggaggggacttagaaattacaacacatagttttaattgtagaggagaatttttttattg

SEQ ID NO: 182899 - DNA, 75 bp, Artificial Sequence
  Synthetic
gcagaataaagcaaattataaatatgtggcagagagtaggacaagcaatatatgcccctcccatccaaggagtaa

SEQ ID NO: 182900 - DNA, 75 bp, Artificial Sequence
  Synthetic
gtggcagagagtaggacaagcaatatatgcccctcccatccaaggagtaataaggtgtgtatcaaacattacagg

SEQ ID NO: 182901 - DNA, 75 bp, Artificial Sequence
  Synthetic
tatgcccctcccatccaaggagtaataaggtgtgtatcaaacattacaggactaatattaacaagagatggtggg

SEQ ID NO: 182902 - DNA, 75 bp, Artificial Sequence
  Synthetic
gctttgcaataaaatggggggcaagtggtcaaaatgcagcatagtaggatggcctgctataagagagagaatgag

SEQ ID NO: 182903 - DNA, 75 bp, Artificial Sequence
  Synthetic
aaagaatgaacaagaattattggaattggataagtgggcaagtttgtggaattggtttagcatatcaaattggct

SEQ ID NO: 182904 - DNA, 75 bp, Artificial Sequence
  Synthetic
ccagtcagacctcaggtgcctttaagaccaatgacttataaggcagcattcgatctcagcttctttttaaaagaa

SEQ ID NO: 182905 - DNA, 75 bp, Artificial Sequence
  Synthetic
acagctcctagggatttggggctgctctggaaggctcatctgcaccactaatgtgccctggaatactagttggag

SEQ ID NO: 182906 - DNA, 75 bp, Artificial Sequence
  Synthetic
aggtcagtcaaaattatcctatagtgcagaatctccaagggcaaatggtacaccaggccatatcacctagaactt

SEQ ID NO: 182907 - DNA, 75 bp, Artificial Sequence
  Synthetic
ggagaaggcttttagcccagaggtaatacccatgtttacagcattatcagaaggggccaccccacaagatttaaa

SEQ ID NO: 182908 - DNA, 75 bp, Artificial Sequence
  Synthetic
acttatctgggacgacctacggagcctgtgcctcttcagctaccaccgcttgagagacttactcttgattgcagc

SEQ ID NO: 182909 - DNA, 75 bp, Artificial Sequence
  Synthetic
ttatcagtaatacaggtaatgttacggaagaaataaaaaattgctcttttgatataaccacagaaataagagata

SEQ ID NO: 182910 - DNA, 75 bp, Artificial Sequence
  Synthetic
tacctcagccataaaacaagcctgtccaaaggtcacttttgacccaattcctatacattattgtgctccagctgg

SEQ ID NO: 182911 - DNA, 75 bp, Artificial Sequence
  Synthetic
gatggaacaatacaatttcaaccatcctcgggaggggatctagaaattacaacacacacctttaattgtatggga

SEQ ID NO: 182912 - DNA, 75 bp, Artificial Sequence
  Synthetic
ggcccgaaggaatcgaagaagaaggtggagagagagacagagacagatccattcgcttagtagatggattcttag

SEQ ID NO: 182913 - DNA, 75 bp, Artificial Sequence
  Synthetic
taaaacaaattataaacatgtggcagggggtaggacgagcaatgtatgcccctcccattaaaggaaacataacat

SEQ ID NO: 182914 - DNA, 75 bp, Artificial Sequence
  Synthetic
tctaggaaaaccaaggactggttttacagacatcattatgagtctagaaatccaagagttagttcaggtgtatat

SEQ ID NO: 182915 - DNA, 75 bp, Artificial Sequence
  Synthetic
ttgctgagagctatagaggcgcaacagcatatgttgcaactcacagtctggggcattaagcagctccaggcaaga

SEQ ID NO: 182916 - DNA, 75 bp, Artificial Sequence
  Synthetic
gtaggctttccagtcagaccacaggtacctctgagaccaatgacttttaagggtgcttttgatctcggcttcttt

SEQ ID NO: 182917 - DNA, 75 bp, Artificial Sequence
  Synthetic
tgaccctgaaacagcagacaggatgatacatctgtattatttcacctgttttacagagtcagcaatcaggaaagc

SEQ ID NO: 182918 - DNA, 75 bp, Artificial Sequence
  Synthetic
gtctgcccacaccaatgatataaaacaactaacagaagcagtgcaaaagataagtacagaaagcataataataca

SEQ ID NO: 182919 - DNA, 75 bp, Artificial Sequence
  Synthetic
atgggcactagagctcctggaagaactgaaagcagaagcagtgagacatttccctaggaattggttacaagacct

SEQ ID NO: 182920 - DNA, 75 bp, Artificial Sequence
  Synthetic
caggcagcagctgacacaggaagtagcagcaaggtcagccaaaattaccctatagtgcaaaatgcacaagggcaa

SEQ ID NO: 182921 - DNA, 75 bp, Artificial Sequence
  Synthetic
acagaagaagcagaattagaactggcagaaaacagggaaattctaaaagaaccagtacatggagtgtattatgac

SEQ ID NO: 182922 - DNA, 75 bp, Artificial Sequence
  Synthetic
aagaagaaatggatccagtagatcctgaggtgcccccttggcaccaccctggaagtcagccccagaccccttgta

SEQ ID NO: 182923 - DNA, 75 bp, Artificial Sequence
  Synthetic
ctcaggtacctttaagaccaatgacttacaaagcagctttagatcttagccactttttaaaagaaaaggggggac

SEQ ID NO: 182924 - DNA, 75 bp, Artificial Sequence
  Synthetic
cttataaatgtaattgtatggatgtttaatcttagaaaatatctagaacaaaagaaacaagagagaagggaaaga

SEQ ID NO: 182925 - DNA, 75 bp, Artificial Sequence
  Synthetic
cttataaatgtatttgtatggatgtttaatcttagaaaatatctagaacaaaagaaacaagagagaagggaaaga

SEQ ID NO: 182926 - DNA, 75 bp, Artificial Sequence
  Synthetic
cttataaatgtacttgtatggatgtttaatcttagaaaatatctagaacaaaagaaacaagagagaagggaaaga

SEQ ID NO: 182927 - DNA, 75 bp, Artificial Sequence
  Synthetic
cttataaatgtagttgtatggatgtttaatcttagaaaatatctagaacaaaagaaacaagagagaagggaaaga

SEQ ID NO: 182928 - DNA, 75 bp, Artificial Sequence
  Synthetic
gcacaagcctgcgttcccacagaccccactccacatgaatatccattatccaatgtgacagataacttcaatata

SEQ ID NO: 182929 - DNA, 75 bp, Artificial Sequence
  Synthetic
gccttttagaaacatcagaaggttgtaaacaaataatgagacagctacaaccagctcttcagacaggaacagagg

SEQ ID NO: 182930 - DNA, 75 bp, Artificial Sequence
  Synthetic
tgaattgcacagatgttactcatactaataatgtaaccatctcgcaggctgtaaccagccccgtaaaaaagtgtg

SEQ ID NO: 182931 - DNA, 75 bp, Artificial Sequence
  Synthetic
aacaatgtatacattaattaactgtaactccacaaccatcaagcaagcctgtccaaaagtaacttttgaacctat

SEQ ID NO: 182932 - DNA, 75 bp, Artificial Sequence
  Synthetic
tgtacacatggcatcaagccagcagtaagtactcaactaatactaaatgggacactctctaaaggaaaaataaga

SEQ ID NO: 182933 - DNA, 75 bp, Artificial Sequence
  Synthetic
taagtactcaactaatactaaatgggacactctctaaaggaaaaataagaattatgggaaaaaatatttcagaca

SEQ ID NO: 182934 - DNA, 75 bp, Artificial Sequence
  Synthetic
ttggtacagtatgtcagtagaaaacaacataacatcaagggaagcttattgcacatataatgtcagtaaatgggc

SEQ ID NO: 182935 - DNA, 75 bp, Artificial Sequence
  Synthetic
agacagtactaaatggagaaaattagtagatttcagagagctcaataaaagaactcaagacttctgggaggtcca

SEQ ID NO: 182936 - DNA, 75 bp, Artificial Sequence
  Synthetic
accaatttacatttcaattgtcatggagaattcttttattgtaacacaacggggttgtttaattatacctttctg

SEQ ID NO: 182937 - DNA, 75 bp, Artificial Sequence
  Synthetic
accccactctgtgtccctttaaaatgtaaaaatgttacctacaatgagagtatgcaggaaataaaaaattgctct

SEQ ID NO: 182938 - DNA, 75 bp, Artificial Sequence
  Synthetic
gtggtaaggtcatggatgaagacagggtcgggactctatgcacctcccatcgaaggtaacctaacatgtaggtca

SEQ ID NO: 182939 - DNA, 75 bp, Artificial Sequence
  Synthetic
tatggagaactgaattgttcaactacaaagtagtaagggtaaaaccttttagtgtggcacctacaaaaattgcaa

SEQ ID NO: 182940 - DNA, 75 bp, Artificial Sequence
  Synthetic
aaaacaataatagtacatcttaatcaatctgtagaaattgtgtgtacaagacccaacaataatacaagaaaaagt

SEQ ID NO: 182941 - DNA, 75 bp, Artificial Sequence
  Synthetic
taccaaagcagtaagtaatatatgtaatgcaacctttagtgatattagcaatagtagcattagtagtagcgctaa

SEQ ID NO: 182942 - DNA, 75 bp, Artificial Sequence
  Synthetic
cttagaaacctttatacggaatcagcaattcctaaacctgtggggctgtaagggacaattagtctgctacacatc

SEQ ID NO: 182943 - DNA, 75 bp, Artificial Sequence
  Synthetic
agaaggcaaagaaaaatagacaggttaattgatagaataatagaaagagcagaagatagtggcaatgagagtgag

SEQ ID NO: 182944 - DNA, 75 bp, Artificial Sequence
  Synthetic
tggtaataacaacatattggggtctgcagacaggagaaagagactggcatttgggtcagggagtctccatagaat

SEQ ID NO: 182945 - DNA, 75 bp, Artificial Sequence
  Synthetic
accctcaggaggggatctagaaattacaacacatagctttaattgtagaggagaatttttctattgcaatacatc

SEQ ID NO: 182946 - DNA, 75 bp, Artificial Sequence
  Synthetic
tcaactcaattgctgttaaatggcagtctagcagaagaagagataataatcagatctgaaaatctcacaaacaat

SEQ ID NO: 182947 - DNA, 75 bp, Artificial Sequence
  Synthetic
aacaacagtactcacaacagcctgctggaggaggagcaggggataataaactgctgttttttcatgatgaccaca

SEQ ID NO: 182948 - DNA, 75 bp, Artificial Sequence
  Synthetic
cttgccactgttgtacacggacctcaggacaataatcttgtggagttaccacctcttgagcaacttagcatcagg

SEQ ID NO: 182949 - DNA, 75 bp, Artificial Sequence
  Synthetic
acctcttgagcaacttagcatcagggatccagaggttgatcagccatctgggacttggactgtggatcctagggc

SEQ ID NO: 182950 - DNA, 75 bp, Artificial Sequence
  Synthetic
ccaagtttgctttatacaaaaaggcttaggcatctcctatggcaggaagaagcggagacaacgacgaagatctcc

SEQ ID NO: 182951 - DNA, 75 bp, Artificial Sequence
  Synthetic
acaaaaaattgtccccctaactgatacaacaaatcagaagactgagctacaagcaatttatctagccttgcagga

SEQ ID NO: 182952 - DNA, 75 bp, Artificial Sequence
  Synthetic
ggaaaatctggccttcccacaagggaaggccagggaatttccttcagagcagaccagagccaacagccccaccag

SEQ ID NO: 182953 - DNA, 75 bp, Artificial Sequence
  Synthetic
ggtagttgccaattggactgacggcatcattttaggactacaacgcataggaagaggaattcttaacatcccaac

SEQ ID NO: 182954 - DNA, 75 bp, Artificial Sequence
  Synthetic
atgtaatgcaacctttagaaatatcagcaatagcagcattagtaatagcagcaataatagcaatagttgtgtgga

SEQ ID NO: 182955 - DNA, 75 bp, Artificial Sequence
  Synthetic
aaaagctcccagtagtgatcctgagccatgtgcacctggagtaggagaactctccagagaattagcagctagagg

SEQ ID NO: 182956 - DNA, 75 bp, Artificial Sequence
  Synthetic
gattaggagtaggagcattgatagtagcactaatcatagcaatagttgtgtggaccatagtatatatagaatata

SEQ ID NO: 182957 - DNA, 75 bp, Artificial Sequence
  Synthetic
agcactaatcatagcaatagttgtgtggaccatagtatatatagaatataggaaattgttaagacaaagaaaaat

SEQ ID NO: 182958 - DNA, 75 bp, Artificial Sequence
  Synthetic
tgctgattgtgcttggctgagagcgcaagaggaggaagaagaagtaggctttccagtcacacctcaggtgccttt

SEQ ID NO: 182959 - DNA, 75 bp, Artificial Sequence
  Synthetic
tgcatacaggagaaagagactggcatttgggtcagggagtctccatagaatggaggaaaaagagatatagcacac

SEQ ID NO: 182960 - DNA, 75 bp, Artificial Sequence
  Synthetic
tcaaggagagctaaaggatggttttacagacatcattatgaaaccagacatccaaaagtaagttcagaagtacac

SEQ ID NO: 182961 - DNA, 75 bp, Artificial Sequence
  Synthetic
aggggggcaggaagtctgcgggtgccgctaaggaagacacaagcgcaaggcagacgggtcaaaattaccctgtag

SEQ ID NO: 182962 - DNA, 75 bp, Artificial Sequence
  Synthetic
gctgccagaaaaagacagctggactgtcaatgacatacagaagttagtgggaaaattgaattgggcaagtcagat

SEQ ID NO: 182963 - DNA, 75 bp, Artificial Sequence
  Synthetic
acatcaggccctctcccccaggactttaaatgcatgggtaaaggcagtagaagaaaaggcctttaaccctgaaat

SEQ ID NO: 182964 - DNA, 75 bp, Artificial Sequence
  Synthetic
aaggaagtaatcaatgaagaagcagcagaatgggatagaactcacccaatagcggtagggccattgccaccggga

SEQ ID NO: 182965 - DNA, 75 bp, Artificial Sequence
  Synthetic
gaataggaccaagatacgcattctatgcaaaagaaactataataggagacataagacaagcacattgtaacatta

SEQ ID NO: 182966 - DNA, 75 bp, Artificial Sequence
  Synthetic
ctgtgcagtagtaggactggtagtagcgctaatcatagcaatagttgtgtggactatagtaggtatagaatataa

SEQ ID NO: 182967 - DNA, 75 bp, Artificial Sequence
  Synthetic
taacatacctagaagaataagacagggcttggaaagggctttgctataaaatgggtaacaagtggtcaaaaagta

SEQ ID NO: 182968 - DNA, 75 bp, Artificial Sequence
  Synthetic
gttaaggcagcctgttggtgggcaggtatccaacaggaatttggaattccctacaatccccaaagtcagggagta

SEQ ID NO: 182969 - DNA, 75 bp, Artificial Sequence
  Synthetic
taccacagcaatagtagtagctgagggaacagatagggttatagaaatagtacaaagagctgttagagctattct

SEQ ID NO: 182970 - DNA, 75 bp, Artificial Sequence
  Synthetic
aataatcctgacttggcctggctggaagcacaagaggaagaggaagtaggctttccagtcagacctcaggtacct

SEQ ID NO: 182971 - DNA, 75 bp, Artificial Sequence
  Synthetic
tccttcagaacaggacagagccaacatccccgccagcagagagctttggattcggagaggagataaccccctctc

SEQ ID NO: 182972 - DNA, 75 bp, Artificial Sequence
  Synthetic
tccttcagaacaggacagagccaacatccccgccagcagagagctttggattcggagaggagatatccccctctc

SEQ ID NO: 182973 - DNA, 75 bp, Artificial Sequence
  Synthetic
tccttcagaacaggacagagccaacatccccgccagcagagagctttggattcggagaggagatacccccctctc

SEQ ID NO: 182974 - DNA, 75 bp, Artificial Sequence
  Synthetic
tccttcagaacaggacagagccaacatccccgccagcagagagctttggattcggagaggagatagccccctctc

SEQ ID NO: 182975 - DNA, 75 bp, Artificial Sequence
  Synthetic
tccttcagaacaggacagagccaacatccccgccagcagagagctttggattcggagaggtgataaccccctctc

SEQ ID NO: 182976 - DNA, 75 bp, Artificial Sequence
  Synthetic
tccttcagaacaggacagagccaacatccccgccagcagagagctttggattcggagaggtgatatccccctctc

SEQ ID NO: 182977 - DNA, 75 bp, Artificial Sequence
  Synthetic
tccttcagaacaggacagagccaacatccccgccagcagagagctttggattcggagaggtgatacccccctctc

SEQ ID NO: 182978 - DNA, 75 bp, Artificial Sequence
  Synthetic
tccttcagaacaggacagagccaacatccccgccagcagagagctttggattcggagaggtgatagccccctctc

SEQ ID NO: 182979 - DNA, 75 bp, Artificial Sequence
  Synthetic
tccttcagaacaggacagagccaacatccccgccagcagagagctttggattcggagaggcgataaccccctctc

SEQ ID NO: 182980 - DNA, 75 bp, Artificial Sequence
  Synthetic
tccttcagaacaggacagagccaacatccccgccagcagagagctttggattcggagaggcgatatccccctctc

SEQ ID NO: 182981 - DNA, 75 bp, Artificial Sequence
  Synthetic
tccttcagaacaggacagagccaacatccccgccagcagagagctttggattcggagaggcgatacccccctctc

SEQ ID NO: 182982 - DNA, 75 bp, Artificial Sequence
  Synthetic
tccttcagaacaggacagagccaacatccccgccagcagagagctttggattcggagaggcgatagccccctctc

SEQ ID NO: 182983 - DNA, 75 bp, Artificial Sequence
  Synthetic
tccttcagaacaggacagagccaacatccccgccagcagagagctttggattcggagaggggataaccccctctc

SEQ ID NO: 182984 - DNA, 75 bp, Artificial Sequence
  Synthetic
tccttcagaacaggacagagccaacatccccgccagcagagagctttggattcggagaggggatatccccctctc

SEQ ID NO: 182985 - DNA, 75 bp, Artificial Sequence
  Synthetic
tccttcagaacaggacagagccaacatccccgccagcagagagctttggattcggagaggggatacccccctctc

SEQ ID NO: 182986 - DNA, 75 bp, Artificial Sequence
  Synthetic
tccttcagaacaggacagagccaacatccccgccagcagagagctttggattcggagaggggatagccccctctc

SEQ ID NO: 182987 - DNA, 75 bp, Artificial Sequence
  Synthetic
tccttcagaacaggacagagccaacatccccgccagcagagagctttggtttcggagaggagataaccccctctc

SEQ ID NO: 182988 - DNA, 75 bp, Artificial Sequence
  Synthetic
tccttcagaacaggacagagccaacatccccgccagcagagagctttggtttcggagaggagatatccccctctc

SEQ ID NO: 182989 - DNA, 75 bp, Artificial Sequence
  Synthetic
tccttcagaacaggacagagccaacatccccgccagcagagagctttggtttcggagaggagatacccccctctc

SEQ ID NO: 182990 - DNA, 75 bp, Artificial Sequence
  Synthetic
tccttcagaacaggacagagccaacatccccgccagcagagagctttggtttcggagaggagatagccccctctc

SEQ ID NO: 182991 - DNA, 75 bp, Artificial Sequence
  Synthetic
tccttcagaacaggacagagccaacatccccgccagcagagagctttggtttcggagaggtgataaccccctctc

SEQ ID NO: 182992 - DNA, 75 bp, Artificial Sequence
  Synthetic
tccttcagaacaggacagagccaacatccccgccagcagagagctttggtttcggagaggtgatatccccctctc

SEQ ID NO: 182993 - DNA, 75 bp, Artificial Sequence
  Synthetic
tccttcagaacaggacagagccaacatccccgccagcagagagctttggtttcggagaggtgatacccccctctc

SEQ ID NO: 182994 - DNA, 75 bp, Artificial Sequence
  Synthetic
tccttcagaacaggacagagccaacatccccgccagcagagagctttggtttcggagaggtgatagccccctctc

SEQ ID NO: 182995 - DNA, 75 bp, Artificial Sequence
  Synthetic
tccttcagaacaggacagagccaacatccccgccagcagagagctttggtttcggagaggcgataaccccctctc

SEQ ID NO: 182996 - DNA, 75 bp, Artificial Sequence
  Synthetic
tccttcagaacaggacagagccaacatccccgccagcagagagctttggtttcggagaggcgatatccccctctc

SEQ ID NO: 182997 - DNA, 75 bp, Artificial Sequence
  Synthetic
tccttcagaacaggacagagccaacatccccgccagcagagagctttggtttcggagaggcgatacccccctctc

SEQ ID NO: 182998 - DNA, 75 bp, Artificial Sequence
  Synthetic
tccttcagaacaggacagagccaacatccccgccagcagagagctttggtttcggagaggcgatagccccctctc

SEQ ID NO: 182999 - DNA, 75 bp, Artificial Sequence
  Synthetic
tccttcagaacaggacagagccaacatccccgccagcagagagctttggtttcggagaggggataaccccctctc

SEQ ID NO: 183000 - DNA, 75 bp, Artificial Sequence
  Synthetic
tccttcagaacaggacagagccaacatccccgccagcagagagctttggtttcggagaggggatatccccctctc

SEQ ID NO: 183001 - DNA, 75 bp, Artificial Sequence
  Synthetic
tccttcagaacaggacagagccaacatccccgccagcagagagctttggtttcggagaggggatacccccctctc

SEQ ID NO: 183002 - DNA, 75 bp, Artificial Sequence
  Synthetic
tccttcagaacaggacagagccaacatccccgccagcagagagctttggtttcggagaggggatagccccctctc

SEQ ID NO: 183003 - DNA, 75 bp, Artificial Sequence
  Synthetic
tccttcagaacaggacagagccaacatccccgccagcagagagctttggcttcggagaggagataaccccctctc

SEQ ID NO: 183004 - DNA, 75 bp, Artificial Sequence
  Synthetic
tccttcagaacaggacagagccaacatccccgccagcagagagctttggcttcggagaggagatatccccctctc

SEQ ID NO: 183005 - DNA, 75 bp, Artificial Sequence
  Synthetic
tccttcagaacaggacagagccaacatccccgccagcagagagctttggcttcggagaggagatacccccctctc

SEQ ID NO: 183006 - DNA, 75 bp, Artificial Sequence
  Synthetic
tccttcagaacaggacagagccaacatccccgccagcagagagctttggcttcggagaggagatagccccctctc

SEQ ID NO: 183007 - DNA, 75 bp, Artificial Sequence
  Synthetic
tccttcagaacaggacagagccaacatccccgccagcagagagctttggcttcggagaggtgataaccccctctc

SEQ ID NO: 183008 - DNA, 75 bp, Artificial Sequence
  Synthetic
tccttcagaacaggacagagccaacatccccgccagcagagagctttggcttcggagaggtgatatccccctctc

SEQ ID NO: 183009 - DNA, 75 bp, Artificial Sequence
  Synthetic
tccttcagaacaggacagagccaacatccccgccagcagagagctttggcttcggagaggtgatacccccctctc

SEQ ID NO: 183010 - DNA, 75 bp, Artificial Sequence
  Synthetic
tccttcagaacaggacagagccaacatccccgccagcagagagctttggcttcggagaggtgatagccccctctc

SEQ ID NO: 183011 - DNA, 75 bp, Artificial Sequence
  Synthetic
tccttcagaacaggacagagccaacatccccgccagcagagagctttggcttcggagaggcgataaccccctctc

SEQ ID NO: 183012 - DNA, 75 bp, Artificial Sequence
  Synthetic
tccttcagaacaggacagagccaacatccccgccagcagagagctttggcttcggagaggcgatatccccctctc

SEQ ID NO: 183013 - DNA, 75 bp, Artificial Sequence
  Synthetic
tccttcagaacaggacagagccaacatccccgccagcagagagctttggcttcggagaggcgatacccccctctc

SEQ ID NO: 183014 - DNA, 75 bp, Artificial Sequence
  Synthetic
tccttcagaacaggacagagccaacatccccgccagcagagagctttggcttcggagaggcgatagccccctctc

SEQ ID NO: 183015 - DNA, 75 bp, Artificial Sequence
  Synthetic
tccttcagaacaggacagagccaacatccccgccagcagagagctttggcttcggagaggggataaccccctctc

SEQ ID NO: 183016 - DNA, 75 bp, Artificial Sequence
  Synthetic
tccttcagaacaggacagagccaacatccccgccagcagagagctttggcttcggagaggggatatccccctctc

SEQ ID NO: 183017 - DNA, 75 bp, Artificial Sequence
  Synthetic
tccttcagaacaggacagagccaacatccccgccagcagagagctttggcttcggagaggggatacccccctctc

SEQ ID NO: 183018 - DNA, 75 bp, Artificial Sequence
  Synthetic
tccttcagaacaggacagagccaacatccccgccagcagagagctttggcttcggagaggggatagccccctctc

SEQ ID NO: 183019 - DNA, 75 bp, Artificial Sequence
  Synthetic
tccttcagaacaggacagagccaacatccccgccagcagagagctttgggttcggagaggagataaccccctctc

SEQ ID NO: 183020 - DNA, 75 bp, Artificial Sequence
  Synthetic
tccttcagaacaggacagagccaacatccccgccagcagagagctttgggttcggagaggagatatccccctctc

SEQ ID NO: 183021 - DNA, 75 bp, Artificial Sequence
  Synthetic
tccttcagaacaggacagagccaacatccccgccagcagagagctttgggttcggagaggagatacccccctctc

SEQ ID NO: 183022 - DNA, 75 bp, Artificial Sequence
  Synthetic
tccttcagaacaggacagagccaacatccccgccagcagagagctttgggttcggagaggagatagccccctctc

SEQ ID NO: 183023 - DNA, 75 bp, Artificial Sequence
  Synthetic
tccttcagaacaggacagagccaacatccccgccagcagagagctttgggttcggagaggtgataaccccctctc

SEQ ID NO: 183024 - DNA, 75 bp, Artificial Sequence
  Synthetic
tccttcagaacaggacagagccaacatccccgccagcagagagctttgggttcggagaggtgatatccccctctc

SEQ ID NO: 183025 - DNA, 75 bp, Artificial Sequence
  Synthetic
tccttcagaacaggacagagccaacatccccgccagcagagagctttgggttcggagaggtgatacccccctctc

SEQ ID NO: 183026 - DNA, 75 bp, Artificial Sequence
  Synthetic
tccttcagaacaggacagagccaacatccccgccagcagagagctttgggttcggagaggtgatagccccctctc

SEQ ID NO: 183027 - DNA, 75 bp, Artificial Sequence
  Synthetic
tccttcagaacaggacagagccaacatccccgccagcagagagctttgggttcggagaggcgataaccccctctc

SEQ ID NO: 183028 - DNA, 75 bp, Artificial Sequence
  Synthetic
tccttcagaacaggacagagccaacatccccgccagcagagagctttgggttcggagaggcgatatccccctctc

SEQ ID NO: 183029 - DNA, 75 bp, Artificial Sequence
  Synthetic
tccttcagaacaggacagagccaacatccccgccagcagagagctttgggttcggagaggcgatacccccctctc

SEQ ID NO: 183030 - DNA, 75 bp, Artificial Sequence
  Synthetic
tccttcagaacaggacagagccaacatccccgccagcagagagctttgggttcggagaggcgatagccccctctc

SEQ ID NO: 183031 - DNA, 75 bp, Artificial Sequence
  Synthetic
tccttcagaacaggacagagccaacatccccgccagcagagagctttgggttcggagaggggataaccccctctc

SEQ ID NO: 183032 - DNA, 75 bp, Artificial Sequence
  Synthetic
tccttcagaacaggacagagccaacatccccgccagcagagagctttgggttcggagaggggatatccccctctc

SEQ ID NO: 183033 - DNA, 75 bp, Artificial Sequence
  Synthetic
tccttcagaacaggacagagccaacatccccgccagcagagagctttgggttcggagaggggatacccccctctc

SEQ ID NO: 183034 - DNA, 75 bp, Artificial Sequence
  Synthetic
tccttcagaacaggacagagccaacatccccgccagcagagagctttgggttcggagaggggatagccccctctc

SEQ ID NO: 183035 - DNA, 75 bp, Artificial Sequence
  Synthetic
atgatactaataccaataatagtagtggggaaaagatggagaaaggagaaataaaaaattgctctttcaatatca

SEQ ID NO: 183036 - DNA, 75 bp, Artificial Sequence
  Synthetic
gatgggtgcgagagcgtcagtattacgcgggggacaattagatgaatgggaaagcattcggttaagaagaggggg

SEQ ID NO: 183037 - DNA, 75 bp, Artificial Sequence
  Synthetic
acccctctctgtgtcactttaacctgtactaatgtaactattaatgtaaccagcagtagcaacagtagtgtaacc

SEQ ID NO: 183038 - DNA, 75 bp, Artificial Sequence
  Synthetic
ctttcaatacaaccacagaaataagagataagaaacagaacgtgtatgcacttttttatagatctgatgtagtac

SEQ ID NO: 183039 - DNA, 75 bp, Artificial Sequence
  Synthetic
gataagttgtaacacctcagtcattacacaagcctgtccaaaggtaacctttgagccaattcccatacattattg

SEQ ID NO: 183040 - DNA, 75 bp, Artificial Sequence
  Synthetic
ttcttttaatatgaccacagaaataagagataagaagcagaaggtccatgcacttttttataagcttgatatagt

SEQ ID NO: 183041 - DNA, 75 bp, Artificial Sequence
  Synthetic
aaaactgctctttcaatataaccacagaaataaaagataggaggaagcaagaatacgcgcttttttataaacttg

SEQ ID NO: 183042 - DNA, 75 bp, Artificial Sequence
  Synthetic
gggttatagaagtagcacagagagcctggagagttattctccacatacctagaagaataagacagggcttggaaa

SEQ ID NO: 183043 - DNA, 75 bp, Artificial Sequence
  Synthetic
gggttatagaagtagcacagagagcctggtgagttattctccacatacctagaagaataagacagggcttggaaa

SEQ ID NO: 183044 - DNA, 75 bp, Artificial Sequence
  Synthetic
gggttatagaagtagcacagagagcctggcgagttattctccacatacctagaagaataagacagggcttggaaa

SEQ ID NO: 183045 - DNA, 75 bp, Artificial Sequence
  Synthetic
gggttatagaagtagcacagagagcctggggagttattctccacatacctagaagaataagacagggcttggaaa

SEQ ID NO: 183046 - DNA, 75 bp, Artificial Sequence
  Synthetic
gggttatagtagtagcacagagagcctggagagttattctccacatacctagaagaataagacagggcttggaaa

SEQ ID NO: 183047 - DNA, 75 bp, Artificial Sequence
  Synthetic
gggttatagtagtagcacagagagcctggtgagttattctccacatacctagaagaataagacagggcttggaaa

SEQ ID NO: 183048 - DNA, 75 bp, Artificial Sequence
  Synthetic
gggttatagtagtagcacagagagcctggcgagttattctccacatacctagaagaataagacagggcttggaaa

SEQ ID NO: 183049 - DNA, 75 bp, Artificial Sequence
  Synthetic
gggttatagtagtagcacagagagcctggggagttattctccacatacctagaagaataagacagggcttggaaa

SEQ ID NO: 183050 - DNA, 75 bp, Artificial Sequence
  Synthetic
gggttatagcagtagcacagagagcctggagagttattctccacatacctagaagaataagacagggcttggaaa

SEQ ID NO: 183051 - DNA, 75 bp, Artificial Sequence
  Synthetic
gggttatagcagtagcacagagagcctggtgagttattctccacatacctagaagaataagacagggcttggaaa

SEQ ID NO: 183052 - DNA, 75 bp, Artificial Sequence
  Synthetic
gggttatagcagtagcacagagagcctggcgagttattctccacatacctagaagaataagacagggcttggaaa

SEQ ID NO: 183053 - DNA, 75 bp, Artificial Sequence
  Synthetic
gggttatagcagtagcacagagagcctggggagttattctccacatacctagaagaataagacagggcttggaaa

SEQ ID NO: 183054 - DNA, 75 bp, Artificial Sequence
  Synthetic
gggttataggagtagcacagagagcctggagagttattctccacatacctagaagaataagacagggcttggaaa

SEQ ID NO: 183055 - DNA, 75 bp, Artificial Sequence
  Synthetic
gggttataggagtagcacagagagcctggtgagttattctccacatacctagaagaataagacagggcttggaaa

SEQ ID NO: 183056 - DNA, 75 bp, Artificial Sequence
  Synthetic
gggttataggagtagcacagagagcctggcgagttattctccacatacctagaagaataagacagggcttggaaa

SEQ ID NO: 183057 - DNA, 75 bp, Artificial Sequence
  Synthetic
gggttataggagtagcacagagagcctggggagttattctccacatacctagaagaataagacagggcttggaaa

SEQ ID NO: 183058 - DNA, 75 bp, Artificial Sequence
  Synthetic
gcaagcggcagctgacaaaggggtcagtcaaaattaccctatagtacagaatctccaggggcaaatggtacacca

SEQ ID NO: 183059 - DNA, 75 bp, Artificial Sequence
  Synthetic
aatgccacagataatgtcaatgtcacagccaaggaagacataatgaaaaactgctctttcaatatcaccacaggc

SEQ ID NO: 183060 - DNA, 75 bp, Artificial Sequence
  Synthetic
aattaattgtacaagacccagcaacaatacaagaaaaagtatacatataggaccagggagagcattttatacaac

SEQ ID NO: 183061 - DNA, 75 bp, Artificial Sequence
  Synthetic
gagatgcttatttctcatgtcctctagacccagatttcagaaaatatactgctttcactattcctagtgtgaaca

SEQ ID NO: 183062 - DNA, 75 bp, Artificial Sequence
  Synthetic
tataggaccaggacaaacattctatgcaacaggtgatataataggggatataagacaagcacattgtaatgtcag

SEQ ID NO: 183063 - DNA, 75 bp, Artificial Sequence
  Synthetic
atgagaccccaggagtaagataccagtacaatgtcctcccacaaggatggaaagggtcaccagctatattccaaa

SEQ ID NO: 183064 - DNA, 75 bp, Artificial Sequence
  Synthetic
atttaggaaggacaacccagaattagaaatatgtcagtacatggatgacctatatgtaggatcagatttaccctt

SEQ ID NO: 183065 - DNA, 75 bp, Artificial Sequence
  Synthetic
aattaaaagagcactttaataataagacaataatctttcaaccaccctcaggaggagatctagaaattacaatgc

SEQ ID NO: 183066 - DNA, 75 bp, Artificial Sequence
  Synthetic
taaaacagattataaacatgtggcagggggtaggacgagcaatgtatgcccctcccattgcaggaaacataacat

SEQ ID NO: 183067 - DNA, 75 bp, Artificial Sequence
  Synthetic
aaccttcagacctggaggaggagatatgagggataattggagaagtgaattatataagtataaggtagtaaaaat

SEQ ID NO: 183068 - DNA, 75 bp, Artificial Sequence
  Synthetic
aaagcaagagttttggctgaggcaatgagccaagcaacaaataatgtaaatgctgctataatgatgcagagaggc

SEQ ID NO: 183069 - DNA, 75 bp, Artificial Sequence
  Synthetic
attcagaagcaaggagaagggcagtggacttaccagatatatcaggatgaacataagaacctcaaaacagggaaa

SEQ ID NO: 183070 - DNA, 75 bp, Artificial Sequence
  Synthetic
tttcagaagcaaggagaagggcagtggacttaccagatatatcaggatgaacataagaacctcaaaacagggaaa

SEQ ID NO: 183071 - DNA, 75 bp, Artificial Sequence
  Synthetic
cttcagaagcaaggagaagggcagtggacttaccagatatatcaggatgaacataagaacctcaaaacagggaaa

SEQ ID NO: 183072 - DNA, 75 bp, Artificial Sequence
  Synthetic
gttcagaagcaaggagaagggcagtggacttaccagatatatcaggatgaacataagaacctcaaaacagggaaa

SEQ ID NO: 183073 - DNA, 75 bp, Artificial Sequence
  Synthetic
aggattccaaggaaaaagtaaatatagtaacagattcacaatatgtattgggcatcatctcctctcaacctacac

SEQ ID NO: 183074 - DNA, 75 bp, Artificial Sequence
  Synthetic
cctcaggaggggacctagaaattacaacacatagctttaattgtagaggagaatttttctattgcaatacatcaa

SEQ ID NO: 183075 - DNA, 75 bp, Artificial Sequence
  Synthetic
agaaggaaaaattatcctggtagcagtccatgtagccagtggctacatggaagcagaggttatcccagcagaaac

SEQ ID NO: 183076 - DNA, 75 bp, Artificial Sequence
  Synthetic
cggcgactggtgagtacgccatttattttgactagcggaggctagaaggagagagatgggtgcgagagcgtcagt

SEQ ID NO: 183077 - DNA, 75 bp, Artificial Sequence
  Synthetic
gctggtagagctattcgccacatacctacaagaataagacagggagcagaaagggctttgctataagatgggggg

SEQ ID NO: 183078 - DNA, 75 bp, Artificial Sequence
  Synthetic
agcagctggcacaggaagcagcagcaaagtcagccaaaattaccctatagtgcaaaatgcacaagggcaaatggt

SEQ ID NO: 183079 - DNA, 75 bp, Artificial Sequence
  Synthetic
tctaggaaggccaaagactggtactacagacatcactatgaatctagaaatccaagagtcagttcaggtgtatat

SEQ ID NO: 183080 - DNA, 75 bp, Artificial Sequence
  Synthetic
tctaggaaggccaaagactggtactacagacatcactatgattctagaaatccaagagtcagttcaggtgtatat

SEQ ID NO: 183081 - DNA, 75 bp, Artificial Sequence
  Synthetic
tctaggaaggccaaagactggtactacagacatcactatgactctagaaatccaagagtcagttcaggtgtatat

SEQ ID NO: 183082 - DNA, 75 bp, Artificial Sequence
  Synthetic
tctaggaaggccaaagactggtactacagacatcactatgagtctagaaatccaagagtcagttcaggtgtatat

SEQ ID NO: 183083 - DNA, 75 bp, Artificial Sequence
  Synthetic
tatcacactcccatgtagaataaaacaaattataaacatgtggcaggaagtaggaaaagcaatgtatgcccctcc

SEQ ID NO: 183084 - DNA, 75 bp, Artificial Sequence
  Synthetic
cagcaggagaaaaatgaaaaagatttactagcattggacagttggaacaatctgtggaattggtttagcataaca

SEQ ID NO: 183085 - DNA, 75 bp, Artificial Sequence
  Synthetic
tactagcattggacagttggaacaatctgtggaattggtttagcataacaaaatggctgtggtatataaaaatat

SEQ ID NO: 183086 - DNA, 75 bp, Artificial Sequence
  Synthetic
gtacaccaggccatatcacctagaactttaaatgcatgggtaaaagtagtagaagaaaaggccttcagtccagaa

SEQ ID NO: 183087 - DNA, 75 bp, Artificial Sequence
  Synthetic
tgccagcatagtagaataggaattaacccatctaacacaagaggaagaggaagaagaaatggatccagtagatcc

SEQ ID NO: 183088 - DNA, 75 bp, Artificial Sequence
  Synthetic
tagtttgctttcagaaaaaaggcttaggcatttcctatggcaggaagaagcgaggacagcgacgcaacgctcctc

SEQ ID NO: 183089 - DNA, 75 bp, Artificial Sequence
  Synthetic
tatgtaaactccttaggggaaccaaagcactaacagaagtagtaccactaacagaagaagcagaactagaactgg

SEQ ID NO: 183090 - DNA, 75 bp, Artificial Sequence
  Synthetic
agaagacagtggcaatgaaagtgaaggggatcaggaagaattatcagcacttgtggagatggggcaccatgctcc

SEQ ID NO: 183091 - DNA, 75 bp, Artificial Sequence
  Synthetic
gagttacaagcaattcatctagctttgcaggattcgggattagaagtaaacatagtaacagactcacaatatgca

SEQ ID NO: 183092 - DNA, 75 bp, Artificial Sequence
  Synthetic
tctgtgcttcagatgctaacctaacaagccctgagcaacataatatttgggcagcacaagcctgtgttcccacag

SEQ ID NO: 183093 - DNA, 75 bp, Artificial Sequence
  Synthetic
cgagctgaaccagcagcagagggggtgggaccagcatctcgagacctggaaagacatggggcactcacaagcagc

SEQ ID NO: 183094 - DNA, 75 bp, Artificial Sequence
  Synthetic
caaagcctaataccatgtgtaaaattaaccccactctgtgttactttaaattgcactaatttcaagaataatgct

SEQ ID NO: 183095 - DNA, 75 bp, Artificial Sequence
  Synthetic
taatgataccttgtatggagagataaaaaattgctctttcaatgtaaccacagaaataagagataagaaaaggaa

SEQ ID NO: 183096 - DNA, 75 bp, Artificial Sequence
  Synthetic
atgggagcagagtttaaaaccttgtgtgaaaatgactttcatgtgtgtacaaatggaatgtaatgacataaatac

SEQ ID NO: 183097 - DNA, 75 bp, Artificial Sequence
  Synthetic
agaaattacaacacatagttttaattgtgcaggagaatttttctattgtaatacatcaggcctgtttaatagtac

SEQ ID NO: 183098 - DNA, 75 bp, Artificial Sequence
  Synthetic
aagataaggtgcagagagaatctgcagttttttataaatctgaattagaaccaataggtaagaatacatattata

SEQ ID NO: 183099 - DNA, 75 bp, Artificial Sequence
  Synthetic
aacccatcaccagacatgaaacagtgtaattttaatgtaaccacagttatcaaagacaaaaaagagaaaaaacag

SEQ ID NO: 183100 - DNA, 75 bp, Artificial Sequence
  Synthetic
catgcagaataaagcaaattataaatatgtggcagagagtaggacaagcaatgtatgcccctcccatccaaggag

SEQ ID NO: 183101 - DNA, 75 bp, Artificial Sequence
  Synthetic
tatgtggcagagagtaggacaagcaatgtatgcccctcccatccaaggagtaataaagtgtgaatcaaacattac

SEQ ID NO: 183102 - DNA, 75 bp, Artificial Sequence
  Synthetic
tccaactggttttacgattctaaaatgtaataaaaaaaatttcactggaacacgcccatgtacaaaattcagtac

SEQ ID NO: 183103 - DNA, 75 bp, Artificial Sequence
  Synthetic
tccaactggttttacgattctaaattgtaataaaaaaaatttcactggaacacgcccatgtacaaaattcagtac

SEQ ID NO: 183104 - DNA, 75 bp, Artificial Sequence
  Synthetic
tccaactggttttacgattctaaactgtaataaaaaaaatttcactggaacacgcccatgtacaaaattcagtac

SEQ ID NO: 183105 - DNA, 75 bp, Artificial Sequence
  Synthetic
tccaactggttttacgattctaaagtgtaataaaaaaaatttcactggaacacgcccatgtacaaaattcagtac

SEQ ID NO: 183106 - DNA, 75 bp, Artificial Sequence
  Synthetic
tccaactggtttttcgattctaaaatgtaataaaaaaaatttcactggaacacgcccatgtacaaaattcagtac

SEQ ID NO: 183107 - DNA, 75 bp, Artificial Sequence
  Synthetic
tccaactggtttttcgattctaaattgtaataaaaaaaatttcactggaacacgcccatgtacaaaattcagtac

SEQ ID NO: 183108 - DNA, 75 bp, Artificial Sequence
  Synthetic
tccaactggtttttcgattctaaactgtaataaaaaaaatttcactggaacacgcccatgtacaaaattcagtac

SEQ ID NO: 183109 - DNA, 75 bp, Artificial Sequence
  Synthetic
tccaactggtttttcgattctaaagtgtaataaaaaaaatttcactggaacacgcccatgtacaaaattcagtac

SEQ ID NO: 183110 - DNA, 75 bp, Artificial Sequence
  Synthetic
tccaactggttttccgattctaaaatgtaataaaaaaaatttcactggaacacgcccatgtacaaaattcagtac

SEQ ID NO: 183111 - DNA, 75 bp, Artificial Sequence
  Synthetic
tccaactggttttccgattctaaattgtaataaaaaaaatttcactggaacacgcccatgtacaaaattcagtac

SEQ ID NO: 183112 - DNA, 75 bp, Artificial Sequence
  Synthetic
tccaactggttttccgattctaaactgtaataaaaaaaatttcactggaacacgcccatgtacaaaattcagtac

SEQ ID NO: 183113 - DNA, 75 bp, Artificial Sequence
  Synthetic
tccaactggttttccgattctaaagtgtaataaaaaaaatttcactggaacacgcccatgtacaaaattcagtac

SEQ ID NO: 183114 - DNA, 75 bp, Artificial Sequence
  Synthetic
tccaactggttttgcgattctaaaatgtaataaaaaaaatttcactggaacacgcccatgtacaaaattcagtac

SEQ ID NO: 183115 - DNA, 75 bp, Artificial Sequence
  Synthetic
tccaactggttttgcgattctaaattgtaataaaaaaaatttcactggaacacgcccatgtacaaaattcagtac

SEQ ID NO: 183116 - DNA, 75 bp, Artificial Sequence
  Synthetic
tccaactggttttgcgattctaaactgtaataaaaaaaatttcactggaacacgcccatgtacaaaattcagtac

SEQ ID NO: 183117 - DNA, 75 bp, Artificial Sequence
  Synthetic
tccaactggttttgcgattctaaagtgtaataaaaaaaatttcactggaacacgcccatgtacaaaattcagtac

SEQ ID NO: 183118 - DNA, 75 bp, Artificial Sequence
  Synthetic
tccatctggttttacgattctaaaatgtaataaaaaaaatttcactggaacacgcccatgtacaaaattcagtac

SEQ ID NO: 183119 - DNA, 75 bp, Artificial Sequence
  Synthetic
tccatctggttttacgattctaaattgtaataaaaaaaatttcactggaacacgcccatgtacaaaattcagtac

SEQ ID NO: 183120 - DNA, 75 bp, Artificial Sequence
  Synthetic
tccatctggttttacgattctaaactgtaataaaaaaaatttcactggaacacgcccatgtacaaaattcagtac

SEQ ID NO: 183121 - DNA, 75 bp, Artificial Sequence
  Synthetic
tccatctggttttacgattctaaagtgtaataaaaaaaatttcactggaacacgcccatgtacaaaattcagtac

SEQ ID NO: 183122 - DNA, 75 bp, Artificial Sequence
  Synthetic
tccatctggtttttcgattctaaaatgtaataaaaaaaatttcactggaacacgcccatgtacaaaattcagtac

SEQ ID NO: 183123 - DNA, 75 bp, Artificial Sequence
  Synthetic
tccatctggtttttcgattctaaattgtaataaaaaaaatttcactggaacacgcccatgtacaaaattcagtac

SEQ ID NO: 183124 - DNA, 75 bp, Artificial Sequence
  Synthetic
tccatctggtttttcgattctaaactgtaataaaaaaaatttcactggaacacgcccatgtacaaaattcagtac

SEQ ID NO: 183125 - DNA, 75 bp, Artificial Sequence
  Synthetic
tccatctggtttttcgattctaaagtgtaataaaaaaaatttcactggaacacgcccatgtacaaaattcagtac

SEQ ID NO: 183126 - DNA, 75 bp, Artificial Sequence
  Synthetic
tccatctggttttccgattctaaaatgtaataaaaaaaatttcactggaacacgcccatgtacaaaattcagtac

SEQ ID NO: 183127 - DNA, 75 bp, Artificial Sequence
  Synthetic
tccatctggttttccgattctaaattgtaataaaaaaaatttcactggaacacgcccatgtacaaaattcagtac

SEQ ID NO: 183128 - DNA, 75 bp, Artificial Sequence
  Synthetic
tccatctggttttccgattctaaactgtaataaaaaaaatttcactggaacacgcccatgtacaaaattcagtac

SEQ ID NO: 183129 - DNA, 75 bp, Artificial Sequence
  Synthetic
tccatctggttttccgattctaaagtgtaataaaaaaaatttcactggaacacgcccatgtacaaaattcagtac

SEQ ID NO: 183130 - DNA, 75 bp, Artificial Sequence
  Synthetic
tccatctggttttgcgattctaaaatgtaataaaaaaaatttcactggaacacgcccatgtacaaaattcagtac

SEQ ID NO: 183131 - DNA, 75 bp, Artificial Sequence
  Synthetic
tccatctggttttgcgattctaaattgtaataaaaaaaatttcactggaacacgcccatgtacaaaattcagtac

SEQ ID NO: 183132 - DNA, 75 bp, Artificial Sequence
  Synthetic
tccatctggttttgcgattctaaactgtaataaaaaaaatttcactggaacacgcccatgtacaaaattcagtac

SEQ ID NO: 183133 - DNA, 75 bp, Artificial Sequence
  Synthetic
tccatctggttttgcgattctaaagtgtaataaaaaaaatttcactggaacacgcccatgtacaaaattcagtac

SEQ ID NO: 183134 - DNA, 75 bp, Artificial Sequence
  Synthetic
tccacctggttttacgattctaaaatgtaataaaaaaaatttcactggaacacgcccatgtacaaaattcagtac

SEQ ID NO: 183135 - DNA, 75 bp, Artificial Sequence
  Synthetic
tccacctggttttacgattctaaattgtaataaaaaaaatttcactggaacacgcccatgtacaaaattcagtac

SEQ ID NO: 183136 - DNA, 75 bp, Artificial Sequence
  Synthetic
tccacctggttttacgattctaaactgtaataaaaaaaatttcactggaacacgcccatgtacaaaattcagtac

SEQ ID NO: 183137 - DNA, 75 bp, Artificial Sequence
  Synthetic
tccacctggttttacgattctaaagtgtaataaaaaaaatttcactggaacacgcccatgtacaaaattcagtac

SEQ ID NO: 183138 - DNA, 75 bp, Artificial Sequence
  Synthetic
tccacctggtttttcgattctaaaatgtaataaaaaaaatttcactggaacacgcccatgtacaaaattcagtac

SEQ ID NO: 183139 - DNA, 75 bp, Artificial Sequence
  Synthetic
tccacctggtttttcgattctaaattgtaataaaaaaaatttcactggaacacgcccatgtacaaaattcagtac

SEQ ID NO: 183140 - DNA, 75 bp, Artificial Sequence
  Synthetic
tccacctggtttttcgattctaaactgtaataaaaaaaatttcactggaacacgcccatgtacaaaattcagtac

SEQ ID NO: 183141 - DNA, 75 bp, Artificial Sequence
  Synthetic
tccacctggtttttcgattctaaagtgtaataaaaaaaatttcactggaacacgcccatgtacaaaattcagtac

SEQ ID NO: 183142 - DNA, 75 bp, Artificial Sequence
  Synthetic
tccacctggttttccgattctaaaatgtaataaaaaaaatttcactggaacacgcccatgtacaaaattcagtac

SEQ ID NO: 183143 - DNA, 75 bp, Artificial Sequence
  Synthetic
tccacctggttttccgattctaaattgtaataaaaaaaatttcactggaacacgcccatgtacaaaattcagtac

SEQ ID NO: 183144 - DNA, 75 bp, Artificial Sequence
  Synthetic
tccacctggttttccgattctaaactgtaataaaaaaaatttcactggaacacgcccatgtacaaaattcagtac

SEQ ID NO: 183145 - DNA, 75 bp, Artificial Sequence
  Synthetic
tccacctggttttccgattctaaagtgtaataaaaaaaatttcactggaacacgcccatgtacaaaattcagtac

SEQ ID NO: 183146 - DNA, 75 bp, Artificial Sequence
  Synthetic
tccacctggttttgcgattctaaaatgtaataaaaaaaatttcactggaacacgcccatgtacaaaattcagtac

SEQ ID NO: 183147 - DNA, 75 bp, Artificial Sequence
  Synthetic
tccacctggttttgcgattctaaattgtaataaaaaaaatttcactggaacacgcccatgtacaaaattcagtac

SEQ ID NO: 183148 - DNA, 75 bp, Artificial Sequence
  Synthetic
tccacctggttttgcgattctaaactgtaataaaaaaaatttcactggaacacgcccatgtacaaaattcagtac

SEQ ID NO: 183149 - DNA, 75 bp, Artificial Sequence
  Synthetic
tccacctggttttgcgattctaaagtgtaataaaaaaaatttcactggaacacgcccatgtacaaaattcagtac

SEQ ID NO: 183150 - DNA, 75 bp, Artificial Sequence
  Synthetic
tccagctggttttacgattctaaaatgtaataaaaaaaatttcactggaacacgcccatgtacaaaattcagtac

SEQ ID NO: 183151 - DNA, 75 bp, Artificial Sequence
  Synthetic
tccagctggttttacgattctaaattgtaataaaaaaaatttcactggaacacgcccatgtacaaaattcagtac

SEQ ID NO: 183152 - DNA, 75 bp, Artificial Sequence
  Synthetic
tccagctggttttacgattctaaactgtaataaaaaaaatttcactggaacacgcccatgtacaaaattcagtac

SEQ ID NO: 183153 - DNA, 75 bp, Artificial Sequence
  Synthetic
tccagctggttttacgattctaaagtgtaataaaaaaaatttcactggaacacgcccatgtacaaaattcagtac

SEQ ID NO: 183154 - DNA, 75 bp, Artificial Sequence
  Synthetic
tccagctggtttttcgattctaaaatgtaataaaaaaaatttcactggaacacgcccatgtacaaaattcagtac

SEQ ID NO: 183155 - DNA, 75 bp, Artificial Sequence
  Synthetic
tccagctggtttttcgattctaaattgtaataaaaaaaatttcactggaacacgcccatgtacaaaattcagtac

SEQ ID NO: 183156 - DNA, 75 bp, Artificial Sequence
  Synthetic
tccagctggtttttcgattctaaactgtaataaaaaaaatttcactggaacacgcccatgtacaaaattcagtac

SEQ ID NO: 183157 - DNA, 75 bp, Artificial Sequence
  Synthetic
tccagctggtttttcgattctaaagtgtaataaaaaaaatttcactggaacacgcccatgtacaaaattcagtac

SEQ ID NO: 183158 - DNA, 75 bp, Artificial Sequence
  Synthetic
tccagctggttttccgattctaaaatgtaataaaaaaaatttcactggaacacgcccatgtacaaaattcagtac

SEQ ID NO: 183159 - DNA, 75 bp, Artificial Sequence
  Synthetic
tccagctggttttccgattctaaattgtaataaaaaaaatttcactggaacacgcccatgtacaaaattcagtac

SEQ ID NO: 183160 - DNA, 75 bp, Artificial Sequence
  Synthetic
tccagctggttttccgattctaaactgtaataaaaaaaatttcactggaacacgcccatgtacaaaattcagtac

SEQ ID NO: 183161 - DNA, 75 bp, Artificial Sequence
  Synthetic
tccagctggttttccgattctaaagtgtaataaaaaaaatttcactggaacacgcccatgtacaaaattcagtac

SEQ ID NO: 183162 - DNA, 75 bp, Artificial Sequence
  Synthetic
tccagctggttttgcgattctaaaatgtaataaaaaaaatttcactggaacacgcccatgtacaaaattcagtac

SEQ ID NO: 183163 - DNA, 75 bp, Artificial Sequence
  Synthetic
tccagctggttttgcgattctaaattgtaataaaaaaaatttcactggaacacgcccatgtacaaaattcagtac

SEQ ID NO: 183164 - DNA, 75 bp, Artificial Sequence
  Synthetic
tccagctggttttgcgattctaaactgtaataaaaaaaatttcactggaacacgcccatgtacaaaattcagtac

SEQ ID NO: 183165 - DNA, 75 bp, Artificial Sequence
  Synthetic
tccagctggttttgcgattctaaagtgtaataaaaaaaatttcactggaacacgcccatgtacaaaattcagtac

SEQ ID NO: 183166 - DNA, 75 bp, Artificial Sequence
  Synthetic
attacaatttacacatggaattagcccattattatcaactcaactgcttttaaaccgcaccctagcagaagaaga

SEQ ID NO: 183167 - DNA, 75 bp, Artificial Sequence
  Synthetic
acaagaaagagtatacacataggaccagggagagcattttatacaataggaataacaagagatataagaaaagca

SEQ ID NO: 183168 - DNA, 75 bp, Artificial Sequence
  Synthetic
acaagaaagagtatacacataggaccagggagagcattttatacaataggaataacatgagatataagaaaagca

SEQ ID NO: 183169 - DNA, 75 bp, Artificial Sequence
  Synthetic
acaagaaagagtatacacataggaccagggagagcattttatacaataggaataacacgagatataagaaaagca

SEQ ID NO: 183170 - DNA, 75 bp, Artificial Sequence
  Synthetic
acaagaaagagtatacacataggaccagggagagcattttatacaataggaataacaggagatataagaaaagca

SEQ ID NO: 183171 - DNA, 75 bp, Artificial Sequence
  Synthetic
acaagaaagagtatacacataggaccagggagagcattttatacaataggattaacaagagatataagaaaagca

SEQ ID NO: 183172 - DNA, 75 bp, Artificial Sequence
  Synthetic
acaagaaagagtatacacataggaccagggagagcattttatacaataggattaacatgagatataagaaaagca

SEQ ID NO: 183173 - DNA, 75 bp, Artificial Sequence
  Synthetic
acaagaaagagtatacacataggaccagggagagcattttatacaataggattaacacgagatataagaaaagca

SEQ ID NO: 183174 - DNA, 75 bp, Artificial Sequence
  Synthetic
acaagaaagagtatacacataggaccagggagagcattttatacaataggattaacaggagatataagaaaagca

SEQ ID NO: 183175 - DNA, 75 bp, Artificial Sequence
  Synthetic
acaagaaagagtatacacataggaccagggagagcattttatacaataggactaacaagagatataagaaaagca

SEQ ID NO: 183176 - DNA, 75 bp, Artificial Sequence
  Synthetic
acaagaaagagtatacacataggaccagggagagcattttatacaataggactaacatgagatataagaaaagca

SEQ ID NO: 183177 - DNA, 75 bp, Artificial Sequence
  Synthetic
acaagaaagagtatacacataggaccagggagagcattttatacaataggactaacacgagatataagaaaagca

SEQ ID NO: 183178 - DNA, 75 bp, Artificial Sequence
  Synthetic
acaagaaagagtatacacataggaccagggagagcattttatacaataggactaacaggagatataagaaaagca

SEQ ID NO: 183179 - DNA, 75 bp, Artificial Sequence
  Synthetic
acaagaaagagtatacacataggaccagggagagcattttatacaataggagtaacaagagatataagaaaagca

SEQ ID NO: 183180 - DNA, 75 bp, Artificial Sequence
  Synthetic
acaagaaagagtatacacataggaccagggagagcattttatacaataggagtaacatgagatataagaaaagca

SEQ ID NO: 183181 - DNA, 75 bp, Artificial Sequence
  Synthetic
acaagaaagagtatacacataggaccagggagagcattttatacaataggagtaacacgagatataagaaaagca

SEQ ID NO: 183182 - DNA, 75 bp, Artificial Sequence
  Synthetic
acaagaaagagtatacacataggaccagggagagcattttatacaataggagtaacaggagatataagaaaagca

SEQ ID NO: 183183 - DNA, 75 bp, Artificial Sequence
  Synthetic
acaagaaagtgtatacacataggaccagggagagcattttatacaataggaataacaagagatataagaaaagca

SEQ ID NO: 183184 - DNA, 75 bp, Artificial Sequence
  Synthetic
acaagaaagtgtatacacataggaccagggagagcattttatacaataggaataacatgagatataagaaaagca

SEQ ID NO: 183185 - DNA, 75 bp, Artificial Sequence
  Synthetic
acaagaaagtgtatacacataggaccagggagagcattttatacaataggaataacacgagatataagaaaagca

SEQ ID NO: 183186 - DNA, 75 bp, Artificial Sequence
  Synthetic
acaagaaagtgtatacacataggaccagggagagcattttatacaataggaataacaggagatataagaaaagca

SEQ ID NO: 183187 - DNA, 75 bp, Artificial Sequence
  Synthetic
acaagaaagtgtatacacataggaccagggagagcattttatacaataggattaacaagagatataagaaaagca

SEQ ID NO: 183188 - DNA, 75 bp, Artificial Sequence
  Synthetic
acaagaaagtgtatacacataggaccagggagagcattttatacaataggattaacatgagatataagaaaagca

SEQ ID NO: 183189 - DNA, 75 bp, Artificial Sequence
  Synthetic
acaagaaagtgtatacacataggaccagggagagcattttatacaataggattaacacgagatataagaaaagca

SEQ ID NO: 183190 - DNA, 75 bp, Artificial Sequence
  Synthetic
acaagaaagtgtatacacataggaccagggagagcattttatacaataggattaacaggagatataagaaaagca

SEQ ID NO: 183191 - DNA, 75 bp, Artificial Sequence
  Synthetic
acaagaaagtgtatacacataggaccagggagagcattttatacaataggactaacaagagatataagaaaagca

SEQ ID NO: 183192 - DNA, 75 bp, Artificial Sequence
  Synthetic
acaagaaagtgtatacacataggaccagggagagcattttatacaataggactaacatgagatataagaaaagca

SEQ ID NO: 183193 - DNA, 75 bp, Artificial Sequence
  Synthetic
acaagaaagtgtatacacataggaccagggagagcattttatacaataggactaacacgagatataagaaaagca

SEQ ID NO: 183194 - DNA, 75 bp, Artificial Sequence
  Synthetic
acaagaaagtgtatacacataggaccagggagagcattttatacaataggactaacaggagatataagaaaagca

SEQ ID NO: 183195 - DNA, 75 bp, Artificial Sequence
  Synthetic
acaagaaagtgtatacacataggaccagggagagcattttatacaataggagtaacaagagatataagaaaagca

SEQ ID NO: 183196 - DNA, 75 bp, Artificial Sequence
  Synthetic
acaagaaagtgtatacacataggaccagggagagcattttatacaataggagtaacatgagatataagaaaagca

SEQ ID NO: 183197 - DNA, 75 bp, Artificial Sequence
  Synthetic
acaagaaagtgtatacacataggaccagggagagcattttatacaataggagtaacacgagatataagaaaagca

SEQ ID NO: 183198 - DNA, 75 bp, Artificial Sequence
  Synthetic
acaagaaagtgtatacacataggaccagggagagcattttatacaataggagtaacaggagatataagaaaagca

SEQ ID NO: 183199 - DNA, 75 bp, Artificial Sequence
  Synthetic
acaagaaagcgtatacacataggaccagggagagcattttatacaataggaataacaagagatataagaaaagca

SEQ ID NO: 183200 - DNA, 75 bp, Artificial Sequence
  Synthetic
acaagaaagcgtatacacataggaccagggagagcattttatacaataggaataacatgagatataagaaaagca

SEQ ID NO: 183201 - DNA, 75 bp, Artificial Sequence
  Synthetic
acaagaaagcgtatacacataggaccagggagagcattttatacaataggaataacacgagatataagaaaagca

SEQ ID NO: 183202 - DNA, 75 bp, Artificial Sequence
  Synthetic
acaagaaagcgtatacacataggaccagggagagcattttatacaataggaataacaggagatataagaaaagca

SEQ ID NO: 183203 - DNA, 75 bp, Artificial Sequence
  Synthetic
acaagaaagcgtatacacataggaccagggagagcattttatacaataggattaacaagagatataagaaaagca

SEQ ID NO: 183204 - DNA, 75 bp, Artificial Sequence
  Synthetic
acaagaaagcgtatacacataggaccagggagagcattttatacaataggattaacatgagatataagaaaagca

SEQ ID NO: 183205 - DNA, 75 bp, Artificial Sequence
  Synthetic
acaagaaagcgtatacacataggaccagggagagcattttatacaataggattaacacgagatataagaaaagca

SEQ ID NO: 183206 - DNA, 75 bp, Artificial Sequence
  Synthetic
acaagaaagcgtatacacataggaccagggagagcattttatacaataggattaacaggagatataagaaaagca

SEQ ID NO: 183207 - DNA, 75 bp, Artificial Sequence
  Synthetic
acaagaaagcgtatacacataggaccagggagagcattttatacaataggactaacaagagatataagaaaagca

SEQ ID NO: 183208 - DNA, 75 bp, Artificial Sequence
  Synthetic
acaagaaagcgtatacacataggaccagggagagcattttatacaataggactaacatgagatataagaaaagca

SEQ ID NO: 183209 - DNA, 75 bp, Artificial Sequence
  Synthetic
acaagaaagcgtatacacataggaccagggagagcattttatacaataggactaacacgagatataagaaaagca

SEQ ID NO: 183210 - DNA, 75 bp, Artificial Sequence
  Synthetic
acaagaaagcgtatacacataggaccagggagagcattttatacaataggactaacaggagatataagaaaagca

SEQ ID NO: 183211 - DNA, 75 bp, Artificial Sequence
  Synthetic
acaagaaagcgtatacacataggaccagggagagcattttatacaataggagtaacaagagatataagaaaagca

SEQ ID NO: 183212 - DNA, 75 bp, Artificial Sequence
  Synthetic
acaagaaagcgtatacacataggaccagggagagcattttatacaataggagtaacatgagatataagaaaagca

SEQ ID NO: 183213 - DNA, 75 bp, Artificial Sequence
  Synthetic
acaagaaagcgtatacacataggaccagggagagcattttatacaataggagtaacacgagatataagaaaagca

SEQ ID NO: 183214 - DNA, 75 bp, Artificial Sequence
  Synthetic
acaagaaagcgtatacacataggaccagggagagcattttatacaataggagtaacaggagatataagaaaagca

SEQ ID NO: 183215 - DNA, 75 bp, Artificial Sequence
  Synthetic
acaagaaagggtatacacataggaccagggagagcattttatacaataggaataacaagagatataagaaaagca

SEQ ID NO: 183216 - DNA, 75 bp, Artificial Sequence
  Synthetic
acaagaaagggtatacacataggaccagggagagcattttatacaataggaataacatgagatataagaaaagca

SEQ ID NO: 183217 - DNA, 75 bp, Artificial Sequence
  Synthetic
acaagaaagggtatacacataggaccagggagagcattttatacaataggaataacacgagatataagaaaagca

SEQ ID NO: 183218 - DNA, 75 bp, Artificial Sequence
  Synthetic
acaagaaagggtatacacataggaccagggagagcattttatacaataggaataacaggagatataagaaaagca

SEQ ID NO: 183219 - DNA, 75 bp, Artificial Sequence
  Synthetic
acaagaaagggtatacacataggaccagggagagcattttatacaataggattaacaagagatataagaaaagca

SEQ ID NO: 183220 - DNA, 75 bp, Artificial Sequence
  Synthetic
acaagaaagggtatacacataggaccagggagagcattttatacaataggattaacatgagatataagaaaagca

SEQ ID NO: 183221 - DNA, 75 bp, Artificial Sequence
  Synthetic
acaagaaagggtatacacataggaccagggagagcattttatacaataggattaacacgagatataagaaaagca

SEQ ID NO: 183222 - DNA, 75 bp, Artificial Sequence
  Synthetic
acaagaaagggtatacacataggaccagggagagcattttatacaataggattaacaggagatataagaaaagca

SEQ ID NO: 183223 - DNA, 75 bp, Artificial Sequence
  Synthetic
acaagaaagggtatacacataggaccagggagagcattttatacaataggactaacaagagatataagaaaagca

SEQ ID NO: 183224 - DNA, 75 bp, Artificial Sequence
  Synthetic
acaagaaagggtatacacataggaccagggagagcattttatacaataggactaacatgagatataagaaaagca

SEQ ID NO: 183225 - DNA, 75 bp, Artificial Sequence
  Synthetic
acaagaaagggtatacacataggaccagggagagcattttatacaataggactaacacgagatataagaaaagca

SEQ ID NO: 183226 - DNA, 75 bp, Artificial Sequence
  Synthetic
acaagaaagggtatacacataggaccagggagagcattttatacaataggactaacaggagatataagaaaagca

SEQ ID NO: 183227 - DNA, 75 bp, Artificial Sequence
  Synthetic
acaagaaagggtatacacataggaccagggagagcattttatacaataggagtaacaagagatataagaaaagca

SEQ ID NO: 183228 - DNA, 75 bp, Artificial Sequence
  Synthetic
acaagaaagggtatacacataggaccagggagagcattttatacaataggagtaacatgagatataagaaaagca

SEQ ID NO: 183229 - DNA, 75 bp, Artificial Sequence
  Synthetic
acaagaaagggtatacacataggaccagggagagcattttatacaataggagtaacacgagatataagaaaagca

SEQ ID NO: 183230 - DNA, 75 bp, Artificial Sequence
  Synthetic
acaagaaagggtatacacataggaccagggagagcattttatacaataggagtaacaggagatataagaaaagca

SEQ ID NO: 183231 - DNA, 75 bp, Artificial Sequence
  Synthetic
cagggagagcattttatacaataggaataacaagagatataagaaaagcacattgtaacattaatagagcagact

SEQ ID NO: 183232 - DNA, 75 bp, Artificial Sequence
  Synthetic
cagggagagcattttatacaataggaataacaagagatataagaaaagcacattgtaacattattagagcagact

SEQ ID NO: 183233 - DNA, 75 bp, Artificial Sequence
  Synthetic
cagggagagcattttatacaataggaataacaagagatataagaaaagcacattgtaacattactagagcagact

SEQ ID NO: 183234 - DNA, 75 bp, Artificial Sequence
  Synthetic
cagggagagcattttatacaataggaataacaagagatataagaaaagcacattgtaacattagtagagcagact

SEQ ID NO: 183235 - DNA, 75 bp, Artificial Sequence
  Synthetic
cagggagagcattttatacaataggaataacatgagatataagaaaagcacattgtaacattaatagagcagact

SEQ ID NO: 183236 - DNA, 75 bp, Artificial Sequence
  Synthetic
cagggagagcattttatacaataggaataacatgagatataagaaaagcacattgtaacattattagagcagact

SEQ ID NO: 183237 - DNA, 75 bp, Artificial Sequence
  Synthetic
cagggagagcattttatacaataggaataacatgagatataagaaaagcacattgtaacattactagagcagact

SEQ ID NO: 183238 - DNA, 75 bp, Artificial Sequence
  Synthetic
cagggagagcattttatacaataggaataacatgagatataagaaaagcacattgtaacattagtagagcagact

SEQ ID NO: 183239 - DNA, 75 bp, Artificial Sequence
  Synthetic
cagggagagcattttatacaataggaataacacgagatataagaaaagcacattgtaacattaatagagcagact

SEQ ID NO: 183240 - DNA, 75 bp, Artificial Sequence
  Synthetic
cagggagagcattttatacaataggaataacacgagatataagaaaagcacattgtaacattattagagcagact

SEQ ID NO: 183241 - DNA, 75 bp, Artificial Sequence
  Synthetic
cagggagagcattttatacaataggaataacacgagatataagaaaagcacattgtaacattactagagcagact

SEQ ID NO: 183242 - DNA, 75 bp, Artificial Sequence
  Synthetic
cagggagagcattttatacaataggaataacacgagatataagaaaagcacattgtaacattagtagagcagact

SEQ ID NO: 183243 - DNA, 75 bp, Artificial Sequence
  Synthetic
cagggagagcattttatacaataggaataacaggagatataagaaaagcacattgtaacattaatagagcagact

SEQ ID NO: 183244 - DNA, 75 bp, Artificial Sequence
  Synthetic
cagggagagcattttatacaataggaataacaggagatataagaaaagcacattgtaacattattagagcagact

SEQ ID NO: 183245 - DNA, 75 bp, Artificial Sequence
  Synthetic
cagggagagcattttatacaataggaataacaggagatataagaaaagcacattgtaacattactagagcagact

SEQ ID NO: 183246 - DNA, 75 bp, Artificial Sequence
  Synthetic
cagggagagcattttatacaataggaataacaggagatataagaaaagcacattgtaacattagtagagcagact

SEQ ID NO: 183247 - DNA, 75 bp, Artificial Sequence
  Synthetic
cagggagagcattttatacaataggattaacaagagatataagaaaagcacattgtaacattaatagagcagact

SEQ ID NO: 183248 - DNA, 75 bp, Artificial Sequence
  Synthetic
cagggagagcattttatacaataggattaacaagagatataagaaaagcacattgtaacattattagagcagact

SEQ ID NO: 183249 - DNA, 75 bp, Artificial Sequence
  Synthetic
cagggagagcattttatacaataggattaacaagagatataagaaaagcacattgtaacattactagagcagact

SEQ ID NO: 183250 - DNA, 75 bp, Artificial Sequence
  Synthetic
cagggagagcattttatacaataggattaacaagagatataagaaaagcacattgtaacattagtagagcagact

SEQ ID NO: 183251 - DNA, 75 bp, Artificial Sequence
  Synthetic
cagggagagcattttatacaataggattaacatgagatataagaaaagcacattgtaacattaatagagcagact

SEQ ID NO: 183252 - DNA, 75 bp, Artificial Sequence
  Synthetic
cagggagagcattttatacaataggattaacatgagatataagaaaagcacattgtaacattattagagcagact

SEQ ID NO: 183253 - DNA, 75 bp, Artificial Sequence
  Synthetic
cagggagagcattttatacaataggattaacatgagatataagaaaagcacattgtaacattactagagcagact

SEQ ID NO: 183254 - DNA, 75 bp, Artificial Sequence
  Synthetic
cagggagagcattttatacaataggattaacatgagatataagaaaagcacattgtaacattagtagagcagact

SEQ ID NO: 183255 - DNA, 75 bp, Artificial Sequence
  Synthetic
cagggagagcattttatacaataggattaacacgagatataagaaaagcacattgtaacattaatagagcagact

SEQ ID NO: 183256 - DNA, 75 bp, Artificial Sequence
  Synthetic
cagggagagcattttatacaataggattaacacgagatataagaaaagcacattgtaacattattagagcagact

SEQ ID NO: 183257 - DNA, 75 bp, Artificial Sequence
  Synthetic
cagggagagcattttatacaataggattaacacgagatataagaaaagcacattgtaacattactagagcagact

SEQ ID NO: 183258 - DNA, 75 bp, Artificial Sequence
  Synthetic
cagggagagcattttatacaataggattaacacgagatataagaaaagcacattgtaacattagtagagcagact

SEQ ID NO: 183259 - DNA, 75 bp, Artificial Sequence
  Synthetic
cagggagagcattttatacaataggattaacaggagatataagaaaagcacattgtaacattaatagagcagact

SEQ ID NO: 183260 - DNA, 75 bp, Artificial Sequence
  Synthetic
cagggagagcattttatacaataggattaacaggagatataagaaaagcacattgtaacattattagagcagact

SEQ ID NO: 183261 - DNA, 75 bp, Artificial Sequence
  Synthetic
cagggagagcattttatacaataggattaacaggagatataagaaaagcacattgtaacattactagagcagact

SEQ ID NO: 183262 - DNA, 75 bp, Artificial Sequence
  Synthetic
cagggagagcattttatacaataggattaacaggagatataagaaaagcacattgtaacattagtagagcagact

SEQ ID NO: 183263 - DNA, 75 bp, Artificial Sequence
  Synthetic
cagggagagcattttatacaataggactaacaagagatataagaaaagcacattgtaacattaatagagcagact

SEQ ID NO: 183264 - DNA, 75 bp, Artificial Sequence
  Synthetic
cagggagagcattttatacaataggactaacaagagatataagaaaagcacattgtaacattattagagcagact

SEQ ID NO: 183265 - DNA, 75 bp, Artificial Sequence
  Synthetic
cagggagagcattttatacaataggactaacaagagatataagaaaagcacattgtaacattactagagcagact

SEQ ID NO: 183266 - DNA, 75 bp, Artificial Sequence
  Synthetic
cagggagagcattttatacaataggactaacaagagatataagaaaagcacattgtaacattagtagagcagact

SEQ ID NO: 183267 - DNA, 75 bp, Artificial Sequence
  Synthetic
cagggagagcattttatacaataggactaacatgagatataagaaaagcacattgtaacattaatagagcagact

SEQ ID NO: 183268 - DNA, 75 bp, Artificial Sequence
  Synthetic
cagggagagcattttatacaataggactaacatgagatataagaaaagcacattgtaacattattagagcagact

SEQ ID NO: 183269 - DNA, 75 bp, Artificial Sequence
  Synthetic
cagggagagcattttatacaataggactaacatgagatataagaaaagcacattgtaacattactagagcagact

SEQ ID NO: 183270 - DNA, 75 bp, Artificial Sequence
  Synthetic
cagggagagcattttatacaataggactaacatgagatataagaaaagcacattgtaacattagtagagcagact

SEQ ID NO: 183271 - DNA, 75 bp, Artificial Sequence
  Synthetic
cagggagagcattttatacaataggactaacacgagatataagaaaagcacattgtaacattaatagagcagact

SEQ ID NO: 183272 - DNA, 75 bp, Artificial Sequence
  Synthetic
cagggagagcattttatacaataggactaacacgagatataagaaaagcacattgtaacattattagagcagact

SEQ ID NO: 183273 - DNA, 75 bp, Artificial Sequence
  Synthetic
cagggagagcattttatacaataggactaacacgagatataagaaaagcacattgtaacattactagagcagact

SEQ ID NO: 183274 - DNA, 75 bp, Artificial Sequence
  Synthetic
cagggagagcattttatacaataggactaacacgagatataagaaaagcacattgtaacattagtagagcagact

SEQ ID NO: 183275 - DNA, 75 bp, Artificial Sequence
  Synthetic
cagggagagcattttatacaataggactaacaggagatataagaaaagcacattgtaacattaatagagcagact

SEQ ID NO: 183276 - DNA, 75 bp, Artificial Sequence
  Synthetic
cagggagagcattttatacaataggactaacaggagatataagaaaagcacattgtaacattattagagcagact

SEQ ID NO: 183277 - DNA, 75 bp, Artificial Sequence
  Synthetic
cagggagagcattttatacaataggactaacaggagatataagaaaagcacattgtaacattactagagcagact

SEQ ID NO: 183278 - DNA, 75 bp, Artificial Sequence
  Synthetic
cagggagagcattttatacaataggactaacaggagatataagaaaagcacattgtaacattagtagagcagact

SEQ ID NO: 183279 - DNA, 75 bp, Artificial Sequence
  Synthetic
cagggagagcattttatacaataggagtaacaagagatataagaaaagcacattgtaacattaatagagcagact

SEQ ID NO: 183280 - DNA, 75 bp, Artificial Sequence
  Synthetic
cagggagagcattttatacaataggagtaacaagagatataagaaaagcacattgtaacattattagagcagact

SEQ ID NO: 183281 - DNA, 75 bp, Artificial Sequence
  Synthetic
cagggagagcattttatacaataggagtaacaagagatataagaaaagcacattgtaacattactagagcagact

SEQ ID NO: 183282 - DNA, 75 bp, Artificial Sequence
  Synthetic
cagggagagcattttatacaataggagtaacaagagatataagaaaagcacattgtaacattagtagagcagact

SEQ ID NO: 183283 - DNA, 75 bp, Artificial Sequence
  Synthetic
cagggagagcattttatacaataggagtaacatgagatataagaaaagcacattgtaacattaatagagcagact

SEQ ID NO: 183284 - DNA, 75 bp, Artificial Sequence
  Synthetic
cagggagagcattttatacaataggagtaacatgagatataagaaaagcacattgtaacattattagagcagact

SEQ ID NO: 183285 - DNA, 75 bp, Artificial Sequence
  Synthetic
cagggagagcattttatacaataggagtaacatgagatataagaaaagcacattgtaacattactagagcagact

SEQ ID NO: 183286 - DNA, 75 bp, Artificial Sequence
  Synthetic
cagggagagcattttatacaataggagtaacatgagatataagaaaagcacattgtaacattagtagagcagact

SEQ ID NO: 183287 - DNA, 75 bp, Artificial Sequence
  Synthetic
cagggagagcattttatacaataggagtaacacgagatataagaaaagcacattgtaacattaatagagcagact

SEQ ID NO: 183288 - DNA, 75 bp, Artificial Sequence
  Synthetic
cagggagagcattttatacaataggagtaacacgagatataagaaaagcacattgtaacattattagagcagact

SEQ ID NO: 183289 - DNA, 75 bp, Artificial Sequence
  Synthetic
cagggagagcattttatacaataggagtaacacgagatataagaaaagcacattgtaacattactagagcagact

SEQ ID NO: 183290 - DNA, 75 bp, Artificial Sequence
  Synthetic
cagggagagcattttatacaataggagtaacacgagatataagaaaagcacattgtaacattagtagagcagact

SEQ ID NO: 183291 - DNA, 75 bp, Artificial Sequence
  Synthetic
cagggagagcattttatacaataggagtaacaggagatataagaaaagcacattgtaacattaatagagcagact

SEQ ID NO: 183292 - DNA, 75 bp, Artificial Sequence
  Synthetic
cagggagagcattttatacaataggagtaacaggagatataagaaaagcacattgtaacattattagagcagact

SEQ ID NO: 183293 - DNA, 75 bp, Artificial Sequence
  Synthetic
cagggagagcattttatacaataggagtaacaggagatataagaaaagcacattgtaacattactagagcagact

SEQ ID NO: 183294 - DNA, 75 bp, Artificial Sequence
  Synthetic
cagggagagcattttatacaataggagtaacaggagatataagaaaagcacattgtaacattagtagagcagact

SEQ ID NO: 183295 - DNA, 75 bp, Artificial Sequence
  Synthetic
tgacggtagaacagatgaagataggcccaatggcctggtacagcatagatatagggagaggaaacacaagcgacc

SEQ ID NO: 183296 - DNA, 75 bp, Artificial Sequence
  Synthetic
tgttagcgtgatcttcaatagaagcaatgatggagatccagagatagcctttttgcattttaactgccatggaga

SEQ ID NO: 183297 - DNA, 75 bp, Artificial Sequence
  Synthetic
ttttgcattttaactgccatggagagttcttttattgtaacacatcggggatgtttaattatacctttacatgta

SEQ ID NO: 183298 - DNA, 75 bp, Artificial Sequence
  Synthetic
gcaataggcatagcagcattaatagtagcactaataatagcaatagttgtgtggattatagcatatatagaatat

SEQ ID NO: 183299 - DNA, 75 bp, Artificial Sequence
  Synthetic
taccacaccagacaaaaaacatcagaaagaacctccattcctttggatgggatatgagcttcatcctgacaaatg

SEQ ID NO: 183300 - DNA, 75 bp, Artificial Sequence
  Synthetic
aagattgttctgagagacaggctaattttttagggagaatctggcctgcccacaaggacaggccaggaaattttt

SEQ ID NO: 183301 - DNA, 75 bp, Artificial Sequence
  Synthetic
cggtacaggccagacaattattgtctggtatagtgcaacagcaaaacaatttgctgagggctattgaagcgcaac

SEQ ID NO: 183302 - DNA, 75 bp, Artificial Sequence
  Synthetic
aaggacattaatgctacatggaacattaatgctacattcagaccaatagggggagatatgaaagatatatggaga

SEQ ID NO: 183303 - DNA, 75 bp, Artificial Sequence
  Synthetic
gaaccatacaatgaatggacactagagcttttagaagaactcaagcaggaagctgtcagacactttcctagacca

SEQ ID NO: 183304 - DNA, 75 bp, Artificial Sequence
  Synthetic
tattggggtcgggaactaaaaattagtgctattaatttgcttgataccatagcaatagcagtagctggctggaca

SEQ ID NO: 183305 - DNA, 75 bp, Artificial Sequence
  Synthetic
aatagtttttgctatattgtctatagtgaatagagttaggcaggggtactcaccattatcattacagaccctcct

SEQ ID NO: 183306 - DNA, 75 bp, Artificial Sequence
  Synthetic
cagtgacatgaaaaattgctcttacaatatgaccacagagctaagggataagaaaacgaagcaatattcactttt

SEQ ID NO: 183307 - DNA, 75 bp, Artificial Sequence
  Synthetic
taccaagaagaaaagcaaagatcattagggattatggaaaacagatggcaggtgatgattgtgtggcaagtagac

SEQ ID NO: 183308 - DNA, 75 bp, Artificial Sequence
  Synthetic
tgttgttaaatggcagcctagcagaaggagatataataatcagatctcaaaatatctcagataatgcaaaaacca

SEQ ID NO: 183309 - DNA, 75 bp, Artificial Sequence
  Synthetic
aattagatcagaaaatctcacaaataatgcaaaaatcataatagtgcagcttaatgagtcagtaacaattaattg

SEQ ID NO: 183310 - DNA, 75 bp, Artificial Sequence
  Synthetic
tgtaatgttagtggaaattggaataaaactttacaacaagtagctaataaattaagagaatattataacaagaca

SEQ ID NO: 183311 - DNA, 75 bp, Artificial Sequence
  Synthetic
agttcccctaataatagtacccctagtaatagtagtctggaaaataatagtgacataaaaaactgctctttcaat

SEQ ID NO: 183312 - DNA, 75 bp, Artificial Sequence
  Synthetic
gcaaaagatagagttaaaagacaccaaggaagctttagataagatagaggaagagcaacacaaaagcaagaaaaa

SEQ ID NO: 183313 - DNA, 75 bp, Artificial Sequence
  Synthetic
atagcacttggaagtttaatagcacttgggagcaagggtcaaataccacggagacaaatgaaactataactctcc

SEQ ID NO: 183314 - DNA, 75 bp, Artificial Sequence
  Synthetic
acaaaggataggaagaggaatacttaacatcccaagaagaattagacagggattagaaagaagcttattgtaaca

SEQ ID NO: 183315 - DNA, 75 bp, Artificial Sequence
  Synthetic
acaaaggataggaagaggaatacttaacatcccaagaagaattagacagggtttagaaagaagcttattgtaaca

SEQ ID NO: 183316 - DNA, 75 bp, Artificial Sequence
  Synthetic
acaaaggataggaagaggaatacttaacatcccaagaagaattagacagggcttagaaagaagcttattgtaaca

SEQ ID NO: 183317 - DNA, 75 bp, Artificial Sequence
  Synthetic
acaaaggataggaagaggaatacttaacatcccaagaagaattagacaggggttagaaagaagcttattgtaaca

SEQ ID NO: 183318 - DNA, 75 bp, Artificial Sequence
  Synthetic
aatgcagaataaagcaaatcataaacatgtggcagacagtaggacaagcaatgtatgctccccccatcccaggag

SEQ ID NO: 183319 - DNA, 75 bp, Artificial Sequence
  Synthetic
acctgtgtggaaagaagcaaaaactactctattttgtgcatcagatgctaaagcatatgagaaagaagtgcataa

SEQ ID NO: 183320 - DNA, 75 bp, Artificial Sequence
  Synthetic
aagaaaaagcatacatatgggaccagggaaagcattttttgcaacaggggatataataggagatataagacaagc

SEQ ID NO: 183321 - DNA, 75 bp, Artificial Sequence
  Synthetic
aacaaattaggttaaagccaggatctaaaaagaaatataggctaaaacatttagtatgggcaagcagggagctgg

SEQ ID NO: 183322 - DNA, 75 bp, Artificial Sequence
  Synthetic
ctcatctgcaccactaatgtgccctggaactctagttggagtaataaaactcagagtgagatatgggagaacatg

SEQ ID NO: 183323 - DNA, 75 bp, Artificial Sequence
  Synthetic
gagattgacaatcatacagaatacatatacaggttaattgaaaaatcgcagaatcagcaagaaataaatgaacaa

SEQ ID NO: 183324 - DNA, 75 bp, Artificial Sequence
  Synthetic
gtgctctggtgtgttcacaacagatataaaattgaagatacacagcaggcaatacaaaggctaagagaagaaaag

SEQ ID NO: 183325 - DNA, 75 bp, Artificial Sequence
  Synthetic
aatatcaagcaggacataataaggtaggatctctacaatatttggcactgaaagcattagtaacaccaacaaaga

SEQ ID NO: 183326 - DNA, 75 bp, Artificial Sequence
  Synthetic
aatacaagaaaaagtataaggatagggccaggacaaacattctatgcaaatgatataataggagacataagacga

SEQ ID NO: 183327 - DNA, 75 bp, Artificial Sequence
  Synthetic
gacagatagaattctagaagttttgcaaagagttggtagagctattctcaacatacccagaaggataagacaagg

SEQ ID NO: 183328 - DNA, 75 bp, Artificial Sequence
  Synthetic
gcagcagaaggggtgggagcagcatctcgggacctggaaaaacatggggcaatcacaagtagcaacacagcacat

SEQ ID NO: 183329 - DNA, 75 bp, Artificial Sequence
  Synthetic
cgaaagacagggaacccttaatttccctcaaatcactctttggcaacgaccccttgtctcaataaaagtaggggg

SEQ ID NO: 183330 - DNA, 75 bp, Artificial Sequence
  Synthetic
aagcacaagaagaggaaggggaagtgggttttccagtcagacctcaggtaccattaagaccaatgacttacaagg

SEQ ID NO: 183331 - DNA, 75 bp, Artificial Sequence
  Synthetic
ggacttgaagcgaaagtagaaccagagaagatctctcgacgcggggactcggcttgctgaagtgcaacacggcaa

SEQ ID NO: 183332 - DNA, 75 bp, Artificial Sequence
  Synthetic
ctcaggtaccattaagaccaatgacttacaaggcagctctagatctgagccactttttaaaagaaaaggggggac

SEQ ID NO: 183333 - DNA, 75 bp, Artificial Sequence
  Synthetic
acaattggagaagtgaattatataaatataaagtagtacaaattgaaccactaggaatagcacccaccagggcaa

SEQ ID NO: 183334 - DNA, 75 bp, Artificial Sequence
  Synthetic
aaacaggcaaattttttaggcaaatactggcctccggggggcacgaggccaggcaattatgtgcagaaacaagtg

SEQ ID NO: 183335 - DNA, 75 bp, Artificial Sequence
  Synthetic
aactttgaacgcatgggtaaaagtaatagaagagaaggctttcagcccagaagtaatacccatgttttcagcatt

SEQ ID NO: 183336 - DNA, 75 bp, Artificial Sequence
  Synthetic
agtcagacctcaggtccctttaagaccaatgactttcaagggagctctagatctcagccactttttaaaagaaaa

SEQ ID NO: 183337 - DNA, 75 bp, Artificial Sequence
  Synthetic
atctggggaatcttctgttatattggggtcaggaactaaaaattagtgctatttctttgcttgatgctacagcaa

SEQ ID NO: 183338 - DNA, 75 bp, Artificial Sequence
  Synthetic
atacaagaaaaagtatacacctcgggccaggacaagcgctctatgcaacaggggacataataggaaatataagac

SEQ ID NO: 183339 - DNA, 75 bp, Artificial Sequence
  Synthetic
catgtgtaaagttgaccccactctgtgtcactttgaactgtacaaatgtaaatgttaatgctaccacaaatggta

SEQ ID NO: 183340 - DNA, 75 bp, Artificial Sequence
  Synthetic
actgatagtacttgcaaaaatgaaagcttggaagacatgaaagaaatgaaaaactgctctttcaatgtcactgca

SEQ ID NO: 183341 - DNA, 75 bp, Artificial Sequence
  Synthetic
gtacaagacccaataacaatacaagacaaggtatacatataggaccagggagagcattttatgcaacaacagaca

SEQ ID NO: 183342 - DNA, 75 bp, Artificial Sequence
  Synthetic
gaaatgaaaaaatagataaattagtaagcaaggatattagaagagtcctattcctagaaggaatagaccaggcac

SEQ ID NO: 183343 - DNA, 75 bp, Artificial Sequence
  Synthetic
aaaaattaagagaacaatttgggaataaaacaatagtctttaattcatcctcaggaggggacccagaaattgtaa

SEQ ID NO: 183344 - DNA, 75 bp, Artificial Sequence
  Synthetic
acagatagggttataaaaatagtacaaagagcttgtagggcttttcttaacatacccacaaggataagacaaggc

SEQ ID NO: 183345 - DNA, 75 bp, Artificial Sequence
  Synthetic
gtgttgctatcattgcccagtttgctttttgaacaaaggcttaggcatctcctatggcaggaagaagcggaaaca

SEQ ID NO: 183346 - DNA, 75 bp, Artificial Sequence
  Synthetic
ctgcaggaacaaataagatggatgaccagcaacccacctatcccagtgggagaaatttataaaagatggataatc

SEQ ID NO: 183347 - DNA, 75 bp, Artificial Sequence
  Synthetic
tataaatataaagtagtaaaaattgaaccattagggatagcacccaccagggcaaagagaagagtggtgcagaga

SEQ ID NO: 183348 - DNA, 75 bp, Artificial Sequence
  Synthetic
catagtaaggtagggacactgcaactactagctctaagagcagttgtaaaagcaaaaagaaataagcctccctta

SEQ ID NO: 183349 - DNA, 75 bp, Artificial Sequence
  Synthetic
ttgcaggattcaggatcagaagtaaacatagtaacagactcacagtatgcattaggaatcattcaggcacaacca

SEQ ID NO: 183350 - DNA, 75 bp, Artificial Sequence
  Synthetic
acaatgcacacatggaatcaagccagtagtatcaactcaactgttgttaaatggtagtctagcaaaaacaaagga

SEQ ID NO: 183351 - DNA, 75 bp, Artificial Sequence
  Synthetic
agaaaaagtatacgtataggaccaggacaatcattctatgcaatgggtgacataataggggagataagaaacgca

SEQ ID NO: 183352 - DNA, 75 bp, Artificial Sequence
  Synthetic
gctgctatcattgctatgtttgtttcacaagaaagggtttgggaatctcctatggcaggaagaagcgacgacgat

SEQ ID NO: 183353 - DNA, 75 bp, Artificial Sequence
  Synthetic
cctcaggaggggatctagaaatcacaacacatagttttaattgtggaggagaatttttctattgtaatacatcag

SEQ ID NO: 183354 - DNA, 75 bp, Artificial Sequence
  Synthetic
taagtgtttcaattgtggcaaagaagggcacatagccagaaattgcagggctcctaggaaaaagggctgttggaa

SEQ ID NO: 183355 - DNA, 75 bp, Artificial Sequence
  Synthetic
tttgcttcttataaatgtaatattatggatgtttattcttagaaaatatttggaacataagagacaagaaagaag

SEQ ID NO: 183356 - DNA, 75 bp, Artificial Sequence
  Synthetic
tttgcttcttataaatgtaatattatggatgtttattcttagataatatttggaacataagagacaagaaagaag

SEQ ID NO: 183357 - DNA, 75 bp, Artificial Sequence
  Synthetic
tttgcttcttataaatgtaatattatggatgtttattcttagacaatatttggaacataagagacaagaaagaag

SEQ ID NO: 183358 - DNA, 75 bp, Artificial Sequence
  Synthetic
tttgcttcttataaatgtaatattatggatgtttattcttagagaatatttggaacataagagacaagaaagaag

SEQ ID NO: 183359 - DNA, 75 bp, Artificial Sequence
  Synthetic
tttgcttcttataaatgtaattttatggatgtttattcttagaaaatatttggaacataagagacaagaaagaag

SEQ ID NO: 183360 - DNA, 75 bp, Artificial Sequence
  Synthetic
tttgcttcttataaatgtaattttatggatgtttattcttagataatatttggaacataagagacaagaaagaag

SEQ ID NO: 183361 - DNA, 75 bp, Artificial Sequence
  Synthetic
tttgcttcttataaatgtaattttatggatgtttattcttagacaatatttggaacataagagacaagaaagaag

SEQ ID NO: 183362 - DNA, 75 bp, Artificial Sequence
  Synthetic
tttgcttcttataaatgtaattttatggatgtttattcttagagaatatttggaacataagagacaagaaagaag

SEQ ID NO: 183363 - DNA, 75 bp, Artificial Sequence
  Synthetic
tttgcttcttataaatgtaatcttatggatgtttattcttagaaaatatttggaacataagagacaagaaagaag

SEQ ID NO: 183364 - DNA, 75 bp, Artificial Sequence
  Synthetic
tttgcttcttataaatgtaatcttatggatgtttattcttagataatatttggaacataagagacaagaaagaag

SEQ ID NO: 183365 - DNA, 75 bp, Artificial Sequence
  Synthetic
tttgcttcttataaatgtaatcttatggatgtttattcttagacaatatttggaacataagagacaagaaagaag

SEQ ID NO: 183366 - DNA, 75 bp, Artificial Sequence
  Synthetic
tttgcttcttataaatgtaatcttatggatgtttattcttagagaatatttggaacataagagacaagaaagaag

SEQ ID NO: 183367 - DNA, 75 bp, Artificial Sequence
  Synthetic
tttgcttcttataaatgtaatgttatggatgtttattcttagaaaatatttggaacataagagacaagaaagaag

SEQ ID NO: 183368 - DNA, 75 bp, Artificial Sequence
  Synthetic
tttgcttcttataaatgtaatgttatggatgtttattcttagataatatttggaacataagagacaagaaagaag

SEQ ID NO: 183369 - DNA, 75 bp, Artificial Sequence
  Synthetic
tttgcttcttataaatgtaatgttatggatgtttattcttagacaatatttggaacataagagacaagaaagaag

SEQ ID NO: 183370 - DNA, 75 bp, Artificial Sequence
  Synthetic
tttgcttcttataaatgtaatgttatggatgtttattcttagagaatatttggaacataagagacaagaaagaag

SEQ ID NO: 183371 - DNA, 75 bp, Artificial Sequence
  Synthetic
tgtccaaaggtcacttttgacccaattcctatacattattgtgctccagctggttatgcgattctaaagtgtaat

SEQ ID NO: 183372 - DNA, 75 bp, Artificial Sequence
  Synthetic
tctattgtgtacatcaaagaatagacataaaagacaccaaggaagctttagacaagatagaggaagagcaaaaca

SEQ ID NO: 183373 - DNA, 75 bp, Artificial Sequence
  Synthetic
gtacatagtcatgggtttgataaccccatgtttgagctctagccagttgtatgcaacagtctattctggagtgcc

SEQ ID NO: 183374 - DNA, 75 bp, Artificial Sequence
  Synthetic
cagatgaagtaaaaaattgtacttttaatatgaccacagaaataagagataagaagcagaaggtcactgcacttt

SEQ ID NO: 183375 - DNA, 75 bp, Artificial Sequence
  Synthetic
gtacaaatgaactgtacagacacaaactcaacagccaacgcatctaaaacagaaacagaagtccacatgaaacag

SEQ ID NO: 183376 - DNA, 75 bp, Artificial Sequence
  Synthetic
ggggaatgctactaataccaacaatagtagtgggggaacggtggagaaagaagaaataaaaaactgctctttcaa

SEQ ID NO: 183377 - DNA, 75 bp, Artificial Sequence
  Synthetic
tgtgagtttaatgtaaccacagttgtcaaagacaagaaagagaaaaaacaggctctattttatgtaacagatttg

SEQ ID NO: 183378 - DNA, 75 bp, Artificial Sequence
  Synthetic
aacccagattgtaagactattttaaaagcattaggaccagcagctacactagaagaaatgatgacagcatgtcag

SEQ ID NO: 183379 - DNA, 75 bp, Artificial Sequence
  Synthetic
cattacagtagttacttgtacacatggtatcaagccaacaataagtactcaactaatactaaatggaacactctc

SEQ ID NO: 183380 - DNA, 75 bp, Artificial Sequence
  Synthetic
gcaaaagaaaatagactggttaattgataggatagtagaaagagaagaggatagtggcaatgagagtgagggaga

SEQ ID NO: 183381 - DNA, 75 bp, Artificial Sequence
  Synthetic
atggtaactgaaaaattaagagaacaatatggggacaaaacaatattctttaaaaactcctcaggaggggaccaa

SEQ ID NO: 183382 - DNA, 75 bp, Artificial Sequence
  Synthetic
attacaatgcatcattttaattgtagaggggaatttttctattgcaatacaacacaactgtttaatagtacttgg

SEQ ID NO: 183383 - DNA, 75 bp, Artificial Sequence
  Synthetic
aatatggggacaaaacaatattctttaaaaactcctcaggaggggaccaagaggttacaatgcacagttttaatt

SEQ ID NO: 183384 - DNA, 75 bp, Artificial Sequence
  Synthetic
ggtgctttacaacgaagggcttaggcatctcctatggcaggaagaagcggagacagcgacacagaactcctcaaa

SEQ ID NO: 183385 - DNA, 75 bp, Artificial Sequence
  Synthetic
tacaatctatcagtacaacagataaggataggcccaatgtcctggtacagcgtgggcatagggagagacaatgca

SEQ ID NO: 183386 - DNA, 75 bp, Artificial Sequence
  Synthetic
agacagaaaatattagcataattttcagtaacagtgctggtggagatctagaggtagcctttttgcattttaact

SEQ ID NO: 183387 - DNA, 75 bp, Artificial Sequence
  Synthetic
agacagataatattagcataattttcagtaacagtgctggtggagatctagaggtagcctttttgcattttaact

SEQ ID NO: 183388 - DNA, 75 bp, Artificial Sequence
  Synthetic
agacagacaatattagcataattttcagtaacagtgctggtggagatctagaggtagcctttttgcattttaact

SEQ ID NO: 183389 - DNA, 75 bp, Artificial Sequence
  Synthetic
agacagagaatattagcataattttcagtaacagtgctggtggagatctagaggtagcctttttgcattttaact

SEQ ID NO: 183390 - DNA, 75 bp, Artificial Sequence
  Synthetic
tggaaaaataaaatggtagagcaaatgcataaagatataatcagtctatgggaccaaagcctaaagccatgtgta

SEQ ID NO: 183391 - DNA, 75 bp, Artificial Sequence
  Synthetic
gaggtagcctttttgcattttaactgtcatggagagttcttttattgtaacacatctgggatatttaattataac

SEQ ID NO: 183392 - DNA, 75 bp, Artificial Sequence
  Synthetic
gaccactatcaatgggaccacaatcaccaagagcatgacaggagaaataaaaaattgctctttcaatatgacaac

SEQ ID NO: 183393 - DNA, 75 bp, Artificial Sequence
  Synthetic
ggtcatggataaagggagggtcaggactctatgcccctcccatcaaaggtaacctaacatgtaggtcaaacataa

SEQ ID NO: 183394 - DNA, 75 bp, Artificial Sequence
  Synthetic
accatggggcagtaatatcacgaatgacacgacatttagaccagtagggggagatatggaagatatatggagaac

SEQ ID NO: 183395 - DNA, 75 bp, Artificial Sequence
  Synthetic
tccatggggcagtaatatcacgaatgacacgacatttagaccagtagggggagatatggaagatatatggagaac

SEQ ID NO: 183396 - DNA, 75 bp, Artificial Sequence
  Synthetic
cccatggggcagtaatatcacgaatgacacgacatttagaccagtagggggagatatggaagatatatggagaac

SEQ ID NO: 183397 - DNA, 75 bp, Artificial Sequence
  Synthetic
gccatggggcagtaatatcacgaatgacacgacatttagaccagtagggggagatatggaagatatatggagaac

SEQ ID NO: 183398 - DNA, 75 bp, Artificial Sequence
  Synthetic
tggaaaaggaaggaaaaatttcaagaattgggcctgaaaatccatacaatactccagtgtttgccataaagaaaa

SEQ ID NO: 183399 - DNA, 75 bp, Artificial Sequence
  Synthetic
gactttaaactgtactaatgccaccaataacagtcaggaaaagccaggggcaatgcaaaactgttctttcaatat

SEQ ID NO: 183400 - DNA, 75 bp, Artificial Sequence
  Synthetic
gaacccgacagacccgaaagaatcgaagaaggaggtggcgagcaaggcagagacagatccgtgcgattagtgagc

SEQ ID NO: 183401 - DNA, 75 bp, Artificial Sequence
  Synthetic
gcaattacacaaatcaaatatatgagctacttacagaatcgcagaaccagcaggaaaggaatgaaaaggatttgt

SEQ ID NO: 183402 - DNA, 75 bp, Artificial Sequence
  Synthetic
aactcaactgctgttgaatggcagtctagcagaagaagaaataatgattagatctgaaaatctcacaaataatgc

SEQ ID NO: 183403 - DNA, 75 bp, Artificial Sequence
  Synthetic
taattacatgaaaaactgctctttcaatatgaccacagaactaaaagataaaaagaaggaagagagggcattgtt

SEQ ID NO: 183404 - DNA, 75 bp, Artificial Sequence
  Synthetic
tgtacatatgggaccaggaaaagcattctatgcaggtgacatagtagggaatataagacaagcacattgtactgt

SEQ ID NO: 183405 - DNA, 75 bp, Artificial Sequence
  Synthetic
cagcagataaacaatgtaagctccatcatatatgatgaaatacaaaaggcacaagtacagcaggaacaaaatgag

SEQ ID NO: 183406 - DNA, 75 bp, Artificial Sequence
  Synthetic
aaggagtaggagcagtatctcaagatctagataaacatggagcagtaacaagtagtaatatgaataatgctgatt

SEQ ID NO: 183407 - DNA, 75 bp, Artificial Sequence
  Synthetic
tgatactataatcccatgcagaataaagcaaattatacgaatgtggcagagagtaggacaagcaatgtacgcccc

SEQ ID NO: 183408 - DNA, 75 bp, Artificial Sequence
  Synthetic
ccgcaggtacctctaagaccaatgacttttaagggagcttttgatcttagcttctttttaaaagaaaagggggga

SEQ ID NO: 183409 - DNA, 75 bp, Artificial Sequence
  Synthetic
acggaactcaggacaataatcttgtggatctaccgcctcttgagcaacttagcatcagggactcagagtgtgacc

SEQ ID NO: 183410 - DNA, 75 bp, Artificial Sequence
  Synthetic
acggatctcaggacaataatcttgtggatctaccgcctcttgagcaacttagcatcagggactcagagtgtgacc

SEQ ID NO: 183411 - DNA, 75 bp, Artificial Sequence
  Synthetic
acggacctcaggacaataatcttgtggatctaccgcctcttgagcaacttagcatcagggactcagagtgtgacc

SEQ ID NO: 183412 - DNA, 75 bp, Artificial Sequence
  Synthetic
acggagctcaggacaataatcttgtggatctaccgcctcttgagcaacttagcatcagggactcagagtgtgacc

SEQ ID NO: 183413 - DNA, 75 bp, Artificial Sequence
  Synthetic
taaacatggagcagtaacaagtactaatatgaataatgctgatagtgtctggctgagagcacaagaggaagaggg

SEQ ID NO: 183414 - DNA, 75 bp, Artificial Sequence
  Synthetic
agctattctccacatacctacaagaataagacagggctttgaaagggctttgctataagatgggtggcaagtggt

SEQ ID NO: 183415 - DNA, 75 bp, Artificial Sequence
  Synthetic
atagtgctacaaatctactagatacctttgcagtggcagtcggcaagtggactgacaacataatcttagggatac

SEQ ID NO: 183416 - DNA, 75 bp, Artificial Sequence
  Synthetic
gatctctacaatatttggcactgaaagcattagtaacaccaacaaagacaaggccacctttgcctagtgttagga

SEQ ID NO: 183417 - DNA, 75 bp, Artificial Sequence
  Synthetic
ggctagaagcacaagaggatgaggaggtgggttttccagtcaaacctcaggtacctttaagaccaatgacttaca

SEQ ID NO: 183418 - DNA, 75 bp, Artificial Sequence
  Synthetic
aaagaataggaagaggaattcttaacatcccaagaagaattagacagggcttagaaagaagcttattgtaacatg

SEQ ID NO: 183419 - DNA, 75 bp, Artificial Sequence
  Synthetic
aaagaataggaagaggaattcttaacatcccaagaagaattagactgggcttagaaagaagcttattgtaacatg

SEQ ID NO: 183420 - DNA, 75 bp, Artificial Sequence
  Synthetic
aaagaataggaagaggaattcttaacatcccaagaagaattagaccgggcttagaaagaagcttattgtaacatg

SEQ ID NO: 183421 - DNA, 75 bp, Artificial Sequence
  Synthetic
aaagaataggaagaggaattcttaacatcccaagaagaattagacggggcttagaaagaagcttattgtaacatg

SEQ ID NO: 183422 - DNA, 75 bp, Artificial Sequence
  Synthetic
aaagaataggaagaggaattcttaacatcccaagaagaattagtcagggcttagaaagaagcttattgtaacatg

SEQ ID NO: 183423 - DNA, 75 bp, Artificial Sequence
  Synthetic
aaagaataggaagaggaattcttaacatcccaagaagaattagtctgggcttagaaagaagcttattgtaacatg

SEQ ID NO: 183424 - DNA, 75 bp, Artificial Sequence
  Synthetic
aaagaataggaagaggaattcttaacatcccaagaagaattagtccgggcttagaaagaagcttattgtaacatg

SEQ ID NO: 183425 - DNA, 75 bp, Artificial Sequence
  Synthetic
aaagaataggaagaggaattcttaacatcccaagaagaattagtcggggcttagaaagaagcttattgtaacatg

SEQ ID NO: 183426 - DNA, 75 bp, Artificial Sequence
  Synthetic
aaagaataggaagaggaattcttaacatcccaagaagaattagccagggcttagaaagaagcttattgtaacatg

SEQ ID NO: 183427 - DNA, 75 bp, Artificial Sequence
  Synthetic
aaagaataggaagaggaattcttaacatcccaagaagaattagcctgggcttagaaagaagcttattgtaacatg

SEQ ID NO: 183428 - DNA, 75 bp, Artificial Sequence
  Synthetic
aaagaataggaagaggaattcttaacatcccaagaagaattagcccgggcttagaaagaagcttattgtaacatg

SEQ ID NO: 183429 - DNA, 75 bp, Artificial Sequence
  Synthetic
aaagaataggaagaggaattcttaacatcccaagaagaattagccggggcttagaaagaagcttattgtaacatg

SEQ ID NO: 183430 - DNA, 75 bp, Artificial Sequence
  Synthetic
aaagaataggaagaggaattcttaacatcccaagaagaattaggcagggcttagaaagaagcttattgtaacatg

SEQ ID NO: 183431 - DNA, 75 bp, Artificial Sequence
  Synthetic
aaagaataggaagaggaattcttaacatcccaagaagaattaggctgggcttagaaagaagcttattgtaacatg

SEQ ID NO: 183432 - DNA, 75 bp, Artificial Sequence
  Synthetic
aaagaataggaagaggaattcttaacatcccaagaagaattaggccgggcttagaaagaagcttattgtaacatg

SEQ ID NO: 183433 - DNA, 75 bp, Artificial Sequence
  Synthetic
aaagaataggaagaggaattcttaacatcccaagaagaattaggcggggcttagaaagaagcttattgtaacatg

SEQ ID NO: 183434 - DNA, 75 bp, Artificial Sequence
  Synthetic
cagcggctggcacaggaagcagcagcacagtcagccataattaccctatagtgcaaaatgcacaagggcaaatgg

SEQ ID NO: 183435 - DNA, 75 bp, Artificial Sequence
  Synthetic
agaataagacagggcttcgaaagggctttactataaaatgggaagcaagtggtcaaaaagcagtgtagtcggatg

SEQ ID NO: 183436 - DNA, 75 bp, Artificial Sequence
  Synthetic
taaaattggagacacgcagcaggcaatacaaaaactaaaggaagtgatggggagcaggaaacctgccggtgccgc

SEQ ID NO: 183437 - DNA, 75 bp, Artificial Sequence
  Synthetic
agcacaagaacaggaagaggaagtaggttttccagtcaggcctcaggtcccattaagaccaatgacttatgcagc

SEQ ID NO: 183438 - DNA, 75 bp, Artificial Sequence
  Synthetic
tagaagaaatgatgacagcatgtcagggagtgggaggacctagccataaagcaagagttttggctgaggcaatga

SEQ ID NO: 183439 - DNA, 75 bp, Artificial Sequence
  Synthetic
ataagggaaccaacaggaagtgacattgctggaacaactagcacccagcaagagcaagttcactggactactagg

SEQ ID NO: 183440 - DNA, 75 bp, Artificial Sequence
  Synthetic
gaaagaggaaagaatacgcgcttttctatagacttgatgtaataccaattaatgatgatagtagtaatagtacag

SEQ ID NO: 183441 - DNA, 75 bp, Artificial Sequence
  Synthetic
aaattgtaatgtctcaaccattaaacaggcttgtccaaaggtggattttgacccaatccccatacattattgtgc

SEQ ID NO: 183442 - DNA, 75 bp, Artificial Sequence
  Synthetic
agcagaccaactaattcatctgtattactttgattgtttttcagaatctgctataagaaatgccatattaggaca

SEQ ID NO: 183443 - DNA, 75 bp, Artificial Sequence
  Synthetic
gcggcggctggtgagtacgccaaattttatttgactagcggaggctagaaggagagagatgggtgcgagagcgtc

SEQ ID NO: 183444 - DNA, 75 bp, Artificial Sequence
  Synthetic
gtagaggtaaaggacaccaaggaagctttagagaagctagaggaagaacaaaacaaaagtcagcaaaagacacag

SEQ ID NO: 183445 - DNA, 75 bp, Artificial Sequence
  Synthetic
agaagagatgatggtagcctgtcagggagtaggaggaccaactcataaggccagaatactagcagaagcaatggc

SEQ ID NO: 183446 - DNA, 75 bp, Artificial Sequence
  Synthetic
tccctcaaatcactctttggcaacgaccccttgttacaataaaaataggaggacagctgaaagaagctctattag

SEQ ID NO: 183447 - DNA, 75 bp, Artificial Sequence
  Synthetic
agaagttattccagcagagacaggacaggaaacagcatactttcttttaaaattagcaggaagatggccagtaaa

SEQ ID NO: 183448 - DNA, 75 bp, Artificial Sequence
  Synthetic
aaagagggacatatagcaaaaaattgccgagcacctagaaaaaagggttgctggaaatgtggacaggaaggtcac

SEQ ID NO: 183449 - DNA, 75 bp, Artificial Sequence
  Synthetic
aggagttgaagctataataagaatattgcaacaactactgtttgttcatttcagaattgggtgcaatcatagcag

SEQ ID NO: 183450 - DNA, 75 bp, Artificial Sequence
  Synthetic
gcaagaaatggagccagtagatcctaaactagagccctggaaccatccaggaagtcagcctaaaactgcttgcaa

SEQ ID NO: 183451 - DNA, 75 bp, Artificial Sequence
  Synthetic
aaaagaaccagtacatggagtatattatgacccatcaaaagacttaatagctgaaatacagaaacaggggcatga

SEQ ID NO: 183452 - DNA, 75 bp, Artificial Sequence
  Synthetic
tacagatattagcaatagtagcattagtagtagcagcaatactagcaatagttgtgtggtccatagtattcatag

SEQ ID NO: 183453 - DNA, 75 bp, Artificial Sequence
  Synthetic
tgtgaatatcaatcaggacataaaaaggtagggtcgctacagtacttggcactagcagcactaacaaaaccaaaa

SEQ ID NO: 183454 - DNA, 75 bp, Artificial Sequence
  Synthetic
acatgacctggatacaatgggacagggaaattagcaattacacacaacaaatatacagcctaattgaagaatcgc

SEQ ID NO: 183455 - DNA, 75 bp, Artificial Sequence
  Synthetic
attggaataccactagtagcgggaatgctactaataccaccttggaacagatggcaaaagaagaaataaaaaact

SEQ ID NO: 183456 - DNA, 75 bp, Artificial Sequence
  Synthetic
acaatattaccaatgctaccatggaacccagggaggcggaaatgaaaaattgctctttcaatataaccacagaaa

SEQ ID NO: 183457 - DNA, 75 bp, Artificial Sequence
  Synthetic
gggaacccgacaggcccgaaagaatcgaagaagaaggtggagagcaagacaaagacagatccattcgattagtga

SEQ ID NO: 183458 - DNA, 75 bp, Artificial Sequence
  Synthetic
aatggacagtccaacccatccaattacctaacaaggatgtgtggacagtaaatgacatacagaaactcataggaa

SEQ ID NO: 183459 - DNA, 75 bp, Artificial Sequence
  Synthetic
ttaatataggaccagggagagcatggtatgcaacaacaaatataataggagatataagacaagcacattgtaaca

SEQ ID NO: 183460 - DNA, 75 bp, Artificial Sequence
  Synthetic
aaaagtataaggataggaccaggacaaacattctttgcaaataatgacataataggagacataagacaagcacat

SEQ ID NO: 183461 - DNA, 75 bp, Artificial Sequence
  Synthetic
gcactaatactactaatattaatggcactgataggggtatgataggagaaataaaaaactgctctttcaatatca

SEQ ID NO: 183462 - DNA, 75 bp, Artificial Sequence
  Synthetic
ccagggatatggcaattagattgcacacatctagaaggaaaagtcatcctggtagcagtccacgtggccagtgga

SEQ ID NO: 183463 - DNA, 75 bp, Artificial Sequence
  Synthetic
aaaacaaattataaacatgtggcaggaggtaggacgagcaatgtatgctcctcccattgcaggaaacataacatg

SEQ ID NO: 183464 - DNA, 75 bp, Artificial Sequence
  Synthetic
attatgacccatcaaaagacttaatagcagaaatacagaaacaagggcaagaccaatggacatatcaaatttatc

SEQ ID NO: 183465 - DNA, 75 bp, Artificial Sequence
  Synthetic
gtggacagagtattggcaggccacctggatccctgagtgggagtttgtcaatacccctcctctagtaaaattatg

SEQ ID NO: 183466 - DNA, 75 bp, Artificial Sequence
  Synthetic
agaacaggccagagccaacagccccacccgcagagagcttcgggttcggagaggagatagccccctccccgaagc

SEQ ID NO: 183467 - DNA, 75 bp, Artificial Sequence
  Synthetic
aacaacaatacaagaaaaagtatacatataggaccagggagagcattttatgcacaagacataataggagatata

SEQ ID NO: 183468 - DNA, 75 bp, Artificial Sequence
  Synthetic
tcattagggattatggaaaacagatggcaggtgatgattgtgtggcaggtagacaggatgaggattagaacatgg

SEQ ID NO: 183469 - DNA, 75 bp, Artificial Sequence
  Synthetic
aaaaatagacaggctaattaagagaatacaagaaagagcagaagacagtggcaatgaaagtgatggggatacaga

SEQ ID NO: 183470 - DNA, 75 bp, Artificial Sequence
  Synthetic
aaaaatagacaggctaattaagagaatacaagaaagagcagaagacagtggcaatgatagtgatggggatacaga

SEQ ID NO: 183471 - DNA, 75 bp, Artificial Sequence
  Synthetic
aaaaatagacaggctaattaagagaatacaagaaagagcagaagacagtggcaatgacagtgatggggatacaga

SEQ ID NO: 183472 - DNA, 75 bp, Artificial Sequence
  Synthetic
aaaaatagacaggctaattaagagaatacaagaaagagcagaagacagtggcaatgagagtgatggggatacaga

SEQ ID NO: 183473 - DNA, 75 bp, Artificial Sequence
  Synthetic
atagaatataggaaattgttaagacaaaaaagaatagactggttaattaaaagaattagggaaagagcagaagac

SEQ ID NO: 183474 - DNA, 75 bp, Artificial Sequence
  Synthetic
ctaactgaaacaacaaatcagaaggctgaattacaagcaattcagctagctttgcaggattcaggatcagaagta

SEQ ID NO: 183475 - DNA, 75 bp, Artificial Sequence
  Synthetic
ctgaattacaagcaattcagctagctttgcaggattcaggatcagaagtaaacatagtaacagactcacagtatg

SEQ ID NO: 183476 - DNA, 75 bp, Artificial Sequence
  Synthetic
gattatggaaaacagatggcaggtactgatagtatggcaagtggacagacagaaagtgaaagcgtggaacagcct

SEQ ID NO: 183477 - DNA, 75 bp, Artificial Sequence
  Synthetic
ctgatagtatggcaagtggacagacagaaagtgaaagcgtggaacagcctagtgaaataccataagtacaggtct

SEQ ID NO: 183478 - DNA, 75 bp, Artificial Sequence
  Synthetic
atagggttatagaagtagtacaaaggatttttaggggtatcctccatatacctagaagaataagacagggctttg

SEQ ID NO: 183479 - DNA, 75 bp, Artificial Sequence
  Synthetic
tgaccacatattggggattgatgccaggggaaagagaggaccagttgggacatggggttagtatagaatggcaat

SEQ ID NO: 183480 - DNA, 75 bp, Artificial Sequence
  Synthetic
tattagtttgcttgatactgtagcaatagcagtagctgagggaacagataggattatagtattcatacaaagaat

SEQ ID NO: 183481 - DNA, 75 bp, Artificial Sequence
  Synthetic
aatgttagtgttaccaatagtagtattcccaatgagaccatgagaaattgctctttcaatgtaaccacagaaata

SEQ ID NO: 183482 - DNA, 75 bp, Artificial Sequence
  Synthetic
aatctgaaaacaggaaaatatgcaaaaagggggtctgcccacactaatgatgtaaaacaattaacagaagtagtg

SEQ ID NO: 183483 - DNA, 75 bp, Artificial Sequence
  Synthetic
aatgtcagctaaaaggggaagccatgcatggacaggtagactgtagtccagggatatggcaattagattgtacac

SEQ ID NO: 183484 - DNA, 75 bp, Artificial Sequence
  Synthetic
cctagggcagagagtactgaccaagtgtgaataccctgcaggacatagtcaggtagggacactgcaactactagc

SEQ ID NO: 183485 - DNA, 75 bp, Artificial Sequence
  Synthetic
aagggaaagaataagaagagctgagccagcagcagagggagtaggagcagtatctcgagatttagaaagacatgg

SEQ ID NO: 183486 - DNA, 75 bp, Artificial Sequence
  Synthetic
ttactgtaaaatatgttgctggcattgccaaatatgctttctgaaaaaaggcttaggcatctcctatggcaggaa

SEQ ID NO: 183487 - DNA, 75 bp, Artificial Sequence
  Synthetic
gcttaggcatctcctatggcaggaagaagcggaagcaccgacgaggaactcctcagagcagtaaggatcatcaaa

SEQ ID NO: 183488 - DNA, 75 bp, Artificial Sequence
  Synthetic
gcaaaaaatgctgctatcattgctatgtttgtttcacaaagaagggtttgggaatctcctatggcaggaagaagc

SEQ ID NO: 183489 - DNA, 75 bp, Artificial Sequence
  Synthetic
ggaatctcctatggcaggaagaagcgacgacgaccggctactgcaagccatccagatcataaagatcctgtacca

SEQ ID NO: 183490 - DNA, 75 bp, Artificial Sequence
  Synthetic
ggggatacttgggcaggagtcgaagctctaataagaatactgcaacaactactgtttattcatttcagaattggg

SEQ ID NO: 183491 - DNA, 75 bp, Artificial Sequence
  Synthetic
aagagtagtggggttggatggtctactataagggagaaaatgagacgagctgagccagcagcagaaggggcagca

SEQ ID NO: 183492 - DNA, 75 bp, Artificial Sequence
  Synthetic
atttagaacaaaagagacaagacagaagagaaagagaaatacttgaaaggataaggaaaataagggaaattaggg

SEQ ID NO: 183493 - DNA, 75 bp, Artificial Sequence
  Synthetic
gaatgatactaatatcaataggacaatagaaggaggagaaataaaaaactgttctttcaatataaccacaagcat

SEQ ID NO: 183494 - DNA, 75 bp, Artificial Sequence
  Synthetic
tgtatgcaacaatctatgctggggtgcctgtatgggaagatgcagcaccagtattattttgtgcttcagatgcta

SEQ ID NO: 183495 - DNA, 75 bp, Artificial Sequence
  Synthetic
gtattattttgtgcttcagatgctaacctaacaagccaggaacagcataatgtttgggcagcacaagcatgtgtt

SEQ ID NO: 183496 - DNA, 75 bp, Artificial Sequence
  Synthetic
tgttgaatttactagcaagagtagattatagattaggagtaggagctctgataatagcactaatcatagcaatag

SEQ ID NO: 183497 - DNA, 75 bp, Artificial Sequence
  Synthetic
aggaatttggggttgctctggaaaactcatctgcaccactaatgtgccctggaactctagttggagtaataaatc

SEQ ID NO: 183498 - DNA, 75 bp, Artificial Sequence
  Synthetic
gaacaggaccatgtacaaatgtcagtacagtacaatgtacacatggaattaggccagtagtatcaactcaactgc

SEQ ID NO: 183499 - DNA, 75 bp, Artificial Sequence
  Synthetic
cagataggattatagaagtagtacaaagaacttgtagagctattcgccacatacctagaagaataagacagggct

SEQ ID NO: 183500 - DNA, 75 bp, Artificial Sequence
  Synthetic
tgtgtacaaatgaattgtacagaccataatacaacagacatgaaaaactgtgagtttaatgcaaccactgtagtc

SEQ ID NO: 183501 - DNA, 75 bp, Artificial Sequence
  Synthetic
tagtacagctaaatgaatctgtagaaattaattgtacaagacccaacaacaatacaagaaaaagtatacatatag

SEQ ID NO: 183502 - DNA, 75 bp, Artificial Sequence
  Synthetic
tttattagcattggacaaatggcaaaatctgtggaattggtttgacataacaaattggctatggtatataaaaat

SEQ ID NO: 183503 - DNA, 75 bp, Artificial Sequence
  Synthetic
ggaaaaacatggagcaatcacaagtagcaatacagcagctactaatgctgattgtgcctggctagaagcacaaga

SEQ ID NO: 183504 - DNA, 75 bp, Artificial Sequence
  Synthetic
gccatattaggacaagtagttagacgtaggtgtgaatatccatcaggacataacaaggtaggatccctacaatat

SEQ ID NO: 183505 - DNA, 75 bp, Artificial Sequence
  Synthetic
ttaaatgggacaatctctaagggaaaaataagaatgatggcaaaaaatattacagacaatacgaaaaatatccta

SEQ ID NO: 183506 - DNA, 75 bp, Artificial Sequence
  Synthetic
catagtatatatagaatataggaaattggtaaaacaaagaaaaatagactggttaattaaaagaattagggaaag

SEQ ID NO: 183507 - DNA, 75 bp, Artificial Sequence
  Synthetic
cgcaatcagggaataacagctcaagggaagctcattgccggtataatcccactgattgggaaagagcactaaaac

SEQ ID NO: 183508 - DNA, 75 bp, Artificial Sequence
  Synthetic
tatacaaataggaccaggacgagcattttatgcaacaggagatataataggagacatcagaaaggcacattgtaa

SEQ ID NO: 183509 - DNA, 75 bp, Artificial Sequence
  Synthetic
gttacattttaattgccatggagaattcttttattgtgacacagggaaaatgtttaattataccctggaatgtaa

SEQ ID NO: 183510 - DNA, 75 bp, Artificial Sequence
  Synthetic
cagcacagtacaatgcacacatggaatcaagccagtagtatcaactcagctgctgttaaatggcagtctagcaga

SEQ ID NO: 183511 - DNA, 75 bp, Artificial Sequence
  Synthetic
caggctgaaacagatggtaaggtcatgggcaacaggagggtcaggaatctatgcacctcccatccaaggcaatct

SEQ ID NO: 183512 - DNA, 75 bp, Artificial Sequence
  Synthetic
gaaaatactaaggcaaagaaaaatagacaggttaattgagagaataagagaaagagcagaagacagtggaaatga

SEQ ID NO: 183513 - DNA, 75 bp, Artificial Sequence
  Synthetic
aatgttaccaacaataatgatactacctacaatattgaagaaatgaggaattgctctttcaatataaccacagaa

SEQ ID NO: 183514 - DNA, 75 bp, Artificial Sequence
  Synthetic
aacaatacaaggaaaagtgtacgtataggaccaggacaagcattatatgtaacaggtggcataataggggatata

SEQ ID NO: 183515 - DNA, 75 bp, Artificial Sequence
  Synthetic
aagggcatagtgcaacagcaggacaacctgctaagagcaatacaggcccagcaacacttgctgaggctgtctgta

SEQ ID NO: 183516 - DNA, 75 bp, Artificial Sequence
  Synthetic
cagtacaatgtacacatggaattaagccagtggtatcaactcaactactgctgaatggcagtttagcagaaggag

SEQ ID NO: 183517 - DNA, 75 bp, Artificial Sequence
  Synthetic
gttacacatcagtaaaatggaatgactcatggacaggaaatgaaagcatttggaacaacctaacatggcaacaat

SEQ ID NO: 183518 - DNA, 75 bp, Artificial Sequence
  Synthetic
gaattaagccagtggtatcaactcaattgctgttaaatggcagtctagcagaagaagagataataatcagatctg

SEQ ID NO: 183519 - DNA, 75 bp, Artificial Sequence
  Synthetic
aaaatctcacagacaatgccaaaaccataatagtgcaccttaataaatctgtagaaatcaattgtaccagaccct

SEQ ID NO: 183520 - DNA, 75 bp, Artificial Sequence
  Synthetic
tgggacgcagcagtctcaagggactgagactggggtgggaaggcctcaaatatctggggaatcttctgttgtatt

SEQ ID NO: 183521 - DNA, 75 bp, Artificial Sequence
  Synthetic
tgtgccttggaactccagttggagtaataaatctcaaacagatatttgggataacatgacctggatgcagtggga

SEQ ID NO: 183522 - DNA, 75 bp, Artificial Sequence
  Synthetic
gtctgggacgacctgaggaacctgtgcctcttcagctaccgccacttgagagacttcatattaattgcagcgagg

SEQ ID NO: 183523 - DNA, 75 bp, Artificial Sequence
  Synthetic
ccagcaggaaaagaatgaacaagacttattggcattggacaagtgggcaaatctgtggagttggtttgacatatc

SEQ ID NO: 183524 - DNA, 75 bp, Artificial Sequence
  Synthetic
taacacaatactggctacaagaattgcagaatagtgctacaagtcttctagatacatttgcagtggcagtagcca

SEQ ID NO: 183525 - DNA, 75 bp, Artificial Sequence
  Synthetic
attggactgacggcataatctcaggaatacaaagaataggaagaggaattcgtaacatcccaaggagaattagac

SEQ ID NO: 183526 - DNA, 75 bp, Artificial Sequence
  Synthetic
agggcttagaaagaagtttattgtaacaatgggaaacgtattaggaaaaagcaagtacgatggatgggcatcagt

SEQ ID NO: 183527 - DNA, 75 bp, Artificial Sequence
  Synthetic
tgcattcctagaaagtcaccaagatgaagaagtaggttttccagtaaggcctcaagtacccctaagaccaatgac

SEQ ID NO: 183528 - DNA, 75 bp, Artificial Sequence
  Synthetic
ttcttagcacttgcctgggacgacctgcggagcctgtgccttttcagttaccaccgattgagagacttcatattg

SEQ ID NO: 183529 - DNA, 75 bp, Artificial Sequence
  Synthetic
tagtgctatttctttgcttgatgctacagcaatagcagtagcggggtggacagatagggttatagaagtagcaca

SEQ ID NO: 183530 - DNA, 75 bp, Artificial Sequence
  Synthetic
tagtgctattaatttgcttgatacaacagcaatagcagtagctaactggacagatagggttatagaaatagtaca

SEQ ID NO: 183531 - DNA, 75 bp, Artificial Sequence
  Synthetic
cattaggagcaggagctacattagaggaaatgatgacagcatgccagggagtgggaggacctagccataaagcaa

SEQ ID NO: 183532 - DNA, 75 bp, Artificial Sequence
  Synthetic
gctgattgtgtggcaggtagacaggatgaagatcagaacatggaatagtttagtaaagcaccacatgtatgtttc

SEQ ID NO: 183533 - DNA, 75 bp, Artificial Sequence
  Synthetic
gattgtaagaccattttaaaagcattaggaccaggggctacactagaagaaatgatgacagcatgtcagggagtg

SEQ ID NO: 183534 - DNA, 75 bp, Artificial Sequence
  Synthetic
aactcaggaagtaaaaaattggatgacagaaaccctgcttgttcaaaatgccaacccagattgcaaacagatttt

SEQ ID NO: 183535 - DNA, 75 bp, Artificial Sequence
  Synthetic
aagtgatatagcaggaactactagtacccttcaggaacaaataggatggatgacaagcaatccacctatcccagt

SEQ ID NO: 183536 - DNA, 75 bp, Artificial Sequence
  Synthetic
ataggaaattggcaagacaaagaaaaatagataagataattaaaagaattagggaaagagcagaagacagtggca

SEQ ID NO: 183537 - DNA, 75 bp, Artificial Sequence
  Synthetic
catcactgttgctaacatcactaacaccccatttgataacttgacaaggatagagcaaggggaaataaaaaactg

SEQ ID NO: 183538 - DNA, 75 bp, Artificial Sequence
  Synthetic
catatgagaaagaagtgcataatgtctgggctacacatgcctgtgtaccaacagaccccaacccacaagaaatag

SEQ ID NO: 183539 - DNA, 75 bp, Artificial Sequence
  Synthetic
ctatcaaagcagtaagtagtacatgtaatgcaatctttacaaatattagcaatagtagcattagtagtagcagca

SEQ ID NO: 183540 - DNA, 75 bp, Artificial Sequence
  Synthetic
ccagcaacaacacaagaaaaggtataaatataggaccagggagagcatggtatacaacaggagaggtaacagggg

SEQ ID NO: 183541 - DNA, 75 bp, Artificial Sequence
  Synthetic
tctctatcaaaacagtaagtagtacatgtaatgcaacctctagaaatattagcaatagtagcattagtagtagca

SEQ ID NO: 183542 - DNA, 75 bp, Artificial Sequence
  Synthetic
catcaaaaggaacctccatttctgtggatggggtatgagctccatccagacaaatggacagtacagcccatccaa

SEQ ID NO: 183543 - DNA, 75 bp, Artificial Sequence
  Synthetic
taaatgatatacaaaagctagtaggaaaattaaattgggcaagtcaaatttatccaggaatcagagtaagagaat

SEQ ID NO: 183544 - DNA, 75 bp, Artificial Sequence
  Synthetic
aattaattgtacaagacccagcaataatacaagaagaagtgtaaggataggaccaggacaagtattctatacaaa

SEQ ID NO: 183545 - DNA, 75 bp, Artificial Sequence
  Synthetic
aatacaagaagaagtgtaaggataggaccaggacaagtattctatacaaatgacataataggagacataaggcaa

SEQ ID NO: 183546 - DNA, 75 bp, Artificial Sequence
  Synthetic
ccagaagaccaggggccgcagagggaaccatacaatgaatggacactagagcttctagaggaactcaaacaggaa

SEQ ID NO: 183547 - DNA, 75 bp, Artificial Sequence
  Synthetic
gaaacttgggaaacatggtgggcggactattggcaagccacctggattccagaatgggaatttgtcagcacaccc

SEQ ID NO: 183548 - DNA, 75 bp, Artificial Sequence
  Synthetic
ccagataagagtgaatcagagttagtcaatcaaataatagagcaattaataaaaaaggaaaaggtctacctgtca

SEQ ID NO: 183549 - DNA, 75 bp, Artificial Sequence
  Synthetic
aggcaggatatgttacagaacaagggaaacagaaaataataaaattagaggagaccaccaatcaaaaggctgaat

SEQ ID NO: 183550 - DNA, 75 bp, Artificial Sequence
  Synthetic
ggctctagaaagatacctaaaggatcaacagctcctagggctttggggctgctctggaaaactcatctgcaccac

SEQ ID NO: 183551 - DNA, 75 bp, Artificial Sequence
  Synthetic
agaaggaatagaccaggcacaagaagatcatgaaaaatatcatagcaattggagagcattagctagtgattttgg

SEQ ID NO: 183552 - DNA, 75 bp, Artificial Sequence
  Synthetic
tgaaggaatagaccaggcacaagaagatcatgaaaaatatcatagcaattggagagcattagctagtgattttgg

SEQ ID NO: 183553 - DNA, 75 bp, Artificial Sequence
  Synthetic
cgaaggaatagaccaggcacaagaagatcatgaaaaatatcatagcaattggagagcattagctagtgattttgg

SEQ ID NO: 183554 - DNA, 75 bp, Artificial Sequence
  Synthetic
ggaaggaatagaccaggcacaagaagatcatgaaaaatatcatagcaattggagagcattagctagtgattttgg

SEQ ID NO: 183555 - DNA, 75 bp, Artificial Sequence
  Synthetic
atataaaaggggaagcaactcatggtcaggtagactacagtccagaagtatggcaaatagattgcacacatttag

SEQ ID NO: 183556 - DNA, 75 bp, Artificial Sequence
  Synthetic
tggcaaatagattgcacacatttagaaggaaaaatcataatagttgctgtccatgtggcaagtggattcatagaa

SEQ ID NO: 183557 - DNA, 75 bp, Artificial Sequence
  Synthetic
tggcaaatagattgcacacatttagaaggtaaaatcataatagttgctgtccatgtggcaagtggattcatagaa

SEQ ID NO: 183558 - DNA, 75 bp, Artificial Sequence
  Synthetic
tggcaaatagattgcacacatttagaaggcaaaatcataatagttgctgtccatgtggcaagtggattcatagaa

SEQ ID NO: 183559 - DNA, 75 bp, Artificial Sequence
  Synthetic
tggcaaatagattgcacacatttagaagggaaaatcataatagttgctgtccatgtggcaagtggattcatagaa

SEQ ID NO: 183560 - DNA, 75 bp, Artificial Sequence
  Synthetic
aatgtctgggctacacatgcctgtgtacccacagaccccaacccacaagaaatacatctggaaaatgtgacagaa

SEQ ID NO: 183561 - DNA, 75 bp, Artificial Sequence
  Synthetic
ccggggaattttcctcagagcagaccagagccaacagccccaccagcagaaaactgggggatgggggaagagata

SEQ ID NO: 183562 - DNA, 75 bp, Artificial Sequence
  Synthetic
actgcagaaatattacctacaataatgttaccattaagggtaatgataccattgaagaaatgaaaagttgctctt

SEQ ID NO: 183563 - DNA, 75 bp, Artificial Sequence
  Synthetic
cgaagcaggagcagaaagacaaggaacatcctcctcctttagtttccctcaaatcactctttggcaacgacccct

SEQ ID NO: 183564 - DNA, 75 bp, Artificial Sequence
  Synthetic
ctgctctttcaatatgaccacagaattaagggataagaaaaagaaagtatattcacttttttatagacttgatat

SEQ ID NO: 183565 - DNA, 75 bp, Artificial Sequence
  Synthetic
accaaaaaggataaggccacctctgcctagtgttaagaaattaacagaagatagatggaacaagccccagaaggt

SEQ ID NO: 183566 - DNA, 75 bp, Artificial Sequence
  Synthetic
atgctgttagtgccaagaagaaaagcaaagatcattagggattatggaaaacagatggcaggtgatgattgtgtg

SEQ ID NO: 183567 - DNA, 75 bp, Artificial Sequence
  Synthetic
aggtttaagaatagtttttactgtactttctatagtaaatagagttaggcagggatattcaccattatcgtttca

SEQ ID NO: 183568 - DNA, 75 bp, Artificial Sequence
  Synthetic
taataggggatataagacaagcatattgtaatgtcagtagatcagaatggaataaaactttacaacaggtagcta

SEQ ID NO: 183569 - DNA, 75 bp, Artificial Sequence
  Synthetic
gaattagggaaagagcagaagatagtggcaatgagagtgagggggatactgaggaattggccacaatggtggata

SEQ ID NO: 183570 - DNA, 75 bp, Artificial Sequence
  Synthetic
gaaaagcagggtatgtcactgacagaggaagacaaaaggtagtttccctaactgagacaacaaatcaaaagactg

SEQ ID NO: 183571 - DNA, 75 bp, Artificial Sequence
  Synthetic
tctcgagacttggaaaaacatggagcaatcacaagtagcaatacagcagctactaatgctgattgtgcctggcta

SEQ ID NO: 183572 - DNA, 75 bp, Artificial Sequence
  Synthetic
tggaaagggcacctgaggatcacggaccagctagagagccattcaatgaatgggtactagagaccctagaagagc

SEQ ID NO: 183573 - DNA, 75 bp, Artificial Sequence
  Synthetic
gaaagagcagaagacagtggaaatgagagtgaaggagacacagatgaattggccaaactggtggaaatgggggac

SEQ ID NO: 183574 - DNA, 75 bp, Artificial Sequence
  Synthetic
gtggcgccggaccagggccttgaaaaggaaataagaaccggaggacctctctggccccaggactgggcttctgga

SEQ ID NO: 183575 - DNA, 75 bp, Artificial Sequence
  Synthetic
tagtgagtatatattaataaattgcaatacctcaaccataacacaagcctgtccaaaggtctcttttgacccaat

SEQ ID NO: 183576 - DNA, 75 bp, Artificial Sequence
  Synthetic
aatacctcaaccataacacaagcctgtccaaaggtctcttttgacccaattcctatacattattgtgctccagct

SEQ ID NO: 183577 - DNA, 75 bp, Artificial Sequence
  Synthetic
tatcattgctatgtttgtttcacaagaaagggtttgggaatctcctatggcaggaagaagtacagacgaagagct

SEQ ID NO: 183578 - DNA, 75 bp, Artificial Sequence
  Synthetic
aatgaaaaggagttattagcattggacaagtggcaaaatctgtggagttggtttagcataacaaactggctgtgg

SEQ ID NO: 183579 - DNA, 75 bp, Artificial Sequence
  Synthetic
aagatacctaaaggatcaacagctcctaggaatttggggttgctctggaaaactcatctgcaccactaatgtgcc

SEQ ID NO: 183580 - DNA, 75 bp, Artificial Sequence
  Synthetic
gtttagcataacaaactggctgtggtatataaaaatatttataatgatagtaggaggcttgataggtttaagaat

SEQ ID NO: 183581 - DNA, 75 bp, Artificial Sequence
  Synthetic
tgaatataaatgtaattctatggatgtttattcttagacaataattaaaaaatacgaaacaagacagaagggaaa

SEQ ID NO: 183582 - DNA, 75 bp, Artificial Sequence
  Synthetic
tgaatataaatgtaattctatggatgtttattcttagacaataatttaaaaatacgaaacaagacagaagggaaa

SEQ ID NO: 183583 - DNA, 75 bp, Artificial Sequence
  Synthetic
tgaatataaatgtaattctatggatgtttattcttagacaataattcaaaaatacgaaacaagacagaagggaaa

SEQ ID NO: 183584 - DNA, 75 bp, Artificial Sequence
  Synthetic
tgaatataaatgtaattctatggatgtttattcttagacaataattgaaaaatacgaaacaagacagaagggaaa

SEQ ID NO: 183585 - DNA, 75 bp, Artificial Sequence
  Synthetic
tgaatataaatgtaattctatggatgtttattcttagacaatatttaaaaaatacgaaacaagacagaagggaaa

SEQ ID NO: 183586 - DNA, 75 bp, Artificial Sequence
  Synthetic
tgaatataaatgtaattctatggatgtttattcttagacaatattttaaaaatacgaaacaagacagaagggaaa

SEQ ID NO: 183587 - DNA, 75 bp, Artificial Sequence
  Synthetic
tgaatataaatgtaattctatggatgtttattcttagacaatatttcaaaaatacgaaacaagacagaagggaaa

SEQ ID NO: 183588 - DNA, 75 bp, Artificial Sequence
  Synthetic
tgaatataaatgtaattctatggatgtttattcttagacaatatttgaaaaatacgaaacaagacagaagggaaa

SEQ ID NO: 183589 - DNA, 75 bp, Artificial Sequence
  Synthetic
tgaatataaatgtaattctatggatgtttattcttagacaatacttaaaaaatacgaaacaagacagaagggaaa

SEQ ID NO: 183590 - DNA, 75 bp, Artificial Sequence
  Synthetic
tgaatataaatgtaattctatggatgtttattcttagacaatactttaaaaatacgaaacaagacagaagggaaa

SEQ ID NO: 183591 - DNA, 75 bp, Artificial Sequence
  Synthetic
tgaatataaatgtaattctatggatgtttattcttagacaatacttcaaaaatacgaaacaagacagaagggaaa

SEQ ID NO: 183592 - DNA, 75 bp, Artificial Sequence
  Synthetic
tgaatataaatgtaattctatggatgtttattcttagacaatacttgaaaaatacgaaacaagacagaagggaaa

SEQ ID NO: 183593 - DNA, 75 bp, Artificial Sequence
  Synthetic
tgaatataaatgtaattctatggatgtttattcttagacaatagttaaaaaatacgaaacaagacagaagggaaa

SEQ ID NO: 183594 - DNA, 75 bp, Artificial Sequence
  Synthetic
tgaatataaatgtaattctatggatgtttattcttagacaatagtttaaaaatacgaaacaagacagaagggaaa

SEQ ID NO: 183595 - DNA, 75 bp, Artificial Sequence
  Synthetic
tgaatataaatgtaattctatggatgtttattcttagacaatagttcaaaaatacgaaacaagacagaagggaaa

SEQ ID NO: 183596 - DNA, 75 bp, Artificial Sequence
  Synthetic
tgaatataaatgtaattctatggatgtttattcttagacaatagttgaaaaatacgaaacaagacagaagggaaa

SEQ ID NO: 183597 - DNA, 75 bp, Artificial Sequence
  Synthetic
tgattataaatgtaattctatggatgtttattcttagacaataattaaaaaatacgaaacaagacagaagggaaa

SEQ ID NO: 183598 - DNA, 75 bp, Artificial Sequence
  Synthetic
tgattataaatgtaattctatggatgtttattcttagacaataatttaaaaatacgaaacaagacagaagggaaa

SEQ ID NO: 183599 - DNA, 75 bp, Artificial Sequence
  Synthetic
tgattataaatgtaattctatggatgtttattcttagacaataattcaaaaatacgaaacaagacagaagggaaa

SEQ ID NO: 183600 - DNA, 75 bp, Artificial Sequence
  Synthetic
tgattataaatgtaattctatggatgtttattcttagacaataattgaaaaatacgaaacaagacagaagggaaa

SEQ ID NO: 183601 - DNA, 75 bp, Artificial Sequence
  Synthetic
tgattataaatgtaattctatggatgtttattcttagacaatatttaaaaaatacgaaacaagacagaagggaaa

SEQ ID NO: 183602 - DNA, 75 bp, Artificial Sequence
  Synthetic
tgattataaatgtaattctatggatgtttattcttagacaatattttaaaaatacgaaacaagacagaagggaaa

SEQ ID NO: 183603 - DNA, 75 bp, Artificial Sequence
  Synthetic
tgattataaatgtaattctatggatgtttattcttagacaatatttcaaaaatacgaaacaagacagaagggaaa

SEQ ID NO: 183604 - DNA, 75 bp, Artificial Sequence
  Synthetic
tgattataaatgtaattctatggatgtttattcttagacaatatttgaaaaatacgaaacaagacagaagggaaa

SEQ ID NO: 183605 - DNA, 75 bp, Artificial Sequence
  Synthetic
tgattataaatgtaattctatggatgtttattcttagacaatacttaaaaaatacgaaacaagacagaagggaaa

SEQ ID NO: 183606 - DNA, 75 bp, Artificial Sequence
  Synthetic
tgattataaatgtaattctatggatgtttattcttagacaatactttaaaaatacgaaacaagacagaagggaaa

SEQ ID NO: 183607 - DNA, 75 bp, Artificial Sequence
  Synthetic
tgattataaatgtaattctatggatgtttattcttagacaatacttcaaaaatacgaaacaagacagaagggaaa

SEQ ID NO: 183608 - DNA, 75 bp, Artificial Sequence
  Synthetic
tgattataaatgtaattctatggatgtttattcttagacaatacttgaaaaatacgaaacaagacagaagggaaa

SEQ ID NO: 183609 - DNA, 75 bp, Artificial Sequence
  Synthetic
tgattataaatgtaattctatggatgtttattcttagacaatagttaaaaaatacgaaacaagacagaagggaaa

SEQ ID NO: 183610 - DNA, 75 bp, Artificial Sequence
  Synthetic
tgattataaatgtaattctatggatgtttattcttagacaatagtttaaaaatacgaaacaagacagaagggaaa

SEQ ID NO: 183611 - DNA, 75 bp, Artificial Sequence
  Synthetic
tgattataaatgtaattctatggatgtttattcttagacaatagttcaaaaatacgaaacaagacagaagggaaa

SEQ ID NO: 183612 - DNA, 75 bp, Artificial Sequence
  Synthetic
tgattataaatgtaattctatggatgtttattcttagacaatagttgaaaaatacgaaacaagacagaagggaaa

SEQ ID NO: 183613 - DNA, 75 bp, Artificial Sequence
  Synthetic
tgactataaatgtaattctatggatgtttattcttagacaataattaaaaaatacgaaacaagacagaagggaaa

SEQ ID NO: 183614 - DNA, 75 bp, Artificial Sequence
  Synthetic
tgactataaatgtaattctatggatgtttattcttagacaataatttaaaaatacgaaacaagacagaagggaaa

SEQ ID NO: 183615 - DNA, 75 bp, Artificial Sequence
  Synthetic
tgactataaatgtaattctatggatgtttattcttagacaataattcaaaaatacgaaacaagacagaagggaaa

SEQ ID NO: 183616 - DNA, 75 bp, Artificial Sequence
  Synthetic
tgactataaatgtaattctatggatgtttattcttagacaataattgaaaaatacgaaacaagacagaagggaaa

SEQ ID NO: 183617 - DNA, 75 bp, Artificial Sequence
  Synthetic
tgactataaatgtaattctatggatgtttattcttagacaatatttaaaaaatacgaaacaagacagaagggaaa

SEQ ID NO: 183618 - DNA, 75 bp, Artificial Sequence
  Synthetic
tgactataaatgtaattctatggatgtttattcttagacaatattttaaaaatacgaaacaagacagaagggaaa

SEQ ID NO: 183619 - DNA, 75 bp, Artificial Sequence
  Synthetic
tgactataaatgtaattctatggatgtttattcttagacaatatttcaaaaatacgaaacaagacagaagggaaa

SEQ ID NO: 183620 - DNA, 75 bp, Artificial Sequence
  Synthetic
tgactataaatgtaattctatggatgtttattcttagacaatatttgaaaaatacgaaacaagacagaagggaaa

SEQ ID NO: 183621 - DNA, 75 bp, Artificial Sequence
  Synthetic
tgactataaatgtaattctatggatgtttattcttagacaatacttaaaaaatacgaaacaagacagaagggaaa

SEQ ID NO: 183622 - DNA, 75 bp, Artificial Sequence
  Synthetic
tgactataaatgtaattctatggatgtttattcttagacaatactttaaaaatacgaaacaagacagaagggaaa

SEQ ID NO: 183623 - DNA, 75 bp, Artificial Sequence
  Synthetic
tgactataaatgtaattctatggatgtttattcttagacaatacttcaaaaatacgaaacaagacagaagggaaa

SEQ ID NO: 183624 - DNA, 75 bp, Artificial Sequence
  Synthetic
tgactataaatgtaattctatggatgtttattcttagacaatacttgaaaaatacgaaacaagacagaagggaaa

SEQ ID NO: 183625 - DNA, 75 bp, Artificial Sequence
  Synthetic
tgactataaatgtaattctatggatgtttattcttagacaatagttaaaaaatacgaaacaagacagaagggaaa

SEQ ID NO: 183626 - DNA, 75 bp, Artificial Sequence
  Synthetic
tgactataaatgtaattctatggatgtttattcttagacaatagtttaaaaatacgaaacaagacagaagggaaa

SEQ ID NO: 183627 - DNA, 75 bp, Artificial Sequence
  Synthetic
tgactataaatgtaattctatggatgtttattcttagacaatagttcaaaaatacgaaacaagacagaagggaaa

SEQ ID NO: 183628 - DNA, 75 bp, Artificial Sequence
  Synthetic
tgactataaatgtaattctatggatgtttattcttagacaatagttgaaaaatacgaaacaagacagaagggaaa

SEQ ID NO: 183629 - DNA, 75 bp, Artificial Sequence
  Synthetic
tgagtataaatgtaattctatggatgtttattcttagacaataattaaaaaatacgaaacaagacagaagggaaa

SEQ ID NO: 183630 - DNA, 75 bp, Artificial Sequence
  Synthetic
tgagtataaatgtaattctatggatgtttattcttagacaataatttaaaaatacgaaacaagacagaagggaaa

SEQ ID NO: 183631 - DNA, 75 bp, Artificial Sequence
  Synthetic
tgagtataaatgtaattctatggatgtttattcttagacaataattcaaaaatacgaaacaagacagaagggaaa

SEQ ID NO: 183632 - DNA, 75 bp, Artificial Sequence
  Synthetic
tgagtataaatgtaattctatggatgtttattcttagacaataattgaaaaatacgaaacaagacagaagggaaa

SEQ ID NO: 183633 - DNA, 75 bp, Artificial Sequence
  Synthetic
tgagtataaatgtaattctatggatgtttattcttagacaatatttaaaaaatacgaaacaagacagaagggaaa

SEQ ID NO: 183634 - DNA, 75 bp, Artificial Sequence
  Synthetic
tgagtataaatgtaattctatggatgtttattcttagacaatattttaaaaatacgaaacaagacagaagggaaa

SEQ ID NO: 183635 - DNA, 75 bp, Artificial Sequence
  Synthetic
tgagtataaatgtaattctatggatgtttattcttagacaatatttcaaaaatacgaaacaagacagaagggaaa

SEQ ID NO: 183636 - DNA, 75 bp, Artificial Sequence
  Synthetic
tgagtataaatgtaattctatggatgtttattcttagacaatatttgaaaaatacgaaacaagacagaagggaaa

SEQ ID NO: 183637 - DNA, 75 bp, Artificial Sequence
  Synthetic
tgagtataaatgtaattctatggatgtttattcttagacaatacttaaaaaatacgaaacaagacagaagggaaa

SEQ ID NO: 183638 - DNA, 75 bp, Artificial Sequence
  Synthetic
tgagtataaatgtaattctatggatgtttattcttagacaatactttaaaaatacgaaacaagacagaagggaaa

SEQ ID NO: 183639 - DNA, 75 bp, Artificial Sequence
  Synthetic
tgagtataaatgtaattctatggatgtttattcttagacaatacttcaaaaatacgaaacaagacagaagggaaa

SEQ ID NO: 183640 - DNA, 75 bp, Artificial Sequence
  Synthetic
tgagtataaatgtaattctatggatgtttattcttagacaatacttgaaaaatacgaaacaagacagaagggaaa

SEQ ID NO: 183641 - DNA, 75 bp, Artificial Sequence
  Synthetic
tgagtataaatgtaattctatggatgtttattcttagacaatagttaaaaaatacgaaacaagacagaagggaaa

SEQ ID NO: 183642 - DNA, 75 bp, Artificial Sequence
  Synthetic
tgagtataaatgtaattctatggatgtttattcttagacaatagtttaaaaatacgaaacaagacagaagggaaa

SEQ ID NO: 183643 - DNA, 75 bp, Artificial Sequence
  Synthetic
tgagtataaatgtaattctatggatgtttattcttagacaatagttcaaaaatacgaaacaagacagaagggaaa

SEQ ID NO: 183644 - DNA, 75 bp, Artificial Sequence
  Synthetic
tgagtataaatgtaattctatggatgtttattcttagacaatagttgaaaaatacgaaacaagacagaagggaaa

SEQ ID NO: 183645 - DNA, 75 bp, Artificial Sequence
  Synthetic
gagggagccatacaatgaatggatgttagaactgttagaggagcttaagcatgaagctgttaggcattttcctag

SEQ ID NO: 183646 - DNA, 75 bp, Artificial Sequence
  Synthetic
aataagagagattaaagatgacagtgactatgaaagtaatgaagaagaagaacaggaagttagagatcttgtaca

SEQ ID NO: 183647 - DNA, 75 bp, Artificial Sequence
  Synthetic
aataagagagattaaagatgacagtgactatgaaagtaatgaagaagatgaacaggaagttagagatcttgtaca

SEQ ID NO: 183648 - DNA, 75 bp, Artificial Sequence
  Synthetic
aataagagagattaaagatgacagtgactatgaaagtaatgaagaagacgaacaggaagttagagatcttgtaca

SEQ ID NO: 183649 - DNA, 75 bp, Artificial Sequence
  Synthetic
aataagagagattaaagatgacagtgactatgaaagtaatgaagaagaggaacaggaagttagagatcttgtaca

SEQ ID NO: 183650 - DNA, 75 bp, Artificial Sequence
  Synthetic
atccattacagaattgggtgccaacatagcagaataggcattattcgaagcagaagaaggagggatggaactggt

SEQ ID NO: 183651 - DNA, 75 bp, Artificial Sequence
  Synthetic
tcagtcattaaacaagcttgtccaaaggtatcctttgagccaattcccatacattattgtgccccggctggtttt

SEQ ID NO: 183652 - DNA, 75 bp, Artificial Sequence
  Synthetic
ccgacgaggaacttctcacagcagtaaggatcatcaaaatcatataccaaagcagtgagtacatgtaatgtctct

SEQ ID NO: 183653 - DNA, 75 bp, Artificial Sequence
  Synthetic
ggtagatcctaacctagagccctggaatcatccgggaagtcagcctacaactgcttgtagcaagtgttactgtaa

SEQ ID NO: 183654 - DNA, 75 bp, Artificial Sequence
  Synthetic
aatgcaggaagacattattagtttatgggaacagagtttaaagccttgtgttcaaatgactttcctgtgtataca

SEQ ID NO: 183655 - DNA, 75 bp, Artificial Sequence
  Synthetic
atcagtagaaattaattgtacaagacccaacaacaatacaagaaaaagtatacatctaggacaagggagcacatg

SEQ ID NO: 183656 - DNA, 75 bp, Artificial Sequence
  Synthetic
cccaacaacaatacaagaaaaagtatacatctaggacaagggagcacatggtatgcacatggagaaatagtggga

SEQ ID NO: 183657 - DNA, 75 bp, Artificial Sequence
  Synthetic
aaaaactgttctttcaatatgaccacagtaataaaagataagcagccgaaagtacaagcacttttttataagctt

SEQ ID NO: 183658 - DNA, 75 bp, Artificial Sequence
  Synthetic
ggcacaaagagtcctaagactacagagagccctaggaacatagagaaccctgtgaaaaagtgtgagtttaataca

SEQ ID NO: 183659 - DNA, 75 bp, Artificial Sequence
  Synthetic
gaataagagaaagagcagaagacagtggcaatgaaagcgagggggatacagaggaactatcaacacttatggaaa

SEQ ID NO: 183660 - DNA, 75 bp, Artificial Sequence
  Synthetic
gggtagattatagaataggaataggagcattcataatagcactaatcatagcaatagttgtttggaccatagtat

SEQ ID NO: 183661 - DNA, 75 bp, Artificial Sequence
  Synthetic
actaaggcaaagaaaaatagacaggttagttaagagaataagagaaagagcagaagacagtggaaatgagagtga

SEQ ID NO: 183662 - DNA, 75 bp, Artificial Sequence
  Synthetic
tcttttgaacccattccaatacattattgtgctccagcaggatatgccatctttaagtgtaacagcacagaattt

SEQ ID NO: 183663 - DNA, 75 bp, Artificial Sequence
  Synthetic
cttgtggaaatgggggactttgatccttgggttggtgataatttgtagtgcctcagacaacttgtgggttacagt

SEQ ID NO: 183664 - DNA, 75 bp, Artificial Sequence
  Synthetic
tctcgctcccttgcagaataaaacaaattataaacatgtggcaggaagtaggaaaagcaatgtatgcccctccca

SEQ ID NO: 183665 - DNA, 75 bp, Artificial Sequence
  Synthetic
tccagcagcagcaggagtaggagcagtatctcaagatttagataaacatggagcaatcacaagcagtaatattaa

SEQ ID NO: 183666 - DNA, 75 bp, Artificial Sequence
  Synthetic
aaggaaaaataagaattatgggaaaaaacatttcagattctgcggaaaatatcttagtgaccctaaattatcctg

SEQ ID NO: 183667 - DNA, 75 bp, Artificial Sequence
  Synthetic
ttccagagaagttctctcgacgcaggactcggcttgctgagtgcacacagcaagaggcgagagcggcgactggtg

SEQ ID NO: 183668 - DNA, 75 bp, Artificial Sequence
  Synthetic
aggaggagatatgaaggacaattggagaagtgaattatataaatataaagtagtaaaaattgaaccactaggagt

SEQ ID NO: 183669 - DNA, 75 bp, Artificial Sequence
  Synthetic
tgtaacagaaaattttaacatgtggaaaaataacatggtagagcagatgcaggaggatgtaatcagtttatggga

SEQ ID NO: 183670 - DNA, 75 bp, Artificial Sequence
  Synthetic
gatagcttcttgcaagtataatggcactgagtgggaaaaagccttaaaacaaacagctgaaaggtatttagaact

SEQ ID NO: 183671 - DNA, 75 bp, Artificial Sequence
  Synthetic
tcaatgtcagtgtcgaagagcacgcaatgacaaactgctctttcaatgtgaccacagcaataagagataaacaac

SEQ ID NO: 183672 - DNA, 75 bp, Artificial Sequence
  Synthetic
ttttttagggaaaatctggccttcccacaaggggaggccagggaattttcttcagaacagaccagagccaacagc

SEQ ID NO: 183673 - DNA, 75 bp, Artificial Sequence
  Synthetic
catcctcaggaggggacctagaaattacaatgcataattttaattgtagaggagaatttttctactgcaatacat

SEQ ID NO: 183674 - DNA, 75 bp, Artificial Sequence
  Synthetic
acaatgacattcaatcgcagccttgatggagacgcagagacaacccatttgcactttaactgtcatggagagttc

SEQ ID NO: 183675 - DNA, 75 bp, Artificial Sequence
  Synthetic
atgctagtgatagtactgatcataataaaactgttaacatgaagggagaaatgaaaaattgcactttcaatgtaa

SEQ ID NO: 183676 - DNA, 75 bp, Artificial Sequence
  Synthetic
gatgaggggagggtcgggactctatgcacctcccatctcaggttacctaacatgtatgtcaaacataactggaat

SEQ ID NO: 183677 - DNA, 75 bp, Artificial Sequence
  Synthetic
caggacaagtattttatgcaacaggaggcataataggggatataagaaaagccttctgtatagtcaatgcaacag

SEQ ID NO: 183678 - DNA, 75 bp, Artificial Sequence
  Synthetic
gaaaagcatattgtgagattaatggaacaaaatggaataaagttttaaaacaggtaactgaaaaattaaaagagc

SEQ ID NO: 183679 - DNA, 75 bp, Artificial Sequence
  Synthetic
acaactccgagctcgcctgctagccttagaaacctttatacagaatcagcaactcctaaacctatggggctgtaa

SEQ ID NO: 183680 - DNA, 75 bp, Artificial Sequence
  Synthetic
accataattcttttatcctgcagaatacaacaaattaatatgtggcagagagtagtacaaccaatgtataaccct

SEQ ID NO: 183681 - DNA, 75 bp, Artificial Sequence
  Synthetic
ttggcaagccacctggattcctgagtgggagtttgtcaatacccctcccttagtgaaattatggtaccagttaga

SEQ ID NO: 183682 - DNA, 75 bp, Artificial Sequence
  Synthetic
aactcctaaacctatggggctgtaagggaagactaatctgttacacatcagtagcatggaacaacacatggacca

SEQ ID NO: 183683 - DNA, 75 bp, Artificial Sequence
  Synthetic
acaaaaagcacaagtacagcaggaacaaaatgagaggaagttgctggagttagatgaatgggcttctatttggaa

SEQ ID NO: 183684 - DNA, 75 bp, Artificial Sequence
  Synthetic
caggtagacaggatgaggattagaacatggaacagtttagtaaaacatcatatgtatgtctcaaagaaagctaaa

SEQ ID NO: 183685 - DNA, 75 bp, Artificial Sequence
  Synthetic
aggctttccagtcaggccgcaggtacctctaagaccaatgactttcaagggagcttttgatcttagcttcttttt

SEQ ID NO: 183686 - DNA, 75 bp, Artificial Sequence
  Synthetic
gagcgtcagtattaagtgggggaaaattagatgcatgggaaaaaattcggttacggccagggggaaagaaaaaat

SEQ ID NO: 183687 - DNA, 75 bp, Artificial Sequence
  Synthetic
agttagagtaatagatctcaggaagatatttgaagaaacatgacctagatgcaataggataaagaagttagcaag

SEQ ID NO: 183688 - DNA, 75 bp, Artificial Sequence
  Synthetic
tggaaaactcatctgcaccactaatgtgccttggaacaaaaattggagtgcaaaaactcaagatgaaatttggga

SEQ ID NO: 183689 - DNA, 75 bp, Artificial Sequence
  Synthetic
gcaaattggactgacagcataatcttagggatacaaagaataggaagaggaatatataacatcccaagaagaatt

SEQ ID NO: 183690 - DNA, 75 bp, Artificial Sequence
  Synthetic
gcaaattggactgacagcataatcttagggatacaaagaataggaagaggaatttataacatcccaagaagaatt

SEQ ID NO: 183691 - DNA, 75 bp, Artificial Sequence
  Synthetic
gcaaattggactgacagcataatcttagggatacaaagaataggaagaggaatctataacatcccaagaagaatt

SEQ ID NO: 183692 - DNA, 75 bp, Artificial Sequence
  Synthetic
gcaaattggactgacagcataatcttagggatacaaagaataggaagaggaatgtataacatcccaagaagaatt

SEQ ID NO: 183693 - DNA, 75 bp, Artificial Sequence
  Synthetic
gctaattggactgacagcataatcttagggatacaaagaataggaagaggaatatataacatcccaagaagaatt

SEQ ID NO: 183694 - DNA, 75 bp, Artificial Sequence
  Synthetic
gctaattggactgacagcataatcttagggatacaaagaataggaagaggaatttataacatcccaagaagaatt

SEQ ID NO: 183695 - DNA, 75 bp, Artificial Sequence
  Synthetic
gctaattggactgacagcataatcttagggatacaaagaataggaagaggaatctataacatcccaagaagaatt

SEQ ID NO: 183696 - DNA, 75 bp, Artificial Sequence
  Synthetic
gctaattggactgacagcataatcttagggatacaaagaataggaagaggaatgtataacatcccaagaagaatt

SEQ ID NO: 183697 - DNA, 75 bp, Artificial Sequence
  Synthetic
gccaattggactgacagcataatcttagggatacaaagaataggaagaggaatatataacatcccaagaagaatt

SEQ ID NO: 183698 - DNA, 75 bp, Artificial Sequence
  Synthetic
gccaattggactgacagcataatcttagggatacaaagaataggaagaggaatttataacatcccaagaagaatt

SEQ ID NO: 183699 - DNA, 75 bp, Artificial Sequence
  Synthetic
gccaattggactgacagcataatcttagggatacaaagaataggaagaggaatctataacatcccaagaagaatt

SEQ ID NO: 183700 - DNA, 75 bp, Artificial Sequence
  Synthetic
gccaattggactgacagcataatcttagggatacaaagaataggaagaggaatgtataacatcccaagaagaatt

SEQ ID NO: 183701 - DNA, 75 bp, Artificial Sequence
  Synthetic
gcgaattggactgacagcataatcttagggatacaaagaataggaagaggaatatataacatcccaagaagaatt

SEQ ID NO: 183702 - DNA, 75 bp, Artificial Sequence
  Synthetic
gcgaattggactgacagcataatcttagggatacaaagaataggaagaggaatttataacatcccaagaagaatt

SEQ ID NO: 183703 - DNA, 75 bp, Artificial Sequence
  Synthetic
gcgaattggactgacagcataatcttagggatacaaagaataggaagaggaatctataacatcccaagaagaatt

SEQ ID NO: 183704 - DNA, 75 bp, Artificial Sequence
  Synthetic
gcgaattggactgacagcataatcttagggatacaaagaataggaagaggaatgtataacatcccaagaagaatt

SEQ ID NO: 183705 - DNA, 75 bp, Artificial Sequence
  Synthetic
aatatataacatcccaagaagaattagacagggcttagaaaggagtttattgtaacatgggaaacgcattgagga

SEQ ID NO: 183706 - DNA, 75 bp, Artificial Sequence
  Synthetic
aatttataacatcccaagaagaattagacagggcttagaaaggagtttattgtaacatgggaaacgcattgagga

SEQ ID NO: 183707 - DNA, 75 bp, Artificial Sequence
  Synthetic
aatctataacatcccaagaagaattagacagggcttagaaaggagtttattgtaacatgggaaacgcattgagga

SEQ ID NO: 183708 - DNA, 75 bp, Artificial Sequence
  Synthetic
aatgtataacatcccaagaagaattagacagggcttagaaaggagtttattgtaacatgggaaacgcattgagga

SEQ ID NO: 183709 - DNA, 75 bp, Artificial Sequence
  Synthetic
cctcaagtgcctctaaggccaatgacctttaaaggagcatttgacctcagcttctttttaaaagaaaagggagga

SEQ ID NO: 183710 - DNA, 75 bp, Artificial Sequence
  Synthetic
gaaataggacaaagaattggtagagcttttcttaacgtacctagaagaatcagacagggcttcgaaagagctttg

SEQ ID NO: 183711 - DNA, 75 bp, Artificial Sequence
  Synthetic
atggcctcaggtcagggaaaaaataaagcaaactcctccagcaacagaaggagtaggagcagtatctcaagatct

SEQ ID NO: 183712 - DNA, 75 bp, Artificial Sequence
  Synthetic
atggagcaattacaagcagtaacacagctgctactaactcagattgtgcttggctggaggcgcaagaggaagggg

SEQ ID NO: 183713 - DNA, 75 bp, Artificial Sequence
  Synthetic
taggattagtagtagcaggcatagcagccataattgtgtgggccatagtttttatacaatataaggaaataagaa

SEQ ID NO: 183714 - DNA, 75 bp, Artificial Sequence
  Synthetic
tggctggaggcgcaagaggaaggggaggtaggctttccagtcaagccgcaaggacctttaaggccaatggcctat

SEQ ID NO: 183715 - DNA, 75 bp, Artificial Sequence
  Synthetic
caactaattcatctatattattttgattgtttttcagagtctgctataagaaatgccttattaggacgcttagtt

SEQ ID NO: 183716 - DNA, 75 bp, Artificial Sequence
  Synthetic
tttttcagttcctttagatgaaaacttcaggaaatacactgcattcactatacctagtataaacaatgaaacacc

SEQ ID NO: 183717 - DNA, 75 bp, Artificial Sequence
  Synthetic
aaagactgcactgagagacaggctaattttttagggaaactttggccttccaacaagggaaggccagggaatttt

SEQ ID NO: 183718 - DNA, 75 bp, Artificial Sequence
  Synthetic
agggggaaagaaaaaatatagaatgaaacatttagtatgggcaagcagggagctggaaaaattcgcacttaaccc

SEQ ID NO: 183719 - DNA, 75 bp, Artificial Sequence
  Synthetic
gacataattagtttatgggatgaaagtctaaagccatgtgtaaagctaacccctctctgtgttactttaacctgt

SEQ ID NO: 183720 - DNA, 75 bp, Artificial Sequence
  Synthetic
tactatgctaaatgccataggaggacatcaaggggctttacaagtgctaaaggaagtaatcaatgaggaagcagc

SEQ ID NO: 183721 - DNA, 75 bp, Artificial Sequence
  Synthetic
agaactcaaatcattatacaacacagtagcaaccctctattgcgtacatcagaagatagagataaaagacaccaa

SEQ ID NO: 183722 - DNA, 75 bp, Artificial Sequence
  Synthetic
actaatgcaaccaacaattgcactaaaggagtcaatagcactgtggacaactgtgaagacataaaaaactgctct

SEQ ID NO: 183723 - DNA, 75 bp, Artificial Sequence
  Synthetic
aggcatttcctatggcaggaagaagcggagacagagacgcagcgctcctccacgcggtgagagccatcagaatct

SEQ ID NO: 183724 - DNA, 75 bp, Artificial Sequence
  Synthetic
acaaccagctcttaagacaggaacagaggaacttaaatcattatataacacagtagcaactctctattgtgtaca

SEQ ID NO: 183725 - DNA, 75 bp, Artificial Sequence
  Synthetic
ggcttaggcatctcctatggcaggaagaagcggagacagcgacgaagacctcctcaggacagtcagactcatcaa

SEQ ID NO: 183726 - DNA, 75 bp, Artificial Sequence
  Synthetic
tattagacagggaccaaaagaaccatttagagactatgtagatcggttctacaaaacattaagagctgagcaagc

SEQ ID NO: 183727 - DNA, 75 bp, Artificial Sequence
  Synthetic
gtggatcagatgcatgaggatgtaatcagtttatgggatcaaagtctaaaacccatgtgtaaagttacccctctc

SEQ ID NO: 183728 - DNA, 75 bp, Artificial Sequence
  Synthetic
tgccactgttagtccagggggagaagacatgaaaaactgctctttcaatatcaccacaagcataagagataaggt

SEQ ID NO: 183729 - DNA, 75 bp, Artificial Sequence
  Synthetic
tgtacacatggaattaaaccagtgatatcaactcaactactgttaaacggtagcagagcagaaggagaaataata

SEQ ID NO: 183730 - DNA, 75 bp, Artificial Sequence
  Synthetic
aagggaggccagggaactttccccagaaaggactagagccaacagccccaccagcagagagcctggggatggggg

SEQ ID NO: 183731 - DNA, 75 bp, Artificial Sequence
  Synthetic
caacagctcctagggctttggggctgctctggaaaactcatctgcaccactaatgtgccttggaacactagttgg

SEQ ID NO: 183732 - DNA, 75 bp, Artificial Sequence
  Synthetic
agcaatagtagtgggatacacaacgggaagggagaaatacaaaactgctctttcaatatcaccacaggcatacaa

SEQ ID NO: 183733 - DNA, 75 bp, Artificial Sequence
  Synthetic
gaaatataacagatgaagtaagaaactgttcttttaatatgaccacagaactaagagataagaagcagaaggtcc

SEQ ID NO: 183734 - DNA, 75 bp, Artificial Sequence
  Synthetic
ctgttcttttaatatgaccacagaactaagagataagaagcagaaggtccatgcacttttttataagcttgatat

SEQ ID NO: 183735 - DNA, 75 bp, Artificial Sequence
  Synthetic
acagaacatagaaaaagggttgaattgcttagagaacacttatatcagtggggattcactacccctgataaaaag

SEQ ID NO: 183736 - DNA, 75 bp, Artificial Sequence
  Synthetic
gtgtaatgataagaaattcaatggaacaggaccatgtacaaatgtcagcacagtacaatgcacacatggaattag

SEQ ID NO: 183737 - DNA, 75 bp, Artificial Sequence
  Synthetic
tccaatgtaaaataaaacaaattataaacaggtggcgggaagtagggaaagcaatgtatgcccctcccatcaaag

SEQ ID NO: 183738 - DNA, 75 bp, Artificial Sequence
  Synthetic
taaatgatatacaaaaactaataggaaagttaaattgggcaagtcaaatctatcaaggaattagagtaaaagaat

SEQ ID NO: 183739 - DNA, 75 bp, Artificial Sequence
  Synthetic
tacaagaaaaggtataccagtagtagggaggacattatatgcaacaggggctataataggagatataagacaagc

SEQ ID NO: 183740 - DNA, 75 bp, Artificial Sequence
  Synthetic
ctatcaatacatggatgacttgtatgtaggatctgatttagaaatagggcagcatagagcaaaaatagaggagtt

SEQ ID NO: 183741 - DNA, 75 bp, Artificial Sequence
  Synthetic
tgcgcatacctagaaggataagacaaggccttgaaagggcgctgctataaaatggggagcaaatggtcaaaaagt

SEQ ID NO: 183742 - DNA, 75 bp, Artificial Sequence
  Synthetic
acagctcctgggaatttggggttgctctggaaaactcatctgcaccactactgtgccttggaatactagttggag

SEQ ID NO: 183743 - DNA, 75 bp, Artificial Sequence
  Synthetic
ctatagttatctggggaaaattgcctaaatttaagctgccagttactagagaaacttgggaagcatggtgggcag

SEQ ID NO: 183744 - DNA, 75 bp, Artificial Sequence
  Synthetic
tggcactatcatacttccatgcaagataaagcaaattataaacatgtggcagggagcaggacaagcaatgtatgc

SEQ ID NO: 183745 - DNA, 75 bp, Artificial Sequence
  Synthetic
gcaatagttgcatggactatagtaggtatagaaattaagaaattgctaaaacaaagaaaaatagacaggctaatt

SEQ ID NO: 183746 - DNA, 75 bp, Artificial Sequence
  Synthetic
gaccggaaggaacgttagtagtgaaatgaaggaagaaataaaaaactgctctttcaatatgaccacagaattaag

SEQ ID NO: 183747 - DNA, 75 bp, Artificial Sequence
  Synthetic
ttgtgtggatcatagcatatatagaatataggaaattgttaagacaaagaaaaatagactggttaattaaaagaa

SEQ ID NO: 183748 - DNA, 75 bp, Artificial Sequence
  Synthetic
agaggtaaaagacaccaaagaagctctagatgaagtggaaaagttacaaaagaaaagtcagcaaaaaatgcaaca

SEQ ID NO: 183749 - DNA, 75 bp, Artificial Sequence
  Synthetic
tagtaaaattatggtaccagttagaaaaagaccccatagtaggagcagaaactttctatgtagatggggcagcta

SEQ ID NO: 183750 - DNA, 75 bp, Artificial Sequence
  Synthetic
gatcatgaaaaatatcatagcaattggagagcattagctagtgactttggactaccaccagtggtggccaaggaa

SEQ ID NO: 183751 - DNA, 75 bp, Artificial Sequence
  Synthetic
aaaactgctctttcaatatgaccacagaattaagggataagaaaaagaaagtatattcacttttttatagacttg

SEQ ID NO: 183752 - DNA, 75 bp, Artificial Sequence
  Synthetic
taatgataccagtaatagtactgctaattaccctgatagcatgaaagaagaaatgaaaaattgttctttcaatgt

SEQ ID NO: 183753 - DNA, 75 bp, Artificial Sequence
  Synthetic
caatgctaagaccataatagtacagctgaatgagtctatagtaattaattgtacaagacccaggaacaaaacaag

SEQ ID NO: 183754 - DNA, 75 bp, Artificial Sequence
  Synthetic
ttcagacctggaggaggagatatgagggacaattggagaagtgaattatataaatataaagtagtagaaattgaa

SEQ ID NO: 183755 - DNA, 75 bp, Artificial Sequence
  Synthetic
taacactttaaaacaggtagtaagaaaattaagagaacagtttgggaataaaacaataatctttaatcaatcctc

SEQ ID NO: 183756 - DNA, 75 bp, Artificial Sequence
  Synthetic
gacagcagagacccaatttggaaaggaccagcaaaactactctggaaaggtgaaggggcagtagtaatacaagat

SEQ ID NO: 183757 - DNA, 75 bp, Artificial Sequence
  Synthetic
ccaaataagagaaccaaggggaagtgatatagcaggaactactagtacccttcaggaacaaataacatggatgac

SEQ ID NO: 183758 - DNA, 75 bp, Artificial Sequence
  Synthetic
accagccagagagccattcaatgaatgggcactagagctcctagaagagctaaaagcagaagcagtaagacattt

SEQ ID NO: 183759 - DNA, 75 bp, Artificial Sequence
  Synthetic
gggaccaggacgagcattttacacaacaggagaaatactaggaaacatcagaaaggcctattgtcttgttaatgg

SEQ ID NO: 183760 - DNA, 75 bp, Artificial Sequence
  Synthetic
caacaatgctgcttgtgcctggctggaagcacaagaggaggaagaagaagtaggctttccagtcagacctcaggt

SEQ ID NO: 183761 - DNA, 75 bp, Artificial Sequence
  Synthetic
ataaagatcttgtaccaaagcagtaagtaacgccaatgcttcatagggatctgctattactaataattattagtg

SEQ ID NO: 183762 - DNA, 75 bp, Artificial Sequence
  Synthetic
ctccgacgcagaactcctcgcagcaataaggatcatcaaaatcctataccaaagcagtaagtataattagttagc

SEQ ID NO: 183763 - DNA, 75 bp, Artificial Sequence
  Synthetic
ttgagaaagcaaaggaaaatagattggttaattgaaagaataagagaaagagcagaagacagtggcaatgaaagt

SEQ ID NO: 183764 - DNA, 75 bp, Artificial Sequence
  Synthetic
atatttgggcatcacaagcctgtgttcccacagaccccactccacatgaatatccattacacaatgtgacagata

SEQ ID NO: 183765 - DNA, 75 bp, Artificial Sequence
  Synthetic
tcccacagaccccactccacatgaatatccattacacaatgtgacagataaatttaatatatggaaaaattacat

SEQ ID NO: 183766 - DNA, 75 bp, Artificial Sequence
  Synthetic
aagatgcagaaaccaccctgttttgtgcatcacatgctaatgcatatgagaaagaacaacatattgtctgggcta

SEQ ID NO: 183767 - DNA, 75 bp, Artificial Sequence
  Synthetic
agaataagacgtactcctccagcagcagcaggagtaggagcagtatcccaagacttagataaacatggagcagtc

SEQ ID NO: 183768 - DNA, 75 bp, Artificial Sequence
  Synthetic
tcatgatgatataatccgtctatgggatcgcagcttacagccacgtgtaaaattaacccctctctgcgttacttt

SEQ ID NO: 183769 - DNA, 75 bp, Artificial Sequence
  Synthetic
tatacattaattaattgtaactccacaaccatcaagcaagcctgtccaaaggtatcttttgagccaattccaata

SEQ ID NO: 183770 - DNA, 75 bp, Artificial Sequence
  Synthetic
aaacagaaagtacggtctcttttttataggattgatttagtacagattggtaataatacaaatgacagtagtaat

SEQ ID NO: 183771 - DNA, 75 bp, Artificial Sequence
  Synthetic
aacattacagtagttacttgtacacatggcatcaagccaacagtaagtactcagctaatattaaatggaacactt

SEQ ID NO: 183772 - DNA, 75 bp, Artificial Sequence
  Synthetic
caggaaatacaacagtacaggagataaaaataggtccaatgtcctggtacagcatgagcacagaaggcaaccctg

SEQ ID NO: 183773 - DNA, 75 bp, Artificial Sequence
  Synthetic
gtaaaaaattggatgacagacaccttgttggtccaaaatgcaaacccagattgtaagaccattttaagagcatta

SEQ ID NO: 183774 - DNA, 75 bp, Artificial Sequence
  Synthetic
aatagtagtagctgagtggacagatagagttctagaagttttgcaaagagtgggtagagctattcttcacatacc

SEQ ID NO: 183775 - DNA, 75 bp, Artificial Sequence
  Synthetic
agcatgagcacagaaggcaaccctgagtcaagaagggcttattgtgagtataataccactaattgggtagaggcc

SEQ ID NO: 183776 - DNA, 75 bp, Artificial Sequence
  Synthetic
tacaatgtacacatggaattaaacctgtagtatcaactcaactgctgttaaatggcagtttagcagaaggaggaa

SEQ ID NO: 183777 - DNA, 75 bp, Artificial Sequence
  Synthetic
aagaacaagtgtgcgtataggaccagggcaaacattttatgcaacaggtgatataatagggaatataagacaagc

SEQ ID NO: 183778 - DNA, 75 bp, Artificial Sequence
  Synthetic
aattgcattttaattgtcatggagagttcttttactgtaacacatctcagatgtttaattatacctttacatgtg

SEQ ID NO: 183779 - DNA, 75 bp, Artificial Sequence
  Synthetic
aaataaaacaataatctttaataaatcatcaggaggggacctagaagtgacacaacatatgtttatttgtggagg

SEQ ID NO: 183780 - DNA, 75 bp, Artificial Sequence
  Synthetic
aggactctatgcacctcccatccaaggtcaattaacatgtagatcaaacataactggaatgattctacaaatgga

SEQ ID NO: 183781 - DNA, 75 bp, Artificial Sequence
  Synthetic
tcagccatggaacgggagccagagcaatagcaatagcacatttagaccgatagggggaaatatgaaagatatatg

SEQ ID NO: 183782 - DNA, 75 bp, Artificial Sequence
  Synthetic
tcctaaactcatggggctgtaaaggaaagctagtctgttacacatcagtaaagtggaacaagacatggacaggaa

SEQ ID NO: 183783 - DNA, 75 bp, Artificial Sequence
  Synthetic
gcgaaagttaatagggactcgaaagcgaaagttccagagaagttctctcgacgcaggactcggcttgctgaggtg

SEQ ID NO: 183784 - DNA, 75 bp, Artificial Sequence
  Synthetic
aaggagagctagtggatggttttacagacatcattatgaaagtagacatccaaaagtaagttcagaagtacacat

SEQ ID NO: 183785 - DNA, 75 bp, Artificial Sequence
  Synthetic
agaagataattagtgcttgcagaatttgtgcagctgtaacacaatactggctacaagaattgcagaatagtgtta

SEQ ID NO: 183786 - DNA, 75 bp, Artificial Sequence
  Synthetic
ttgtgcagctgtaacacaatactggctacaagaattgcagaatagtgttataagtctagtagatactattgcagt

SEQ ID NO: 183787 - DNA, 75 bp, Artificial Sequence
  Synthetic
aaaagaaaccatcaatgaggaagctgcagaatgggatagggtacacccagtacatgcagggcctattccaccagg

SEQ ID NO: 183788 - DNA, 75 bp, Artificial Sequence
  Synthetic
ggacaccaaatgaaagactgcactgaaagacaggctaattttttagggaaaatttggccttcccacaaggggagg

SEQ ID NO: 183789 - DNA, 75 bp, Artificial Sequence
  Synthetic
agcttgttataacatgggaaacgcattgaggaaaagcaaatttgagggatggccagcagtaagagaaagaatgag

SEQ ID NO: 183790 - DNA, 75 bp, Artificial Sequence
  Synthetic
tgaaaatccatacaatactccaatatttgccataaagaaaaaagacagtactaaatggagaaaattagtagattt

SEQ ID NO: 183791 - DNA, 75 bp, Artificial Sequence
  Synthetic
aaaaacttcccctgaacctaaagattgtgcacctggagtaggacaaatctccaaggaattagcagctagaggagg

SEQ ID NO: 183792 - DNA, 75 bp, Artificial Sequence
  Synthetic
atggagcagtcacaagcaataatacagcagctactaatcctgattgcgcctggctggaagcacaagaggaagagg

SEQ ID NO: 183793 - DNA, 75 bp, Artificial Sequence
  Synthetic
tggctggaagcacaagaggaagaggaggtaggcttcccagtcaggccacaggtaccaacaagaccaatgacttat

SEQ ID NO: 183794 - DNA, 75 bp, Artificial Sequence
  Synthetic
tgtttattcatttcagaattgggtgccatcatagcagaataggcattattcgacagagaagagcaagaaatggag

SEQ ID NO: 183795 - DNA, 75 bp, Artificial Sequence
  Synthetic
gaaattgcactactactaatggcactgtaaacaactctgcagatataaaaaactgctctttcaatataaccacag

SEQ ID NO: 183796 - DNA, 75 bp, Artificial Sequence
  Synthetic
acaaagaaaaatagacaggttaattgatagaataagagaaagagcagaagacagtggcaatgagagtgatgggga

SEQ ID NO: 183797 - DNA, 75 bp, Artificial Sequence
  Synthetic
ttcagttcccttagatgaggatttcaggaagtacactgcattcaccatacctagtgtcaacaatgagacaccagg

SEQ ID NO: 183798 - DNA, 75 bp, Artificial Sequence
  Synthetic
aaactcctccagcagcagaaggagtaggagcagtatctcaagatctagataaacatggagcagtaacaagtagta

SEQ ID NO: 183799 - DNA, 75 bp, Artificial Sequence
  Synthetic
gggtcacagtctattatggggtacctgtgtggagagaagcaaaaactactctattttgtgcatcagatgctaaag

SEQ ID NO: 183800 - DNA, 75 bp, Artificial Sequence
  Synthetic
gtagcattagtagtagtaacaataatagcaatagttgtgtggtccatagtactcatagaatataggaaaatatta

SEQ ID NO: 183801 - DNA, 75 bp, Artificial Sequence
  Synthetic
taacatttggaccaggacaagcattctatgcaacaggtgacataataggaaatataagagaagcattttgtgtgg

SEQ ID NO: 183802 - DNA, 75 bp, Artificial Sequence
  Synthetic
tgctccttgggatattaatgatctgtagtgttgcaggacaattgtgggtcacagtatattatggggtacctgtgt

SEQ ID NO: 183803 - DNA, 75 bp, Artificial Sequence
  Synthetic
tagcatgagtagagaaatgagaaactgctctttcaagacaaccacagaaataagagataagcaacagaacacgta

SEQ ID NO: 183804 - DNA, 75 bp, Artificial Sequence
  Synthetic
aaattctaaaagaaccagtacatggggtatattatgacccatcaaaagacttaatagcagaaatacagaaacaag

SEQ ID NO: 183805 - DNA, 75 bp, Artificial Sequence
  Synthetic
atcaggccagtagtatcaactcaattgctgttaaatggtagtctagcaaatgaaaagataataattagatctaaa

SEQ ID NO: 183806 - DNA, 75 bp, Artificial Sequence
  Synthetic
cagcaatagtaggattagtaatagcagaaataatagcaatagttgtgtggtccatagtattaatagaatataaaa

SEQ ID NO: 183807 - DNA, 75 bp, Artificial Sequence
  Synthetic
cagcaatagtaggattagtaatagcagtaataatagcaatagttgtgtggtccatagtattaatagaatataaaa

SEQ ID NO: 183808 - DNA, 75 bp, Artificial Sequence
  Synthetic
cagcaatagtaggattagtaatagcagcaataatagcaatagttgtgtggtccatagtattaatagaatataaaa

SEQ ID NO: 183809 - DNA, 75 bp, Artificial Sequence
  Synthetic
cagcaatagtaggattagtaatagcaggaataatagcaatagttgtgtggtccatagtattaatagaatataaaa

SEQ ID NO: 183810 - DNA, 75 bp, Artificial Sequence
  Synthetic
cagcaatagtaggattagtattagcagaaataatagcaatagttgtgtggtccatagtattaatagaatataaaa

SEQ ID NO: 183811 - DNA, 75 bp, Artificial Sequence
  Synthetic
cagcaatagtaggattagtattagcagtaataatagcaatagttgtgtggtccatagtattaatagaatataaaa

SEQ ID NO: 183812 - DNA, 75 bp, Artificial Sequence
  Synthetic
cagcaatagtaggattagtattagcagcaataatagcaatagttgtgtggtccatagtattaatagaatataaaa

SEQ ID NO: 183813 - DNA, 75 bp, Artificial Sequence
  Synthetic
cagcaatagtaggattagtattagcaggaataatagcaatagttgtgtggtccatagtattaatagaatataaaa

SEQ ID NO: 183814 - DNA, 75 bp, Artificial Sequence
  Synthetic
cagcaatagtaggattagtactagcagaaataatagcaatagttgtgtggtccatagtattaatagaatataaaa

SEQ ID NO: 183815 - DNA, 75 bp, Artificial Sequence
  Synthetic
cagcaatagtaggattagtactagcagtaataatagcaatagttgtgtggtccatagtattaatagaatataaaa

SEQ ID NO: 183816 - DNA, 75 bp, Artificial Sequence
  Synthetic
cagcaatagtaggattagtactagcagcaataatagcaatagttgtgtggtccatagtattaatagaatataaaa

SEQ ID NO: 183817 - DNA, 75 bp, Artificial Sequence
  Synthetic
cagcaatagtaggattagtactagcaggaataatagcaatagttgtgtggtccatagtattaatagaatataaaa

SEQ ID NO: 183818 - DNA, 75 bp, Artificial Sequence
  Synthetic
cagcaatagtaggattagtagtagcagaaataatagcaatagttgtgtggtccatagtattaatagaatataaaa

SEQ ID NO: 183819 - DNA, 75 bp, Artificial Sequence
  Synthetic
cagcaatagtaggattagtagtagcagtaataatagcaatagttgtgtggtccatagtattaatagaatataaaa

SEQ ID NO: 183820 - DNA, 75 bp, Artificial Sequence
  Synthetic
cagcaatagtaggattagtagtagcagcaataatagcaatagttgtgtggtccatagtattaatagaatataaaa

SEQ ID NO: 183821 - DNA, 75 bp, Artificial Sequence
  Synthetic
cagcaatagtaggattagtagtagcaggaataatagcaatagttgtgtggtccatagtattaatagaatataaaa

SEQ ID NO: 183822 - DNA, 75 bp, Artificial Sequence
  Synthetic
gggtcatggagtctccatagaatggagattgagaagatatagcacacaagtagatcctggcctggcagaccagct

SEQ ID NO: 183823 - DNA, 75 bp, Artificial Sequence
  Synthetic
taggtgtgactatcaagcaggacataataaggtaggatctctacaatacttggcactgacagcattgataaagcc

SEQ ID NO: 183824 - DNA, 75 bp, Artificial Sequence
  Synthetic
agagacaggctaattttttagggaaagtttggccttccaacaaaggaaggccagggaactttccccaaaacagac

SEQ ID NO: 183825 - DNA, 75 bp, Artificial Sequence
  Synthetic
agaataaggaatataaggataggaccaggacgagcattccatacaaatggcgtaataggagacataagaaaagca

SEQ ID NO: 183826 - DNA, 75 bp, Artificial Sequence
  Synthetic
caatacatggatgacttgtatgtgggatctgatttagaaatagggcagcacagagcaaaagtagaggagctaaga

SEQ ID NO: 183827 - DNA, 75 bp, Artificial Sequence
  Synthetic
gtactacggacaatactactaataatagtacaataatggggaaagaagaaataaaaaactgctctttcaatacta

SEQ ID NO: 183828 - DNA, 75 bp, Artificial Sequence
  Synthetic
gcaggtaagagatcaagctgaacaccttaagacagcagtacaaatggcagtattcattcacaattttaaaagaaa

SEQ ID NO: 183829 - DNA, 75 bp, Artificial Sequence
  Synthetic
ttgacccaattcctatacattattgtgctccagctggttatgcgattctaaagtgtaataataagacattcaatg

SEQ ID NO: 183830 - DNA, 75 bp, Artificial Sequence
  Synthetic
ggtgggagggcctcaaatatctgtggaatctcctgctgtattggggtcaggaactaaagaatagtgctattaatt

SEQ ID NO: 183831 - DNA, 75 bp, Artificial Sequence
  Synthetic
ataatgtctgggctacacatgcctgtgtacccacagaccccaacccacaagaaatagttttggaaaatgtaacag

SEQ ID NO: 183832 - DNA, 75 bp, Artificial Sequence
  Synthetic
aagacttattggcattggacaagtgggcaagtctgtggaattggtttgacatatcaagatggctgtggtatataa

SEQ ID NO: 183833 - DNA, 75 bp, Artificial Sequence
  Synthetic
aagacttattggcattggacaagtgggcaagtctgtggatttggtttgacatatcaagatggctgtggtatataa

SEQ ID NO: 183834 - DNA, 75 bp, Artificial Sequence
  Synthetic
aagacttattggcattggacaagtgggcaagtctgtggacttggtttgacatatcaagatggctgtggtatataa

SEQ ID NO: 183835 - DNA, 75 bp, Artificial Sequence
  Synthetic
aagacttattggcattggacaagtgggcaagtctgtggagttggtttgacatatcaagatggctgtggtatataa

SEQ ID NO: 183836 - DNA, 75 bp, Artificial Sequence
  Synthetic
accagtgcatggtgtatactatcaacctgacaaagacttatgggttaatattcagaagcaaggagaagggcaatg

SEQ ID NO: 183837 - DNA, 75 bp, Artificial Sequence
  Synthetic
cctgacaaagacttatgggttaatattcagaagcaaggagaagggcaatggacttaccaaatatatcaggatgaa

SEQ ID NO: 183838 - DNA, 75 bp, Artificial Sequence
  Synthetic
ttttaacaaaacaagggaacaaatgagaaactgctctttcaatgtaaccacagaactaagagataagaagaaatc

SEQ ID NO: 183839 - DNA, 75 bp, Artificial Sequence
  Synthetic
aagctaaattagtaataacaacatactgggggctgcatacaggagaaagagattggcatctgggtcagggagtct

SEQ ID NO: 183840 - DNA, 75 bp, Artificial Sequence
  Synthetic
gctaccaccgattgagggacttcatattggtggcggcgaggacagtggaaattctgggacgcagagggtgggaag

SEQ ID NO: 183841 - DNA, 75 bp, Artificial Sequence
  Synthetic
gaaacagaaaataataaaattagaagagaccaccaatcaaaaggctgaattaatggcagtattattagccttaca

SEQ ID NO: 183842 - DNA, 75 bp, Artificial Sequence
  Synthetic
cccatgcagaataaaacaaattgtaaacatgtggcagggggtaggacgagcaatgtatgcccctcccattgaagg

SEQ ID NO: 183843 - DNA, 75 bp, Artificial Sequence
  Synthetic
ctttcattgttactggtgctttgcaacgaagggcttaggcatctcctatggcaggaagaagcggagacagcgacg

SEQ ID NO: 183844 - DNA, 75 bp, Artificial Sequence
  Synthetic
agaagaaataaaaaactgctctttccaggtcaccacagaactaagagataagacaaggaaggaatatgcactttt

SEQ ID NO: 183845 - DNA, 75 bp, Artificial Sequence
  Synthetic
caacatgagtttggaataccatataatccacaaagtcaaggagtagtagaagccatgaataaggaattaaaatca

SEQ ID NO: 183846 - DNA, 75 bp, Artificial Sequence
  Synthetic
aagacagggctttgaagcagctttgcaataaaatggggggcaagtggtcaaaaagcagcatagttggatggcctg

SEQ ID NO: 183847 - DNA, 75 bp, Artificial Sequence
  Synthetic
tgaaaaaaggcttaggcatctcccatggcaggaagaagcggaagcaccgacgaggaactcctcagagcagtaagg

SEQ ID NO: 183848 - DNA, 75 bp, Artificial Sequence
  Synthetic
aatacaagaaaaagcatacatatagcaccagggagagcattttatgcaacaggagaaataataggagatataaga

SEQ ID NO: 183849 - DNA, 75 bp, Artificial Sequence
  Synthetic
ctggtgaaataccataagtacaggtctaggaagaccaaggactggtattacagacatcattatgaatgtagaaat

SEQ ID NO: 183850 - DNA, 75 bp, Artificial Sequence
  Synthetic
acaggggcaaatggtacatcaggccatatcacctagaactttaaatgcatgggtaaaagtaatagaagaaaaggc

SEQ ID NO: 183851 - DNA, 75 bp, Artificial Sequence
  Synthetic
ggactgatagtagcgctaatcttagcaatagtagtgtggactatagtattcatagaatataggaaaatattaaga

SEQ ID NO: 183852 - DNA, 75 bp, Artificial Sequence
  Synthetic
tggttggaagcacaagaggaggaagaggtaggctttccagtcagacctcaggtaccgatgagaccaatgacttat

SEQ ID NO: 183853 - DNA, 75 bp, Artificial Sequence
  Synthetic
aaggaagagccaggggcaatacaaaactgttcttttaatatgaccacagaattaagagataagcagatgaaagta

SEQ ID NO: 183854 - DNA, 75 bp, Artificial Sequence
  Synthetic
caatgtcgagagcgataacataaccactgtaaaaaatacaacagatgaagtaagaaactgttcttttaatacaac

SEQ ID NO: 183855 - DNA, 75 bp, Artificial Sequence
  Synthetic
ccctctcagaagcaggagccgatagacaaggaactgtatcctttagcttccctcaaatcactctttggcaacgac

SEQ ID NO: 183856 - DNA, 75 bp, Artificial Sequence
  Synthetic
gcaagggtttgggaatctcctatggcaggaagaagcgacgacgtccagccgctgctgcaagccgtccggataata

SEQ ID NO: 183857 - DNA, 75 bp, Artificial Sequence
  Synthetic
aataaggaatggagccagtagatcctaacctagagccctggaagcatccgggaagtcagcctaagactgcttgta

SEQ ID NO: 183858 - DNA, 75 bp, Artificial Sequence
  Synthetic
cagcaagaaaaaaatgaacaagaattattggaattggataaatgggcaagtttgtggaattggtttgacataaca

SEQ ID NO: 183859 - DNA, 75 bp, Artificial Sequence
  Synthetic
aaagagaaatacttgaaaggttaagaagaataagagaaattagagatgatagtgactatgaaagtaatgaagaag

SEQ ID NO: 183860 - DNA, 75 bp, Artificial Sequence
  Synthetic
aaagagatatacttgaaaggttaagaagaataagagaaattagagatgatagtgactatgaaagtaatgaagaag

SEQ ID NO: 183861 - DNA, 75 bp, Artificial Sequence
  Synthetic
aaagagacatacttgaaaggttaagaagaataagagaaattagagatgatagtgactatgaaagtaatgaagaag

SEQ ID NO: 183862 - DNA, 75 bp, Artificial Sequence
  Synthetic
aaagagagatacttgaaaggttaagaagaataagagaaattagagatgatagtgactatgaaagtaatgaagaag

SEQ ID NO: 183863 - DNA, 75 bp, Artificial Sequence
  Synthetic
aagcacagagaaccctaacagcatagagaaccctatgaaaaattgtgagtttaatgtaactacagttctcaaaga

SEQ ID NO: 183864 - DNA, 75 bp, Artificial Sequence
  Synthetic
agtgcataatgtctgggctacacatgcctgtgttcccacagaccccaacccacaagtaatgcctctagccgatgt

SEQ ID NO: 183865 - DNA, 75 bp, Artificial Sequence
  Synthetic
aagcagaattagaattggcagagaacagggagattctaaaagaccctgtgcatggagtatattatgacccatcaa

SEQ ID NO: 183866 - DNA, 75 bp, Artificial Sequence
  Synthetic
gcagaaatacagaagcaggggctaggccaatggacatatcaaatttatcaagagccatttaagaatctgaaaaca

SEQ ID NO: 183867 - DNA, 75 bp, Artificial Sequence
  Synthetic
tccacaaccatcaagcaagcctgtccaaaggtatcttttgagccaattccaatacactattgtgctccagcagga

SEQ ID NO: 183868 - DNA, 75 bp, Artificial Sequence
  Synthetic
acccctctctgtgttactttacattgccattatgtcatcaacaacacagcccacaaggtttctgtttctccagaa

SEQ ID NO: 183869 - DNA, 75 bp, Artificial Sequence
  Synthetic
acacatggtatcaagccaacagtaagtactcagctaatattaaatggaacactttcggaaggaaagataagaata

SEQ ID NO: 183870 - DNA, 75 bp, Artificial Sequence
  Synthetic
agacagaaaacagaaagtatattctcttttttatagggaagatttagtacctattgatgaggataaaaataacag

SEQ ID NO: 183871 - DNA, 75 bp, Artificial Sequence
  Synthetic
gggatttggggttgctctggaaaactcatctgcaccactgctgtgccttggaatactagttggagtaataaatct

SEQ ID NO: 183872 - DNA, 75 bp, Artificial Sequence
  Synthetic
agataatgacaggtccactggcctggtatagcatggaactaaagaaagacacaaacacatccaaatcaagaatag

SEQ ID NO: 183873 - DNA, 75 bp, Artificial Sequence
  Synthetic
cttattgtgagtataataccaagaagtgggaagaggccttaagacagacagctgaaaggtatttagaattagtaa

SEQ ID NO: 183874 - DNA, 75 bp, Artificial Sequence
  Synthetic
caatgtacacatggaatcaagccagtagtatcaactcaactgctgctaaatggcagtctagcaaaagaaacagta

SEQ ID NO: 183875 - DNA, 75 bp, Artificial Sequence
  Synthetic
ccagagataacccagttgcattttaattgtcatggagagttcttttactgcaacacatctcagatgtttaattat

SEQ ID NO: 183876 - DNA, 75 bp, Artificial Sequence
  Synthetic
gaacaagtgtacgtataggaccaggacaaacattttatacaagtgatataataggggatataagacaagcctact

SEQ ID NO: 183877 - DNA, 75 bp, Artificial Sequence
  Synthetic
ggcaggtagtaaggtcatggatgaggggaggatcgggaccctatgcacctcccatccgaggtaacttaacatgtg

SEQ ID NO: 183878 - DNA, 75 bp, Artificial Sequence
  Synthetic
gggaggatcgggaccctatgcacctcccatccgaggtaacttaacatgtggatcaaacataactggaatgattct

SEQ ID NO: 183879 - DNA, 75 bp, Artificial Sequence
  Synthetic
aaagcgaaagtagaaccagagaagatctctcgacgcaggactcggcttgctgaagtgcacacggcaagaggcgag

SEQ ID NO: 183880 - DNA, 75 bp, Artificial Sequence
  Synthetic
gaatgctattcttgggggttctaagtgcagcaggtagcactatgggcgcagcggcaacagcgctgacggtacaga

SEQ ID NO: 183881 - DNA, 75 bp, Artificial Sequence
  Synthetic
atgtagaataatacaaattataaatatgtggcagagactaggacaggcaatgtatgcccctcccatcaaaggatt

SEQ ID NO: 183882 - DNA, 75 bp, Artificial Sequence
  Synthetic
aagatagaggtaaaggacaccaaggaagctttagataagctagaggaagaacaaaacaaaagtcagcaaaagaca

SEQ ID NO: 183883 - DNA, 75 bp, Artificial Sequence
  Synthetic
aggaaggctagtctgttacacatcagtaatatggaacacatcagaatggaaaggaaatgagtctatttggggcaa

SEQ ID NO: 183884 - DNA, 75 bp, Artificial Sequence
  Synthetic
ggaaataagaaaacagaaaaaaatagataggatacttgaaagaataagagaaagagcagaagacagtggaaatga

SEQ ID NO: 183885 - DNA, 75 bp, Artificial Sequence
  Synthetic
gaaaatattaagacaaagaaaaatagacaggttacttgatagaataatagaaagagcagaagacagtggcaatga

SEQ ID NO: 183886 - DNA, 75 bp, Artificial Sequence
  Synthetic
aagtctgtggaattggtttgacatatcaaattggctatggtatataagaatatttataatgatagtaggaggctt

SEQ ID NO: 183887 - DNA, 75 bp, Artificial Sequence
  Synthetic
tactggcttcaagaattgcagaatagtgctacaaatctagtagatactattgcagtagcagtagctaattggact

SEQ ID NO: 183888 - DNA, 75 bp, Artificial Sequence
  Synthetic
aagccatattaggacatatagttagccctaggtgtgaatatcaagcaggacataacaaggtaggatctctacaat

SEQ ID NO: 183889 - DNA, 75 bp, Artificial Sequence
  Synthetic
ttgattgcagcgaggactgtggaacttctgggacacagcagtctcaagggactgagactggggtgggaaggcctc

SEQ ID NO: 183890 - DNA, 75 bp, Artificial Sequence
  Synthetic
aattggtagagcttttctcaacatacctagaagaatcagacagggcttcgaaagagctttgctataaaatgggtg

SEQ ID NO: 183891 - DNA, 75 bp, Artificial Sequence
  Synthetic
tagatctgaaaacctcacaaacaatgccaaagtcataatagtgcagcttaataaaagtatagcaattaattgtac

SEQ ID NO: 183892 - DNA, 75 bp, Artificial Sequence
  Synthetic
agaaaaagcctttaaccctgaaattattcctatgttcatggcattgtcagagggagctattccctatgatattaa

SEQ ID NO: 183893 - DNA, 75 bp, Artificial Sequence
  Synthetic
ttaagggccaaaaaagaattaagtgcttcaactgtggcaaagaaggacacctagccagaaattgcagggccccta

SEQ ID NO: 183894 - DNA, 75 bp, Artificial Sequence
  Synthetic
aatcatagcaataattgtgtggaccatagtatatatagaatataggaaactgttaaggcaaagaaaaatagactg

SEQ ID NO: 183895 - DNA, 75 bp, Artificial Sequence
  Synthetic
actttaagatgtacaaatgctacctacaataatgataataacatggatggaaaaaattgctctttcaatgtaacc

SEQ ID NO: 183896 - DNA, 75 bp, Artificial Sequence
  Synthetic
agaaatgaaatctttatttaatgcagtagcagtcctctattgtgtacatcaaaggataagggtaaatgacaccaa

SEQ ID NO: 183897 - DNA, 75 bp, Artificial Sequence
  Synthetic
agattgccataagtataacagcacctataacggcaccaacagtacggttgacatgcgagaagaaataaaaaactg

SEQ ID NO: 183898 - DNA, 75 bp, Artificial Sequence
  Synthetic
aatcttagagccctttagaacaagaaatccagacatagttatctaccaatacatggatgatttgtatgtagggtc

SEQ ID NO: 183899 - DNA, 75 bp, Artificial Sequence
  Synthetic
acagatgttaaaagtgctaatagtaccagtgaagatatgagaaattgctctttcaatgtaaccacagagaggaaa

SEQ ID NO: 183900 - DNA, 75 bp, Artificial Sequence
  Synthetic
acaataatctttcaaccaccctcaggaggagatctagaaattacaacacatcattttaattgtagaggggaattt

SEQ ID NO: 183901 - DNA, 75 bp, Artificial Sequence
  Synthetic
tataaaaaagaaagatagtactaagtggagaaaattggtagactttagggaattaaacaagagaacacaagattt

SEQ ID NO: 183902 - DNA, 75 bp, Artificial Sequence
  Synthetic
gctccttgggatgttaatgatatgtaaagctgcagataacttgtgggtcacagtctattatggggtacctgtgtg

SEQ ID NO: 183903 - DNA, 75 bp, Artificial Sequence
  Synthetic
ataaaacaaattataaacatgtggcagggggtaggaagagcaatgtatgcccctcccattgcaggaaacataaca

SEQ ID NO: 183904 - DNA, 75 bp, Artificial Sequence
  Synthetic
aatgtcaccacagaaataagagataagacaagaaaagaatatgcacttttttataggcttgatgtagtaccaata

SEQ ID NO: 183905 - DNA, 75 bp, Artificial Sequence
  Synthetic
accagcaggacaaaaatgaaaaggatttgttagaattggataaatgggcaagtctgtggaattggtttgacataa

SEQ ID NO: 183906 - DNA, 75 bp, Artificial Sequence
  Synthetic
agaaacctattatgtagatggagcagctaatagaaatacaaaactaggaaaggcaggatatgttacagaacaagg

SEQ ID NO: 183907 - DNA, 75 bp, Artificial Sequence
  Synthetic
aggggaggccagggaattttcctcagaacagactggaaccaacagccccaccagcagagagctttgggatggggg

SEQ ID NO: 183908 - DNA, 75 bp, Artificial Sequence
  Synthetic
acccttgcgcaggaggagagggaaataaaaaactgcactttcaatatcacaacaggcttaaaagatagggtgaaa

SEQ ID NO: 183909 - DNA, 75 bp, Artificial Sequence
  Synthetic
atataatcagtttatgggatcaaagcctaaagccatgtgtaaagttgaccccactctgtgtcactttaaattgta

SEQ ID NO: 183910 - DNA, 75 bp, Artificial Sequence
  Synthetic
caatgtacacatggaattaagccagtagtatcaactcaactgctgttaaatggcagtctagcagaagaagagata

SEQ ID NO: 183911 - DNA, 75 bp, Artificial Sequence
  Synthetic
gcaatgttgataatagtactagcagccataatgtgagcaaggaaatgacgggagaaataaaaaactgctctttca

SEQ ID NO: 183912 - DNA, 75 bp, Artificial Sequence
  Synthetic
gagagccatgtatgcaacaggaggcatagtaggaaatataagactagcacattgtaacattagtggagaaaagtg

SEQ ID NO: 183913 - DNA, 75 bp, Artificial Sequence
  Synthetic
gacaggctcggaagaatcgaagaagaaggtggagagcaagacagagacagatccattcgattagtgagcggattc

SEQ ID NO: 183914 - DNA, 75 bp, Artificial Sequence
  Synthetic
ttggagtaataaatctctggattacatttggaataacatgacctggatgcagtgggaaaaagaaattgacaatta

SEQ ID NO: 183915 - DNA, 75 bp, Artificial Sequence
  Synthetic
gaaatgtaacagaaaattttaacatgtgggaaaatgacatggtggatcaaatgcatgaggatataatcagtttat

SEQ ID NO: 183916 - DNA, 75 bp, Artificial Sequence
  Synthetic
catgggtaaaagtagtagaagaaaaggctttcagcccagaagtaatacccatgttttcagcattatcagaaggag

SEQ ID NO: 183917 - DNA, 75 bp, Artificial Sequence
  Synthetic
gaagaataagacagggctttgaagcggctttgctataaaatggggggcaagtggtcaaaaagcagcatagtggga

SEQ ID NO: 183918 - DNA, 75 bp, Artificial Sequence
  Synthetic
tgtagagctattctccacatacctagaagaatcagacaaggcttcgaaagggctttactataacatgggtggcaa

SEQ ID NO: 183919 - DNA, 75 bp, Artificial Sequence
  Synthetic
ccacagtaataaatgataggaagcagtcagtgcatgcacttttttataagcttgatatagaaccacttgataata

SEQ ID NO: 183920 - DNA, 75 bp, Artificial Sequence
  Synthetic
ctttgcaataaaatggggggcaagtggtcaaaaagcagtatagttggatggcctgctgtaagagaaagaataaga

SEQ ID NO: 183921 - DNA, 75 bp, Artificial Sequence
  Synthetic
gcacaagaggaagaggaggtaggctttccagtcaggccacaagtacctctaagaccaatgacttacaagggagct

SEQ ID NO: 183922 - DNA, 75 bp, Artificial Sequence
  Synthetic
gcaacagtctatgctggggtgcctgtatgggaagaggcagaaccagtattattctgtgcctcagatgctaaccta

SEQ ID NO: 183923 - DNA, 75 bp, Artificial Sequence
  Synthetic
tctgaaaatctgacaaacaacgcccaaacaataatagtacatctgaatgcatctgtagcaattaattgtacaaga

SEQ ID NO: 183924 - DNA, 75 bp, Artificial Sequence
  Synthetic
gttctcaaagataaaaaggagagaagacaggctttattctatgtatcagacttggctagagtggatgatagcgaa

SEQ ID NO: 183925 - DNA, 75 bp, Artificial Sequence
  Synthetic
acaaaaaggtaggcaagaaattagcagaacacttccctagtaaaacaataaactttacatcatcctcaggagggg

SEQ ID NO: 183926 - DNA, 75 bp, Artificial Sequence
  Synthetic
aatacccatgtttacagcactatcagaaggagccaccccacaagatttaaacaccatgctaaatacagtgggggg

SEQ ID NO: 183927 - DNA, 75 bp, Artificial Sequence
  Synthetic
aaaacttgtgggttactgtctactatggggtacctgtgtggaaagacgcagagaccaccttattttgtgcatcag

SEQ ID NO: 183928 - DNA, 75 bp, Artificial Sequence
  Synthetic
tctctctgaccaaagcagtaccctgaaggaagaaccaggggcaatacaaaactgttctttcaatatgaccacaga

SEQ ID NO: 183929 - DNA, 75 bp, Artificial Sequence
  Synthetic
tcctcagagcagtaaggatcatcaaaatcctgtaccaaagcagtaagtaataagtatatgtaatgacacctttgg

SEQ ID NO: 183930 - DNA, 75 bp, Artificial Sequence
  Synthetic
tagattaataaattgtaatacctcagccattacacaagcttgtccaaaggtaacctttgagccaattcccataca

SEQ ID NO: 183931 - DNA, 75 bp, Artificial Sequence
  Synthetic
ctgagccagcagcagagggagtaggagcagcgtctcaagacttagataaatatggggcacttacaagcagcaaca

SEQ ID NO: 183932 - DNA, 75 bp, Artificial Sequence
  Synthetic
ctggctgcaagcacaagaggaggaagaagaagtaggctttccagtcagacctcaggtgcctacaagaccaatgac

SEQ ID NO: 183933 - DNA, 75 bp, Artificial Sequence
  Synthetic
tagacaaataatagaacagctccaatcatcccttcaaacaggatcagaagaacttagatcattatttaatacagt

SEQ ID NO: 183934 - DNA, 75 bp, Artificial Sequence
  Synthetic
atataggaccaggacaagcattctatgcaacaggtaaaataataggggatataagacaagcacattgtaatgtca

SEQ ID NO: 183935 - DNA, 75 bp, Artificial Sequence
  Synthetic
gtttatgggatcaaagtctaaagccatgtgtaaagttaactcctctctgcgttactttaaattgtaccgatgcta

SEQ ID NO: 183936 - DNA, 75 bp, Artificial Sequence
  Synthetic
gtcaaaacccaggatagttggatggcctgttgtaagagaaagaataagacaagctgagccaggaataagacaagc

SEQ ID NO: 183937 - DNA, 75 bp, Artificial Sequence
  Synthetic
tctacagatgaaatgaaaagctgttcttttaatatgaccacagaagtaggagataggaagcagaatgtcagtgca

SEQ ID NO: 183938 - DNA, 75 bp, Artificial Sequence
  Synthetic
tagtgagaaacattaggcagggatatcaacccctctcgttccagatccccatccatcaccaatcggaagcagaaa

SEQ ID NO: 183939 - DNA, 75 bp, Artificial Sequence
  Synthetic
atccatcaccaatcggaagcagaaacgccaggaagaacaggagaaggaggtggagaagaaggcaggcccagattg

SEQ ID NO: 183940 - DNA, 75 bp, Artificial Sequence
  Synthetic
acaatacaagaaaaggtatacatatgggaccagggcacgcatggcatacaacaagacaaataataggagatataa

SEQ ID NO: 183941 - DNA, 75 bp, Artificial Sequence
  Synthetic
gtaaggatcatcaaaatcctgtatcaaagcagtaagtattataatagtagatgtaatgtcaatcttagagatctg

SEQ ID NO: 183942 - DNA, 75 bp, Artificial Sequence
  Synthetic
caagttcctatactcctcaaaacaatgcagcccttgcatttctagagagccaccaagatgaagatgtaggtttcc

SEQ ID NO: 183943 - DNA, 75 bp, Artificial Sequence
  Synthetic
gctcccttgcagaataaaacaaattgtaaacatgtggcagcaagtaggaagagcaatgtatgcccctcccattgc

SEQ ID NO: 183944 - DNA, 75 bp, Artificial Sequence
  Synthetic
aggttaattgaaagaatagcagaaagagcagaagacagtggcaatgaaagtgatggggacacagaggaattatcc

SEQ ID NO: 183945 - DNA, 75 bp, Artificial Sequence
  Synthetic
acaagccccagaagaccaagggccacagagggagccatacaatgaatgggcactagagcttttagaggagcttaa

SEQ ID NO: 183946 - DNA, 75 bp, Artificial Sequence
  Synthetic
aagaaatgccatattaggacatatagttagtcctagttgtgaatatcaagcaggacataacaaggtaggatctct

SEQ ID NO: 183947 - DNA, 75 bp, Artificial Sequence
  Synthetic
cgacaggcccgaaggaatcgaagaaggaggtggagagcaaggcaaagacagatccgtgcgattagtgaacggatt

SEQ ID NO: 183948 - DNA, 75 bp, Artificial Sequence
  Synthetic
acacatgcctgtgtacccacagaccccaacccacaagagatggtcctggaaaatgtaacagagaactttaatatg

SEQ ID NO: 183949 - DNA, 75 bp, Artificial Sequence
  Synthetic
aaaattatggtaccagctggagaaagaacccatagcaggagcagaaactttctatgtagatggagcagctaatag

SEQ ID NO: 183950 - DNA, 75 bp, Artificial Sequence
  Synthetic
ttggagtcaggaactaaagaatagtgctattagcttgtttaataccacagcaatagtagtagctgaggggacaga

SEQ ID NO: 183951 - DNA, 75 bp, Artificial Sequence
  Synthetic
atataactacagaaataagagataagagacagaaagaatacgcgcttttctataaacttgatatagtaccactta

SEQ ID NO: 183952 - DNA, 75 bp, Artificial Sequence
  Synthetic
agtgaccacatattggggattgatgccaggagaaagagatgaacatatgggacatggggttagtatagaatggca

SEQ ID NO: 183953 - DNA, 75 bp, Artificial Sequence
  Synthetic
aacatcacagacaatactaaaaacataatagtacagcttaatgagactgtagaaattaactgtaccaggcctaat

SEQ ID NO: 183954 - DNA, 75 bp, Artificial Sequence
  Synthetic
atagacaggttaattgatagaataatagaaagagcagaagacagtggcaatgagagtgaaggagatcaggaagaa

SEQ ID NO: 183955 - DNA, 75 bp, Artificial Sequence
  Synthetic
taggaccaggacgagcattctatgcaacaagtgacatcataggagacataagacaagcacattgtagcattagta

SEQ ID NO: 183956 - DNA, 75 bp, Artificial Sequence
  Synthetic
gatgtttattcttagaaaatatttagaacaaaagagacaagacagaagggaaagagaaatacttgaaaggttaag

SEQ ID NO: 183957 - DNA, 75 bp, Artificial Sequence
  Synthetic
atagaggtaaaagacaccaaggaagctctagataaaatagaggaaatacaaaataagagcaagcaaaagacacaa

SEQ ID NO: 183958 - DNA, 75 bp, Artificial Sequence
  Synthetic
caggcagcagctgccacaggaaacagcagcaatgtcagccaaaattaccctatagtgcaaaatgcacaagggcaa

SEQ ID NO: 183959 - DNA, 75 bp, Artificial Sequence
  Synthetic
tgacatttggaacaacatgacttggatggaatgggaaagacaaattgacaattacacagaggtaatatacaattt

SEQ ID NO: 183960 - DNA, 75 bp, Artificial Sequence
  Synthetic
tagtatgggcaagcagggagctggaaagattcgcatgtaatcctgagctactagaaactgcagagggtaatgagc

SEQ ID NO: 183961 - DNA, 75 bp, Artificial Sequence
  Synthetic
agcattgataaaaccaaagaagataaagccacctctgcctagtgttaggaaattagtagaggatagatggaacaa

SEQ ID NO: 183962 - DNA, 75 bp, Artificial Sequence
  Synthetic
gtctaaaaccatgtgtaaagctaacccctctctgtgttactttaagctgtactaatgtaaacagtaccagaaata

SEQ ID NO: 183963 - DNA, 75 bp, Artificial Sequence
  Synthetic
tgatgcagaaaggtaactttaagggccaaagaagaagtgttaaatgttttaactgtggcaaagaaggacacatag

SEQ ID NO: 183964 - DNA, 75 bp, Artificial Sequence
  Synthetic
atatcactctggaacacagtagcagtgctctggtgtgttcacaaaggatataaagttagagatacacagcaggca

SEQ ID NO: 183965 - DNA, 75 bp, Artificial Sequence
  Synthetic
taaacaaaagaaagaatacacgcttttctataaacttgatataatgccaattagtgataatagtaataataatac

SEQ ID NO: 183966 - DNA, 75 bp, Artificial Sequence
  Synthetic
taaacaaaagaaagaatacacgcttttctataaacttgatatattgccaattagtgataatagtaataataatac

SEQ ID NO: 183967 - DNA, 75 bp, Artificial Sequence
  Synthetic
taaacaaaagaaagaatacacgcttttctataaacttgatatactgccaattagtgataatagtaataataatac

SEQ ID NO: 183968 - DNA, 75 bp, Artificial Sequence
  Synthetic
taaacaaaagaaagaatacacgcttttctataaacttgatatagtgccaattagtgataatagtaataataatac

SEQ ID NO: 183969 - DNA, 75 bp, Artificial Sequence
  Synthetic
taaacaaaagaaagaatactcgcttttctataaacttgatataatgccaattagtgataatagtaataataatac

SEQ ID NO: 183970 - DNA, 75 bp, Artificial Sequence
  Synthetic
taaacaaaagaaagaatactcgcttttctataaacttgatatattgccaattagtgataatagtaataataatac

SEQ ID NO: 183971 - DNA, 75 bp, Artificial Sequence
  Synthetic
taaacaaaagaaagaatactcgcttttctataaacttgatatactgccaattagtgataatagtaataataatac

SEQ ID NO: 183972 - DNA, 75 bp, Artificial Sequence
  Synthetic
taaacaaaagaaagaatactcgcttttctataaacttgatatagtgccaattagtgataatagtaataataatac

SEQ ID NO: 183973 - DNA, 75 bp, Artificial Sequence
  Synthetic
taaacaaaagaaagaatacccgcttttctataaacttgatataatgccaattagtgataatagtaataataatac

SEQ ID NO: 183974 - DNA, 75 bp, Artificial Sequence
  Synthetic
taaacaaaagaaagaatacccgcttttctataaacttgatatattgccaattagtgataatagtaataataatac

SEQ ID NO: 183975 - DNA, 75 bp, Artificial Sequence
  Synthetic
taaacaaaagaaagaatacccgcttttctataaacttgatatactgccaattagtgataatagtaataataatac

SEQ ID NO: 183976 - DNA, 75 bp, Artificial Sequence
  Synthetic
taaacaaaagaaagaatacccgcttttctataaacttgatatagtgccaattagtgataatagtaataataatac

SEQ ID NO: 183977 - DNA, 75 bp, Artificial Sequence
  Synthetic
taaacaaaagaaagaatacgcgcttttctataaacttgatataatgccaattagtgataatagtaataataatac

SEQ ID NO: 183978 - DNA, 75 bp, Artificial Sequence
  Synthetic
taaacaaaagaaagaatacgcgcttttctataaacttgatatattgccaattagtgataatagtaataataatac

SEQ ID NO: 183979 - DNA, 75 bp, Artificial Sequence
  Synthetic
taaacaaaagaaagaatacgcgcttttctataaacttgatatactgccaattagtgataatagtaataataatac

SEQ ID NO: 183980 - DNA, 75 bp, Artificial Sequence
  Synthetic
taaacaaaagaaagaatacgcgcttttctataaacttgatatagtgccaattagtgataatagtaataataatac

SEQ ID NO: 183981 - DNA, 75 bp, Artificial Sequence
  Synthetic
taaacataagaaagaatacacgcttttctataaacttgatataatgccaattagtgataatagtaataataatac

SEQ ID NO: 183982 - DNA, 75 bp, Artificial Sequence
  Synthetic
taaacataagaaagaatacacgcttttctataaacttgatatattgccaattagtgataatagtaataataatac

SEQ ID NO: 183983 - DNA, 75 bp, Artificial Sequence
  Synthetic
taaacataagaaagaatacacgcttttctataaacttgatatactgccaattagtgataatagtaataataatac

SEQ ID NO: 183984 - DNA, 75 bp, Artificial Sequence
  Synthetic
taaacataagaaagaatacacgcttttctataaacttgatatagtgccaattagtgataatagtaataataatac

SEQ ID NO: 183985 - DNA, 75 bp, Artificial Sequence
  Synthetic
taaacataagaaagaatactcgcttttctataaacttgatataatgccaattagtgataatagtaataataatac

SEQ ID NO: 183986 - DNA, 75 bp, Artificial Sequence
  Synthetic
taaacataagaaagaatactcgcttttctataaacttgatatattgccaattagtgataatagtaataataatac

SEQ ID NO: 183987 - DNA, 75 bp, Artificial Sequence
  Synthetic
taaacataagaaagaatactcgcttttctataaacttgatatactgccaattagtgataatagtaataataatac

SEQ ID NO: 183988 - DNA, 75 bp, Artificial Sequence
  Synthetic
taaacataagaaagaatactcgcttttctataaacttgatatagtgccaattagtgataatagtaataataatac

SEQ ID NO: 183989 - DNA, 75 bp, Artificial Sequence
  Synthetic
taaacataagaaagaatacccgcttttctataaacttgatataatgccaattagtgataatagtaataataatac

SEQ ID NO: 183990 - DNA, 75 bp, Artificial Sequence
  Synthetic
taaacataagaaagaatacccgcttttctataaacttgatatattgccaattagtgataatagtaataataatac

SEQ ID NO: 183991 - DNA, 75 bp, Artificial Sequence
  Synthetic
taaacataagaaagaatacccgcttttctataaacttgatatactgccaattagtgataatagtaataataatac

SEQ ID NO: 183992 - DNA, 75 bp, Artificial Sequence
  Synthetic
taaacataagaaagaatacccgcttttctataaacttgatatagtgccaattagtgataatagtaataataatac

SEQ ID NO: 183993 - DNA, 75 bp, Artificial Sequence
  Synthetic
taaacataagaaagaatacgcgcttttctataaacttgatataatgccaattagtgataatagtaataataatac

SEQ ID NO: 183994 - DNA, 75 bp, Artificial Sequence
  Synthetic
taaacataagaaagaatacgcgcttttctataaacttgatatattgccaattagtgataatagtaataataatac

SEQ ID NO: 183995 - DNA, 75 bp, Artificial Sequence
  Synthetic
taaacataagaaagaatacgcgcttttctataaacttgatatactgccaattagtgataatagtaataataatac

SEQ ID NO: 183996 - DNA, 75 bp, Artificial Sequence
  Synthetic
taaacataagaaagaatacgcgcttttctataaacttgatatagtgccaattagtgataatagtaataataatac

SEQ ID NO: 183997 - DNA, 75 bp, Artificial Sequence
  Synthetic
taaacacaagaaagaatacacgcttttctataaacttgatataatgccaattagtgataatagtaataataatac

SEQ ID NO: 183998 - DNA, 75 bp, Artificial Sequence
  Synthetic
taaacacaagaaagaatacacgcttttctataaacttgatatattgccaattagtgataatagtaataataatac

SEQ ID NO: 183999 - DNA, 75 bp, Artificial Sequence
  Synthetic
taaacacaagaaagaatacacgcttttctataaacttgatatactgccaattagtgataatagtaataataatac

SEQ ID NO: 184000 - DNA, 75 bp, Artificial Sequence
  Synthetic
taaacacaagaaagaatacacgcttttctataaacttgatatagtgccaattagtgataatagtaataataatac

SEQ ID NO: 184001 - DNA, 75 bp, Artificial Sequence
  Synthetic
taaacacaagaaagaatactcgcttttctataaacttgatataatgccaattagtgataatagtaataataatac

SEQ ID NO: 184002 - DNA, 75 bp, Artificial Sequence
  Synthetic
taaacacaagaaagaatactcgcttttctataaacttgatatattgccaattagtgataatagtaataataatac

SEQ ID NO: 184003 - DNA, 75 bp, Artificial Sequence
  Synthetic
taaacacaagaaagaatactcgcttttctataaacttgatatactgccaattagtgataatagtaataataatac

SEQ ID NO: 184004 - DNA, 75 bp, Artificial Sequence
  Synthetic
taaacacaagaaagaatactcgcttttctataaacttgatatagtgccaattagtgataatagtaataataatac

SEQ ID NO: 184005 - DNA, 75 bp, Artificial Sequence
  Synthetic
taaacacaagaaagaatacccgcttttctataaacttgatataatgccaattagtgataatagtaataataatac

SEQ ID NO: 184006 - DNA, 75 bp, Artificial Sequence
  Synthetic
taaacacaagaaagaatacccgcttttctataaacttgatatattgccaattagtgataatagtaataataatac

SEQ ID NO: 184007 - DNA, 75 bp, Artificial Sequence
  Synthetic
taaacacaagaaagaatacccgcttttctataaacttgatatactgccaattagtgataatagtaataataatac

SEQ ID NO: 184008 - DNA, 75 bp, Artificial Sequence
  Synthetic
taaacacaagaaagaatacccgcttttctataaacttgatatagtgccaattagtgataatagtaataataatac

SEQ ID NO: 184009 - DNA, 75 bp, Artificial Sequence
  Synthetic
taaacacaagaaagaatacgcgcttttctataaacttgatataatgccaattagtgataatagtaataataatac

SEQ ID NO: 184010 - DNA, 75 bp, Artificial Sequence
  Synthetic
taaacacaagaaagaatacgcgcttttctataaacttgatatattgccaattagtgataatagtaataataatac

SEQ ID NO: 184011 - DNA, 75 bp, Artificial Sequence
  Synthetic
taaacacaagaaagaatacgcgcttttctataaacttgatatactgccaattagtgataatagtaataataatac

SEQ ID NO: 184012 - DNA, 75 bp, Artificial Sequence
  Synthetic
taaacacaagaaagaatacgcgcttttctataaacttgatatagtgccaattagtgataatagtaataataatac

SEQ ID NO: 184013 - DNA, 75 bp, Artificial Sequence
  Synthetic
taaacagaagaaagaatacacgcttttctataaacttgatataatgccaattagtgataatagtaataataatac

SEQ ID NO: 184014 - DNA, 75 bp, Artificial Sequence
  Synthetic
taaacagaagaaagaatacacgcttttctataaacttgatatattgccaattagtgataatagtaataataatac

SEQ ID NO: 184015 - DNA, 75 bp, Artificial Sequence
  Synthetic
taaacagaagaaagaatacacgcttttctataaacttgatatactgccaattagtgataatagtaataataatac

SEQ ID NO: 184016 - DNA, 75 bp, Artificial Sequence
  Synthetic
taaacagaagaaagaatacacgcttttctataaacttgatatagtgccaattagtgataatagtaataataatac

SEQ ID NO: 184017 - DNA, 75 bp, Artificial Sequence
  Synthetic
taaacagaagaaagaatactcgcttttctataaacttgatataatgccaattagtgataatagtaataataatac

SEQ ID NO: 184018 - DNA, 75 bp, Artificial Sequence
  Synthetic
taaacagaagaaagaatactcgcttttctataaacttgatatattgccaattagtgataatagtaataataatac

SEQ ID NO: 184019 - DNA, 75 bp, Artificial Sequence
  Synthetic
taaacagaagaaagaatactcgcttttctataaacttgatatactgccaattagtgataatagtaataataatac

SEQ ID NO: 184020 - DNA, 75 bp, Artificial Sequence
  Synthetic
taaacagaagaaagaatactcgcttttctataaacttgatatagtgccaattagtgataatagtaataataatac

SEQ ID NO: 184021 - DNA, 75 bp, Artificial Sequence
  Synthetic
taaacagaagaaagaatacccgcttttctataaacttgatataatgccaattagtgataatagtaataataatac

SEQ ID NO: 184022 - DNA, 75 bp, Artificial Sequence
  Synthetic
taaacagaagaaagaatacccgcttttctataaacttgatatattgccaattagtgataatagtaataataatac

SEQ ID NO: 184023 - DNA, 75 bp, Artificial Sequence
  Synthetic
taaacagaagaaagaatacccgcttttctataaacttgatatactgccaattagtgataatagtaataataatac

SEQ ID NO: 184024 - DNA, 75 bp, Artificial Sequence
  Synthetic
taaacagaagaaagaatacccgcttttctataaacttgatatagtgccaattagtgataatagtaataataatac

SEQ ID NO: 184025 - DNA, 75 bp, Artificial Sequence
  Synthetic
taaacagaagaaagaatacgcgcttttctataaacttgatataatgccaattagtgataatagtaataataatac

SEQ ID NO: 184026 - DNA, 75 bp, Artificial Sequence
  Synthetic
taaacagaagaaagaatacgcgcttttctataaacttgatatattgccaattagtgataatagtaataataatac

SEQ ID NO: 184027 - DNA, 75 bp, Artificial Sequence
  Synthetic
taaacagaagaaagaatacgcgcttttctataaacttgatatactgccaattagtgataatagtaataataatac

SEQ ID NO: 184028 - DNA, 75 bp, Artificial Sequence
  Synthetic
taaacagaagaaagaatacgcgcttttctataaacttgatatagtgccaattagtgataatagtaataataatac

SEQ ID NO: 184029 - DNA, 75 bp, Artificial Sequence
  Synthetic
tgatagtaggaggcttaataggattaagaatagtttttgctgtgctttctatagtaaatagagttaggcagggat

SEQ ID NO: 184030 - DNA, 75 bp, Artificial Sequence
  Synthetic
aattcccatacactattgtgctccacctggatttgcaattctaaaatgtaaggatgaagagttcaatgaaacagg

SEQ ID NO: 184031 - DNA, 75 bp, Artificial Sequence
  Synthetic
aattcccatacactattgtgctccacctggatttgcaattctaaaatgtaaggatgaagagttcaatgtaacagg

SEQ ID NO: 184032 - DNA, 75 bp, Artificial Sequence
  Synthetic
aattcccatacactattgtgctccacctggatttgcaattctaaaatgtaaggatgaagagttcaatgcaacagg

SEQ ID NO: 184033 - DNA, 75 bp, Artificial Sequence
  Synthetic
aattcccatacactattgtgctccacctggatttgcaattctaaaatgtaaggatgaagagttcaatggaacagg

SEQ ID NO: 184034 - DNA, 75 bp, Artificial Sequence
  Synthetic
aattcccatacactattgtgctccacctggttttgcaattctaaaatgtaaggatgaagagttcaatgaaacagg

SEQ ID NO: 184035 - DNA, 75 bp, Artificial Sequence
  Synthetic
aattcccatacactattgtgctccacctggttttgcaattctaaaatgtaaggatgaagagttcaatgtaacagg

SEQ ID NO: 184036 - DNA, 75 bp, Artificial Sequence
  Synthetic
aattcccatacactattgtgctccacctggttttgcaattctaaaatgtaaggatgaagagttcaatgcaacagg

SEQ ID NO: 184037 - DNA, 75 bp, Artificial Sequence
  Synthetic
aattcccatacactattgtgctccacctggttttgcaattctaaaatgtaaggatgaagagttcaatggaacagg

SEQ ID NO: 184038 - DNA, 75 bp, Artificial Sequence
  Synthetic
aattcccatacactattgtgctccacctggctttgcaattctaaaatgtaaggatgaagagttcaatgaaacagg

SEQ ID NO: 184039 - DNA, 75 bp, Artificial Sequence
  Synthetic
aattcccatacactattgtgctccacctggctttgcaattctaaaatgtaaggatgaagagttcaatgtaacagg

SEQ ID NO: 184040 - DNA, 75 bp, Artificial Sequence
  Synthetic
aattcccatacactattgtgctccacctggctttgcaattctaaaatgtaaggatgaagagttcaatgcaacagg

SEQ ID NO: 184041 - DNA, 75 bp, Artificial Sequence
  Synthetic
aattcccatacactattgtgctccacctggctttgcaattctaaaatgtaaggatgaagagttcaatggaacagg

SEQ ID NO: 184042 - DNA, 75 bp, Artificial Sequence
  Synthetic
aattcccatacactattgtgctccacctgggtttgcaattctaaaatgtaaggatgaagagttcaatgaaacagg

SEQ ID NO: 184043 - DNA, 75 bp, Artificial Sequence
  Synthetic
aattcccatacactattgtgctccacctgggtttgcaattctaaaatgtaaggatgaagagttcaatgtaacagg

SEQ ID NO: 184044 - DNA, 75 bp, Artificial Sequence
  Synthetic
aattcccatacactattgtgctccacctgggtttgcaattctaaaatgtaaggatgaagagttcaatgcaacagg

SEQ ID NO: 184045 - DNA, 75 bp, Artificial Sequence
  Synthetic
aattcccatacactattgtgctccacctgggtttgcaattctaaaatgtaaggatgaagagttcaatggaacagg

SEQ ID NO: 184046 - DNA, 75 bp, Artificial Sequence
  Synthetic
atttcccatacactattgtgctccacctggatttgcaattctaaaatgtaaggatgaagagttcaatgaaacagg

SEQ ID NO: 184047 - DNA, 75 bp, Artificial Sequence
  Synthetic
atttcccatacactattgtgctccacctggatttgcaattctaaaatgtaaggatgaagagttcaatgtaacagg

SEQ ID NO: 184048 - DNA, 75 bp, Artificial Sequence
  Synthetic
atttcccatacactattgtgctccacctggatttgcaattctaaaatgtaaggatgaagagttcaatgcaacagg

SEQ ID NO: 184049 - DNA, 75 bp, Artificial Sequence
  Synthetic
atttcccatacactattgtgctccacctggatttgcaattctaaaatgtaaggatgaagagttcaatggaacagg

SEQ ID NO: 184050 - DNA, 75 bp, Artificial Sequence
  Synthetic
atttcccatacactattgtgctccacctggttttgcaattctaaaatgtaaggatgaagagttcaatgaaacagg

SEQ ID NO: 184051 - DNA, 75 bp, Artificial Sequence
  Synthetic
atttcccatacactattgtgctccacctggttttgcaattctaaaatgtaaggatgaagagttcaatgtaacagg

SEQ ID NO: 184052 - DNA, 75 bp, Artificial Sequence
  Synthetic
atttcccatacactattgtgctccacctggttttgcaattctaaaatgtaaggatgaagagttcaatgcaacagg

SEQ ID NO: 184053 - DNA, 75 bp, Artificial Sequence
  Synthetic
atttcccatacactattgtgctccacctggttttgcaattctaaaatgtaaggatgaagagttcaatggaacagg

SEQ ID NO: 184054 - DNA, 75 bp, Artificial Sequence
  Synthetic
atttcccatacactattgtgctccacctggctttgcaattctaaaatgtaaggatgaagagttcaatgaaacagg

SEQ ID NO: 184055 - DNA, 75 bp, Artificial Sequence
  Synthetic
atttcccatacactattgtgctccacctggctttgcaattctaaaatgtaaggatgaagagttcaatgtaacagg

SEQ ID NO: 184056 - DNA, 75 bp, Artificial Sequence
  Synthetic
atttcccatacactattgtgctccacctggctttgcaattctaaaatgtaaggatgaagagttcaatgcaacagg

SEQ ID NO: 184057 - DNA, 75 bp, Artificial Sequence
  Synthetic
atttcccatacactattgtgctccacctggctttgcaattctaaaatgtaaggatgaagagttcaatggaacagg

SEQ ID NO: 184058 - DNA, 75 bp, Artificial Sequence
  Synthetic
atttcccatacactattgtgctccacctgggtttgcaattctaaaatgtaaggatgaagagttcaatgaaacagg

SEQ ID NO: 184059 - DNA, 75 bp, Artificial Sequence
  Synthetic
atttcccatacactattgtgctccacctgggtttgcaattctaaaatgtaaggatgaagagttcaatgtaacagg

SEQ ID NO: 184060 - DNA, 75 bp, Artificial Sequence
  Synthetic
atttcccatacactattgtgctccacctgggtttgcaattctaaaatgtaaggatgaagagttcaatgcaacagg

SEQ ID NO: 184061 - DNA, 75 bp, Artificial Sequence
  Synthetic
atttcccatacactattgtgctccacctgggtttgcaattctaaaatgtaaggatgaagagttcaatggaacagg

SEQ ID NO: 184062 - DNA, 75 bp, Artificial Sequence
  Synthetic
acttcccatacactattgtgctccacctggatttgcaattctaaaatgtaaggatgaagagttcaatgaaacagg

SEQ ID NO: 184063 - DNA, 75 bp, Artificial Sequence
  Synthetic
acttcccatacactattgtgctccacctggatttgcaattctaaaatgtaaggatgaagagttcaatgtaacagg

SEQ ID NO: 184064 - DNA, 75 bp, Artificial Sequence
  Synthetic
acttcccatacactattgtgctccacctggatttgcaattctaaaatgtaaggatgaagagttcaatgcaacagg

SEQ ID NO: 184065 - DNA, 75 bp, Artificial Sequence
  Synthetic
acttcccatacactattgtgctccacctggatttgcaattctaaaatgtaaggatgaagagttcaatggaacagg

SEQ ID NO: 184066 - DNA, 75 bp, Artificial Sequence
  Synthetic
acttcccatacactattgtgctccacctggttttgcaattctaaaatgtaaggatgaagagttcaatgaaacagg

SEQ ID NO: 184067 - DNA, 75 bp, Artificial Sequence
  Synthetic
acttcccatacactattgtgctccacctggttttgcaattctaaaatgtaaggatgaagagttcaatgtaacagg

SEQ ID NO: 184068 - DNA, 75 bp, Artificial Sequence
  Synthetic
acttcccatacactattgtgctccacctggttttgcaattctaaaatgtaaggatgaagagttcaatgcaacagg

SEQ ID NO: 184069 - DNA, 75 bp, Artificial Sequence
  Synthetic
acttcccatacactattgtgctccacctggttttgcaattctaaaatgtaaggatgaagagttcaatggaacagg

SEQ ID NO: 184070 - DNA, 75 bp, Artificial Sequence
  Synthetic
acttcccatacactattgtgctccacctggctttgcaattctaaaatgtaaggatgaagagttcaatgaaacagg

SEQ ID NO: 184071 - DNA, 75 bp, Artificial Sequence
  Synthetic
acttcccatacactattgtgctccacctggctttgcaattctaaaatgtaaggatgaagagttcaatgtaacagg

SEQ ID NO: 184072 - DNA, 75 bp, Artificial Sequence
  Synthetic
acttcccatacactattgtgctccacctggctttgcaattctaaaatgtaaggatgaagagttcaatgcaacagg

SEQ ID NO: 184073 - DNA, 75 bp, Artificial Sequence
  Synthetic
acttcccatacactattgtgctccacctggctttgcaattctaaaatgtaaggatgaagagttcaatggaacagg

SEQ ID NO: 184074 - DNA, 75 bp, Artificial Sequence
  Synthetic
acttcccatacactattgtgctccacctgggtttgcaattctaaaatgtaaggatgaagagttcaatgaaacagg

SEQ ID NO: 184075 - DNA, 75 bp, Artificial Sequence
  Synthetic
acttcccatacactattgtgctccacctgggtttgcaattctaaaatgtaaggatgaagagttcaatgtaacagg

SEQ ID NO: 184076 - DNA, 75 bp, Artificial Sequence
  Synthetic
acttcccatacactattgtgctccacctgggtttgcaattctaaaatgtaaggatgaagagttcaatgcaacagg

SEQ ID NO: 184077 - DNA, 75 bp, Artificial Sequence
  Synthetic
acttcccatacactattgtgctccacctgggtttgcaattctaaaatgtaaggatgaagagttcaatggaacagg

SEQ ID NO: 184078 - DNA, 75 bp, Artificial Sequence
  Synthetic
agttcccatacactattgtgctccacctggatttgcaattctaaaatgtaaggatgaagagttcaatgaaacagg

SEQ ID NO: 184079 - DNA, 75 bp, Artificial Sequence
  Synthetic
agttcccatacactattgtgctccacctggatttgcaattctaaaatgtaaggatgaagagttcaatgtaacagg

SEQ ID NO: 184080 - DNA, 75 bp, Artificial Sequence
  Synthetic
agttcccatacactattgtgctccacctggatttgcaattctaaaatgtaaggatgaagagttcaatgcaacagg

SEQ ID NO: 184081 - DNA, 75 bp, Artificial Sequence
  Synthetic
agttcccatacactattgtgctccacctggatttgcaattctaaaatgtaaggatgaagagttcaatggaacagg

SEQ ID NO: 184082 - DNA, 75 bp, Artificial Sequence
  Synthetic
agttcccatacactattgtgctccacctggttttgcaattctaaaatgtaaggatgaagagttcaatgaaacagg

SEQ ID NO: 184083 - DNA, 75 bp, Artificial Sequence
  Synthetic
agttcccatacactattgtgctccacctggttttgcaattctaaaatgtaaggatgaagagttcaatgtaacagg

SEQ ID NO: 184084 - DNA, 75 bp, Artificial Sequence
  Synthetic
agttcccatacactattgtgctccacctggttttgcaattctaaaatgtaaggatgaagagttcaatgcaacagg

SEQ ID NO: 184085 - DNA, 75 bp, Artificial Sequence
  Synthetic
agttcccatacactattgtgctccacctggttttgcaattctaaaatgtaaggatgaagagttcaatggaacagg

SEQ ID NO: 184086 - DNA, 75 bp, Artificial Sequence
  Synthetic
agttcccatacactattgtgctccacctggctttgcaattctaaaatgtaaggatgaagagttcaatgaaacagg

SEQ ID NO: 184087 - DNA, 75 bp, Artificial Sequence
  Synthetic
agttcccatacactattgtgctccacctggctttgcaattctaaaatgtaaggatgaagagttcaatgtaacagg

SEQ ID NO: 184088 - DNA, 75 bp, Artificial Sequence
  Synthetic
agttcccatacactattgtgctccacctggctttgcaattctaaaatgtaaggatgaagagttcaatgcaacagg

SEQ ID NO: 184089 - DNA, 75 bp, Artificial Sequence
  Synthetic
agttcccatacactattgtgctccacctggctttgcaattctaaaatgtaaggatgaagagttcaatggaacagg

SEQ ID NO: 184090 - DNA, 75 bp, Artificial Sequence
  Synthetic
agttcccatacactattgtgctccacctgggtttgcaattctaaaatgtaaggatgaagagttcaatgaaacagg

SEQ ID NO: 184091 - DNA, 75 bp, Artificial Sequence
  Synthetic
agttcccatacactattgtgctccacctgggtttgcaattctaaaatgtaaggatgaagagttcaatgtaacagg

SEQ ID NO: 184092 - DNA, 75 bp, Artificial Sequence
  Synthetic
agttcccatacactattgtgctccacctgggtttgcaattctaaaatgtaaggatgaagagttcaatgcaacagg

SEQ ID NO: 184093 - DNA, 75 bp, Artificial Sequence
  Synthetic
agttcccatacactattgtgctccacctgggtttgcaattctaaaatgtaaggatgaagagttcaatggaacagg

SEQ ID NO: 184094 - DNA, 75 bp, Artificial Sequence
  Synthetic
gccaggaaaatggaaaccaagaatgatagggggaattggaggttttatcaaagtaaaacagtatgatcagatact

SEQ ID NO: 184095 - DNA, 75 bp, Artificial Sequence
  Synthetic
acgagcgttctatacaacaggtgatataataggagatataagacaagcacactgtatagttaatggaacaaaatg

SEQ ID NO: 184096 - DNA, 75 bp, Artificial Sequence
  Synthetic
tttgcttgatgctacagcaatagcagtagctgggtggacagatagggttatagaaataggacaaagagttcttag

SEQ ID NO: 184097 - DNA, 75 bp, Artificial Sequence
  Synthetic
aatggtactaatggtaccagtaatactaagggtaccaataatagtagtgttcccatggaagaagaaatgaaaaat

SEQ ID NO: 184098 - DNA, 75 bp, Artificial Sequence
  Synthetic
ggtctcgtataagggaaagaatgaggcgagctcccccagcagcagaaggagtaggagcagtgtctcaagatctgg

SEQ ID NO: 184099 - DNA, 75 bp, Artificial Sequence
  Synthetic
gcgagctcccccagcagcagaaggagtaggagcagtgtctcaagatctggataaacgtggggcagttacaatcaa

SEQ ID NO: 184100 - DNA, 75 bp, Artificial Sequence
  Synthetic
gtttccctcaaatcactctttggcaacgaccccttgtcacagtaaaaataggaggacagctaaaagaagctctat

SEQ ID NO: 184101 - DNA, 75 bp, Artificial Sequence
  Synthetic
aatcagtttatgggatcaaagtctaaaaccatgtgtaaagttgaccccactctgtgtcactttaaactgtacaaa

SEQ ID NO: 184102 - DNA, 75 bp, Artificial Sequence
  Synthetic
actcccagtcctaatactactactgttgcccctgaagaaataatgaaaaattgctctttcaatacaaccacagaa

SEQ ID NO: 184103 - DNA, 75 bp, Artificial Sequence
  Synthetic
tttaaaccatcctcaggaggggacatagaaattacaacacatagctttaattgtggaggagaatttttctattgt

SEQ ID NO: 184104 - DNA, 75 bp, Artificial Sequence
  Synthetic
atagtgcaaaatgcacaagggcaatgggtacaccaggccatatcacctaggaccttaaatgcatgggtcaaagta

SEQ ID NO: 184105 - DNA, 75 bp, Artificial Sequence
  Synthetic
acaagcctgtccaaaggtctcttttgatccaattcctatacattattgtgctccagctggttatgcgattctaaa

SEQ ID NO: 184106 - DNA, 75 bp, Artificial Sequence
  Synthetic
gtcacagtctattatggggtacctgtgtggaaagaagcaaaaactactctattctgtgcatcagatgctaaagca

SEQ ID NO: 184107 - DNA, 75 bp, Artificial Sequence
  Synthetic
ggattgagatgaagaaagtaatgaaaaactgctctttcaatatcgccacaagcataagaaataagatgcaaagag

SEQ ID NO: 184108 - DNA, 75 bp, Artificial Sequence
  Synthetic
gagagatgggtgcgagagcgtcggtattaagcgggggagaattagataaatgggaaaaaattcggttaaggccag

SEQ ID NO: 184109 - DNA, 75 bp, Artificial Sequence
  Synthetic
acatgtggaaaaatgacatggtggatcagatgcatgaggatataatcagtttatgggatcaaagtctaaaaccat

SEQ ID NO: 184110 - DNA, 75 bp, Artificial Sequence
  Synthetic
ctggggtgggagggtctcaagtatctgtggaatcttctgttgtattggggtcgggaactaaagaatagtgctatt

SEQ ID NO: 184111 - DNA, 75 bp, Artificial Sequence
  Synthetic
aggatagatgtaaaagacaccaaggaagctttagagaagatagaggaagagcaaaacaaaagtaagaaaaaggca

SEQ ID NO: 184112 - DNA, 75 bp, Artificial Sequence
  Synthetic
tacaatgtacacatggaattaagccagtagtgtcaactcaactgctgttaaatggcagtctagcagaagaagaga

SEQ ID NO: 184113 - DNA, 75 bp, Artificial Sequence
  Synthetic
tatcccttagcctccctcaaatcactctttggcaacgacccctcgtcacaataaggataggggggcaactaaagg

SEQ ID NO: 184114 - DNA, 75 bp, Artificial Sequence
  Synthetic
aatggcagtctagcagaagaagagatagtaattagatctgaaaatttcacaaacaatgctaaaaccataatagta

SEQ ID NO: 184115 - DNA, 75 bp, Artificial Sequence
  Synthetic
gctgctataaaatgggaaacaaatggtcaaaaagtgtatctgaatggcctagggtaagagaaagaataaggcgaa

SEQ ID NO: 184116 - DNA, 75 bp, Artificial Sequence
  Synthetic
aagaaaaggtatacgtataggaccggggagagcatttattgcaacagaaaaaataataggagacataagacaagc

SEQ ID NO: 184117 - DNA, 75 bp, Artificial Sequence
  Synthetic
gtcatgggtaccagcacacaaagggattggaggaaatgaacaagtagataaattagtcagtgctggaatcaggaa

SEQ ID NO: 184118 - DNA, 75 bp, Artificial Sequence
  Synthetic
aatcgaagaagaaggtggagagcaagacagaggcagatccattcgattagtgagcggattcttagcacttgcctg

SEQ ID NO: 184119 - DNA, 75 bp, Artificial Sequence
  Synthetic
ccacaggtacctttaagaccaatgacctataaggctgcttttgatctcagcttctttttaaaagaaaagggggga

SEQ ID NO: 184120 - DNA, 75 bp, Artificial Sequence
  Synthetic
taacagaagtagtacctctaagcaaagaggcagaactagaattagaagaaaacagagaaaagctaaaagaaccag

SEQ ID NO: 184121 - DNA, 75 bp, Artificial Sequence
  Synthetic
tggcaagccacctggattccagaatgggaatttgtcagcacacccccattgatcaaattatggtacagattagaa

SEQ ID NO: 184122 - DNA, 75 bp, Artificial Sequence
  Synthetic
acaaccagacaggagtgaatcagaagtagtcaaccaaataatagaggagctaataaaaaaggaaaaggtctacct

SEQ ID NO: 184123 - DNA, 75 bp, Artificial Sequence
  Synthetic
ctggaaaactcatctgcaccactgctgtgccttggaatactagttggagtaataaatctctggattacatttgga

SEQ ID NO: 184124 - DNA, 75 bp, Artificial Sequence
  Synthetic
aaggcccaggaagaccatgagaaatatcacaataattggagagcaatggctagtgattttaacctgccacctgta

SEQ ID NO: 184125 - DNA, 75 bp, Artificial Sequence
  Synthetic
cctaaaggatcaacagctcctagggctttggggctgctctggaaaactcatctgcaccactaatgtgccttggaa

SEQ ID NO: 184126 - DNA, 75 bp, Artificial Sequence
  Synthetic
aagatatagcacacaaatagatcctgacctagcagaccaactaattcatctgcattattttgactgtttttcaga

SEQ ID NO: 184127 - DNA, 75 bp, Artificial Sequence
  Synthetic
aaaaagagtgctattaatctgcttgataccttagcaatagcagtagctgaaggaacagataggattattgaagta

SEQ ID NO: 184128 - DNA, 75 bp, Artificial Sequence
  Synthetic
caggggagccaaagcactaacagacatagtaacattgactgaggaagcagaattagaattggcagagaacaggga

SEQ ID NO: 184129 - DNA, 75 bp, Artificial Sequence
  Synthetic
aagatgggtggcaagtggtcaaaaagtagtgtggttgggtggcctgctgtaagggaaagaatgagacgaactgag

SEQ ID NO: 184130 - DNA, 75 bp, Artificial Sequence
  Synthetic
gaactcctcacagcagtaaggatcatcaaaatcctataccaaagcagtaagtatcagtaattagtatatgtaatg

SEQ ID NO: 184131 - DNA, 75 bp, Artificial Sequence
  Synthetic
gtggaaaaataacatggtagaacagatgcaggaggatgtaatcagtttatgggatcaaagtctaaagccatgtgt

SEQ ID NO: 184132 - DNA, 75 bp, Artificial Sequence
  Synthetic
gcagcattaatagtagcactaataatagcaatagttgtgtggactatagtatatatagaatataggaaaatagta

SEQ ID NO: 184133 - DNA, 75 bp, Artificial Sequence
  Synthetic
atagtatggcaagtggacagacagaaagtgaaagcatggaacagcctagtgaaataccataagtacaggtctaga

SEQ ID NO: 184134 - DNA, 75 bp, Artificial Sequence
  Synthetic
aagtgaaagcatggaacagcctagtgaaataccataagtacaggtctagaaagaccaaggactggcattacagac

SEQ ID NO: 184135 - DNA, 75 bp, Artificial Sequence
  Synthetic
acaagaacaaggataactatgggaccaggaaaagtattctatagaacagaagacataagaggagatataagaaaa

SEQ ID NO: 184136 - DNA, 75 bp, Artificial Sequence
  Synthetic
ccaccaacatcactgaggacatgagaggagaaataaaaaactgctcgtacaatatgaccacagtattaagggata

SEQ ID NO: 184137 - DNA, 75 bp, Artificial Sequence
  Synthetic
ctgtggcaaggaagggcacctagccagaaactgcagggcacctagaaaaaagggctgttggaaatgtggaaagga

SEQ ID NO: 184138 - DNA, 75 bp, Artificial Sequence
  Synthetic
tttaaaccatcctcaggaggggacctagaaattacaacacatagctttaattgtggaggagaatttttctattgt

SEQ ID NO: 184139 - DNA, 75 bp, Artificial Sequence
  Synthetic
aatgtcagcacagtacaatgtacacatggaattaaaccagtggtatcaactcaattgttgttaaatggcagccta

SEQ ID NO: 184140 - DNA, 75 bp, Artificial Sequence
  Synthetic
cctgtaccaaagcagtaagtaacgctgatgtatcttaaggacctgctactgtatcataaggacctgatactagta

SEQ ID NO: 184141 - DNA, 75 bp, Artificial Sequence
  Synthetic
tgtacacatggaattaggccagtagtgtcaactcaactgctgttaaatggcagcctagcagaagaagaggtaata

SEQ ID NO: 184142 - DNA, 75 bp, Artificial Sequence
  Synthetic
agaaataagggatgatagtgactatgaaagtaatggagaagaagaacaagaagttatggatctggtacatggtca

SEQ ID NO: 184143 - DNA, 75 bp, Artificial Sequence
  Synthetic
gccaatatctctaacacagtaggaaatatgtcagataacacagtaggaaatatgtcaaatgaggtaagaaactgt

SEQ ID NO: 184144 - DNA, 75 bp, Artificial Sequence
  Synthetic
ccattgcaggaaacattacctgtaactcaaatattacaggtctactattgacaagagatggtggtcaggataatg

SEQ ID NO: 184145 - DNA, 75 bp, Artificial Sequence
  Synthetic
gaagaagcggagacagcgacgaagagctcctcaggacagtcagactcatcaagcttctctatcaaagcagtaagt

SEQ ID NO: 184146 - DNA, 75 bp, Artificial Sequence
  Synthetic
cagagtttaaagccttgtgttaaaatgactttcatgtgtgtacaaatgaattgtacaaacctaaatgaaacatca

SEQ ID NO: 184147 - DNA, 75 bp, Artificial Sequence
  Synthetic
ttgtacaaacctaaatgaaacatcaaagggaaacagcagctcagaaaatgaaacccctgtaaaaaagtgtgagtt

SEQ ID NO: 184148 - DNA, 75 bp, Artificial Sequence
  Synthetic
atgtcagctcagtacaatgcacacatggaattaagccagtggtatcaactcaattgctgttaaatggcagtctag

SEQ ID NO: 184149 - DNA, 75 bp, Artificial Sequence
  Synthetic
cctataggaccaggacaagtattctataaaacaggagacataattggagatataagaaaggcatattgtgaggtt

SEQ ID NO: 184150 - DNA, 75 bp, Artificial Sequence
  Synthetic
tcagctactattaaatgggacactctctaaaggaaaattaaggattatgggaaaaaatatttcggacagtgcaca

SEQ ID NO: 184151 - DNA, 75 bp, Artificial Sequence
  Synthetic
ttggaaagaagaaataaaaggagaaataaaaaactgctctttcaatatcaccacaagcataagagataagattca

SEQ ID NO: 184152 - DNA, 75 bp, Artificial Sequence
  Synthetic
agcatgagctttagaaaggaaggcaaccattcaaggatagcctattgtgagtataatgcctctgattgggaaaca

SEQ ID NO: 184153 - DNA, 75 bp, Artificial Sequence
  Synthetic
agacaacccatttacattttaactgtcatggagagttcttttattgtaacaccactaagttgtttaattataact

SEQ ID NO: 184154 - DNA, 75 bp, Artificial Sequence
  Synthetic
agaatgttactagtaacatgaatggtaccagtaacagggatgaaatgaaaaattgctctttcaacacaaccacag

SEQ ID NO: 184155 - DNA, 75 bp, Artificial Sequence
  Synthetic
taccttgcaaattgaagcaggtggtaaggtcatggatacagggagggtcgggactctatgcacctcccatcaaag

SEQ ID NO: 184156 - DNA, 75 bp, Artificial Sequence
  Synthetic
tcacagttagctctaacaacacagataacccggaggaaggggagaggaaaaactgctctttcaatataaccacag

SEQ ID NO: 184157 - DNA, 75 bp, Artificial Sequence
  Synthetic
agagaacagtttgggaataataaaacaatagtctttaatcaatcctcaggaggggacccagaaattgtaatgcac

SEQ ID NO: 184158 - DNA, 75 bp, Artificial Sequence
  Synthetic
aggggacccagaaattgtaatgcacagttttaattgtagaggggaatttttctactgtaatacaacacaactgtt

SEQ ID NO: 184159 - DNA, 75 bp, Artificial Sequence
  Synthetic
aaatatgaaagatatatggagaactgagttgtacaactacaaagtagtaagggtaaaaccttttagtgtggcacc

SEQ ID NO: 184160 - DNA, 75 bp, Artificial Sequence
  Synthetic
aggcttttactgtaaaatgggtagcaagttgtcaaaaagtaagatagtaggatggtccactataagggaaagaat

SEQ ID NO: 184161 - DNA, 75 bp, Artificial Sequence
  Synthetic
acaatgtacacatggaattaagccagtagtgtcaacacaactgctgttgaatggcagtttagcagaaaaagagat

SEQ ID NO: 184162 - DNA, 75 bp, Artificial Sequence
  Synthetic
agctacacaggaggtaaaaaattggatgacagaaaccttgctagtccaaaatgcgaatccagactgtaagtccat

SEQ ID NO: 184163 - DNA, 75 bp, Artificial Sequence
  Synthetic
atacaaaagacaccaataggatcagggcaagcactttttacagccagaagaatagtaggagacataagacaagca

SEQ ID NO: 184164 - DNA, 75 bp, Artificial Sequence
  Synthetic
ggatacttgggaaggagttgaagccataataagaatactgcaacaactactgtttatccatttcagaattgggtg

SEQ ID NO: 184165 - DNA, 75 bp, Artificial Sequence
  Synthetic
ataataagaatactgcaacaactactgtttatccatttcagaattgggtgccaacatagcagaataggcattagt

SEQ ID NO: 184166 - DNA, 75 bp, Artificial Sequence
  Synthetic
agctaccaccgcttgagcgacttactcttgattgcaacgaggactgtgggacttctgggacacagggggtgggaa

SEQ ID NO: 184167 - DNA, 75 bp, Artificial Sequence
  Synthetic
cctcaggaggggacctagaaattacaacacacagttttaactgtggaggggaattcttctactgcaatacatcaa

SEQ ID NO: 184168 - DNA, 75 bp, Artificial Sequence
  Synthetic
cacatacctagaagaatcagacagggcttcgaaagggctttggtataagatgggcggcaagggctctaaaatggc

SEQ ID NO: 184169 - DNA, 75 bp, Artificial Sequence
  Synthetic
caagaaaagaatgaacaagaattattagaattggataagtgggcaagtttgtggaattggtttagcataacaaac

SEQ ID NO: 184170 - DNA, 75 bp, Artificial Sequence
  Synthetic
tttaagaatagtttttgctgtgctttctatagtgaatagagttaggcagggatactcaccattgtcatttcagac

SEQ ID NO: 184171 - DNA, 75 bp, Artificial Sequence
  Synthetic
agatacagttgcagtggcagtaggcgattggactgacggcataatctcagggatacaaagaataggaagaggaat

SEQ ID NO: 184172 - DNA, 75 bp, Artificial Sequence
  Synthetic
gattggactgacggcataatctcagggatacaaagaataggaagaggaattaggaacatcccaaatttgcaggat

SEQ ID NO: 184173 - DNA, 75 bp, Artificial Sequence
  Synthetic
catgacctggatgcagtgggatagagaaattagtaattacacagacacaatatacaggttgcttgaagactcgca

SEQ ID NO: 184174 - DNA, 75 bp, Artificial Sequence
  Synthetic
tctgggacgcagcagtctcaggggactacagagggggtgggaagcccttaagtatctaggaagtcttgtgcagta

SEQ ID NO: 184175 - DNA, 75 bp, Artificial Sequence
  Synthetic
ccaaaagaacccttcagagattatgtagataggttctttaaaactctcagagctgagcaagctacacaggaggta

SEQ ID NO: 184176 - DNA, 75 bp, Artificial Sequence
  Synthetic
tggggtgggagagcctcaagtatctgtggaatctcctgcagtattggggccgggaactgagaaaaagtgctatta

SEQ ID NO: 184177 - DNA, 75 bp, Artificial Sequence
  Synthetic
aggacaagcgttttttgcaacaggtgacataataggagatataagacaagcacattgtgtgattaataggacagc

SEQ ID NO: 184178 - DNA, 75 bp, Artificial Sequence
  Synthetic
tgcttctgcaacagcagcaccagcaacagcagcaccaggagtaggagcagtatctcaagatttagctaagcatgg

SEQ ID NO: 184179 - DNA, 75 bp, Artificial Sequence
  Synthetic
cagggtatgtcactgacagaggaagacaaaaggtagtttccctaactgagacaacaaatcaaaagactgaattac

SEQ ID NO: 184180 - DNA, 75 bp, Artificial Sequence
  Synthetic
tgtacagtccagtgagcatcttagatattaagcagggaccaaaagaaccattcagagattatgtagatcggttct

SEQ ID NO: 184181 - DNA, 75 bp, Artificial Sequence
  Synthetic
tattaagcagggaccaaaagaaccattcagagattatgtagatcggttctacaaaacattgagagctgaacaagc

SEQ ID NO: 184182 - DNA, 75 bp, Artificial Sequence
  Synthetic
ggcaacgacctcttgtcacagtaaaaatagggggacagctaaaagaagctctattagatacaggagcagatgata

SEQ ID NO: 184183 - DNA, 75 bp, Artificial Sequence
  Synthetic
agcacggtgagaatgggggaagaaataaaaaattgctctttcaatacaaccacaggactaagagataagaaacaa

SEQ ID NO: 184184 - DNA, 75 bp, Artificial Sequence
  Synthetic
tgtgtggatcatagtatatatagaatataggaaattattaagacaaagaaaaatagactggttaattaaaagaat

SEQ ID NO: 184185 - DNA, 75 bp, Artificial Sequence
  Synthetic
taaatgtttcaattgtggcaaagaagggcacatagccaaaaactgcagggcccctaggaaaaagggctgttggaa

SEQ ID NO: 184186 - DNA, 75 bp, Artificial Sequence
  Synthetic
ccctaataaaacaatagaatttaaaccatcctcaggaggggacctagaaattacaacacatagctttaattgtag

SEQ ID NO: 184187 - DNA, 75 bp, Artificial Sequence
  Synthetic
ccatcctcaggaggggacctagaaattacaacacatagctttaattgtagaggagaatttttctattgtaataca

SEQ ID NO: 184188 - DNA, 75 bp, Artificial Sequence
  Synthetic
aggatggagaaataaaaaactgctctttcaatatcaccacaaacataagagataaggtgcagaaaaactatgcac

SEQ ID NO: 184189 - DNA, 75 bp, Artificial Sequence
  Synthetic
agcaataatagcaatagttgtgtggaccatagtatttttagaatataggaaaatattaaaacaaagaaaaataga

SEQ ID NO: 184190 - DNA, 75 bp, Artificial Sequence
  Synthetic
tgattgtgtggcaggtagacaggatgaggattagaacatggaacagtttagtaaaacatcatatgtatatctcaa

SEQ ID NO: 184191 - DNA, 75 bp, Artificial Sequence
  Synthetic
taatgtaacaatagaaatagaaggaagggaagtacagggaacagtattggtgggacctactcctgttaatattat

SEQ ID NO: 184192 - DNA, 75 bp, Artificial Sequence
  Synthetic
aagggctgttggaaatgtggcaaggaaggacaccaaatgaaagactgtactgaaaggcaggctaattttttaggg

SEQ ID NO: 184193 - DNA, 75 bp, Artificial Sequence
  Synthetic
tgcactgattatactaatagtaatgagactaataacaatagtagcagctgggaaaggggagaaataaaaaactgt

SEQ ID NO: 184194 - DNA, 75 bp, Artificial Sequence
  Synthetic
acaacaggagaaataataggagatataagacaagcacattgtaacattagtagagaaaaatggaataacacttta

SEQ ID NO: 184195 - DNA, 75 bp, Artificial Sequence
  Synthetic
gctaattttttagggaaaatctggccttccagcaaagggaggccagggaattttcctcagagcagactggagcca

SEQ ID NO: 184196 - DNA, 75 bp, Artificial Sequence
  Synthetic
caagacttagataaacatggggcacttacaaccagcaacacagccgccaacaatgctgcttgtgcctggctggaa

SEQ ID NO: 184197 - DNA, 75 bp, Artificial Sequence
  Synthetic
aatagtaggactgatagtagcgctaatcttagcaatagtagtgtggactatagtagctatagaatttaagaaaat

SEQ ID NO: 184198 - DNA, 75 bp, Artificial Sequence
  Synthetic
acaatttaaaaataaaacaataagctttaatcaatcctcaggaggggacccagaaattgtattgcacagttttaa

SEQ ID NO: 184199 - DNA, 75 bp, Artificial Sequence
  Synthetic
acaatttaaaaataaaacaataagctttaatcaatcctcaggaggggacccagaaattgtattgcacagttttat

SEQ ID NO: 184200 - DNA, 75 bp, Artificial Sequence
  Synthetic
acaatttaaaaataaaacaataagctttaatcaatcctcaggaggggacccagaaattgtattgcacagttttac

SEQ ID NO: 184201 - DNA, 75 bp, Artificial Sequence
  Synthetic
acaatttaaaaataaaacaataagctttaatcaatcctcaggaggggacccagaaattgtattgcacagttttag

SEQ ID NO: 184202 - DNA, 75 bp, Artificial Sequence
  Synthetic
ttaagtaaagaggcagagctggaattagaggaaaacagagaaaagttaaaagaaccagtgcatggtgtatactat

SEQ ID NO: 184203 - DNA, 75 bp, Artificial Sequence
  Synthetic
tgtggaattggtttgacataacaaaatggctgtggtatataaaaatattcataatgatagtaggaggcttgatag

SEQ ID NO: 184204 - DNA, 75 bp, Artificial Sequence
  Synthetic
acaagtagaccctggcctggcagaccaactgatccatatatattattttgattgttttgcagaatctgccataag

SEQ ID NO: 184205 - DNA, 75 bp, Artificial Sequence
  Synthetic
cagactattggcaagccacctggattccagaatgggaatttgtcagcacacccccattgatcaaattatggtaca

SEQ ID NO: 184206 - DNA, 75 bp, Artificial Sequence
  Synthetic
ttggggtcaggaactgaggaatagtgctgtcagcttgctaaacgccacagctatagcagtagctgaggggacaga

SEQ ID NO: 184207 - DNA, 75 bp, Artificial Sequence
  Synthetic
tgtcaatgatatacagaagttagtggggaaattaaattgggcaagccagatttatccaggaattaaagtaagaca

SEQ ID NO: 184208 - DNA, 75 bp, Artificial Sequence
  Synthetic
tcctgctcataaaggcataggaggaaatgaaaaaatagataaattagtaagcaaagatattagaagagtcctgtt

SEQ ID NO: 184209 - DNA, 75 bp, Artificial Sequence
  Synthetic
agccaacagctgagccagcagcaactggggtgggagcagtatctcgagacctggaaaaatatggcgcagtcacaa

SEQ ID NO: 184210 - DNA, 75 bp, Artificial Sequence
  Synthetic
ggcttaggcatctcctatggcaggaagaagcggagacagcgacgcagacctcctcaaagcagtcagatacatcaa

SEQ ID NO: 184211 - DNA, 75 bp, Artificial Sequence
  Synthetic
ggtgatgattgtgtggcaggtagacaggatgaggattagaacatggcacagtttagtaaaacatcatatatatat

SEQ ID NO: 184212 - DNA, 75 bp, Artificial Sequence
  Synthetic
actcaaaacagcctgaaggaagaggtaggggcagtaaaaaactgttctttcaatatgaccacagaagtaagagat

SEQ ID NO: 184213 - DNA, 75 bp, Artificial Sequence
  Synthetic
atagtagcattagtagtagtagcaataatagcaataattgtgtggaccatagtattcatagaatataggaaaata

SEQ ID NO: 184214 - DNA, 75 bp, Artificial Sequence
  Synthetic
taaaaaattggatgacagaaaccttgttggtccaaaatgcgaacccagattgtaagaccattttaaaagcattag

SEQ ID NO: 184215 - DNA, 75 bp, Artificial Sequence
  Synthetic
gttggtccaaaatgcgaacccagattgtaagaccattttaaaagcattaggaccaggagctacactagaagaaat

SEQ ID NO: 184216 - DNA, 75 bp, Artificial Sequence
  Synthetic
atgccaggggaagaagatgaacagttgggacacggggttagtatagaatggcagtataaagggtataaaacacag

SEQ ID NO: 184217 - DNA, 75 bp, Artificial Sequence
  Synthetic
tgggacacggggttagtatagaatggcagtataaagggtataaaacacagattgaccctacaacagcagaaagga

SEQ ID NO: 184218 - DNA, 75 bp, Artificial Sequence
  Synthetic
tgggacacggggttagtatagaatggcagtataaagggtataaaacacagattgaccctacaacagcagatagga

SEQ ID NO: 184219 - DNA, 75 bp, Artificial Sequence
  Synthetic
tgggacacggggttagtatagaatggcagtataaagggtataaaacacagattgaccctacaacagcagacagga

SEQ ID NO: 184220 - DNA, 75 bp, Artificial Sequence
  Synthetic
tgggacacggggttagtatagaatggcagtataaagggtataaaacacagattgaccctacaacagcagagagga

SEQ ID NO: 184221 - DNA, 75 bp, Artificial Sequence
  Synthetic
gctaattttttagggaaaatctggccttcccacaagggaaggccagggaattttcttcagagcagaccagagcca

SEQ ID NO: 184222 - DNA, 75 bp, Artificial Sequence
  Synthetic
ggggtctgcaaacaggagaaagagaatggcatttgggtcatggagtctccatagaatggagactgagaaaatata

SEQ ID NO: 184223 - DNA, 75 bp, Artificial Sequence
  Synthetic
aggcatctcctatggcaggaagaagcggaagcaccgacgaagaactcctcagagcagtgaggatcatcaaaatcc

SEQ ID NO: 184224 - DNA, 75 bp, Artificial Sequence
  Synthetic
ctagctctaagagtagttgtaaaagcaaaaagaagtaagcctcccctacccagtgtccagaaattaacagaagat

SEQ ID NO: 184225 - DNA, 75 bp, Artificial Sequence
  Synthetic
ttttatgcaacaggagaaataataggagacatcagaaaggcacattgtaacattagtggaacacaatggaataaa

SEQ ID NO: 184226 - DNA, 75 bp, Artificial Sequence
  Synthetic
cagtgtccagaaattaacagaagatagatggaacaagcaccggagaatcagggaccagctagagagccattcaat

SEQ ID NO: 184227 - DNA, 75 bp, Artificial Sequence
  Synthetic
tttccctaggccttggctacacgccttgggacaatacatctatgagacttatggagacacttgggtaggagttat

SEQ ID NO: 184228 - DNA, 75 bp, Artificial Sequence
  Synthetic
ctgtgttactttaaattgcactgatctggtgaatgctactaatacggggaatgctactaataccactagtagtag

SEQ ID NO: 184229 - DNA, 75 bp, Artificial Sequence
  Synthetic
gggcaaatatcacacaagaatttggaattccctacaatccccaaagccaaggagtagtggaatctatgaataaag

SEQ ID NO: 184230 - DNA, 75 bp, Artificial Sequence
  Synthetic
aaaaactgctctttcaatataaccacagagataagggataagaaacagaaggtgtattcacttttttataaactt

SEQ ID NO: 184231 - DNA, 75 bp, Artificial Sequence
  Synthetic
tgctatcattgccctgtttgtttcacaaagaagggtttgggaatctcctatggcaggaagaagcgacgacaccca

SEQ ID NO: 184232 - DNA, 75 bp, Artificial Sequence
  Synthetic
ttttcagactctgccataaggagagccatattaggacaagtagttagccctagttgtgaatatcaagcaggacat

SEQ ID NO: 184233 - DNA, 75 bp, Artificial Sequence
  Synthetic
tgctgtttataaatataatcttatggatatatgttcttagaaaatatttagaacaaaggaaacaagacagaaggg

SEQ ID NO: 184234 - DNA, 75 bp, Artificial Sequence
  Synthetic
tgtcagcacagtacaatgcacacatggaatcaagccagtagtatcaactcaactgctgttaaatggcagtctagc

SEQ ID NO: 184235 - DNA, 75 bp, Artificial Sequence
  Synthetic
gcaataacaatacagatttaagaaatataacagatgaagtaagaaactgttcttttaatacaaccacagaaataa

SEQ ID NO: 184236 - DNA, 75 bp, Artificial Sequence
  Synthetic
agtgattatgaaagcaatgaagaagaagaacaagaagttatggatcttgtacataatcatggctttgataaccct

SEQ ID NO: 184237 - DNA, 75 bp, Artificial Sequence
  Synthetic
gggggatgcatatttttcagttcctttagataaagacttcaggaagtatactgcattcaccatacctagtataaa

SEQ ID NO: 184238 - DNA, 75 bp, Artificial Sequence
  Synthetic
gagaaatgaaaaattgctctttcaatataaccacagaattaataaataagaaacagcgagagtatgcattgtttt

SEQ ID NO: 184239 - DNA, 75 bp, Artificial Sequence
  Synthetic
ggagttgaagccctaataagaatactacaacaactactgtttatccatttcagaattgggtgccaacatagcaga

SEQ ID NO: 184240 - DNA, 75 bp, Artificial Sequence
  Synthetic
atgccggcacgacaaccagtagcccagatctcaaacaagatctcaaacagtgtgagtttaatatgaccacagttg

SEQ ID NO: 184241 - DNA, 75 bp, Artificial Sequence
  Synthetic
aagacaaaggtaactatgggaccaggacgagtattctatagaacaggagagataatgggagatataaaacaagca

SEQ ID NO: 184242 - DNA, 75 bp, Artificial Sequence
  Synthetic
tctaccaaagcagtgagtagtacctgtaatgcaagctttagagatatcagcagtagtagcattagtagtaacagc

SEQ ID NO: 184243 - DNA, 75 bp, Artificial Sequence
  Synthetic
aaatttaccaagaaccatttaaaaatctgaaaacagggaagtatgcaaaaaggaggactgcccacactaatgatg

SEQ ID NO: 184244 - DNA, 75 bp, Artificial Sequence
  Synthetic
taagaaagcaaaggaaaatagatcagttaattaagaggatactagaaagagcagaagacagtggcaatgagagtg

SEQ ID NO: 184245 - DNA, 75 bp, Artificial Sequence
  Synthetic
aagcataaggataggaccaggacaagcattctatgcaacaggagacataataggagacataagacaagcacattg

SEQ ID NO: 184246 - DNA, 75 bp, Artificial Sequence
  Synthetic
gcctgtccaaaggtatcttttgagccaattccaatacactattgtgctccagcaggatatgccatttttaagtgt

SEQ ID NO: 184247 - DNA, 75 bp, Artificial Sequence
  Synthetic
aattgctctttcaatgtaaccacagagctaagagataaaaacaagcaagaaagagcacttttttatagacttgat

SEQ ID NO: 184248 - DNA, 75 bp, Artificial Sequence
  Synthetic
atgggacactatctaaaggaaaaataagaattatgggacaaaatatctcggacagtgggaaaaatatcatagtga

SEQ ID NO: 184249 - DNA, 75 bp, Artificial Sequence
  Synthetic
gctttgctataaaatgggtggcaagtggtcaaaaagtagtatagttggatggcctgctataagggaaagaatgag

SEQ ID NO: 184250 - DNA, 75 bp, Artificial Sequence
  Synthetic
ggatgcaataagaaatagctcaagggcagcttattgcacgtataataccactgattgggagaaaacattaaaaca

SEQ ID NO: 184251 - DNA, 75 bp, Artificial Sequence
  Synthetic
acgaaagtctaaaaccatgtgtaaaattaaccccattctgtgtcactctaaactgcactgactggaagaataatg

SEQ ID NO: 184252 - DNA, 75 bp, Artificial Sequence
  Synthetic
acaagagatacctctggaaaatgtaacagaaaattttaacatgtggaaaaataacatggtagaacagatgaatga

SEQ ID NO: 184253 - DNA, 75 bp, Artificial Sequence
  Synthetic
tttaactgtcatggggaattcttttattgtaacacatctaagatgtttaattatagcttctcatgtgtagaaaac

SEQ ID NO: 184254 - DNA, 75 bp, Artificial Sequence
  Synthetic
gctctttcaatataaccacagaaataagagataagcagaaacgagtacatgcacttttttataaaattgatgtgg

SEQ ID NO: 184255 - DNA, 75 bp, Artificial Sequence
  Synthetic
tactaatttatcagtaaatagcactgtcacgtctagtgaagacataaacatctgctctttctatataaccacaga

SEQ ID NO: 184256 - DNA, 75 bp, Artificial Sequence
  Synthetic
ttgtaagctgagacaggtggtaaggtcatggatacagggagggtcgggaatctatgcacctcccatccaaggtaa

SEQ ID NO: 184257 - DNA, 75 bp, Artificial Sequence
  Synthetic
agtctagcagaagaagaaataatagttagatctgaaaatatctcagaaaatactaaaactataatagtacagctt

SEQ ID NO: 184258 - DNA, 75 bp, Artificial Sequence
  Synthetic
gaagctttagacaagatagaggaagagcaaaacaaaagtaagaaaaaggcacagcaagcagcagctgacacagga

SEQ ID NO: 184259 - DNA, 75 bp, Artificial Sequence
  Synthetic
aatgtcagtacagtacaatgtacacatggaattaagccagtggtatcaactcaattactgctgaatggcagctta

SEQ ID NO: 184260 - DNA, 75 bp, Artificial Sequence
  Synthetic
gagatataagacaagcacattgtaacattagtgcagaacaatggaataaaactttacaacaggtagctaaaaaat

SEQ ID NO: 184261 - DNA, 75 bp, Artificial Sequence
  Synthetic
aatacagaatcagcacctcctaaacctgtggggctgtagaggaaggctagtctgctacacatcagtaccatggaa

SEQ ID NO: 184262 - DNA, 75 bp, Artificial Sequence
  Synthetic
ctactgcaatacatcaagactgttcaatagtacatgggtattaaatagtacatcaaatagtacatggacattaaa

SEQ ID NO: 184263 - DNA, 75 bp, Artificial Sequence
  Synthetic
aaaatgagagaaagttgctggagttagatgaatgggcttctatttggaattggcttgacataactaaatggttgt

SEQ ID NO: 184264 - DNA, 75 bp, Artificial Sequence
  Synthetic
agatgaatgggcttctatttggaattggcttgacataactaaatggttgtggtatataaaaatagcaataatcat

SEQ ID NO: 184265 - DNA, 75 bp, Artificial Sequence
  Synthetic
atgggcaagcagggagctggaaagatttgcacttaaccctagccttttagaaacagcagaaggatgtcaacaaat

SEQ ID NO: 184266 - DNA, 75 bp, Artificial Sequence
  Synthetic
cctcccattgaaggactaattcactgttcatcaaatattacaggactactattaacaagagatggtgggaaccct

SEQ ID NO: 184267 - DNA, 75 bp, Artificial Sequence
  Synthetic
attatcatgatagtacttaatctagtgaaaaacattaggcagggatatcaacccctctcgttacagatccccatc

SEQ ID NO: 184268 - DNA, 75 bp, Artificial Sequence
  Synthetic
tgttgtacacggacctcaggacaataatattgtggatttgccacctcttgagcgccttagcatcagggatccaga

SEQ ID NO: 184269 - DNA, 75 bp, Artificial Sequence
  Synthetic
gagtgatcagctatctgggacttggactggggatcctagggcagaagataattaatgcttgcagaatttgtggag

SEQ ID NO: 184270 - DNA, 75 bp, Artificial Sequence
  Synthetic
acacatttgcaccactgatgtgccctggaactctacttggagtaatagaactctagcggagatttggaataacat

SEQ ID NO: 184271 - DNA, 75 bp, Artificial Sequence
  Synthetic
ataatagaacagttacagtcaactctcaagacaggatcagaagaacttagatcattatttaatacagtagtaacc

SEQ ID NO: 184272 - DNA, 75 bp, Artificial Sequence
  Synthetic
aggaatacaaagaataggaagaggaattaggaacatcccaaggagaattagacagggctttgaacgagctttatt

SEQ ID NO: 184273 - DNA, 75 bp, Artificial Sequence
  Synthetic
aacttaagcaggaagctgtcagacactttcctagaccatggctccatagcttaggacaacatatctatgaaacct

SEQ ID NO: 184274 - DNA, 75 bp, Artificial Sequence
  Synthetic
atcccactaggggatgctaaattggtaataaaaacatattgggggttacatacaggagaaagggactggcatttg

SEQ ID NO: 184275 - DNA, 75 bp, Artificial Sequence
  Synthetic
gaataagaagaactcctccaacagcagaaggggtgggggcagcatctcgagactcagaaaaacatggggcgctca

SEQ ID NO: 184276 - DNA, 75 bp, Artificial Sequence
  Synthetic
cattaggaatcattcaagcacaaccagataagagtgagtcagagttagtcagtcaaataatagagcagttaataa

SEQ ID NO: 184277 - DNA, 75 bp, Artificial Sequence
  Synthetic
ttatagaaatagtacaaagaggatttagagcttttctgcacatacctagaaggataagacaaggctttgaaaggg

SEQ ID NO: 184278 - DNA, 75 bp, Artificial Sequence
  Synthetic
tacaatcactctggaacacaataacagtgctctggtgtgttcacaacagatatcaagttatagacacgcaggagg

SEQ ID NO: 184279 - DNA, 75 bp, Artificial Sequence
  Synthetic
tacattcactctggaacacaataacagtgctctggtgtgttcacaacagatatcaagttatagacacgcaggagg

SEQ ID NO: 184280 - DNA, 75 bp, Artificial Sequence
  Synthetic
tacactcactctggaacacaataacagtgctctggtgtgttcacaacagatatcaagttatagacacgcaggagg

SEQ ID NO: 184281 - DNA, 75 bp, Artificial Sequence
  Synthetic
tacagtcactctggaacacaataacagtgctctggtgtgttcacaacagatatcaagttatagacacgcaggagg

SEQ ID NO: 184282 - DNA, 75 bp, Artificial Sequence
  Synthetic
ttcaatcactctggaacacaataacagtgctctggtgtgttcacaacagatatcaagttatagacacgcaggagg

SEQ ID NO: 184283 - DNA, 75 bp, Artificial Sequence
  Synthetic
ttcattcactctggaacacaataacagtgctctggtgtgttcacaacagatatcaagttatagacacgcaggagg

SEQ ID NO: 184284 - DNA, 75 bp, Artificial Sequence
  Synthetic
ttcactcactctggaacacaataacagtgctctggtgtgttcacaacagatatcaagttatagacacgcaggagg

SEQ ID NO: 184285 - DNA, 75 bp, Artificial Sequence
  Synthetic
ttcagtcactctggaacacaataacagtgctctggtgtgttcacaacagatatcaagttatagacacgcaggagg

SEQ ID NO: 184286 - DNA, 75 bp, Artificial Sequence
  Synthetic
tccaatcactctggaacacaataacagtgctctggtgtgttcacaacagatatcaagttatagacacgcaggagg

SEQ ID NO: 184287 - DNA, 75 bp, Artificial Sequence
  Synthetic
tccattcactctggaacacaataacagtgctctggtgtgttcacaacagatatcaagttatagacacgcaggagg

SEQ ID NO: 184288 - DNA, 75 bp, Artificial Sequence
  Synthetic
tccactcactctggaacacaataacagtgctctggtgtgttcacaacagatatcaagttatagacacgcaggagg

SEQ ID NO: 184289 - DNA, 75 bp, Artificial Sequence
  Synthetic
tccagtcactctggaacacaataacagtgctctggtgtgttcacaacagatatcaagttatagacacgcaggagg

SEQ ID NO: 184290 - DNA, 75 bp, Artificial Sequence
  Synthetic
tgcaatcactctggaacacaataacagtgctctggtgtgttcacaacagatatcaagttatagacacgcaggagg

SEQ ID NO: 184291 - DNA, 75 bp, Artificial Sequence
  Synthetic
tgcattcactctggaacacaataacagtgctctggtgtgttcacaacagatatcaagttatagacacgcaggagg

SEQ ID NO: 184292 - DNA, 75 bp, Artificial Sequence
  Synthetic
tgcactcactctggaacacaataacagtgctctggtgtgttcacaacagatatcaagttatagacacgcaggagg

SEQ ID NO: 184293 - DNA, 75 bp, Artificial Sequence
  Synthetic
tgcagtcactctggaacacaataacagtgctctggtgtgttcacaacagatatcaagttatagacacgcaggagg

SEQ ID NO: 184294 - DNA, 75 bp, Artificial Sequence
  Synthetic
agtgctctggtgtgttcacaacagatatcaagttatagacacgcaggaggcaatacaaaagttaaaggaagtcat

SEQ ID NO: 184295 - DNA, 75 bp, Artificial Sequence
  Synthetic
tttcaatacaaccacagaactaagggataagaagcagaaagtgtatgcacttttttatagacctgatatagtacc

SEQ ID NO: 184296 - DNA, 75 bp, Artificial Sequence
  Synthetic
tatatattaataaattgcaatacctcaaccataacacaagcctgtccaaaggtctcttttgacccgattcctata

SEQ ID NO: 184297 - DNA, 75 bp, Artificial Sequence
  Synthetic
ggggacagcgacgaagacctcctcaaggcagtcagactcatcaagttcctctatcaaagcagtaagtagatgtaa

SEQ ID NO: 184298 - DNA, 75 bp, Artificial Sequence
  Synthetic
gtgatggtactgtcacccacattaatagcataaaggaagaaataaaaaattgctctttcaatacaaccacagaaa

SEQ ID NO: 184299 - DNA, 75 bp, Artificial Sequence
  Synthetic
taataccaatagtaacagcagtagtacagaaatacaacaacagggagaaataaaaaactgctctttcaatgtcac

SEQ ID NO: 184300 - DNA, 75 bp, Artificial Sequence
  Synthetic
tgtgaagttttgctggatacaggggcagatgatacagtattaaccaacatacaattggaaggtaaatggaaacca

SEQ ID NO: 184301 - DNA, 75 bp, Artificial Sequence
  Synthetic
acaataatacaagaagaagtatacatataggaccagggagaacaatttttgcaacagacataataggagatataa

SEQ ID NO: 184302 - DNA, 75 bp, Artificial Sequence
  Synthetic
gactgaagaagcagaattagaattggcagagaacagggaaattctaaaagaaccagtacatggagtatattatga

SEQ ID NO: 184303 - DNA, 75 bp, Artificial Sequence
  Synthetic
atactcacctttgtcgtttcagacccttaccccgaacccaagggaacccgacaggctcggaagaatcgaagaaga

SEQ ID NO: 184304 - DNA, 75 bp, Artificial Sequence
  Synthetic
taaaattagcaggaagatggccagtaaaagtaatacacacagacaatggcagcaatttcaccagcgctgcagtta

SEQ ID NO: 184305 - DNA, 75 bp, Artificial Sequence
  Synthetic
gtcattaacagaagtagtacccttaagtaaagaggcagagctagaattagaggaaaacagagaaaggctaaaaga

SEQ ID NO: 184306 - DNA, 75 bp, Artificial Sequence
  Synthetic
gtcattaacagaagtagtacccttaagtaaagaggcagagctagaattagaggaaaacagagataggctaaaaga

SEQ ID NO: 184307 - DNA, 75 bp, Artificial Sequence
  Synthetic
gtcattaacagaagtagtacccttaagtaaagaggcagagctagaattagaggaaaacagagacaggctaaaaga

SEQ ID NO: 184308 - DNA, 75 bp, Artificial Sequence
  Synthetic
gtcattaacagaagtagtacccttaagtaaagaggcagagctagaattagaggaaaacagagagaggctaaaaga

SEQ ID NO: 184309 - DNA, 75 bp, Artificial Sequence
  Synthetic
tatagaattaatacaaggaatttgtagagctatccttaacatacctagaagaataagacaaggctttgaagcagc

SEQ ID NO: 184310 - DNA, 75 bp, Artificial Sequence
  Synthetic
agtaataaaagtctaaaggggatttgggataacatgacctggatggagtgggaaaaagaaattgacaattacaca

SEQ ID NO: 184311 - DNA, 75 bp, Artificial Sequence
  Synthetic
ccagacaaagaaagctggactgtcaatgatatacagaagttagtgggaaaattaaattgggcaagccagatttat

SEQ ID NO: 184312 - DNA, 75 bp, Artificial Sequence
  Synthetic
cctgctgtaagagaaagaataagacaagctgagccagcagcagagggagtaggaccagcatctcaagatttagat

SEQ ID NO: 184313 - DNA, 75 bp, Artificial Sequence
  Synthetic
tggaaaggaccagccaaactactctggaaaggtgaaggggcagtagtactacaagataatagtgacataaaggta

SEQ ID NO: 184314 - DNA, 75 bp, Artificial Sequence
  Synthetic
tgcctggctgcaagcacaagaggaggacgaggaagtaggctttccagtcagacctcaggtgcctttaagaccaat

SEQ ID NO: 184315 - DNA, 75 bp, Artificial Sequence
  Synthetic
tccaaaagtaagttcagaagtacacatcccactaggggatgctagattagtagtaagaacatattggggtctgca

SEQ ID NO: 184316 - DNA, 75 bp, Artificial Sequence
  Synthetic
ggggtctgcatacaggagaaaaagattggcatttgggtcatggggtttccatagaatggaagcagagagaatata

SEQ ID NO: 184317 - DNA, 75 bp, Artificial Sequence
  Synthetic
tgggagatcctcaagtattggtggaaccttctgcagtattggagccaggaactaaagaatagtgctattagcttg

SEQ ID NO: 184318 - DNA, 75 bp, Artificial Sequence
  Synthetic
aaccagctcttcagacaggaacagaggaacttagatcattatacaacacagtagcaactctctattgtgtacatg

SEQ ID NO: 184319 - DNA, 75 bp, Artificial Sequence
  Synthetic
ggcagggagcagaaagagctttgcaataaaatgggtggcaagtggtcaaaatttagtgggtggtctactgtaagg

SEQ ID NO: 184320 - DNA, 75 bp, Artificial Sequence
  Synthetic
gaaagaatgagacgagctgagccaaaagctgagccagcagcagttggggtgggaaaagcatctcgagacctggaa

SEQ ID NO: 184321 - DNA, 75 bp, Artificial Sequence
  Synthetic
tgtgcatcagatgctaaagcatatgaaaaagaggtacataatgtctgggctacacatgcctgtgtacccacagat

SEQ ID NO: 184322 - DNA, 75 bp, Artificial Sequence
  Synthetic
gtggaaaaataacatggtagaacaaatgcatacagatataatcagtttatgggatcaaagcctaaagccatgtgt

SEQ ID NO: 184323 - DNA, 75 bp, Artificial Sequence
  Synthetic
aaaactgttctttcaatatgaccacagaagtaagagataagcagctgaaagtacatgcacttttttataaacttg

SEQ ID NO: 184324 - DNA, 75 bp, Artificial Sequence
  Synthetic
atacaacagcagtaagtatcagtaattagtatatgtaatgattcctttgcaaatctgggcaatagcaggactaat

SEQ ID NO: 184325 - DNA, 75 bp, Artificial Sequence
  Synthetic
cattgccaaatatgctttctgaaaaaaggcttaggcatctcctatggcaggaagaagcggaagcaccgacgaaga

SEQ ID NO: 184326 - DNA, 75 bp, Artificial Sequence
  Synthetic
gaatcgcaaaaacaacaggaaaagaatgaacaagaattattagcattagatcagtgggcaaatttgtggaattgg

SEQ ID NO: 184327 - DNA, 75 bp, Artificial Sequence
  Synthetic
tctgggacgatctacggagcctgtgcctcttcagctaccaccgcttgagagacttactcttgattgtagcgagga

SEQ ID NO: 184328 - DNA, 75 bp, Artificial Sequence
  Synthetic
aattaattgtaccagacccaacaacaatacaagaaagagtataagatttggaccaggacaagcgttctatgcaac

SEQ ID NO: 184329 - DNA, 75 bp, Artificial Sequence
  Synthetic
aatacaagaaagagtataagatttggaccaggacaagcgttctatgcaacaggtgacataataggagatataaga

SEQ ID NO: 184330 - DNA, 75 bp, Artificial Sequence
  Synthetic
gaataaaacaaattgtaaacatgtggcaggaagtaggacgagcaatgtatgccgctcccattgcaggaaacatta

SEQ ID NO: 184331 - DNA, 75 bp, Artificial Sequence
  Synthetic
gaccaggacaagcgttctatgcaacaggtgacataataggagatataagagaagcatattgtgtggttaatagaa

SEQ ID NO: 184332 - DNA, 75 bp, Artificial Sequence
  Synthetic
aatataacagatgaagtaaaaaactgttcttttaatatgaccgcagaaataagagataagcagcggaaggtctat

SEQ ID NO: 184333 - DNA, 75 bp, Artificial Sequence
  Synthetic
gaagtagcacaaagagcttggagagcctttctccacatacctagaagaatcagacagggcttagaaagggctttg

SEQ ID NO: 184334 - DNA, 75 bp, Artificial Sequence
  Synthetic
aatcacaagcagcaatactaacaatgctgcctgtgcctgggtagaagcacaagcacaagaggaggaggaggttgg

SEQ ID NO: 184335 - DNA, 75 bp, Artificial Sequence
  Synthetic
aacaagccccagaagaccaaggaccccaaagggaaccatacaatgaatggacattagaattgttagaagagctta

SEQ ID NO: 184336 - DNA, 75 bp, Artificial Sequence
  Synthetic
agtataaggataggaccaggacaaacattctttgcaacaggagacataataggagacataagacaagcatattgt

SEQ ID NO: 184337 - DNA, 75 bp, Artificial Sequence
  Synthetic
acaatatgaggacacgtatgacttttggaccaggacacgtattctatagaacaggagagataataggagatataa

SEQ ID NO: 184338 - DNA, 75 bp, Artificial Sequence
  Synthetic
aatgcatcatagggacctgctaacattaataattggtagtgctttgctgcttataaatgtactgttatggatgtt

SEQ ID NO: 184339 - DNA, 75 bp, Artificial Sequence
  Synthetic
tatgaaagtaatggagaggaggaacaagaagttatggaacttgtacttagccatggctttgataaccccatgttt

SEQ ID NO: 184340 - DNA, 75 bp, Artificial Sequence
  Synthetic
tatgaaagtaatggagaggaggaacaagaagttatggatcttgtacttagccatggctttgataaccccatgttt

SEQ ID NO: 184341 - DNA, 75 bp, Artificial Sequence
  Synthetic
tatgaaagtaatggagaggaggaacaagaagttatggaccttgtacttagccatggctttgataaccccatgttt

SEQ ID NO: 184342 - DNA, 75 bp, Artificial Sequence
  Synthetic
tatgaaagtaatggagaggaggaacaagaagttatggagcttgtacttagccatggctttgataaccccatgttt

SEQ ID NO: 184343 - DNA, 75 bp, Artificial Sequence
  Synthetic
acagcgacgaagagctccttacaacagtaaagatcatcaaaatcctataccaaagcagtaagtattagtagttag

SEQ ID NO: 184344 - DNA, 75 bp, Artificial Sequence
  Synthetic
agtaaagatcatcaaaatcctataccaaagcagtaagtattagtagttagtatatgtaaatgtctcctttacaaa

SEQ ID NO: 184345 - DNA, 75 bp, Artificial Sequence
  Synthetic
agccattgggaatagcacccactaaggcaaaaaggagagtggtggagagagaaaaaagagcagtgggaataggag

SEQ ID NO: 184346 - DNA, 75 bp, Artificial Sequence
  Synthetic
atcaactcttatggagatgggggattatgatcttgggaatgttaatcttctgtagttccgcagagaacttgtggg

SEQ ID NO: 184347 - DNA, 75 bp, Artificial Sequence
  Synthetic
gggctgaggagggggtgggaagccctcaaatatctggggaatctcacgcagtattggagtcaggaactaaagaat

SEQ ID NO: 184348 - DNA, 75 bp, Artificial Sequence
  Synthetic
gcaggaagacattattagtttatgggaacagagtcttaaaccttgtgttcaaatgactttcctgtgtgtacaaat

SEQ ID NO: 184349 - DNA, 75 bp, Artificial Sequence
  Synthetic
gtaaatggaaccagcagctcagaaagcgatatgcaaaggtgtgagtttaatgtaaccactgttgtaaaagacaaa

SEQ ID NO: 184350 - DNA, 75 bp, Artificial Sequence
  Synthetic
actttaaactgcgtagaatggaaagggaataccactgggaaagggaataataacaatgggacagtgaatgccact

SEQ ID NO: 184351 - DNA, 75 bp, Artificial Sequence
  Synthetic
gtacacatggcatcaagccaacagtaagtactcaactaatattaaatgggacactctctaaaggaaaaataagaa

SEQ ID NO: 184352 - DNA, 75 bp, Artificial Sequence
  Synthetic
ataaacttgatgtagtacaaatagataatgataatactagctatagattaataaattgtaatacctcagccatta

SEQ ID NO: 184353 - DNA, 75 bp, Artificial Sequence
  Synthetic
tggctgtggtatataaagatatttataatgatagtaggaggtttaataggtttaagaatagtttttgctgtgctt

SEQ ID NO: 184354 - DNA, 75 bp, Artificial Sequence
  Synthetic
ctcgacgcaggactcggcttgctgaaagtgcacacggcaagaggcgagagcggcggctggtgagtacgccaaatt

SEQ ID NO: 184355 - DNA, 75 bp, Artificial Sequence
  Synthetic
tgagccaattcccatacattattgtgccccagctggatttgcgattctaaaatgtaatgataagaggttcaatgg

SEQ ID NO: 184356 - DNA, 75 bp, Artificial Sequence
  Synthetic
catgggcgtaggtccaatggccgtatacagtgcacacctaagggaatcagggacaaacggatcaaggatagctta

SEQ ID NO: 184357 - DNA, 75 bp, Artificial Sequence
  Synthetic
aacaaaagcaacgatggtggagatccagagacaacccatttacattttaattgtcatggagaattcttttattgt

SEQ ID NO: 184358 - DNA, 75 bp, Artificial Sequence
  Synthetic
acgggggtgggaaggcctcaaatatctggggaatcttctggtatattggagccaggaactaaaaactagtgctat

SEQ ID NO: 184359 - DNA, 75 bp, Artificial Sequence
  Synthetic
atacaagaagaagtgtaccaataggaccaggacgagcattctatgcaagaggtcaagtaataggggatataagaa

SEQ ID NO: 184360 - DNA, 75 bp, Artificial Sequence
  Synthetic
ggagacagcgacgaagcactcctccaagcagtgaggatcatcaaaatcttatatcaaagcagtaagtatatgtaa

SEQ ID NO: 184361 - DNA, 75 bp, Artificial Sequence
  Synthetic
gtagcaaaagaaatagtagccagctgtgataaatgtcagctaaaaggggaagccatacatggacaagtagactgt

SEQ ID NO: 184362 - DNA, 75 bp, Artificial Sequence
  Synthetic
gacaggtagtaaggtcatggataaaaggacagtcaggattctatgcacctcccatcaagggtaacctgacatgta

SEQ ID NO: 184363 - DNA, 75 bp, Artificial Sequence
  Synthetic
ctttgaagcagctttgcaataaaatggggggcaagtggtcaaaatggcctgctgtaagagaaagaatgagacgaa

SEQ ID NO: 184364 - DNA, 75 bp, Artificial Sequence
  Synthetic
accagaaacaacagcgaaaaccaaactgcaacatttagaccaacagggggagaaatgaaagatatatggagaact

SEQ ID NO: 184365 - DNA, 75 bp, Artificial Sequence
  Synthetic
ataaaaaattgctctttcaatgcaaccacagaaataagggataagaaacagaaagtgtatgcactcttttataaa

SEQ ID NO: 184366 - DNA, 75 bp, Artificial Sequence
  Synthetic
acaagaaaaagtataaggatagggccaggacaaacattctatgcaacaaatgccataataggagacataagacaa

SEQ ID NO: 184367 - DNA, 75 bp, Artificial Sequence
  Synthetic
agacagggcttagagagaagtctattgtaacatgggaaacgtattgggaaaaaataaatatgagggatgggcagc

SEQ ID NO: 184368 - DNA, 75 bp, Artificial Sequence
  Synthetic
agacagggcttagagagaagtctattgtaacatgggatacgtattgggaaaaaataaatatgagggatgggcagc

SEQ ID NO: 184369 - DNA, 75 bp, Artificial Sequence
  Synthetic
agacagggcttagagagaagtctattgtaacatgggacacgtattgggaaaaaataaatatgagggatgggcagc

SEQ ID NO: 184370 - DNA, 75 bp, Artificial Sequence
  Synthetic
agacagggcttagagagaagtctattgtaacatgggagacgtattgggaaaaaataaatatgagggatgggcagc

SEQ ID NO: 184371 - DNA, 75 bp, Artificial Sequence
  Synthetic
gtagctggctggacagataggcttatagaaataatacaagcagttggtagagctattatccacatacctagaaga

SEQ ID NO: 184372 - DNA, 75 bp, Artificial Sequence
  Synthetic
tagaaataatacaagcagttggtagagctattatccacatacctagaagaatcagacaggattttgaactagctt

SEQ ID NO: 184373 - DNA, 75 bp, Artificial Sequence
  Synthetic
aaaaatagaggaactgagacaacatctgttgaagtggggatttaccacaccagacaaaaaacatcagaaagaacc

SEQ ID NO: 184374 - DNA, 75 bp, Artificial Sequence
  Synthetic
gtttccctcaaatcactctttggcaacgaccccttgtcacagtaagaatagggggacagctaaaagaagctctat

SEQ ID NO: 184375 - DNA, 75 bp, Artificial Sequence
  Synthetic
agtgctctggtgtgttcacaacagatataaaattggagatacgcagcaggcaatacaaaagttaaaggaagtaat

SEQ ID NO: 184376 - DNA, 75 bp, Artificial Sequence
  Synthetic
taaatcattatttaatacagtagcagtcctctggtgtgtacatcaaagaatagatgtaagagacaccaaggaagc

SEQ ID NO: 184377 - DNA, 75 bp, Artificial Sequence
  Synthetic
ccggtagggccgttgccaccagggcagataagggaaccaacaggaagtgacattgctgggacaactagcacccag

SEQ ID NO: 184378 - DNA, 75 bp, Artificial Sequence
  Synthetic
tattaagacaaagaaaaatagacaggttaattgatagaataagagaaagagcagaagacagtggcaatgagagtg

SEQ ID NO: 184379 - DNA, 75 bp, Artificial Sequence
  Synthetic
gaaatcattagggccaggagctaccttagaagagatgatggtagcctgtcagggagtaggaggaccaactcataa

SEQ ID NO: 184380 - DNA, 75 bp, Artificial Sequence
  Synthetic
ttagaagagatgatggtagcctgtcagggagtaggaggaccaactcataaggccagagtgctagcagaagcaatg

SEQ ID NO: 184381 - DNA, 75 bp, Artificial Sequence
  Synthetic
ggccagagtgctagcagaagcaatggctacagcccagcaagatttgaaaggaggatacacagcagtattcatgca

SEQ ID NO: 184382 - DNA, 75 bp, Artificial Sequence
  Synthetic
taattgtacaagacccaacaataatacaagaaaaagtataaggataggaccaggacaaacattctatgcaacagg

SEQ ID NO: 184383 - DNA, 75 bp, Artificial Sequence
  Synthetic
gaggatacacagcagtattcatgcaaagagggcaaaatccaattaggaaaggaactataaaatgtttcaactgtg

SEQ ID NO: 184384 - DNA, 75 bp, Artificial Sequence
  Synthetic
acaagaaaaagtataaggataggaccaggacaaacattctatgcaacaggtgacataataggagatataagacaa

SEQ ID NO: 184385 - DNA, 75 bp, Artificial Sequence
  Synthetic
gaaaagagggacatatagcaagaaattgtcgagcacctaggaaaaagggttgctggaaatgtggacaggaaggtc

SEQ ID NO: 184386 - DNA, 75 bp, Artificial Sequence
  Synthetic
cacacgcaggaggggatctagaaattacaacacatagctttaattgtagaggagaatttttctattgcaatacaa

SEQ ID NO: 184387 - DNA, 75 bp, Artificial Sequence
  Synthetic
cactggtaataataccactattagcaacggagaaatgaaaaattgctctttcaatatcaccacaaacatgagcaa

SEQ ID NO: 184388 - DNA, 75 bp, Artificial Sequence
  Synthetic
aaaatttcaagaataggacctgaaaatccttataatacacctatctttgctataaaaaagaaagatggtactaaa

SEQ ID NO: 184389 - DNA, 75 bp, Artificial Sequence
  Synthetic
caacactttaatactgatagttaaaaaattaagagaacaatatgagaataaaacaatagtctttaagcaatcctc

SEQ ID NO: 184390 - DNA, 75 bp, Artificial Sequence
  Synthetic
aaacaatagtctttaagcaatcctcaggaggagatctagaaatcacaatgcacagttttaattgtggaggggaat

SEQ ID NO: 184391 - DNA, 75 bp, Artificial Sequence
  Synthetic
tacaatgtcctcccgcaaggatggaaaggttcaccagctatattccaaagttcaatgacaaaaattctagatcca

SEQ ID NO: 184392 - DNA, 75 bp, Artificial Sequence
  Synthetic
ccaatgcagaataaaacagattataaacatgtggcaggaagtaggaagagcaatgtatgcccctcccatcgaagg

SEQ ID NO: 184393 - DNA, 75 bp, Artificial Sequence
  Synthetic
gggcaaggccaatggacatatcaaatttatcaagagccatttaaaaatctgaaaacaggaaagtatgcaagaacg

SEQ ID NO: 184394 - DNA, 75 bp, Artificial Sequence
  Synthetic
cataagaacctcaaaacagggaaatatactaggcaaaaggcctcccacacaaatgatataagacaattagcagaa

SEQ ID NO: 184395 - DNA, 75 bp, Artificial Sequence
  Synthetic
aatataggaaattgttaagacagaaaaagatagacaggttaattgaaagaattagggaaagagcagaagacagtg

SEQ ID NO: 184396 - DNA, 75 bp, Artificial Sequence
  Synthetic
cagatgcatgaggatgtaatcagtttatgggatcaaagcctaaagccatgtgtaaaattaaccccactctgtgtt

SEQ ID NO: 184397 - DNA, 75 bp, Artificial Sequence
  Synthetic
taacacctatggggatacttgggaaggagttgaagctataataagaattctgcaacaactactgtttgttcattt

SEQ ID NO: 184398 - DNA, 75 bp, Artificial Sequence
  Synthetic
aagaataagagaaagagcagaagacagtggcaatgagagtgagggggatgcagaggaattggcagcacttgggga

SEQ ID NO: 184399 - DNA, 75 bp, Artificial Sequence
  Synthetic
cagctaccaccgcttgagagacttactcttgattgtagcgaggattgtggaacttctgggacgcagggggtggga

SEQ ID NO: 184400 - DNA, 75 bp, Artificial Sequence
  Synthetic
aaggcaaaatcataatagttgctgtccatgtggcaagtgggttcatagaagcagaagtgataccagcagaaacag

SEQ ID NO: 184401 - DNA, 75 bp, Artificial Sequence
  Synthetic
gaaggagctgagccagcagcagctggggtgggagcagcatctcgagacctagacagatatggagcactcacaact

SEQ ID NO: 184402 - DNA, 75 bp, Artificial Sequence
  Synthetic
gtgccttggaggaagacaacagtaccttgaaggaagagtcaggggcaataaaaaactgttctttcaatatgacct

SEQ ID NO: 184403 - DNA, 75 bp, Artificial Sequence
  Synthetic
cgggtggggaagaaataaaaaactgctcttacaatattaccacagaactaagggataaaagaaagaaagtatatt

SEQ ID NO: 184404 - DNA, 75 bp, Artificial Sequence
  Synthetic
attagtagtagtagcaataatagcaatagttgtgtggtctatagtattcatagaatataggaaaatattaagaca

SEQ ID NO: 184405 - DNA, 75 bp, Artificial Sequence
  Synthetic
attctcccatgtagaataatacgaattgtagacatgtggcaggaagtagcacgagcaatgtatgccgctcccatt

SEQ ID NO: 184406 - DNA, 75 bp, Artificial Sequence
  Synthetic
caaaacaataatctttactaactcctcaggaggggatatagaaatcacaacacatagttttaattgtggaggaga

SEQ ID NO: 184407 - DNA, 75 bp, Artificial Sequence
  Synthetic
taaaagcagaagcagtaagacatttccctaggccttggctacacgccttgggacaatacatttatgagacttatg

SEQ ID NO: 184408 - DNA, 75 bp, Artificial Sequence
  Synthetic
ggacaatacatttatgagacttatggggacacttgggtaggagttatggcaattataagaatcttacaacaattg

SEQ ID NO: 184409 - DNA, 75 bp, Artificial Sequence
  Synthetic
taaaatgtaaaaatgttactagtaatagtactaataaggaagaaatgaaaaattgtactttcaatgcaactgcaa

SEQ ID NO: 184410 - DNA, 75 bp, Artificial Sequence
  Synthetic
gttgttaaatggtagtctagcagaagaagagataataatcagatctgaaaatctcacagacaatgccaaaaccat

SEQ ID NO: 184411 - DNA, 75 bp, Artificial Sequence
  Synthetic
tcatagggacctgctagcaataataattattagtgctttgctgtttataaatgtaattttatgggggtttattct

SEQ ID NO: 184412 - DNA, 75 bp, Artificial Sequence
  Synthetic
caacaataatacaagaagaggtataggaataggaccaggacaaatgttctttgcaacagacataataggagatat

SEQ ID NO: 184413 - DNA, 75 bp, Artificial Sequence
  Synthetic
tggatcagatgcatgaggatataattagtttatgggatcaaagcctaaaaccatgtgtaaagttgaccccactct

SEQ ID NO: 184414 - DNA, 75 bp, Artificial Sequence
  Synthetic
gaaaaccttatgaagaagtgtgagtttaatgtaaccactgttatcaaagacaaaaaggagaaaaaacaggctcta

SEQ ID NO: 184415 - DNA, 75 bp, Artificial Sequence
  Synthetic
agaaataaaaaattgctctttcaatataaccacagaaataagagataagaggaaacaagtatatgcactttttta

SEQ ID NO: 184416 - DNA, 75 bp, Artificial Sequence
  Synthetic
ggccaacagtaagtactcagctaatattaaatgggacactctctaaaggaaaaataagaatgatggcaaaagata

SEQ ID NO: 184417 - DNA, 75 bp, Artificial Sequence
  Synthetic
atctaatatgggcaagcagggagctagaacgatttgcacttgatcctggccttctagaaacatcagaaggctgtc

SEQ ID NO: 184418 - DNA, 75 bp, Artificial Sequence
  Synthetic
aatggcctggtacagcatgggaatagggggaacagcaggaaacagctcaagggcagcttattgcaagtataatgc

SEQ ID NO: 184419 - DNA, 75 bp, Artificial Sequence
  Synthetic
taagccagtggcatcaactcaactactgttaaatggcagtttagcagaagaaaagataatgattagatctgaaaa

SEQ ID NO: 184420 - DNA, 75 bp, Artificial Sequence
  Synthetic
tgcttgaagtctcgcaaaaccagcaggaaaaaaatgaacaagatttactagcattggacaaatggcaaaatctgt

SEQ ID NO: 184421 - DNA, 75 bp, Artificial Sequence
  Synthetic
ggagatctagaggtaacccatttacactttaactgtcatggagaattcttttattgtaacacagctaagatgttt

SEQ ID NO: 184422 - DNA, 75 bp, Artificial Sequence
  Synthetic
aggaggggatctagaagttacaacacatagctttaattgtagaggagaatttttctattgcaatacaacaaaact

SEQ ID NO: 184423 - DNA, 75 bp, Artificial Sequence
  Synthetic
tgcaaactgagacaggtggtaaggtcatggataaggggacagtcgggactctatgcacctcccatcaaaggtaat

SEQ ID NO: 184424 - DNA, 75 bp, Artificial Sequence
  Synthetic
tcacaacacatagttttaattgtagaggagaatttttctattgcaatacatcaagactgtttaatagcatttggg

SEQ ID NO: 184425 - DNA, 75 bp, Artificial Sequence
  Synthetic
ttgcaataaaatggggaacaagtggtcaaaatgtagtccagtgggatggcctagtgtattagaaagaataagaag

SEQ ID NO: 184426 - DNA, 75 bp, Artificial Sequence
  Synthetic
tggggcactcacaagcagcaatacagcaactaataatgctgattgtgcctggctagaagcacaagaagaagcaga

SEQ ID NO: 184427 - DNA, 75 bp, Artificial Sequence
  Synthetic
gcctggctggaagcgcaagaggaggaagaagaggtaggctttccagtcagacctcaggtacctttaagaccaatg

SEQ ID NO: 184428 - DNA, 75 bp, Artificial Sequence
  Synthetic
ggatcggcagataagcaacataagctccaccatatatgaggaaatacaaaaggcacaagtacagcaggaacaaaa

SEQ ID NO: 184429 - DNA, 75 bp, Artificial Sequence
  Synthetic
gtatacatatagggccagggagagcattttatgcaacaggagacataataggagatataagacaagcacattgta

SEQ ID NO: 184430 - DNA, 75 bp, Artificial Sequence
  Synthetic
caaagaccaccctattttgtgcatcagatgctaaagcatatgagacagaaaagcataatgtctgggctacacatg

SEQ ID NO: 184431 - DNA, 75 bp, Artificial Sequence
  Synthetic
cgaaagaatcgaagaaggaggtggcgagcaaggcagagacagatccgtgcgattagtgagcggattcttagcact

SEQ ID NO: 184432 - DNA, 75 bp, Artificial Sequence
  Synthetic
gggcttagaaagaagtttattgtaacatgggaaacgcattgagaaaaggtaaatttgagggatgggcagcagtaa

SEQ ID NO: 184433 - DNA, 75 bp, Artificial Sequence
  Synthetic
aattagcagctagaggagggataccaagttcccatactcctcaaaacaatgcagcccttgcattcctagaaagtc

SEQ ID NO: 184434 - DNA, 75 bp, Artificial Sequence
  Synthetic
cactgcattcaccatacctagtgtcaacaatgagacaccaggaattagataccagtacaatgtgcttccacaagg

SEQ ID NO: 184435 - DNA, 75 bp, Artificial Sequence
  Synthetic
cgaagcactcctccaaacagtgaggatcatcaaaatcttgtatcaaagcagtgagtatatatgtctctctccttc

SEQ ID NO: 184436 - DNA, 75 bp, Artificial Sequence
  Synthetic
ctcaagtgcctctaaggccaatgacctataaaggagcatttgacctcagcttctttttaaaagaaaagggaggac

SEQ ID NO: 184437 - DNA, 75 bp, Artificial Sequence
  Synthetic
ggtaggagcagcatctcgggacctagaaagacatggggcaatcacaagtagtaatacagcacaaaataatgctga

SEQ ID NO: 184438 - DNA, 75 bp, Artificial Sequence
  Synthetic
cctgcagtcactctggaacacaatagcagtgctctggtgtgttcacaacagatataaagttgaagatacgcagca

SEQ ID NO: 184439 - DNA, 75 bp, Artificial Sequence
  Synthetic
tagatcattatttaatacagtagcaaccctctattgcgtacatcaacggatagatgtaaaagacaccaaggaagc

SEQ ID NO: 184440 - DNA, 75 bp, Artificial Sequence
  Synthetic
taacaaaaactacaaatggaaaaaatgccagtactgatatgatgaaatgctctttcaatacaaccacagaattaa

SEQ ID NO: 184441 - DNA, 75 bp, Artificial Sequence
  Synthetic
gtaccaaatgcgcagggacaaatgatacatcaggccctctcccccaggactttaaatgcatgggtaaaggcagta

SEQ ID NO: 184442 - DNA, 75 bp, Artificial Sequence
  Synthetic
tttaaatgcatgggtaaaggcagtagaagaaaaggcctttaaccctgaaatcattcctatgttcatggcattgtc

SEQ ID NO: 184443 - DNA, 75 bp, Artificial Sequence
  Synthetic
agagggagctattccctatgatattaataccatgctaaatgccataggaggacatcaaggggccttacaagtgct

SEQ ID NO: 184444 - DNA, 75 bp, Artificial Sequence
  Synthetic
taggattaatagtagcaggcatagcagccataattgtgtggaccatagttttcatacaatataaggaaataagaa

SEQ ID NO: 184445 - DNA, 75 bp, Artificial Sequence
  Synthetic
caccctcaggaggggatctagaaattacaacacatagttttaattgtagaggagaatttttctattgcaatacat

SEQ ID NO: 184446 - DNA, 75 bp, Artificial Sequence
  Synthetic
aggtaaaggaattatgtaaactccttaggggagccaaagcactaacagaagtaataccactaacagaagaagcag

SEQ ID NO: 184447 - DNA, 75 bp, Artificial Sequence
  Synthetic
tggaaaagagggacatatagcaaaaaattgtcgagcacctagaaagaaaggttgctggaaatgtggacaggaagg

SEQ ID NO: 184448 - DNA, 75 bp, Artificial Sequence
  Synthetic
ggctaattttttagggaaaatttggccttcccacaaggggaggccagggaatttccttcagagcagaccagagcc

SEQ ID NO: 184449 - DNA, 75 bp, Artificial Sequence
  Synthetic
ccaaacgaactctatccgtttgcctccctcaaatccctctttgggacagaccagtagttacagcaaaagttgggg

SEQ ID NO: 184450 - DNA, 75 bp, Artificial Sequence
  Synthetic
ccacagaattaaaggatagacagaagcaagaatacgcgcttttctataaacttgatatagtgccaattaatgata

SEQ ID NO: 184451 - DNA, 75 bp, Artificial Sequence
  Synthetic
taataactatagtgactataggctaataaattgtaatgtctcagccattaaacaggcttgcccaaaggtgtcttt

SEQ ID NO: 184452 - DNA, 75 bp, Artificial Sequence
  Synthetic
ctccagcagcaacaggagtaggagcagtatctcaagatttagataaacatggagcaatcacaagcaagaatatca

SEQ ID NO: 184453 - DNA, 75 bp, Artificial Sequence
  Synthetic
gaagtaaatatagtaacagactcacaatatgcattaggaatcattcaggcacaaccagacaggagtgaatcagag

SEQ ID NO: 184454 - DNA, 75 bp, Artificial Sequence
  Synthetic
gggtgggaataatactagtattgaggggggaaagatggagagaggagaactgaaaaactgctctttcaacatctc

SEQ ID NO: 184455 - DNA, 75 bp, Artificial Sequence
  Synthetic
acataatatacaacttgcttgaagaatcgcaaaatcagcaggagaaaaatgaaaaggatttattagcattggaca

SEQ ID NO: 184456 - DNA, 75 bp, Artificial Sequence
  Synthetic
accaggacaagcgttctatacaacaggtgaaataataggagatataagacaagcacattgtgaggttaataaaac

SEQ ID NO: 184457 - DNA, 75 bp, Artificial Sequence
  Synthetic
tgggcaagtttgtggaattggtttgacataacaaattggctgtggtatataaaaatattcataatgatagtagga

SEQ ID NO: 184458 - DNA, 75 bp, Artificial Sequence
  Synthetic
gaagtaaacatagtaacagactcacagtatgcattaggaattattcaagcacaaccagataaaagtgaatcagag

SEQ ID NO: 184459 - DNA, 75 bp, Artificial Sequence
  Synthetic
gataaaacagattgtgagaatgtggcagagagtaggacaagcaatgtatgcccctcccatcgcaggaaacattac

SEQ ID NO: 184460 - DNA, 75 bp, Artificial Sequence
  Synthetic
ccctaggtgtaactatcaagcaggacataacaaggtaggatccctacaatatttggcactaacagcattaatagc

SEQ ID NO: 184461 - DNA, 75 bp, Artificial Sequence
  Synthetic
gaccaggacaagtattctatagaacaggagacataataggagatataagaaaagcatattgtgagattaatggaa

SEQ ID NO: 184462 - DNA, 75 bp, Artificial Sequence
  Synthetic
aggagacataataggagatataagaaaagcatattgtgagattaatggaacaaaatggaatgaagttttaaaaca

SEQ ID NO: 184463 - DNA, 75 bp, Artificial Sequence
  Synthetic
ggaacagataggattatagaattagtacaaagaatttgtagagctatccgcaacatacctagaagaataagacag

SEQ ID NO: 184464 - DNA, 75 bp, Artificial Sequence
  Synthetic
catccagacaaatggacagtacagcccatccaattacctaacaaggatgtgtggacagtaaatgatatacaaaaa

SEQ ID NO: 184465 - DNA, 75 bp, Artificial Sequence
  Synthetic
tgggatagagaaattaataattacacaaacacaatatacaggttgcttgaagaatcacaaaaccagcaggagaaa

SEQ ID NO: 184466 - DNA, 75 bp, Artificial Sequence
  Synthetic
ctccacatacctacaagaataagacagggcttggaaaggcttttgctataagatgggtggcaagtggtcaaaacg

SEQ ID NO: 184467 - DNA, 75 bp, Artificial Sequence
  Synthetic
ggctttgaagcagctttgctataacatgggaggcaagtggtcaaaaggttgcatgtcaggatggcctgcagtaag

SEQ ID NO: 184468 - DNA, 75 bp, Artificial Sequence
  Synthetic
gcactcacaagtagcaatacagcaactaataatgctgcttgtgcctggctagaagcacaagaggaagaggaggtg

SEQ ID NO: 184469 - DNA, 75 bp, Artificial Sequence
  Synthetic
ggttcagattcagaagcatgaaacagggcaatggacttaccagatatatcaggatgaatataagaacctcaaaac

SEQ ID NO: 184470 - DNA, 75 bp, Artificial Sequence
  Synthetic
ggttcagattcagaagcatgaatcagggcaatggacttaccagatatatcaggatgaatataagaacctcaaaac

SEQ ID NO: 184471 - DNA, 75 bp, Artificial Sequence
  Synthetic
ggttcagattcagaagcatgaaccagggcaatggacttaccagatatatcaggatgaatataagaacctcaaaac

SEQ ID NO: 184472 - DNA, 75 bp, Artificial Sequence
  Synthetic
ggttcagattcagaagcatgaagcagggcaatggacttaccagatatatcaggatgaatataagaacctcaaaac

SEQ ID NO: 184473 - DNA, 75 bp, Artificial Sequence
  Synthetic
cttaggcatctcccatggcaggaagaagcggagacaacgacaaagaactcctccaagcagtcggatacatcaaga

SEQ ID NO: 184474 - DNA, 75 bp, Artificial Sequence
  Synthetic
acatatagtatgggcaagcagggaactagaacgattcgcagttaatcctggcctgttagaaacatcagaaggctg

SEQ ID NO: 184475 - DNA, 75 bp, Artificial Sequence
  Synthetic
tcaagaagccatagttatctggggaaaattgcctaaatttaagctgccagtcactagagaaacttgggaaacatg

SEQ ID NO: 184476 - DNA, 75 bp, Artificial Sequence
  Synthetic
gtgggtcacagtctattatggggtacctgtgtggaaagaagcaaccactactctattctgtgcatcagatgctaa

SEQ ID NO: 184477 - DNA, 75 bp, Artificial Sequence
  Synthetic
gaacaagggaaacagaaaatagtaaaattagaggagaccaccaatcaaaaggctgaattaatggcgatactatta

SEQ ID NO: 184478 - DNA, 75 bp, Artificial Sequence
  Synthetic
gaacaagggaaacagaaaatagtaaaattagaggagaccaccaatcaaaaggctgatttaatggcgatactatta

SEQ ID NO: 184479 - DNA, 75 bp, Artificial Sequence
  Synthetic
gaacaagggaaacagaaaatagtaaaattagaggagaccaccaatcaaaaggctgacttaatggcgatactatta

SEQ ID NO: 184480 - DNA, 75 bp, Artificial Sequence
  Synthetic
gaacaagggaaacagaaaatagtaaaattagaggagaccaccaatcaaaaggctgagttaatggcgatactatta

SEQ ID NO: 184481 - DNA, 75 bp, Artificial Sequence
  Synthetic
aaatgggcaaatttgtggaattggtttaacatatcaaattggctgtggtatataaaaatattcataatgatagta

SEQ ID NO: 184482 - DNA, 75 bp, Artificial Sequence
  Synthetic
agtcaaaattatcctatagtgcagaatctccaagggcaaatggtacatcagcccatatcacctagaactttaaat

SEQ ID NO: 184483 - DNA, 75 bp, Artificial Sequence
  Synthetic
ctcaaaatatctcagataatacaaaaaccataatagtacaccttaatgaatctgtacagattaattgtacaagac

SEQ ID NO: 184484 - DNA, 75 bp, Artificial Sequence
  Synthetic
aaccataatagtacaccttaatgaatctgtacagattaattgtacaagacccaacaacaatacaagaaaaagtat

SEQ ID NO: 184485 - DNA, 75 bp, Artificial Sequence
  Synthetic
gcagtacaaatggcagtatttgttcacaattttaaaagaaaaggggggattggggggtacactgcaggagaaagg

SEQ ID NO: 184486 - DNA, 75 bp, Artificial Sequence
  Synthetic
aagcgctcctccaagcagtgaggatcatcaaaatcttgtatcaaagcagtaagtactaaatagtagatgtaatgg

SEQ ID NO: 184487 - DNA, 75 bp, Artificial Sequence
  Synthetic
tggggaactttgatccttgggttggagatactttgtagtgctgcagaccacttgtgggtcacagtttattatgag

SEQ ID NO: 184488 - DNA, 75 bp, Artificial Sequence
  Synthetic
aaggagtctggtaggatggcctcagataagagaaagaatgagacgcactgggcgcactgaaccagcagcaggacg

SEQ ID NO: 184489 - DNA, 75 bp, Artificial Sequence
  Synthetic
agaataaaacaaattataaacatgtggcaggaagtaggaaaagcaatgtatgcccctcccatcaaaggacaaatt

SEQ ID NO: 184490 - DNA, 75 bp, Artificial Sequence
  Synthetic
tacccacagaccccaacccacaagaagtggtattggtaaatgtgacggaaaactttaacatgtggaaaaataaca

SEQ ID NO: 184491 - DNA, 75 bp, Artificial Sequence
  Synthetic
atttgtacccaatgctagttcgaccaatgtcaatgacacagtcaatgtctctagcataataggaaatataacaga

SEQ ID NO: 184492 - DNA, 75 bp, Artificial Sequence
  Synthetic
gtacaggtctgggaaggccaggaactggtattacaggcatcattttgaatctagaaatccaagattcagttcagg

SEQ ID NO: 184493 - DNA, 75 bp, Artificial Sequence
  Synthetic
aaatatgaaagacaattggagaagtgaattatataaatataaagtagtagaaattgaaccactaggagtagcacc

SEQ ID NO: 184494 - DNA, 75 bp, Artificial Sequence
  Synthetic
ctagcataataggaaatataacagatgaagtgaagaactgttcttttaatgtaaccacagaaataagagataagc

SEQ ID NO: 184495 - DNA, 75 bp, Artificial Sequence
  Synthetic
ggataatcatacccacaatgagaacatgggggaaaaaataaatagggaagaaataaaaaactgttctttcaatat

SEQ ID NO: 184496 - DNA, 75 bp, Artificial Sequence
  Synthetic
ggataatcatacccacaatgagaacatgggggtaaaaataaatagggaagaaataaaaaactgttctttcaatat

SEQ ID NO: 184497 - DNA, 75 bp, Artificial Sequence
  Synthetic
ggataatcatacccacaatgagaacatgggggcaaaaataaatagggaagaaataaaaaactgttctttcaatat

SEQ ID NO: 184498 - DNA, 75 bp, Artificial Sequence
  Synthetic
ggataatcatacccacaatgagaacatggggggaaaaataaatagggaagaaataaaaaactgttctttcaatat

SEQ ID NO: 184499 - DNA, 75 bp, Artificial Sequence
  Synthetic
ggataatcatacccacaatgagatcatgggggaaaaaataaatagggaagaaataaaaaactgttctttcaatat

SEQ ID NO: 184500 - DNA, 75 bp, Artificial Sequence
  Synthetic
ggataatcatacccacaatgagatcatgggggtaaaaataaatagggaagaaataaaaaactgttctttcaatat

SEQ ID NO: 184501 - DNA, 75 bp, Artificial Sequence
  Synthetic
ggataatcatacccacaatgagatcatgggggcaaaaataaatagggaagaaataaaaaactgttctttcaatat

SEQ ID NO: 184502 - DNA, 75 bp, Artificial Sequence
  Synthetic
ggataatcatacccacaatgagatcatggggggaaaaataaatagggaagaaataaaaaactgttctttcaatat

SEQ ID NO: 184503 - DNA, 75 bp, Artificial Sequence
  Synthetic
ggataatcatacccacaatgagaccatgggggaaaaaataaatagggaagaaataaaaaactgttctttcaatat

SEQ ID NO: 184504 - DNA, 75 bp, Artificial Sequence
  Synthetic
ggataatcatacccacaatgagaccatgggggtaaaaataaatagggaagaaataaaaaactgttctttcaatat

SEQ ID NO: 184505 - DNA, 75 bp, Artificial Sequence
  Synthetic
ggataatcatacccacaatgagaccatgggggcaaaaataaatagggaagaaataaaaaactgttctttcaatat

SEQ ID NO: 184506 - DNA, 75 bp, Artificial Sequence
  Synthetic
ggataatcatacccacaatgagaccatggggggaaaaataaatagggaagaaataaaaaactgttctttcaatat

SEQ ID NO: 184507 - DNA, 75 bp, Artificial Sequence
  Synthetic
ggataatcatacccacaatgagagcatgggggaaaaaataaatagggaagaaataaaaaactgttctttcaatat

SEQ ID NO: 184508 - DNA, 75 bp, Artificial Sequence
  Synthetic
ggataatcatacccacaatgagagcatgggggtaaaaataaatagggaagaaataaaaaactgttctttcaatat

SEQ ID NO: 184509 - DNA, 75 bp, Artificial Sequence
  Synthetic
ggataatcatacccacaatgagagcatgggggcaaaaataaatagggaagaaataaaaaactgttctttcaatat

SEQ ID NO: 184510 - DNA, 75 bp, Artificial Sequence
  Synthetic
ggataatcatacccacaatgagagcatggggggaaaaataaatagggaagaaataaaaaactgttctttcaatat

SEQ ID NO: 184511 - DNA, 75 bp, Artificial Sequence
  Synthetic
ggttaatcatacccacaatgagaacatgggggaaaaaataaatagggaagaaataaaaaactgttctttcaatat

SEQ ID NO: 184512 - DNA, 75 bp, Artificial Sequence
  Synthetic
ggttaatcatacccacaatgagaacatgggggtaaaaataaatagggaagaaataaaaaactgttctttcaatat

SEQ ID NO: 184513 - DNA, 75 bp, Artificial Sequence
  Synthetic
ggttaatcatacccacaatgagaacatgggggcaaaaataaatagggaagaaataaaaaactgttctttcaatat

SEQ ID NO: 184514 - DNA, 75 bp, Artificial Sequence
  Synthetic
ggttaatcatacccacaatgagaacatggggggaaaaataaatagggaagaaataaaaaactgttctttcaatat

SEQ ID NO: 184515 - DNA, 75 bp, Artificial Sequence
  Synthetic
ggttaatcatacccacaatgagatcatgggggaaaaaataaatagggaagaaataaaaaactgttctttcaatat

SEQ ID NO: 184516 - DNA, 75 bp, Artificial Sequence
  Synthetic
ggttaatcatacccacaatgagatcatgggggtaaaaataaatagggaagaaataaaaaactgttctttcaatat

SEQ ID NO: 184517 - DNA, 75 bp, Artificial Sequence
  Synthetic
ggttaatcatacccacaatgagatcatgggggcaaaaataaatagggaagaaataaaaaactgttctttcaatat

SEQ ID NO: 184518 - DNA, 75 bp, Artificial Sequence
  Synthetic
ggttaatcatacccacaatgagatcatggggggaaaaataaatagggaagaaataaaaaactgttctttcaatat

SEQ ID NO: 184519 - DNA, 75 bp, Artificial Sequence
  Synthetic
ggttaatcatacccacaatgagaccatgggggaaaaaataaatagggaagaaataaaaaactgttctttcaatat

SEQ ID NO: 184520 - DNA, 75 bp, Artificial Sequence
  Synthetic
ggttaatcatacccacaatgagaccatgggggtaaaaataaatagggaagaaataaaaaactgttctttcaatat

SEQ ID NO: 184521 - DNA, 75 bp, Artificial Sequence
  Synthetic
ggttaatcatacccacaatgagaccatgggggcaaaaataaatagggaagaaataaaaaactgttctttcaatat

SEQ ID NO: 184522 - DNA, 75 bp, Artificial Sequence
  Synthetic
ggttaatcatacccacaatgagaccatggggggaaaaataaatagggaagaaataaaaaactgttctttcaatat

SEQ ID NO: 184523 - DNA, 75 bp, Artificial Sequence
  Synthetic
ggttaatcatacccacaatgagagcatgggggaaaaaataaatagggaagaaataaaaaactgttctttcaatat

SEQ ID NO: 184524 - DNA, 75 bp, Artificial Sequence
  Synthetic
ggttaatcatacccacaatgagagcatgggggtaaaaataaatagggaagaaataaaaaactgttctttcaatat

SEQ ID NO: 184525 - DNA, 75 bp, Artificial Sequence
  Synthetic
ggttaatcatacccacaatgagagcatgggggcaaaaataaatagggaagaaataaaaaactgttctttcaatat

SEQ ID NO: 184526 - DNA, 75 bp, Artificial Sequence
  Synthetic
ggttaatcatacccacaatgagagcatggggggaaaaataaatagggaagaaataaaaaactgttctttcaatat

SEQ ID NO: 184527 - DNA, 75 bp, Artificial Sequence
  Synthetic
ggctaatcatacccacaatgagaacatgggggaaaaaataaatagggaagaaataaaaaactgttctttcaatat

SEQ ID NO: 184528 - DNA, 75 bp, Artificial Sequence
  Synthetic
ggctaatcatacccacaatgagaacatgggggtaaaaataaatagggaagaaataaaaaactgttctttcaatat

SEQ ID NO: 184529 - DNA, 75 bp, Artificial Sequence
  Synthetic
ggctaatcatacccacaatgagaacatgggggcaaaaataaatagggaagaaataaaaaactgttctttcaatat

SEQ ID NO: 184530 - DNA, 75 bp, Artificial Sequence
  Synthetic
ggctaatcatacccacaatgagaacatggggggaaaaataaatagggaagaaataaaaaactgttctttcaatat

SEQ ID NO: 184531 - DNA, 75 bp, Artificial Sequence
  Synthetic
ggctaatcatacccacaatgagatcatgggggaaaaaataaatagggaagaaataaaaaactgttctttcaatat

SEQ ID NO: 184532 - DNA, 75 bp, Artificial Sequence
  Synthetic
ggctaatcatacccacaatgagatcatgggggtaaaaataaatagggaagaaataaaaaactgttctttcaatat

SEQ ID NO: 184533 - DNA, 75 bp, Artificial Sequence
  Synthetic
ggctaatcatacccacaatgagatcatgggggcaaaaataaatagggaagaaataaaaaactgttctttcaatat

SEQ ID NO: 184534 - DNA, 75 bp, Artificial Sequence
  Synthetic
ggctaatcatacccacaatgagatcatggggggaaaaataaatagggaagaaataaaaaactgttctttcaatat

SEQ ID NO: 184535 - DNA, 75 bp, Artificial Sequence
  Synthetic
ggctaatcatacccacaatgagaccatgggggaaaaaataaatagggaagaaataaaaaactgttctttcaatat

SEQ ID NO: 184536 - DNA, 75 bp, Artificial Sequence
  Synthetic
ggctaatcatacccacaatgagaccatgggggtaaaaataaatagggaagaaataaaaaactgttctttcaatat

SEQ ID NO: 184537 - DNA, 75 bp, Artificial Sequence
  Synthetic
ggctaatcatacccacaatgagaccatgggggcaaaaataaatagggaagaaataaaaaactgttctttcaatat

SEQ ID NO: 184538 - DNA, 75 bp, Artificial Sequence
  Synthetic
ggctaatcatacccacaatgagaccatggggggaaaaataaatagggaagaaataaaaaactgttctttcaatat

SEQ ID NO: 184539 - DNA, 75 bp, Artificial Sequence
  Synthetic
ggctaatcatacccacaatgagagcatgggggaaaaaataaatagggaagaaataaaaaactgttctttcaatat

SEQ ID NO: 184540 - DNA, 75 bp, Artificial Sequence
  Synthetic
ggctaatcatacccacaatgagagcatgggggtaaaaataaatagggaagaaataaaaaactgttctttcaatat

SEQ ID NO: 184541 - DNA, 75 bp, Artificial Sequence
  Synthetic
ggctaatcatacccacaatgagagcatgggggcaaaaataaatagggaagaaataaaaaactgttctttcaatat

SEQ ID NO: 184542 - DNA, 75 bp, Artificial Sequence
  Synthetic
ggctaatcatacccacaatgagagcatggggggaaaaataaatagggaagaaataaaaaactgttctttcaatat

SEQ ID NO: 184543 - DNA, 75 bp, Artificial Sequence
  Synthetic
gggtaatcatacccacaatgagaacatgggggaaaaaataaatagggaagaaataaaaaactgttctttcaatat

SEQ ID NO: 184544 - DNA, 75 bp, Artificial Sequence
  Synthetic
gggtaatcatacccacaatgagaacatgggggtaaaaataaatagggaagaaataaaaaactgttctttcaatat

SEQ ID NO: 184545 - DNA, 75 bp, Artificial Sequence
  Synthetic
gggtaatcatacccacaatgagaacatgggggcaaaaataaatagggaagaaataaaaaactgttctttcaatat

SEQ ID NO: 184546 - DNA, 75 bp, Artificial Sequence
  Synthetic
gggtaatcatacccacaatgagaacatggggggaaaaataaatagggaagaaataaaaaactgttctttcaatat

SEQ ID NO: 184547 - DNA, 75 bp, Artificial Sequence
  Synthetic
gggtaatcatacccacaatgagatcatgggggaaaaaataaatagggaagaaataaaaaactgttctttcaatat

SEQ ID NO: 184548 - DNA, 75 bp, Artificial Sequence
  Synthetic
gggtaatcatacccacaatgagatcatgggggtaaaaataaatagggaagaaataaaaaactgttctttcaatat

SEQ ID NO: 184549 - DNA, 75 bp, Artificial Sequence
  Synthetic
gggtaatcatacccacaatgagatcatgggggcaaaaataaatagggaagaaataaaaaactgttctttcaatat

SEQ ID NO: 184550 - DNA, 75 bp, Artificial Sequence
  Synthetic
gggtaatcatacccacaatgagatcatggggggaaaaataaatagggaagaaataaaaaactgttctttcaatat

SEQ ID NO: 184551 - DNA, 75 bp, Artificial Sequence
  Synthetic
gggtaatcatacccacaatgagaccatgggggaaaaaataaatagggaagaaataaaaaactgttctttcaatat

SEQ ID NO: 184552 - DNA, 75 bp, Artificial Sequence
  Synthetic
gggtaatcatacccacaatgagaccatgggggtaaaaataaatagggaagaaataaaaaactgttctttcaatat

SEQ ID NO: 184553 - DNA, 75 bp, Artificial Sequence
  Synthetic
gggtaatcatacccacaatgagaccatgggggcaaaaataaatagggaagaaataaaaaactgttctttcaatat

SEQ ID NO: 184554 - DNA, 75 bp, Artificial Sequence
  Synthetic
gggtaatcatacccacaatgagaccatggggggaaaaataaatagggaagaaataaaaaactgttctttcaatat

SEQ ID NO: 184555 - DNA, 75 bp, Artificial Sequence
  Synthetic
gggtaatcatacccacaatgagagcatgggggaaaaaataaatagggaagaaataaaaaactgttctttcaatat

SEQ ID NO: 184556 - DNA, 75 bp, Artificial Sequence
  Synthetic
gggtaatcatacccacaatgagagcatgggggtaaaaataaatagggaagaaataaaaaactgttctttcaatat

SEQ ID NO: 184557 - DNA, 75 bp, Artificial Sequence
  Synthetic
gggtaatcatacccacaatgagagcatgggggcaaaaataaatagggaagaaataaaaaactgttctttcaatat

SEQ ID NO: 184558 - DNA, 75 bp, Artificial Sequence
  Synthetic
gggtaatcatacccacaatgagagcatggggggaaaaataaatagggaagaaataaaaaactgttctttcaatat

SEQ ID NO: 184559 - DNA, 75 bp, Artificial Sequence
  Synthetic
gatcaaggaccaactagggagccattcaatgaatgggcactagaaactctagaagaactaaaaacagaagcagta

SEQ ID NO: 184560 - DNA, 75 bp, Artificial Sequence
  Synthetic
gatcaaggaccatctagggagccattcaatgaatgggcactagaaactctagaagaactaaaaacagaagcagta

SEQ ID NO: 184561 - DNA, 75 bp, Artificial Sequence
  Synthetic
gatcaaggaccacctagggagccattcaatgaatgggcactagaaactctagaagaactaaaaacagaagcagta

SEQ ID NO: 184562 - DNA, 75 bp, Artificial Sequence
  Synthetic
gatcaaggaccagctagggagccattcaatgaatgggcactagaaactctagaagaactaaaaacagaagcagta

SEQ ID NO: 184563 - DNA, 75 bp, Artificial Sequence
  Synthetic
ataaatctgtagtaatcaattgtaccagaccctccaacaatacaagaacaagtatacgtataggaccaggacaag

SEQ ID NO: 184564 - DNA, 75 bp, Artificial Sequence
  Synthetic
gtagatcctaacctagagccctggaaccacccgggaagtcagcctacaactccttgtaacaaatgttactgtaaa

SEQ ID NO: 184565 - DNA, 75 bp, Artificial Sequence
  Synthetic
atgaaatatacaggttaattgaaaaatcgcagaaccagcaggaaaagaatgaacaagaattattggcattggaca

SEQ ID NO: 184566 - DNA, 75 bp, Artificial Sequence
  Synthetic
atcgcagaaccagcaggaaaagaatgaacaagaattattggcattggacaaatgggcaagtctgtggaattggtt

SEQ ID NO: 184567 - DNA, 75 bp, Artificial Sequence
  Synthetic
ataaactttcagccaccatcaggaggagatcttgaagttacaacgcatcatcttaatagtagaggggaatttttc

SEQ ID NO: 184568 - DNA, 75 bp, Artificial Sequence
  Synthetic
gatgtaatcagtttatgggatcaaagtctaaagccatgtgtaaagttaacccctctctgcgttactttaaattgt

SEQ ID NO: 184569 - DNA, 75 bp, Artificial Sequence
  Synthetic
acaataatacaagacaaagtataaggataggaccaggacaaacattctatgcaacaggaggcataataggagata

SEQ ID NO: 184570 - DNA, 75 bp, Artificial Sequence
  Synthetic
atcataattccatgcaagataaagcaaattattaacatctggcagcgagcagcacaaccaacgtatgctcctccc

SEQ ID NO: 184571 - DNA, 75 bp, Artificial Sequence
  Synthetic
tttgctaattataaatgtaattctatggatgtatgttcttagacaatgcttagaacacaagaaacaagctagaag

SEQ ID NO: 184572 - DNA, 75 bp, Artificial Sequence
  Synthetic
tttaaattgtgaaaatgcaagggttaagcctgactacaatgatagcacgaatggagaagtacaaaattgcacttt

SEQ ID NO: 184573 - DNA, 75 bp, Artificial Sequence
  Synthetic
ggaaagagaaataattgacagactaagaagaataagagaaattagagatgatagtgactatgagagcaatggaga

SEQ ID NO: 184574 - DNA, 75 bp, Artificial Sequence
  Synthetic
gtagaggtgccaataatggcaccattaatatgaaagaagaaataaaaaactgctctttcaatatgaccacagaag

SEQ ID NO: 184575 - DNA, 75 bp, Artificial Sequence
  Synthetic
gtacaaatgaattgtacagacatagaaaacaaaaacagtagctcagaaaaccctatgaaaaagtgtgagtttaat

SEQ ID NO: 184576 - DNA, 75 bp, Artificial Sequence
  Synthetic
ctggaagcacaagaggaagaggaagtaggctttccagtcagacctcaggtacctttaagaccaatgacttataag

SEQ ID NO: 184577 - DNA, 75 bp, Artificial Sequence
  Synthetic
ataatagaagaagaagtgtaaggataggaccaggacaatcattctatgcatataatgacataataggaaatataa

SEQ ID NO: 184578 - DNA, 75 bp, Artificial Sequence
  Synthetic
aggaccaggacaatcattctatgcatataatgacataataggaaatataagagaagcatattgtatcattaatga

SEQ ID NO: 184579 - DNA, 75 bp, Artificial Sequence
  Synthetic
tacacaagagaaatatacaccttaattgaagaatcgcagaaccaacaagaaaagaatgaactagaattattgaaa

SEQ ID NO: 184580 - DNA, 75 bp, Artificial Sequence
  Synthetic
aagatgtaatcagtctatgggatcaaagcttaaagccatgtgtacaattaactccactatgtgttactttaaact

SEQ ID NO: 184581 - DNA, 75 bp, Artificial Sequence
  Synthetic
aagatgtaatcagtctatgggatcaaagcttaaagccatgtgtacaattaactccactatgtgttactttatact

SEQ ID NO: 184582 - DNA, 75 bp, Artificial Sequence
  Synthetic
aagatgtaatcagtctatgggatcaaagcttaaagccatgtgtacaattaactccactatgtgttactttacact

SEQ ID NO: 184583 - DNA, 75 bp, Artificial Sequence
  Synthetic
aagatgtaatcagtctatgggatcaaagcttaaagccatgtgtacaattaactccactatgtgttactttagact

SEQ ID NO: 184584 - DNA, 75 bp, Artificial Sequence
  Synthetic
aagatgtaatcagtctatgggatcaaagcttaaagccatgtgtacaattaactccactttgtgttactttaaact

SEQ ID NO: 184585 - DNA, 75 bp, Artificial Sequence
  Synthetic
aagatgtaatcagtctatgggatcaaagcttaaagccatgtgtacaattaactccactttgtgttactttatact

SEQ ID NO: 184586 - DNA, 75 bp, Artificial Sequence
  Synthetic
aagatgtaatcagtctatgggatcaaagcttaaagccatgtgtacaattaactccactttgtgttactttacact

SEQ ID NO: 184587 - DNA, 75 bp, Artificial Sequence
  Synthetic
aagatgtaatcagtctatgggatcaaagcttaaagccatgtgtacaattaactccactttgtgttactttagact

SEQ ID NO: 184588 - DNA, 75 bp, Artificial Sequence
  Synthetic
aagatgtaatcagtctatgggatcaaagcttaaagccatgtgtacaattaactccactctgtgttactttaaact

SEQ ID NO: 184589 - DNA, 75 bp, Artificial Sequence
  Synthetic
aagatgtaatcagtctatgggatcaaagcttaaagccatgtgtacaattaactccactctgtgttactttatact

SEQ ID NO: 184590 - DNA, 75 bp, Artificial Sequence
  Synthetic
aagatgtaatcagtctatgggatcaaagcttaaagccatgtgtacaattaactccactctgtgttactttacact

SEQ ID NO: 184591 - DNA, 75 bp, Artificial Sequence
  Synthetic
aagatgtaatcagtctatgggatcaaagcttaaagccatgtgtacaattaactccactctgtgttactttagact

SEQ ID NO: 184592 - DNA, 75 bp, Artificial Sequence
  Synthetic
aagatgtaatcagtctatgggatcaaagcttaaagccatgtgtacaattaactccactgtgtgttactttaaact

SEQ ID NO: 184593 - DNA, 75 bp, Artificial Sequence
  Synthetic
aagatgtaatcagtctatgggatcaaagcttaaagccatgtgtacaattaactccactgtgtgttactttatact

SEQ ID NO: 184594 - DNA, 75 bp, Artificial Sequence
  Synthetic
aagatgtaatcagtctatgggatcaaagcttaaagccatgtgtacaattaactccactgtgtgttactttacact

SEQ ID NO: 184595 - DNA, 75 bp, Artificial Sequence
  Synthetic
aagatgtaatcagtctatgggatcaaagcttaaagccatgtgtacaattaactccactgtgtgttactttagact

SEQ ID NO: 184596 - DNA, 75 bp, Artificial Sequence
  Synthetic
aagatgtaatcagtctatgggatcaaagcttaaagccatgtgtactattaactccactatgtgttactttaaact

SEQ ID NO: 184597 - DNA, 75 bp, Artificial Sequence
  Synthetic
aagatgtaatcagtctatgggatcaaagcttaaagccatgtgtactattaactccactatgtgttactttatact

SEQ ID NO: 184598 - DNA, 75 bp, Artificial Sequence
  Synthetic
aagatgtaatcagtctatgggatcaaagcttaaagccatgtgtactattaactccactatgtgttactttacact

SEQ ID NO: 184599 - DNA, 75 bp, Artificial Sequence
  Synthetic
aagatgtaatcagtctatgggatcaaagcttaaagccatgtgtactattaactccactatgtgttactttagact

SEQ ID NO: 184600 - DNA, 75 bp, Artificial Sequence
  Synthetic
aagatgtaatcagtctatgggatcaaagcttaaagccatgtgtactattaactccactttgtgttactttaaact

SEQ ID NO: 184601 - DNA, 75 bp, Artificial Sequence
  Synthetic
aagatgtaatcagtctatgggatcaaagcttaaagccatgtgtactattaactccactttgtgttactttatact

SEQ ID NO: 184602 - DNA, 75 bp, Artificial Sequence
  Synthetic
aagatgtaatcagtctatgggatcaaagcttaaagccatgtgtactattaactccactttgtgttactttacact

SEQ ID NO: 184603 - DNA, 75 bp, Artificial Sequence
  Synthetic
aagatgtaatcagtctatgggatcaaagcttaaagccatgtgtactattaactccactttgtgttactttagact

SEQ ID NO: 184604 - DNA, 75 bp, Artificial Sequence
  Synthetic
aagatgtaatcagtctatgggatcaaagcttaaagccatgtgtactattaactccactctgtgttactttaaact

SEQ ID NO: 184605 - DNA, 75 bp, Artificial Sequence
  Synthetic
aagatgtaatcagtctatgggatcaaagcttaaagccatgtgtactattaactccactctgtgttactttatact

SEQ ID NO: 184606 - DNA, 75 bp, Artificial Sequence
  Synthetic
aagatgtaatcagtctatgggatcaaagcttaaagccatgtgtactattaactccactctgtgttactttacact

SEQ ID NO: 184607 - DNA, 75 bp, Artificial Sequence
  Synthetic
aagatgtaatcagtctatgggatcaaagcttaaagccatgtgtactattaactccactctgtgttactttagact

SEQ ID NO: 184608 - DNA, 75 bp, Artificial Sequence
  Synthetic
aagatgtaatcagtctatgggatcaaagcttaaagccatgtgtactattaactccactgtgtgttactttaaact

SEQ ID NO: 184609 - DNA, 75 bp, Artificial Sequence
  Synthetic
aagatgtaatcagtctatgggatcaaagcttaaagccatgtgtactattaactccactgtgtgttactttatact

SEQ ID NO: 184610 - DNA, 75 bp, Artificial Sequence
  Synthetic
aagatgtaatcagtctatgggatcaaagcttaaagccatgtgtactattaactccactgtgtgttactttacact

SEQ ID NO: 184611 - DNA, 75 bp, Artificial Sequence
  Synthetic
aagatgtaatcagtctatgggatcaaagcttaaagccatgtgtactattaactccactgtgtgttactttagact

SEQ ID NO: 184612 - DNA, 75 bp, Artificial Sequence
  Synthetic
aagatgtaatcagtctatgggatcaaagcttaaagccatgtgtaccattaactccactatgtgttactttaaact

SEQ ID NO: 184613 - DNA, 75 bp, Artificial Sequence
  Synthetic
aagatgtaatcagtctatgggatcaaagcttaaagccatgtgtaccattaactccactatgtgttactttatact

SEQ ID NO: 184614 - DNA, 75 bp, Artificial Sequence
  Synthetic
aagatgtaatcagtctatgggatcaaagcttaaagccatgtgtaccattaactccactatgtgttactttacact

SEQ ID NO: 184615 - DNA, 75 bp, Artificial Sequence
  Synthetic
aagatgtaatcagtctatgggatcaaagcttaaagccatgtgtaccattaactccactatgtgttactttagact

SEQ ID NO: 184616 - DNA, 75 bp, Artificial Sequence
  Synthetic
aagatgtaatcagtctatgggatcaaagcttaaagccatgtgtaccattaactccactttgtgttactttaaact

SEQ ID NO: 184617 - DNA, 75 bp, Artificial Sequence
  Synthetic
aagatgtaatcagtctatgggatcaaagcttaaagccatgtgtaccattaactccactttgtgttactttatact

SEQ ID NO: 184618 - DNA, 75 bp, Artificial Sequence
  Synthetic
aagatgtaatcagtctatgggatcaaagcttaaagccatgtgtaccattaactccactttgtgttactttacact

SEQ ID NO: 184619 - DNA, 75 bp, Artificial Sequence
  Synthetic
aagatgtaatcagtctatgggatcaaagcttaaagccatgtgtaccattaactccactttgtgttactttagact

SEQ ID NO: 184620 - DNA, 75 bp, Artificial Sequence
  Synthetic
aagatgtaatcagtctatgggatcaaagcttaaagccatgtgtaccattaactccactctgtgttactttaaact

SEQ ID NO: 184621 - DNA, 75 bp, Artificial Sequence
  Synthetic
aagatgtaatcagtctatgggatcaaagcttaaagccatgtgtaccattaactccactctgtgttactttatact

SEQ ID NO: 184622 - DNA, 75 bp, Artificial Sequence
  Synthetic
aagatgtaatcagtctatgggatcaaagcttaaagccatgtgtaccattaactccactctgtgttactttacact

SEQ ID NO: 184623 - DNA, 75 bp, Artificial Sequence
  Synthetic
aagatgtaatcagtctatgggatcaaagcttaaagccatgtgtaccattaactccactctgtgttactttagact

SEQ ID NO: 184624 - DNA, 75 bp, Artificial Sequence
  Synthetic
aagatgtaatcagtctatgggatcaaagcttaaagccatgtgtaccattaactccactgtgtgttactttaaact

SEQ ID NO: 184625 - DNA, 75 bp, Artificial Sequence
  Synthetic
aagatgtaatcagtctatgggatcaaagcttaaagccatgtgtaccattaactccactgtgtgttactttatact

SEQ ID NO: 184626 - DNA, 75 bp, Artificial Sequence
  Synthetic
aagatgtaatcagtctatgggatcaaagcttaaagccatgtgtaccattaactccactgtgtgttactttacact

SEQ ID NO: 184627 - DNA, 75 bp, Artificial Sequence
  Synthetic
aagatgtaatcagtctatgggatcaaagcttaaagccatgtgtaccattaactccactgtgtgttactttagact

SEQ ID NO: 184628 - DNA, 75 bp, Artificial Sequence
  Synthetic
aagatgtaatcagtctatgggatcaaagcttaaagccatgtgtacgattaactccactatgtgttactttaaact

SEQ ID NO: 184629 - DNA, 75 bp, Artificial Sequence
  Synthetic
aagatgtaatcagtctatgggatcaaagcttaaagccatgtgtacgattaactccactatgtgttactttatact

SEQ ID NO: 184630 - DNA, 75 bp, Artificial Sequence
  Synthetic
aagatgtaatcagtctatgggatcaaagcttaaagccatgtgtacgattaactccactatgtgttactttacact

SEQ ID NO: 184631 - DNA, 75 bp, Artificial Sequence
  Synthetic
aagatgtaatcagtctatgggatcaaagcttaaagccatgtgtacgattaactccactatgtgttactttagact

SEQ ID NO: 184632 - DNA, 75 bp, Artificial Sequence
  Synthetic
aagatgtaatcagtctatgggatcaaagcttaaagccatgtgtacgattaactccactttgtgttactttaaact

SEQ ID NO: 184633 - DNA, 75 bp, Artificial Sequence
  Synthetic
aagatgtaatcagtctatgggatcaaagcttaaagccatgtgtacgattaactccactttgtgttactttatact

SEQ ID NO: 184634 - DNA, 75 bp, Artificial Sequence
  Synthetic
aagatgtaatcagtctatgggatcaaagcttaaagccatgtgtacgattaactccactttgtgttactttacact

SEQ ID NO: 184635 - DNA, 75 bp, Artificial Sequence
  Synthetic
aagatgtaatcagtctatgggatcaaagcttaaagccatgtgtacgattaactccactttgtgttactttagact

SEQ ID NO: 184636 - DNA, 75 bp, Artificial Sequence
  Synthetic
aagatgtaatcagtctatgggatcaaagcttaaagccatgtgtacgattaactccactctgtgttactttaaact

SEQ ID NO: 184637 - DNA, 75 bp, Artificial Sequence
  Synthetic
aagatgtaatcagtctatgggatcaaagcttaaagccatgtgtacgattaactccactctgtgttactttatact

SEQ ID NO: 184638 - DNA, 75 bp, Artificial Sequence
  Synthetic
aagatgtaatcagtctatgggatcaaagcttaaagccatgtgtacgattaactccactctgtgttactttacact

SEQ ID NO: 184639 - DNA, 75 bp, Artificial Sequence
  Synthetic
aagatgtaatcagtctatgggatcaaagcttaaagccatgtgtacgattaactccactctgtgttactttagact

SEQ ID NO: 184640 - DNA, 75 bp, Artificial Sequence
  Synthetic
aagatgtaatcagtctatgggatcaaagcttaaagccatgtgtacgattaactccactgtgtgttactttaaact

SEQ ID NO: 184641 - DNA, 75 bp, Artificial Sequence
  Synthetic
aagatgtaatcagtctatgggatcaaagcttaaagccatgtgtacgattaactccactgtgtgttactttatact

SEQ ID NO: 184642 - DNA, 75 bp, Artificial Sequence
  Synthetic
aagatgtaatcagtctatgggatcaaagcttaaagccatgtgtacgattaactccactgtgtgttactttacact

SEQ ID NO: 184643 - DNA, 75 bp, Artificial Sequence
  Synthetic
aagatgtaatcagtctatgggatcaaagcttaaagccatgtgtacgattaactccactgtgtgttactttagact

SEQ ID NO: 184644 - DNA, 75 bp, Artificial Sequence
  Synthetic
atctgcaccactaatgtgccttggaactctagttggagtaataaaacttatgaaagaatttggaataacatgacc

SEQ ID NO: 184645 - DNA, 75 bp, Artificial Sequence
  Synthetic
tgctactatgaccaatactaatattagtggggaaatagataaaggagaaataaaaaactgttctttcaatatcac

SEQ ID NO: 184646 - DNA, 75 bp, Artificial Sequence
  Synthetic
tgctactatgaccaatactattattagtggggaaatagataaaggagaaataaaaaactgttctttcaatatcac

SEQ ID NO: 184647 - DNA, 75 bp, Artificial Sequence
  Synthetic
tgctactatgaccaatactactattagtggggaaatagataaaggagaaataaaaaactgttctttcaatatcac

SEQ ID NO: 184648 - DNA, 75 bp, Artificial Sequence
  Synthetic
tgctactatgaccaatactagtattagtggggaaatagataaaggagaaataaaaaactgttctttcaatatcac

SEQ ID NO: 184649 - DNA, 75 bp, Artificial Sequence
  Synthetic
caactgatattaaatgggacactctcaaaagaaaaaataagaattatgggacaaaatatttcggccactgcacaa

SEQ ID NO: 184650 - DNA, 75 bp, Artificial Sequence
  Synthetic
aggaaaggtgtacatataggaccgggacaaacatggtatgcaacaggtgatataataggagatataagactagca

SEQ ID NO: 184651 - DNA, 75 bp, Artificial Sequence
  Synthetic
gtggagttggtttagcataacaaactggctgtggtatataaaaatattcataatgatagtaggaggcttgatagg

SEQ ID NO: 184652 - DNA, 75 bp, Artificial Sequence
  Synthetic
gcatggccataagtggaacaaacagctcaagggtagcctattgccagtataacaccactgagtgggaaaaagcct

SEQ ID NO: 184653 - DNA, 75 bp, Artificial Sequence
  Synthetic
tagtaaaattatggtaccagttagagaaagaacccatagtaggagcagaaactttctatgtagatggggcagcta

SEQ ID NO: 184654 - DNA, 75 bp, Artificial Sequence
  Synthetic
ccatttgcattttaactgtcatggagagttcttctattgtaacacatctgggatgtttaattatacctttttatg

SEQ ID NO: 184655 - DNA, 75 bp, Artificial Sequence
  Synthetic
tgtgtgagaccccacaacaatacaaggaaaagtatacacataggaccagggagagcatggtatgcaacaggagaa

SEQ ID NO: 184656 - DNA, 75 bp, Artificial Sequence
  Synthetic
tgtgtgagaccccacaacaatacaaggaaaagtatacacataggaccagggagagcatggtatgcaacaggagat

SEQ ID NO: 184657 - DNA, 75 bp, Artificial Sequence
  Synthetic
tgtgtgagaccccacaacaatacaaggaaaagtatacacataggaccagggagagcatggtatgcaacaggagac

SEQ ID NO: 184658 - DNA, 75 bp, Artificial Sequence
  Synthetic
tgtgtgagaccccacaacaatacaaggaaaagtatacacataggaccagggagagcatggtatgcaacaggagag

SEQ ID NO: 184659 - DNA, 75 bp, Artificial Sequence
  Synthetic
tgtgtgagaccccacaacaatacaaggaaaagtatactcataggaccagggagagcatggtatgcaacaggagaa

SEQ ID NO: 184660 - DNA, 75 bp, Artificial Sequence
  Synthetic
tgtgtgagaccccacaacaatacaaggaaaagtatactcataggaccagggagagcatggtatgcaacaggagat

SEQ ID NO: 184661 - DNA, 75 bp, Artificial Sequence
  Synthetic
tgtgtgagaccccacaacaatacaaggaaaagtatactcataggaccagggagagcatggtatgcaacaggagac

SEQ ID NO: 184662 - DNA, 75 bp, Artificial Sequence
  Synthetic
tgtgtgagaccccacaacaatacaaggaaaagtatactcataggaccagggagagcatggtatgcaacaggagag

SEQ ID NO: 184663 - DNA, 75 bp, Artificial Sequence
  Synthetic
tgtgtgagaccccacaacaatacaaggaaaagtatacccataggaccagggagagcatggtatgcaacaggagaa

SEQ ID NO: 184664 - DNA, 75 bp, Artificial Sequence
  Synthetic
tgtgtgagaccccacaacaatacaaggaaaagtatacccataggaccagggagagcatggtatgcaacaggagat

SEQ ID NO: 184665 - DNA, 75 bp, Artificial Sequence
  Synthetic
tgtgtgagaccccacaacaatacaaggaaaagtatacccataggaccagggagagcatggtatgcaacaggagac

SEQ ID NO: 184666 - DNA, 75 bp, Artificial Sequence
  Synthetic
tgtgtgagaccccacaacaatacaaggaaaagtatacccataggaccagggagagcatggtatgcaacaggagag

SEQ ID NO: 184667 - DNA, 75 bp, Artificial Sequence
  Synthetic
tgtgtgagaccccacaacaatacaaggaaaagtatacgcataggaccagggagagcatggtatgcaacaggagaa

SEQ ID NO: 184668 - DNA, 75 bp, Artificial Sequence
  Synthetic
tgtgtgagaccccacaacaatacaaggaaaagtatacgcataggaccagggagagcatggtatgcaacaggagat

SEQ ID NO: 184669 - DNA, 75 bp, Artificial Sequence
  Synthetic
tgtgtgagaccccacaacaatacaaggaaaagtatacgcataggaccagggagagcatggtatgcaacaggagac

SEQ ID NO: 184670 - DNA, 75 bp, Artificial Sequence
  Synthetic
tgtgtgagaccccacaacaatacaaggaaaagtatacgcataggaccagggagagcatggtatgcaacaggagag

SEQ ID NO: 184671 - DNA, 75 bp, Artificial Sequence
  Synthetic
taccttgcaagttgaaacaggtggtaagatcatggatgaggggagggtcgggactctatgcacctcccatcccag

SEQ ID NO: 184672 - DNA, 75 bp, Artificial Sequence
  Synthetic
aatactagctataggttgataagttgtaacacctcagtcattacacaggcctgtccaaaggtatcctttgagcca

SEQ ID NO: 184673 - DNA, 75 bp, Artificial Sequence
  Synthetic
aatgaaaaggatttattagcattggacagttggaaaaatctgtggagttggtttgacataacaaattggctgtgg

SEQ ID NO: 184674 - DNA, 75 bp, Artificial Sequence
  Synthetic
cctagcaatagctgtgtggactatagtaggtatagaatataagaaaataagaaaacaaagaaaaatagataggtt

SEQ ID NO: 184675 - DNA, 75 bp, Artificial Sequence
  Synthetic
cagctttgcaatagaatggggggcaaatggtcaaaacgtagtcaagggggatggcctgctataagagaaaggatg

SEQ ID NO: 184676 - DNA, 75 bp, Artificial Sequence
  Synthetic
aatttccttcagaacaggccagagccaacagccccgccagcagagagcttcgggttcggagaggagataacccct

SEQ ID NO: 184677 - DNA, 75 bp, Artificial Sequence
  Synthetic
tatagaccaaatttggggaaacttaacatggcaggaatgggatcagcagatagacaacgtaagtgccaccatata

SEQ ID NO: 184678 - DNA, 75 bp, Artificial Sequence
  Synthetic
tatagaccaaatttggggaaacttaacatggcaggaatgggatcagcagatagacaacgtaagtgcctccatata

SEQ ID NO: 184679 - DNA, 75 bp, Artificial Sequence
  Synthetic
tatagaccaaatttggggaaacttaacatggcaggaatgggatcagcagatagacaacgtaagtgcccccatata

SEQ ID NO: 184680 - DNA, 75 bp, Artificial Sequence
  Synthetic
tatagaccaaatttggggaaacttaacatggcaggaatgggatcagcagatagacaacgtaagtgccgccatata

SEQ ID NO: 184681 - DNA, 75 bp, Artificial Sequence
  Synthetic
atagaggtaaaagacaccaaggaagctttagataaaatggaagaagcacaaaataaaggtcagcaaaagacacag

SEQ ID NO: 184682 - DNA, 75 bp, Artificial Sequence
  Synthetic
atagaggtaaaagacaccaaggaagcttttgataaaatggaagaagcacaaaataaaggtcagcaaaagacacag

SEQ ID NO: 184683 - DNA, 75 bp, Artificial Sequence
  Synthetic
atagaggtaaaagacaccaaggaagctttcgataaaatggaagaagcacaaaataaaggtcagcaaaagacacag

SEQ ID NO: 184684 - DNA, 75 bp, Artificial Sequence
  Synthetic
atagaggtaaaagacaccaaggaagctttggataaaatggaagaagcacaaaataaaggtcagcaaaagacacag

SEQ ID NO: 184685 - DNA, 75 bp, Artificial Sequence
  Synthetic
agtgcaaaatgcacaagggcaaatggtacatcagcctatatcacctagaactttgaatgcatgggtgaaagtagt

SEQ ID NO: 184686 - DNA, 75 bp, Artificial Sequence
  Synthetic
aaactgctctttcaatatgaccacagaactaagggataagagacagaaagtatattcacttttttatagacttga

SEQ ID NO: 184687 - DNA, 75 bp, Artificial Sequence
  Synthetic
attagtcctattgaaactgtaccagtaaaattgaagccaggaatggatggcccaaaggttaaacaatggccattg

SEQ ID NO: 184688 - DNA, 75 bp, Artificial Sequence
  Synthetic
tcaggacaataaccttgtggagttaccacctcttgagcaacttaatatcagggatacagacggtgatcagccatc

SEQ ID NO: 184689 - DNA, 75 bp, Artificial Sequence
  Synthetic
tcaggacaataaccttgtggagttaccacctcttgagcaacttaatatcagggattcagacggtgatcagccatc

SEQ ID NO: 184690 - DNA, 75 bp, Artificial Sequence
  Synthetic
tcaggacaataaccttgtggagttaccacctcttgagcaacttaatatcagggatccagacggtgatcagccatc

SEQ ID NO: 184691 - DNA, 75 bp, Artificial Sequence
  Synthetic
tcaggacaataaccttgtggagttaccacctcttgagcaacttaatatcagggatgcagacggtgatcagccatc

SEQ ID NO: 184692 - DNA, 75 bp, Artificial Sequence
  Synthetic
tcacagtatgcattaggaatcattcaagcacaaccagataaaagtgaatcagagttagtcaatcaaataatagag

SEQ ID NO: 184693 - DNA, 75 bp, Artificial Sequence
  Synthetic
gtttttgctgtgctttctatagtaaacagagttaggcaggggtactcaccattatcattgcagacccacctccca

SEQ ID NO: 184694 - DNA, 75 bp, Artificial Sequence
  Synthetic
gtttttgctgtgctttctatagtaaacagagttaggcaggggtactcaccattatctttgcagacccacctccca

SEQ ID NO: 184695 - DNA, 75 bp, Artificial Sequence
  Synthetic
gtttttgctgtgctttctatagtaaacagagttaggcaggggtactcaccattatccttgcagacccacctccca

SEQ ID NO: 184696 - DNA, 75 bp, Artificial Sequence
  Synthetic
gtttttgctgtgctttctatagtaaacagagttaggcaggggtactcaccattatcgttgcagacccacctccca

SEQ ID NO: 184697 - DNA, 75 bp, Artificial Sequence
  Synthetic
gtttttgctgtgctttctatagtaaacagagttaggcaggggtactcaccattttcattgcagacccacctccca

SEQ ID NO: 184698 - DNA, 75 bp, Artificial Sequence
  Synthetic
gtttttgctgtgctttctatagtaaacagagttaggcaggggtactcaccattttctttgcagacccacctccca

SEQ ID NO: 184699 - DNA, 75 bp, Artificial Sequence
  Synthetic
gtttttgctgtgctttctatagtaaacagagttaggcaggggtactcaccattttccttgcagacccacctccca

SEQ ID NO: 184700 - DNA, 75 bp, Artificial Sequence
  Synthetic
gtttttgctgtgctttctatagtaaacagagttaggcaggggtactcaccattttcgttgcagacccacctccca

SEQ ID NO: 184701 - DNA, 75 bp, Artificial Sequence
  Synthetic
gtttttgctgtgctttctatagtaaacagagttaggcaggggtactcaccattctcattgcagacccacctccca

SEQ ID NO: 184702 - DNA, 75 bp, Artificial Sequence
  Synthetic
gtttttgctgtgctttctatagtaaacagagttaggcaggggtactcaccattctctttgcagacccacctccca

SEQ ID NO: 184703 - DNA, 75 bp, Artificial Sequence
  Synthetic
gtttttgctgtgctttctatagtaaacagagttaggcaggggtactcaccattctccttgcagacccacctccca

SEQ ID NO: 184704 - DNA, 75 bp, Artificial Sequence
  Synthetic
gtttttgctgtgctttctatagtaaacagagttaggcaggggtactcaccattctcgttgcagacccacctccca

SEQ ID NO: 184705 - DNA, 75 bp, Artificial Sequence
  Synthetic
gtttttgctgtgctttctatagtaaacagagttaggcaggggtactcaccattgtcattgcagacccacctccca

SEQ ID NO: 184706 - DNA, 75 bp, Artificial Sequence
  Synthetic
gtttttgctgtgctttctatagtaaacagagttaggcaggggtactcaccattgtctttgcagacccacctccca

SEQ ID NO: 184707 - DNA, 75 bp, Artificial Sequence
  Synthetic
gtttttgctgtgctttctatagtaaacagagttaggcaggggtactcaccattgtccttgcagacccacctccca

SEQ ID NO: 184708 - DNA, 75 bp, Artificial Sequence
  Synthetic
gtttttgctgtgctttctatagtaaacagagttaggcaggggtactcaccattgtcgttgcagacccacctccca

SEQ ID NO: 184709 - DNA, 75 bp, Artificial Sequence
  Synthetic
tactagcctactagatacctgtgcagtagcagttgctaattggactgacggcataatcttagggatacaaaggct

SEQ ID NO: 184710 - DNA, 75 bp, Artificial Sequence
  Synthetic
tactagcctactagatacctgtgcagtagcagttgctaattggactgacggcataatcttagggttacaaaggct

SEQ ID NO: 184711 - DNA, 75 bp, Artificial Sequence
  Synthetic
tactagcctactagatacctgtgcagtagcagttgctaattggactgacggcataatcttagggctacaaaggct

SEQ ID NO: 184712 - DNA, 75 bp, Artificial Sequence
  Synthetic
tactagcctactagatacctgtgcagtagcagttgctaattggactgacggcataatcttaggggtacaaaggct

SEQ ID NO: 184713 - DNA, 75 bp, Artificial Sequence
  Synthetic
gacagatagggttatagaactaatacaaagggctttcagagctatcctccacgtacctagaagaatcagacaagg

SEQ ID NO: 184714 - DNA, 75 bp, Artificial Sequence
  Synthetic
cgaagaataagacagggcttggaaagaagtttattgtaacatgggaaacgtattggggaaagataaatttaaagg

SEQ ID NO: 184715 - DNA, 75 bp, Artificial Sequence
  Synthetic
aaaaagtatacgtataggaccaggacaagcattctatgcaacaggtgacataataggggatataagacaagcaca

SEQ ID NO: 184716 - DNA, 75 bp, Artificial Sequence
  Synthetic
ggcaagtcagatttatgcagggattaaagtaaagcaattatgtaaactcctcagaggagccaaagcactaacaga

SEQ ID NO: 184717 - DNA, 75 bp, Artificial Sequence
  Synthetic
aagcagtacaaagagctttaagaagaataagacagggcttggaaaggctttagctatagaatgggtggcaagtgg

SEQ ID NO: 184718 - DNA, 75 bp, Artificial Sequence
  Synthetic
aagcagtacaaagagctttaagaagaataagacagggcttggaaaggctttagctatagtatgggtggcaagtgg

SEQ ID NO: 184719 - DNA, 75 bp, Artificial Sequence
  Synthetic
aagcagtacaaagagctttaagaagaataagacagggcttggaaaggctttagctatagcatgggtggcaagtgg

SEQ ID NO: 184720 - DNA, 75 bp, Artificial Sequence
  Synthetic
aagcagtacaaagagctttaagaagaataagacagggcttggaaaggctttagctataggatgggtggcaagtgg

SEQ ID NO: 184721 - DNA, 75 bp, Artificial Sequence
  Synthetic
aagcagtacaaagagctttaagaagaataagacagggcttggaaaggctttagctttagaatgggtggcaagtgg

SEQ ID NO: 184722 - DNA, 75 bp, Artificial Sequence
  Synthetic
aagcagtacaaagagctttaagaagaataagacagggcttggaaaggctttagctttagtatgggtggcaagtgg

SEQ ID NO: 184723 - DNA, 75 bp, Artificial Sequence
  Synthetic
aagcagtacaaagagctttaagaagaataagacagggcttggaaaggctttagctttagcatgggtggcaagtgg

SEQ ID NO: 184724 - DNA, 75 bp, Artificial Sequence
  Synthetic
aagcagtacaaagagctttaagaagaataagacagggcttggaaaggctttagctttaggatgggtggcaagtgg

SEQ ID NO: 184725 - DNA, 75 bp, Artificial Sequence
  Synthetic
aagcagtacaaagagctttaagaagaataagacagggcttggaaaggctttagctctagaatgggtggcaagtgg

SEQ ID NO: 184726 - DNA, 75 bp, Artificial Sequence
  Synthetic
aagcagtacaaagagctttaagaagaataagacagggcttggaaaggctttagctctagtatgggtggcaagtgg

SEQ ID NO: 184727 - DNA, 75 bp, Artificial Sequence
  Synthetic
aagcagtacaaagagctttaagaagaataagacagggcttggaaaggctttagctctagcatgggtggcaagtgg

SEQ ID NO: 184728 - DNA, 75 bp, Artificial Sequence
  Synthetic
aagcagtacaaagagctttaagaagaataagacagggcttggaaaggctttagctctaggatgggtggcaagtgg

SEQ ID NO: 184729 - DNA, 75 bp, Artificial Sequence
  Synthetic
aagcagtacaaagagctttaagaagaataagacagggcttggaaaggctttagctgtagaatgggtggcaagtgg

SEQ ID NO: 184730 - DNA, 75 bp, Artificial Sequence
  Synthetic
aagcagtacaaagagctttaagaagaataagacagggcttggaaaggctttagctgtagtatgggtggcaagtgg

SEQ ID NO: 184731 - DNA, 75 bp, Artificial Sequence
  Synthetic
aagcagtacaaagagctttaagaagaataagacagggcttggaaaggctttagctgtagcatgggtggcaagtgg

SEQ ID NO: 184732 - DNA, 75 bp, Artificial Sequence
  Synthetic
aagcagtacaaagagctttaagaagaataagacagggcttggaaaggctttagctgtaggatgggtggcaagtgg

SEQ ID NO: 184733 - DNA, 75 bp, Artificial Sequence
  Synthetic
aagcagtacaaagagctttaagaagaataagacagggcttggaaaggcttttgctatagaatgggtggcaagtgg

SEQ ID NO: 184734 - DNA, 75 bp, Artificial Sequence
  Synthetic
aagcagtacaaagagctttaagaagaataagacagggcttggaaaggcttttgctatagtatgggtggcaagtgg

SEQ ID NO: 184735 - DNA, 75 bp, Artificial Sequence
  Synthetic
aagcagtacaaagagctttaagaagaataagacagggcttggaaaggcttttgctatagcatgggtggcaagtgg

SEQ ID NO: 184736 - DNA, 75 bp, Artificial Sequence
  Synthetic
aagcagtacaaagagctttaagaagaataagacagggcttggaaaggcttttgctataggatgggtggcaagtgg

SEQ ID NO: 184737 - DNA, 75 bp, Artificial Sequence
  Synthetic
aagcagtacaaagagctttaagaagaataagacagggcttggaaaggcttttgctttagaatgggtggcaagtgg

SEQ ID NO: 184738 - DNA, 75 bp, Artificial Sequence
  Synthetic
aagcagtacaaagagctttaagaagaataagacagggcttggaaaggcttttgctttagtatgggtggcaagtgg

SEQ ID NO: 184739 - DNA, 75 bp, Artificial Sequence
  Synthetic
aagcagtacaaagagctttaagaagaataagacagggcttggaaaggcttttgctttagcatgggtggcaagtgg

SEQ ID NO: 184740 - DNA, 75 bp, Artificial Sequence
  Synthetic
aagcagtacaaagagctttaagaagaataagacagggcttggaaaggcttttgctttaggatgggtggcaagtgg

SEQ ID NO: 184741 - DNA, 75 bp, Artificial Sequence
  Synthetic
aagcagtacaaagagctttaagaagaataagacagggcttggaaaggcttttgctctagaatgggtggcaagtgg

SEQ ID NO: 184742 - DNA, 75 bp, Artificial Sequence
  Synthetic
aagcagtacaaagagctttaagaagaataagacagggcttggaaaggcttttgctctagtatgggtggcaagtgg

SEQ ID NO: 184743 - DNA, 75 bp, Artificial Sequence
  Synthetic
aagcagtacaaagagctttaagaagaataagacagggcttggaaaggcttttgctctagcatgggtggcaagtgg

SEQ ID NO: 184744 - DNA, 75 bp, Artificial Sequence
  Synthetic
aagcagtacaaagagctttaagaagaataagacagggcttggaaaggcttttgctctaggatgggtggcaagtgg

SEQ ID NO: 184745 - DNA, 75 bp, Artificial Sequence
  Synthetic
aagcagtacaaagagctttaagaagaataagacagggcttggaaaggcttttgctgtagaatgggtggcaagtgg

SEQ ID NO: 184746 - DNA, 75 bp, Artificial Sequence
  Synthetic
aagcagtacaaagagctttaagaagaataagacagggcttggaaaggcttttgctgtagtatgggtggcaagtgg

SEQ ID NO: 184747 - DNA, 75 bp, Artificial Sequence
  Synthetic
aagcagtacaaagagctttaagaagaataagacagggcttggaaaggcttttgctgtagcatgggtggcaagtgg

SEQ ID NO: 184748 - DNA, 75 bp, Artificial Sequence
  Synthetic
aagcagtacaaagagctttaagaagaataagacagggcttggaaaggcttttgctgtaggatgggtggcaagtgg

SEQ ID NO: 184749 - DNA, 75 bp, Artificial Sequence
  Synthetic
aagcagtacaaagagctttaagaagaataagacagggcttggaaaggctttcgctatagaatgggtggcaagtgg

SEQ ID NO: 184750 - DNA, 75 bp, Artificial Sequence
  Synthetic
aagcagtacaaagagctttaagaagaataagacagggcttggaaaggctttcgctatagtatgggtggcaagtgg

SEQ ID NO: 184751 - DNA, 75 bp, Artificial Sequence
  Synthetic
aagcagtacaaagagctttaagaagaataagacagggcttggaaaggctttcgctatagcatgggtggcaagtgg

SEQ ID NO: 184752 - DNA, 75 bp, Artificial Sequence
  Synthetic
aagcagtacaaagagctttaagaagaataagacagggcttggaaaggctttcgctataggatgggtggcaagtgg

SEQ ID NO: 184753 - DNA, 75 bp, Artificial Sequence
  Synthetic
aagcagtacaaagagctttaagaagaataagacagggcttggaaaggctttcgctttagaatgggtggcaagtgg

SEQ ID NO: 184754 - DNA, 75 bp, Artificial Sequence
  Synthetic
aagcagtacaaagagctttaagaagaataagacagggcttggaaaggctttcgctttagtatgggtggcaagtgg

SEQ ID NO: 184755 - DNA, 75 bp, Artificial Sequence
  Synthetic
aagcagtacaaagagctttaagaagaataagacagggcttggaaaggctttcgctttagcatgggtggcaagtgg

SEQ ID NO: 184756 - DNA, 75 bp, Artificial Sequence
  Synthetic
aagcagtacaaagagctttaagaagaataagacagggcttggaaaggctttcgctttaggatgggtggcaagtgg

SEQ ID NO: 184757 - DNA, 75 bp, Artificial Sequence
  Synthetic
aagcagtacaaagagctttaagaagaataagacagggcttggaaaggctttcgctctagaatgggtggcaagtgg

SEQ ID NO: 184758 - DNA, 75 bp, Artificial Sequence
  Synthetic
aagcagtacaaagagctttaagaagaataagacagggcttggaaaggctttcgctctagtatgggtggcaagtgg

SEQ ID NO: 184759 - DNA, 75 bp, Artificial Sequence
  Synthetic
aagcagtacaaagagctttaagaagaataagacagggcttggaaaggctttcgctctagcatgggtggcaagtgg

SEQ ID NO: 184760 - DNA, 75 bp, Artificial Sequence
  Synthetic
aagcagtacaaagagctttaagaagaataagacagggcttggaaaggctttcgctctaggatgggtggcaagtgg

SEQ ID NO: 184761 - DNA, 75 bp, Artificial Sequence
  Synthetic
aagcagtacaaagagctttaagaagaataagacagggcttggaaaggctttcgctgtagaatgggtggcaagtgg

SEQ ID NO: 184762 - DNA, 75 bp, Artificial Sequence
  Synthetic
aagcagtacaaagagctttaagaagaataagacagggcttggaaaggctttcgctgtagtatgggtggcaagtgg

SEQ ID NO: 184763 - DNA, 75 bp, Artificial Sequence
  Synthetic
aagcagtacaaagagctttaagaagaataagacagggcttggaaaggctttcgctgtagcatgggtggcaagtgg

SEQ ID NO: 184764 - DNA, 75 bp, Artificial Sequence
  Synthetic
aagcagtacaaagagctttaagaagaataagacagggcttggaaaggctttcgctgtaggatgggtggcaagtgg

SEQ ID NO: 184765 - DNA, 75 bp, Artificial Sequence
  Synthetic
aagcagtacaaagagctttaagaagaataagacagggcttggaaaggctttggctatagaatgggtggcaagtgg

SEQ ID NO: 184766 - DNA, 75 bp, Artificial Sequence
  Synthetic
aagcagtacaaagagctttaagaagaataagacagggcttggaaaggctttggctatagtatgggtggcaagtgg

SEQ ID NO: 184767 - DNA, 75 bp, Artificial Sequence
  Synthetic
aagcagtacaaagagctttaagaagaataagacagggcttggaaaggctttggctatagcatgggtggcaagtgg

SEQ ID NO: 184768 - DNA, 75 bp, Artificial Sequence
  Synthetic
aagcagtacaaagagctttaagaagaataagacagggcttggaaaggctttggctataggatgggtggcaagtgg

SEQ ID NO: 184769 - DNA, 75 bp, Artificial Sequence
  Synthetic
aagcagtacaaagagctttaagaagaataagacagggcttggaaaggctttggctttagaatgggtggcaagtgg

SEQ ID NO: 184770 - DNA, 75 bp, Artificial Sequence
  Synthetic
aagcagtacaaagagctttaagaagaataagacagggcttggaaaggctttggctttagtatgggtggcaagtgg

SEQ ID NO: 184771 - DNA, 75 bp, Artificial Sequence
  Synthetic
aagcagtacaaagagctttaagaagaataagacagggcttggaaaggctttggctttagcatgggtggcaagtgg

SEQ ID NO: 184772 - DNA, 75 bp, Artificial Sequence
  Synthetic
aagcagtacaaagagctttaagaagaataagacagggcttggaaaggctttggctttaggatgggtggcaagtgg

SEQ ID NO: 184773 - DNA, 75 bp, Artificial Sequence
  Synthetic
aagcagtacaaagagctttaagaagaataagacagggcttggaaaggctttggctctagaatgggtggcaagtgg

SEQ ID NO: 184774 - DNA, 75 bp, Artificial Sequence
  Synthetic
aagcagtacaaagagctttaagaagaataagacagggcttggaaaggctttggctctagtatgggtggcaagtgg

SEQ ID NO: 184775 - DNA, 75 bp, Artificial Sequence
  Synthetic
aagcagtacaaagagctttaagaagaataagacagggcttggaaaggctttggctctagcatgggtggcaagtgg

SEQ ID NO: 184776 - DNA, 75 bp, Artificial Sequence
  Synthetic
aagcagtacaaagagctttaagaagaataagacagggcttggaaaggctttggctctaggatgggtggcaagtgg

SEQ ID NO: 184777 - DNA, 75 bp, Artificial Sequence
  Synthetic
aagcagtacaaagagctttaagaagaataagacagggcttggaaaggctttggctgtagaatgggtggcaagtgg

SEQ ID NO: 184778 - DNA, 75 bp, Artificial Sequence
  Synthetic
aagcagtacaaagagctttaagaagaataagacagggcttggaaaggctttggctgtagtatgggtggcaagtgg

SEQ ID NO: 184779 - DNA, 75 bp, Artificial Sequence
  Synthetic
aagcagtacaaagagctttaagaagaataagacagggcttggaaaggctttggctgtagcatgggtggcaagtgg

SEQ ID NO: 184780 - DNA, 75 bp, Artificial Sequence
  Synthetic
aagcagtacaaagagctttaagaagaataagacagggcttggaaaggctttggctgtaggatgggtggcaagtgg

SEQ ID NO: 184781 - DNA, 75 bp, Artificial Sequence
  Synthetic
ttgactagcggaggctagaaggagagagatgggtgcgagagcgtcagtattaagcgggggaaaattagataaatg

SEQ ID NO: 184782 - DNA, 75 bp, Artificial Sequence
  Synthetic
caacaatggtggatatggggcatcttaggcttttggatgttaatgatttgtaatgtggtggggaacttgtgggtc

SEQ ID NO: 184783 - DNA, 75 bp, Artificial Sequence
  Synthetic
ggaaagtatgcaaaaatgaggactgcccacactaatgatgtaaaacaattaacagaagcagtgcaaaagatagct

SEQ ID NO: 184784 - DNA, 75 bp, Artificial Sequence
  Synthetic
cccacactaatgatgtaaaacaattaacagaagcagtgcaaaagatagctcaagaaagcatagtaatatggggaa

SEQ ID NO: 184785 - DNA, 75 bp, Artificial Sequence
  Synthetic
cattagaagaaatgatgacagcatgtcagggagtgggaggacctagccacaaggcaagagtgttggctgaggcaa

SEQ ID NO: 184786 - DNA, 75 bp, Artificial Sequence
  Synthetic
tgtagatggggcagctaacagggagactaaattaggaaaagcaggatatgttactaacaaaggaagacaaaaagt

SEQ ID NO: 184787 - DNA, 75 bp, Artificial Sequence
  Synthetic
tataaggaaataagaaaacagagaaaaatagataggatacttgaaagaataagagaaagagcagaagacagtgga

SEQ ID NO: 184788 - DNA, 75 bp, Artificial Sequence
  Synthetic
ggcacaacaggcagcagctgccacaggaggcagcgtcagccaaaattatcctatagtacagaatgcacaagggca

SEQ ID NO: 184789 - DNA, 75 bp, Artificial Sequence
  Synthetic
gggaaaatttggccttcccacaaggggaggccagggaatttccttcagagcagaccagagccaacagccccacca

SEQ ID NO: 184790 - DNA, 75 bp, Artificial Sequence
  Synthetic
aaattgctctttcaatgcaaccacagaaataagagataagactcgcaaagagtatgcacttttttatagacttga

SEQ ID NO: 184791 - DNA, 75 bp, Artificial Sequence
  Synthetic
taatgtgccctggaactctagttggagtaataaatctctggatgagatatggaacaacatgacctggctgcaatg

SEQ ID NO: 184792 - DNA, 75 bp, Artificial Sequence
  Synthetic
ttccctcaaatcactctttggcaacgaccccttgtcacagtaaaaataggaggacagctgaaagaagctctatta

SEQ ID NO: 184793 - DNA, 75 bp, Artificial Sequence
  Synthetic
ggggggacaccaggcagctatgcaaatgttaaaagataccatcaatgaggaagctgcagaatgggacaggttaca

SEQ ID NO: 184794 - DNA, 75 bp, Artificial Sequence
  Synthetic
ggaaacttgtgggtcacagtgtattatggggtacctgtgtggagagaagcaaaaactactctattttgtgcatca

SEQ ID NO: 184795 - DNA, 75 bp, Artificial Sequence
  Synthetic
tttgatccaattcctatacattattgtgctccagctggatttgcgattctaaagtgtaataataagacattcaat

SEQ ID NO: 184796 - DNA, 75 bp, Artificial Sequence
  Synthetic
aacagtaatcaaaccaaaaattgcactgaagaaagcaacagcactgtgataaactgtaaagaaataaaaaactgc

SEQ ID NO: 184797 - DNA, 75 bp, Artificial Sequence
  Synthetic
tttttgctgtgctttctgtaataaatagagttaggcagggatactcacctttgtcatttcagacccataccccaa

SEQ ID NO: 184798 - DNA, 75 bp, Artificial Sequence
  Synthetic
taacacaagaaaaagtataaggataggacccggacaaacattttatgcaacaaacggaataataggagaaataag

SEQ ID NO: 184799 - DNA, 75 bp, Artificial Sequence
  Synthetic
gtaagaaattgctctttcaatacaaccacactagtaaaagataagaagcagaaagagtatgcacttttttataga

SEQ ID NO: 184800 - DNA, 75 bp, Artificial Sequence
  Synthetic
gagccgaaggaaaaggagctatatcccttagcctccctcaaatcactctttggcaacgacccctagtcacagtaa

SEQ ID NO: 184801 - DNA, 75 bp, Artificial Sequence
  Synthetic
aaattttccaattagtcctattgaaactgtaccagtaaaattaaagccaggaatggatggcccaaaggttaaaca

SEQ ID NO: 184802 - DNA, 75 bp, Artificial Sequence
  Synthetic
taaaaacatattggggtctgcatacaggagaaagagaatggcatttgggtcagggagtctccatagaatggagga

SEQ ID NO: 184803 - DNA, 75 bp, Artificial Sequence
  Synthetic
cagccaaaattaccctatagtgcaaaatgcacaagggcaaatgatacatcagaatttgtcacctaggactttaaa

SEQ ID NO: 184804 - DNA, 75 bp, Artificial Sequence
  Synthetic
aaatttcaagaataggacctgaaaatccttataatacacctatctttgctataaaaaagaaagatagcactaagt

SEQ ID NO: 184805 - DNA, 75 bp, Artificial Sequence
  Synthetic
attaaacaagagaacacaagatttctgggaggtacagttaggtatcccacatccggggggtttaaagcaaaagca

SEQ ID NO: 184806 - DNA, 75 bp, Artificial Sequence
  Synthetic
atctgttacagtcctagatgtaggagatgcttatttctcatgccccttagacccagatttcagaaaatatactgc

SEQ ID NO: 184807 - DNA, 75 bp, Artificial Sequence
  Synthetic
cccacctatcccagtgggagacatctataaaagatggataattctgggattaaataaaatagtaagaatgtatag

SEQ ID NO: 184808 - DNA, 75 bp, Artificial Sequence
  Synthetic
tatgagctccatcctgacaaatggacagtacagcctatacagctgccagaaaaagaaagctggactgtcaatgat

SEQ ID NO: 184809 - DNA, 75 bp, Artificial Sequence
  Synthetic
aaaatagacaggttacttgatagaataagagaaagagcagaagacagtggcaatgagagtgaaggggatcaggaa

SEQ ID NO: 184810 - DNA, 75 bp, Artificial Sequence
  Synthetic
accatagcaatagcagtagctgagggaacagataggattatagaattcatacaaagattttgtagagctatccgc

SEQ ID NO: 184811 - DNA, 75 bp, Artificial Sequence
  Synthetic
caagggccaaaagaacccttcagagactatgtagataggttctttaaaactctcagagctgagcaagctacacag

SEQ ID NO: 184812 - DNA, 75 bp, Artificial Sequence
  Synthetic
cgatcaaaacagcaccctgcgggaagagccaggggcaatacaaaactgttcttttaatatgaccacagaagtaag

SEQ ID NO: 184813 - DNA, 75 bp, Artificial Sequence
  Synthetic
tgaaaatttcacaaacaatgctaaaaccataatagtccagctgaatgaatctgtaacaattaattgtacaagacc

SEQ ID NO: 184814 - DNA, 75 bp, Artificial Sequence
  Synthetic
atagcctttaatcaatcctcaggaggggacccagaaatagcaatgcacatgtttaattgtagaggggaatttttc

SEQ ID NO: 184815 - DNA, 75 bp, Artificial Sequence
  Synthetic
atcaaggaattagagtaaaagaattgtgtaagttaattagaggcaccaagtcattgacagaagtagtacctttaa

SEQ ID NO: 184816 - DNA, 75 bp, Artificial Sequence
  Synthetic
gtgtaagttaattagaggcaccaagtcattgacagaagtagtacctttaagtaaagaggcagagctagaattaga

SEQ ID NO: 184817 - DNA, 75 bp, Artificial Sequence
  Synthetic
tgaatctgtacagattaattgtacaagacccaacaacaatacaagaaaaagtatacatataggaccaggacaagc

SEQ ID NO: 184818 - DNA, 75 bp, Artificial Sequence
  Synthetic
gatttagctaggcatggagcaattacaagcagcaatacagtagccaataatcctgattgtgcctggctggaagca

SEQ ID NO: 184819 - DNA, 75 bp, Artificial Sequence
  Synthetic
ctcaggtgcctttaagaccaatgacttttaaaggagcatttgatctcagcttctttttaaaagaaaaggggggac

SEQ ID NO: 184820 - DNA, 75 bp, Artificial Sequence
  Synthetic
tatacatatgggacccgggggagcattttatgcaacaggagccatcataggagatataagacaagcacattgtaa

SEQ ID NO: 184821 - DNA, 75 bp, Artificial Sequence
  Synthetic
tagataaagcccaagaagagcatgaaaaatatcacaacaattggagagcaatggctagtgattttaatctgccac

SEQ ID NO: 184822 - DNA, 75 bp, Artificial Sequence
  Synthetic
aataaaaacatattggggtttgcaaacaggagaaagagaatggcatttgggtaatggagtctccatagaatggag

SEQ ID NO: 184823 - DNA, 75 bp, Artificial Sequence
  Synthetic
ttggggggtacagtgcaggggaaagaatagtagacataatagcaacagacatacaaactaaagaattacaaaaac

SEQ ID NO: 184824 - DNA, 75 bp, Artificial Sequence
  Synthetic
aataaatctcaagatgatatttggaataacatgacctggatgcagtgggaaaaagaaattgacaattacacaggc

SEQ ID NO: 184825 - DNA, 75 bp, Artificial Sequence
  Synthetic
cacactcccatgcagaataaaacaaattataaacatgtggcaggaagtaggaaaagcaatgtatgcccctcccat

SEQ ID NO: 184826 - DNA, 75 bp, Artificial Sequence
  Synthetic
ggaaaggatcaccagcaatattccagagtagcatgacaaaaatcttagagccctttagatcaaaaaatccagaaa

SEQ ID NO: 184827 - DNA, 75 bp, Artificial Sequence
  Synthetic
agttaggaagggatactcaccattatcgtttcagacccgccccccaaacccaagggaacccgacaggccagaagg

SEQ ID NO: 184828 - DNA, 75 bp, Artificial Sequence
  Synthetic
ggaagaagcggaagcaccgacgaggaactcctcagagcagtaaggatcatcaaaatcctataccaaagcagtaag

SEQ ID NO: 184829 - DNA, 75 bp, Artificial Sequence
  Synthetic
tgacaagtggacagtccagcctatagtgctgccacaaaaagaaagctggactgtcaatgatatacagaaattagt

SEQ ID NO: 184830 - DNA, 75 bp, Artificial Sequence
  Synthetic
caaagcactaacagatatagtgacactgactgaggaagcagaattagaattggcagaaaacagggaaattctaaa

SEQ ID NO: 184831 - DNA, 75 bp, Artificial Sequence
  Synthetic
actagaagaaatgatgacagcatgtcagggagtgggaggacccagccataaagcaagagttttagctgaagcaat

SEQ ID NO: 184832 - DNA, 75 bp, Artificial Sequence
  Synthetic
aagccacctttgcctagtgttaggaaattaacagaagatagatggaacaagccccagaagatcaagggccacaga

SEQ ID NO: 184833 - DNA, 75 bp, Artificial Sequence
  Synthetic
ctcctacaatattggagtcaggaactgaggaatagtgcagttagcttgttcaacgccatagctatagcagtagct

SEQ ID NO: 184834 - DNA, 75 bp, Artificial Sequence
  Synthetic
ctcctacaatattggagtcaggaactgaggaatagtgcagttagcttgttcaacgccatagctttagcagtagct

SEQ ID NO: 184835 - DNA, 75 bp, Artificial Sequence
  Synthetic
ctcctacaatattggagtcaggaactgaggaatagtgcagttagcttgttcaacgccatagctctagcagtagct

SEQ ID NO: 184836 - DNA, 75 bp, Artificial Sequence
  Synthetic
ctcctacaatattggagtcaggaactgaggaatagtgcagttagcttgttcaacgccatagctgtagcagtagct

SEQ ID NO: 184837 - DNA, 75 bp, Artificial Sequence
  Synthetic
ctcctacaatattggagtcaggaactgaggaatagtgctgttagcttgttcaacgccatagctatagcagtagct

SEQ ID NO: 184838 - DNA, 75 bp, Artificial Sequence
  Synthetic
ctcctacaatattggagtcaggaactgaggaatagtgctgttagcttgttcaacgccatagctttagcagtagct

SEQ ID NO: 184839 - DNA, 75 bp, Artificial Sequence
  Synthetic
ctcctacaatattggagtcaggaactgaggaatagtgctgttagcttgttcaacgccatagctctagcagtagct

SEQ ID NO: 184840 - DNA, 75 bp, Artificial Sequence
  Synthetic
ctcctacaatattggagtcaggaactgaggaatagtgctgttagcttgttcaacgccatagctgtagcagtagct

SEQ ID NO: 184841 - DNA, 75 bp, Artificial Sequence
  Synthetic
ctcctacaatattggagtcaggaactgaggaatagtgccgttagcttgttcaacgccatagctatagcagtagct

SEQ ID NO: 184842 - DNA, 75 bp, Artificial Sequence
  Synthetic
ctcctacaatattggagtcaggaactgaggaatagtgccgttagcttgttcaacgccatagctttagcagtagct

SEQ ID NO: 184843 - DNA, 75 bp, Artificial Sequence
  Synthetic
ctcctacaatattggagtcaggaactgaggaatagtgccgttagcttgttcaacgccatagctctagcagtagct

SEQ ID NO: 184844 - DNA, 75 bp, Artificial Sequence
  Synthetic
ctcctacaatattggagtcaggaactgaggaatagtgccgttagcttgttcaacgccatagctgtagcagtagct

SEQ ID NO: 184845 - DNA, 75 bp, Artificial Sequence
  Synthetic
ctcctacaatattggagtcaggaactgaggaatagtgcggttagcttgttcaacgccatagctatagcagtagct

SEQ ID NO: 184846 - DNA, 75 bp, Artificial Sequence
  Synthetic
ctcctacaatattggagtcaggaactgaggaatagtgcggttagcttgttcaacgccatagctttagcagtagct

SEQ ID NO: 184847 - DNA, 75 bp, Artificial Sequence
  Synthetic
ctcctacaatattggagtcaggaactgaggaatagtgcggttagcttgttcaacgccatagctctagcagtagct

SEQ ID NO: 184848 - DNA, 75 bp, Artificial Sequence
  Synthetic
ctcctacaatattggagtcaggaactgaggaatagtgcggttagcttgttcaacgccatagctgtagcagtagct

SEQ ID NO: 184849 - DNA, 75 bp, Artificial Sequence
  Synthetic
ctcctacattattggagtcaggaactgaggaatagtgcagttagcttgttcaacgccatagctatagcagtagct

SEQ ID NO: 184850 - DNA, 75 bp, Artificial Sequence
  Synthetic
ctcctacattattggagtcaggaactgaggaatagtgcagttagcttgttcaacgccatagctttagcagtagct

SEQ ID NO: 184851 - DNA, 75 bp, Artificial Sequence
  Synthetic
ctcctacattattggagtcaggaactgaggaatagtgcagttagcttgttcaacgccatagctctagcagtagct

SEQ ID NO: 184852 - DNA, 75 bp, Artificial Sequence
  Synthetic
ctcctacattattggagtcaggaactgaggaatagtgcagttagcttgttcaacgccatagctgtagcagtagct

SEQ ID NO: 184853 - DNA, 75 bp, Artificial Sequence
  Synthetic
ctcctacattattggagtcaggaactgaggaatagtgctgttagcttgttcaacgccatagctatagcagtagct

SEQ ID NO: 184854 - DNA, 75 bp, Artificial Sequence
  Synthetic
ctcctacattattggagtcaggaactgaggaatagtgctgttagcttgttcaacgccatagctttagcagtagct

SEQ ID NO: 184855 - DNA, 75 bp, Artificial Sequence
  Synthetic
ctcctacattattggagtcaggaactgaggaatagtgctgttagcttgttcaacgccatagctctagcagtagct

SEQ ID NO: 184856 - DNA, 75 bp, Artificial Sequence
  Synthetic
ctcctacattattggagtcaggaactgaggaatagtgctgttagcttgttcaacgccatagctgtagcagtagct

SEQ ID NO: 184857 - DNA, 75 bp, Artificial Sequence
  Synthetic
ctcctacattattggagtcaggaactgaggaatagtgccgttagcttgttcaacgccatagctatagcagtagct

SEQ ID NO: 184858 - DNA, 75 bp, Artificial Sequence
  Synthetic
ctcctacattattggagtcaggaactgaggaatagtgccgttagcttgttcaacgccatagctttagcagtagct

SEQ ID NO: 184859 - DNA, 75 bp, Artificial Sequence
  Synthetic
ctcctacattattggagtcaggaactgaggaatagtgccgttagcttgttcaacgccatagctctagcagtagct

SEQ ID NO: 184860 - DNA, 75 bp, Artificial Sequence
  Synthetic
ctcctacattattggagtcaggaactgaggaatagtgccgttagcttgttcaacgccatagctgtagcagtagct

SEQ ID NO: 184861 - DNA, 75 bp, Artificial Sequence
  Synthetic
ctcctacattattggagtcaggaactgaggaatagtgcggttagcttgttcaacgccatagctatagcagtagct

SEQ ID NO: 184862 - DNA, 75 bp, Artificial Sequence
  Synthetic
ctcctacattattggagtcaggaactgaggaatagtgcggttagcttgttcaacgccatagctttagcagtagct

SEQ ID NO: 184863 - DNA, 75 bp, Artificial Sequence
  Synthetic
ctcctacattattggagtcaggaactgaggaatagtgcggttagcttgttcaacgccatagctctagcagtagct

SEQ ID NO: 184864 - DNA, 75 bp, Artificial Sequence
  Synthetic
ctcctacattattggagtcaggaactgaggaatagtgcggttagcttgttcaacgccatagctgtagcagtagct

SEQ ID NO: 184865 - DNA, 75 bp, Artificial Sequence
  Synthetic
ctcctacactattggagtcaggaactgaggaatagtgcagttagcttgttcaacgccatagctatagcagtagct

SEQ ID NO: 184866 - DNA, 75 bp, Artificial Sequence
  Synthetic
ctcctacactattggagtcaggaactgaggaatagtgcagttagcttgttcaacgccatagctttagcagtagct

SEQ ID NO: 184867 - DNA, 75 bp, Artificial Sequence
  Synthetic
ctcctacactattggagtcaggaactgaggaatagtgcagttagcttgttcaacgccatagctctagcagtagct

SEQ ID NO: 184868 - DNA, 75 bp, Artificial Sequence
  Synthetic
ctcctacactattggagtcaggaactgaggaatagtgcagttagcttgttcaacgccatagctgtagcagtagct

SEQ ID NO: 184869 - DNA, 75 bp, Artificial Sequence
  Synthetic
ctcctacactattggagtcaggaactgaggaatagtgctgttagcttgttcaacgccatagctatagcagtagct

SEQ ID NO: 184870 - DNA, 75 bp, Artificial Sequence
  Synthetic
ctcctacactattggagtcaggaactgaggaatagtgctgttagcttgttcaacgccatagctttagcagtagct

SEQ ID NO: 184871 - DNA, 75 bp, Artificial Sequence
  Synthetic
ctcctacactattggagtcaggaactgaggaatagtgctgttagcttgttcaacgccatagctctagcagtagct

SEQ ID NO: 184872 - DNA, 75 bp, Artificial Sequence
  Synthetic
ctcctacactattggagtcaggaactgaggaatagtgctgttagcttgttcaacgccatagctgtagcagtagct

SEQ ID NO: 184873 - DNA, 75 bp, Artificial Sequence
  Synthetic
ctcctacactattggagtcaggaactgaggaatagtgccgttagcttgttcaacgccatagctatagcagtagct

SEQ ID NO: 184874 - DNA, 75 bp, Artificial Sequence
  Synthetic
ctcctacactattggagtcaggaactgaggaatagtgccgttagcttgttcaacgccatagctttagcagtagct

SEQ ID NO: 184875 - DNA, 75 bp, Artificial Sequence
  Synthetic
ctcctacactattggagtcaggaactgaggaatagtgccgttagcttgttcaacgccatagctctagcagtagct

SEQ ID NO: 184876 - DNA, 75 bp, Artificial Sequence
  Synthetic
ctcctacactattggagtcaggaactgaggaatagtgccgttagcttgttcaacgccatagctgtagcagtagct

SEQ ID NO: 184877 - DNA, 75 bp, Artificial Sequence
  Synthetic
ctcctacactattggagtcaggaactgaggaatagtgcggttagcttgttcaacgccatagctatagcagtagct

SEQ ID NO: 184878 - DNA, 75 bp, Artificial Sequence
  Synthetic
ctcctacactattggagtcaggaactgaggaatagtgcggttagcttgttcaacgccatagctttagcagtagct

SEQ ID NO: 184879 - DNA, 75 bp, Artificial Sequence
  Synthetic
ctcctacactattggagtcaggaactgaggaatagtgcggttagcttgttcaacgccatagctctagcagtagct

SEQ ID NO: 184880 - DNA, 75 bp, Artificial Sequence
  Synthetic
ctcctacactattggagtcaggaactgaggaatagtgcggttagcttgttcaacgccatagctgtagcagtagct

SEQ ID NO: 184881 - DNA, 75 bp, Artificial Sequence
  Synthetic
ctcctacagtattggagtcaggaactgaggaatagtgcagttagcttgttcaacgccatagctatagcagtagct

SEQ ID NO: 184882 - DNA, 75 bp, Artificial Sequence
  Synthetic
ctcctacagtattggagtcaggaactgaggaatagtgcagttagcttgttcaacgccatagctttagcagtagct

SEQ ID NO: 184883 - DNA, 75 bp, Artificial Sequence
  Synthetic
ctcctacagtattggagtcaggaactgaggaatagtgcagttagcttgttcaacgccatagctctagcagtagct

SEQ ID NO: 184884 - DNA, 75 bp, Artificial Sequence
  Synthetic
ctcctacagtattggagtcaggaactgaggaatagtgcagttagcttgttcaacgccatagctgtagcagtagct

SEQ ID NO: 184885 - DNA, 75 bp, Artificial Sequence
  Synthetic
ctcctacagtattggagtcaggaactgaggaatagtgctgttagcttgttcaacgccatagctatagcagtagct

SEQ ID NO: 184886 - DNA, 75 bp, Artificial Sequence
  Synthetic
ctcctacagtattggagtcaggaactgaggaatagtgctgttagcttgttcaacgccatagctttagcagtagct

SEQ ID NO: 184887 - DNA, 75 bp, Artificial Sequence
  Synthetic
ctcctacagtattggagtcaggaactgaggaatagtgctgttagcttgttcaacgccatagctctagcagtagct

SEQ ID NO: 184888 - DNA, 75 bp, Artificial Sequence
  Synthetic
ctcctacagtattggagtcaggaactgaggaatagtgctgttagcttgttcaacgccatagctgtagcagtagct

SEQ ID NO: 184889 - DNA, 75 bp, Artificial Sequence
  Synthetic
ctcctacagtattggagtcaggaactgaggaatagtgccgttagcttgttcaacgccatagctatagcagtagct

SEQ ID NO: 184890 - DNA, 75 bp, Artificial Sequence
  Synthetic
ctcctacagtattggagtcaggaactgaggaatagtgccgttagcttgttcaacgccatagctttagcagtagct

SEQ ID NO: 184891 - DNA, 75 bp, Artificial Sequence
  Synthetic
ctcctacagtattggagtcaggaactgaggaatagtgccgttagcttgttcaacgccatagctctagcagtagct

SEQ ID NO: 184892 - DNA, 75 bp, Artificial Sequence
  Synthetic
ctcctacagtattggagtcaggaactgaggaatagtgccgttagcttgttcaacgccatagctgtagcagtagct

SEQ ID NO: 184893 - DNA, 75 bp, Artificial Sequence
  Synthetic
ctcctacagtattggagtcaggaactgaggaatagtgcggttagcttgttcaacgccatagctatagcagtagct

SEQ ID NO: 184894 - DNA, 75 bp, Artificial Sequence
  Synthetic
ctcctacagtattggagtcaggaactgaggaatagtgcggttagcttgttcaacgccatagctttagcagtagct

SEQ ID NO: 184895 - DNA, 75 bp, Artificial Sequence
  Synthetic
ctcctacagtattggagtcaggaactgaggaatagtgcggttagcttgttcaacgccatagctctagcagtagct

SEQ ID NO: 184896 - DNA, 75 bp, Artificial Sequence
  Synthetic
ctcctacagtattggagtcaggaactgaggaatagtgcggttagcttgttcaacgccatagctgtagcagtagct

SEQ ID NO: 184897 - DNA, 75 bp, Artificial Sequence
  Synthetic
agccagtggtatcaactcaattgctgttaaatggtagtctagcagaagaagagataataatcagatctgaaaatc

SEQ ID NO: 184898 - DNA, 75 bp, Artificial Sequence
  Synthetic
aaattgctctttcaatataaccacagaaataagagataagaaaaagaatgaatatgcacttttttatagacttga

SEQ ID NO: 184899 - DNA, 75 bp, Artificial Sequence
  Synthetic
agacaaggcttcgaaaggcttttactataaaatgggtggcaagtggtcaaaaagtagtatgattggatggcctaa

SEQ ID NO: 184900 - DNA, 75 bp, Artificial Sequence
  Synthetic
cttaataaatctgtagaaatcaattgtaccagaccctccaacaatacaagaacaagtataagtataggaccagga

SEQ ID NO: 184901 - DNA, 75 bp, Artificial Sequence
  Synthetic
ggagacataataggagatataagaaaagcatattgtgagattaatggaacagcatggaatgaaactttaaaacag

SEQ ID NO: 184902 - DNA, 75 bp, Artificial Sequence
  Synthetic
aatatgcacttttttataaacttgatatagtaccaatagataatgataatacaagctatacattgataaattgta

SEQ ID NO: 184903 - DNA, 75 bp, Artificial Sequence
  Synthetic
acaagctatacattgataaattgtaacacctcagtcattacacaagcctgtccaaaggtatcctttgaaccaatt

SEQ ID NO: 184904 - DNA, 75 bp, Artificial Sequence
  Synthetic
taataaaacaataagatttgcaccacccataggaggggacctagaaattacaacacatagttttaattgtagagg

SEQ ID NO: 184905 - DNA, 75 bp, Artificial Sequence
  Synthetic
cccataggaggggacctagaaattacaacacatagttttaattgtagaggagaatttttctattgcaatacaaca

SEQ ID NO: 184906 - DNA, 75 bp, Artificial Sequence
  Synthetic
gtgcatcagatgctaaagcatataagacagaagtgcataatgtctgggctacgcatgcctgtgtacctacggacc

SEQ ID NO: 184907 - DNA, 75 bp, Artificial Sequence
  Synthetic
tgtatgcccctcccattgaaggaagcataacatgtaactcaaatatcacaggactactattgacacgtgatggag

SEQ ID NO: 184908 - DNA, 75 bp, Artificial Sequence
  Synthetic
ttagatctgaaaatttcacggacaatgctaaaaccataatagtacagctgaatgaatctgtagaaattaattgta

SEQ ID NO: 184909 - DNA, 75 bp, Artificial Sequence
  Synthetic
tgctaaaaccataatagtacagctgaatgaatctgtagaaattaattgtacaagacccaacaacaatacaagaaa

SEQ ID NO: 184910 - DNA, 75 bp, Artificial Sequence
  Synthetic
tccttgggttcttgggagcagcaggaagcactatgggcgcagcgtcaataacgctgacggtacaggccagacaat

SEQ ID NO: 184911 - DNA, 75 bp, Artificial Sequence
  Synthetic
aatgaatctgtagaaattaattgtacaagacccaacaacaatacaagaaaaagtatacctataggaccggggaga

SEQ ID NO: 184912 - DNA, 75 bp, Artificial Sequence
  Synthetic
agaataagacaaattgaggatgacagtgactatgaaagtgatggaaaagaggaacaggaagttagggatcttgtg

SEQ ID NO: 184913 - DNA, 75 bp, Artificial Sequence
  Synthetic
caatataaccacagaattacaggataagaaacggaaagtatattcacttttttatagacttgatttagtaccact

SEQ ID NO: 184914 - DNA, 75 bp, Artificial Sequence
  Synthetic
ggatttggggttgctctggaaaactcatctgcaccactactgtgccttggaatgctagctggagtaataaatctc

SEQ ID NO: 184915 - DNA, 75 bp, Artificial Sequence
  Synthetic
cagcaggagaaaaatgaaaaagatttattagcattggacagttggaaaaatctgtggaattggtttaacataaca

SEQ ID NO: 184916 - DNA, 75 bp, Artificial Sequence
  Synthetic
aatggcagtctagcagaaggagaggtaatgattagatctgaaaatatcacaaacaatgccaaaaacataatagta

SEQ ID NO: 184917 - DNA, 75 bp, Artificial Sequence
  Synthetic
atgaaaaagtgtgagtttaatgtaaccacagttctcaaagacaaaaaggagaaacaacaggctctattctatgta

SEQ ID NO: 184918 - DNA, 75 bp, Artificial Sequence
  Synthetic
ggacaagccttctatacaactggtgccattataggggatataagacaagcatattgtaatgtcagtagatcagaa

SEQ ID NO: 184919 - DNA, 75 bp, Artificial Sequence
  Synthetic
caaacctgtccaaaggtatcgtttgaggcaattccaatacactattgtgctccagcgggatatgccatctttaag

SEQ ID NO: 184920 - DNA, 75 bp, Artificial Sequence
  Synthetic
tgggacgcagcagtctcaggggactacagagggggtgggaagcccttaagtatctgggaaatcttgtgcagtatt

SEQ ID NO: 184921 - DNA, 75 bp, Artificial Sequence
  Synthetic
taaatgggacaatctctgaaggaaagataagaattatgggaaaaaatatttcagacactgggaaaaatatcatag

SEQ ID NO: 184922 - DNA, 75 bp, Artificial Sequence
  Synthetic
taggcatctcctatggcaggaagaagcggaaacagcgacgaggaactcctcacagcagtaaggatcatcaaaatc

SEQ ID NO: 184923 - DNA, 75 bp, Artificial Sequence
  Synthetic
catgcagaataaagcaaattgtaagaatgtggcagagagtaggacaagcaatgtatgcccctcccattgcaggag

SEQ ID NO: 184924 - DNA, 75 bp, Artificial Sequence
  Synthetic
gaaaaataacctaactaactcaagggcagcctcttgcaagtataacagctctgtttgggaagaagccttaaaaca

SEQ ID NO: 184925 - DNA, 75 bp, Artificial Sequence
  Synthetic
aggagatatgagagataattggagaagtgaattatataagtataaagtagtaaaacttgaaccactaggagtagc

SEQ ID NO: 184926 - DNA, 75 bp, Artificial Sequence
  Synthetic
tttaactgtcatggagaattcttctattgtaacacatctcagatgtttaattataccttttcatgtacaagaacc

SEQ ID NO: 184927 - DNA, 75 bp, Artificial Sequence
  Synthetic
gtattggggtctagagctaaaaaagagtgctattagtctgtttgataccatagcaatagcagtagctgaaggaac

SEQ ID NO: 184928 - DNA, 75 bp, Artificial Sequence
  Synthetic
gataaaacaggtggtaaggtcatggatacagggagggtcgggactttatgcacctcccaggccaggttacctaac

SEQ ID NO: 184929 - DNA, 75 bp, Artificial Sequence
  Synthetic
gtggaacttctgggacgcagggggtgggaagccctcaaatattggtggaatctcctgcagtattggagtcaggaa

SEQ ID NO: 184930 - DNA, 75 bp, Artificial Sequence
  Synthetic
ctaaagaatagtgctgttagtttgtttaatgccatagctatagcagtagctgaggggacagatagggttatagaa

SEQ ID NO: 184931 - DNA, 75 bp, Artificial Sequence
  Synthetic
gaaaattagtagattttagagaacttaataagagaactcaagacttctgggaagttcaattaggaataccacatc

SEQ ID NO: 184932 - DNA, 75 bp, Artificial Sequence
  Synthetic
aaagatatatggagaactgaattgttcaaatacaaagtagtaaagataaaaccttttagtgtggcacctacaaaa

SEQ ID NO: 184933 - DNA, 75 bp, Artificial Sequence
  Synthetic
ttccctcaaatcactctttggcaacgaccccttgtcacaataaaaataggaggacagctgaaagaagctctatta

SEQ ID NO: 184934 - DNA, 75 bp, Artificial Sequence
  Synthetic
ttggcacttgggtcatggggtctccatagaatggaagcagagaaaatatagcacacaaatagatcctgacctagc

SEQ ID NO: 184935 - DNA, 75 bp, Artificial Sequence
  Synthetic
ctgctctttcaatgtgaccacagtaataagggataagagacagaaagtatattcacttttttatagacttgatgt

SEQ ID NO: 184936 - DNA, 75 bp, Artificial Sequence
  Synthetic
aaaactgctctttcaatatctccacagatgtggtagataaggtaaagaaagaatatgcatctttttataaacttg

SEQ ID NO: 184937 - DNA, 75 bp, Artificial Sequence
  Synthetic
atttgtttgatacagcagcaatagcagtagctaactggactgatagggttatagatatagcacaaagaggtatta

SEQ ID NO: 184938 - DNA, 75 bp, Artificial Sequence
  Synthetic
ctaagataagggatagaataagacaaacccctcccactccagcagcagaaggagtaggagcagcatctcgagatt

SEQ ID NO: 184939 - DNA, 75 bp, Artificial Sequence
  Synthetic
cacctcttgagcaacttagcatcagggatccagacggtgatcagccatctgggacttggactgtggatcctggga

SEQ ID NO: 184940 - DNA, 75 bp, Artificial Sequence
  Synthetic
ggatccagacggtgatcagccatctgggacttggactgtggatcctgggacagaagataattagtgcttgcagaa

SEQ ID NO: 184941 - DNA, 75 bp, Artificial Sequence
  Synthetic
tataattttagggctacaaaggataggaagaggaattcttaacatcccaagaagaattagacagggcttagaaag

SEQ ID NO: 184942 - DNA, 75 bp, Artificial Sequence
  Synthetic
gaaaaacttcccctgagcctgaaccatgtgcacctggagtaggacaagtctccagggaattagcagctagaggag

SEQ ID NO: 184943 - DNA, 75 bp, Artificial Sequence
  Synthetic
agacttattagcattggacaagtgggcaagtctgtggaattggtttgacatatcaaactggctgtggtatataaa

SEQ ID NO: 184944 - DNA, 75 bp, Artificial Sequence
  Synthetic
aatataacagatgaagtaaaaaactgtacttttaatatgaccacagaactaaaagataagaagcagaaggtccat

SEQ ID NO: 184945 - DNA, 75 bp, Artificial Sequence
  Synthetic
aagtcataatagtgcagcttaatgaaactatagaaattaattgtaccagacccaacaacaatacaagaaaaagta

SEQ ID NO: 184946 - DNA, 75 bp, Artificial Sequence
  Synthetic
gagatattcagacctggaggaggaaatatgaaggacaattggagaagtgaattatacaaatataaagtggtagaa

SEQ ID NO: 184947 - DNA, 75 bp, Artificial Sequence
  Synthetic
ttcagaacagaccagagccaacagccccaccagcagagagcttcgggttcggagaggagatagccccctccccga

SEQ ID NO: 184948 - DNA, 75 bp, Artificial Sequence
  Synthetic
tgtcgagcacctagaaagaaaggttgctggaaatgtggacaggaaggtcaccaaatgaaagattgcaaaaatgga

SEQ ID NO: 184949 - DNA, 75 bp, Artificial Sequence
  Synthetic
cacaggtgcctctaagaccaatgacttacaagggagctgtagatctcagccactttttaaaagaaaaggggggac

SEQ ID NO: 184950 - DNA, 75 bp, Artificial Sequence
  Synthetic
gaagccctattagacacaggagcagatgatacagtgttagaagaaataagtttaccaggaaaatggaaaccaaaa

SEQ ID NO: 184951 - DNA, 75 bp, Artificial Sequence
  Synthetic
ttaaggccagggggaaagaaaaaatatagaatgaaacatctagtatgggcaagcagggagctggaaagatttgca

SEQ ID NO: 184952 - DNA, 75 bp, Artificial Sequence
  Synthetic
tcgtttcagacccttaccccaaacccgaggggactcgacaggctcggaagaatcgaagaagaaggtggagagcaa

SEQ ID NO: 184953 - DNA, 75 bp, Artificial Sequence
  Synthetic
atagataggataattgatagaataagagaaagagcagaagacagtggcaatgagagcgaaggagaccaggaagaa

SEQ ID NO: 184954 - DNA, 75 bp, Artificial Sequence
  Synthetic
acagcagtctcaagggactgagactggggtgggaaggcctcaaatatctgtggaatctcctggtgtattggggtc

SEQ ID NO: 184955 - DNA, 75 bp, Artificial Sequence
  Synthetic
gtagctaactggacagatagggttatagaaatagtacaaagaacttgtagggcttttctcaacatacctagaagg

SEQ ID NO: 184956 - DNA, 75 bp, Artificial Sequence
  Synthetic
aggaagaagaagtaggctttccagtcagacctcaggtgcctttaagaccaatgacttataagggagcattcgatc

SEQ ID NO: 184957 - DNA, 75 bp, Artificial Sequence
  Synthetic
gactatgtagataggttctttaaagctctcagagctgagcaagctacacaggaggtaaaaggttggatgacagaa

SEQ ID NO: 184958 - DNA, 75 bp, Artificial Sequence
  Synthetic
tgctactagaactagtagtccaaatgatatgaaaaattgctctttcaatatcaccacaagcctaagagatagagt

SEQ ID NO: 184959 - DNA, 75 bp, Artificial Sequence
  Synthetic
aaagagtgctattagtctgtttgataccatagccataacagtagctgaaggaacagatagaattatagaattagt

SEQ ID NO: 184960 - DNA, 75 bp, Artificial Sequence
  Synthetic
tgtgtaaaattaaccccactctgtgttactttaaattgcactgacttgacaaataaaactacccctaccaatagt

SEQ ID NO: 184961 - DNA, 75 bp, Artificial Sequence
  Synthetic
gagcaatgtatgccaatcccattgcaggaaacattacctgtaactcaaatattacaggtctgctattgacaagag

SEQ ID NO: 184962 - DNA, 75 bp, Artificial Sequence
  Synthetic
atgggtgcgagagcgtcaatattaagagggggaaaattagataaatgggaaagaattaggttaaggccaggggga

SEQ ID NO: 184963 - DNA, 75 bp, Artificial Sequence
  Synthetic
tggatcagatgcatgaggatataatcagtatatgggatcaaagtctaaaaccatgtgtaaaattgaccccactct

SEQ ID NO: 184964 - DNA, 75 bp, Artificial Sequence
  Synthetic
aaattagcagaacacttccctaataaaacaataagctttgcaaatccctcaggaggggacctagaagttacaaca

SEQ ID NO: 184965 - DNA, 75 bp, Artificial Sequence
  Synthetic
agagctgagcaagctacacaggaagtaaaaaattggatgacagacaccttgttggtccaaaatgcgaacccagat

SEQ ID NO: 184966 - DNA, 75 bp, Artificial Sequence
  Synthetic
aagaaataagcctcccctacccagtgtccagaagttaacagaagatagatggagcaggcacctgaggatcaggga

SEQ ID NO: 184967 - DNA, 75 bp, Artificial Sequence
  Synthetic
tgcaaagagctggtagagctattctcaacatacctagaagaataagacagggcttggaaagggctttgctataaa

SEQ ID NO: 184968 - DNA, 75 bp, Artificial Sequence
  Synthetic
aggaagaagcgacggagaccagccgctgctgcgcgccatccagataatcaagatattgtaccagagcagtaagta

SEQ ID NO: 184969 - DNA, 75 bp, Artificial Sequence
  Synthetic
ggcttggaaagggctttgctataaaatgggtggcaagtggtcaaaaagtagtatagttggatggcctgctataag

SEQ ID NO: 184970 - DNA, 75 bp, Artificial Sequence
  Synthetic
atgggtggcaagtggtcaaaaagtagtatagttggatggcctgctataagggaaagaatgaggcgaacccctcca

SEQ ID NO: 184971 - DNA, 75 bp, Artificial Sequence
  Synthetic
ccctcaaatcactctttggcagcgacccctagtcacagtaagaatagggggacagctaatagaagccctattaga

SEQ ID NO: 184972 - DNA, 75 bp, Artificial Sequence
  Synthetic
aacaaaagaaacaagataaaagggaaagagaaatacttgaaaggttaagaagaataagacaaattgaggatgaca

SEQ ID NO: 184973 - DNA, 75 bp, Artificial Sequence
  Synthetic
acggggggcaattacaagcagcaatactagagctaataatcctgacttggcctggctggaagcacaagaggaaga

SEQ ID NO: 184974 - DNA, 75 bp, Artificial Sequence
  Synthetic
gaaagcatagtaatatggggaaagactcctaaatttaaactacccatacaaaaagaaacatgggaaacatggtgg

SEQ ID NO: 184975 - DNA, 75 bp, Artificial Sequence
  Synthetic
gtgaatatcaagcaggacataacaaggtaggatctctacaatatttggcactgaaagcattagtaacaccaacaa

SEQ ID NO: 184976 - DNA, 75 bp, Artificial Sequence
  Synthetic
ttctgtgcttcagatgctaacctaacaagcactgagcagcataatatttgggcatcacaagcctgtgttcccaca

SEQ ID NO: 184977 - DNA, 75 bp, Artificial Sequence
  Synthetic
cataaataatgataccagcagtccagagaaccttgtgaaacagtgtgaatttaatgtaaccacagttgtcaaaga

SEQ ID NO: 184978 - DNA, 75 bp, Artificial Sequence
  Synthetic
ttcttagcacttgcctgggacgatctgcggagcctgtgcctcttcagctaccaccaattgagggacttcatattg

SEQ ID NO: 184979 - DNA, 75 bp, Artificial Sequence
  Synthetic
aatctgaagacaggaaagtatgcaaaaatgaggactgcccacactaatgatgtaaaacagttaacagaggcagtg

SEQ ID NO: 184980 - DNA, 75 bp, Artificial Sequence
  Synthetic
ttgtagagctatccgcaacatacctacaagaataagacagggctttgaagcagctttgctataaaatggggggca

SEQ ID NO: 184981 - DNA, 75 bp, Artificial Sequence
  Synthetic
accatgccataatgtcagcacagtacaatgcacacatggaattaaaccagtggtatcaactcaactattgttaaa

SEQ ID NO: 184982 - DNA, 75 bp, Artificial Sequence
  Synthetic
gtactcaactaatattaaatgggacactctctgaaggaaacataagaattatgggaaaaaatatttcagacaata

SEQ ID NO: 184983 - DNA, 75 bp, Artificial Sequence
  Synthetic
gtacagcatgagcctggcccaagagggaaaaccaaataactcaaggatagcctattgcaagtataacatctctga

SEQ ID NO: 184984 - DNA, 75 bp, Artificial Sequence
  Synthetic
ggaaaaccaaataactcaaggatagcctattgcaagtataacatctctgattgggaaaaagccttaaaacagaca

SEQ ID NO: 184985 - DNA, 75 bp, Artificial Sequence
  Synthetic
ctcaggtacctttaagaccaatgacttataaggcagcattcgatctcggcttctttttaaaagaaaaggggggac

SEQ ID NO: 184986 - DNA, 75 bp, Artificial Sequence
  Synthetic
atgaaacatatagtatgggcaagcagggagttagaaagattcgcacttaaccctgacctattagaaacagcagaa

SEQ ID NO: 184987 - DNA, 75 bp, Artificial Sequence
  Synthetic
atgaaacatatagtatgggcaagcagggagttagaaagattcgcacttaaccctgaccttttagaaacagcagaa

SEQ ID NO: 184988 - DNA, 75 bp, Artificial Sequence
  Synthetic
atgaaacatatagtatgggcaagcagggagttagaaagattcgcacttaaccctgacctcttagaaacagcagaa

SEQ ID NO: 184989 - DNA, 75 bp, Artificial Sequence
  Synthetic
atgaaacatatagtatgggcaagcagggagttagaaagattcgcacttaaccctgacctgttagaaacagcagaa

SEQ ID NO: 184990 - DNA, 75 bp, Artificial Sequence
  Synthetic
atgaaacatatagtatgggcaagcagggagttagaaagattcgcacttaaccctgtcctattagaaacagcagaa

SEQ ID NO: 184991 - DNA, 75 bp, Artificial Sequence
  Synthetic
atgaaacatatagtatgggcaagcagggagttagaaagattcgcacttaaccctgtccttttagaaacagcagaa

SEQ ID NO: 184992 - DNA, 75 bp, Artificial Sequence
  Synthetic
atgaaacatatagtatgggcaagcagggagttagaaagattcgcacttaaccctgtcctcttagaaacagcagaa

SEQ ID NO: 184993 - DNA, 75 bp, Artificial Sequence
  Synthetic
atgaaacatatagtatgggcaagcagggagttagaaagattcgcacttaaccctgtcctgttagaaacagcagaa

SEQ ID NO: 184994 - DNA, 75 bp, Artificial Sequence
  Synthetic
atgaaacatatagtatgggcaagcagggagttagaaagattcgcacttaaccctgccctattagaaacagcagaa

SEQ ID NO: 184995 - DNA, 75 bp, Artificial Sequence
  Synthetic
atgaaacatatagtatgggcaagcagggagttagaaagattcgcacttaaccctgcccttttagaaacagcagaa

SEQ ID NO: 184996 - DNA, 75 bp, Artificial Sequence
  Synthetic
atgaaacatatagtatgggcaagcagggagttagaaagattcgcacttaaccctgccctcttagaaacagcagaa

SEQ ID NO: 184997 - DNA, 75 bp, Artificial Sequence
  Synthetic
atgaaacatatagtatgggcaagcagggagttagaaagattcgcacttaaccctgccctgttagaaacagcagaa

SEQ ID NO: 184998 - DNA, 75 bp, Artificial Sequence
  Synthetic
atgaaacatatagtatgggcaagcagggagttagaaagattcgcacttaaccctggcctattagaaacagcagaa

SEQ ID NO: 184999 - DNA, 75 bp, Artificial Sequence
  Synthetic
atgaaacatatagtatgggcaagcagggagttagaaagattcgcacttaaccctggccttttagaaacagcagaa

SEQ ID NO: 185000 - DNA, 75 bp, Artificial Sequence
  Synthetic
atgaaacatatagtatgggcaagcagggagttagaaagattcgcacttaaccctggcctcttagaaacagcagaa

SEQ ID NO: 185001 - DNA, 75 bp, Artificial Sequence
  Synthetic
atgaaacatatagtatgggcaagcagggagttagaaagattcgcacttaaccctggcctgttagaaacagcagaa

SEQ ID NO: 185002 - DNA, 75 bp, Artificial Sequence
  Synthetic
gaccaatggacatatcaaatttatcaagagccatacaaaaatctgaaaacaggaaaatatgcaaaaagggggtct

SEQ ID NO: 185003 - DNA, 75 bp, Artificial Sequence
  Synthetic
ctcaggaggggacctagaaattacaacacatagctttaattgtggaggagaatttttctattgcaatacatcaaa

SEQ ID NO: 185004 - DNA, 75 bp, Artificial Sequence
  Synthetic
gtaaacaaataataagacagctacaaccagctcttcagacaggaacagaggaacttaaatcattatacaacacag

SEQ ID NO: 185005 - DNA, 75 bp, Artificial Sequence
  Synthetic
ggatacagggagggtcaggactctatgcacctcccaggaaaggtaacctaacatgcagctcactcataactggaa

SEQ ID NO: 185006 - DNA, 75 bp, Artificial Sequence
  Synthetic
ccataagtatatttcaaagaaagccaagaactggatttatagacctcactatgaaagtgctcatccaagaataag

SEQ ID NO: 185007 - DNA, 75 bp, Artificial Sequence
  Synthetic
gggctgctctggaaaactcatctgcaccactgctgtgccttggaactctagttggagtaataagtctcaagagga

SEQ ID NO: 185008 - DNA, 75 bp, Artificial Sequence
  Synthetic
ggggctgtaagggaaagctaatctgctacacatcagtaaaatggaacacgacatggacaaattgcacaaatacca

SEQ ID NO: 185009 - DNA, 75 bp, Artificial Sequence
  Synthetic
tatcctttagcttccctcagatcactctttggcaacgacccctcgtcacaataaaggtaggggggcaactaaagg

SEQ ID NO: 185010 - DNA, 75 bp, Artificial Sequence
  Synthetic
cagtattccaagaaatgagtttgccaggaagatggaaaccaaaaataattggaggaattggaggttttatgaaag

SEQ ID NO: 185011 - DNA, 75 bp, Artificial Sequence
  Synthetic
taataggggtgagaattgttatgatagtacttaatctagtgaaaaacattaggcagggatatcaacccctctcat

SEQ ID NO: 185012 - DNA, 75 bp, Artificial Sequence
  Synthetic
ggaagcagaagcgccaggaggaacaggagaaggaggtggagaacgaggcatgcccacgttgataccctggccgca

SEQ ID NO: 185013 - DNA, 75 bp, Artificial Sequence
  Synthetic
gaacttctgggacacagcagtctcaagggactgagacgggggtgggaaggcctcaaatatctggggaatcttctg

SEQ ID NO: 185014 - DNA, 75 bp, Artificial Sequence
  Synthetic
aaaaatagacaggttaattgagagaataagagaaagagcagaagacagtggcaatgagagtgaaggggatacaga

SEQ ID NO: 185015 - DNA, 75 bp, Artificial Sequence
  Synthetic
tgtgggttactgtctactatggggtgcctgtgtggaaggacgcagagaccaccctattttgtgcatcagatgcta

SEQ ID NO: 185016 - DNA, 75 bp, Artificial Sequence
  Synthetic
cacaaatagatcctgacctagcagaccaactgattcatctgcattattttaactgtttttcagactctgccataa

SEQ ID NO: 185017 - DNA, 75 bp, Artificial Sequence
  Synthetic
cccaccagaggagagcttcaggtttggggaagagacaacaactccctctcagaagcaggagccgatagacaagga

SEQ ID NO: 185018 - DNA, 75 bp, Artificial Sequence
  Synthetic
gaaccatgtgcacctggagtaggacaaatctccagggaattagcagctagaggagggataccaagttcctatact

SEQ ID NO: 185019 - DNA, 75 bp, Artificial Sequence
  Synthetic
cctcaaaacaatgcagcccttgcattcctagaaagtcaccaagatgaagaagtaggcttcccagtaagacctcaa

SEQ ID NO: 185020 - DNA, 75 bp, Artificial Sequence
  Synthetic
agtctaaagccatgtgtaaaattaaccccactctgtgttactttaaattgcagtaattacatcccaccctgtgtt

SEQ ID NO: 185021 - DNA, 75 bp, Artificial Sequence
  Synthetic
atatagaattgaagatacacagcaggcaataaaaaaattgagggaagtaatgggaagcaagaaatctgcaagtga

SEQ ID NO: 185022 - DNA, 75 bp, Artificial Sequence
  Synthetic
atatagaattgaagatacacagcaggcaataaaaaaattgagggaagtaatgggaagcatgaaatctgcaagtga

SEQ ID NO: 185023 - DNA, 75 bp, Artificial Sequence
  Synthetic
atatagaattgaagatacacagcaggcaataaaaaaattgagggaagtaatgggaagcacgaaatctgcaagtga

SEQ ID NO: 185024 - DNA, 75 bp, Artificial Sequence
  Synthetic
atatagaattgaagatacacagcaggcaataaaaaaattgagggaagtaatgggaagcaggaaatctgcaagtga

SEQ ID NO: 185025 - DNA, 75 bp, Artificial Sequence
  Synthetic
atatagaattgaagatacacagcaggcaataaaaaaattgagggaagtaatgggtagcaagaaatctgcaagtga

SEQ ID NO: 185026 - DNA, 75 bp, Artificial Sequence
  Synthetic
atatagaattgaagatacacagcaggcaataaaaaaattgagggaagtaatgggtagcatgaaatctgcaagtga

SEQ ID NO: 185027 - DNA, 75 bp, Artificial Sequence
  Synthetic
atatagaattgaagatacacagcaggcaataaaaaaattgagggaagtaatgggtagcacgaaatctgcaagtga

SEQ ID NO: 185028 - DNA, 75 bp, Artificial Sequence
  Synthetic
atatagaattgaagatacacagcaggcaataaaaaaattgagggaagtaatgggtagcaggaaatctgcaagtga

SEQ ID NO: 185029 - DNA, 75 bp, Artificial Sequence
  Synthetic
atatagaattgaagatacacagcaggcaataaaaaaattgagggaagtaatgggcagcaagaaatctgcaagtga

SEQ ID NO: 185030 - DNA, 75 bp, Artificial Sequence
  Synthetic
atatagaattgaagatacacagcaggcaataaaaaaattgagggaagtaatgggcagcatgaaatctgcaagtga

SEQ ID NO: 185031 - DNA, 75 bp, Artificial Sequence
  Synthetic
atatagaattgaagatacacagcaggcaataaaaaaattgagggaagtaatgggcagcacgaaatctgcaagtga

SEQ ID NO: 185032 - DNA, 75 bp, Artificial Sequence
  Synthetic
atatagaattgaagatacacagcaggcaataaaaaaattgagggaagtaatgggcagcaggaaatctgcaagtga

SEQ ID NO: 185033 - DNA, 75 bp, Artificial Sequence
  Synthetic
atatagaattgaagatacacagcaggcaataaaaaaattgagggaagtaatggggagcaagaaatctgcaagtga

SEQ ID NO: 185034 - DNA, 75 bp, Artificial Sequence
  Synthetic
atatagaattgaagatacacagcaggcaataaaaaaattgagggaagtaatggggagcatgaaatctgcaagtga

SEQ ID NO: 185035 - DNA, 75 bp, Artificial Sequence
  Synthetic
atatagaattgaagatacacagcaggcaataaaaaaattgagggaagtaatggggagcacgaaatctgcaagtga

SEQ ID NO: 185036 - DNA, 75 bp, Artificial Sequence
  Synthetic
atatagaattgaagatacacagcaggcaataaaaaaattgagggaagtaatggggagcaggaaatctgcaagtga

SEQ ID NO: 185037 - DNA, 75 bp, Artificial Sequence
  Synthetic
ataataatgccacttgtgttaataacatgaaggaagaaataaaaaattgctctttcagtataaccacagtgataa

SEQ ID NO: 185038 - DNA, 75 bp, Artificial Sequence
  Synthetic
taccaaatgcacaaggacaaatggtgcatcagcccatctcccccaggactttgaatgcatgggtaaaggcagtag

SEQ ID NO: 185039 - DNA, 75 bp, Artificial Sequence
  Synthetic
tagtatgggcaagcagggagctggaaagattcgcacttaaccctagccttttagaaacaacagaaggatgtcaac

SEQ ID NO: 185040 - DNA, 75 bp, Artificial Sequence
  Synthetic
aacttgtgggtcacagtctattatggggtacctgtgtgggaagatgcagatacccctctattttgtgcatctgat

SEQ ID NO: 185041 - DNA, 75 bp, Artificial Sequence
  Synthetic
agatgtaaaagacaccaaggaagctctagataaaatagaggaaatacaaaataagagcaagcaaaaagcacaaca

SEQ ID NO: 185042 - DNA, 75 bp, Artificial Sequence
  Synthetic
agagttagtcagtcaaataatagaacagttaataaaaaaggaaaaggtctacctggcatgggtaccagcacacaa

SEQ ID NO: 185043 - DNA, 75 bp, Artificial Sequence
  Synthetic
aggaagagcattttatgcaacaggaaatataataggaaatataagacaagcacattgcaatattagtaaagcagg

SEQ ID NO: 185044 - DNA, 75 bp, Artificial Sequence
  Synthetic
gggctacacatgcctgtgtacctacagaccccaacccacaagaaatagagttgaaaaatgtaacagaaaatttta

SEQ ID NO: 185045 - DNA, 75 bp, Artificial Sequence
  Synthetic
aatgaagaaataaaaaactgttctttcaatataaccacagagatacaagataagaagaagacagtatacgcgctt

SEQ ID NO: 185046 - DNA, 75 bp, Artificial Sequence
  Synthetic
acatttaattcatcctcaggaggggacctagaaattacaagtcatacctttaattgtagaggagaatttttctat

SEQ ID NO: 185047 - DNA, 75 bp, Artificial Sequence
  Synthetic
tggcaacgaccccttgtcacaataaaagtagggggacagttaaaggaggctctcttagacacaggagcagatgat

SEQ ID NO: 185048 - DNA, 75 bp, Artificial Sequence
  Synthetic
ttcagccctacaatagtagtgagggtaaggaaataaaaaattgctctttcaatgcaaccacagaattaaaaaaca

SEQ ID NO: 185049 - DNA, 75 bp, Artificial Sequence
  Synthetic
caccaaatgaaagattgcagaaatggaaaacaggcaaattttttagggaaatactggcctccggggggcacgagg

SEQ ID NO: 185050 - DNA, 75 bp, Artificial Sequence
  Synthetic
agcaggaaaaaaatgaacaagacttattagcattggacaagtgggcaagtctgtggaattggtttgacatatcaa

SEQ ID NO: 185051 - DNA, 75 bp, Artificial Sequence
  Synthetic
aagaaaaagtataagattcggaccaggacaagcgttctatgcaacaggtgatataataggagatataagacaagc

SEQ ID NO: 185052 - DNA, 75 bp, Artificial Sequence
  Synthetic
ttggaatagtagttggaataataaaactcagaaggagatttgggataacatgacctggatgcagtgggataaaga

SEQ ID NO: 185053 - DNA, 75 bp, Artificial Sequence
  Synthetic
tctatgcaacaggaggaataataggggacataagacaagcacattgtaacattagtgaaaagagctggcatgaaa

SEQ ID NO: 185054 - DNA, 75 bp, Artificial Sequence
  Synthetic
ctttaattgtagaggagaattcttctattgtaacacatcaggcctgtttaatagtacatacatacttaatggtac

SEQ ID NO: 185055 - DNA, 75 bp, Artificial Sequence
  Synthetic
actagagcttttagaggagcttaagaatgaagctgttagacattttcctaggccatggcttcatggcttagggca

SEQ ID NO: 185056 - DNA, 75 bp, Artificial Sequence
  Synthetic
taatagcaatagttgtgtggtccatagtattcatagaatataggagaatattaagacaaagaatagtaccctgtg

SEQ ID NO: 185057 - DNA, 75 bp, Artificial Sequence
  Synthetic
actatacaagaaaaagtatatatttaggaccaggacgagcatttcatacagcaggaaaaataataggagacatca

SEQ ID NO: 185058 - DNA, 75 bp, Artificial Sequence
  Synthetic
actatacaagaaaaagtatatattttggaccaggacgagcatttcatacagcaggaaaaataataggagacatca

SEQ ID NO: 185059 - DNA, 75 bp, Artificial Sequence
  Synthetic
actatacaagaaaaagtatatatttcggaccaggacgagcatttcatacagcaggaaaaataataggagacatca

SEQ ID NO: 185060 - DNA, 75 bp, Artificial Sequence
  Synthetic
actatacaagaaaaagtatatatttgggaccaggacgagcatttcatacagcaggaaaaataataggagacatca

SEQ ID NO: 185061 - DNA, 75 bp, Artificial Sequence
  Synthetic
ataagaacatattggggtctgcagacaggagaaaaggactggcacttgggtcatggagtctccatagaatggagg

SEQ ID NO: 185062 - DNA, 75 bp, Artificial Sequence
  Synthetic
aagaatttgcagagcttttcgccacgtacctagaagaataagacagggcttggaaaggattttgctataagatgg

SEQ ID NO: 185063 - DNA, 75 bp, Artificial Sequence
  Synthetic
gagctaaaaaagagtgctgttagtctgcttgataccatagcaatagtagtagctgaaggaacagataggattata

SEQ ID NO: 185064 - DNA, 75 bp, Artificial Sequence
  Synthetic
atgtatgccgctcccattgaaggaaacattacctgtaactcaaatattacaggtctactattgacaagagatggt

SEQ ID NO: 185065 - DNA, 75 bp, Artificial Sequence
  Synthetic
ttccagacccttacccaccaccagagggaacccgacaggcccgaaagaatcgaagaaggaggtggcgagcaagac

SEQ ID NO: 185066 - DNA, 75 bp, Artificial Sequence
  Synthetic
gtagagccagcagcagagggagtaggagcagcatctcaagacttagataaacatggagcacttacaagtagcaac

SEQ ID NO: 185067 - DNA, 75 bp, Artificial Sequence
  Synthetic
tcaactgctgttaaatggcagtctagcagaagaagaggtagtaattagatctgccaatttcacggacaatgctaa

SEQ ID NO: 185068 - DNA, 75 bp, Artificial Sequence
  Synthetic
ccaacaacaatacaagaaaaggtatacatataggaccagggagagcattttatgcaacaggagaaataataggag

SEQ ID NO: 185069 - DNA, 75 bp, Artificial Sequence
  Synthetic
aaaatatgttgctggcattgtcaactatgctttctgaaaaaaggcttaggcatctcctatggcaggaagaagcgg

SEQ ID NO: 185070 - DNA, 75 bp, Artificial Sequence
  Synthetic
tatgcaacaggagaaataataggagatataagacaagcacattgtaaccttagtagagcagaatggaataacact

SEQ ID NO: 185071 - DNA, 75 bp, Artificial Sequence
  Synthetic
gaaaattttaacatgtggaaaaataacatggtagaacagatgcaagaggatataatcagtttatgggatcaaagt

SEQ ID NO: 185072 - DNA, 75 bp, Artificial Sequence
  Synthetic
tataatcagtttatgggatcaaagtctaaagccatgtgtaaaattaaccccactctgtgttactttaaattgcac

SEQ ID NO: 185073 - DNA, 75 bp, Artificial Sequence
  Synthetic
caagtctgtggaattggtttgacatatcaaattggctgtggtatataaaaatattcataatgatagtaggaggct

SEQ ID NO: 185074 - DNA, 75 bp, Artificial Sequence
  Synthetic
accacaagcttaagaggtaaggttcagagagaatatgcacttttttataaacttgatgtagtaccaatagatggt

SEQ ID NO: 185075 - DNA, 75 bp, Artificial Sequence
  Synthetic
tacaagaccctaccacaatataagaagatggatacatataggaccagggagagcattttatgccgcaaaaggcat

SEQ ID NO: 185076 - DNA, 75 bp, Artificial Sequence
  Synthetic
gatcaaagtctaaagccatgtgtaaagttaactcctctctgcgttactttaaattgtaccaatgctaaattgaat

SEQ ID NO: 185077 - DNA, 75 bp, Artificial Sequence
  Synthetic
aatcattgctaattgtcctaaatgtcatataaaaggggaagcaattcatggtcaggtagactgcagtccagaagt

SEQ ID NO: 185078 - DNA, 75 bp, Artificial Sequence
  Synthetic
ctgttcttttaatataaccacagaactaagagataagaagcagaaggtctatgcacttttttataagcttgatat

SEQ ID NO: 185079 - DNA, 75 bp, Artificial Sequence
  Synthetic
aagctgtagtgattaattgtacaagacccaacaacaatacaagaaaaaggataaccacgggaccaggaagggtac

SEQ ID NO: 185080 - DNA, 75 bp, Artificial Sequence
  Synthetic
tgaatccaacagtaatagcacaagcatagataaagagatgatgatgaattgctctttcaatataaccacagaagt

SEQ ID NO: 185081 - DNA, 75 bp, Artificial Sequence
  Synthetic
ccctctattgtgtacatcaaaggatagatgtaaaagacaccaaagaagctctagaggaagtggaaaagatacaaa

SEQ ID NO: 185082 - DNA, 75 bp, Artificial Sequence
  Synthetic
caaaattatcctatagtgcagaatgcacaagggcaaatggtacaccaggccatatcacctagaactttaaatgca

SEQ ID NO: 185083 - DNA, 75 bp, Artificial Sequence
  Synthetic
ggagtaatagatctcaggatgatatttggaataacaataacttgacctggatgcagtgggaaagagaaattgaaa

SEQ ID NO: 185084 - DNA, 75 bp, Artificial Sequence
  Synthetic
gacagaaagtgaaaacgtggaacagcttggtgaaataccataaacacagatctagaaagaccaaggaatggcatt

SEQ ID NO: 185085 - DNA, 75 bp, Artificial Sequence
  Synthetic
gtcagaaagtgaaaacgtggaacagcttggtgaaataccataaacacagatctagaaagaccaaggaatggcatt

SEQ ID NO: 185086 - DNA, 75 bp, Artificial Sequence
  Synthetic
gccagaaagtgaaaacgtggaacagcttggtgaaataccataaacacagatctagaaagaccaaggaatggcatt

SEQ ID NO: 185087 - DNA, 75 bp, Artificial Sequence
  Synthetic
ggcagaaagtgaaaacgtggaacagcttggtgaaataccataaacacagatctagaaagaccaaggaatggcatt

SEQ ID NO: 185088 - DNA, 75 bp, Artificial Sequence
  Synthetic
atgctgattgtgcctggctagaagcacaagaggaggaggaggtgggttttccagtcagacctcaggtacctttaa

SEQ ID NO: 185089 - DNA, 75 bp, Artificial Sequence
  Synthetic
acatcaaatgaaagactgcacagagagacaggctaattttttagggaaaatctggccttccaacaaggggaggcc

SEQ ID NO: 185090 - DNA, 75 bp, Artificial Sequence
  Synthetic
cagataagggaacctaggggaagtgatatagctggaactactagtacccttcaggaacaaatacaatggatgaca

SEQ ID NO: 185091 - DNA, 75 bp, Artificial Sequence
  Synthetic
ttgggcaagtcaaatttatgcaggaattaaagtaaagcaactgtgtaaactcctcaggggagccaaagcactaac

SEQ ID NO: 185092 - DNA, 75 bp, Artificial Sequence
  Synthetic
gatgcatatttttcagttcctttagatgaaggctttaggaaatatactgcattcaccatacctagtataaacaat

SEQ ID NO: 185093 - DNA, 75 bp, Artificial Sequence
  Synthetic
cagcaagcagcagctgacacaggaaacaacagccaggtcagccaaaattaccctatagtgcagaacctccagggg

SEQ ID NO: 185094 - DNA, 75 bp, Artificial Sequence
  Synthetic
atcaacagctcctagggatgtggggctgctctggaaaactcatctgcaccactaatgtgccttggaatgacactt

SEQ ID NO: 185095 - DNA, 75 bp, Artificial Sequence
  Synthetic
ggaatcacaaagccagcaggaaaagaatgaaaaagacttattggcattggacaagtgggcaaatctgtggaattg

SEQ ID NO: 185096 - DNA, 75 bp, Artificial Sequence
  Synthetic
actttgtgttactttacactgtagtaatgttcaaagtaatgctacctacgagaatggcacaaaagaagaaatgaa

SEQ ID NO: 185097 - DNA, 75 bp, Artificial Sequence
  Synthetic
taggactttggggctgctctggaaaaatcatctgcaccactgctgtgccctggaactcctcttggagtaataaat

SEQ ID NO: 185098 - DNA, 75 bp, Artificial Sequence
  Synthetic
aatattaataattactagtgctttgctgcttataaatgtaattctatggctgtttgttcttaagcaatgtttaga

SEQ ID NO: 185099 - DNA, 75 bp, Artificial Sequence
  Synthetic
cttttgaagagatttgggacaacatgacatggatagaatgggagagagaaattagcaattacacaagccaaatat

SEQ ID NO: 185100 - DNA, 75 bp, Artificial Sequence
  Synthetic
ctgcttataaatgtaattctatggctgtttgttcttaagcaatgtttagaacaaaagaaacaaactaaaagagaa

SEQ ID NO: 185101 - DNA, 75 bp, Artificial Sequence
  Synthetic
gcctgggacgacctgcggagcctgtgcctcttcagctaccaccgcttgagagacttcatcttgattgtagcgagg

SEQ ID NO: 185102 - DNA, 75 bp, Artificial Sequence
  Synthetic
ccagagccaacagccccgccagcagagagcttcgggttcagagaggagacaaccccctctccgaagcaggagcag

SEQ ID NO: 185103 - DNA, 75 bp, Artificial Sequence
  Synthetic
gcctggctagaagcacaagaggaggaagaagtgggtttcccagttagacctcaggtacctttaaggccaatgact

SEQ ID NO: 185104 - DNA, 75 bp, Artificial Sequence
  Synthetic
tctgtgcttcagatgttaacctaacaagcactgagaagcataatatttgggcatcacaagcctgtgttcccacag

SEQ ID NO: 185105 - DNA, 75 bp, Artificial Sequence
  Synthetic
aaatgcaggaagacattattagtttatgggaacagagtttaaaaccttgtgttcaaatgactttcctgtgtgtac

SEQ ID NO: 185106 - DNA, 75 bp, Artificial Sequence
  Synthetic
acattctatgcaacaggagacataataggagatataagacaagcacattgtaacattagtagaaaagaatggaat

SEQ ID NO: 185107 - DNA, 75 bp, Artificial Sequence
  Synthetic
atgtaaactccttaggggggccaaagcactaacagacatagtaccactgactgcagaagcagaattggaattggc

SEQ ID NO: 185108 - DNA, 75 bp, Artificial Sequence
  Synthetic
cacaggtacctttaagaccaatgacttataagggagcttttgatcttagcttctttttaaaagaaaaggggggac

SEQ ID NO: 185109 - DNA, 75 bp, Artificial Sequence
  Synthetic
tgtggaaaaataacatggtagagcagatgcatacagatataatcagtctatgggaccaaagcctaaagccatgtg

SEQ ID NO: 185110 - DNA, 75 bp, Artificial Sequence
  Synthetic
accaataaaagtaataagacggacaccgaggtggcaggagaaataaaaaactgctcttacaatatgactacaatg

SEQ ID NO: 185111 - DNA, 75 bp, Artificial Sequence
  Synthetic
aaacactatatgatgaaacacctagtatgggcaagcagggagctggaaaaatttgcacttgaacctagcctttta

SEQ ID NO: 185112 - DNA, 75 bp, Artificial Sequence
  Synthetic
aactagtattaaatgggacactctctgaaggaaaaataagaattatgggaaaaaatattacagacagtggaaaaa

SEQ ID NO: 185113 - DNA, 75 bp, Artificial Sequence
  Synthetic
aggatgtcaacaaataatagaacagttacagtcaactctcaagacaggatcagaagaacttaaatcattatttaa

SEQ ID NO: 185114 - DNA, 75 bp, Artificial Sequence
  Synthetic
catgggcataagctcaccactctcaaatgcctcaaggttagcttattgccggtataatgccactgagtggaaaaa

SEQ ID NO: 185115 - DNA, 75 bp, Artificial Sequence
  Synthetic
gattcagagatagcccacttgcattttagctgtcatggagagtttttctattgtaacacaacccagatgtttaat

SEQ ID NO: 185116 - DNA, 75 bp, Artificial Sequence
  Synthetic
gcatgggtaaaagtaatagaggagaaggctttcagcccagaggtaatacccatgtttacagcattatcagaagga

SEQ ID NO: 185117 - DNA, 75 bp, Artificial Sequence
  Synthetic
aagaagtataaggataggaccaggacagacgttctatgcaacaggaggcataataggagatataagaaaagcaca

SEQ ID NO: 185118 - DNA, 75 bp, Artificial Sequence
  Synthetic
tagtaaggtcatggataaggggagagtcgggactctatgcacctcccatcaaaggtcctctaaaatgtgagtcaa

SEQ ID NO: 185119 - DNA, 75 bp, Artificial Sequence
  Synthetic
tagtaaggtcatggataaggggtgagtcgggactctatgcacctcccatcaaaggtcctctaaaatgtgagtcaa

SEQ ID NO: 185120 - DNA, 75 bp, Artificial Sequence
  Synthetic
tagtaaggtcatggataaggggcgagtcgggactctatgcacctcccatcaaaggtcctctaaaatgtgagtcaa

SEQ ID NO: 185121 - DNA, 75 bp, Artificial Sequence
  Synthetic
tagtaaggtcatggataaggggggagtcgggactctatgcacctcccatcaaaggtcctctaaaatgtgagtcaa

SEQ ID NO: 185122 - DNA, 75 bp, Artificial Sequence
  Synthetic
attattttaactgtttttcagactctgccataaggaaagccatattaggacaagtagttagccctagttgtgaat

SEQ ID NO: 185123 - DNA, 75 bp, Artificial Sequence
  Synthetic
tcaggaggggacccagaaattacaaaacacacctttaattgtggaggagaatttttctattgtaacacatcaggc

SEQ ID NO: 185124 - DNA, 75 bp, Artificial Sequence
  Synthetic
aacacacctttaattgtggaggagaatttttctattgtaacacatcaggcctgtttaatagcacttggaatgaga

SEQ ID NO: 185125 - DNA, 75 bp, Artificial Sequence
  Synthetic
ttaatatgaccacagaactaaaagataagaagcagaaggtccatgcacttttttataagcttgatatagtacaaa

SEQ ID NO: 185126 - DNA, 75 bp, Artificial Sequence
  Synthetic
atatgcccctcccattgaaggactaatcaaatgttcatcaaatattacaggactattgttgacaagggatggtgg

SEQ ID NO: 185127 - DNA, 75 bp, Artificial Sequence
  Synthetic
aaatggaataacacatgggcaaacggcactaatctaaatacaatttgggacaacctaacatggcagcaatgggat

SEQ ID NO: 185128 - DNA, 75 bp, Artificial Sequence
  Synthetic
gcatctcctatggcaggaagaagcggagacagcgacgaagagctcctcaggacagtcagactcatcaagcttctc

SEQ ID NO: 185129 - DNA, 75 bp, Artificial Sequence
  Synthetic
ggaaagatacctaagggatcaacagctcctaggaatttggggctgctctggaaagctcatctgcaccactaatgt

SEQ ID NO: 185130 - DNA, 75 bp, Artificial Sequence
  Synthetic
gatagtacttaatctagtgagaaacattaggcagggatatcaacccctctcgtttcagatccccaaccatcacca

SEQ ID NO: 185131 - DNA, 75 bp, Artificial Sequence
  Synthetic
taacaagaattctgcaacaactgctgtttattcatttcagaatcgggtgtcaacatagcagaataggcattattc

SEQ ID NO: 185132 - DNA, 75 bp, Artificial Sequence
  Synthetic
agcatcagggatccagacggtgatcagccatctgggactgggactgtggatcctaggacagaagataattaatgc

SEQ ID NO: 185133 - DNA, 75 bp, Artificial Sequence
  Synthetic
actgacagcatattcttagggatacaaaggataggaagaggaattcttaacatcccaagaagaattagacagggc

SEQ ID NO: 185134 - DNA, 75 bp, Artificial Sequence
  Synthetic
tgtccaaaggtaacctttgagccaattcccatacattattgtgccccagctggttttgcgatcctaaagtgtaag

SEQ ID NO: 185135 - DNA, 75 bp, Artificial Sequence
  Synthetic
cattcctagaaagtcattcagatgaagaagtaggtttcccagtaagacctcaagttcctgtaagaccaatgacct

SEQ ID NO: 185136 - DNA, 75 bp, Artificial Sequence
  Synthetic
gcgtgttgctggcattgccaactttgctttctgaacaaaggcttaggcatttcctatggcaggaagaagcggaga

SEQ ID NO: 185137 - DNA, 75 bp, Artificial Sequence
  Synthetic
attagtgagcggattcttagcacttgcctgggacgacctacggagcctgtgccttttcagctaccaccgcttgag

SEQ ID NO: 185138 - DNA, 75 bp, Artificial Sequence
  Synthetic
agcacaagaagaggacgaggacgtaggctttccagtcagacctcaggttcctttaagaccaatgacgtataaggg

SEQ ID NO: 185139 - DNA, 75 bp, Artificial Sequence
  Synthetic
aaaaatgctacaaacaatgtgagtgggccaattgaggctgggaaggaaatacaaaattgctctttcaacgcaacc

SEQ ID NO: 185140 - DNA, 75 bp, Artificial Sequence
  Synthetic
ggaaggcctcaaatatctggggaatcttctgttatattggggacaggaactaaaaattagtgctatttctttgct

SEQ ID NO: 185141 - DNA, 75 bp, Artificial Sequence
  Synthetic
gaataggcattactcgacagagaagagtaagaaatggagctagtagatcctaacttagatccctggaaccatcca

SEQ ID NO: 185142 - DNA, 75 bp, Artificial Sequence
  Synthetic
agtaagaaatggagctagtagatcctaacttagatccctggaaccatccaggaagccagcctacaactccttgta

SEQ ID NO: 185143 - DNA, 75 bp, Artificial Sequence
  Synthetic
attaccctatagtagcaaatgcacagggacaaatggtacatagtgccatctcccccaggactttaaatgcatggg

SEQ ID NO: 185144 - DNA, 75 bp, Artificial Sequence
  Synthetic
gatataatcagtttatgggatgaaagcctaaagccatgtgtaaagctaacccctctctgtgttactttaaactgt

SEQ ID NO: 185145 - DNA, 75 bp, Artificial Sequence
  Synthetic
aaaaggaaacatgggaaacatggtggacagactattggcaggccacctggattcctgagtgggagtttgtcaata

SEQ ID NO: 185146 - DNA, 75 bp, Artificial Sequence
  Synthetic
aggctttccagtcaggccgcaggtacctctaagaccaatgacttttaagggagcttttgatcttagcttcttttt

SEQ ID NO: 185147 - DNA, 75 bp, Artificial Sequence
  Synthetic
aactgctctttcaatataaccacagagatacaggataaaaagaaacaagaatatgcgcttttctatagacttgat

SEQ ID NO: 185148 - DNA, 75 bp, Artificial Sequence
  Synthetic
ctatcccagtaggagacatctatagaaaatggatagtgttaggattaaacaaaatggtaaaaatgtacagcccag

SEQ ID NO: 185149 - DNA, 75 bp, Artificial Sequence
  Synthetic
ttaagagaacaatttaggaataaaacaatagtctttaaccattcctcaggaggggatccagaaattgtaatgcac

SEQ ID NO: 185150 - DNA, 75 bp, Artificial Sequence
  Synthetic
gtagatcggttctacaaaacattaagagctgagcaagcaactcaagaagtaaaaaattggatgacagaaaccctg

SEQ ID NO: 185151 - DNA, 75 bp, Artificial Sequence
  Synthetic
aacacctagtctgggcaagcagggagctggaaagatttgcacttgaccctggccttttagagacatcaggaggct

SEQ ID NO: 185152 - DNA, 75 bp, Artificial Sequence
  Synthetic
tcacactccaatgcagaataaaacaaattataaacatgtggcagaaagtaggaaaagcaatgtatgcccctccca

SEQ ID NO: 185153 - DNA, 75 bp, Artificial Sequence
  Synthetic
atatagcaaaaaattgtcgagcacctagaaaaaagggttgctggaaatgtggacaggaaggtcaccaaatgaaag

SEQ ID NO: 185154 - DNA, 75 bp, Artificial Sequence
  Synthetic
agctggctggacagatagggttatagaactaggacaaggactttgtagagctattttacacatacctagaagaat

SEQ ID NO: 185155 - DNA, 75 bp, Artificial Sequence
  Synthetic
cagacagggcttagaaagggctttgctataacatggggggcaagtggtcaaaaagtagcatagtgggatggcctg

SEQ ID NO: 185156 - DNA, 75 bp, Artificial Sequence
  Synthetic
aatagaaggaagggaagtacaaggaacagtattggtgggacctactcctgttaatattattggaagaaatatatt

SEQ ID NO: 185157 - DNA, 75 bp, Artificial Sequence
  Synthetic
acagtattggtgggacctactcctgttaatattattggaagaaatatattgacaggattaggttgtacactaaat

SEQ ID NO: 185158 - DNA, 75 bp, Artificial Sequence
  Synthetic
tgccagtaaaactaaaaccaggaatggatggaccaaaagtaaaacaatggcccctatctaaagaaaaaatagaag

SEQ ID NO: 185159 - DNA, 75 bp, Artificial Sequence
  Synthetic
tcacagtctattatggggtacctgtgtggaaagaagcaaacaccactctattttgtgcatcagatgctaaagcat

SEQ ID NO: 185160 - DNA, 75 bp, Artificial Sequence
  Synthetic
ctcaggtgcctttaagaccaatgacttataagggagcattcgatctcggcttctttttaaaagaaaaggggggac

SEQ ID NO: 185161 - DNA, 75 bp, Artificial Sequence
  Synthetic
aagggaaagaaggagaagagatgagccagcagcagtgggggtgggaccagcatctcaagacctagcaaaacatgg

SEQ ID NO: 185162 - DNA, 75 bp, Artificial Sequence
  Synthetic
ggaatggagggaggagaaataaaaaactgctctttcaatatcaccacaaacataagagataaggtgcagcaacaa

SEQ ID NO: 185163 - DNA, 75 bp, Artificial Sequence
  Synthetic
tggaaaactcatctgcaccactaatgtgccctggaactctagttggagtaataaatctcaggaggagatttggga

SEQ ID NO: 185164 - DNA, 75 bp, Artificial Sequence
  Synthetic
tcttatatcaaagcagtaagtactaaatagtatatgtaatgttaagtttattagcaagagtagattatagattag

SEQ ID NO: 185165 - DNA, 75 bp, Artificial Sequence
  Synthetic
gggcaagtctgtggaattggtttagcatatcaaactggctgtggtatataaaaatattcataatgatagtaggag

SEQ ID NO: 185166 - DNA, 75 bp, Artificial Sequence
  Synthetic
catatcaaactggctgtggtatataaaaatattcataatgatagtaggaggcttgataggcttaagaatagtttt

SEQ ID NO: 185167 - DNA, 75 bp, Artificial Sequence
  Synthetic
acagcaggcaaaagcggctgacgggaaagtcagtcaaaattaccctatagtgcagaatctccaagggcaaatggt

SEQ ID NO: 185168 - DNA, 75 bp, Artificial Sequence
  Synthetic
accagggagagcatttattggaacagacatagaaggaaatataagacaagcatattgtaacattagtggagaaga

SEQ ID NO: 185169 - DNA, 75 bp, Artificial Sequence
  Synthetic
gaaagattgtactgagagacaggctaattttttagggaaaatctggccttcccacaaggggaggccagggaattt

SEQ ID NO: 185170 - DNA, 75 bp, Artificial Sequence
  Synthetic
tatagttcagcagataatagaggaactaacaaacaaggaacaggtgtatcttacatgggttcctgctcataaagg

SEQ ID NO: 185171 - DNA, 75 bp, Artificial Sequence
  Synthetic
gagcagaaagacagggaacaggccccacccttagtttccctcaaatcactctttggcaacgacccattgtcacag

SEQ ID NO: 185172 - DNA, 75 bp, Artificial Sequence
  Synthetic
agctgtactaattatggtaatattccccacaacaataccataaggggagaaataaaaaattgcactttcaatacg

SEQ ID NO: 185173 - DNA, 75 bp, Artificial Sequence
  Synthetic
gtcacagtaaagataggggggcagctaaaggaagctctattagatacaggagcagatgatacagtattagaagaa

SEQ ID NO: 185174 - DNA, 75 bp, Artificial Sequence
  Synthetic
atgcctgtgtacccacagaccccaacccacaagaagtagtattgaaaaatgtgacagaaaattttaacatgtgga

SEQ ID NO: 185175 - DNA, 75 bp, Artificial Sequence
  Synthetic
aggacaagcaatgtatgctcctcccatcagtggaaaaattaattgtgtatcaaatattacaggaatactattgac

SEQ ID NO: 185176 - DNA, 75 bp, Artificial Sequence
  Synthetic
aagtatacatataggaccagggagagcattttatacaacaggagaaataataggagatataagacaagcacattg

SEQ ID NO: 185177 - DNA, 75 bp, Artificial Sequence
  Synthetic
taaaacacagattgaccctgaaacagcagacaggatgatacatctgcattatttcacctgttttacaaagtcagc

SEQ ID NO: 185178 - DNA, 75 bp, Artificial Sequence
  Synthetic
cctcaaatcactctttggcaacgaccagtagtcacaataaaagtagggggacagctaaaggaagctctattagat

SEQ ID NO: 185179 - DNA, 75 bp, Artificial Sequence
  Synthetic
caggattcaggatcagaagtaaacatagtaacagactcacaatatgcattaggaatcattcaagcacaaccagat

SEQ ID NO: 185180 - DNA, 75 bp, Artificial Sequence
  Synthetic
ttggattcaggagctaaagaatagtgctgttagcttgcttgataccgtagctatagcagtagctgaggggacaga

SEQ ID NO: 185181 - DNA, 75 bp, Artificial Sequence
  Synthetic
attattagtgctttgctgcttataaatataattctatggatgtttattcttaaacaatgtatagaacaaaagaaa

SEQ ID NO: 185182 - DNA, 75 bp, Artificial Sequence
  Synthetic
caaatggtcaaaaagtagcatagtgggatggcctgaggttagggaaagaatgagacgtgctcctccagcagcaga

SEQ ID NO: 185183 - DNA, 75 bp, Artificial Sequence
  Synthetic
ggatggcctgaggttagggaaagaatgagacgtgctcctccagcagcagaaggagtaggagcagcgtctcaagac

SEQ ID NO: 185184 - DNA, 75 bp, Artificial Sequence
  Synthetic
ttagggaccttgtacatagtcatggctttgataatcccatgtttgagccatgaccagctgtatgcaacagtcttt

SEQ ID NO: 185185 - DNA, 75 bp, Artificial Sequence
  Synthetic
agagccattctccacatacctagaagaatcagacagggcttagaaagggctttgctataacatgggaggcaagtg

SEQ ID NO: 185186 - DNA, 75 bp, Artificial Sequence
  Synthetic
agaactaaaaaactgctcttacaacatgaccacagaattaagggataagaaaaagaaagtatattcactctttta

SEQ ID NO: 185187 - DNA, 75 bp, Artificial Sequence
  Synthetic
tacaaacgtaaacggaacaaacgcaaacggaaccaggaaagagcaagagcaacttatgaaacagtgtgagtttaa

SEQ ID NO: 185188 - DNA, 75 bp, Artificial Sequence
  Synthetic
tatacattaattaattgtaattccacaaccattaagcaagcctgtccaaaggtaacttttgagccaattccaata

SEQ ID NO: 185189 - DNA, 75 bp, Artificial Sequence
  Synthetic
tttgctataaaatgggtggcaagtggtcaaaacgtagtgtgtttggatggtctgctataagggaaagaatgagac

SEQ ID NO: 185190 - DNA, 75 bp, Artificial Sequence
  Synthetic
cattgccaagtttgtttcacaacaaaaggcttaggcatctcctatggcaggaagaagcggagacagcgacgaaga

SEQ ID NO: 185191 - DNA, 75 bp, Artificial Sequence
  Synthetic
gagttcaatggaacagggccatgcaagaatgttagcacagtacaatgcacacatggaatcaagccagtagtatca

SEQ ID NO: 185192 - DNA, 75 bp, Artificial Sequence
  Synthetic
tcaactagtattaaatgggacactctctaaagaaaaaataaggattatgggaaaaaatatttcagacagtgcaaa

SEQ ID NO: 185193 - DNA, 75 bp, Artificial Sequence
  Synthetic
tgcctggctagaagcacaagaggaggaggaggtgggttttccagtcagacctcaggtacctttaagaccaatgac

SEQ ID NO: 185194 - DNA, 75 bp, Artificial Sequence
  Synthetic
agcatgggcataatcagagaggaaaaatcctcaaacctctcaaggttagcctattgcaagtataatatcactgac

SEQ ID NO: 185195 - DNA, 75 bp, Artificial Sequence
  Synthetic
aatcctcaaacctctcaaggttagcctattgcaagtataatatcactgactgggaaaaagccttaaaacaagtag

SEQ ID NO: 185196 - DNA, 75 bp, Artificial Sequence
  Synthetic
aatgcaaccacagaactaagagataagaaaaagaaggagtatgcacttttttatagacttgatatagtaccactt

SEQ ID NO: 185197 - DNA, 75 bp, Artificial Sequence
  Synthetic
taactgtcatggagagttcttctattgtaacacatctgggatgtttaattatactttctcatgtaaaggaaccaa

SEQ ID NO: 185198 - DNA, 75 bp, Artificial Sequence
  Synthetic
ggagaagagtcagggatggatccggtagaccctaacctagagccctggaaccatccgggaagtcagcctacaact

SEQ ID NO: 185199 - DNA, 75 bp, Artificial Sequence
  Synthetic
aacagatagtaaggtcatggatgaggggagagtcgggactctatgcacctcccatcaaaggtaatctaacatgta

SEQ ID NO: 185200 - DNA, 75 bp, Artificial Sequence
  Synthetic
catgcaataatgtcagcacagtacaatgtacacatggaattaagccagtggtatcaactcaactgctgttaaatg

SEQ ID NO: 185201 - DNA, 75 bp, Artificial Sequence
  Synthetic
tgcatatctgtgcaatagtaggactggtagtggcactaatcctagcaatagttgtgtggactatagtaggtatag

SEQ ID NO: 185202 - DNA, 75 bp, Artificial Sequence
  Synthetic
agagaaaaaagagcagtaggattgggaatgctattcttgggggttctaagtgcagcaggtagcactatgggcgca

SEQ ID NO: 185203 - DNA, 75 bp, Artificial Sequence
  Synthetic
gaaaatagacaggttaattaagagaataagtgaaagagcagaagacagtggcaatgagagcgatggggacacaga

SEQ ID NO: 185204 - DNA, 75 bp, Artificial Sequence
  Synthetic
ttagaaaccttaatacagaatcagcaactcctaaacctatggggttgtaagggaaggctaatctgttacacatca

SEQ ID NO: 185205 - DNA, 75 bp, Artificial Sequence
  Synthetic
aactcctaaacctatggggttgtaagggaaggctaatctgttacacatcagtaaaatggaacgatacatggacaa

SEQ ID NO: 185206 - DNA, 75 bp, Artificial Sequence
  Synthetic
ggttttatagacatcactatgaaagcaggcatccaaaagtaagttcagaagtacacatcccactaggggatgcta

SEQ ID NO: 185207 - DNA, 75 bp, Artificial Sequence
  Synthetic
caagaataataggagacacaaggcgagcacattgtaatgttagtggagaagattggaataagactttaagccatg

SEQ ID NO: 185208 - DNA, 75 bp, Artificial Sequence
  Synthetic
atttaacatgtggaaaaataacatggtagagcagatgcatgaagatataatcagtctatgggatcaaagcctaaa

SEQ ID NO: 185209 - DNA, 75 bp, Artificial Sequence
  Synthetic
gaaataaaaaactgctctttcaatatgaccacagaattaagggataagcaacagaaaatacattcacttttttat

SEQ ID NO: 185210 - DNA, 75 bp, Artificial Sequence
  Synthetic
agggaaagagcagaagacagtggcaatgagagtgagggggatattgaggaattgtcaacaatggtggatatgggg

SEQ ID NO: 185211 - DNA, 75 bp, Artificial Sequence
  Synthetic
ctaataataataatactgccagtaatagttctgattgggaaaagatggagggagaaataaaaaactgctctttca

SEQ ID NO: 185212 - DNA, 75 bp, Artificial Sequence
  Synthetic
actctattttgtgcatcagatgctaaagcatatgatacagaggtacataatgtctgggctacacatgcctgtgta

SEQ ID NO: 185213 - DNA, 75 bp, Artificial Sequence
  Synthetic
aagaatagtgctattagcttgcttaataccacagcaatagcagtagctgaagggacagataggattatagaagta

SEQ ID NO: 185214 - DNA, 75 bp, Artificial Sequence
  Synthetic
aatacaagaacaagtgtacgtataggaccaggacaagcattctatgcaacaggtgacataataggggatataaga

SEQ ID NO: 185215 - DNA, 75 bp, Artificial Sequence
  Synthetic
aaaaagtaatactatcaacaatgttactagggagatgaaaaattgctctttcaatgcaaccacagaattaagaga

SEQ ID NO: 185216 - DNA, 75 bp, Artificial Sequence
  Synthetic
tgtgtcactttaagatgtgaggatgttccgtttaataagagtgagacggaaataagaaattgctctttcaacgca

SEQ ID NO: 185217 - DNA, 75 bp, Artificial Sequence
  Synthetic
gaccaggacaagcattctatgcaacaggtgacataataggggatataagacaagcacattgtaatatcagtagag

SEQ ID NO: 185218 - DNA, 75 bp, Artificial Sequence
  Synthetic
aatcaattgtaccagaccctccaacaatacaagaacaagtataactataggaccaggacaagtattctatagaac

SEQ ID NO: 185219 - DNA, 75 bp, Artificial Sequence
  Synthetic
agcagctagaggagggataccaagttcccatactcctcaaaacaatgcagcccttgcattcctagaaagccacca

SEQ ID NO: 185220 - DNA, 75 bp, Artificial Sequence
  Synthetic
gcgggggaaaattagatgcgtgggagaaaattcggttaaggcgggggggaagaaaaatatataaacaaaacttgt

SEQ ID NO: 185221 - DNA, 75 bp, Artificial Sequence
  Synthetic
ggtttaagaatagtttttactgtgctttctatagtaaatagagttaggcagggatattcacccttatcgtttcag

SEQ ID NO: 185222 - DNA, 75 bp, Artificial Sequence
  Synthetic
ataatacaagaaaaagtataaggataggaccaggacaagcattctatgcaacaggtgacataataggagacataa

SEQ ID NO: 185223 - DNA, 75 bp, Artificial Sequence
  Synthetic
ccagcaggacaggaatgaaaaggatttgttagaattggataaatgggcaagtctgtggaattggtttgacataac

SEQ ID NO: 185224 - DNA, 75 bp, Artificial Sequence
  Synthetic
gcacacaaaggaattggaggaaatgaacaagtagataaattagtcagtgctggaatcaggaaagtactatttttg

SEQ ID NO: 185225 - DNA, 75 bp, Artificial Sequence
  Synthetic
gggagtaataggactaatgcagaattgaaaatggaaattggagaagtgaaaaactgctctttcaatataacccca

SEQ ID NO: 185226 - DNA, 75 bp, Artificial Sequence
  Synthetic
aaagaagtaatcaatgaggaagcagcagattgggatagaactcacccaccagcggtagggccgttaccaccaggg

SEQ ID NO: 185227 - DNA, 75 bp, Artificial Sequence
  Synthetic
agggatacatttcggcccagggcaagcactctatacaacagggatagtaggagatataagaagagcatattgtac

SEQ ID NO: 185228 - DNA, 75 bp, Artificial Sequence
  Synthetic
aggcaattttaggaaccaaagaaagattgttaagtgtttcaattgtggcaaagaagggcacatagccagaaattg

SEQ ID NO: 185229 - DNA, 75 bp, Artificial Sequence
  Synthetic
cagcaggagaaaaatgaacaggatttattagcactggacaagtggcaaaatttgtggagttggtttagcataaca

SEQ ID NO: 185230 - DNA, 75 bp, Artificial Sequence
  Synthetic
aactggtagtatcacactcccatgcagaataaaacaaattataaatatgtggcagaaaacaggaaaagctatgta

SEQ ID NO: 185231 - DNA, 75 bp, Artificial Sequence
  Synthetic
taagacaaactcctccagcagcaaaaggagtaggagcagtatctcaagatttagataaacatggagcagtcacaa

SEQ ID NO: 185232 - DNA, 75 bp, Artificial Sequence
  Synthetic
aggacctataaaatgtttcaattgtggaaaagagggacatctagcaagaaattgtcgagcacctagaaagaaagg

SEQ ID NO: 185233 - DNA, 75 bp, Artificial Sequence
  Synthetic
tgcggagcctgtgcctcttcagctaccaccgattgagagacttcatattgattgcagcgagagtggtggaacttc

SEQ ID NO: 185234 - DNA, 75 bp, Artificial Sequence
  Synthetic
caagggttgggggccatctatgtgaagttttgctggacacaggggcagatgatacagtactaaacaacatacaat

SEQ ID NO: 185235 - DNA, 75 bp, Artificial Sequence
  Synthetic
aattggaagaaatctgatgactcagcttggttgcactttaaattttcccattagtcctattgaaactgtaccagt

SEQ ID NO: 185236 - DNA, 75 bp, Artificial Sequence
  Synthetic
ccacaaagcaagagtgttggctgaggcaatgagccaagtaaacaatacaaacataatgatgcagagaagcaattt

SEQ ID NO: 185237 - DNA, 75 bp, Artificial Sequence
  Synthetic
ctctattgtgtacatcaacggatagatgtaaaagacaccaaggaagctctagataaaatagaggaaatacaaaat

SEQ ID NO: 185238 - DNA, 75 bp, Artificial Sequence
  Synthetic
ctgagccagcagcagaaggagtaggagcagcgtctcaagacttagataaatatggagcacttacaagcagcaaca

SEQ ID NO: 185239 - DNA, 75 bp, Artificial Sequence
  Synthetic
tctattatggggtacctgtgtggaaagaagcaactaccactctattctgtgcatcagatgctaaagcatatgata

SEQ ID NO: 185240 - DNA, 75 bp, Artificial Sequence
  Synthetic
atagcacacaagtagaccctggcctggcagaccaactaattcatatgcattattttgattgttttgcagactctg

SEQ ID NO: 185241 - DNA, 75 bp, Artificial Sequence
  Synthetic
ttggacaggagaaataaggaaaggagaaataaaaaactgctcttttaatatcaccacaagcataagagataaggt

SEQ ID NO: 185242 - DNA, 75 bp, Artificial Sequence
  Synthetic
gaaaaacaacccagaattagaaatttgtcagtacatggatgacctatatgtaggatcagatttacccctgacaga

SEQ ID NO: 185243 - DNA, 75 bp, Artificial Sequence
  Synthetic
ggaagccttagacaagatagaggaagaacaaaacaaaagtcagcaaaaaacacagcaggcaaaagcggctgacgg

SEQ ID NO: 185244 - DNA, 75 bp, Artificial Sequence
  Synthetic
gctatcattgtctagtttgctttcagaaaaaaggcttaggcatttcctatggcaggaagaagcggagacagcgac

SEQ ID NO: 185245 - DNA, 75 bp, Artificial Sequence
  Synthetic
agggaaagaataagacgaactcccccaacagaaacaggagtaggagcagtatctcaagatgcagtatctcaagat

SEQ ID NO: 185246 - DNA, 75 bp, Artificial Sequence
  Synthetic
ggggacgcaaaaaatatagactaaaacatctagtatgggcaagcagggagctggaaaaattcgcaattaaccctg

SEQ ID NO: 185247 - DNA, 75 bp, Artificial Sequence
  Synthetic
gcctgtgtacccacagaccccaacccacaagaagtagtattgggaaatgtgacagaaaactttaacatgtggaaa

SEQ ID NO: 185248 - DNA, 75 bp, Artificial Sequence
  Synthetic
taataacaaaagtgaagaaatgaaaaattgctctttcagtgtatcaacagaattaaaagataagaaacagaaaca

SEQ ID NO: 185249 - DNA, 75 bp, Artificial Sequence
  Synthetic
atctcctcccaacctacacagagtgaatcccctatagttcagcagataatagaggaactaacaaaaaaggaccag

SEQ ID NO: 185250 - DNA, 75 bp, Artificial Sequence
  Synthetic
gaaagactgtactgagaggcaggctaattttttagggaaaatttggccttcccacaaggggaggccagggaattt

SEQ ID NO: 185251 - DNA, 75 bp, Artificial Sequence
  Synthetic
tctgtagaaatcaattgtaccagaccctccaacaatacaagaacaagtatacatataggaccaggacaagtattt

SEQ ID NO: 185252 - DNA, 75 bp, Artificial Sequence
  Synthetic
gcacattgtaacattagtaaaaaggattggaatgaaactttacaagaggtaggtaaaaaattagcaaaatacttc

SEQ ID NO: 185253 - DNA, 75 bp, Artificial Sequence
  Synthetic
cattttaagagcattaggaccaggggctacattagaagaaatgatgacagcatgccagggagtgggaggacctgg

SEQ ID NO: 185254 - DNA, 75 bp, Artificial Sequence
  Synthetic
gtacaatgtgcttccacagggatggaaaggatcaccagcaatattccaaagtagcatgacaaaaatcttagagcc

SEQ ID NO: 185255 - DNA, 75 bp, Artificial Sequence
  Synthetic
tccatgcaaaataaagcaaattataaacatgtggcagggaataggacaagcaatgtatgctcctcctatcagtgg

SEQ ID NO: 185256 - DNA, 75 bp, Artificial Sequence
  Synthetic
caatgtatgctcctcctatcagtgggagcattaattgtgtatcaaatattacaggaatactattgacaagagatg

SEQ ID NO: 185257 - DNA, 75 bp, Artificial Sequence
  Synthetic
gaccttcagacctggaggaggaaatataaaggacaattggagaagtgaattatataaatataaagtagtacaaat

SEQ ID NO: 185258 - DNA, 75 bp, Artificial Sequence
  Synthetic
atagtatggcaagtggacagacagaaagtgaaaacgtggaacagcctggtgaaataccataaatacagatctagg

SEQ ID NO: 185259 - DNA, 75 bp, Artificial Sequence
  Synthetic
agggagaatttggccttccagcaaagggaggccaggaaacttacatcaaaacagactggagccatcagccccacc

SEQ ID NO: 185260 - DNA, 75 bp, Artificial Sequence
  Synthetic
agggagaatttggccttccagcaaagggaggccaggaaactttcatcaaaacagactggagccatcagccccacc

SEQ ID NO: 185261 - DNA, 75 bp, Artificial Sequence
  Synthetic
agggagaatttggccttccagcaaagggaggccaggaaacttccatcaaaacagactggagccatcagccccacc

SEQ ID NO: 185262 - DNA, 75 bp, Artificial Sequence
  Synthetic
agggagaatttggccttccagcaaagggaggccaggaaacttgcatcaaaacagactggagccatcagccccacc

SEQ ID NO: 185263 - DNA, 75 bp, Artificial Sequence
  Synthetic
ctaggccatggttacatgcactaggacaacaaatctacaacacctatgggaatacttggcaaggagctgcagttc

SEQ ID NO: 185264 - DNA, 75 bp, Artificial Sequence
  Synthetic
ctgcaccacttctgtgccttggaatgaaagttggagtaatatatcttatgacacaatttggggtaacatgacttg

SEQ ID NO: 185265 - DNA, 75 bp, Artificial Sequence
  Synthetic
tagggacactgcaactattagctctaagagtagtagtaaaagaaaaaaggaataagcctcccctacccagtgtcc

SEQ ID NO: 185266 - DNA, 75 bp, Artificial Sequence
  Synthetic
tagcagtcctctattgtgtacatcaaaggatagaggtaaaagacaccaaggaagctttagataagatagaggaag

SEQ ID NO: 185267 - DNA, 75 bp, Artificial Sequence
  Synthetic
ctaacacaagaggaagaggaagaagaaatggatccagtagatcctgagatgcccccttggcatcaccctggaagt

SEQ ID NO: 185268 - DNA, 75 bp, Artificial Sequence
  Synthetic
ggaatcattcaagcacaaccagataagagtgaatcagagttagtcagtcaaataatagaacagttaataaaaaag

SEQ ID NO: 185269 - DNA, 75 bp, Artificial Sequence
  Synthetic
gggggtgggaagttcttaagtatttaggaagccttgtgcagtattggtgtttagagctaaaagggagtgctatta

SEQ ID NO: 185270 - DNA, 75 bp, Artificial Sequence
  Synthetic
attaataattattagtgctttgctgcttataaatataattctatggatgtttattcttaaacaatgtatagaaca

SEQ ID NO: 185271 - DNA, 75 bp, Artificial Sequence
  Synthetic
ccaagttcattaacgtcattgctaacagtaccgctgtaaaggaaatgacagatgacataaaaaactgctcttaca

SEQ ID NO: 185272 - DNA, 75 bp, Artificial Sequence
  Synthetic
tataggaaattggtaagacaaagaaaaatagactggttaattaaaagaattagggaaagagcagaagacagtggc

SEQ ID NO: 185273 - DNA, 75 bp, Artificial Sequence
  Synthetic
gcgcccgaatagggactcgaaagcgaaagttccagagaagttctctcgacgcaggactcggcttgctgaggtgca

SEQ ID NO: 185274 - DNA, 75 bp, Artificial Sequence
  Synthetic
ctaaagcaaaggaaaatagacaggttaattgagagaataagagaaagagcagaagacagtggcaatgagagtgat

SEQ ID NO: 185275 - DNA, 75 bp, Artificial Sequence
  Synthetic
cactttgggaacaaaacaatagtctttaccaactcctcaggaggggatctagaaataacaacacacatgtttaat

SEQ ID NO: 185276 - DNA, 75 bp, Artificial Sequence
  Synthetic
gtaccttagataagaacatgaggggagaaataaaaaattgctctttcaatatgaccacagaactaaaagataaga

SEQ ID NO: 185277 - DNA, 75 bp, Artificial Sequence
  Synthetic
taataacaacatattggggtctgcatacaggagaaagagactggcatttgggtcagggagtctccatagaatgga

SEQ ID NO: 185278 - DNA, 75 bp, Artificial Sequence
  Synthetic
ttaccaactcctcaggaggggatctagaaataacaacacacatgtttaattgtggaggagaatttttctattgta

SEQ ID NO: 185279 - DNA, 75 bp, Artificial Sequence
  Synthetic
gttactgtctactatggggtacctgtgtggaaagatgcagataccaccttattttgtgcatcagatgctaaagca

SEQ ID NO: 185280 - DNA, 75 bp, Artificial Sequence
  Synthetic
ttggaaatatgacagaggaagtaaaaaactgttcttttaatatagccacagaattaagagataagaagcagcagg

SEQ ID NO: 185281 - DNA, 75 bp, Artificial Sequence
  Synthetic
gtaggttccatgagaacatgaaaggagaaatacaaaactgctcttacaatgtgaccacagaattaagggataaga

SEQ ID NO: 185282 - DNA, 75 bp, Artificial Sequence
  Synthetic
aggatcaacagctcctaggaatttggggctgctctggaaaactcatctgcaccactaatgtgccttggaactcta

SEQ ID NO: 185283 - DNA, 75 bp, Artificial Sequence
  Synthetic
agaagaagaacagctataggacaaggacaggtattctctagaacaggaaaaataataggagatataagacaagca

SEQ ID NO: 185284 - DNA, 75 bp, Artificial Sequence
  Synthetic
aaattggtaagacaaagaaaaatagaccagttagttaaaagaattagggaaagagcagaagacagtggcaatgag

SEQ ID NO: 185285 - DNA, 75 bp, Artificial Sequence
  Synthetic
acgaggattgtggaacttctgggacgcagggggtgggaagccctcaaatattggtggaatctcctgcaatattgg

SEQ ID NO: 185286 - DNA, 75 bp, Artificial Sequence
  Synthetic
tataaacatgtggcaggaagtaggaaaagcaatgtatgcccctcccatcagaggacaaattagatgttcatcaaa

SEQ ID NO: 185287 - DNA, 75 bp, Artificial Sequence
  Synthetic
atttggccttccagcaaggggaggccaggaaattttcctcagagcagaccagagccaacagccccaccagcagag

SEQ ID NO: 185288 - DNA, 75 bp, Artificial Sequence
  Synthetic
caggaggggatctagaaattacaacacatagttttaattgtggaggagaatttttctattgtaatacatcaggcc

SEQ ID NO: 185289 - DNA, 75 bp, Artificial Sequence
  Synthetic
tacagcagctactaatgctgattgtgcctggctagaagcacaagaggaggaggaggtgggttttccagtcagacc

SEQ ID NO: 185290 - DNA, 75 bp, Artificial Sequence
  Synthetic
ttgctctttcaatgtaaccacagtaataagagataagaaacacaaagagtatgcacttttttatagacctgatat

SEQ ID NO: 185291 - DNA, 75 bp, Artificial Sequence
  Synthetic
tacctccattaataccacgaatggaggcattaacatgaaggaagaaataaaaaattgctctttcaatacaaccac

SEQ ID NO: 185292 - DNA, 75 bp, Artificial Sequence
  Synthetic
tgctaacagtactgctagtaatagcagtactaattggaaaaacataaatgaagtaatgacaaactgctctttcaa

SEQ ID NO: 185293 - DNA, 75 bp, Artificial Sequence
  Synthetic
tttatccatttcagaattgggtgccaacatagcaggataggcattactcggcagagaagagcaaggcatggaccc

SEQ ID NO: 185294 - DNA, 75 bp, Artificial Sequence
  Synthetic
aggggggcaaaagggaatggactgaggttagaagaagaatagaacaaacccctccatcagcatcagcagcaacag

SEQ ID NO: 185295 - DNA, 75 bp, Artificial Sequence
  Synthetic
taggaggcttgataggtttaagaataatttttgctgtgctttctatagtgaatagagttaggcagggatactcac

SEQ ID NO: 185296 - DNA, 75 bp, Artificial Sequence
  Synthetic
atagcagaataggcattattcgagggaggagaagagtcagggatggagccggtagatcctaacctagagccctgg

SEQ ID NO: 185297 - DNA, 75 bp, Artificial Sequence
  Synthetic
tgctttatgacaaaaggcttaggaatttcctatggcaggaagaagcggggaaagcgacgaagaactcctcagagc

SEQ ID NO: 185298 - DNA, 75 bp, Artificial Sequence
  Synthetic
aaagcgacgaagaactcctcagagcggtccgaatcatcaaaatattgtatcaaagcagtaagtactaccaatgtc

SEQ ID NO: 185299 - DNA, 75 bp, Artificial Sequence
  Synthetic
agtaaggatcatcaaaatcctataccagagcagtaagtataattaaagagtatatgtaatgaaaactttagaaat

SEQ ID NO: 185300 - DNA, 75 bp, Artificial Sequence
  Synthetic
agtacagctgaataaaactgtagtaattaattgtacaagacccaacaacaatacaagaaaaggtatacatatagg

SEQ ID NO: 185301 - DNA, 75 bp, Artificial Sequence
  Synthetic
aacttcccctgagcctgaaccatgtgcacctggagtaggacaagtctccagggacttagcagctagaggagggat

SEQ ID NO: 185302 - DNA, 75 bp, Artificial Sequence
  Synthetic
attgtaaaaagtgttgctttcattgccaagtttgtttcacaaaaaaaggcttaggcatctcctatggcaggaaga

SEQ ID NO: 185303 - DNA, 75 bp, Artificial Sequence
  Synthetic
aaagagcagaagacagtggcaatgagagtgagggagatgcagaggaactggcagcacttggggagatggggcatc

SEQ ID NO: 185304 - DNA, 75 bp, Artificial Sequence
  Synthetic
ttaatctaacaacaattgtctttacaacaccctcaggaggggacccagaaattacaatgcacagttttacttgtg

SEQ ID NO: 185305 - DNA, 75 bp, Artificial Sequence
  Synthetic
gtgggggaaaattggatgcatgggagaaaattcggttaaggccagggggaaagaaaaaatatagactaaaacata

SEQ ID NO: 185306 - DNA, 75 bp, Artificial Sequence
  Synthetic
aaatcattatataatacagtagtagtcctttattgcgtacatcaaaggatagacataaaggacaccaaggaagcc

SEQ ID NO: 185307 - DNA, 75 bp, Artificial Sequence
  Synthetic
tagaattggcagagaacagggagattctaaaaaaccctgtgcatggagtatattatgacccatcaaaagacttag

SEQ ID NO: 185308 - DNA, 75 bp, Artificial Sequence
  Synthetic
tattatgacccatcaaaagacttagtagcagaaatacagaaacaagggcaaggccaatggacatatcaaatttat

SEQ ID NO: 185309 - DNA, 75 bp, Artificial Sequence
  Synthetic
tgatgtaaagaatagtactaacaataacactgaagaagctaccatcacaaattgctccttcaaggtacccacaga

SEQ ID NO: 185310 - DNA, 75 bp, Artificial Sequence
  Synthetic
taaaaattagtgctattaatttgcttgataccatagcaatagcagtagctggctggacagatagggttatagaaa

SEQ ID NO: 185311 - DNA, 75 bp, Artificial Sequence
  Synthetic
tctccacatacctagaagaatcagacagggctttgaaagagctttgctataacatgggtggcaagtggtcaaaaa

SEQ ID NO: 185312 - DNA, 75 bp, Artificial Sequence
  Synthetic
ttaataaattgtaatacctcaaccattacacaggcttgtccaaaggtatcctttgagccaattcctatacattat

SEQ ID NO: 185313 - DNA, 75 bp, Artificial Sequence
  Synthetic
taatagcactgacaacagcaaagaaatgaaaaactgctcttacaatatcaccacagaactaagagatagaaaaca

SEQ ID NO: 185314 - DNA, 75 bp, Artificial Sequence
  Synthetic
ttacacaggcttgtccaaaggtatcctttgagccaattcctatacattattgtgcccctgctggttttgcgattc

SEQ ID NO: 185315 - DNA, 75 bp, Artificial Sequence
  Synthetic
tagggaaagaatgagacgtgctcctccagcagcaccaggagtaggagcagtatctcaagatttagataaacatgg

SEQ ID NO: 185316 - DNA, 75 bp, Artificial Sequence
  Synthetic
aatatacaggttgcttgaagaatcgcaaacccagcaggaacaaaatgaaaaagatttattagcattggacagttg

SEQ ID NO: 185317 - DNA, 75 bp, Artificial Sequence
  Synthetic
tactaataccactagtagtagcggggttataatagagaaaggagaaataaaaaactgctctttcaagatcaacac

SEQ ID NO: 185318 - DNA, 75 bp, Artificial Sequence
  Synthetic
tgcaactctctattgtgtacatgaaaagatagaggtacgagacaccaaggaagccttagacaaaataaaggaaga

SEQ ID NO: 185319 - DNA, 75 bp, Artificial Sequence
  Synthetic
aaaattaattgtaccagacccggatccgacaagaagataagacaaagtatacgtataggaccaggaaaagtattc

SEQ ID NO: 185320 - DNA, 75 bp, Artificial Sequence
  Synthetic
acaagcaacccacctatcccagtgggagacatttataaaagatggataattctgggattaaataaaatagtaaga

SEQ ID NO: 185321 - DNA, 75 bp, Artificial Sequence
  Synthetic
ttaataataaatcaataatatttaactcatcctcaggaggggacatagagattacaacacatacttttaactgtg

SEQ ID NO: 185322 - DNA, 75 bp, Artificial Sequence
  Synthetic
ctagcaacaatacaagaaagagtgtacacataggacctggacaagtgttgtatgcaacaggcgacatagtaggaa

SEQ ID NO: 185323 - DNA, 75 bp, Artificial Sequence
  Synthetic
aaatattacactcccatgcaggataaaacaagtggtaagaacatggcagggagtaggacaagcaatgtatgcccc

SEQ ID NO: 185324 - DNA, 75 bp, Artificial Sequence
  Synthetic
atgatgcagagaggcaattttaggggccagagaacaataaagtgtttcaactgtggcaaagagggacacctagcc

SEQ ID NO: 185325 - DNA, 75 bp, Artificial Sequence
  Synthetic
aaacaagtggtaagaacatggcagggagtaggacaagcaatgtatgcccctcctatcgaagggacaattaggtgc

SEQ ID NO: 185326 - DNA, 75 bp, Artificial Sequence
  Synthetic
gcaacaggacaaataataggagatataagacaagcacattgtaaccttagtagagcaaaatggaataacacttta

SEQ ID NO: 185327 - DNA, 75 bp, Artificial Sequence
  Synthetic
gaaaggtgaaggggcagtagtaatacaagataatagtgacataaaggtagtgccaagaagaaaagcaaagatcat

SEQ ID NO: 185328 - DNA, 75 bp, Artificial Sequence
  Synthetic
cacatacctacaaggataagacagggcctcgaaagagctttgctataagatgggtggcaagtggtcaaagtttag

SEQ ID NO: 185329 - DNA, 75 bp, Artificial Sequence
  Synthetic
aaatttgtggaaaaaaggctataggtacagtgttagtaggacctacacctgtcaacataattggacgaaatatgt

SEQ ID NO: 185330 - DNA, 75 bp, Artificial Sequence
  Synthetic
ctctagctggagtaataaatccttggataacatttgggacaatctgacctggatggagtgggatagagaaattag

SEQ ID NO: 185331 - DNA, 75 bp, Artificial Sequence
  Synthetic
gcattaatagaaatttgtacagagatggaaaaggaagaaaaaatttcaagaattgggcctgaaaatccatacaat

SEQ ID NO: 185332 - DNA, 75 bp, Artificial Sequence
  Synthetic
ttaattgaagaatcgcaaaaccaacaagaaaagaatgaacaagaattattggaattagataaatgggcaagtttg

SEQ ID NO: 185333 - DNA, 75 bp, Artificial Sequence
  Synthetic
taaagaatagtgctattagtttgcttaatgccacagcaatagtagtagctgagggaacagatagaattatagaag

SEQ ID NO: 185334 - DNA, 75 bp, Artificial Sequence
  Synthetic
ggagtcaggaactaaagaatagtgctgttagtttgcttaatgccacagctatagcagtagctgaggggacagata

SEQ ID NO: 185335 - DNA, 75 bp, Artificial Sequence
  Synthetic
gaaaaaagacagtactaaatggagaaaattagtagattttagagaacttaataaaagaactcaagacttctggga

SEQ ID NO: 185336 - DNA, 75 bp, Artificial Sequence
  Synthetic
aatggcctgctataagggagagaatgagacgagctaggccagcagctgagccagcagcagatggagtaggagcag

SEQ ID NO: 185337 - DNA, 75 bp, Artificial Sequence
  Synthetic
atagagttatagaattaggacaaagattttatagagctctccttaatatacctagaagaatcagacaaggcgctg

SEQ ID NO: 185338 - DNA, 75 bp, Artificial Sequence
  Synthetic
gaagaagcggaagcaccgacgaggaactcctccaggcagtaaggaccatcaaaatcctgtaccaaagcagtaagt

SEQ ID NO: 185339 - DNA, 75 bp, Artificial Sequence
  Synthetic
tagtaggggtaatcctagcagtagtagtgtgggctatagtaattatagaatataagaaaatactaaagcaaagaa

SEQ ID NO: 185340 - DNA, 75 bp, Artificial Sequence
  Synthetic
cttaaatcattatataatacagtagcaactctctattgtgtacatcaaaggatagacataaaagacaccaaggaa

SEQ ID NO: 185341 - DNA, 75 bp, Artificial Sequence
  Synthetic
atggggtatattatgacccatcaaaagacttaatagcagaaatacagaaacaagggcaagaccaatggacatatc

SEQ ID NO: 185342 - DNA, 75 bp, Artificial Sequence
  Synthetic
actagtaccaacagtagcaacgtggagaacataggagaaataagaaattgttcctttaatataaccacagaaata

SEQ ID NO: 185343 - DNA, 75 bp, Artificial Sequence
  Synthetic
tagtagcaaaagaaatagtagccagctgtgataaatgccaactaaaaggggaagccatgcatggacaagtagact

SEQ ID NO: 185344 - DNA, 75 bp, Artificial Sequence
  Synthetic
aatgcgaacccagattgtaaaactatcttaaaagcattaggaccaggagcgacactagaggaaatgatgacagca

SEQ ID NO: 185345 - DNA, 75 bp, Artificial Sequence
  Synthetic
tgaacgtataggaccaggacaagtattctatagaacaggagagataataggaaacataagaaaagcatattgtca

SEQ ID NO: 185346 - DNA, 75 bp, Artificial Sequence
  Synthetic
aataaaatttcaaccatcctcaggaggagatccagaagttacaatgcatagttttaattgtggaggggaattttt

SEQ ID NO: 185347 - DNA, 75 bp, Artificial Sequence
  Synthetic
cacacaaatagaccctgacctggcagaccaactgattcatctgtattattttgactgtttttcagactctgccat

SEQ ID NO: 185348 - DNA, 75 bp, Artificial Sequence
  Synthetic
aatattccaaagtagcatgacaaaaatcttagagccttttagaaaacaaaatccagacatagttatctatcaata

SEQ ID NO: 185349 - DNA, 75 bp, Artificial Sequence
  Synthetic
agcagcaggaagcactatgggcgcggcgtcaataacgctgacggtacaggccagacaattattgtctggtatagt

SEQ ID NO: 185350 - DNA, 75 bp, Artificial Sequence
  Synthetic
catggtggacagattattggcaagccacctggattcctgagtgggagtttgttaatacccctcccctagtaaaat

SEQ ID NO: 185351 - DNA, 75 bp, Artificial Sequence
  Synthetic
aaaggcttaggcatctcctatggcaggaagaagcggaaacgcagacgagggactcctcacagcagtaaggatcat

SEQ ID NO: 185352 - DNA, 75 bp, Artificial Sequence
  Synthetic
aatgcatgggtaaaagtagtagaagaaaaggctttcagtccagaagtaatacccatgttttcagcattatcagaa

SEQ ID NO: 185353 - DNA, 75 bp, Artificial Sequence
  Synthetic
tggggcaacatgacatggatagaatgggatagagaaattaacaattacacaaacctaatatataggctacttaca

SEQ ID NO: 185354 - DNA, 75 bp, Artificial Sequence
  Synthetic
caattaacagaggcagtgcaaaaaataaccacagaaagcatagtaatatggggaaagatccctaagtttaaatta

SEQ ID NO: 185355 - DNA, 75 bp, Artificial Sequence
  Synthetic
gacgatctgcggagcctgtgcctcttcagctaccaccgattgagagactttatattggtgacagcgagagcagtg

SEQ ID NO: 185356 - DNA, 75 bp, Artificial Sequence
  Synthetic
ctccacatacctagaagaatcagacagggcttcgaaagggctttgctataacatgggtggcaagtggtcaaaaag

SEQ ID NO: 185357 - DNA, 75 bp, Artificial Sequence
  Synthetic
ggagaaatgaaaaactgctctttcaatatgaccacagaattaagagataggaaaagaaaggtacattcacttttt

SEQ ID NO: 185358 - DNA, 75 bp, Artificial Sequence
  Synthetic
tagcatagtgggatggcctcaagtcagggaaagaataaagcaaactcctgtagcagcagaaggagtaggagaagt

SEQ ID NO: 185359 - DNA, 75 bp, Artificial Sequence
  Synthetic
gattaggagtaggagcattaatagtaggactaataatagcaataattgtgtggatcatagtttatatagaatata

SEQ ID NO: 185360 - DNA, 75 bp, Artificial Sequence
  Synthetic
agcagtaagtaataagtatatgtaatgtcccttttagtaattagtgcaattgcaggactggtagtagcgctaatc

SEQ ID NO: 185361 - DNA, 75 bp, Artificial Sequence
  Synthetic
cagcacagtacaatgcacacatggaatcaagccagtagtatcaactcaactgctgttaaatggcagtctagcaga

SEQ ID NO: 185362 - DNA, 75 bp, Artificial Sequence
  Synthetic
atagtactatacccaagaagaaaaataacagcagctcagaggaccttctgaaacagtgtgattttaatgcaacca

SEQ ID NO: 185363 - DNA, 75 bp, Artificial Sequence
  Synthetic
gaagtagagagcggttgctataccagtacggatctatgggatacgaatacgaaggagtatgcactttcagataga

SEQ ID NO: 185364 - DNA, 75 bp, Artificial Sequence
  Synthetic
aagagccagcaaaagacacagcaggcagcagctagcacaggaagcagcagcaaagtcagccaaaattatcctata

SEQ ID NO: 185365 - DNA, 75 bp, Artificial Sequence
  Synthetic
gaccctataattctcccatgcagaataaagcagattataaatatgtggcaaagagtagggcaggcaatgtatgct

SEQ ID NO: 185366 - DNA, 75 bp, Artificial Sequence
  Synthetic
catggaatcaagccagtagtatcaactcaactgctgttaaatggcagtctagcagaaggaaagataatgattaga

SEQ ID NO: 185367 - DNA, 75 bp, Artificial Sequence
  Synthetic
taaacgggacactctctgaaggaaaaataagaattatgggaagaaatatcacggacagtggaaaaaatattatag

SEQ ID NO: 185368 - DNA, 75 bp, Artificial Sequence
  Synthetic
agagaaagacaaaaacacaactggctcgaggtcagcagattgccagtataacacctctgaatggacaagagcctt

SEQ ID NO: 185369 - DNA, 75 bp, Artificial Sequence
  Synthetic
ctaagagataagaaagagaaagtatatgcacttttttataggcttgatatagtaccacttaatggggatagcaac

SEQ ID NO: 185370 - DNA, 75 bp, Artificial Sequence
  Synthetic
tcgaggtcagcagattgccagtataacacctctgaatggacaagagccttagaacaaacagctgaaaggtattta

SEQ ID NO: 185371 - DNA, 75 bp, Artificial Sequence
  Synthetic
atcaagatcctatatcaaagcagtaagtatatgtaatgtttagtttactagacagagtagatgctagattagggg

SEQ ID NO: 185372 - DNA, 75 bp, Artificial Sequence
  Synthetic
caagaacaagtatacatataggaccaggacaagtattctatagaacaggagagataacaggagatataagaaaag

SEQ ID NO: 185373 - DNA, 75 bp, Artificial Sequence
  Synthetic
ggataaggggagggtcgggactctatgcacctcccaggcaaggtcccctaaaatgtagctcaaacataactggaa

SEQ ID NO: 185374 - DNA, 75 bp, Artificial Sequence
  Synthetic
ttccctaataaaacaataaaatttgcaccacactcaggaggggacctagaaattacaacacatagctttaattgt

SEQ ID NO: 185375 - DNA, 75 bp, Artificial Sequence
  Synthetic
caccacactcaggaggggacctagaaattacaacacatagctttaattgtagaggagaatttttctattgcaata

SEQ ID NO: 185376 - DNA, 75 bp, Artificial Sequence
  Synthetic
actaccagaaggaccaaccatactacccaagaaatgaaaaattgcacttttaatgcaaccacagaaataaaggat

SEQ ID NO: 185377 - DNA, 75 bp, Artificial Sequence
  Synthetic
agtagtatcaactcaactgctgttaaatggcagtctagcagaaggagaggtaataattagatctgaaaatatcac

SEQ ID NO: 185378 - DNA, 75 bp, Artificial Sequence
  Synthetic
ttgccaggaaaatggaaaccaaaaatgatagggggaattggaggttttatcaaagtaagacagtatgatcaaata

SEQ ID NO: 185379 - DNA, 75 bp, Artificial Sequence
  Synthetic
gtaagaacatattggggtctgcaaacaggagaaaaagactggcacttgggtcatggggtctccatagaatggagg

SEQ ID NO: 185380 - DNA, 75 bp, Artificial Sequence
  Synthetic
tagattcaatttgggaaaatctaacatggcaggaatgggatcagcagataagcaacataagctccgccatatatg

SEQ ID NO: 185381 - DNA, 75 bp, Artificial Sequence
  Synthetic
gtactgctaatgacaatagtactaattgggaatggatagataaagaaatgacaaactgctctttcaatgtcacca

SEQ ID NO: 185382 - DNA, 75 bp, Artificial Sequence
  Synthetic
actgagatcttcagacctggaggaggagatatgagggacaattggagaagtgaattatataaatataaagtagta

SEQ ID NO: 185383 - DNA, 75 bp, Artificial Sequence
  Synthetic
cttcaagaattgcagaatagcgctacaagcatactagatacccttgcagtgacagttgccaattggactgacagt

SEQ ID NO: 185384 - DNA, 75 bp, Artificial Sequence
  Synthetic
aggcatctcctatggcaggaagaagcggaagcaccgaggaactcctcacggcagtaaggatcatcaaactcctgt

SEQ ID NO: 185385 - DNA, 75 bp, Artificial Sequence
  Synthetic
gcagtaaggatcatcaaactcctgtaccagagcagtaagtataattaaatagtatttgtaatgaatgctttagta

SEQ ID NO: 185386 - DNA, 75 bp, Artificial Sequence
  Synthetic
ggtggagcgtactttatgcaacaggagctatagtaggagatataagacaagcacattgtaaccttagtagacaag

SEQ ID NO: 185387 - DNA, 75 bp, Artificial Sequence
  Synthetic
tgatgattgtgtggcaagtagacaggatgaggattaaaacatggaacagtttagtaaaacaccatatgtatatat

SEQ ID NO: 185388 - DNA, 75 bp, Artificial Sequence
  Synthetic
gggtcacggtctactatggggtacctgtatggaaagaggcaaagaccaccctattttgtgcatcagatgctaaag

SEQ ID NO: 185389 - DNA, 75 bp, Artificial Sequence
  Synthetic
ggaggaggtgggctttccagtcaggccgcaggtacctataagaccaatgactttcaagggggcttttgatttgag

SEQ ID NO: 185390 - DNA, 75 bp, Artificial Sequence
  Synthetic
ggaggaggtgggctttccagtcaggccgcaggtacctttaagaccaatgactttcaagggggcttttgatttgag

SEQ ID NO: 185391 - DNA, 75 bp, Artificial Sequence
  Synthetic
ggaggaggtgggctttccagtcaggccgcaggtacctctaagaccaatgactttcaagggggcttttgatttgag

SEQ ID NO: 185392 - DNA, 75 bp, Artificial Sequence
  Synthetic
ggaggaggtgggctttccagtcaggccgcaggtacctgtaagaccaatgactttcaagggggcttttgatttgag

SEQ ID NO: 185393 - DNA, 75 bp, Artificial Sequence
  Synthetic
caaggctacttccctgattggcaaaactacacaccagggccagggattagatatccactgacctttggatggtgc

SEQ ID NO: 185394 - DNA, 75 bp, Artificial Sequence
  Synthetic
gatcaacagctcctagggctttggggatgcgctggaaaaaccatttgcaccactgctgtaccgtggaactccagt

SEQ ID NO: 185395 - DNA, 75 bp, Artificial Sequence
  Synthetic
cagagagagaagtgttaaagtggagatttaacagccacctggcatttgagcacaaggcccgagtgaagcatccgg

SEQ ID NO: 185396 - DNA, 75 bp, Artificial Sequence
  Synthetic
atgttaccagtaatggtaatactagtagcataaaggaagctggagaaataaaaaattgctctttcaatgcaacca

SEQ ID NO: 185397 - DNA, 75 bp, Artificial Sequence
  Synthetic
gcagctgacacaggaaacaacagccaggtcagccaaaattaccctatagtgcaaaacctccaggggcaaatggta

SEQ ID NO: 185398 - DNA, 75 bp, Artificial Sequence
  Synthetic
accctcagatgctgcatataagcagctgctttctgcctgtacggggtctctcttgatagaccagatcgagcctgg

SEQ ID NO: 185399 - DNA, 75 bp, Artificial Sequence
  Synthetic
atgccataacatcacaaacaacaacactggaataaaggaagaaatgagaaactgctcttacaatatgaccacaga

SEQ ID NO: 185400 - DNA, 75 bp, Artificial Sequence
  Synthetic
aagctgcagaatgggataggttacatccagcacaggcagggcctttgccaccaggccagctgagagaaccaaggg

SEQ ID NO: 185401 - DNA, 75 bp, Artificial Sequence
  Synthetic
tatagactaataaattgtaatacctcagccattacacaggcttgtccaaaggtatcctttgagccaattcccata

SEQ ID NO: 185402 - DNA, 75 bp, Artificial Sequence
  Synthetic
tgggagacatctataaaagatggataatcctgggattaaataaaatagtaagaatgtacagccctgttagcattt

SEQ ID NO: 185403 - DNA, 75 bp, Artificial Sequence
  Synthetic
tagtagcaatagtagcattagtagtagtagcaataatagcaatagttgtgtggactatagtgttcttagaatata

SEQ ID NO: 185404 - DNA, 75 bp, Artificial Sequence
  Synthetic
aatacaagacaaagtataaggtttggaccaggacaagtattctttggaacagacgtaataggagacataagacaa

SEQ ID NO: 185405 - DNA, 75 bp, Artificial Sequence
  Synthetic
gaccaggacaagtattctttggaacagacgtaataggagacataagacaagcacattgtaacattagtaaagctg

SEQ ID NO: 185406 - DNA, 75 bp, Artificial Sequence
  Synthetic
atttttagatgggatagataaggctcaagaagaacatgaaagatatcacagcaattggagagcaatggctagtga

SEQ ID NO: 185407 - DNA, 75 bp, Artificial Sequence
  Synthetic
gcaatagtagcattagtagtagcagcaatactagcaatagttgtgtggaccatagtattcatagaatataggaaa

SEQ ID NO: 185408 - DNA, 75 bp, Artificial Sequence
  Synthetic
caactgtggcaaagaaggacacctagccagaaattgcagggcccctaggaaaaagggctgttggaaatgtggaaa

SEQ ID NO: 185409 - DNA, 75 bp, Artificial Sequence
  Synthetic
gtttcaactgtggcaaagaaggacacctagccagaaattgtagggcccctaggaaaaagggctgttggaaatgtg

SEQ ID NO: 185410 - DNA, 75 bp, Artificial Sequence
  Synthetic
ggcactaattggaatagtagtagtgaatgggaagagatgaagaaagaaatgacaaactgctctttcaatatcacc

SEQ ID NO: 185411 - DNA, 75 bp, Artificial Sequence
  Synthetic
gatgaaagcctaaagccatgtgtaaaactaaccccactctgtgttactttaaattgcactgatgagttgattgtc

SEQ ID NO: 185412 - DNA, 75 bp, Artificial Sequence
  Synthetic
aaaactgctctttcaatatccccacaagtgtaaaagataagatgcagaaacaatatgctctcttctataaacttg

SEQ ID NO: 185413 - DNA, 75 bp, Artificial Sequence
  Synthetic
tttcaactgtggcaaggaagggcacatagctagaaattgcagggcccctaggaaaaagggctgttggaaatgtgg

SEQ ID NO: 185414 - DNA, 75 bp, Artificial Sequence
  Synthetic
taataagaacagtagtaattataatagtagtaagcttagtagtagcaatagtaattgtggtaaaagtgataataa

SEQ ID NO: 185415 - DNA, 75 bp, Artificial Sequence
  Synthetic
ggaactctagctggagtaataaatctttagattatatttggaataacatgacctgggcgcagtgggaaagagaaa

SEQ ID NO: 185416 - DNA, 75 bp, Artificial Sequence
  Synthetic
aaaaagtatacacataggagtggggagagcactttatgcaacaggagatataataggagacataagacaagcaca

SEQ ID NO: 185417 - DNA, 75 bp, Artificial Sequence
  Synthetic
cctttgagccaattcccatacattattgtaccccggctggttttgcgattctaaagtgtaatgataagaggttca

SEQ ID NO: 185418 - DNA, 75 bp, Artificial Sequence
  Synthetic
ggaaattagtagatttcagagagctcaataaaagaacacaagacttttgggaagttcaattaggaataccgcatc

SEQ ID NO: 185419 - DNA, 75 bp, Artificial Sequence
  Synthetic
attagtagatttcagagaacttaataagagaacacaagacttttgggaagttcaattaggaataccacacccagc

SEQ ID NO: 185420 - DNA, 75 bp, Artificial Sequence
  Synthetic
taggaccagggagaacattttatgcggcggaaaaaataataggagatataagaaaagcatactgtatcattaacg

SEQ ID NO: 185421 - DNA, 75 bp, Artificial Sequence
  Synthetic
ctaccaccgattgagagactccatattgattgtggcgaggattttggaacttctgggacacagggggtgggagat

SEQ ID NO: 185422 - DNA, 75 bp, Artificial Sequence
  Synthetic
aactgaagaagagtgctattagcttgcttgatactatagcagtagcagtagctgagtggacagatagggttatag

SEQ ID NO: 185423 - DNA, 75 bp, Artificial Sequence
  Synthetic
ccttcaagcagtgagaatcatcaaaatcctgtatcaaagcagtaagtaataagtagtagatgtaatgtttgcttt

SEQ ID NO: 185424 - DNA, 75 bp, Artificial Sequence
  Synthetic
taagaaaatacaaaaagaaagaaaaatagaaaagttacttgagagaataagagaaagagcagaagacagtggaaa

SEQ ID NO: 185425 - DNA, 75 bp, Artificial Sequence
  Synthetic
aggctacctggattcctgaatgggagtttgtcaatacccctcctctagtaaaactatggtaccagttggagaaag

SEQ ID NO: 185426 - DNA, 75 bp, Artificial Sequence
  Synthetic
aaaatagccacagaaagcatagtaatatggggaaagacccctaaatttagattacccatacagagagaaacatgg

SEQ ID NO: 185427 - DNA, 75 bp, Artificial Sequence
  Synthetic
ggaagcgcaagaggaagaggaggaggtaggctttccagtcagaccgcaggtacctttaagaccaatgacttataa

SEQ ID NO: 185428 - DNA, 75 bp, Artificial Sequence
  Synthetic
aagcatagtaatatggggaaagactcctaaatttagactacccatacaaaaagaaacatgggaaacatggtggac

SEQ ID NO: 185429 - DNA, 75 bp, Artificial Sequence
  Synthetic
accattggcaacaataccaatgacataggaaatataatagatgaaataagaaactgtacttttaacatgaccaca

SEQ ID NO: 185430 - DNA, 75 bp, Artificial Sequence
  Synthetic
taggaaatataatagatgaaataagaaactgtacttttaacatgaccacagagataagagataggaagcagaagg

SEQ ID NO: 185431 - DNA, 75 bp, Artificial Sequence
  Synthetic
ctgtagtgctgccaataatactgttgctgaaatgaagggagaaataaaaaattgctctttccatatatccacaga

SEQ ID NO: 185432 - DNA, 75 bp, Artificial Sequence
  Synthetic
agtaggaggcttgataggtttaagaatagtttttgctgtactttctatagtgaatagagttaggcagggatactc

SEQ ID NO: 185433 - DNA, 75 bp, Artificial Sequence
  Synthetic
aggaagatggccagtaaaagtagtacacacagataatggcagcaatttcaccagcagtgcagttaaagctgcctg

SEQ ID NO: 185434 - DNA, 75 bp, Artificial Sequence
  Synthetic
atggctagtgattttaatctgccacctatagtagcaaaggaaatagtagccagctgtgataaatgtcagctaaaa

SEQ ID NO: 185435 - DNA, 75 bp, Artificial Sequence
  Synthetic
caatggaacaggaccatgcaataatgtcagcacagtacaatgtacacatggaattaagccagtggtatcaactca

SEQ ID NO: 185436 - DNA, 75 bp, Artificial Sequence
  Synthetic
acaataacacaggaaaaagtgtgaggataggaccaggacaaacattctttgcaacaggaggcataataggggaaa

SEQ ID NO: 185437 - DNA, 75 bp, Artificial Sequence
  Synthetic
acagggatggaaaggatcaccagcaatattccaaagtagcatgacaaaaatcttagagccttttagaaaacaaaa

SEQ ID NO: 185438 - DNA, 75 bp, Artificial Sequence
  Synthetic
gatggaacaagccccagaagaccaagggccacagagggagccatacaatgaatggacactagagcttttagagga

SEQ ID NO: 185439 - DNA, 75 bp, Artificial Sequence
  Synthetic
cagagggagccatacaatgaatggacattagaactgttagaagagcttaagcatgaagctgttagacattttcct

SEQ ID NO: 185440 - DNA, 75 bp, Artificial Sequence
  Synthetic
agggatttggggctgctctggaaaaatcatctgcaccactgccgtgccttggaatagtagttggagtaataaaaa

SEQ ID NO: 185441 - DNA, 75 bp, Artificial Sequence
  Synthetic
tgggcaagtctgtggaattggtttgacataacaaactggctgtggtatataagaatatttataatgatagtagga

SEQ ID NO: 185442 - DNA, 75 bp, Artificial Sequence
  Synthetic
atagtattcatagaatataggaaaatattaagacaaagaaaaatagacaggttaattgatagaataagagaaaga

SEQ ID NO: 185443 - DNA, 75 bp, Artificial Sequence
  Synthetic
aggccacctttgcctagtgttaggatattaacagagggtagatggaacaagccccagaagaccaggggccacaga

SEQ ID NO: 185444 - DNA, 75 bp, Artificial Sequence
  Synthetic
agaactgttagaagatcttaagcatgaagcagttagacattttcctaggccatggcttcatggattaggacaaca

SEQ ID NO: 185445 - DNA, 75 bp, Artificial Sequence
  Synthetic
gacgtaggctttccagttaggccacaggtacctctaagaccaatgacttttaagggagcttttgatctcagcttc

SEQ ID NO: 185446 - DNA, 75 bp, Artificial Sequence
  Synthetic
tgctctttcaatatgaccacagaactaagagataagaaaaagaaggtacatgcacttttttatagacttgatgta

SEQ ID NO: 185447 - DNA, 75 bp, Artificial Sequence
  Synthetic
gcaaggaagaaatgaaaaactgctctttcaatataaccacagaactaagagataagacaaaaaaggtatattcac

SEQ ID NO: 185448 - DNA, 75 bp, Artificial Sequence
  Synthetic
aaagtatacgtataggacaaaggagagcattttatgcaacagggaaaataataggtgatataagacatgcacatt

SEQ ID NO: 185449 - DNA, 75 bp, Artificial Sequence
  Synthetic
ttcaatataaccacagaaataagagataagaaaaagcaagtgtatgcacttttttataaacctgatatagtacca

SEQ ID NO: 185450 - DNA, 75 bp, Artificial Sequence
  Synthetic
ataacatcacgggggaaatggaagaaataagaaactgctctttcaatacgactacagtgctaagggataagagac

SEQ ID NO: 185451 - DNA, 75 bp, Artificial Sequence
  Synthetic
caataatatttagaaaccactcaggaggggacttagaagttacaacacacgctttaattgtagaggagaattttt

SEQ ID NO: 185452 - DNA, 75 bp, Artificial Sequence
  Synthetic
caaacattctatgcaacagatataataggggacataagaaaagcatattgttttgtcaatagaacagaatggaat

SEQ ID NO: 185453 - DNA, 75 bp, Artificial Sequence
  Synthetic
caaacattctatgcaacagatataataggggacataagataagcatattgttttgtcaatagaacagaatggaat

SEQ ID NO: 185454 - DNA, 75 bp, Artificial Sequence
  Synthetic
caaacattctatgcaacagatataataggggacataagacaagcatattgttttgtcaatagaacagaatggaat

SEQ ID NO: 185455 - DNA, 75 bp, Artificial Sequence
  Synthetic
caaacattctatgcaacagatataataggggacataagagaagcatattgttttgtcaatagaacagaatggaat

SEQ ID NO: 185456 - DNA, 75 bp, Artificial Sequence
  Synthetic
ctgcaacaactactgtttattcatttcagaattgggtgccagcatagcagaataggaatcttgcgacaaagaaga

SEQ ID NO: 185457 - DNA, 75 bp, Artificial Sequence
  Synthetic
agacaaattagtcagttctggaatcaggaaagtgttatttttagatgggatagataaggctcaagaagaacatga

SEQ ID NO: 185458 - DNA, 75 bp, Artificial Sequence
  Synthetic
atcgcagatccagcaggaaaagaatgaacaagatttattggcattagacaagtgggcaggtctgtggaattggtt

SEQ ID NO: 185459 - DNA, 75 bp, Artificial Sequence
  Synthetic
agaagaaatgatgacagcatgtcagggagtgggaggacctagccacaaagcaagggttttggctgaggcaatgag

SEQ ID NO: 185460 - DNA, 75 bp, Artificial Sequence
  Synthetic
tttagaggaacttaagagtgaagctgttagacattttcctaggccatggctccatagcttaggacaatatatcta

SEQ ID NO: 185461 - DNA, 75 bp, Artificial Sequence
  Synthetic
agcgaacggattcttagcacttgcctgggacgatctccggagcctgtgcctttggagctaccacctcttgagaga

SEQ ID NO: 185462 - DNA, 75 bp, Artificial Sequence
  Synthetic
ctatagtgaatagagttaggcagggatactcaccattatcgtttcagacccacctcccagcaccgaggggacccg

SEQ ID NO: 185463 - DNA, 75 bp, Artificial Sequence
  Synthetic
tgtcacagtaaaaataggaggacagctgaaagaagctctattagatacaggagcagatgatacagtattagaaga

SEQ ID NO: 185464 - DNA, 75 bp, Artificial Sequence
  Synthetic
gatataaaaaacaatagtaccagggggaataatggtagtgatagcatcaaggaaagcatgacaaattgctctttc

SEQ ID NO: 185465 - DNA, 75 bp, Artificial Sequence
  Synthetic
gaccagatcgagcctgggagctctctggctagcaggagaacccactgcttaagcctcaataaagcttgccttgag

SEQ ID NO: 185466 - DNA, 75 bp, Artificial Sequence
  Synthetic
aactaaagaatagtgctattagcttgctcaatactacagctatagcagtggctgagaggacagataagattatag

SEQ ID NO: 185467 - DNA, 75 bp, Artificial Sequence
  Synthetic
cgaaagttccagagaagttctctcgacgcaagactcggcttgctgaggtgcacacagcaagaggcgagagcggcg

SEQ ID NO: 185468 - DNA, 75 bp, Artificial Sequence
  Synthetic
ctcaaccataacacaagcctgtccaaaggtctcctttgatccaattcctatacattattgtgctccagctggtta

SEQ ID NO: 185469 - DNA, 75 bp, Artificial Sequence
  Synthetic
aaggtctcctttgatccaattcctatacattattgtgctccagctggttatgcgattctaaagtgtaatgataag

SEQ ID NO: 185470 - DNA, 75 bp, Artificial Sequence
  Synthetic
aaagtagcatagttagatggcctgctataaaagagagactaagacgaactgagccagcagcagagggggtgggag

SEQ ID NO: 185471 - DNA, 75 bp, Artificial Sequence
  Synthetic
tataaaagagagactaagacgaactgagccagcagcagagggggtgggagcagtatctcgagacctagaaaaaca

SEQ ID NO: 185472 - DNA, 75 bp, Artificial Sequence
  Synthetic
gagtaggagcagtatctcaagatttagataaacatggagcagttacaagtagtaatgtaaatcaccctagttgcg

SEQ ID NO: 185473 - DNA, 75 bp, Artificial Sequence
  Synthetic
ggttgagcccgggagctctctggctagcaagggaacccactgcttaaagcctcaataaagcttgccttgagtgct

SEQ ID NO: 185474 - DNA, 75 bp, Artificial Sequence
  Synthetic
cctggctggaagcgcaagaggaagaggaggtaggctttccggtcaggccacaagtacctctaagaccaatgactt

SEQ ID NO: 185475 - DNA, 75 bp, Artificial Sequence
  Synthetic
gtggcgcccgaacagggacctgaaaagcgaaagtaaaagggactcgaaagcggcggttccagagaagttctctcg

SEQ ID NO: 185476 - DNA, 75 bp, Artificial Sequence
  Synthetic
atcaaaatcctataccaaagcagtaagtataattaagtagtatatgtaatgaattatttaatagtaggaatagca

SEQ ID NO: 185477 - DNA, 75 bp, Artificial Sequence
  Synthetic
aggaagctttagataaaatagaggaagtacaaaataagagccagcaaaagacacagcaggcagcagctggcacag

SEQ ID NO: 185478 - DNA, 75 bp, Artificial Sequence
  Synthetic
aaaggtagatgacaccaaagaagctctggataaagtagaggaaatacaaaacaaaaagacagagcaggcagcagc

SEQ ID NO: 185479 - DNA, 75 bp, Artificial Sequence
  Synthetic
aatgtgactaatgtgactgctacccctaccatgaagccaggggaaataaaaaactgctctttcaatagcaccaca

SEQ ID NO: 185480 - DNA, 75 bp, Artificial Sequence
  Synthetic
gctgttgaagagatgagaaactgctctttcaatatgactacagaactaagagataaacaacaggaaagatattca

SEQ ID NO: 185481 - DNA, 75 bp, Artificial Sequence
  Synthetic
gatcagatgcatgaggatataatcagtttatgggatcaaagcctaaagccatgtgtaaagttgaccccactctgt

SEQ ID NO: 185482 - DNA, 75 bp, Artificial Sequence
  Synthetic
aaataaaatagtaagaatgtatagccctgttagcattttggacataagacaagggccaaaagaaccctttagaga

SEQ ID NO: 185483 - DNA, 75 bp, Artificial Sequence
  Synthetic
aacctttaacttccctcagatcactctttggcagcgacccgtcgtcacaataaaagtagggggacagctaaagga

SEQ ID NO: 185484 - DNA, 75 bp, Artificial Sequence
  Synthetic
gctcctaatgttacgactaatgctaatggagaaatgacaaattgctctttcaatacaactgcagtgctaagagat

SEQ ID NO: 185485 - DNA, 75 bp, Artificial Sequence
  Synthetic
aaatttggccttccaacaagggaaggccagggaattttcctcagagcagaccagagccaacagccccaccagcag

SEQ ID NO: 185486 - DNA, 75 bp, Artificial Sequence
  Synthetic
cctacaaacaatacaagaacaagtgtgcgtataggaccaggacaagtgttctatgcaacaggtgatataacagga

SEQ ID NO: 185487 - DNA, 75 bp, Artificial Sequence
  Synthetic
tagaaattgaaatgcacagttttaattgtggaggggaatttttctactgtaatacaacaaaactgtttaatagta

SEQ ID NO: 185488 - DNA, 75 bp, Artificial Sequence
  Synthetic
tagcctttaattcatctgcaggaggggatttagaaattacaacacatagttttaattgtggaggagaatttttct

SEQ ID NO: 185489 - DNA, 75 bp, Artificial Sequence
  Synthetic
gttggtaggacctacacctgtcaacataattggacgaaatatgttgactcagattggttgtactttaaattttcc

SEQ ID NO: 185490 - DNA, 75 bp, Artificial Sequence
  Synthetic
ataatacaaggaaaagtatagggataggaccaggacgaacattatatgcaacaggagctataataggagatataa

SEQ ID NO: 185491 - DNA, 75 bp, Artificial Sequence
  Synthetic
ataatacaaggaaaagtatagggataggaccaggacgaacattttatgcaacaggagctataataggagatataa

SEQ ID NO: 185492 - DNA, 75 bp, Artificial Sequence
  Synthetic
ataatacaaggaaaagtatagggataggaccaggacgaacattctatgcaacaggagctataataggagatataa

SEQ ID NO: 185493 - DNA, 75 bp, Artificial Sequence
  Synthetic
ataatacaaggaaaagtatagggataggaccaggacgaacattgtatgcaacaggagctataataggagatataa

SEQ ID NO: 185494 - DNA, 75 bp, Artificial Sequence
  Synthetic
aactaaaagaagtgctattaatctgcttgataccaatagcaatagtagtagctgaggggacagataggattatag

SEQ ID NO: 185495 - DNA, 75 bp, Artificial Sequence
  Synthetic
aactaaaagaagtgctattaatctgcttgataccattagcaatagtagtagctgaggggacagataggattatag

SEQ ID NO: 185496 - DNA, 75 bp, Artificial Sequence
  Synthetic
aactaaaagaagtgctattaatctgcttgataccactagcaatagtagtagctgaggggacagataggattatag

SEQ ID NO: 185497 - DNA, 75 bp, Artificial Sequence
  Synthetic
aactaaaagaagtgctattaatctgcttgataccagtagcaatagtagtagctgaggggacagataggattatag

SEQ ID NO: 185498 - DNA, 75 bp, Artificial Sequence
  Synthetic
gccagaaattgcagggcccctagaaaaaagggctgttggaaatgtggaaaagaaggacaccaaatgaaagactgt

SEQ ID NO: 185499 - DNA, 75 bp, Artificial Sequence
  Synthetic
agagcagaagacagtggcaatgagagcgaaggggatcaggaagaattggcaggacttgtggaaagggggcatctt

SEQ ID NO: 185500 - DNA, 75 bp, Artificial Sequence
  Synthetic
ccctcaaatcactctttggcaacgaccccttgtcacagtaaaaatagaaggacagctaagagaagctctattaga

SEQ ID NO: 185501 - DNA, 75 bp, Artificial Sequence
  Synthetic
tgaaccatcctcaggaggggacctagaaattacaacacatagctttaattgtagaggagaatttttctattgcaa

SEQ ID NO: 185502 - DNA, 75 bp, Artificial Sequence
  Synthetic
aacaaaaatagaggagctgagagctcatctattgagctggggatttactacaccagacaaaaagcatcagaaaga

SEQ ID NO: 185503 - DNA, 75 bp, Artificial Sequence
  Synthetic
tatgggatcaaagtctaaagccatgtgtaaaattaaccccaatctgtgttatgttaaactgcactgattatactg

SEQ ID NO: 185504 - DNA, 75 bp, Artificial Sequence
  Synthetic
gaagggagaaataaaaaaatgttctttcaatatcaccacacaactaggcaataaagtgaagaaagaatatgcact

SEQ ID NO: 185505 - DNA, 75 bp, Artificial Sequence
  Synthetic
acctgcggaacctgtgcctcttcagctaccaccgcttgagagacttcatcttgattgcagcgaggactgtggaga

SEQ ID NO: 185506 - DNA, 75 bp, Artificial Sequence
  Synthetic
acaagaagaagtatacatctagggccagggagcgcattttatgcaacaggtgacataataggaaatataaggcaa

SEQ ID NO: 185507 - DNA, 75 bp, Artificial Sequence
  Synthetic
aacgaatcaaaagactgaattacatgcaatccatctagttttgcaggattcaggatcagaagtagatatagtaaa

SEQ ID NO: 185508 - DNA, 75 bp, Artificial Sequence
  Synthetic
gagtctacctgttcgtaggtaccagcgcacaagaggattagagaaaatgaacaagtagataaattagtcagtaat

SEQ ID NO: 185509 - DNA, 75 bp, Artificial Sequence
  Synthetic
gagtctacctgttcgtaggtaccagcgcacaagaggattagagtaaatgaacaagtagataaattagtcagtaat

SEQ ID NO: 185510 - DNA, 75 bp, Artificial Sequence
  Synthetic
gagtctacctgttcgtaggtaccagcgcacaagaggattagagcaaatgaacaagtagataaattagtcagtaat

SEQ ID NO: 185511 - DNA, 75 bp, Artificial Sequence
  Synthetic
gagtctacctgttcgtaggtaccagcgcacaagaggattagaggaaatgaacaagtagataaattagtcagtaat

SEQ ID NO: 185512 - DNA, 75 bp, Artificial Sequence
  Synthetic
gagtctacctgttcgtaggtaccagcgcacaagaggatttgagaaaatgaacaagtagataaattagtcagtaat

SEQ ID NO: 185513 - DNA, 75 bp, Artificial Sequence
  Synthetic
gagtctacctgttcgtaggtaccagcgcacaagaggatttgagtaaatgaacaagtagataaattagtcagtaat

SEQ ID NO: 185514 - DNA, 75 bp, Artificial Sequence
  Synthetic
gagtctacctgttcgtaggtaccagcgcacaagaggatttgagcaaatgaacaagtagataaattagtcagtaat

SEQ ID NO: 185515 - DNA, 75 bp, Artificial Sequence
  Synthetic
gagtctacctgttcgtaggtaccagcgcacaagaggatttgaggaaatgaacaagtagataaattagtcagtaat

SEQ ID NO: 185516 - DNA, 75 bp, Artificial Sequence
  Synthetic
gagtctacctgttcgtaggtaccagcgcacaagaggattcgagaaaatgaacaagtagataaattagtcagtaat

SEQ ID NO: 185517 - DNA, 75 bp, Artificial Sequence
  Synthetic
gagtctacctgttcgtaggtaccagcgcacaagaggattcgagtaaatgaacaagtagataaattagtcagtaat

SEQ ID NO: 185518 - DNA, 75 bp, Artificial Sequence
  Synthetic
gagtctacctgttcgtaggtaccagcgcacaagaggattcgagcaaatgaacaagtagataaattagtcagtaat

SEQ ID NO: 185519 - DNA, 75 bp, Artificial Sequence
  Synthetic
gagtctacctgttcgtaggtaccagcgcacaagaggattcgaggaaatgaacaagtagataaattagtcagtaat

SEQ ID NO: 185520 - DNA, 75 bp, Artificial Sequence
  Synthetic
gagtctacctgttcgtaggtaccagcgcacaagaggattggagaaaatgaacaagtagataaattagtcagtaat

SEQ ID NO: 185521 - DNA, 75 bp, Artificial Sequence
  Synthetic
gagtctacctgttcgtaggtaccagcgcacaagaggattggagtaaatgaacaagtagataaattagtcagtaat

SEQ ID NO: 185522 - DNA, 75 bp, Artificial Sequence
  Synthetic
gagtctacctgttcgtaggtaccagcgcacaagaggattggagcaaatgaacaagtagataaattagtcagtaat

SEQ ID NO: 185523 - DNA, 75 bp, Artificial Sequence
  Synthetic
gagtctacctgttcgtaggtaccagcgcacaagaggattggaggaaatgaacaagtagataaattagtcagtaat

SEQ ID NO: 185524 - DNA, 75 bp, Artificial Sequence
  Synthetic
gtgtctacctgttcgtaggtaccagcgcacaagaggattagagaaaatgaacaagtagataaattagtcagtaat

SEQ ID NO: 185525 - DNA, 75 bp, Artificial Sequence
  Synthetic
gtgtctacctgttcgtaggtaccagcgcacaagaggattagagtaaatgaacaagtagataaattagtcagtaat

SEQ ID NO: 185526 - DNA, 75 bp, Artificial Sequence
  Synthetic
gtgtctacctgttcgtaggtaccagcgcacaagaggattagagcaaatgaacaagtagataaattagtcagtaat

SEQ ID NO: 185527 - DNA, 75 bp, Artificial Sequence
  Synthetic
gtgtctacctgttcgtaggtaccagcgcacaagaggattagaggaaatgaacaagtagataaattagtcagtaat

SEQ ID NO: 185528 - DNA, 75 bp, Artificial Sequence
  Synthetic
gtgtctacctgttcgtaggtaccagcgcacaagaggatttgagaaaatgaacaagtagataaattagtcagtaat

SEQ ID NO: 185529 - DNA, 75 bp, Artificial Sequence
  Synthetic
gtgtctacctgttcgtaggtaccagcgcacaagaggatttgagtaaatgaacaagtagataaattagtcagtaat

SEQ ID NO: 185530 - DNA, 75 bp, Artificial Sequence
  Synthetic
gtgtctacctgttcgtaggtaccagcgcacaagaggatttgagcaaatgaacaagtagataaattagtcagtaat

SEQ ID NO: 185531 - DNA, 75 bp, Artificial Sequence
  Synthetic
gtgtctacctgttcgtaggtaccagcgcacaagaggatttgaggaaatgaacaagtagataaattagtcagtaat

SEQ ID NO: 185532 - DNA, 75 bp, Artificial Sequence
  Synthetic
gtgtctacctgttcgtaggtaccagcgcacaagaggattcgagaaaatgaacaagtagataaattagtcagtaat

SEQ ID NO: 185533 - DNA, 75 bp, Artificial Sequence
  Synthetic
gtgtctacctgttcgtaggtaccagcgcacaagaggattcgagtaaatgaacaagtagataaattagtcagtaat

SEQ ID NO: 185534 - DNA, 75 bp, Artificial Sequence
  Synthetic
gtgtctacctgttcgtaggtaccagcgcacaagaggattcgagcaaatgaacaagtagataaattagtcagtaat

SEQ ID NO: 185535 - DNA, 75 bp, Artificial Sequence
  Synthetic
gtgtctacctgttcgtaggtaccagcgcacaagaggattcgaggaaatgaacaagtagataaattagtcagtaat

SEQ ID NO: 185536 - DNA, 75 bp, Artificial Sequence
  Synthetic
gtgtctacctgttcgtaggtaccagcgcacaagaggattggagaaaatgaacaagtagataaattagtcagtaat

SEQ ID NO: 185537 - DNA, 75 bp, Artificial Sequence
  Synthetic
gtgtctacctgttcgtaggtaccagcgcacaagaggattggagtaaatgaacaagtagataaattagtcagtaat

SEQ ID NO: 185538 - DNA, 75 bp, Artificial Sequence
  Synthetic
gtgtctacctgttcgtaggtaccagcgcacaagaggattggagcaaatgaacaagtagataaattagtcagtaat

SEQ ID NO: 185539 - DNA, 75 bp, Artificial Sequence
  Synthetic
gtgtctacctgttcgtaggtaccagcgcacaagaggattggaggaaatgaacaagtagataaattagtcagtaat

SEQ ID NO: 185540 - DNA, 75 bp, Artificial Sequence
  Synthetic
gcgtctacctgttcgtaggtaccagcgcacaagaggattagagaaaatgaacaagtagataaattagtcagtaat

SEQ ID NO: 185541 - DNA, 75 bp, Artificial Sequence
  Synthetic
gcgtctacctgttcgtaggtaccagcgcacaagaggattagagtaaatgaacaagtagataaattagtcagtaat

SEQ ID NO: 185542 - DNA, 75 bp, Artificial Sequence
  Synthetic
gcgtctacctgttcgtaggtaccagcgcacaagaggattagagcaaatgaacaagtagataaattagtcagtaat

SEQ ID NO: 185543 - DNA, 75 bp, Artificial Sequence
  Synthetic
gcgtctacctgttcgtaggtaccagcgcacaagaggattagaggaaatgaacaagtagataaattagtcagtaat

SEQ ID NO: 185544 - DNA, 75 bp, Artificial Sequence
  Synthetic
gcgtctacctgttcgtaggtaccagcgcacaagaggatttgagaaaatgaacaagtagataaattagtcagtaat

SEQ ID NO: 185545 - DNA, 75 bp, Artificial Sequence
  Synthetic
gcgtctacctgttcgtaggtaccagcgcacaagaggatttgagtaaatgaacaagtagataaattagtcagtaat

SEQ ID NO: 185546 - DNA, 75 bp, Artificial Sequence
  Synthetic
gcgtctacctgttcgtaggtaccagcgcacaagaggatttgagcaaatgaacaagtagataaattagtcagtaat

SEQ ID NO: 185547 - DNA, 75 bp, Artificial Sequence
  Synthetic
gcgtctacctgttcgtaggtaccagcgcacaagaggatttgaggaaatgaacaagtagataaattagtcagtaat

SEQ ID NO: 185548 - DNA, 75 bp, Artificial Sequence
  Synthetic
gcgtctacctgttcgtaggtaccagcgcacaagaggattcgagaaaatgaacaagtagataaattagtcagtaat

SEQ ID NO: 185549 - DNA, 75 bp, Artificial Sequence
  Synthetic
gcgtctacctgttcgtaggtaccagcgcacaagaggattcgagtaaatgaacaagtagataaattagtcagtaat

SEQ ID NO: 185550 - DNA, 75 bp, Artificial Sequence
  Synthetic
gcgtctacctgttcgtaggtaccagcgcacaagaggattcgagcaaatgaacaagtagataaattagtcagtaat

SEQ ID NO: 185551 - DNA, 75 bp, Artificial Sequence
  Synthetic
gcgtctacctgttcgtaggtaccagcgcacaagaggattcgaggaaatgaacaagtagataaattagtcagtaat

SEQ ID NO: 185552 - DNA, 75 bp, Artificial Sequence
  Synthetic
gcgtctacctgttcgtaggtaccagcgcacaagaggattggagaaaatgaacaagtagataaattagtcagtaat

SEQ ID NO: 185553 - DNA, 75 bp, Artificial Sequence
  Synthetic
gcgtctacctgttcgtaggtaccagcgcacaagaggattggagtaaatgaacaagtagataaattagtcagtaat

SEQ ID NO: 185554 - DNA, 75 bp, Artificial Sequence
  Synthetic
gcgtctacctgttcgtaggtaccagcgcacaagaggattggagcaaatgaacaagtagataaattagtcagtaat

SEQ ID NO: 185555 - DNA, 75 bp, Artificial Sequence
  Synthetic
gcgtctacctgttcgtaggtaccagcgcacaagaggattggaggaaatgaacaagtagataaattagtcagtaat

SEQ ID NO: 185556 - DNA, 75 bp, Artificial Sequence
  Synthetic
gggtctacctgttcgtaggtaccagcgcacaagaggattagagaaaatgaacaagtagataaattagtcagtaat

SEQ ID NO: 185557 - DNA, 75 bp, Artificial Sequence
  Synthetic
gggtctacctgttcgtaggtaccagcgcacaagaggattagagtaaatgaacaagtagataaattagtcagtaat

SEQ ID NO: 185558 - DNA, 75 bp, Artificial Sequence
  Synthetic
gggtctacctgttcgtaggtaccagcgcacaagaggattagagcaaatgaacaagtagataaattagtcagtaat

SEQ ID NO: 185559 - DNA, 75 bp, Artificial Sequence
  Synthetic
gggtctacctgttcgtaggtaccagcgcacaagaggattagaggaaatgaacaagtagataaattagtcagtaat

SEQ ID NO: 185560 - DNA, 75 bp, Artificial Sequence
  Synthetic
gggtctacctgttcgtaggtaccagcgcacaagaggatttgagaaaatgaacaagtagataaattagtcagtaat

SEQ ID NO: 185561 - DNA, 75 bp, Artificial Sequence
  Synthetic
gggtctacctgttcgtaggtaccagcgcacaagaggatttgagtaaatgaacaagtagataaattagtcagtaat

SEQ ID NO: 185562 - DNA, 75 bp, Artificial Sequence
  Synthetic
gggtctacctgttcgtaggtaccagcgcacaagaggatttgagcaaatgaacaagtagataaattagtcagtaat

SEQ ID NO: 185563 - DNA, 75 bp, Artificial Sequence
  Synthetic
gggtctacctgttcgtaggtaccagcgcacaagaggatttgaggaaatgaacaagtagataaattagtcagtaat

SEQ ID NO: 185564 - DNA, 75 bp, Artificial Sequence
  Synthetic
gggtctacctgttcgtaggtaccagcgcacaagaggattcgagaaaatgaacaagtagataaattagtcagtaat

SEQ ID NO: 185565 - DNA, 75 bp, Artificial Sequence
  Synthetic
gggtctacctgttcgtaggtaccagcgcacaagaggattcgagtaaatgaacaagtagataaattagtcagtaat

SEQ ID NO: 185566 - DNA, 75 bp, Artificial Sequence
  Synthetic
gggtctacctgttcgtaggtaccagcgcacaagaggattcgagcaaatgaacaagtagataaattagtcagtaat

SEQ ID NO: 185567 - DNA, 75 bp, Artificial Sequence
  Synthetic
gggtctacctgttcgtaggtaccagcgcacaagaggattcgaggaaatgaacaagtagataaattagtcagtaat

SEQ ID NO: 185568 - DNA, 75 bp, Artificial Sequence
  Synthetic
gggtctacctgttcgtaggtaccagcgcacaagaggattggagaaaatgaacaagtagataaattagtcagtaat

SEQ ID NO: 185569 - DNA, 75 bp, Artificial Sequence
  Synthetic
gggtctacctgttcgtaggtaccagcgcacaagaggattggagtaaatgaacaagtagataaattagtcagtaat

SEQ ID NO: 185570 - DNA, 75 bp, Artificial Sequence
  Synthetic
gggtctacctgttcgtaggtaccagcgcacaagaggattggagcaaatgaacaagtagataaattagtcagtaat

SEQ ID NO: 185571 - DNA, 75 bp, Artificial Sequence
  Synthetic
gggtctacctgttcgtaggtaccagcgcacaagaggattggaggaaatgaacaagtagataaattagtcagtaat

SEQ ID NO: 185572 - DNA, 75 bp, Artificial Sequence
  Synthetic
gtaaccacagaaataagagatagggacagaaaggaatatgcactcttttataggcctgatatagtacaacttagt

SEQ ID NO: 185573 - DNA, 75 bp, Artificial Sequence
  Synthetic
agggaaagaatgagaagaactaggccagcagcagaagaaactagaccagcagcagaaggggtgggagcagcatct

SEQ ID NO: 185574 - DNA, 75 bp, Artificial Sequence
  Synthetic
taagaattttacaacaattactgtttgtccatttcagagtggggtgtcagcatagccgaataggcattgtaagac

SEQ ID NO: 185575 - DNA, 75 bp, Artificial Sequence
  Synthetic
ctcaggtaccgttaagaccaatgacttacaagggagctttagatctgagccactttttaaaagaaaaggggggac

SEQ ID NO: 185576 - DNA, 75 bp, Artificial Sequence
  Synthetic
gcatagtgatatggggaaagactcctaaatttagactccccatacaaaaagaaacatgggaagcatggtggacag

SEQ ID NO: 185577 - DNA, 75 bp, Artificial Sequence
  Synthetic
gctggagtaatagatctctagactacatctggggaaacatgacctggatgcagtgggagaaagaaattgacaatt

SEQ ID NO: 185578 - DNA, 75 bp, Artificial Sequence
  Synthetic
cggcggctggtgagtacgccaattttatttgactagcggaggctagaaggagagagatgggtgcgagagcgtcag

SEQ ID NO: 185579 - DNA, 75 bp, Artificial Sequence
  Synthetic
aacacatagtatgggcaagcagggagctggaaagatttgcacttaaccctggccttttagaaacatcagaaggct

SEQ ID NO: 185580 - DNA, 75 bp, Artificial Sequence
  Synthetic
tcaaaacgtagtaagagtgactggtctgctgtaagggagagaatgaggcaagctaagccacaagctgagccccca

SEQ ID NO: 185581 - DNA, 75 bp, Artificial Sequence
  Synthetic
tatatcaaagcagtaagtactaaataaatgtaatgacacctttaaaaatttatgcaatagtagcattagtagtag

SEQ ID NO: 185582 - DNA, 75 bp, Artificial Sequence
  Synthetic
tatatcaaagcagtaagtactaaataaatgtaatgacacctttataaatttatgcaatagtagcattagtagtag

SEQ ID NO: 185583 - DNA, 75 bp, Artificial Sequence
  Synthetic
tatatcaaagcagtaagtactaaataaatgtaatgacacctttacaaatttatgcaatagtagcattagtagtag

SEQ ID NO: 185584 - DNA, 75 bp, Artificial Sequence
  Synthetic
tatatcaaagcagtaagtactaaataaatgtaatgacacctttagaaatttatgcaatagtagcattagtagtag

SEQ ID NO: 185585 - DNA, 75 bp, Artificial Sequence
  Synthetic
aagagcagaagacagtggcaatgaaagcgagggggatgcaaaggaattatcaacacttatggaggtgaggaacta

SEQ ID NO: 185586 - DNA, 75 bp, Artificial Sequence
  Synthetic
aagagcagaagacagtggcaatgaaagcgagggggatgcaaaggaattatcaacacttatggaggtgtggaacta

SEQ ID NO: 185587 - DNA, 75 bp, Artificial Sequence
  Synthetic
aagagcagaagacagtggcaatgaaagcgagggggatgcaaaggaattatcaacacttatggaggtgcggaacta

SEQ ID NO: 185588 - DNA, 75 bp, Artificial Sequence
  Synthetic
aagagcagaagacagtggcaatgaaagcgagggggatgcaaaggaattatcaacacttatggaggtggggaacta

SEQ ID NO: 185589 - DNA, 75 bp, Artificial Sequence
  Synthetic
aagagcagaagacagtggcaatgaaagcgagggggatgcataggaattatcaacacttatggaggtgaggaacta

SEQ ID NO: 185590 - DNA, 75 bp, Artificial Sequence
  Synthetic
aagagcagaagacagtggcaatgaaagcgagggggatgcataggaattatcaacacttatggaggtgtggaacta

SEQ ID NO: 185591 - DNA, 75 bp, Artificial Sequence
  Synthetic
aagagcagaagacagtggcaatgaaagcgagggggatgcataggaattatcaacacttatggaggtgcggaacta

SEQ ID NO: 185592 - DNA, 75 bp, Artificial Sequence
  Synthetic
aagagcagaagacagtggcaatgaaagcgagggggatgcataggaattatcaacacttatggaggtggggaacta

SEQ ID NO: 185593 - DNA, 75 bp, Artificial Sequence
  Synthetic
aagagcagaagacagtggcaatgaaagcgagggggatgcacaggaattatcaacacttatggaggtgaggaacta

SEQ ID NO: 185594 - DNA, 75 bp, Artificial Sequence
  Synthetic
aagagcagaagacagtggcaatgaaagcgagggggatgcacaggaattatcaacacttatggaggtgtggaacta

SEQ ID NO: 185595 - DNA, 75 bp, Artificial Sequence
  Synthetic
aagagcagaagacagtggcaatgaaagcgagggggatgcacaggaattatcaacacttatggaggtgcggaacta

SEQ ID NO: 185596 - DNA, 75 bp, Artificial Sequence
  Synthetic
aagagcagaagacagtggcaatgaaagcgagggggatgcacaggaattatcaacacttatggaggtggggaacta

SEQ ID NO: 185597 - DNA, 75 bp, Artificial Sequence
  Synthetic
aagagcagaagacagtggcaatgaaagcgagggggatgcagaggaattatcaacacttatggaggtgaggaacta

SEQ ID NO: 185598 - DNA, 75 bp, Artificial Sequence
  Synthetic
aagagcagaagacagtggcaatgaaagcgagggggatgcagaggaattatcaacacttatggaggtgtggaacta

SEQ ID NO: 185599 - DNA, 75 bp, Artificial Sequence
  Synthetic
aagagcagaagacagtggcaatgaaagcgagggggatgcagaggaattatcaacacttatggaggtgcggaacta

SEQ ID NO: 185600 - DNA, 75 bp, Artificial Sequence
  Synthetic
aagagcagaagacagtggcaatgaaagcgagggggatgcagaggaattatcaacacttatggaggtggggaacta

SEQ ID NO: 185601 - DNA, 75 bp, Artificial Sequence
  Synthetic
tagagcagaagacagtggcaatgaaagcgagggggatgcaaaggaattatcaacacttatggaggtgaggaacta

SEQ ID NO: 185602 - DNA, 75 bp, Artificial Sequence
  Synthetic
tagagcagaagacagtggcaatgaaagcgagggggatgcaaaggaattatcaacacttatggaggtgtggaacta

SEQ ID NO: 185603 - DNA, 75 bp, Artificial Sequence
  Synthetic
tagagcagaagacagtggcaatgaaagcgagggggatgcaaaggaattatcaacacttatggaggtgcggaacta

SEQ ID NO: 185604 - DNA, 75 bp, Artificial Sequence
  Synthetic
tagagcagaagacagtggcaatgaaagcgagggggatgcaaaggaattatcaacacttatggaggtggggaacta

SEQ ID NO: 185605 - DNA, 75 bp, Artificial Sequence
  Synthetic
tagagcagaagacagtggcaatgaaagcgagggggatgcataggaattatcaacacttatggaggtgaggaacta

SEQ ID NO: 185606 - DNA, 75 bp, Artificial Sequence
  Synthetic
tagagcagaagacagtggcaatgaaagcgagggggatgcataggaattatcaacacttatggaggtgtggaacta

SEQ ID NO: 185607 - DNA, 75 bp, Artificial Sequence
  Synthetic
tagagcagaagacagtggcaatgaaagcgagggggatgcataggaattatcaacacttatggaggtgcggaacta

SEQ ID NO: 185608 - DNA, 75 bp, Artificial Sequence
  Synthetic
tagagcagaagacagtggcaatgaaagcgagggggatgcataggaattatcaacacttatggaggtggggaacta

SEQ ID NO: 185609 - DNA, 75 bp, Artificial Sequence
  Synthetic
tagagcagaagacagtggcaatgaaagcgagggggatgcacaggaattatcaacacttatggaggtgaggaacta

SEQ ID NO: 185610 - DNA, 75 bp, Artificial Sequence
  Synthetic
tagagcagaagacagtggcaatgaaagcgagggggatgcacaggaattatcaacacttatggaggtgtggaacta

SEQ ID NO: 185611 - DNA, 75 bp, Artificial Sequence
  Synthetic
tagagcagaagacagtggcaatgaaagcgagggggatgcacaggaattatcaacacttatggaggtgcggaacta

SEQ ID NO: 185612 - DNA, 75 bp, Artificial Sequence
  Synthetic
tagagcagaagacagtggcaatgaaagcgagggggatgcacaggaattatcaacacttatggaggtggggaacta

SEQ ID NO: 185613 - DNA, 75 bp, Artificial Sequence
  Synthetic
tagagcagaagacagtggcaatgaaagcgagggggatgcagaggaattatcaacacttatggaggtgaggaacta

SEQ ID NO: 185614 - DNA, 75 bp, Artificial Sequence
  Synthetic
tagagcagaagacagtggcaatgaaagcgagggggatgcagaggaattatcaacacttatggaggtgtggaacta

SEQ ID NO: 185615 - DNA, 75 bp, Artificial Sequence
  Synthetic
tagagcagaagacagtggcaatgaaagcgagggggatgcagaggaattatcaacacttatggaggtgcggaacta

SEQ ID NO: 185616 - DNA, 75 bp, Artificial Sequence
  Synthetic
tagagcagaagacagtggcaatgaaagcgagggggatgcagaggaattatcaacacttatggaggtggggaacta

SEQ ID NO: 185617 - DNA, 75 bp, Artificial Sequence
  Synthetic
cagagcagaagacagtggcaatgaaagcgagggggatgcaaaggaattatcaacacttatggaggtgaggaacta

SEQ ID NO: 185618 - DNA, 75 bp, Artificial Sequence
  Synthetic
cagagcagaagacagtggcaatgaaagcgagggggatgcaaaggaattatcaacacttatggaggtgtggaacta

SEQ ID NO: 185619 - DNA, 75 bp, Artificial Sequence
  Synthetic
cagagcagaagacagtggcaatgaaagcgagggggatgcaaaggaattatcaacacttatggaggtgcggaacta

SEQ ID NO: 185620 - DNA, 75 bp, Artificial Sequence
  Synthetic
cagagcagaagacagtggcaatgaaagcgagggggatgcaaaggaattatcaacacttatggaggtggggaacta

SEQ ID NO: 185621 - DNA, 75 bp, Artificial Sequence
  Synthetic
cagagcagaagacagtggcaatgaaagcgagggggatgcataggaattatcaacacttatggaggtgaggaacta

SEQ ID NO: 185622 - DNA, 75 bp, Artificial Sequence
  Synthetic
cagagcagaagacagtggcaatgaaagcgagggggatgcataggaattatcaacacttatggaggtgtggaacta

SEQ ID NO: 185623 - DNA, 75 bp, Artificial Sequence
  Synthetic
cagagcagaagacagtggcaatgaaagcgagggggatgcataggaattatcaacacttatggaggtgcggaacta

SEQ ID NO: 185624 - DNA, 75 bp, Artificial Sequence
  Synthetic
cagagcagaagacagtggcaatgaaagcgagggggatgcataggaattatcaacacttatggaggtggggaacta

SEQ ID NO: 185625 - DNA, 75 bp, Artificial Sequence
  Synthetic
cagagcagaagacagtggcaatgaaagcgagggggatgcacaggaattatcaacacttatggaggtgaggaacta

SEQ ID NO: 185626 - DNA, 75 bp, Artificial Sequence
  Synthetic
cagagcagaagacagtggcaatgaaagcgagggggatgcacaggaattatcaacacttatggaggtgtggaacta

SEQ ID NO: 185627 - DNA, 75 bp, Artificial Sequence
  Synthetic
cagagcagaagacagtggcaatgaaagcgagggggatgcacaggaattatcaacacttatggaggtgcggaacta

SEQ ID NO: 185628 - DNA, 75 bp, Artificial Sequence
  Synthetic
cagagcagaagacagtggcaatgaaagcgagggggatgcacaggaattatcaacacttatggaggtggggaacta

SEQ ID NO: 185629 - DNA, 75 bp, Artificial Sequence
  Synthetic
cagagcagaagacagtggcaatgaaagcgagggggatgcagaggaattatcaacacttatggaggtgaggaacta

SEQ ID NO: 185630 - DNA, 75 bp, Artificial Sequence
  Synthetic
cagagcagaagacagtggcaatgaaagcgagggggatgcagaggaattatcaacacttatggaggtgtggaacta

SEQ ID NO: 185631 - DNA, 75 bp, Artificial Sequence
  Synthetic
cagagcagaagacagtggcaatgaaagcgagggggatgcagaggaattatcaacacttatggaggtgcggaacta

SEQ ID NO: 185632 - DNA, 75 bp, Artificial Sequence
  Synthetic
cagagcagaagacagtggcaatgaaagcgagggggatgcagaggaattatcaacacttatggaggtggggaacta

SEQ ID NO: 185633 - DNA, 75 bp, Artificial Sequence
  Synthetic
gagagcagaagacagtggcaatgaaagcgagggggatgcaaaggaattatcaacacttatggaggtgaggaacta

SEQ ID NO: 185634 - DNA, 75 bp, Artificial Sequence
  Synthetic
gagagcagaagacagtggcaatgaaagcgagggggatgcaaaggaattatcaacacttatggaggtgtggaacta

SEQ ID NO: 185635 - DNA, 75 bp, Artificial Sequence
  Synthetic
gagagcagaagacagtggcaatgaaagcgagggggatgcaaaggaattatcaacacttatggaggtgcggaacta

SEQ ID NO: 185636 - DNA, 75 bp, Artificial Sequence
  Synthetic
gagagcagaagacagtggcaatgaaagcgagggggatgcaaaggaattatcaacacttatggaggtggggaacta

SEQ ID NO: 185637 - DNA, 75 bp, Artificial Sequence
  Synthetic
gagagcagaagacagtggcaatgaaagcgagggggatgcataggaattatcaacacttatggaggtgaggaacta

SEQ ID NO: 185638 - DNA, 75 bp, Artificial Sequence
  Synthetic
gagagcagaagacagtggcaatgaaagcgagggggatgcataggaattatcaacacttatggaggtgtggaacta

SEQ ID NO: 185639 - DNA, 75 bp, Artificial Sequence
  Synthetic
gagagcagaagacagtggcaatgaaagcgagggggatgcataggaattatcaacacttatggaggtgcggaacta

SEQ ID NO: 185640 - DNA, 75 bp, Artificial Sequence
  Synthetic
gagagcagaagacagtggcaatgaaagcgagggggatgcataggaattatcaacacttatggaggtggggaacta

SEQ ID NO: 185641 - DNA, 75 bp, Artificial Sequence
  Synthetic
gagagcagaagacagtggcaatgaaagcgagggggatgcacaggaattatcaacacttatggaggtgaggaacta

SEQ ID NO: 185642 - DNA, 75 bp, Artificial Sequence
  Synthetic
gagagcagaagacagtggcaatgaaagcgagggggatgcacaggaattatcaacacttatggaggtgtggaacta

SEQ ID NO: 185643 - DNA, 75 bp, Artificial Sequence
  Synthetic
gagagcagaagacagtggcaatgaaagcgagggggatgcacaggaattatcaacacttatggaggtgcggaacta

SEQ ID NO: 185644 - DNA, 75 bp, Artificial Sequence
  Synthetic
gagagcagaagacagtggcaatgaaagcgagggggatgcacaggaattatcaacacttatggaggtggggaacta

SEQ ID NO: 185645 - DNA, 75 bp, Artificial Sequence
  Synthetic
gagagcagaagacagtggcaatgaaagcgagggggatgcagaggaattatcaacacttatggaggtgaggaacta

SEQ ID NO: 185646 - DNA, 75 bp, Artificial Sequence
  Synthetic
gagagcagaagacagtggcaatgaaagcgagggggatgcagaggaattatcaacacttatggaggtgtggaacta

SEQ ID NO: 185647 - DNA, 75 bp, Artificial Sequence
  Synthetic
gagagcagaagacagtggcaatgaaagcgagggggatgcagaggaattatcaacacttatggaggtgcggaacta

SEQ ID NO: 185648 - DNA, 75 bp, Artificial Sequence
  Synthetic
gagagcagaagacagtggcaatgaaagcgagggggatgcagaggaattatcaacacttatggaggtggggaacta

SEQ ID NO: 185649 - DNA, 75 bp, Artificial Sequence
  Synthetic
acacagacacaatataccagttgcttgaagaatcgcaaatccaacaggaaaaaaatgaaaaagatttattagcat

SEQ ID NO: 185650 - DNA, 75 bp, Artificial Sequence
  Synthetic
gctaatattagtagatgggaaaggatggatccaggagaaataaaaaactgctctttcaatgtcaccagtaatata

SEQ ID NO: 185651 - DNA, 75 bp, Artificial Sequence
  Synthetic
ccaactaattcatctgcaatattttgattgtttttcagaatctaccataaggaaagccatattaggacatagaat

SEQ ID NO: 185652 - DNA, 75 bp, Artificial Sequence
  Synthetic
aaggcagaaagttattactctaactgaaacaacaaatcagaagactgaattacaagcaattcagctagctttgca

SEQ ID NO: 185653 - DNA, 75 bp, Artificial Sequence
  Synthetic
cccggaggaatcgaagaagaaggtggagagcaagacagagacagatcagtgagattagtgaacggattcttagcg

SEQ ID NO: 185654 - DNA, 75 bp, Artificial Sequence
  Synthetic
gtaaagatcatcaggatcctataccagagcagtaagtaaaattaaataattctgtaatgcaacccttacaaatag

SEQ ID NO: 185655 - DNA, 75 bp, Artificial Sequence
  Synthetic
aatgaaaaactgctctttcaatatcaccacaagtataagagataaggtgcagaaagaatatgcacttttttataa

SEQ ID NO: 185656 - DNA, 75 bp, Artificial Sequence
  Synthetic
aacatgaccacagaactaagagataaaaggaaaactgtacattcacttttttataaacttgatatagtatcaact

SEQ ID NO: 185657 - DNA, 75 bp, Artificial Sequence
  Synthetic
aagcataatagtacagctgaacgagtctgtagtagttaattgtacaagacccaacaacaatacaagaaaaggtat

SEQ ID NO: 185658 - DNA, 75 bp, Artificial Sequence
  Synthetic
atacataggaccagggaaaaaagtttatacaacagatagaataataggcgatataagaaaagcacattgcaacat

SEQ ID NO: 185659 - DNA, 75 bp, Artificial Sequence
  Synthetic
gatctttgggttggggataatttgtagtgcctcaaataacttgtgggtcacagtctattatggggtacctgtgtg

SEQ ID NO: 185660 - DNA, 75 bp, Artificial Sequence
  Synthetic
atttttgggaagttcaattaggaataccacatcctgctgggttaaaaaagaaaaaatcagtaacagtattggatg

SEQ ID NO: 185661 - DNA, 75 bp, Artificial Sequence
  Synthetic
gtgtggtttgtagtaataatagattataggataataatacaacgaaggataatcgactggcttcttaaaataata

SEQ ID NO: 185662 - DNA, 75 bp, Artificial Sequence
  Synthetic
ataggataataatacaacgaaggataatcgactggcttcttaaaataataaataatacagcagacagcagcaaca

SEQ ID NO: 185663 - DNA, 75 bp, Artificial Sequence
  Synthetic
gactattttaaaagcattgggaccagcagctacactagaagaaatgatgacagcatgtcagggagtgggaggacc

SEQ ID NO: 185664 - DNA, 75 bp, Artificial Sequence
  Synthetic
caatataaccacagaaatgaaagataaacagaagaaagaatacgcgcttttctatagagttgatatagtaccact

SEQ ID NO: 185665 - DNA, 75 bp, Artificial Sequence
  Synthetic
aagaaaagcatattgtaatgtcagcagagcagcatagaatagcactttacaaaagataagtacacaattaagaaa

SEQ ID NO: 185666 - DNA, 75 bp, Artificial Sequence
  Synthetic
aagaaaagcatattgtaatgtcagcagagcagcattgaatagcactttacaaaagataagtacacaattaagaaa

SEQ ID NO: 185667 - DNA, 75 bp, Artificial Sequence
  Synthetic
aagaaaagcatattgtaatgtcagcagagcagcatcgaatagcactttacaaaagataagtacacaattaagaaa

SEQ ID NO: 185668 - DNA, 75 bp, Artificial Sequence
  Synthetic
aagaaaagcatattgtaatgtcagcagagcagcatggaatagcactttacaaaagataagtacacaattaagaaa

SEQ ID NO: 185669 - DNA, 75 bp, Artificial Sequence
  Synthetic
tagaagttacaacacatagtttcaattgtggaggagaatttttctattgcaatacaacagacctgttcaatagca

SEQ ID NO: 185670 - DNA, 75 bp, Artificial Sequence
  Synthetic
gctttgctataagatgggtggcaagtggtcaaaattgtctggatggtccactgtaagggaaagaatgaggcgagc

SEQ ID NO: 185671 - DNA, 75 bp, Artificial Sequence
  Synthetic
taccagtaatggtaatactacccacaataataccatgtatgaagaaatgaggaattgctctttcaatgcaaccac

SEQ ID NO: 185672 - DNA, 75 bp, Artificial Sequence
  Synthetic
acagggatggaaaggatcaccagcaatattccaaagtagcatgacaaaaattttagagccctttagagcacggaa

SEQ ID NO: 185673 - DNA, 75 bp, Artificial Sequence
  Synthetic
acaataggggacgcaacacaagacatgaaaaactgctctttcaatatgaccacaattctaacagacaagaaagag

SEQ ID NO: 185674 - DNA, 75 bp, Artificial Sequence
  Synthetic
aagggaaagaatgagacgaactgagccagcagcagagggggtgggagcagtatctcgagacctggaaaaacatgg

SEQ ID NO: 185675 - DNA, 75 bp, Artificial Sequence
  Synthetic
ctccatcctgacaaatggacagtacagcctatacagctgccagaaaaagatagctggactgtcaatgatatacag

SEQ ID NO: 185676 - DNA, 75 bp, Artificial Sequence
  Synthetic
tggaactctagttggagtaataaaacttataatgaaatatgggataatatgacctggcagcaatgggagaaagaa

SEQ ID NO: 185677 - DNA, 75 bp, Artificial Sequence
  Synthetic
ggctgtggaaagatacctaaaggatcagcagatcctaagaatttgaggttgctctagaaaactcatctgcaccac

SEQ ID NO: 185678 - DNA, 75 bp, Artificial Sequence
  Synthetic
ggctgtggaaagatacctaaaggatcagcagatcctaagaatttgtggttgctctagaaaactcatctgcaccac

SEQ ID NO: 185679 - DNA, 75 bp, Artificial Sequence
  Synthetic
ggctgtggaaagatacctaaaggatcagcagatcctaagaatttgcggttgctctagaaaactcatctgcaccac

SEQ ID NO: 185680 - DNA, 75 bp, Artificial Sequence
  Synthetic
ggctgtggaaagatacctaaaggatcagcagatcctaagaatttggggttgctctagaaaactcatctgcaccac

SEQ ID NO: 185681 - DNA, 75 bp, Artificial Sequence
  Synthetic
ggctgtggaaagatacctaaaggatcagcagttcctaagaatttgaggttgctctagaaaactcatctgcaccac

SEQ ID NO: 185682 - DNA, 75 bp, Artificial Sequence
  Synthetic
ggctgtggaaagatacctaaaggatcagcagttcctaagaatttgtggttgctctagaaaactcatctgcaccac

SEQ ID NO: 185683 - DNA, 75 bp, Artificial Sequence
  Synthetic
ggctgtggaaagatacctaaaggatcagcagttcctaagaatttgcggttgctctagaaaactcatctgcaccac

SEQ ID NO: 185684 - DNA, 75 bp, Artificial Sequence
  Synthetic
ggctgtggaaagatacctaaaggatcagcagttcctaagaatttggggttgctctagaaaactcatctgcaccac

SEQ ID NO: 185685 - DNA, 75 bp, Artificial Sequence
  Synthetic
ggctgtggaaagatacctaaaggatcagcagctcctaagaatttgaggttgctctagaaaactcatctgcaccac

SEQ ID NO: 185686 - DNA, 75 bp, Artificial Sequence
  Synthetic
ggctgtggaaagatacctaaaggatcagcagctcctaagaatttgtggttgctctagaaaactcatctgcaccac

SEQ ID NO: 185687 - DNA, 75 bp, Artificial Sequence
  Synthetic
ggctgtggaaagatacctaaaggatcagcagctcctaagaatttgcggttgctctagaaaactcatctgcaccac

SEQ ID NO: 185688 - DNA, 75 bp, Artificial Sequence
  Synthetic
ggctgtggaaagatacctaaaggatcagcagctcctaagaatttggggttgctctagaaaactcatctgcaccac

SEQ ID NO: 185689 - DNA, 75 bp, Artificial Sequence
  Synthetic
ggctgtggaaagatacctaaaggatcagcaggtcctaagaatttgaggttgctctagaaaactcatctgcaccac

SEQ ID NO: 185690 - DNA, 75 bp, Artificial Sequence
  Synthetic
ggctgtggaaagatacctaaaggatcagcaggtcctaagaatttgtggttgctctagaaaactcatctgcaccac

SEQ ID NO: 185691 - DNA, 75 bp, Artificial Sequence
  Synthetic
ggctgtggaaagatacctaaaggatcagcaggtcctaagaatttgcggttgctctagaaaactcatctgcaccac

SEQ ID NO: 185692 - DNA, 75 bp, Artificial Sequence
  Synthetic
ggctgtggaaagatacctaaaggatcagcaggtcctaagaatttggggttgctctagaaaactcatctgcaccac

SEQ ID NO: 185693 - DNA, 75 bp, Artificial Sequence
  Synthetic
ggctgtggaaagttacctaaaggatcagcagatcctaagaatttgaggttgctctagaaaactcatctgcaccac

SEQ ID NO: 185694 - DNA, 75 bp, Artificial Sequence
  Synthetic
ggctgtggaaagttacctaaaggatcagcagatcctaagaatttgtggttgctctagaaaactcatctgcaccac

SEQ ID NO: 185695 - DNA, 75 bp, Artificial Sequence
  Synthetic
ggctgtggaaagttacctaaaggatcagcagatcctaagaatttgcggttgctctagaaaactcatctgcaccac

SEQ ID NO: 185696 - DNA, 75 bp, Artificial Sequence
  Synthetic
ggctgtggaaagttacctaaaggatcagcagatcctaagaatttggggttgctctagaaaactcatctgcaccac

SEQ ID NO: 185697 - DNA, 75 bp, Artificial Sequence
  Synthetic
ggctgtggaaagttacctaaaggatcagcagttcctaagaatttgaggttgctctagaaaactcatctgcaccac

SEQ ID NO: 185698 - DNA, 75 bp, Artificial Sequence
  Synthetic
ggctgtggaaagttacctaaaggatcagcagttcctaagaatttgtggttgctctagaaaactcatctgcaccac

SEQ ID NO: 185699 - DNA, 75 bp, Artificial Sequence
  Synthetic
ggctgtggaaagttacctaaaggatcagcagttcctaagaatttgcggttgctctagaaaactcatctgcaccac

SEQ ID NO: 185700 - DNA, 75 bp, Artificial Sequence
  Synthetic
ggctgtggaaagttacctaaaggatcagcagttcctaagaatttggggttgctctagaaaactcatctgcaccac

SEQ ID NO: 185701 - DNA, 75 bp, Artificial Sequence
  Synthetic
ggctgtggaaagttacctaaaggatcagcagctcctaagaatttgaggttgctctagaaaactcatctgcaccac

SEQ ID NO: 185702 - DNA, 75 bp, Artificial Sequence
  Synthetic
ggctgtggaaagttacctaaaggatcagcagctcctaagaatttgtggttgctctagaaaactcatctgcaccac

SEQ ID NO: 185703 - DNA, 75 bp, Artificial Sequence
  Synthetic
ggctgtggaaagttacctaaaggatcagcagctcctaagaatttgcggttgctctagaaaactcatctgcaccac

SEQ ID NO: 185704 - DNA, 75 bp, Artificial Sequence
  Synthetic
ggctgtggaaagttacctaaaggatcagcagctcctaagaatttggggttgctctagaaaactcatctgcaccac

SEQ ID NO: 185705 - DNA, 75 bp, Artificial Sequence
  Synthetic
ggctgtggaaagttacctaaaggatcagcaggtcctaagaatttgaggttgctctagaaaactcatctgcaccac

SEQ ID NO: 185706 - DNA, 75 bp, Artificial Sequence
  Synthetic
ggctgtggaaagttacctaaaggatcagcaggtcctaagaatttgtggttgctctagaaaactcatctgcaccac

SEQ ID NO: 185707 - DNA, 75 bp, Artificial Sequence
  Synthetic
ggctgtggaaagttacctaaaggatcagcaggtcctaagaatttgcggttgctctagaaaactcatctgcaccac

SEQ ID NO: 185708 - DNA, 75 bp, Artificial Sequence
  Synthetic
ggctgtggaaagttacctaaaggatcagcaggtcctaagaatttggggttgctctagaaaactcatctgcaccac

SEQ ID NO: 185709 - DNA, 75 bp, Artificial Sequence
  Synthetic
ggctgtggaaagctacctaaaggatcagcagatcctaagaatttgaggttgctctagaaaactcatctgcaccac

SEQ ID NO: 185710 - DNA, 75 bp, Artificial Sequence
  Synthetic
ggctgtggaaagctacctaaaggatcagcagatcctaagaatttgtggttgctctagaaaactcatctgcaccac

SEQ ID NO: 185711 - DNA, 75 bp, Artificial Sequence
  Synthetic
ggctgtggaaagctacctaaaggatcagcagatcctaagaatttgcggttgctctagaaaactcatctgcaccac

SEQ ID NO: 185712 - DNA, 75 bp, Artificial Sequence
  Synthetic
ggctgtggaaagctacctaaaggatcagcagatcctaagaatttggggttgctctagaaaactcatctgcaccac

SEQ ID NO: 185713 - DNA, 75 bp, Artificial Sequence
  Synthetic
ggctgtggaaagctacctaaaggatcagcagttcctaagaatttgaggttgctctagaaaactcatctgcaccac

SEQ ID NO: 185714 - DNA, 75 bp, Artificial Sequence
  Synthetic
ggctgtggaaagctacctaaaggatcagcagttcctaagaatttgtggttgctctagaaaactcatctgcaccac

SEQ ID NO: 185715 - DNA, 75 bp, Artificial Sequence
  Synthetic
ggctgtggaaagctacctaaaggatcagcagttcctaagaatttgcggttgctctagaaaactcatctgcaccac

SEQ ID NO: 185716 - DNA, 75 bp, Artificial Sequence
  Synthetic
ggctgtggaaagctacctaaaggatcagcagttcctaagaatttggggttgctctagaaaactcatctgcaccac

SEQ ID NO: 185717 - DNA, 75 bp, Artificial Sequence
  Synthetic
ggctgtggaaagctacctaaaggatcagcagctcctaagaatttgaggttgctctagaaaactcatctgcaccac

SEQ ID NO: 185718 - DNA, 75 bp, Artificial Sequence
  Synthetic
ggctgtggaaagctacctaaaggatcagcagctcctaagaatttgtggttgctctagaaaactcatctgcaccac

SEQ ID NO: 185719 - DNA, 75 bp, Artificial Sequence
  Synthetic
ggctgtggaaagctacctaaaggatcagcagctcctaagaatttgcggttgctctagaaaactcatctgcaccac

SEQ ID NO: 185720 - DNA, 75 bp, Artificial Sequence
  Synthetic
ggctgtggaaagctacctaaaggatcagcagctcctaagaatttggggttgctctagaaaactcatctgcaccac

SEQ ID NO: 185721 - DNA, 75 bp, Artificial Sequence
  Synthetic
ggctgtggaaagctacctaaaggatcagcaggtcctaagaatttgaggttgctctagaaaactcatctgcaccac

SEQ ID NO: 185722 - DNA, 75 bp, Artificial Sequence
  Synthetic
ggctgtggaaagctacctaaaggatcagcaggtcctaagaatttgtggttgctctagaaaactcatctgcaccac

SEQ ID NO: 185723 - DNA, 75 bp, Artificial Sequence
  Synthetic
ggctgtggaaagctacctaaaggatcagcaggtcctaagaatttgcggttgctctagaaaactcatctgcaccac

SEQ ID NO: 185724 - DNA, 75 bp, Artificial Sequence
  Synthetic
ggctgtggaaagctacctaaaggatcagcaggtcctaagaatttggggttgctctagaaaactcatctgcaccac

SEQ ID NO: 185725 - DNA, 75 bp, Artificial Sequence
  Synthetic
ggctgtggaaaggtacctaaaggatcagcagatcctaagaatttgaggttgctctagaaaactcatctgcaccac

SEQ ID NO: 185726 - DNA, 75 bp, Artificial Sequence
  Synthetic
ggctgtggaaaggtacctaaaggatcagcagatcctaagaatttgtggttgctctagaaaactcatctgcaccac

SEQ ID NO: 185727 - DNA, 75 bp, Artificial Sequence
  Synthetic
ggctgtggaaaggtacctaaaggatcagcagatcctaagaatttgcggttgctctagaaaactcatctgcaccac

SEQ ID NO: 185728 - DNA, 75 bp, Artificial Sequence
  Synthetic
ggctgtggaaaggtacctaaaggatcagcagatcctaagaatttggggttgctctagaaaactcatctgcaccac

SEQ ID NO: 185729 - DNA, 75 bp, Artificial Sequence
  Synthetic
ggctgtggaaaggtacctaaaggatcagcagttcctaagaatttgaggttgctctagaaaactcatctgcaccac

SEQ ID NO: 185730 - DNA, 75 bp, Artificial Sequence
  Synthetic
ggctgtggaaaggtacctaaaggatcagcagttcctaagaatttgtggttgctctagaaaactcatctgcaccac

SEQ ID NO: 185731 - DNA, 75 bp, Artificial Sequence
  Synthetic
ggctgtggaaaggtacctaaaggatcagcagttcctaagaatttgcggttgctctagaaaactcatctgcaccac

SEQ ID NO: 185732 - DNA, 75 bp, Artificial Sequence
  Synthetic
ggctgtggaaaggtacctaaaggatcagcagttcctaagaatttggggttgctctagaaaactcatctgcaccac

SEQ ID NO: 185733 - DNA, 75 bp, Artificial Sequence
  Synthetic
ggctgtggaaaggtacctaaaggatcagcagctcctaagaatttgaggttgctctagaaaactcatctgcaccac

SEQ ID NO: 185734 - DNA, 75 bp, Artificial Sequence
  Synthetic
ggctgtggaaaggtacctaaaggatcagcagctcctaagaatttgtggttgctctagaaaactcatctgcaccac

SEQ ID NO: 185735 - DNA, 75 bp, Artificial Sequence
  Synthetic
ggctgtggaaaggtacctaaaggatcagcagctcctaagaatttgcggttgctctagaaaactcatctgcaccac

SEQ ID NO: 185736 - DNA, 75 bp, Artificial Sequence
  Synthetic
ggctgtggaaaggtacctaaaggatcagcagctcctaagaatttggggttgctctagaaaactcatctgcaccac

SEQ ID NO: 185737 - DNA, 75 bp, Artificial Sequence
  Synthetic
ggctgtggaaaggtacctaaaggatcagcaggtcctaagaatttgaggttgctctagaaaactcatctgcaccac

SEQ ID NO: 185738 - DNA, 75 bp, Artificial Sequence
  Synthetic
ggctgtggaaaggtacctaaaggatcagcaggtcctaagaatttgtggttgctctagaaaactcatctgcaccac

SEQ ID NO: 185739 - DNA, 75 bp, Artificial Sequence
  Synthetic
ggctgtggaaaggtacctaaaggatcagcaggtcctaagaatttgcggttgctctagaaaactcatctgcaccac

SEQ ID NO: 185740 - DNA, 75 bp, Artificial Sequence
  Synthetic
ggctgtggaaaggtacctaaaggatcagcaggtcctaagaatttggggttgctctagaaaactcatctgcaccac

SEQ ID NO: 185741 - DNA, 75 bp, Artificial Sequence
  Synthetic
tatgacctggatgcagtgggaaaaagaaattggcaattacacaagcttaatatacaccttaattgaagaatcgca

SEQ ID NO: 185742 - DNA, 75 bp, Artificial Sequence
  Synthetic
gtatgaggataggaccaggacaagtattctatgccacaaacggcataataggagacataagacaagcacattgta

SEQ ID NO: 185743 - DNA, 75 bp, Artificial Sequence
  Synthetic
gacataatatatgatctaattaaaaaatcgcaaaaccagcaggaaaagaatgaacaagatttattggcattagat

SEQ ID NO: 185744 - DNA, 75 bp, Artificial Sequence
  Synthetic
gacataatatatgatctaattaaaaaatcgcaaaaccagcaggaaaagaatgatcaagatttattggcattagat

SEQ ID NO: 185745 - DNA, 75 bp, Artificial Sequence
  Synthetic
gacataatatatgatctaattaaaaaatcgcaaaaccagcaggaaaagaatgaccaagatttattggcattagat

SEQ ID NO: 185746 - DNA, 75 bp, Artificial Sequence
  Synthetic
gacataatatatgatctaattaaaaaatcgcaaaaccagcaggaaaagaatgagcaagatttattggcattagat

SEQ ID NO: 185747 - DNA, 75 bp, Artificial Sequence
  Synthetic
gacataatatatgatctaatttaaaaatcgcaaaaccagcaggaaaagaatgaacaagatttattggcattagat

SEQ ID NO: 185748 - DNA, 75 bp, Artificial Sequence
  Synthetic
gacataatatatgatctaatttaaaaatcgcaaaaccagcaggaaaagaatgatcaagatttattggcattagat

SEQ ID NO: 185749 - DNA, 75 bp, Artificial Sequence
  Synthetic
gacataatatatgatctaatttaaaaatcgcaaaaccagcaggaaaagaatgaccaagatttattggcattagat

SEQ ID NO: 185750 - DNA, 75 bp, Artificial Sequence
  Synthetic
gacataatatatgatctaatttaaaaatcgcaaaaccagcaggaaaagaatgagcaagatttattggcattagat

SEQ ID NO: 185751 - DNA, 75 bp, Artificial Sequence
  Synthetic
gacataatatatgatctaattcaaaaatcgcaaaaccagcaggaaaagaatgaacaagatttattggcattagat

SEQ ID NO: 185752 - DNA, 75 bp, Artificial Sequence
  Synthetic
gacataatatatgatctaattcaaaaatcgcaaaaccagcaggaaaagaatgatcaagatttattggcattagat

SEQ ID NO: 185753 - DNA, 75 bp, Artificial Sequence
  Synthetic
gacataatatatgatctaattcaaaaatcgcaaaaccagcaggaaaagaatgaccaagatttattggcattagat

SEQ ID NO: 185754 - DNA, 75 bp, Artificial Sequence
  Synthetic
gacataatatatgatctaattcaaaaatcgcaaaaccagcaggaaaagaatgagcaagatttattggcattagat

SEQ ID NO: 185755 - DNA, 75 bp, Artificial Sequence
  Synthetic
gacataatatatgatctaattgaaaaatcgcaaaaccagcaggaaaagaatgaacaagatttattggcattagat

SEQ ID NO: 185756 - DNA, 75 bp, Artificial Sequence
  Synthetic
gacataatatatgatctaattgaaaaatcgcaaaaccagcaggaaaagaatgatcaagatttattggcattagat

SEQ ID NO: 185757 - DNA, 75 bp, Artificial Sequence
  Synthetic
gacataatatatgatctaattgaaaaatcgcaaaaccagcaggaaaagaatgaccaagatttattggcattagat

SEQ ID NO: 185758 - DNA, 75 bp, Artificial Sequence
  Synthetic
gacataatatatgatctaattgaaaaatcgcaaaaccagcaggaaaagaatgagcaagatttattggcattagat

SEQ ID NO: 185759 - DNA, 75 bp, Artificial Sequence
  Synthetic
acgtataggaccaggacaagcattctatgcaacaggtgaagtaacaggagacataaggcaagctcattgcaacat

SEQ ID NO: 185760 - DNA, 75 bp, Artificial Sequence
  Synthetic
attcttagcacttgcctgggacgatctgaggaacctgtgcctcttcagctaccaccgattgagagacttcgcctt

SEQ ID NO: 185761 - DNA, 75 bp, Artificial Sequence
  Synthetic
atggtggacagactattggcaggccacctggattcctgagtgggaatttgtcaatacccctcctctagtaaaatt

SEQ ID NO: 185762 - DNA, 75 bp, Artificial Sequence
  Synthetic
acttcatctcgattgcagcgaggactgtagaacttctgaaacgcagcagtctcaaaggactgagactgaggtatg

SEQ ID NO: 185763 - DNA, 75 bp, Artificial Sequence
  Synthetic
acttcatctcgattgcagcgaggactgtagaacttctgaaacgcagcagtctcaaaggactgagactgtggtatg

SEQ ID NO: 185764 - DNA, 75 bp, Artificial Sequence
  Synthetic
acttcatctcgattgcagcgaggactgtagaacttctgaaacgcagcagtctcaaaggactgagactgcggtatg

SEQ ID NO: 185765 - DNA, 75 bp, Artificial Sequence
  Synthetic
acttcatctcgattgcagcgaggactgtagaacttctgaaacgcagcagtctcaaaggactgagactggggtatg

SEQ ID NO: 185766 - DNA, 75 bp, Artificial Sequence
  Synthetic
acttcatctcgattgcagcgaggactgtagaacttctgaaacgcagcagtctcaatggactgagactgaggtatg

SEQ ID NO: 185767 - DNA, 75 bp, Artificial Sequence
  Synthetic
acttcatctcgattgcagcgaggactgtagaacttctgaaacgcagcagtctcaatggactgagactgtggtatg

SEQ ID NO: 185768 - DNA, 75 bp, Artificial Sequence
  Synthetic
acttcatctcgattgcagcgaggactgtagaacttctgaaacgcagcagtctcaatggactgagactgcggtatg

SEQ ID NO: 185769 - DNA, 75 bp, Artificial Sequence
  Synthetic
acttcatctcgattgcagcgaggactgtagaacttctgaaacgcagcagtctcaatggactgagactggggtatg

SEQ ID NO: 185770 - DNA, 75 bp, Artificial Sequence
  Synthetic
acttcatctcgattgcagcgaggactgtagaacttctgaaacgcagcagtctcaacggactgagactgaggtatg

SEQ ID NO: 185771 - DNA, 75 bp, Artificial Sequence
  Synthetic
acttcatctcgattgcagcgaggactgtagaacttctgaaacgcagcagtctcaacggactgagactgtggtatg

SEQ ID NO: 185772 - DNA, 75 bp, Artificial Sequence
  Synthetic
acttcatctcgattgcagcgaggactgtagaacttctgaaacgcagcagtctcaacggactgagactgcggtatg

SEQ ID NO: 185773 - DNA, 75 bp, Artificial Sequence
  Synthetic
acttcatctcgattgcagcgaggactgtagaacttctgaaacgcagcagtctcaacggactgagactggggtatg

SEQ ID NO: 185774 - DNA, 75 bp, Artificial Sequence
  Synthetic
acttcatctcgattgcagcgaggactgtagaacttctgaaacgcagcagtctcaagggactgagactgaggtatg

SEQ ID NO: 185775 - DNA, 75 bp, Artificial Sequence
  Synthetic
acttcatctcgattgcagcgaggactgtagaacttctgaaacgcagcagtctcaagggactgagactgtggtatg

SEQ ID NO: 185776 - DNA, 75 bp, Artificial Sequence
  Synthetic
acttcatctcgattgcagcgaggactgtagaacttctgaaacgcagcagtctcaagggactgagactgcggtatg

SEQ ID NO: 185777 - DNA, 75 bp, Artificial Sequence
  Synthetic
acttcatctcgattgcagcgaggactgtagaacttctgaaacgcagcagtctcaagggactgagactggggtatg

SEQ ID NO: 185778 - DNA, 75 bp, Artificial Sequence
  Synthetic
acttcatctcgattgcagcgaggactgttgaacttctgaaacgcagcagtctcaaaggactgagactgaggtatg

SEQ ID NO: 185779 - DNA, 75 bp, Artificial Sequence
  Synthetic
acttcatctcgattgcagcgaggactgttgaacttctgaaacgcagcagtctcaaaggactgagactgtggtatg

SEQ ID NO: 185780 - DNA, 75 bp, Artificial Sequence
  Synthetic
acttcatctcgattgcagcgaggactgttgaacttctgaaacgcagcagtctcaaaggactgagactgcggtatg

SEQ ID NO: 185781 - DNA, 75 bp, Artificial Sequence
  Synthetic
acttcatctcgattgcagcgaggactgttgaacttctgaaacgcagcagtctcaaaggactgagactggggtatg

SEQ ID NO: 185782 - DNA, 75 bp, Artificial Sequence
  Synthetic
acttcatctcgattgcagcgaggactgttgaacttctgaaacgcagcagtctcaatggactgagactgaggtatg

SEQ ID NO: 185783 - DNA, 75 bp, Artificial Sequence
  Synthetic
acttcatctcgattgcagcgaggactgttgaacttctgaaacgcagcagtctcaatggactgagactgtggtatg

SEQ ID NO: 185784 - DNA, 75 bp, Artificial Sequence
  Synthetic
acttcatctcgattgcagcgaggactgttgaacttctgaaacgcagcagtctcaatggactgagactgcggtatg

SEQ ID NO: 185785 - DNA, 75 bp, Artificial Sequence
  Synthetic
acttcatctcgattgcagcgaggactgttgaacttctgaaacgcagcagtctcaatggactgagactggggtatg

SEQ ID NO: 185786 - DNA, 75 bp, Artificial Sequence
  Synthetic
acttcatctcgattgcagcgaggactgttgaacttctgaaacgcagcagtctcaacggactgagactgaggtatg

SEQ ID NO: 185787 - DNA, 75 bp, Artificial Sequence
  Synthetic
acttcatctcgattgcagcgaggactgttgaacttctgaaacgcagcagtctcaacggactgagactgtggtatg

SEQ ID NO: 185788 - DNA, 75 bp, Artificial Sequence
  Synthetic
acttcatctcgattgcagcgaggactgttgaacttctgaaacgcagcagtctcaacggactgagactgcggtatg

SEQ ID NO: 185789 - DNA, 75 bp, Artificial Sequence
  Synthetic
acttcatctcgattgcagcgaggactgttgaacttctgaaacgcagcagtctcaacggactgagactggggtatg

SEQ ID NO: 185790 - DNA, 75 bp, Artificial Sequence
  Synthetic
acttcatctcgattgcagcgaggactgttgaacttctgaaacgcagcagtctcaagggactgagactgaggtatg

SEQ ID NO: 185791 - DNA, 75 bp, Artificial Sequence
  Synthetic
acttcatctcgattgcagcgaggactgttgaacttctgaaacgcagcagtctcaagggactgagactgtggtatg

SEQ ID NO: 185792 - DNA, 75 bp, Artificial Sequence
  Synthetic
acttcatctcgattgcagcgaggactgttgaacttctgaaacgcagcagtctcaagggactgagactgcggtatg

SEQ ID NO: 185793 - DNA, 75 bp, Artificial Sequence
  Synthetic
acttcatctcgattgcagcgaggactgttgaacttctgaaacgcagcagtctcaagggactgagactggggtatg

SEQ ID NO: 185794 - DNA, 75 bp, Artificial Sequence
  Synthetic
acttcatctcgattgcagcgaggactgtcgaacttctgaaacgcagcagtctcaaaggactgagactgaggtatg

SEQ ID NO: 185795 - DNA, 75 bp, Artificial Sequence
  Synthetic
acttcatctcgattgcagcgaggactgtcgaacttctgaaacgcagcagtctcaaaggactgagactgtggtatg

SEQ ID NO: 185796 - DNA, 75 bp, Artificial Sequence
  Synthetic
acttcatctcgattgcagcgaggactgtcgaacttctgaaacgcagcagtctcaaaggactgagactgcggtatg

SEQ ID NO: 185797 - DNA, 75 bp, Artificial Sequence
  Synthetic
acttcatctcgattgcagcgaggactgtcgaacttctgaaacgcagcagtctcaaaggactgagactggggtatg

SEQ ID NO: 185798 - DNA, 75 bp, Artificial Sequence
  Synthetic
acttcatctcgattgcagcgaggactgtcgaacttctgaaacgcagcagtctcaatggactgagactgaggtatg

SEQ ID NO: 185799 - DNA, 75 bp, Artificial Sequence
  Synthetic
acttcatctcgattgcagcgaggactgtcgaacttctgaaacgcagcagtctcaatggactgagactgtggtatg

SEQ ID NO: 185800 - DNA, 75 bp, Artificial Sequence
  Synthetic
acttcatctcgattgcagcgaggactgtcgaacttctgaaacgcagcagtctcaatggactgagactgcggtatg

SEQ ID NO: 185801 - DNA, 75 bp, Artificial Sequence
  Synthetic
acttcatctcgattgcagcgaggactgtcgaacttctgaaacgcagcagtctcaatggactgagactggggtatg

SEQ ID NO: 185802 - DNA, 75 bp, Artificial Sequence
  Synthetic
acttcatctcgattgcagcgaggactgtcgaacttctgaaacgcagcagtctcaacggactgagactgaggtatg

SEQ ID NO: 185803 - DNA, 75 bp, Artificial Sequence
  Synthetic
acttcatctcgattgcagcgaggactgtcgaacttctgaaacgcagcagtctcaacggactgagactgtggtatg

SEQ ID NO: 185804 - DNA, 75 bp, Artificial Sequence
  Synthetic
acttcatctcgattgcagcgaggactgtcgaacttctgaaacgcagcagtctcaacggactgagactgcggtatg

SEQ ID NO: 185805 - DNA, 75 bp, Artificial Sequence
  Synthetic
acttcatctcgattgcagcgaggactgtcgaacttctgaaacgcagcagtctcaacggactgagactggggtatg

SEQ ID NO: 185806 - DNA, 75 bp, Artificial Sequence
  Synthetic
acttcatctcgattgcagcgaggactgtcgaacttctgaaacgcagcagtctcaagggactgagactgaggtatg

SEQ ID NO: 185807 - DNA, 75 bp, Artificial Sequence
  Synthetic
acttcatctcgattgcagcgaggactgtcgaacttctgaaacgcagcagtctcaagggactgagactgtggtatg

SEQ ID NO: 185808 - DNA, 75 bp, Artificial Sequence
  Synthetic
acttcatctcgattgcagcgaggactgtcgaacttctgaaacgcagcagtctcaagggactgagactgcggtatg

SEQ ID NO: 185809 - DNA, 75 bp, Artificial Sequence
  Synthetic
acttcatctcgattgcagcgaggactgtcgaacttctgaaacgcagcagtctcaagggactgagactggggtatg

SEQ ID NO: 185810 - DNA, 75 bp, Artificial Sequence
  Synthetic
acttcatctcgattgcagcgaggactgtggaacttctgaaacgcagcagtctcaaaggactgagactgaggtatg

SEQ ID NO: 185811 - DNA, 75 bp, Artificial Sequence
  Synthetic
acttcatctcgattgcagcgaggactgtggaacttctgaaacgcagcagtctcaaaggactgagactgtggtatg

SEQ ID NO: 185812 - DNA, 75 bp, Artificial Sequence
  Synthetic
acttcatctcgattgcagcgaggactgtggaacttctgaaacgcagcagtctcaaaggactgagactgcggtatg

SEQ ID NO: 185813 - DNA, 75 bp, Artificial Sequence
  Synthetic
acttcatctcgattgcagcgaggactgtggaacttctgaaacgcagcagtctcaaaggactgagactggggtatg

SEQ ID NO: 185814 - DNA, 75 bp, Artificial Sequence
  Synthetic
acttcatctcgattgcagcgaggactgtggaacttctgaaacgcagcagtctcaatggactgagactgaggtatg

SEQ ID NO: 185815 - DNA, 75 bp, Artificial Sequence
  Synthetic
acttcatctcgattgcagcgaggactgtggaacttctgaaacgcagcagtctcaatggactgagactgtggtatg

SEQ ID NO: 185816 - DNA, 75 bp, Artificial Sequence
  Synthetic
acttcatctcgattgcagcgaggactgtggaacttctgaaacgcagcagtctcaatggactgagactgcggtatg

SEQ ID NO: 185817 - DNA, 75 bp, Artificial Sequence
  Synthetic
acttcatctcgattgcagcgaggactgtggaacttctgaaacgcagcagtctcaatggactgagactggggtatg

SEQ ID NO: 185818 - DNA, 75 bp, Artificial Sequence
  Synthetic
acttcatctcgattgcagcgaggactgtggaacttctgaaacgcagcagtctcaacggactgagactgaggtatg

SEQ ID NO: 185819 - DNA, 75 bp, Artificial Sequence
  Synthetic
acttcatctcgattgcagcgaggactgtggaacttctgaaacgcagcagtctcaacggactgagactgtggtatg

SEQ ID NO: 185820 - DNA, 75 bp, Artificial Sequence
  Synthetic
acttcatctcgattgcagcgaggactgtggaacttctgaaacgcagcagtctcaacggactgagactgcggtatg

SEQ ID NO: 185821 - DNA, 75 bp, Artificial Sequence
  Synthetic
acttcatctcgattgcagcgaggactgtggaacttctgaaacgcagcagtctcaacggactgagactggggtatg

SEQ ID NO: 185822 - DNA, 75 bp, Artificial Sequence
  Synthetic
acttcatctcgattgcagcgaggactgtggaacttctgaaacgcagcagtctcaagggactgagactgaggtatg

SEQ ID NO: 185823 - DNA, 75 bp, Artificial Sequence
  Synthetic
acttcatctcgattgcagcgaggactgtggaacttctgaaacgcagcagtctcaagggactgagactgtggtatg

SEQ ID NO: 185824 - DNA, 75 bp, Artificial Sequence
  Synthetic
acttcatctcgattgcagcgaggactgtggaacttctgaaacgcagcagtctcaagggactgagactgcggtatg

SEQ ID NO: 185825 - DNA, 75 bp, Artificial Sequence
  Synthetic
acttcatctcgattgcagcgaggactgtggaacttctgaaacgcagcagtctcaagggactgagactggggtatg

SEQ ID NO: 185826 - DNA, 75 bp, Artificial Sequence
  Synthetic
tcaagtacctgggaagtcttgcacagtattggagccaggaaataaagaagagtgccattagtttgcttaatgcca

SEQ ID NO: 185827 - DNA, 75 bp, Artificial Sequence
  Synthetic
gaaacataacaatgctcccatgcaggataaaacaaattgtaaacatgtggcagggagtaggacgagcaatatatg

SEQ ID NO: 185828 - DNA, 75 bp, Artificial Sequence
  Synthetic
gtgggatggcctgaaattagggaacggataagacaaacccctgtagcagcaccaggagtaggagcagtctctcaa

SEQ ID NO: 185829 - DNA, 75 bp, Artificial Sequence
  Synthetic
cgctgacggtacaggccagacaattattgtctggcatagtgcaacagcaaagcaatttgctgagggctatagagg

SEQ ID NO: 185830 - DNA, 75 bp, Artificial Sequence
  Synthetic
atgctaaaaccataatagtacagtttaacagttctgtaggaattaattgtaccagacctagcaacaatacaagaa

SEQ ID NO: 185831 - DNA, 75 bp, Artificial Sequence
  Synthetic
gaaataggcattgtgcaaaagagaagagtcaggaatagatccagtagatcctaacctagagccctagaatcatcc

SEQ ID NO: 185832 - DNA, 75 bp, Artificial Sequence
  Synthetic
gaaataggcattgtgcaaaagagaagagtcaggaatagatccagtagatcctaacctagagcccttgaatcatcc

SEQ ID NO: 185833 - DNA, 75 bp, Artificial Sequence
  Synthetic
gaaataggcattgtgcaaaagagaagagtcaggaatagatccagtagatcctaacctagagccctcgaatcatcc

SEQ ID NO: 185834 - DNA, 75 bp, Artificial Sequence
  Synthetic
gaaataggcattgtgcaaaagagaagagtcaggaatagatccagtagatcctaacctagagccctggaatcatcc

SEQ ID NO: 185835 - DNA, 75 bp, Artificial Sequence
  Synthetic
gaaataggcattgtgcaaaagagaagagtcaggaattgatccagtagatcctaacctagagccctagaatcatcc

SEQ ID NO: 185836 - DNA, 75 bp, Artificial Sequence
  Synthetic
gaaataggcattgtgcaaaagagaagagtcaggaattgatccagtagatcctaacctagagcccttgaatcatcc

SEQ ID NO: 185837 - DNA, 75 bp, Artificial Sequence
  Synthetic
gaaataggcattgtgcaaaagagaagagtcaggaattgatccagtagatcctaacctagagccctcgaatcatcc

SEQ ID NO: 185838 - DNA, 75 bp, Artificial Sequence
  Synthetic
gaaataggcattgtgcaaaagagaagagtcaggaattgatccagtagatcctaacctagagccctggaatcatcc

SEQ ID NO: 185839 - DNA, 75 bp, Artificial Sequence
  Synthetic
gaaataggcattgtgcaaaagagaagagtcaggaatcgatccagtagatcctaacctagagccctagaatcatcc

SEQ ID NO: 185840 - DNA, 75 bp, Artificial Sequence
  Synthetic
gaaataggcattgtgcaaaagagaagagtcaggaatcgatccagtagatcctaacctagagcccttgaatcatcc

SEQ ID NO: 185841 - DNA, 75 bp, Artificial Sequence
  Synthetic
gaaataggcattgtgcaaaagagaagagtcaggaatcgatccagtagatcctaacctagagccctcgaatcatcc

SEQ ID NO: 185842 - DNA, 75 bp, Artificial Sequence
  Synthetic
gaaataggcattgtgcaaaagagaagagtcaggaatcgatccagtagatcctaacctagagccctggaatcatcc

SEQ ID NO: 185843 - DNA, 75 bp, Artificial Sequence
  Synthetic
gaaataggcattgtgcaaaagagaagagtcaggaatggatccagtagatcctaacctagagccctagaatcatcc

SEQ ID NO: 185844 - DNA, 75 bp, Artificial Sequence
  Synthetic
gaaataggcattgtgcaaaagagaagagtcaggaatggatccagtagatcctaacctagagcccttgaatcatcc

SEQ ID NO: 185845 - DNA, 75 bp, Artificial Sequence
  Synthetic
gaaataggcattgtgcaaaagagaagagtcaggaatggatccagtagatcctaacctagagccctcgaatcatcc

SEQ ID NO: 185846 - DNA, 75 bp, Artificial Sequence
  Synthetic
gaaataggcattgtgcaaaagagaagagtcaggaatggatccagtagatcctaacctagagccctggaatcatcc

SEQ ID NO: 185847 - DNA, 75 bp, Artificial Sequence
  Synthetic
gaaataggcattgtgcaaatgagaagagtcaggaatagatccagtagatcctaacctagagccctagaatcatcc

SEQ ID NO: 185848 - DNA, 75 bp, Artificial Sequence
  Synthetic
gaaataggcattgtgcaaatgagaagagtcaggaatagatccagtagatcctaacctagagcccttgaatcatcc

SEQ ID NO: 185849 - DNA, 75 bp, Artificial Sequence
  Synthetic
gaaataggcattgtgcaaatgagaagagtcaggaatagatccagtagatcctaacctagagccctcgaatcatcc

SEQ ID NO: 185850 - DNA, 75 bp, Artificial Sequence
  Synthetic
gaaataggcattgtgcaaatgagaagagtcaggaatagatccagtagatcctaacctagagccctggaatcatcc

SEQ ID NO: 185851 - DNA, 75 bp, Artificial Sequence
  Synthetic
gaaataggcattgtgcaaatgagaagagtcaggaattgatccagtagatcctaacctagagccctagaatcatcc

SEQ ID NO: 185852 - DNA, 75 bp, Artificial Sequence
  Synthetic
gaaataggcattgtgcaaatgagaagagtcaggaattgatccagtagatcctaacctagagcccttgaatcatcc

SEQ ID NO: 185853 - DNA, 75 bp, Artificial Sequence
  Synthetic
gaaataggcattgtgcaaatgagaagagtcaggaattgatccagtagatcctaacctagagccctcgaatcatcc

SEQ ID NO: 185854 - DNA, 75 bp, Artificial Sequence
  Synthetic
gaaataggcattgtgcaaatgagaagagtcaggaattgatccagtagatcctaacctagagccctggaatcatcc

SEQ ID NO: 185855 - DNA, 75 bp, Artificial Sequence
  Synthetic
gaaataggcattgtgcaaatgagaagagtcaggaatcgatccagtagatcctaacctagagccctagaatcatcc

SEQ ID NO: 185856 - DNA, 75 bp, Artificial Sequence
  Synthetic
gaaataggcattgtgcaaatgagaagagtcaggaatcgatccagtagatcctaacctagagcccttgaatcatcc

SEQ ID NO: 185857 - DNA, 75 bp, Artificial Sequence
  Synthetic
gaaataggcattgtgcaaatgagaagagtcaggaatcgatccagtagatcctaacctagagccctcgaatcatcc

SEQ ID NO: 185858 - DNA, 75 bp, Artificial Sequence
  Synthetic
gaaataggcattgtgcaaatgagaagagtcaggaatcgatccagtagatcctaacctagagccctggaatcatcc

SEQ ID NO: 185859 - DNA, 75 bp, Artificial Sequence
  Synthetic
gaaataggcattgtgcaaatgagaagagtcaggaatggatccagtagatcctaacctagagccctagaatcatcc

SEQ ID NO: 185860 - DNA, 75 bp, Artificial Sequence
  Synthetic
gaaataggcattgtgcaaatgagaagagtcaggaatggatccagtagatcctaacctagagcccttgaatcatcc

SEQ ID NO: 185861 - DNA, 75 bp, Artificial Sequence
  Synthetic
gaaataggcattgtgcaaatgagaagagtcaggaatggatccagtagatcctaacctagagccctcgaatcatcc

SEQ ID NO: 185862 - DNA, 75 bp, Artificial Sequence
  Synthetic
gaaataggcattgtgcaaatgagaagagtcaggaatggatccagtagatcctaacctagagccctggaatcatcc

SEQ ID NO: 185863 - DNA, 75 bp, Artificial Sequence
  Synthetic
gaaataggcattgtgcaaacgagaagagtcaggaatagatccagtagatcctaacctagagccctagaatcatcc

SEQ ID NO: 185864 - DNA, 75 bp, Artificial Sequence
  Synthetic
gaaataggcattgtgcaaacgagaagagtcaggaatagatccagtagatcctaacctagagcccttgaatcatcc

SEQ ID NO: 185865 - DNA, 75 bp, Artificial Sequence
  Synthetic
gaaataggcattgtgcaaacgagaagagtcaggaatagatccagtagatcctaacctagagccctcgaatcatcc

SEQ ID NO: 185866 - DNA, 75 bp, Artificial Sequence
  Synthetic
gaaataggcattgtgcaaacgagaagagtcaggaatagatccagtagatcctaacctagagccctggaatcatcc

SEQ ID NO: 185867 - DNA, 75 bp, Artificial Sequence
  Synthetic
gaaataggcattgtgcaaacgagaagagtcaggaattgatccagtagatcctaacctagagccctagaatcatcc

SEQ ID NO: 185868 - DNA, 75 bp, Artificial Sequence
  Synthetic
gaaataggcattgtgcaaacgagaagagtcaggaattgatccagtagatcctaacctagagcccttgaatcatcc

SEQ ID NO: 185869 - DNA, 75 bp, Artificial Sequence
  Synthetic
gaaataggcattgtgcaaacgagaagagtcaggaattgatccagtagatcctaacctagagccctcgaatcatcc

SEQ ID NO: 185870 - DNA, 75 bp, Artificial Sequence
  Synthetic
gaaataggcattgtgcaaacgagaagagtcaggaattgatccagtagatcctaacctagagccctggaatcatcc

SEQ ID NO: 185871 - DNA, 75 bp, Artificial Sequence
  Synthetic
gaaataggcattgtgcaaacgagaagagtcaggaatcgatccagtagatcctaacctagagccctagaatcatcc

SEQ ID NO: 185872 - DNA, 75 bp, Artificial Sequence
  Synthetic
gaaataggcattgtgcaaacgagaagagtcaggaatcgatccagtagatcctaacctagagcccttgaatcatcc

SEQ ID NO: 185873 - DNA, 75 bp, Artificial Sequence
  Synthetic
gaaataggcattgtgcaaacgagaagagtcaggaatcgatccagtagatcctaacctagagccctcgaatcatcc

SEQ ID NO: 185874 - DNA, 75 bp, Artificial Sequence
  Synthetic
gaaataggcattgtgcaaacgagaagagtcaggaatcgatccagtagatcctaacctagagccctggaatcatcc

SEQ ID NO: 185875 - DNA, 75 bp, Artificial Sequence
  Synthetic
gaaataggcattgtgcaaacgagaagagtcaggaatggatccagtagatcctaacctagagccctagaatcatcc

SEQ ID NO: 185876 - DNA, 75 bp, Artificial Sequence
  Synthetic
gaaataggcattgtgcaaacgagaagagtcaggaatggatccagtagatcctaacctagagcccttgaatcatcc

SEQ ID NO: 185877 - DNA, 75 bp, Artificial Sequence
  Synthetic
gaaataggcattgtgcaaacgagaagagtcaggaatggatccagtagatcctaacctagagccctcgaatcatcc

SEQ ID NO: 185878 - DNA, 75 bp, Artificial Sequence
  Synthetic
gaaataggcattgtgcaaacgagaagagtcaggaatggatccagtagatcctaacctagagccctggaatcatcc

SEQ ID NO: 185879 - DNA, 75 bp, Artificial Sequence
  Synthetic
gaaataggcattgtgcaaaggagaagagtcaggaatagatccagtagatcctaacctagagccctagaatcatcc

SEQ ID NO: 185880 - DNA, 75 bp, Artificial Sequence
  Synthetic
gaaataggcattgtgcaaaggagaagagtcaggaatagatccagtagatcctaacctagagcccttgaatcatcc

SEQ ID NO: 185881 - DNA, 75 bp, Artificial Sequence
  Synthetic
gaaataggcattgtgcaaaggagaagagtcaggaatagatccagtagatcctaacctagagccctcgaatcatcc

SEQ ID NO: 185882 - DNA, 75 bp, Artificial Sequence
  Synthetic
gaaataggcattgtgcaaaggagaagagtcaggaatagatccagtagatcctaacctagagccctggaatcatcc

SEQ ID NO: 185883 - DNA, 75 bp, Artificial Sequence
  Synthetic
gaaataggcattgtgcaaaggagaagagtcaggaattgatccagtagatcctaacctagagccctagaatcatcc

SEQ ID NO: 185884 - DNA, 75 bp, Artificial Sequence
  Synthetic
gaaataggcattgtgcaaaggagaagagtcaggaattgatccagtagatcctaacctagagcccttgaatcatcc

SEQ ID NO: 185885 - DNA, 75 bp, Artificial Sequence
  Synthetic
gaaataggcattgtgcaaaggagaagagtcaggaattgatccagtagatcctaacctagagccctcgaatcatcc

SEQ ID NO: 185886 - DNA, 75 bp, Artificial Sequence
  Synthetic
gaaataggcattgtgcaaaggagaagagtcaggaattgatccagtagatcctaacctagagccctggaatcatcc

SEQ ID NO: 185887 - DNA, 75 bp, Artificial Sequence
  Synthetic
gaaataggcattgtgcaaaggagaagagtcaggaatcgatccagtagatcctaacctagagccctagaatcatcc

SEQ ID NO: 185888 - DNA, 75 bp, Artificial Sequence
  Synthetic
gaaataggcattgtgcaaaggagaagagtcaggaatcgatccagtagatcctaacctagagcccttgaatcatcc

SEQ ID NO: 185889 - DNA, 75 bp, Artificial Sequence
  Synthetic
gaaataggcattgtgcaaaggagaagagtcaggaatcgatccagtagatcctaacctagagccctcgaatcatcc

SEQ ID NO: 185890 - DNA, 75 bp, Artificial Sequence
  Synthetic
gaaataggcattgtgcaaaggagaagagtcaggaatcgatccagtagatcctaacctagagccctggaatcatcc

SEQ ID NO: 185891 - DNA, 75 bp, Artificial Sequence
  Synthetic
gaaataggcattgtgcaaaggagaagagtcaggaatggatccagtagatcctaacctagagccctagaatcatcc

SEQ ID NO: 185892 - DNA, 75 bp, Artificial Sequence
  Synthetic
gaaataggcattgtgcaaaggagaagagtcaggaatggatccagtagatcctaacctagagcccttgaatcatcc

SEQ ID NO: 185893 - DNA, 75 bp, Artificial Sequence
  Synthetic
gaaataggcattgtgcaaaggagaagagtcaggaatggatccagtagatcctaacctagagccctcgaatcatcc

SEQ ID NO: 185894 - DNA, 75 bp, Artificial Sequence
  Synthetic
gaaataggcattgtgcaaaggagaagagtcaggaatggatccagtagatcctaacctagagccctggaatcatcc

SEQ ID NO: 185895 - DNA, 75 bp, Artificial Sequence
  Synthetic
gaatgagatttgggataacatgacctggttgcaatgggataaagaaattaacaattacacagaaacaatatataa

SEQ ID NO: 185896 - DNA, 75 bp, Artificial Sequence
  Synthetic
agacctggcaacaatacaagaacaagtatacgtataggaccaggacaaaccttctatgcaacaggtgatgtaata

SEQ ID NO: 185897 - DNA, 75 bp, Artificial Sequence
  Synthetic
cctataagaggagatatgaggaacaattggagaagtgaactatataagaataaagtagtaaaaattgaaccaata

SEQ ID NO: 185898 - DNA, 75 bp, Artificial Sequence
  Synthetic
cctataagaggagatatgaggaacaattggagaagtgaactatataagtataaagtagtaaaaattgaaccaata

SEQ ID NO: 185899 - DNA, 75 bp, Artificial Sequence
  Synthetic
cctataagaggagatatgaggaacaattggagaagtgaactatataagcataaagtagtaaaaattgaaccaata

SEQ ID NO: 185900 - DNA, 75 bp, Artificial Sequence
  Synthetic
cctataagaggagatatgaggaacaattggagaagtgaactatataaggataaagtagtaaaaattgaaccaata

SEQ ID NO: 185901 - DNA, 75 bp, Artificial Sequence
  Synthetic
cctataagaggagatttgaggaacaattggagaagtgaactatataagaataaagtagtaaaaattgaaccaata

SEQ ID NO: 185902 - DNA, 75 bp, Artificial Sequence
  Synthetic
cctataagaggagatttgaggaacaattggagaagtgaactatataagtataaagtagtaaaaattgaaccaata

SEQ ID NO: 185903 - DNA, 75 bp, Artificial Sequence
  Synthetic
cctataagaggagatttgaggaacaattggagaagtgaactatataagcataaagtagtaaaaattgaaccaata

SEQ ID NO: 185904 - DNA, 75 bp, Artificial Sequence
  Synthetic
cctataagaggagatttgaggaacaattggagaagtgaactatataaggataaagtagtaaaaattgaaccaata

SEQ ID NO: 185905 - DNA, 75 bp, Artificial Sequence
  Synthetic
cctataagaggagatctgaggaacaattggagaagtgaactatataagaataaagtagtaaaaattgaaccaata

SEQ ID NO: 185906 - DNA, 75 bp, Artificial Sequence
  Synthetic
cctataagaggagatctgaggaacaattggagaagtgaactatataagtataaagtagtaaaaattgaaccaata

SEQ ID NO: 185907 - DNA, 75 bp, Artificial Sequence
  Synthetic
cctataagaggagatctgaggaacaattggagaagtgaactatataagcataaagtagtaaaaattgaaccaata

SEQ ID NO: 185908 - DNA, 75 bp, Artificial Sequence
  Synthetic
cctataagaggagatctgaggaacaattggagaagtgaactatataaggataaagtagtaaaaattgaaccaata

SEQ ID NO: 185909 - DNA, 75 bp, Artificial Sequence
  Synthetic
cctataagaggagatgtgaggaacaattggagaagtgaactatataagaataaagtagtaaaaattgaaccaata

SEQ ID NO: 185910 - DNA, 75 bp, Artificial Sequence
  Synthetic
cctataagaggagatgtgaggaacaattggagaagtgaactatataagtataaagtagtaaaaattgaaccaata

SEQ ID NO: 185911 - DNA, 75 bp, Artificial Sequence
  Synthetic
cctataagaggagatgtgaggaacaattggagaagtgaactatataagcataaagtagtaaaaattgaaccaata

SEQ ID NO: 185912 - DNA, 75 bp, Artificial Sequence
  Synthetic
cctataagaggagatgtgaggaacaattggagaagtgaactatataaggataaagtagtaaaaattgaaccaata

SEQ ID NO: 185913 - DNA, 75 bp, Artificial Sequence
  Synthetic
cctatatgaggagatatgaggaacaattggagaagtgaactatataagaataaagtagtaaaaattgaaccaata

SEQ ID NO: 185914 - DNA, 75 bp, Artificial Sequence
  Synthetic
cctatatgaggagatatgaggaacaattggagaagtgaactatataagtataaagtagtaaaaattgaaccaata

SEQ ID NO: 185915 - DNA, 75 bp, Artificial Sequence
  Synthetic
cctatatgaggagatatgaggaacaattggagaagtgaactatataagcataaagtagtaaaaattgaaccaata

SEQ ID NO: 185916 - DNA, 75 bp, Artificial Sequence
  Synthetic
cctatatgaggagatatgaggaacaattggagaagtgaactatataaggataaagtagtaaaaattgaaccaata

SEQ ID NO: 185917 - DNA, 75 bp, Artificial Sequence
  Synthetic
cctatatgaggagatttgaggaacaattggagaagtgaactatataagaataaagtagtaaaaattgaaccaata

SEQ ID NO: 185918 - DNA, 75 bp, Artificial Sequence
  Synthetic
cctatatgaggagatttgaggaacaattggagaagtgaactatataagtataaagtagtaaaaattgaaccaata

SEQ ID NO: 185919 - DNA, 75 bp, Artificial Sequence
  Synthetic
cctatatgaggagatttgaggaacaattggagaagtgaactatataagcataaagtagtaaaaattgaaccaata

SEQ ID NO: 185920 - DNA, 75 bp, Artificial Sequence
  Synthetic
cctatatgaggagatttgaggaacaattggagaagtgaactatataaggataaagtagtaaaaattgaaccaata

SEQ ID NO: 185921 - DNA, 75 bp, Artificial Sequence
  Synthetic
cctatatgaggagatctgaggaacaattggagaagtgaactatataagaataaagtagtaaaaattgaaccaata

SEQ ID NO: 185922 - DNA, 75 bp, Artificial Sequence
  Synthetic
cctatatgaggagatctgaggaacaattggagaagtgaactatataagtataaagtagtaaaaattgaaccaata

SEQ ID NO: 185923 - DNA, 75 bp, Artificial Sequence
  Synthetic
cctatatgaggagatctgaggaacaattggagaagtgaactatataagcataaagtagtaaaaattgaaccaata

SEQ ID NO: 185924 - DNA, 75 bp, Artificial Sequence
  Synthetic
cctatatgaggagatctgaggaacaattggagaagtgaactatataaggataaagtagtaaaaattgaaccaata

SEQ ID NO: 185925 - DNA, 75 bp, Artificial Sequence
  Synthetic
cctatatgaggagatgtgaggaacaattggagaagtgaactatataagaataaagtagtaaaaattgaaccaata

SEQ ID NO: 185926 - DNA, 75 bp, Artificial Sequence
  Synthetic
cctatatgaggagatgtgaggaacaattggagaagtgaactatataagtataaagtagtaaaaattgaaccaata

SEQ ID NO: 185927 - DNA, 75 bp, Artificial Sequence
  Synthetic
cctatatgaggagatgtgaggaacaattggagaagtgaactatataagcataaagtagtaaaaattgaaccaata

SEQ ID NO: 185928 - DNA, 75 bp, Artificial Sequence
  Synthetic
cctatatgaggagatgtgaggaacaattggagaagtgaactatataaggataaagtagtaaaaattgaaccaata

SEQ ID NO: 185929 - DNA, 75 bp, Artificial Sequence
  Synthetic
cctatacgaggagatatgaggaacaattggagaagtgaactatataagaataaagtagtaaaaattgaaccaata

SEQ ID NO: 185930 - DNA, 75 bp, Artificial Sequence
  Synthetic
cctatacgaggagatatgaggaacaattggagaagtgaactatataagtataaagtagtaaaaattgaaccaata

SEQ ID NO: 185931 - DNA, 75 bp, Artificial Sequence
  Synthetic
cctatacgaggagatatgaggaacaattggagaagtgaactatataagcataaagtagtaaaaattgaaccaata

SEQ ID NO: 185932 - DNA, 75 bp, Artificial Sequence
  Synthetic
cctatacgaggagatatgaggaacaattggagaagtgaactatataaggataaagtagtaaaaattgaaccaata

SEQ ID NO: 185933 - DNA, 75 bp, Artificial Sequence
  Synthetic
cctatacgaggagatttgaggaacaattggagaagtgaactatataagaataaagtagtaaaaattgaaccaata

SEQ ID NO: 185934 - DNA, 75 bp, Artificial Sequence
  Synthetic
cctatacgaggagatttgaggaacaattggagaagtgaactatataagtataaagtagtaaaaattgaaccaata

SEQ ID NO: 185935 - DNA, 75 bp, Artificial Sequence
  Synthetic
cctatacgaggagatttgaggaacaattggagaagtgaactatataagcataaagtagtaaaaattgaaccaata

SEQ ID NO: 185936 - DNA, 75 bp, Artificial Sequence
  Synthetic
cctatacgaggagatttgaggaacaattggagaagtgaactatataaggataaagtagtaaaaattgaaccaata

SEQ ID NO: 185937 - DNA, 75 bp, Artificial Sequence
  Synthetic
cctatacgaggagatctgaggaacaattggagaagtgaactatataagaataaagtagtaaaaattgaaccaata

SEQ ID NO: 185938 - DNA, 75 bp, Artificial Sequence
  Synthetic
cctatacgaggagatctgaggaacaattggagaagtgaactatataagtataaagtagtaaaaattgaaccaata

SEQ ID NO: 185939 - DNA, 75 bp, Artificial Sequence
  Synthetic
cctatacgaggagatctgaggaacaattggagaagtgaactatataagcataaagtagtaaaaattgaaccaata

SEQ ID NO: 185940 - DNA, 75 bp, Artificial Sequence
  Synthetic
cctatacgaggagatctgaggaacaattggagaagtgaactatataaggataaagtagtaaaaattgaaccaata

SEQ ID NO: 185941 - DNA, 75 bp, Artificial Sequence
  Synthetic
cctatacgaggagatgtgaggaacaattggagaagtgaactatataagaataaagtagtaaaaattgaaccaata

SEQ ID NO: 185942 - DNA, 75 bp, Artificial Sequence
  Synthetic
cctatacgaggagatgtgaggaacaattggagaagtgaactatataagtataaagtagtaaaaattgaaccaata

SEQ ID NO: 185943 - DNA, 75 bp, Artificial Sequence
  Synthetic
cctatacgaggagatgtgaggaacaattggagaagtgaactatataagcataaagtagtaaaaattgaaccaata

SEQ ID NO: 185944 - DNA, 75 bp, Artificial Sequence
  Synthetic
cctatacgaggagatgtgaggaacaattggagaagtgaactatataaggataaagtagtaaaaattgaaccaata

SEQ ID NO: 185945 - DNA, 75 bp, Artificial Sequence
  Synthetic
cctataggaggagatatgaggaacaattggagaagtgaactatataagaataaagtagtaaaaattgaaccaata

SEQ ID NO: 185946 - DNA, 75 bp, Artificial Sequence
  Synthetic
cctataggaggagatatgaggaacaattggagaagtgaactatataagtataaagtagtaaaaattgaaccaata

SEQ ID NO: 185947 - DNA, 75 bp, Artificial Sequence
  Synthetic
cctataggaggagatatgaggaacaattggagaagtgaactatataagcataaagtagtaaaaattgaaccaata

SEQ ID NO: 185948 - DNA, 75 bp, Artificial Sequence
  Synthetic
cctataggaggagatatgaggaacaattggagaagtgaactatataaggataaagtagtaaaaattgaaccaata

SEQ ID NO: 185949 - DNA, 75 bp, Artificial Sequence
  Synthetic
cctataggaggagatttgaggaacaattggagaagtgaactatataagaataaagtagtaaaaattgaaccaata

SEQ ID NO: 185950 - DNA, 75 bp, Artificial Sequence
  Synthetic
cctataggaggagatttgaggaacaattggagaagtgaactatataagtataaagtagtaaaaattgaaccaata

SEQ ID NO: 185951 - DNA, 75 bp, Artificial Sequence
  Synthetic
cctataggaggagatttgaggaacaattggagaagtgaactatataagcataaagtagtaaaaattgaaccaata

SEQ ID NO: 185952 - DNA, 75 bp, Artificial Sequence
  Synthetic
cctataggaggagatttgaggaacaattggagaagtgaactatataaggataaagtagtaaaaattgaaccaata

SEQ ID NO: 185953 - DNA, 75 bp, Artificial Sequence
  Synthetic
cctataggaggagatctgaggaacaattggagaagtgaactatataagaataaagtagtaaaaattgaaccaata

SEQ ID NO: 185954 - DNA, 75 bp, Artificial Sequence
  Synthetic
cctataggaggagatctgaggaacaattggagaagtgaactatataagtataaagtagtaaaaattgaaccaata

SEQ ID NO: 185955 - DNA, 75 bp, Artificial Sequence
  Synthetic
cctataggaggagatctgaggaacaattggagaagtgaactatataagcataaagtagtaaaaattgaaccaata

SEQ ID NO: 185956 - DNA, 75 bp, Artificial Sequence
  Synthetic
cctataggaggagatctgaggaacaattggagaagtgaactatataaggataaagtagtaaaaattgaaccaata

SEQ ID NO: 185957 - DNA, 75 bp, Artificial Sequence
  Synthetic
cctataggaggagatgtgaggaacaattggagaagtgaactatataagaataaagtagtaaaaattgaaccaata

SEQ ID NO: 185958 - DNA, 75 bp, Artificial Sequence
  Synthetic
cctataggaggagatgtgaggaacaattggagaagtgaactatataagtataaagtagtaaaaattgaaccaata

SEQ ID NO: 185959 - DNA, 75 bp, Artificial Sequence
  Synthetic
cctataggaggagatgtgaggaacaattggagaagtgaactatataagcataaagtagtaaaaattgaaccaata

SEQ ID NO: 185960 - DNA, 75 bp, Artificial Sequence
  Synthetic
cctataggaggagatgtgaggaacaattggagaagtgaactatataaggataaagtagtaaaaattgaaccaata

SEQ ID NO: 185961 - DNA, 75 bp, Artificial Sequence
  Synthetic
cttaaatcattatttaatacagtagcagtcctctattgtgtacatcaaaggatagaggtaaaagacaccaaggaa

SEQ ID NO: 185962 - DNA, 75 bp, Artificial Sequence
  Synthetic
cagtcctctattgtgtacatcaaaggatagaggtaaaagacaccaaggaagctttagatagaatagaggaagaac

SEQ ID NO: 185963 - DNA, 75 bp, Artificial Sequence
  Synthetic
gagcctaacacctagaactttaaatgcatgggtaaaagtaatagaagaaaagaatttcagtccagaagtaatacc

SEQ ID NO: 185964 - DNA, 75 bp, Artificial Sequence
  Synthetic
acaagtaaaggtgtaaggataggaccaggacaaacattctttgcaacagatagaataataggagacataagacaa

SEQ ID NO: 185965 - DNA, 75 bp, Artificial Sequence
  Synthetic
atctatcaatatatggatgacttatatgtaggatctgatttagaaataatgcaacatagagcaaaaatagaagag

SEQ ID NO: 185966 - DNA, 75 bp, Artificial Sequence
  Synthetic
actactaataacaatagtattgattgggaatgggtaaataaagaaatgacaaactgctctttcaatgtcaccaca

SEQ ID NO: 185967 - DNA, 75 bp, Artificial Sequence
  Synthetic
ctttgctataaaatgggtggcaaatggtcaaaaagcagcatagtgggatggcctgatgttagggaaagaatgaga

SEQ ID NO: 185968 - DNA, 75 bp, Artificial Sequence
  Synthetic
gcctgatgttagggaaagaatgagacgggctagtccagcagcagaaggagtgggagcagcgtctaaagatttaga

SEQ ID NO: 185969 - DNA, 75 bp, Artificial Sequence
  Synthetic
tcaaaattaccccatagtgcaaaatgcacaagggcaaatggtacaccagtccatatcacctaggactttgaatgc

SEQ ID NO: 185970 - DNA, 75 bp, Artificial Sequence
  Synthetic
tttcagaattgggtgccagcatagcagaataggaatcttgcgacagagaagagcaagaaatggagccagtagatc

SEQ ID NO: 185971 - DNA, 75 bp, Artificial Sequence
  Synthetic
ggcttaggcatctcctatggcaggaagaagcggaaacaccgacgaggaactcctcacggcaataaagattatcaa

SEQ ID NO: 185972 - DNA, 75 bp, Artificial Sequence
  Synthetic
ggcttaggcatctcctatggcaggaagaagcggaaacaccgacgaggaactcctcacggcaataatgattatcaa

SEQ ID NO: 185973 - DNA, 75 bp, Artificial Sequence
  Synthetic
ggcttaggcatctcctatggcaggaagaagcggaaacaccgacgaggaactcctcacggcaataacgattatcaa

SEQ ID NO: 185974 - DNA, 75 bp, Artificial Sequence
  Synthetic
ggcttaggcatctcctatggcaggaagaagcggaaacaccgacgaggaactcctcacggcaataaggattatcaa

SEQ ID NO: 185975 - DNA, 75 bp, Artificial Sequence
  Synthetic
agcgaaagtaaaagggactcgaaagcggaagttccagagaagttctctcgacgcaggactcggcttgctgagtgc

SEQ ID NO: 185976 - DNA, 75 bp, Artificial Sequence
  Synthetic
aatgatgacagcatgccagggagtgggaggacccagccataaagcaagaattttggctgaagcaatgagccaagc

SEQ ID NO: 185977 - DNA, 75 bp, Artificial Sequence
  Synthetic
aataattgtggggaccatagtatatatagaatataggaaagtggtaaaccaaagaagaataaattggttatttga

SEQ ID NO: 185978 - DNA, 75 bp, Artificial Sequence
  Synthetic
aaagaagaataaattggttatttgaaagaataaaagaaagagcagaagacagtgccaataagagtgagggggatg

SEQ ID NO: 185979 - DNA, 75 bp, Artificial Sequence
  Synthetic
aaagaagaataaattggttatttgaaagaataaaagaaagagcagaagacagtgccaattagagtgagggggatg

SEQ ID NO: 185980 - DNA, 75 bp, Artificial Sequence
  Synthetic
aaagaagaataaattggttatttgaaagaataaaagaaagagcagaagacagtgccaatcagagtgagggggatg

SEQ ID NO: 185981 - DNA, 75 bp, Artificial Sequence
  Synthetic
aaagaagaataaattggttatttgaaagaataaaagaaagagcagaagacagtgccaatgagagtgagggggatg

SEQ ID NO: 185982 - DNA, 75 bp, Artificial Sequence
  Synthetic
agagcagaccagagccaacagccccaccagcagagaacctttggaagggggaagagataatcaggcaggaacagc

SEQ ID NO: 185983 - DNA, 75 bp, Artificial Sequence
  Synthetic
cagaagacagtggcaatgagagtgagggggatacagaggaattggccacaatggtggatattgaacatcttaggc

SEQ ID NO: 185984 - DNA, 75 bp, Artificial Sequence
  Synthetic
agaggtaaaagacaccaaggaagctttggataaaatagaggaaatacaaaacaaaaagaaacagcaggcagcagc

SEQ ID NO: 185985 - DNA, 75 bp, Artificial Sequence
  Synthetic
aatgtagctatcattgtcaagtttgctttctgacaaaaggcttaggcatttactatggcaggaagaagcggagac

SEQ ID NO: 185986 - DNA, 75 bp, Artificial Sequence
  Synthetic
cataacatagccaacaatgggaacaccactggccttgacatgaaaaactgctcttacaatatgactacagaacta

SEQ ID NO: 185987 - DNA, 75 bp, Artificial Sequence
  Synthetic
taataccaatattactgctgaaatgaatgaagaaataagaaattgctctttcaatatgaccacagaactgagaga

SEQ ID NO: 185988 - DNA, 75 bp, Artificial Sequence
  Synthetic
aagggccaaaagaaccctttagagactatgtggatagattctttaaaactcttagagctgagcaagctacacagg

SEQ ID NO: 185989 - DNA, 75 bp, Artificial Sequence
  Synthetic
tgctccaggacaagcattttatacaacagggcaaatcataggaaatataagacatgcatattgtactgtcaatag

SEQ ID NO: 185990 - DNA, 75 bp, Artificial Sequence
  Synthetic
gggaggagacatgaaaaactgctctttcaatatcaccacaaccatggataaggtgcaggaagaacgtgcaatttt

SEQ ID NO: 185991 - DNA, 75 bp, Artificial Sequence
  Synthetic
ccaatgcagaataaagcaaattataaatatgtggcagagggtaggacaggcgatgtatgcccctcccatcccagg

SEQ ID NO: 185992 - DNA, 75 bp, Artificial Sequence
  Synthetic
acaattggagaaatgaattatatacgtataaagtagtacaaattgaaccaataggaggaccacccacaaaggcaa

SEQ ID NO: 185993 - DNA, 75 bp, Artificial Sequence
  Synthetic
acaattggagaaatgaattatatacgtataaagtagtacaaattgaaccaataggaggaccacccactaaggcaa

SEQ ID NO: 185994 - DNA, 75 bp, Artificial Sequence
  Synthetic
acaattggagaaatgaattatatacgtataaagtagtacaaattgaaccaataggaggaccacccaccaaggcaa

SEQ ID NO: 185995 - DNA, 75 bp, Artificial Sequence
  Synthetic
acaattggagaaatgaattatatacgtataaagtagtacaaattgaaccaataggaggaccacccacgaaggcaa

SEQ ID NO: 185996 - DNA, 75 bp, Artificial Sequence
  Synthetic
acaattggagaaatgaattatatacgtataatgtagtacaaattgaaccaataggaggaccacccacaaaggcaa

SEQ ID NO: 185997 - DNA, 75 bp, Artificial Sequence
  Synthetic
acaattggagaaatgaattatatacgtataatgtagtacaaattgaaccaataggaggaccacccactaaggcaa

SEQ ID NO: 185998 - DNA, 75 bp, Artificial Sequence
  Synthetic
acaattggagaaatgaattatatacgtataatgtagtacaaattgaaccaataggaggaccacccaccaaggcaa

SEQ ID NO: 185999 - DNA, 75 bp, Artificial Sequence
  Synthetic
acaattggagaaatgaattatatacgtataatgtagtacaaattgaaccaataggaggaccacccacgaaggcaa

SEQ ID NO: 186000 - DNA, 75 bp, Artificial Sequence
  Synthetic
acaattggagaaatgaattatatacgtataacgtagtacaaattgaaccaataggaggaccacccacaaaggcaa

SEQ ID NO: 186001 - DNA, 75 bp, Artificial Sequence
  Synthetic
acaattggagaaatgaattatatacgtataacgtagtacaaattgaaccaataggaggaccacccactaaggcaa

SEQ ID NO: 186002 - DNA, 75 bp, Artificial Sequence
  Synthetic
acaattggagaaatgaattatatacgtataacgtagtacaaattgaaccaataggaggaccacccaccaaggcaa

SEQ ID NO: 186003 - DNA, 75 bp, Artificial Sequence
  Synthetic
acaattggagaaatgaattatatacgtataacgtagtacaaattgaaccaataggaggaccacccacgaaggcaa

SEQ ID NO: 186004 - DNA, 75 bp, Artificial Sequence
  Synthetic
acaattggagaaatgaattatatacgtataaggtagtacaaattgaaccaataggaggaccacccacaaaggcaa

SEQ ID NO: 186005 - DNA, 75 bp, Artificial Sequence
  Synthetic
acaattggagaaatgaattatatacgtataaggtagtacaaattgaaccaataggaggaccacccactaaggcaa

SEQ ID NO: 186006 - DNA, 75 bp, Artificial Sequence
  Synthetic
acaattggagaaatgaattatatacgtataaggtagtacaaattgaaccaataggaggaccacccaccaaggcaa

SEQ ID NO: 186007 - DNA, 75 bp, Artificial Sequence
  Synthetic
acaattggagaaatgaattatatacgtataaggtagtacaaattgaaccaataggaggaccacccacgaaggcaa

SEQ ID NO: 186008 - DNA, 75 bp, Artificial Sequence
  Synthetic
acaattggagaattgaattatatacgtataaagtagtacaaattgaaccaataggaggaccacccacaaaggcaa

SEQ ID NO: 186009 - DNA, 75 bp, Artificial Sequence
  Synthetic
acaattggagaattgaattatatacgtataaagtagtacaaattgaaccaataggaggaccacccactaaggcaa

SEQ ID NO: 186010 - DNA, 75 bp, Artificial Sequence
  Synthetic
acaattggagaattgaattatatacgtataaagtagtacaaattgaaccaataggaggaccacccaccaaggcaa

SEQ ID NO: 186011 - DNA, 75 bp, Artificial Sequence
  Synthetic
acaattggagaattgaattatatacgtataaagtagtacaaattgaaccaataggaggaccacccacgaaggcaa

SEQ ID NO: 186012 - DNA, 75 bp, Artificial Sequence
  Synthetic
acaattggagaattgaattatatacgtataatgtagtacaaattgaaccaataggaggaccacccacaaaggcaa

SEQ ID NO: 186013 - DNA, 75 bp, Artificial Sequence
  Synthetic
acaattggagaattgaattatatacgtataatgtagtacaaattgaaccaataggaggaccacccactaaggcaa

SEQ ID NO: 186014 - DNA, 75 bp, Artificial Sequence
  Synthetic
acaattggagaattgaattatatacgtataatgtagtacaaattgaaccaataggaggaccacccaccaaggcaa

SEQ ID NO: 186015 - DNA, 75 bp, Artificial Sequence
  Synthetic
acaattggagaattgaattatatacgtataatgtagtacaaattgaaccaataggaggaccacccacgaaggcaa

SEQ ID NO: 186016 - DNA, 75 bp, Artificial Sequence
  Synthetic
acaattggagaattgaattatatacgtataacgtagtacaaattgaaccaataggaggaccacccacaaaggcaa

SEQ ID NO: 186017 - DNA, 75 bp, Artificial Sequence
  Synthetic
acaattggagaattgaattatatacgtataacgtagtacaaattgaaccaataggaggaccacccactaaggcaa

SEQ ID NO: 186018 - DNA, 75 bp, Artificial Sequence
  Synthetic
acaattggagaattgaattatatacgtataacgtagtacaaattgaaccaataggaggaccacccaccaaggcaa

SEQ ID NO: 186019 - DNA, 75 bp, Artificial Sequence
  Synthetic
acaattggagaattgaattatatacgtataacgtagtacaaattgaaccaataggaggaccacccacgaaggcaa

SEQ ID NO: 186020 - DNA, 75 bp, Artificial Sequence
  Synthetic
acaattggagaattgaattatatacgtataaggtagtacaaattgaaccaataggaggaccacccacaaaggcaa

SEQ ID NO: 186021 - DNA, 75 bp, Artificial Sequence
  Synthetic
acaattggagaattgaattatatacgtataaggtagtacaaattgaaccaataggaggaccacccactaaggcaa

SEQ ID NO: 186022 - DNA, 75 bp, Artificial Sequence
  Synthetic
acaattggagaattgaattatatacgtataaggtagtacaaattgaaccaataggaggaccacccaccaaggcaa

SEQ ID NO: 186023 - DNA, 75 bp, Artificial Sequence
  Synthetic
acaattggagaattgaattatatacgtataaggtagtacaaattgaaccaataggaggaccacccacgaaggcaa

SEQ ID NO: 186024 - DNA, 75 bp, Artificial Sequence
  Synthetic
acaattggagaactgaattatatacgtataaagtagtacaaattgaaccaataggaggaccacccacaaaggcaa

SEQ ID NO: 186025 - DNA, 75 bp, Artificial Sequence
  Synthetic
acaattggagaactgaattatatacgtataaagtagtacaaattgaaccaataggaggaccacccactaaggcaa

SEQ ID NO: 186026 - DNA, 75 bp, Artificial Sequence
  Synthetic
acaattggagaactgaattatatacgtataaagtagtacaaattgaaccaataggaggaccacccaccaaggcaa

SEQ ID NO: 186027 - DNA, 75 bp, Artificial Sequence
  Synthetic
acaattggagaactgaattatatacgtataaagtagtacaaattgaaccaataggaggaccacccacgaaggcaa

SEQ ID NO: 186028 - DNA, 75 bp, Artificial Sequence
  Synthetic
acaattggagaactgaattatatacgtataatgtagtacaaattgaaccaataggaggaccacccacaaaggcaa

SEQ ID NO: 186029 - DNA, 75 bp, Artificial Sequence
  Synthetic
acaattggagaactgaattatatacgtataatgtagtacaaattgaaccaataggaggaccacccactaaggcaa

SEQ ID NO: 186030 - DNA, 75 bp, Artificial Sequence
  Synthetic
acaattggagaactgaattatatacgtataatgtagtacaaattgaaccaataggaggaccacccaccaaggcaa

SEQ ID NO: 186031 - DNA, 75 bp, Artificial Sequence
  Synthetic
acaattggagaactgaattatatacgtataatgtagtacaaattgaaccaataggaggaccacccacgaaggcaa

SEQ ID NO: 186032 - DNA, 75 bp, Artificial Sequence
  Synthetic
acaattggagaactgaattatatacgtataacgtagtacaaattgaaccaataggaggaccacccacaaaggcaa

SEQ ID NO: 186033 - DNA, 75 bp, Artificial Sequence
  Synthetic
acaattggagaactgaattatatacgtataacgtagtacaaattgaaccaataggaggaccacccactaaggcaa

SEQ ID NO: 186034 - DNA, 75 bp, Artificial Sequence
  Synthetic
acaattggagaactgaattatatacgtataacgtagtacaaattgaaccaataggaggaccacccaccaaggcaa

SEQ ID NO: 186035 - DNA, 75 bp, Artificial Sequence
  Synthetic
acaattggagaactgaattatatacgtataacgtagtacaaattgaaccaataggaggaccacccacgaaggcaa

SEQ ID NO: 186036 - DNA, 75 bp, Artificial Sequence
  Synthetic
acaattggagaactgaattatatacgtataaggtagtacaaattgaaccaataggaggaccacccacaaaggcaa

SEQ ID NO: 186037 - DNA, 75 bp, Artificial Sequence
  Synthetic
acaattggagaactgaattatatacgtataaggtagtacaaattgaaccaataggaggaccacccactaaggcaa

SEQ ID NO: 186038 - DNA, 75 bp, Artificial Sequence
  Synthetic
acaattggagaactgaattatatacgtataaggtagtacaaattgaaccaataggaggaccacccaccaaggcaa

SEQ ID NO: 186039 - DNA, 75 bp, Artificial Sequence
  Synthetic
acaattggagaactgaattatatacgtataaggtagtacaaattgaaccaataggaggaccacccacgaaggcaa

SEQ ID NO: 186040 - DNA, 75 bp, Artificial Sequence
  Synthetic
acaattggagaagtgaattatatacgtataaagtagtacaaattgaaccaataggaggaccacccacaaaggcaa

SEQ ID NO: 186041 - DNA, 75 bp, Artificial Sequence
  Synthetic
acaattggagaagtgaattatatacgtataaagtagtacaaattgaaccaataggaggaccacccactaaggcaa

SEQ ID NO: 186042 - DNA, 75 bp, Artificial Sequence
  Synthetic
acaattggagaagtgaattatatacgtataaagtagtacaaattgaaccaataggaggaccacccaccaaggcaa

SEQ ID NO: 186043 - DNA, 75 bp, Artificial Sequence
  Synthetic
acaattggagaagtgaattatatacgtataaagtagtacaaattgaaccaataggaggaccacccacgaaggcaa

SEQ ID NO: 186044 - DNA, 75 bp, Artificial Sequence
  Synthetic
acaattggagaagtgaattatatacgtataatgtagtacaaattgaaccaataggaggaccacccacaaaggcaa

SEQ ID NO: 186045 - DNA, 75 bp, Artificial Sequence
  Synthetic
acaattggagaagtgaattatatacgtataatgtagtacaaattgaaccaataggaggaccacccactaaggcaa

SEQ ID NO: 186046 - DNA, 75 bp, Artificial Sequence
  Synthetic
acaattggagaagtgaattatatacgtataatgtagtacaaattgaaccaataggaggaccacccaccaaggcaa

SEQ ID NO: 186047 - DNA, 75 bp, Artificial Sequence
  Synthetic
acaattggagaagtgaattatatacgtataatgtagtacaaattgaaccaataggaggaccacccacgaaggcaa

SEQ ID NO: 186048 - DNA, 75 bp, Artificial Sequence
  Synthetic
acaattggagaagtgaattatatacgtataacgtagtacaaattgaaccaataggaggaccacccacaaaggcaa

SEQ ID NO: 186049 - DNA, 75 bp, Artificial Sequence
  Synthetic
acaattggagaagtgaattatatacgtataacgtagtacaaattgaaccaataggaggaccacccactaaggcaa

SEQ ID NO: 186050 - DNA, 75 bp, Artificial Sequence
  Synthetic
acaattggagaagtgaattatatacgtataacgtagtacaaattgaaccaataggaggaccacccaccaaggcaa

SEQ ID NO: 186051 - DNA, 75 bp, Artificial Sequence
  Synthetic
acaattggagaagtgaattatatacgtataacgtagtacaaattgaaccaataggaggaccacccacgaaggcaa

SEQ ID NO: 186052 - DNA, 75 bp, Artificial Sequence
  Synthetic
acaattggagaagtgaattatatacgtataaggtagtacaaattgaaccaataggaggaccacccacaaaggcaa

SEQ ID NO: 186053 - DNA, 75 bp, Artificial Sequence
  Synthetic
acaattggagaagtgaattatatacgtataaggtagtacaaattgaaccaataggaggaccacccactaaggcaa

SEQ ID NO: 186054 - DNA, 75 bp, Artificial Sequence
  Synthetic
acaattggagaagtgaattatatacgtataaggtagtacaaattgaaccaataggaggaccacccaccaaggcaa

SEQ ID NO: 186055 - DNA, 75 bp, Artificial Sequence
  Synthetic
acaattggagaagtgaattatatacgtataaggtagtacaaattgaaccaataggaggaccacccacgaaggcaa

SEQ ID NO: 186056 - DNA, 75 bp, Artificial Sequence
  Synthetic
gaccttcaggcctggaggaggagacatgagggacaattggagaagtgagctgtataaatataaagtaataaaaat

SEQ ID NO: 186057 - DNA, 75 bp, Artificial Sequence
  Synthetic
aatacatggatgatttgtatgtaggatctgacttagaaatagggcaacatagagcaaaaatagaggagttaagag

SEQ ID NO: 186058 - DNA, 75 bp, Artificial Sequence
  Synthetic
aaaggatacgtataggaatagggagaacatttcagacaacaagaacagtagatggagatataagaaaagcatatt

SEQ ID NO: 186059 - DNA, 75 bp, Artificial Sequence
  Synthetic
ggaatttggggctgctctggaaaactcatctgcaccactactgtgccttggaactctagttggagtaataaatct

SEQ ID NO: 186060 - DNA, 75 bp, Artificial Sequence
  Synthetic
agtaagtctacccacactaatgatgtaaaacaattaacagctgcagtgcaaaagatagccatggaatgcatagtg

SEQ ID NO: 186061 - DNA, 75 bp, Artificial Sequence
  Synthetic
aacatatagaacacaaatagatcctgacctagcagatcgactgattcatctacactattttaactgtttttcaga

SEQ ID NO: 186062 - DNA, 75 bp, Artificial Sequence
  Synthetic
ggaggaatcgaagaagaaggtggagagcaagacaaagacagatccattcgattagtgaacggattcttagcactt

SEQ ID NO: 186063 - DNA, 75 bp, Artificial Sequence
  Synthetic
agtagattatagattaggagtaggagcattgatagtagcactaatcatagcaataattgtgtggatcatagcata

SEQ ID NO: 186064 - DNA, 75 bp, Artificial Sequence
  Synthetic
ggagctatgttccttgggttcttgggagcagcaggaagcactatgggcgcagcgtcaatgacgctgacggtacag

SEQ ID NO: 186065 - DNA, 75 bp, Artificial Sequence
  Synthetic
aactgctctttcaagatcaccacaaacataagagataaggtgaagaaagaatatgcacttttttataaccttgat

SEQ ID NO: 186066 - DNA, 75 bp, Artificial Sequence
  Synthetic
cctagaagaatcagacaaggctttgagagggctctcctataacatgggtggcaagtggtcaaaaagtagcctagt

SEQ ID NO: 186067 - DNA, 75 bp, Artificial Sequence
  Synthetic
gggactacagagggggtgggaagcccttaagtatctgggaagtcttgtgcagtattggggtctggaactaaaaaa

SEQ ID NO: 186068 - DNA, 75 bp, Artificial Sequence
  Synthetic
gcctgtccaaaggtatcctttgagccaattcccatacattattgtgccccggctggttttgcgattctaaagtgt

SEQ ID NO: 186069 - DNA, 75 bp, Artificial Sequence
  Synthetic
gataaacatggagcagttacaagcagtaatacagcagctactaatgctagttgcgcctggctggaagcgcaagag

SEQ ID NO: 186070 - DNA, 75 bp, Artificial Sequence
  Synthetic
ccccaccagccccaccagaggagagcttcaggtttggggaaaagacaacaactccctcccagaagcaggagccga

SEQ ID NO: 186071 - DNA, 75 bp, Artificial Sequence
  Synthetic
aataaatcttacaatgagatttggaacaacatgacctggatggagtgggaaagagaaattgataattacacacac

SEQ ID NO: 186072 - DNA, 75 bp, Artificial Sequence
  Synthetic
gtaatacagcagctactaatgctagttgcgcctggctggaagcgcaagaggaaggggaagaggtaggctttccag

SEQ ID NO: 186073 - DNA, 75 bp, Artificial Sequence
  Synthetic
aagaagtaagggcagcagaaggagtaggagcggtatctcgagatctagagagacatggagcaatcacaagcagta

SEQ ID NO: 186074 - DNA, 75 bp, Artificial Sequence
  Synthetic
ttgtacaagaccctacaacaaaataaaaaaaagaatcatgcatataggaccagggagagcattttatacaacagg

SEQ ID NO: 186075 - DNA, 75 bp, Artificial Sequence
  Synthetic
cttaagacagcagtacaaatggcagtattcattcacaattttaaaagaaaaggggggattggagggtacagtgca

SEQ ID NO: 186076 - DNA, 75 bp, Artificial Sequence
  Synthetic
tggattcctgagtgggagtttgtcaatacccctcctttagtaaaactatggtaccagttagaaaaagaacccata

SEQ ID NO: 186077 - DNA, 75 bp, Artificial Sequence
  Synthetic
ttatggggttcctgtgtggagagatgcagagaccactctattttgtgcttcagatgccaaagcacatgtgacaga

SEQ ID NO: 186078 - DNA, 75 bp, Artificial Sequence
  Synthetic
aggccagtagtatcaactcaactgctgttaaatggcagtctagcagaagaagaggtagtaattagatctgccaat

SEQ ID NO: 186079 - DNA, 75 bp, Artificial Sequence
  Synthetic
aataaaacaatagtctttaatcaatcctcaggaggggacccagagattgtaatgcacagctttaattgtggaggg

SEQ ID NO: 186080 - DNA, 75 bp, Artificial Sequence
  Synthetic
gatagaggaagacaaaaaattatctccctaactgagacaaccaatcaaaagactgaattacatgcaatatatcta

SEQ ID NO: 186081 - DNA, 75 bp, Artificial Sequence
  Synthetic
ccaatgctaagttcaacaatacaactggaggacctgacacaccaaatataacagatgaagtgagaaactgtactt

SEQ ID NO: 186082 - DNA, 75 bp, Artificial Sequence
  Synthetic
aagttcagaaatacacatcccgctaggggaagctagactaatagtaacaacatattggggtctgcatacaggaga

SEQ ID NO: 186083 - DNA, 75 bp, Artificial Sequence
  Synthetic
gatgggtggcaagtggtcaaaaagtagtgtggttggatggcctaaggtgagggaaagaatgaggcgaactgagcc

SEQ ID NO: 186084 - DNA, 75 bp, Artificial Sequence
  Synthetic
ctataggaccaggacaagtattctacagaacaggagatataataggagatataagaaaagcattttgtgaaatta

SEQ ID NO: 186085 - DNA, 75 bp, Artificial Sequence
  Synthetic
agacccgcctcccaaccccgaggggacccgacaggcccgaaggaatcgaagaagacggtggagagagagacagag

SEQ ID NO: 186086 - DNA, 75 bp, Artificial Sequence
  Synthetic
aggataaagcaaattgtaaacatgtggcagggaacagggcaagcaatgtatgctcctcccatcagaggaccaatt

SEQ ID NO: 186087 - DNA, 75 bp, Artificial Sequence
  Synthetic
tggtggtataggcatcactatgaaagcagacatccaaaagtatgttcagaagtacacatcccaatagagaatgct

SEQ ID NO: 186088 - DNA, 75 bp, Artificial Sequence
  Synthetic
aatagtagcattaatagtagcagctcttatagccatctgtgtatggaccatagtctatgtagaatatagaagact

SEQ ID NO: 186089 - DNA, 75 bp, Artificial Sequence
  Synthetic
gttaaggcaaaagaaaatagataagttaattgatagaataagagaaagagcagaagatagtggcaatgagagtga

SEQ ID NO: 186090 - DNA, 75 bp, Artificial Sequence
  Synthetic
ttaattgatagaataagagaaagagcagaagatagtggcaatgagagtgatggagacgaagaggaattatcagcg

SEQ ID NO: 186091 - DNA, 75 bp, Artificial Sequence
  Synthetic
gcactgaaagacaggctaattttttagggaaaatttggccttccagcaagggaaggccagggaattttcctcaga

SEQ ID NO: 186092 - DNA, 75 bp, Artificial Sequence
  Synthetic
acaggctcggaagaatcgaagaagaaggtggagagcaagacagagacagatccgtgagattagtgaacggattct

SEQ ID NO: 186093 - DNA, 75 bp, Artificial Sequence
  Synthetic
agaaatgaaaaactgttcttttaatataaccacagaaataagagataagaagaaacaagaatatgcgctttttta

SEQ ID NO: 186094 - DNA, 75 bp, Artificial Sequence
  Synthetic
agatcctgtaccaaagcagtaagtaataaatagtatatgtaatgaattatttgataataacaatagtagcatatg

SEQ ID NO: 186095 - DNA, 75 bp, Artificial Sequence
  Synthetic
taaagataagaatttcaatggaacaggaccatgcagcaatgtcagtacagtacaatgtacacatggaattaagcc

SEQ ID NO: 186096 - DNA, 75 bp, Artificial Sequence
  Synthetic
agtgatatcaactcaattactgctaaatggcagtctagcagaaaaagagataaaaattagatctgagaatatcac

SEQ ID NO: 186097 - DNA, 75 bp, Artificial Sequence
  Synthetic
gcagaatcagaaatgatactgatatgaaaaactgctctttccaaatgaccacagaactaagagatagaacaaaaa

SEQ ID NO: 186098 - DNA, 75 bp, Artificial Sequence
  Synthetic
caaagggggaaataaaaaattgctctttcaatgcaaccacattattagcagataggaagcagaaagtgtatgcac

SEQ ID NO: 186099 - DNA, 75 bp, Artificial Sequence
  Synthetic
caactaaaggaagctctattagacacaggagcagatgatacagtattagaagaaatagatttgccaggaagatgg

SEQ ID NO: 186100 - DNA, 75 bp, Artificial Sequence
  Synthetic
aagaaaaagtataagaatagggccaggacaaacattctatacaacaggcgaagtaataggaaatataagacaagc

SEQ ID NO: 186101 - DNA, 75 bp, Artificial Sequence
  Synthetic
ggtggacagatagggttatagaagcagcacaaggagctgggagagctattctccacatacctagaagaatcagac

SEQ ID NO: 186102 - DNA, 75 bp, Artificial Sequence
  Synthetic
ggcctgtcctaaggtaacctttgagccaattcctatacattattgtgccccagctggttttgcgattctaaaatg

SEQ ID NO: 186103 - DNA, 75 bp, Artificial Sequence
  Synthetic
aacatttagtatgggcaagcagggagctggaaagatttgcacttaaccctggccttttagaaacatcagaaggct

SEQ ID NO: 186104 - DNA, 75 bp, Artificial Sequence
  Synthetic
tcctcaggaggggacctagaaattgtaacacatagttttaattgtggaggagaatttttctattgtaatacatca

SEQ ID NO: 186105 - DNA, 75 bp, Artificial Sequence
  Synthetic
agtagtatcaactcaactgctgttaaatggcagtctagcagagaaagagataatgattagatctaaaaatctctc

SEQ ID NO: 186106 - DNA, 75 bp, Artificial Sequence
  Synthetic
acaggaccaggacaagccatctatgtaacaggtgctgtaacaggggacataagaaaagcacattgtaatgtcagc

SEQ ID NO: 186107 - DNA, 75 bp, Artificial Sequence
  Synthetic
agaaatacaaaactgttctttcaatgcaaccacagaaataagggacaaagtaaagaaagtacatgcactttttta

SEQ ID NO: 186108 - DNA, 75 bp, Artificial Sequence
  Synthetic
agtgataatgagaccttcagacctacaggaggagatatgagggacatttggagaagtgaattatataattataag

SEQ ID NO: 186109 - DNA, 75 bp, Artificial Sequence
  Synthetic
cacagcattatcagaaggagccaccccacaagatctaaacaccatgttaaatacagtggggggacatcaagcagc

SEQ ID NO: 186110 - DNA, 75 bp, Artificial Sequence
  Synthetic
agcaaccctctggtgtgtacatcaaaggatagatgtaaaagacaccaaggaagctttagataaactagaggaagt

SEQ ID NO: 186111 - DNA, 75 bp, Artificial Sequence
  Synthetic
ttcaattgtggcaaagaagggcacatagccaaaaattgcagggcccctaggaaaaagggctgttggaaatgtgga

SEQ ID NO: 186112 - DNA, 75 bp, Artificial Sequence
  Synthetic
ataactctgccatgcagaataaagcaaattgtaaggatgtggcagagagtaggacaagcaatgtatgcccctcct

SEQ ID NO: 186113 - DNA, 75 bp, Artificial Sequence
  Synthetic
aagccagtggtgtcaacccaactactgttaaatggcagcctagcagaaaaagggataataattagatctgagaac

SEQ ID NO: 186114 - DNA, 75 bp, Artificial Sequence
  Synthetic
ggcaagccacctggattcctgagtgggagtttgttaatacccctcccctagtaaaattatggtaccagctagaga

SEQ ID NO: 186115 - DNA, 75 bp, Artificial Sequence
  Synthetic
gaggagacataagggacaattggagaaatgaactatataagtataaagtagtagaaattgaaccaataggagtag

SEQ ID NO: 186116 - DNA, 75 bp, Artificial Sequence
  Synthetic
cctaataaaacaatagactttcagcaatcctcaggaggggacttagaaataacaatgcatagttttaattgtaga

SEQ ID NO: 186117 - DNA, 75 bp, Artificial Sequence
  Synthetic
aataaatagagttaggcagggatactcacctctgtcgtttcagatccataccccaagcccagagggactcgacag

SEQ ID NO: 186118 - DNA, 75 bp, Artificial Sequence
  Synthetic
gaggactgtggaacttctgggacgcagcagcctcaagggactgaggctagggtgggaaggcctcaaatatctgtg

SEQ ID NO: 186119 - DNA, 75 bp, Artificial Sequence
  Synthetic
gatccattcgattagtgaacggattcttagcacttgcctgggacgacctgcggaacctgtgcctcttcagctacc

SEQ ID NO: 186120 - DNA, 75 bp, Artificial Sequence
  Synthetic
gaagtaggacaaagaatttgtagagctatttgcaatatccctagaagaataagacagggcttcgaaagggctttg

SEQ ID NO: 186121 - DNA, 75 bp, Artificial Sequence
  Synthetic
gaatgagaaggactcctccaactccaactccagcagcagaaggagtgggagcagtgtctaaaagtttacagaagc

SEQ ID NO: 186122 - DNA, 75 bp, Artificial Sequence
  Synthetic
tgggtggacagatagggttatagaaataggacaaagattttgtagagccattcgtaacatacctaggagaatcag

SEQ ID NO: 186123 - DNA, 75 bp, Artificial Sequence
  Synthetic
aatgtaaggattataagaataggaccaggacgagcattccatgcaaataacataataggagacataagacaagca

SEQ ID NO: 186124 - DNA, 75 bp, Artificial Sequence
  Synthetic
ttccacagggatggaaaggatcaccagcaatattccagagtagcatgacaaaaatcttagagccctttagagcaa

SEQ ID NO: 186125 - DNA, 75 bp, Artificial Sequence
  Synthetic
aagcaccatatgtatatttcaaagagagctaagggatggttttacagacatcattatgaaagcagacatccaaag

SEQ ID NO: 186126 - DNA, 75 bp, Artificial Sequence
  Synthetic
tatggaaaacagatggcaggtgatgattgtgtggcaagtggacaggatgaggattagaacatggaaaagtttagt

SEQ ID NO: 186127 - DNA, 75 bp, Artificial Sequence
  Synthetic
ccatgcagaattaaacaaatcataaacatgtggcagacggtaggacgagcaatgtatgctcctcccattgaagga

SEQ ID NO: 186128 - DNA, 75 bp, Artificial Sequence
  Synthetic
aaagagatattcagacctgcaggaggagatatgaggaacaattggagaagtgaattatacaaatataaagtagta

SEQ ID NO: 186129 - DNA, 75 bp, Artificial Sequence
  Synthetic
aagaataaactggttatttgatagaataagagaaagagcagaagacagtggcaatgagagtgagggagatacaga

SEQ ID NO: 186130 - DNA, 75 bp, Artificial Sequence
  Synthetic
cgcaggactcggcttgctgagtgcacacagcaagaggcgaggggcggcgactggtgagtacgccaaaaatttttt

SEQ ID NO: 186131 - DNA, 75 bp, Artificial Sequence
  Synthetic
cctgtcatgggtaccagcacataaaggaattggaggaaatgaacaaatagataaattagtaagtagtggaatcag

SEQ ID NO: 186132 - DNA, 75 bp, Artificial Sequence
  Synthetic
acatggcatgaccaacaacagctttaagtttgacaacatcactgatgaaatgaaaaactgctctttcaatatgac

SEQ ID NO: 186133 - DNA, 75 bp, Artificial Sequence
  Synthetic
ttaaatcattatataatacagtagcaactctctactgtgtacatcaaaggatagatgtaaaagatacaaaggaag

SEQ ID NO: 186134 - DNA, 75 bp, Artificial Sequence
  Synthetic
tgagcggattcttgtcacttgcctgggacgatctgcggagcctgtgcctcttcagctaccaccgattgagagact

SEQ ID NO: 186135 - DNA, 75 bp, Artificial Sequence
  Synthetic
agccccaccattccctcagagcagcctagagccaacagccccaccagcagagagcctggggaaggcggaagggat

SEQ ID NO: 186136 - DNA, 75 bp, Artificial Sequence
  Synthetic
acaatgctaaaaccataatagtacagctgaatgaaactgtagaaattaattgtacaagacccaacaacaatacaa

SEQ ID NO: 186137 - DNA, 75 bp, Artificial Sequence
  Synthetic
acaatgctaaaaccataatagtacagctgaatgaaactgtagaaattatttgtacaagacccaacaacaatacaa

SEQ ID NO: 186138 - DNA, 75 bp, Artificial Sequence
  Synthetic
acaatgctaaaaccataatagtacagctgaatgaaactgtagaaattacttgtacaagacccaacaacaatacaa

SEQ ID NO: 186139 - DNA, 75 bp, Artificial Sequence
  Synthetic
acaatgctaaaaccataatagtacagctgaatgaaactgtagaaattagttgtacaagacccaacaacaatacaa

SEQ ID NO: 186140 - DNA, 75 bp, Artificial Sequence
  Synthetic
gggaatttccttcagaacagaccagagccaacagccccactagagccaacagccccaccagcagagagcttcagg

SEQ ID NO: 186141 - DNA, 75 bp, Artificial Sequence
  Synthetic
tgcatgaagacataatcagtctgtgggaccaaagcctacaaccatgtgtaaagttaacccctctctgcgttactt

SEQ ID NO: 186142 - DNA, 75 bp, Artificial Sequence
  Synthetic
aggactagggcgagcgttctatgcaacaggtgacataataggagatataagaagtgcacattgtaatattagcaa

SEQ ID NO: 186143 - DNA, 75 bp, Artificial Sequence
  Synthetic
gaaactaataccactatcagtaactgggaaaagatggacataagtgagataaaaaactgctctttcaatatcacc

SEQ ID NO: 186144 - DNA, 75 bp, Artificial Sequence
  Synthetic
aaactgctctttcaatataaccacagaaataaaggataggaaaaagcaagtgtattcacttttttataagcttga

SEQ ID NO: 186145 - DNA, 75 bp, Artificial Sequence
  Synthetic
gaaataaaggataggaaaaagcaagtgtattcacttttttataagcttgatataacaccaattgaagatgatgag

SEQ ID NO: 186146 - DNA, 75 bp, Artificial Sequence
  Synthetic
ttagaactgttagaggagcttaaaaatgaagctgttagacattttcctaggccctggctccatggcttaggacag

SEQ ID NO: 186147 - DNA, 75 bp, Artificial Sequence
  Synthetic
ttgtaacacctcagtcattacacaggcctgtccaaaagtatcttttgagccaattcccatacattattgtgcccc

SEQ ID NO: 186148 - DNA, 75 bp, Artificial Sequence
  Synthetic
tcaatactactgatacctatgttggtaatgtcaatattagcagcagggaaccgataaacaactgctcttttaata

SEQ ID NO: 186149 - DNA, 75 bp, Artificial Sequence
  Synthetic
gaaattaacagaggatagatggaacaagccccagaagaccatgggccacagagagaaccatacaatgaatggaca

SEQ ID NO: 186150 - DNA, 75 bp, Artificial Sequence
  Synthetic
atggcagtctagcagaaaaagaggtagtaattagatctgacaatttctcagacaatgctaaaaccataatagtac

SEQ ID NO: 186151 - DNA, 75 bp, Artificial Sequence
  Synthetic
ctgtagaaattaattgtaccagacctaacaacaatacaagaaaaggtatacatgtaggaccaggacaagcattct

SEQ ID NO: 186152 - DNA, 75 bp, Artificial Sequence
  Synthetic
ctccaccagcagagaactatgggatgggagaagggacaaccccctccccgaagcaggagccaagagagagggaac

SEQ ID NO: 186153 - DNA, 75 bp, Artificial Sequence
  Synthetic
ttagcaatagtagtgtggactatagtagctatagaatataggaaaatactaaggcaaagaaaaatagacaggtta

SEQ ID NO: 186154 - DNA, 75 bp, Artificial Sequence
  Synthetic
cttaattgaaaaagcgcaaaaccaacaagaaaagaatgaacaagaattattgcaattggattcgtgggcaagttt

SEQ ID NO: 186155 - DNA, 75 bp, Artificial Sequence
  Synthetic
gatttaggataatggtcaacaacaagtcaatgagaagtataaaaacacattgtaaccttagtatagaaaattggg

SEQ ID NO: 186156 - DNA, 75 bp, Artificial Sequence
  Synthetic
aaaagcaatgtatgcccctcctatcagaggacaaattagatgctcatcaaatattacaggtctaatattgacaag

SEQ ID NO: 186157 - DNA, 75 bp, Artificial Sequence
  Synthetic
aatgctactgacaccttaacagctggaggaggaaatatgaacgactgttggagaggtgaattttattattataaa

SEQ ID NO: 186158 - DNA, 75 bp, Artificial Sequence
  Synthetic
cccagaaattgtaatgcatacttttaattgtggaggggaatttttctactgtaattcatcaaaactgtttaatag

SEQ ID NO: 186159 - DNA, 75 bp, Artificial Sequence
  Synthetic
atggagaaaattagtagatttcagagagctcaacaaaagaactcaagatttctgggaagttcaattaggaatacc

SEQ ID NO: 186160 - DNA, 75 bp, Artificial Sequence
  Synthetic
ttttaatgtgaccacagagataagagataagcagcatcgggtccaggcactgttttataagcttgatatagtacc

SEQ ID NO: 186161 - DNA, 75 bp, Artificial Sequence
  Synthetic
aggaactaaagaatagtgctattaacttgcttgataccatagcaatagcagtagctgggtggacagatagggtta

SEQ ID NO: 186162 - DNA, 75 bp, Artificial Sequence
  Synthetic
tgcgattagggatagaataagacgaactcctccaggagaaagaccaactcccccagcagcagtaggagtgggggc

SEQ ID NO: 186163 - DNA, 75 bp, Artificial Sequence
  Synthetic
agtttatgggatcaaagcctaaagccctgtgtaaagttgactccactctgtgtcacgctaaactgtattaatgtc

SEQ ID NO: 186164 - DNA, 75 bp, Artificial Sequence
  Synthetic
attgctctttcaatataaccacagaactaaaagataagaaaaggaaagaatatgcacttttttatagacttgata

SEQ ID NO: 186165 - DNA, 75 bp, Artificial Sequence
  Synthetic
gagtcaggaactaaagaatagtgctgttagtttgcttaacgccacagccatagcagtagctgaggggacagatag

SEQ ID NO: 186166 - DNA, 75 bp, Artificial Sequence
  Synthetic
gctattaatctgcttaatactatagcaatagcagtagctgagggaacagatagaattatagaattaatacaagga

SEQ ID NO: 186167 - DNA, 75 bp, Artificial Sequence
  Synthetic
aaagggctttgctataagatgggtggcaagtggtcaaaaagtagtgtggttggatggcctaaggtgagggaaaga

SEQ ID NO: 186168 - DNA, 75 bp, Artificial Sequence
  Synthetic
cagcaggcagaagcggctgacaaaggaaaggtcagtcaaaattatcctatagtgcagaatctccaagggcaaatg

SEQ ID NO: 186169 - DNA, 75 bp, Artificial Sequence
  Synthetic
gtacaatgtacacatggaattaagccagtggtatcaactcaattactgttaaatggtagtctagcagaagaagag

SEQ ID NO: 186170 - DNA, 75 bp, Artificial Sequence
  Synthetic
gagccagcagcagttggggtgggagcagcatctcgagacctggaaagacatggagcaatcacaagtagcaataca

SEQ ID NO: 186171 - DNA, 75 bp, Artificial Sequence
  Synthetic
gatgtaaaagacaccaaggaagctttagataaattagaggaaatacaaaataagaacaagcaaaagacacagcag

SEQ ID NO: 186172 - DNA, 75 bp, Artificial Sequence
  Synthetic
ggatggcaggttgtaagggaaagaataagaaaaactgatccagcagcagaaagagcaggagcagcatcccaagca

SEQ ID NO: 186173 - DNA, 75 bp, Artificial Sequence
  Synthetic
ggctagaagcacaagaggagggggaagaagtgggttttccagtcagacctcaggtacctttaagaccaatgactt

SEQ ID NO: 186174 - DNA, 75 bp, Artificial Sequence
  Synthetic
ctttccagtcaaacctcaggtacctttaagaccaatgacttataagggagcatttgatctcagcttctttttaaa

SEQ ID NO: 186175 - DNA, 75 bp, Artificial Sequence
  Synthetic
ctcaggtacctttaagaccaatgacttataagggagcatttgatctcagcttctttttaaaagaaaaggggggac

SEQ ID NO: 186176 - DNA, 75 bp, Artificial Sequence
  Synthetic
tctgccataaggaaagccatattaggacaaatagttagccctaggtgtgaatatcaagcaggacataacaaggta

SEQ ID NO: 186177 - DNA, 75 bp, Artificial Sequence
  Synthetic
gaccagagccaacagctccaccagcagagagcttcgagataaaggaggaaatggcctcctctctgaagcagcagg

SEQ ID NO: 186178 - DNA, 75 bp, Artificial Sequence
  Synthetic
aaggggaagtgacatagcaggaactactagtacccttcaggaacaaatagcatggatgacaaataacccacctat

SEQ ID NO: 186179 - DNA, 75 bp, Artificial Sequence
  Synthetic
atagaatataggaaattgctaaaacaaagaaaaatagacaggttaattgagagaataagagaaagagcagaagac

SEQ ID NO: 186180 - DNA, 75 bp, Artificial Sequence
  Synthetic
cgacgagcggctcctctcagcagtaaggatcatcaaaatcctgtaccaaagcagtaagtacatttgtagagtatt

SEQ ID NO: 186181 - DNA, 75 bp, Artificial Sequence
  Synthetic
tccaaaagtaagttcagaagtacatatcccaatacaggatggtagattaatagttagaacatactggggtctaca

SEQ ID NO: 186182 - DNA, 75 bp, Artificial Sequence
  Synthetic
accaccagtaatgatactatttataaatataccacaagtgacataagaaattgccctttcaatgtaaccacagaa

SEQ ID NO: 186183 - DNA, 75 bp, Artificial Sequence
  Synthetic
aagtgtttcaactgtggcaaagaaggacacctagccagaaattgcagggcccctagaaaaaagggctgttggaaa

SEQ ID NO: 186184 - DNA, 75 bp, Artificial Sequence
  Synthetic
gacaaggaactgtatcctttagcttccctcagatcactctttggcaacgacccctcgtcacaataaagatagggg

SEQ ID NO: 186185 - DNA, 75 bp, Artificial Sequence
  Synthetic
cagtttattatggggtacctgtgtggagagaggcaaaggccactttattttgcgcatctgatgctcaatcatata

SEQ ID NO: 186186 - DNA, 75 bp, Artificial Sequence
  Synthetic
ggaaaccaaaaatgatagggggaattggaggttttatcaaagtaagacagtatgatcaggtacccatagaaatct

SEQ ID NO: 186187 - DNA, 75 bp, Artificial Sequence
  Synthetic
agaataaggagagctgatccagcagcagaaggagtaggagcagcatctcaagacttagatagacatggggcactg

SEQ ID NO: 186188 - DNA, 75 bp, Artificial Sequence
  Synthetic
atgcatgaagatataatcagtttatgggatgaaagtctaaaaccctgtgtaaaattaacccctctctgtgttact

SEQ ID NO: 186189 - DNA, 75 bp, Artificial Sequence
  Synthetic
actgtttgttcatttcagaattggttgcaatcatagcagaataggcattatccgaaggagaagaggcagggatgg

SEQ ID NO: 186190 - DNA, 75 bp, Artificial Sequence
  Synthetic
gtaatgcaactattagtactaatgcaactctcaacgccaccactggggaaataaaaaactgcacttttaatatga

SEQ ID NO: 186191 - DNA, 75 bp, Artificial Sequence
  Synthetic
gaatataggaaattgttaagacagagaaaaatagacaggttaattaaaagaattagggaaagagcagaagacagt

SEQ ID NO: 186192 - DNA, 75 bp, Artificial Sequence
  Synthetic
caactgtgtaaactccttaggggagccaaagcactaacagacatagtaccactgactgaagaagcagaattagaa

SEQ ID NO: 186193 - DNA, 75 bp, Artificial Sequence
  Synthetic
ggcatatcctatggcaggaagaagcggagatcccgacgaggaacttctcagaacaataaggatcatcaaaatcct

SEQ ID NO: 186194 - DNA, 75 bp, Artificial Sequence
  Synthetic
gtggcaactctctattgtgtacatagcaacatagagataagagacaccaaggaagccttagacaaaatagaggag

SEQ ID NO: 186195 - DNA, 75 bp, Artificial Sequence
  Synthetic
caggaggggatttagaagttacaacacatagtttcaattgtggaggagaatttttctactgcaatacaacagacc

SEQ ID NO: 186196 - DNA, 75 bp, Artificial Sequence
  Synthetic
tctatagtattaatagaatatagaaaaatactaaagcaaaagaaaatagacaggttacttgatagaataagagac

SEQ ID NO: 186197 - DNA, 75 bp, Artificial Sequence
  Synthetic
agaaaaagtataagaatagggccaggacaaacattctttgcaacagacataataggagatataagacaagcatat

SEQ ID NO: 186198 - DNA, 75 bp, Artificial Sequence
  Synthetic
acagaactaagagataagaaacagaaagcgtatgcacttttttatagacctgatttagtaccacttaatgagaat

SEQ ID NO: 186199 - DNA, 75 bp, Artificial Sequence
  Synthetic
gagggacaattggagaagtgaactatataagtataaagtagtaaaaattgaaccaataggagtagcacctaccag

SEQ ID NO: 186200 - DNA, 75 bp, Artificial Sequence
  Synthetic
cctttgatgaggcctccgggggggatccagaaattgtaacacatagttttaattgtggaggagaatttttttatt

SEQ ID NO: 186201 - DNA, 75 bp, Artificial Sequence
  Synthetic
tgtaacaactacggcaacacaaccgcaaccgaaatgaatggagaaataaaaaactgctctttcagtatgaccaca

SEQ ID NO: 186202 - DNA, 75 bp, Artificial Sequence
  Synthetic
tcaactcaactactgttaaatggtagcctagcagaagaggagataataattagatctgaaaatctgacagacaat

SEQ ID NO: 186203 - DNA, 75 bp, Artificial Sequence
  Synthetic
agaatgtggcagagagtaggacaagcaatgtatgcccctcccattgcaggaaatattacatgtgtatcaaacatt

SEQ ID NO: 186204 - DNA, 75 bp, Artificial Sequence
  Synthetic
tgtgctttatataataaatagagccaggcagggatactcacccttgtcattgcagacccttaccccacacccgga

SEQ ID NO: 186205 - DNA, 75 bp, Artificial Sequence
  Synthetic
caacaatagaaggaagagtatacatttggcacaagggcaaacatggtatgcaacaggtgcaataacaggagatat

SEQ ID NO: 186206 - DNA, 75 bp, Artificial Sequence
  Synthetic
atgttactgacagaggaaggcagaaaattgtttctctaactgaaacaacaaatcagaagactgaattacaagcaa

SEQ ID NO: 186207 - DNA, 75 bp, Artificial Sequence
  Synthetic
gttttatcaaagtaagacagtatgatcaaatacttatagaaatttgtggaaaaaaggctataggtacagtattag

SEQ ID NO: 186208 - DNA, 75 bp, Artificial Sequence
  Synthetic
gcgagagcgtcagtattaagcgggggaaaattagatgcatgggaaaaaattcggttaaggccagggggaaagaaa

SEQ ID NO: 186209 - DNA, 75 bp, Artificial Sequence
  Synthetic
catagtgggatggcctgctatcagtgaaagaatgagaagggctactccacctccagcagcagcagaaggagtggg

SEQ ID NO: 186210 - DNA, 75 bp, Artificial Sequence
  Synthetic
catagtgggatggcctgctatcagtgaaagaatgagaagggctactccacctccagcagcagcagtaggagtggg

SEQ ID NO: 186211 - DNA, 75 bp, Artificial Sequence
  Synthetic
catagtgggatggcctgctatcagtgaaagaatgagaagggctactccacctccagcagcagcagcaggagtggg

SEQ ID NO: 186212 - DNA, 75 bp, Artificial Sequence
  Synthetic
catagtgggatggcctgctatcagtgaaagaatgagaagggctactccacctccagcagcagcaggaggagtggg

SEQ ID NO: 186213 - DNA, 75 bp, Artificial Sequence
  Synthetic
catagtgggatggcctgctatcagtgaaagaatgagaagggcttctccacctccagcagcagcagaaggagtggg

SEQ ID NO: 186214 - DNA, 75 bp, Artificial Sequence
  Synthetic
catagtgggatggcctgctatcagtgaaagaatgagaagggcttctccacctccagcagcagcagtaggagtggg

SEQ ID NO: 186215 - DNA, 75 bp, Artificial Sequence
  Synthetic
catagtgggatggcctgctatcagtgaaagaatgagaagggcttctccacctccagcagcagcagcaggagtggg

SEQ ID NO: 186216 - DNA, 75 bp, Artificial Sequence
  Synthetic
catagtgggatggcctgctatcagtgaaagaatgagaagggcttctccacctccagcagcagcaggaggagtggg

SEQ ID NO: 186217 - DNA, 75 bp, Artificial Sequence
  Synthetic
catagtgggatggcctgctatcagtgaaagaatgagaagggctcctccacctccagcagcagcagaaggagtggg

SEQ ID NO: 186218 - DNA, 75 bp, Artificial Sequence
  Synthetic
catagtgggatggcctgctatcagtgaaagaatgagaagggctcctccacctccagcagcagcagtaggagtggg

SEQ ID NO: 186219 - DNA, 75 bp, Artificial Sequence
  Synthetic
catagtgggatggcctgctatcagtgaaagaatgagaagggctcctccacctccagcagcagcagcaggagtggg

SEQ ID NO: 186220 - DNA, 75 bp, Artificial Sequence
  Synthetic
catagtgggatggcctgctatcagtgaaagaatgagaagggctcctccacctccagcagcagcaggaggagtggg

SEQ ID NO: 186221 - DNA, 75 bp, Artificial Sequence
  Synthetic
catagtgggatggcctgctatcagtgaaagaatgagaagggctgctccacctccagcagcagcagaaggagtggg

SEQ ID NO: 186222 - DNA, 75 bp, Artificial Sequence
  Synthetic
catagtgggatggcctgctatcagtgaaagaatgagaagggctgctccacctccagcagcagcagtaggagtggg

SEQ ID NO: 186223 - DNA, 75 bp, Artificial Sequence
  Synthetic
catagtgggatggcctgctatcagtgaaagaatgagaagggctgctccacctccagcagcagcagcaggagtggg

SEQ ID NO: 186224 - DNA, 75 bp, Artificial Sequence
  Synthetic
catagtgggatggcctgctatcagtgaaagaatgagaagggctgctccacctccagcagcagcaggaggagtggg

SEQ ID NO: 186225 - DNA, 75 bp, Artificial Sequence
  Synthetic
catagtgggatggcctgctttcagtgaaagaatgagaagggctactccacctccagcagcagcagaaggagtggg

SEQ ID NO: 186226 - DNA, 75 bp, Artificial Sequence
  Synthetic
catagtgggatggcctgctttcagtgaaagaatgagaagggctactccacctccagcagcagcagtaggagtggg

SEQ ID NO: 186227 - DNA, 75 bp, Artificial Sequence
  Synthetic
catagtgggatggcctgctttcagtgaaagaatgagaagggctactccacctccagcagcagcagcaggagtggg

SEQ ID NO: 186228 - DNA, 75 bp, Artificial Sequence
  Synthetic
catagtgggatggcctgctttcagtgaaagaatgagaagggctactccacctccagcagcagcaggaggagtggg

SEQ ID NO: 186229 - DNA, 75 bp, Artificial Sequence
  Synthetic
catagtgggatggcctgctttcagtgaaagaatgagaagggcttctccacctccagcagcagcagaaggagtggg

SEQ ID NO: 186230 - DNA, 75 bp, Artificial Sequence
  Synthetic
catagtgggatggcctgctttcagtgaaagaatgagaagggcttctccacctccagcagcagcagtaggagtggg

SEQ ID NO: 186231 - DNA, 75 bp, Artificial Sequence
  Synthetic
catagtgggatggcctgctttcagtgaaagaatgagaagggcttctccacctccagcagcagcagcaggagtggg

SEQ ID NO: 186232 - DNA, 75 bp, Artificial Sequence
  Synthetic
catagtgggatggcctgctttcagtgaaagaatgagaagggcttctccacctccagcagcagcaggaggagtggg

SEQ ID NO: 186233 - DNA, 75 bp, Artificial Sequence
  Synthetic
catagtgggatggcctgctttcagtgaaagaatgagaagggctcctccacctccagcagcagcagaaggagtggg

SEQ ID NO: 186234 - DNA, 75 bp, Artificial Sequence
  Synthetic
catagtgggatggcctgctttcagtgaaagaatgagaagggctcctccacctccagcagcagcagtaggagtggg

SEQ ID NO: 186235 - DNA, 75 bp, Artificial Sequence
  Synthetic
catagtgggatggcctgctttcagtgaaagaatgagaagggctcctccacctccagcagcagcagcaggagtggg

SEQ ID NO: 186236 - DNA, 75 bp, Artificial Sequence
  Synthetic
catagtgggatggcctgctttcagtgaaagaatgagaagggctcctccacctccagcagcagcaggaggagtggg

SEQ ID NO: 186237 - DNA, 75 bp, Artificial Sequence
  Synthetic
catagtgggatggcctgctttcagtgaaagaatgagaagggctgctccacctccagcagcagcagaaggagtggg

SEQ ID NO: 186238 - DNA, 75 bp, Artificial Sequence
  Synthetic
catagtgggatggcctgctttcagtgaaagaatgagaagggctgctccacctccagcagcagcagtaggagtggg

SEQ ID NO: 186239 - DNA, 75 bp, Artificial Sequence
  Synthetic
catagtgggatggcctgctttcagtgaaagaatgagaagggctgctccacctccagcagcagcagcaggagtggg

SEQ ID NO: 186240 - DNA, 75 bp, Artificial Sequence
  Synthetic
catagtgggatggcctgctttcagtgaaagaatgagaagggctgctccacctccagcagcagcaggaggagtggg

SEQ ID NO: 186241 - DNA, 75 bp, Artificial Sequence
  Synthetic
catagtgggatggcctgctctcagtgaaagaatgagaagggctactccacctccagcagcagcagaaggagtggg

SEQ ID NO: 186242 - DNA, 75 bp, Artificial Sequence
  Synthetic
catagtgggatggcctgctctcagtgaaagaatgagaagggctactccacctccagcagcagcagtaggagtggg

SEQ ID NO: 186243 - DNA, 75 bp, Artificial Sequence
  Synthetic
catagtgggatggcctgctctcagtgaaagaatgagaagggctactccacctccagcagcagcagcaggagtggg

SEQ ID NO: 186244 - DNA, 75 bp, Artificial Sequence
  Synthetic
catagtgggatggcctgctctcagtgaaagaatgagaagggctactccacctccagcagcagcaggaggagtggg

SEQ ID NO: 186245 - DNA, 75 bp, Artificial Sequence
  Synthetic
catagtgggatggcctgctctcagtgaaagaatgagaagggcttctccacctccagcagcagcagaaggagtggg

SEQ ID NO: 186246 - DNA, 75 bp, Artificial Sequence
  Synthetic
catagtgggatggcctgctctcagtgaaagaatgagaagggcttctccacctccagcagcagcagtaggagtggg

SEQ ID NO: 186247 - DNA, 75 bp, Artificial Sequence
  Synthetic
catagtgggatggcctgctctcagtgaaagaatgagaagggcttctccacctccagcagcagcagcaggagtggg

SEQ ID NO: 186248 - DNA, 75 bp, Artificial Sequence
  Synthetic
catagtgggatggcctgctctcagtgaaagaatgagaagggcttctccacctccagcagcagcaggaggagtggg

SEQ ID NO: 186249 - DNA, 75 bp, Artificial Sequence
  Synthetic
catagtgggatggcctgctctcagtgaaagaatgagaagggctcctccacctccagcagcagcagaaggagtggg

SEQ ID NO: 186250 - DNA, 75 bp, Artificial Sequence
  Synthetic
catagtgggatggcctgctctcagtgaaagaatgagaagggctcctccacctccagcagcagcagtaggagtggg

SEQ ID NO: 186251 - DNA, 75 bp, Artificial Sequence
  Synthetic
catagtgggatggcctgctctcagtgaaagaatgagaagggctcctccacctccagcagcagcagcaggagtggg

SEQ ID NO: 186252 - DNA, 75 bp, Artificial Sequence
  Synthetic
catagtgggatggcctgctctcagtgaaagaatgagaagggctcctccacctccagcagcagcaggaggagtggg

SEQ ID NO: 186253 - DNA, 75 bp, Artificial Sequence
  Synthetic
catagtgggatggcctgctctcagtgaaagaatgagaagggctgctccacctccagcagcagcagaaggagtggg

SEQ ID NO: 186254 - DNA, 75 bp, Artificial Sequence
  Synthetic
catagtgggatggcctgctctcagtgaaagaatgagaagggctgctccacctccagcagcagcagtaggagtggg

SEQ ID NO: 186255 - DNA, 75 bp, Artificial Sequence
  Synthetic
catagtgggatggcctgctctcagtgaaagaatgagaagggctgctccacctccagcagcagcagcaggagtggg

SEQ ID NO: 186256 - DNA, 75 bp, Artificial Sequence
  Synthetic
catagtgggatggcctgctctcagtgaaagaatgagaagggctgctccacctccagcagcagcaggaggagtggg

SEQ ID NO: 186257 - DNA, 75 bp, Artificial Sequence
  Synthetic
catagtgggatggcctgctgtcagtgaaagaatgagaagggctactccacctccagcagcagcagaaggagtggg

SEQ ID NO: 186258 - DNA, 75 bp, Artificial Sequence
  Synthetic
catagtgggatggcctgctgtcagtgaaagaatgagaagggctactccacctccagcagcagcagtaggagtggg

SEQ ID NO: 186259 - DNA, 75 bp, Artificial Sequence
  Synthetic
catagtgggatggcctgctgtcagtgaaagaatgagaagggctactccacctccagcagcagcagcaggagtggg

SEQ ID NO: 186260 - DNA, 75 bp, Artificial Sequence
  Synthetic
catagtgggatggcctgctgtcagtgaaagaatgagaagggctactccacctccagcagcagcaggaggagtggg

SEQ ID NO: 186261 - DNA, 75 bp, Artificial Sequence
  Synthetic
catagtgggatggcctgctgtcagtgaaagaatgagaagggcttctccacctccagcagcagcagaaggagtggg

SEQ ID NO: 186262 - DNA, 75 bp, Artificial Sequence
  Synthetic
catagtgggatggcctgctgtcagtgaaagaatgagaagggcttctccacctccagcagcagcagtaggagtggg

SEQ ID NO: 186263 - DNA, 75 bp, Artificial Sequence
  Synthetic
catagtgggatggcctgctgtcagtgaaagaatgagaagggcttctccacctccagcagcagcagcaggagtggg

SEQ ID NO: 186264 - DNA, 75 bp, Artificial Sequence
  Synthetic
catagtgggatggcctgctgtcagtgaaagaatgagaagggcttctccacctccagcagcagcaggaggagtggg

SEQ ID NO: 186265 - DNA, 75 bp, Artificial Sequence
  Synthetic
catagtgggatggcctgctgtcagtgaaagaatgagaagggctcctccacctccagcagcagcagaaggagtggg

SEQ ID NO: 186266 - DNA, 75 bp, Artificial Sequence
  Synthetic
catagtgggatggcctgctgtcagtgaaagaatgagaagggctcctccacctccagcagcagcagtaggagtggg

SEQ ID NO: 186267 - DNA, 75 bp, Artificial Sequence
  Synthetic
catagtgggatggcctgctgtcagtgaaagaatgagaagggctcctccacctccagcagcagcagcaggagtggg

SEQ ID NO: 186268 - DNA, 75 bp, Artificial Sequence
  Synthetic
catagtgggatggcctgctgtcagtgaaagaatgagaagggctcctccacctccagcagcagcaggaggagtggg

SEQ ID NO: 186269 - DNA, 75 bp, Artificial Sequence
  Synthetic
catagtgggatggcctgctgtcagtgaaagaatgagaagggctgctccacctccagcagcagcagaaggagtggg

SEQ ID NO: 186270 - DNA, 75 bp, Artificial Sequence
  Synthetic
catagtgggatggcctgctgtcagtgaaagaatgagaagggctgctccacctccagcagcagcagtaggagtggg

SEQ ID NO: 186271 - DNA, 75 bp, Artificial Sequence
  Synthetic
catagtgggatggcctgctgtcagtgaaagaatgagaagggctgctccacctccagcagcagcagcaggagtggg

SEQ ID NO: 186272 - DNA, 75 bp, Artificial Sequence
  Synthetic
catagtgggatggcctgctgtcagtgaaagaatgagaagggctgctccacctccagcagcagcaggaggagtggg

SEQ ID NO: 186273 - DNA, 75 bp, Artificial Sequence
  Synthetic
aaatagagttaggcagggatactcacctttgtctttccagacccctaccccatacccagaggaagtcgccaggcc

SEQ ID NO: 186274 - DNA, 75 bp, Artificial Sequence
  Synthetic
cacacagcaagaggcgagagcggcgactggtgagtacgccaaatttttgactagcggaggctagaaggagagaga

SEQ ID NO: 186275 - DNA, 75 bp, Artificial Sequence
  Synthetic
ttatttgactagcggaggctagaaggagagagatgggtgcgagagcgtcaatattaagaggcgaaaaattagata

SEQ ID NO: 186276 - DNA, 75 bp, Artificial Sequence
  Synthetic
gtggcgcccgaacagggaccttaaagcgaaagtaaaagggactcgaaagcggaagttccagagaagactctcgac

SEQ ID NO: 186277 - DNA, 75 bp, Artificial Sequence
  Synthetic
ggaactagtaaccacagtatcgacaatggtgccatggaagaaataaaaaattgctctttcaatatgaccacagta

SEQ ID NO: 186278 - DNA, 75 bp, Artificial Sequence
  Synthetic
tgtgccttggaatactagttggagtaataaatctctgaatgagatttgggataacatgacctggatgcagtggga

SEQ ID NO: 186279 - DNA, 75 bp, Artificial Sequence
  Synthetic
aacgctagcgacaacaacgctagcgagctaagggaaaaagacatgagaaactgctctttcaatatgactacagaa

SEQ ID NO: 186280 - DNA, 75 bp, Artificial Sequence
  Synthetic
gatcatcaaaatcctatatcaaagcagtaagtagtaataaacagtatatgtaatgacttctttagaaatctatgc

SEQ ID NO: 186281 - DNA, 75 bp, Artificial Sequence
  Synthetic
taccgtaaaaaattgctctttcaatgtcaccacaagcataaggaatgagaggcagaaagaatatgcactttttaa

SEQ ID NO: 186282 - DNA, 75 bp, Artificial Sequence
  Synthetic
ataacacaggaagcagcagtaaggtcagtcaaaattatcctatagtgcaaaatgcacaaggacagatggtacatc

SEQ ID NO: 186283 - DNA, 75 bp, Artificial Sequence
  Synthetic
atacccccattgttagttcaggagagataaaaaactgctcttttaataccaccacaagcataagagataagataa

SEQ ID NO: 186284 - DNA, 75 bp, Artificial Sequence
  Synthetic
tacaaataccaccaggactaatagtactagtattgggaaaaacatgcaaggagaaataaaaaactgctctttcaa

SEQ ID NO: 186285 - DNA, 75 bp, Artificial Sequence
  Synthetic
ggacagagccaacagccccgcccgcagagagcttcgagatgaaagaggagacaacctcctctccgaagcaggaac

SEQ ID NO: 186286 - DNA, 75 bp, Artificial Sequence
  Synthetic
ataaattgtaacacctcagtcattacacaggcctgtccaaaggtatcctttgaaccaattcccatacattattgt

SEQ ID NO: 186287 - DNA, 75 bp, Artificial Sequence
  Synthetic
gccagtagtgtcaactcaattgctattaaatggcagtctagcagaagaaggaatagtaattagatctgaaaattt

SEQ ID NO: 186288 - DNA, 75 bp, Artificial Sequence
  Synthetic
ccatcccttcagacaggatcagaagaacttaaatcattatataatacagtagcaaccctctattgtgtgcatcaa

SEQ ID NO: 186289 - DNA, 75 bp, Artificial Sequence
  Synthetic
atcttagcaatagtagtgtggactatagtagctatagaatataagaaaatactaagggaaagaaaaatagacagg

SEQ ID NO: 186290 - DNA, 75 bp, Artificial Sequence
  Synthetic
ggatggcccaaaagttaaacagtggcctttgacagaagaaaaaataaaggccttaagagaaatatgtacagaaat

SEQ ID NO: 186291 - DNA, 75 bp, Artificial Sequence
  Synthetic
atcctcaggaggggacccagaaattgtaatgcacacttttaattgtggaggggaatttttctactgtaatacagc

SEQ ID NO: 186292 - DNA, 75 bp, Artificial Sequence
  Synthetic
agggccatgcaagaatgtcagcacagtacaatgcacacatggaatcaagccagtagtatcaactcagctgctgtt

SEQ ID NO: 186293 - DNA, 75 bp, Artificial Sequence
  Synthetic
agcaatgtatgcccctcccattgaaggacaaattagctgttcatcaaatattacagggctgctattaacaagaga

SEQ ID NO: 186294 - DNA, 75 bp, Artificial Sequence
  Synthetic
gaaatgacactatcacactcccatgcagaataaaacaaattataaacaggtggcaggaagtaggaaaagcaatgt

SEQ ID NO: 186295 - DNA, 75 bp, Artificial Sequence
  Synthetic
gagacaggctaattttttagggagattctggcctcccaacaaggggaggccagggaattttcctcagagcaggtt

SEQ ID NO: 186296 - DNA, 75 bp, Artificial Sequence
  Synthetic
aggaaaatatgcaaaaaaggggtctgcccacactaatgatgtaaaacaattaacagcagtggtgcaaaaagtggc

SEQ ID NO: 186297 - DNA, 75 bp, Artificial Sequence
  Synthetic
tggaattggataagtgggcaaatttgtggaattggtttgacatatcaaactggctgtggtatataaaaatattca

SEQ ID NO: 186298 - DNA, 75 bp, Artificial Sequence
  Synthetic
aaaatgtctagcgggatggcctactgtaagggaaaggatgagacaagctggtccaccagcagagggagcagcaga

SEQ ID NO: 186299 - DNA, 75 bp, Artificial Sequence
  Synthetic
acaattaacagaagcagtacaaaagatagccatggaatgcatagtaatatggggaaagactcctaagtttagatt

SEQ ID NO: 186300 - DNA, 75 bp, Artificial Sequence
  Synthetic
tcagagtagcatgacaaaaatcttagaaccctttagggcacagaatccagaaatagttatctaccaatacatgga

SEQ ID NO: 186301 - DNA, 75 bp, Artificial Sequence
  Synthetic
tcgcagaaccagcaggaaaagaatgaacaagacttattggcattggacaagtgggcaaatctgtggaattggttt

SEQ ID NO: 186302 - DNA, 75 bp, Artificial Sequence
  Synthetic
aaacagatggcaggtgatgattgtgtggcaggtagacaggatgaagattagaacatggaacagtttagtaaagca

SEQ ID NO: 186303 - DNA, 75 bp, Artificial Sequence
  Synthetic
cagctatcgcagtagctgaggggacagataggattctagaagcagtacaaagagcttgtagagctttcctgcata

SEQ ID NO: 186304 - DNA, 75 bp, Artificial Sequence
  Synthetic
aatagtagtagctgaggggacagatagaattatagaagctttgcaaagaattggtagagctattctcaacatacc

SEQ ID NO: 186305 - DNA, 75 bp, Artificial Sequence
  Synthetic
gccacaggaaacagcagcaagatcagtcaaaattaccctatagtgcaaaatgcacaagggcaaatggtacatcag

SEQ ID NO: 186306 - DNA, 75 bp, Artificial Sequence
  Synthetic
gctttgaagcagctttgcaataaaatgggaagcaagtggtcaaaatgtagtccagtaggatggcctgctgtaaga

SEQ ID NO: 186307 - DNA, 75 bp, Artificial Sequence
  Synthetic
agagaacacttccctaataaaacaatacaatttgaaccaccctcaggaggggacctagaagttacaacacatagt

SEQ ID NO: 186308 - DNA, 75 bp, Artificial Sequence
  Synthetic
ggacctagaagttacaacacatagttttaattgtatgggggaatttttctattgcaatacatcaaaactgtttaa

SEQ ID NO: 186309 - DNA, 75 bp, Artificial Sequence
  Synthetic
ttgcctagtgttaggaaactaacagaggatagatggaacaagccccagaagaccaggggccgcagagggaaccat

SEQ ID NO: 186310 - DNA, 75 bp, Artificial Sequence
  Synthetic
tgaaagtagaaacccaagagcaagttcagaagtacacatcccattaggggaggctaaattagtagtaagaacata

SEQ ID NO: 186311 - DNA, 75 bp, Artificial Sequence
  Synthetic
aggcttaggcatctcctatggcaggaagaagcggagacccagacgcggaactcctcacaacagtaaggatcatca

SEQ ID NO: 186312 - DNA, 75 bp, Artificial Sequence
  Synthetic
ggctgacgggaaggtcagtcaaaattatcctatagtgcagaatctccaagggcaaatggtacaccaggccatatc

SEQ ID NO: 186313 - DNA, 75 bp, Artificial Sequence
  Synthetic
tccgaagcaggagcagaaggacagggaacagccccctcctttagtttccctcaaatcactctttggcagcgaccc

SEQ ID NO: 186314 - DNA, 75 bp, Artificial Sequence
  Synthetic
agtagaagatagatggaacaagtcccagaagaccaagggccgcagagagagccacataatgaatggacactaaca

SEQ ID NO: 186315 - DNA, 75 bp, Artificial Sequence
  Synthetic
aaccaaaaatgatagggggaattggaggttttatcaaagtaagacagtatgatcagatacttatagaaatttgtg

SEQ ID NO: 186316 - DNA, 75 bp, Artificial Sequence
  Synthetic
tgggtcacggtatactatggggtacctgtgtggagagatgcagagaccaccctattttgtgcatcagatgctaaa

SEQ ID NO: 186317 - DNA, 75 bp, Artificial Sequence
  Synthetic
gcttaggcatctcctatggcaggaagaagcggagacagcgacgaagagctcctcaagacagtcagaatcatcaag

SEQ ID NO: 186318 - DNA, 75 bp, Artificial Sequence
  Synthetic
acccatagaaatttgtggacataaagctataggtacagtattagtaggacctacacctgtcaacataattggaag

SEQ ID NO: 186319 - DNA, 75 bp, Artificial Sequence
  Synthetic
ccaaagcagtaagtaataagcatatgtaatgtcatccatgtcttccttgcaagtctgggcaataacagcattgat

SEQ ID NO: 186320 - DNA, 75 bp, Artificial Sequence
  Synthetic
atcagtacaatgtgcttccacaaggatggaaaggatcaccagcaatattccagagtagcatgacaaaaatcttag

SEQ ID NO: 186321 - DNA, 75 bp, Artificial Sequence
  Synthetic
ataggaaattgctaaggcaaagaaaaatagacagattgtgcaagagaataatagaaagagcagaagacagtggca

SEQ ID NO: 186322 - DNA, 75 bp, Artificial Sequence
  Synthetic
agtctactatggggtacctgtgtggaaagaagcaaaagctactctattctgtgcatcagatgctaaagcatatga

SEQ ID NO: 186323 - DNA, 75 bp, Artificial Sequence
  Synthetic
caactactgtttgttcatttcagaattgggtgcagtcatagcagaataggcattttccgaagcagaagaggcagg

SEQ ID NO: 186324 - DNA, 75 bp, Artificial Sequence
  Synthetic
ataatctttaagagctccacaggaggggatttagaagttacaacacatagtttcaattgtggaggagaatttttc

SEQ ID NO: 186325 - DNA, 75 bp, Artificial Sequence
  Synthetic
aaaaaactgctcttttaatatcaccacagggataagagataaggtgcagaaagaatatgcacttttgtataaatt

SEQ ID NO: 186326 - DNA, 75 bp, Artificial Sequence
  Synthetic
taaattgtacaagtgttaaggataccaagaataatactaccaagcacaatgatagcatgattcaagaaatgagta

SEQ ID NO: 186327 - DNA, 75 bp, Artificial Sequence
  Synthetic
tgccagctttgctttataaccaaaggcttaggcatatcctatggcaggaagaagcggagaccccgacgaggcact

SEQ ID NO: 186328 - DNA, 75 bp, Artificial Sequence
  Synthetic
tcacctagaactttgaatgcatgggtaaaagtaatagaggagaaggcttttagcccagaggtaatacccatgttt

SEQ ID NO: 186329 - DNA, 75 bp, Artificial Sequence
  Synthetic
tctcggagcaatcaggatcatcaaaatcctctaccaaagcagtaagtagtattgtaatgacccccttacaaatct

SEQ ID NO: 186330 - DNA, 75 bp, Artificial Sequence
  Synthetic
aattgtaatgtctcatccattacacaagcttgcccaaagataaagtttgaaccaattcccatacattattgtgct

SEQ ID NO: 186331 - DNA, 75 bp, Artificial Sequence
  Synthetic
gtagtacaagttgaaccaataggagtagcacctaccacggcaaagagaagagtggtggagagagaaaaaagagca

SEQ ID NO: 186332 - DNA, 75 bp, Artificial Sequence
  Synthetic
agccacctggattcctgagggggagtttgtcaacacccctcccctagggaaattatggacccagttagaaaaaga

SEQ ID NO: 186333 - DNA, 75 bp, Artificial Sequence
  Synthetic
cagacaataccaaaaatataatagtacagcttgcagaggctgtaaaaattaattgtaccagacctaacaacaata

SEQ ID NO: 186334 - DNA, 75 bp, Artificial Sequence
  Synthetic
agacctggtaataagacaagcagaagtataaggataggaccaggacgagtattctatacaaataacataatagga

SEQ ID NO: 186335 - DNA, 75 bp, Artificial Sequence
  Synthetic
gtataaggataggaccaggacgagtattctatacaaataacataataggagacataagacgagcacattgtaata

SEQ ID NO: 186336 - DNA, 75 bp, Artificial Sequence
  Synthetic
ttggaatacaactttacaaaagatagttgatgaattaagaaaacacttccctaataaaaacataacatttgctcc

SEQ ID NO: 186337 - DNA, 75 bp, Artificial Sequence
  Synthetic
atagaactagcagaaaccatactgacataaacagggaaatgagaaactgctctttcaatatgaccacagtactaa

SEQ ID NO: 186338 - DNA, 75 bp, Artificial Sequence
  Synthetic
taaatgtttcaactgtggcaaggaagggcacatagccagaaattgcagggcccctaggaaaaaaggctgttggaa

SEQ ID NO: 186339 - DNA, 75 bp, Artificial Sequence
  Synthetic
gttaataaaaacgaaacaaatagtacaaacacgacagatgaaaaaattatcaggcttccatgcagaataaaacaa

SEQ ID NO: 186340 - DNA, 75 bp, Artificial Sequence
  Synthetic
aacaacagtgccaatagtaacatcacactcccatgcaagataaaacaaattataaacatgtggcagcaggtggga

SEQ ID NO: 186341 - DNA, 75 bp, Artificial Sequence
  Synthetic
caaacacgacagatgaaaaaattatcaggcttccatgcagaataaaacaaattgtaaacaggtggcaggaagtgg

SEQ ID NO: 186342 - DNA, 75 bp, Artificial Sequence
  Synthetic
tggcaatgagaccttcagacctggaggaggagacatgagggacaattggagaagtgaactatataaatataaagt

SEQ ID NO: 186343 - DNA, 75 bp, Artificial Sequence
  Synthetic
taactgtagcagacccaacaacaatacaagaaaaagtatacatctaggaccaggacaatcattctatgcaacagg

SEQ ID NO: 186344 - DNA, 75 bp, Artificial Sequence
  Synthetic
acaagaaaaagtatacatctaggaccaggacaatcattctatgcaacaggtgatataataggagacataagacaa

SEQ ID NO: 186345 - DNA, 75 bp, Artificial Sequence
  Synthetic
aattatggtaccagctggagaaagatcccatagcaggagcagaaactttctatgtagatggagcagctaataggg

SEQ ID NO: 186346 - DNA, 75 bp, Artificial Sequence
  Synthetic
gttaaggccgcctgttggtgggcggggatcaagcaggaatttggcattccctacaatccccaaagtcaaggagta

SEQ ID NO: 186347 - DNA, 75 bp, Artificial Sequence
  Synthetic
cctgtcatgggtaccagcacataaaggaattggaggaaatgaacaagtagataaattagtaagtaatggaatcag

SEQ ID NO: 186348 - DNA, 75 bp, Artificial Sequence
  Synthetic
caggttagggaaagaataagacgagctcctgctccagcagcaagaggagtaggaccagtatctcaagatttggat

SEQ ID NO: 186349 - DNA, 75 bp, Artificial Sequence
  Synthetic
cgcctggctggaggcgcaagaggaagaggaggtaggctttccagtcaggccgcaggtacctttgagaccgatgac

SEQ ID NO: 186350 - DNA, 75 bp, Artificial Sequence
  Synthetic
tattagtttgcttgataccacagcagtagcagtagctgagggaacagataggattatagaagcagtgcagagaat

SEQ ID NO: 186351 - DNA, 75 bp, Artificial Sequence
  Synthetic
gtgccttggaacactagttggagtaataaatcttggaatgaaatttgggacaacatgacctggttgcagtgggat

SEQ ID NO: 186352 - DNA, 75 bp, Artificial Sequence
  Synthetic
aaaatggggggcaagtggtcaaaaagcagcaaaaataaatgggagaatgtaagagaaagaatgagacaaactgag

SEQ ID NO: 186353 - DNA, 75 bp, Artificial Sequence
  Synthetic
taagggaaagaatgaggcgagctcgagctgagccagctcgagctgagccagcagcagtaggagtaggagcagtgt

SEQ ID NO: 186354 - DNA, 75 bp, Artificial Sequence
  Synthetic
tagagccctggaaccatccgggaagtcagcctacaactgcttgtaacaagtgttactgtaaaaagtgttgctatc

SEQ ID NO: 186355 - DNA, 75 bp, Artificial Sequence
  Synthetic
aatcacaaccagcaatacagcagctactaatcctgacaaagcctggctggaagcacaggaagaggaagaggaggt

SEQ ID NO: 186356 - DNA, 75 bp, Artificial Sequence
  Synthetic
ctctcgacgcaggactcggcttgctgaggtgcacacagcaagaggcgagagcggcgactggtgagtacgccaaat

SEQ ID NO: 186357 - DNA, 75 bp, Artificial Sequence
  Synthetic
atagaatataggaaaataagaaaacaaaaaagaatagatagactaattaatagaataagagagagaacagaagat

SEQ ID NO: 186358 - DNA, 75 bp, Artificial Sequence
  Synthetic
aaaaaagaatagatagactaattaatagaataagagagagaacagaagatagtggcaatgagagtgaaggggaca

SEQ ID NO: 186359 - DNA, 75 bp, Artificial Sequence
  Synthetic
tgggtcacagtatattatggggtacctgtgtggaaagaagcaaccaccactctattttgtgcatcagatgctaaa

SEQ ID NO: 186360 - DNA, 75 bp, Artificial Sequence
  Synthetic
tgcaaaagaagagcaagcaaaagacacagcaggcagcagctgacacaggaggtagcagcaaggtcagccaaaatt

SEQ ID NO: 186361 - DNA, 75 bp, Artificial Sequence
  Synthetic
gggggcaagtggtcaaaaagcagcgtagtgggatggcctgaagtcagggaaagaatgagaaggactcctccagca

SEQ ID NO: 186362 - DNA, 75 bp, Artificial Sequence
  Synthetic
accctatagtgcaaaatgcacaagggcaaatggtacatcaggccatgtcacctagaactttgaatgcatgggtga

SEQ ID NO: 186363 - DNA, 75 bp, Artificial Sequence
  Synthetic
cctagaactttgaatgcatgggtgaaagtaatagaagaaaaggctttcagcccagaagtaatacccatgttctca

SEQ ID NO: 186364 - DNA, 75 bp, Artificial Sequence
  Synthetic
cacaagaggaagagggggaggtaggctttccagtcagaccacaggtacctttaagaccaatgacttataaggcag

SEQ ID NO: 186365 - DNA, 75 bp, Artificial Sequence
  Synthetic
actaacaccactagtactagggcacaggggagagaggagaaaatgaaaagtgaaatgaaaaattgctctttcaat

SEQ ID NO: 186366 - DNA, 75 bp, Artificial Sequence
  Synthetic
cacaggtacctttaagaccaatgacttataaggcagcctttgatctcggcttctttttaaaagaaaaggggggac

SEQ ID NO: 186367 - DNA, 75 bp, Artificial Sequence
  Synthetic
ttaatatcaccacaaccatgaataaggtgcagaaagaatatgcactcttttatacacatgatgtagtacaaatag

SEQ ID NO: 186368 - DNA, 75 bp, Artificial Sequence
  Synthetic
ggaagaaagaatacgcacttttttatagacctgatgtattaccaattgataagaataaaattaataataagactt

SEQ ID NO: 186369 - DNA, 75 bp, Artificial Sequence
  Synthetic
atcagtttatgggatcaaagcctaaagccatgtgtaaaattaaccccactctgtgttactttaaattgcactgat

SEQ ID NO: 186370 - DNA, 75 bp, Artificial Sequence
  Synthetic
agaagagcaagaaatggagccagtagatcctaacctagagccctggaaccacccaggaagtcagcctaaaactgc

SEQ ID NO: 186371 - DNA, 75 bp, Artificial Sequence
  Synthetic
agaaataaaaaactgctctttcaatgtcacaagcatagggaataaggtgcggaaagaacatgcaatttttaataa

SEQ ID NO: 186372 - DNA, 75 bp, Artificial Sequence
  Synthetic
gatgggtgcgagagcgtcagtattaagtgggggaaaattagatgcatgggagaaaattaggttaaggccaggggg

SEQ ID NO: 186373 - DNA, 75 bp, Artificial Sequence
  Synthetic
tcctggttgtgcgattctaaattgcacggataaaaatttctctggaactggaacatgtaaacatggcactcctgt

SEQ ID NO: 186374 - DNA, 75 bp, Artificial Sequence
  Synthetic
ctatggcaggaagaagcggagacagcgacgaagcgctcctcaaagcagtgaggatcatcaaaatcctatatcaaa

SEQ ID NO: 186375 - DNA, 75 bp, Artificial Sequence
  Synthetic
aataatgctaaaaacataatagtacagttggttgagccaataaaaattaattgtaccaggcctaacaacaataca

SEQ ID NO: 186376 - DNA, 75 bp, Artificial Sequence
  Synthetic
ccaatgccactaccaataataaacaaaccagcaccctgaaggaagagccaggggcaatactaaactgttccttta

SEQ ID NO: 186377 - DNA, 75 bp, Artificial Sequence
  Synthetic
caaaatgcgaatccagactgtaagtccatcttaaaagcattaggaacaggggctacattagaagagatgatgaca

SEQ ID NO: 186378 - DNA, 75 bp, Artificial Sequence
  Synthetic
ggaatgaaaccctacaaaaggtagataacaaattaagaaaatactttggtaataagacaatatgctttcagccac

SEQ ID NO: 186379 - DNA, 75 bp, Artificial Sequence
  Synthetic
aagacccaacaacaatacaagaaaaagtataaatatgggaccagggagagcattttatgcaacaggagatataat

SEQ ID NO: 186380 - DNA, 75 bp, Artificial Sequence
  Synthetic
cagaaattgtaaagcacagttttaattgtggaggggaatttttctactgcaattcaacacaactgtttaatagta

SEQ ID NO: 186381 - DNA, 75 bp, Artificial Sequence
  Synthetic
ccaataacaatacaagaaaaagtatacatctaggaccagggaaagcctggtatacaacaggagacataataggaa

SEQ ID NO: 186382 - DNA, 75 bp, Artificial Sequence
  Synthetic
gaaatgtggaaaggaaggacatcaaatgaaagactgcactgagagacaggctaattttttagggagaatgtggcc

SEQ ID NO: 186383 - DNA, 75 bp, Artificial Sequence
  Synthetic
aaaaggcacaaatgccaacattaccaacatgactatcccatgcaaaataaagcaaattgtacgtatgtggcagag

SEQ ID NO: 186384 - DNA, 75 bp, Artificial Sequence
  Synthetic
aacatgactatcccatgcaaaataaagcaaattgtacgtatgtggcagagagtaggacaagcaatgtatgcccct

SEQ ID NO: 186385 - DNA, 75 bp, Artificial Sequence
  Synthetic
tccaccaggccagatgagggaaccaaggggaagtgacatagcaggaactaccagtacccttcaggaacaaatagg

SEQ ID NO: 186386 - DNA, 75 bp, Artificial Sequence
  Synthetic
ctgctctttcaaaatcaccacaagcataaatactaaggtgaaagaccatgctcttttctataaaggtgatatagt

SEQ ID NO: 186387 - DNA, 75 bp, Artificial Sequence
  Synthetic
aagacccggcaacaatacaagaaaaggtatatatatgggaccagggagagcatggtatacaacaagaagaataac

SEQ ID NO: 186388 - DNA, 75 bp, Artificial Sequence
  Synthetic
ttgtgtggactatagcatatatagagtatagaaaattggtaagacaaagacaaatagacaggttaattgaaagga

SEQ ID NO: 186389 - DNA, 75 bp, Artificial Sequence
  Synthetic
tccaggcaagagtcctggctgtggaaagatacctaagggatcaacagctcctagggctttggggttgctctggaa

SEQ ID NO: 186390 - DNA, 75 bp, Artificial Sequence
  Synthetic
caatgagagtgatggagatcaagaggaattgtcaacgatggtggacatggggcatcttaggcttttggatgctaa

SEQ ID NO: 186391 - DNA, 75 bp, Artificial Sequence
  Synthetic
taagacaaattgtaaacatgtggcaggaagtaggaaaagcaatgtatgcccctcccattgaaggacaaattagat

SEQ ID NO: 186392 - DNA, 75 bp, Artificial Sequence
  Synthetic
cagtttatgggatcaaagtctaaagccatgtgtaaagttgaccccactctgtgtcactttaaattgtacaaatgt

SEQ ID NO: 186393 - DNA, 75 bp, Artificial Sequence
  Synthetic
ggtcagggagtctccatagaatggaggaaaaagagatatagcacacaagtagaccctgacctagcagaccaacta

SEQ ID NO: 186394 - DNA, 75 bp, Artificial Sequence
  Synthetic
gtaggagtaggagcagtatctcaagatttagctagacatggagcaatcacaagtaggaatacagcggctactaat

SEQ ID NO: 186395 - DNA, 75 bp, Artificial Sequence
  Synthetic
acaggaaaagaatgaactagaattattggaattggataaatgggcaagcttgtggaattggtttgacataacaaa

SEQ ID NO: 186396 - DNA, 75 bp, Artificial Sequence
  Synthetic
ggatggtactgtccttaatgataccaatggagaaataaaaaattgctctttcaatgccaccacagaaataagaga

SEQ ID NO: 186397 - DNA, 75 bp, Artificial Sequence
  Synthetic
gtgcgagagcgtcaatattaagcgggggagaattggatagatgggaaaaaattcggttaaggccagggggaaaga

SEQ ID NO: 186398 - DNA, 75 bp, Artificial Sequence
  Synthetic
agatagaattatagagttagtacaaagaattggtagagctatctgcaacatacctagaagaataagacagggctt

SEQ ID NO: 186399 - DNA, 75 bp, Artificial Sequence
  Synthetic
tacctagaagaataagacagggctttgaagcagctttgcaataagatggggggcaagtggtcaaaaagtagcata

SEQ ID NO: 186400 - DNA, 75 bp, Artificial Sequence
  Synthetic
ggctccatggattaggacaacatatctataacacctatggggatacttgggaaggggttgaagctataataagaa

SEQ ID NO: 186401 - DNA, 75 bp, Artificial Sequence
  Synthetic
agaatgtatagcctgactagcatcttggacataagacagggaccaaagaaaccccttagagactatgtagacagg

SEQ ID NO: 186402 - DNA, 75 bp, Artificial Sequence
  Synthetic
agaatgtatagcctgactagcatcttggtcataagacagggaccaaagaaaccccttagagactatgtagacagg

SEQ ID NO: 186403 - DNA, 75 bp, Artificial Sequence
  Synthetic
agaatgtatagcctgactagcatcttggccataagacagggaccaaagaaaccccttagagactatgtagacagg

SEQ ID NO: 186404 - DNA, 75 bp, Artificial Sequence
  Synthetic
agaatgtatagcctgactagcatcttgggcataagacagggaccaaagaaaccccttagagactatgtagacagg

SEQ ID NO: 186405 - DNA, 75 bp, Artificial Sequence
  Synthetic
gcggaactcctcacagcagtaaggatcatcaaattcctatatcaaagcagtaagtactaaataaatgtaatgaca

SEQ ID NO: 186406 - DNA, 75 bp, Artificial Sequence
  Synthetic
aggacgagcaatgtatgctcctcccattgcaggaaacataacatgtaaatcaaacatcacaggattactattggt

SEQ ID NO: 186407 - DNA, 75 bp, Artificial Sequence
  Synthetic
aaagaaaaatagacaggttaattgagagaataagagaaagagcagaagacagtggcaatgaaagcgagggggatg

SEQ ID NO: 186408 - DNA, 75 bp, Artificial Sequence
  Synthetic
ggcaaatggtacaccaggccatatcacctagaactttaaatgcatgggtaaaagtaatagaggagaaggctttta

SEQ ID NO: 186409 - DNA, 75 bp, Artificial Sequence
  Synthetic
atagcaagaaattgcagggcccctagaaaaaagggctgttggaaatgtggaagagaaggacaccaaatgaaagac

SEQ ID NO: 186410 - DNA, 75 bp, Artificial Sequence
  Synthetic
tcttagcacttgtctgggacgatctgcggagcctgtgcctcttcagctaccaccgattgagagacttcatattga

SEQ ID NO: 186411 - DNA, 75 bp, Artificial Sequence
  Synthetic
aaaaaggctataggtacagtactagtaggacctacccctgtcaacataattggaaggaacatgttgactcagctt

SEQ ID NO: 186412 - DNA, 75 bp, Artificial Sequence
  Synthetic
tcgtcaaaatcctataccaaagcagtaagtattaagtatatgtaatgtcatccttgtcatccttggaaatctgga

SEQ ID NO: 186413 - DNA, 75 bp, Artificial Sequence
  Synthetic
gcagaagacagtggcaatgagagtgatggggatacagaggaattatccacacttgtgggaatgggggactttgat

SEQ ID NO: 186414 - DNA, 75 bp, Artificial Sequence
  Synthetic
ttgtaaacaaaggcttaggcatatcctatggcaggaagaagtggagacagcgacgaggcgcttctcgaagcaata

SEQ ID NO: 186415 - DNA, 75 bp, Artificial Sequence
  Synthetic
cgacgaggcgcttctcgaagcaataaagatcatcaaaatcctatacaaaagcagtaagtatcatatgtaatgaca

SEQ ID NO: 186416 - DNA, 75 bp, Artificial Sequence
  Synthetic
gctctttcaatataaccacagaagtaagagataagcagaagaaagaacatgcacttttctatagacttgatgtag

SEQ ID NO: 186417 - DNA, 75 bp, Artificial Sequence
  Synthetic
gtaatacctccaaccataaacaggcttgcccaaaggtgactttggagcccaattcccatacattattgtgccccg

SEQ ID NO: 186418 - DNA, 75 bp, Artificial Sequence
  Synthetic
gggggtaggacaagcaatgtatgcccctcccattgcaggaaacataacatgtagatcaaatatcacaggactact

SEQ ID NO: 186419 - DNA, 75 bp, Artificial Sequence
  Synthetic
aatttgtgggtcacagtctattatggggtacctgtgtggagagatgcagaaaccaccctattctgtgcatcagat

SEQ ID NO: 186420 - DNA, 75 bp, Artificial Sequence
  Synthetic
aggaagtgaacgtatcggtatagggccaggacacacatggtatgcaacaggtaacatagtaggagatataagaca

SEQ ID NO: 186421 - DNA, 75 bp, Artificial Sequence
  Synthetic
caatcctcaggaggggacctagagattacaacacatagctttaattgtggaggggaatttttctactgcaataca

SEQ ID NO: 186422 - DNA, 75 bp, Artificial Sequence
  Synthetic
atgaccacagtactaaaagataagaaagaaaaggtacatgctcttttttatagactagatatagtaccaattaat

SEQ ID NO: 186423 - DNA, 75 bp, Artificial Sequence
  Synthetic
ttacaacacatagctttaattgtggaggggaatttttctactgcaatacatcaggactgtttaatagtacataca

SEQ ID NO: 186424 - DNA, 75 bp, Artificial Sequence
  Synthetic
aggacaagcaatgtacgcccctcccattgcagggagcattaactgcagctcagatattacaggaataatattgac

SEQ ID NO: 186425 - DNA, 75 bp, Artificial Sequence
  Synthetic
tctagtaaaattatggtaccaattagaaaaagaccccataataggagcagaaactttctatgtagatggggcagc

SEQ ID NO: 186426 - DNA, 75 bp, Artificial Sequence
  Synthetic
caactgtaccagacccaacaacaatacaaggaaaagtatacgtataggaccaggacaatcattctatgcaacagg

SEQ ID NO: 186427 - DNA, 75 bp, Artificial Sequence
  Synthetic
aaaaaattcggttaaggccaggggggaagaaaaaatatagattaaagcatctagtatgggcaagcagggagctgg

SEQ ID NO: 186428 - DNA, 75 bp, Artificial Sequence
  Synthetic
acaaggaaaagtatacgtataggaccaggacaatcattctatgcaacaggtgaagtaataggaaacataaggcaa

SEQ ID NO: 186429 - DNA, 75 bp, Artificial Sequence
  Synthetic
caaataatggaacagttacaatcagctctcaggacagggacagaagaacttagatcattatataatacagtagca

SEQ ID NO: 186430 - DNA, 75 bp, Artificial Sequence
  Synthetic
agacttcatattgattgcagcgagagcagtggaacttctgggacgcagcagtctcaggggactacagagggggtg

SEQ ID NO: 186431 - DNA, 75 bp, Artificial Sequence
  Synthetic
atagtagcattagtagtagcaacaataatagcaatagttgtgtggaccatagtactcatagaatatagaaaaata

SEQ ID NO: 186432 - DNA, 75 bp, Artificial Sequence
  Synthetic
taaaaaagagtgctattagtctgcttgatactatagcaatagtagtagctgaaggaacagataggatcatagaag

SEQ ID NO: 186433 - DNA, 75 bp, Artificial Sequence
  Synthetic
tggaactctagttggaataataaatcttataatgatatatggggcaatatgacctggctgcaatgggataaagaa

SEQ ID NO: 186434 - DNA, 75 bp, Artificial Sequence
  Synthetic
ggcgcggcgtcaataacgctgacggtacaggccaggcaattattgtctggcatagtgcaacagcaaagcaatttg

SEQ ID NO: 186435 - DNA, 75 bp, Artificial Sequence
  Synthetic
gggacccagagattgtaatgcacagttttaattgtggaggggaatttttctactgtaatacatcaaaactgttta

SEQ ID NO: 186436 - DNA, 75 bp, Artificial Sequence
  Synthetic
aataccactgaaaatagttgggaaaagatggagccaggagaaataaaaaattgctctttcaatttcaccacaagc

SEQ ID NO: 186437 - DNA, 75 bp, Artificial Sequence
  Synthetic
tcattgccaagtttgcttcataacaaaaggcttaggcatctcctatggcaggaagaagcggagacagcgacgaag

SEQ ID NO: 186438 - DNA, 75 bp, Artificial Sequence
  Synthetic
aggaccatcaaaatcctgtaccaaagcagtaagtagtaataattagtatatgtgatgcaacctttagaaatagct

SEQ ID NO: 186439 - DNA, 75 bp, Artificial Sequence
  Synthetic
gaagaattgctctttcaatatcaccacaaacataagagataaggtaacaaaagaatatgcacttttctataagct

SEQ ID NO: 186440 - DNA, 75 bp, Artificial Sequence
  Synthetic
tagcaatagtagcattagtagtagcaacaataatagcaatagttgtgtggaccatagtattcatagaatatagga

SEQ ID NO: 186441 - DNA, 75 bp, Artificial Sequence
  Synthetic
tgctaaccaaactagtaacaatagcagcactattgatatgaagggagaaataaaaaactgttctttcaatatgac

SEQ ID NO: 186442 - DNA, 75 bp, Artificial Sequence
  Synthetic
taagaatagtttttgctgtgctttctatagtaaatagagttaggcagggatactcacctttatcgtttcagaccc

SEQ ID NO: 186443 - DNA, 75 bp, Artificial Sequence
  Synthetic
ccagcagcagaaggagtgggagcagtgtctaaagatttagagaaacatggggcaatcacaagcagtaatacatca

SEQ ID NO: 186444 - DNA, 75 bp, Artificial Sequence
  Synthetic
ataataatagtaccaataataatagtagtgaggaaagggaaatgaagaagtgctctttcaatgtcaccacagtca

SEQ ID NO: 186445 - DNA, 75 bp, Artificial Sequence
  Synthetic
atataaaaaactgctctttcaatatcaccccaacagtgagagataaaatgaagaaagaatatgcattttttaata

SEQ ID NO: 186446 - DNA, 75 bp, Artificial Sequence
  Synthetic
gagagaaaaaagagcagtgggaatgctaggagctatgttccttgggttcttgggaacagcaggaagcactatggg

SEQ ID NO: 186447 - DNA, 75 bp, Artificial Sequence
  Synthetic
actgataaggaagaaataaaaaactgctctttcaatataaccacaggcataggaaaacaggtgaggagggaatat

SEQ ID NO: 186448 - DNA, 75 bp, Artificial Sequence
  Synthetic
gtggcgcccgaacagggacttgaaagcgaaagtaaaagggactcgaaagcggaagttccagagaaggttctctcg

SEQ ID NO: 186449 - DNA, 75 bp, Artificial Sequence
  Synthetic
agacatcctttgaaccaattcccatacatttttgtgccccggctggttttgcgattctaaagtgtaatgataaga

SEQ ID NO: 186450 - DNA, 75 bp, Artificial Sequence
  Synthetic
taaaacaataatctttaatcaatcctcaggaggggacccagaaattgtaatgcacagttttaattgtagagggga

SEQ ID NO: 186451 - DNA, 75 bp, Artificial Sequence
  Synthetic
tactaaggcaaagaaaaatagacaggttaattgaaagaataagagaaagaacagaagacagtggaaatgagagtg

SEQ ID NO: 186452 - DNA, 75 bp, Artificial Sequence
  Synthetic
atacaagaaaaagcatacatctcgggccaggacaaacattctatgcaacaggtgacataataggggatataagac

SEQ ID NO: 186453 - DNA, 75 bp, Artificial Sequence
  Synthetic
gaaattacaacacatagctttaattgtaaaggagaatttttctattgcaatacatcaagactgtttaatagagca

SEQ ID NO: 186454 - DNA, 75 bp, Artificial Sequence
  Synthetic
atatgtggcaggaggtaggacgagccatgtatgcccctcccgttaaaggaataataacatgtagatcaaatatca

SEQ ID NO: 186455 - DNA, 75 bp, Artificial Sequence
  Synthetic
ctattaaaattagagaataaaacaacaataatctttaatcaatcctcaggaggggacccagaagttgtaaggcac

SEQ ID NO: 186456 - DNA, 75 bp, Artificial Sequence
  Synthetic
cataactctcccatgcagactaaggcaaattataaatatgtggcagagagtagagcgagcaatgtatgcccctcc

SEQ ID NO: 186457 - DNA, 75 bp, Artificial Sequence
  Synthetic
caaatttaagggccaaagaagaactattaagtgtttcaactgtggcaaggaaggacatctagccagaaattgcag

SEQ ID NO: 186458 - DNA, 75 bp, Artificial Sequence
  Synthetic
agaaagatacctaaaggatcaacagctcctaggaatttggggctgctctggaaaaatcatctgcaccactgctgt

SEQ ID NO: 186459 - DNA, 75 bp, Artificial Sequence
  Synthetic
tttctatagtaaatagagttaggaagggatactcaccattatcgttccagacccgcctcccagctcagaggggac

SEQ ID NO: 186460 - DNA, 75 bp, Artificial Sequence
  Synthetic
taacaaagtggctgtggtatataaaaatattcataatgatagtaggaggcttgataggtttaagaataatttttg

SEQ ID NO: 186461 - DNA, 75 bp, Artificial Sequence
  Synthetic
tcttgacacttatctgggtcgacctgaggagcctgttcctcttcagctaccaccgcttgagagacttactcttga

SEQ ID NO: 186462 - DNA, 75 bp, Artificial Sequence
  Synthetic
agacaagaacacgtttacatataggaccaggacgggcattccttagaacaagaggaataataggagatataagaa

SEQ ID NO: 186463 - DNA, 75 bp, Artificial Sequence
  Synthetic
aaattgacaattacacagacttaatatacaccttacttgaagaatcgcagaaccaacaagaaaagaatgaacaag

SEQ ID NO: 186464 - DNA, 75 bp, Artificial Sequence
  Synthetic
gggacgcagggggtgggagatcctcaagtattggtggaatctcctgcagtattggagtcaggaactaaagaatag

SEQ ID NO: 186465 - DNA, 75 bp, Artificial Sequence
  Synthetic
ctcaggtatctttaagaccaatgacttccagggcagctagggatcttagctactttttaaaagaaaaggggggac

SEQ ID NO: 186466 - DNA, 75 bp, Artificial Sequence
  Synthetic
cagtctcaagggactgagacaagggtgggaagccctcaaacatctgtggagtctcctatcctactggggtcagga

SEQ ID NO: 186467 - DNA, 75 bp, Artificial Sequence
  Synthetic
cagtctcaagggactgagactagggtgggaagccctcaaacatctgtggagtctcctatcctactggggtcagga

SEQ ID NO: 186468 - DNA, 75 bp, Artificial Sequence
  Synthetic
cagtctcaagggactgagaccagggtgggaagccctcaaacatctgtggagtctcctatcctactggggtcagga

SEQ ID NO: 186469 - DNA, 75 bp, Artificial Sequence
  Synthetic
cagtctcaagggactgagacgagggtgggaagccctcaaacatctgtggagtctcctatcctactggggtcagga

SEQ ID NO: 186470 - DNA, 75 bp, Artificial Sequence
  Synthetic
aagcagcaacacacctgccactaatgctgcttgtgcctggctggaagcacaacaggaggaagatgaggaggttcc

SEQ ID NO: 186471 - DNA, 75 bp, Artificial Sequence
  Synthetic
ataacatgggtggcaagtggtcaaaatgcatagtgggatggcctcaagttagggaaagaatgagacaaactactc

SEQ ID NO: 186472 - DNA, 75 bp, Artificial Sequence
  Synthetic
tgagccagcagcagatggggtgggagcagtatctcgagacctggaaagacatggagcaatcacaagtagcaatac

SEQ ID NO: 186473 - DNA, 75 bp, Artificial Sequence
  Synthetic
cagagaacagggagattctaaaagaaccagtacatggggcatattatgacccatcaaaagacttaatagcagaaa

SEQ ID NO: 186474 - DNA, 75 bp, Artificial Sequence
  Synthetic
ctggctggaagcacaggaggacgaagaggtaggctttccagtcagaccacaggtacctttaagaccaatgactta

SEQ ID NO: 186475 - DNA, 75 bp, Artificial Sequence
  Synthetic
agaagaagtataaggataggaccaggacaagcattctatgcaacaggtgacataataggagacataagacaagca

SEQ ID NO: 186476 - DNA, 75 bp, Artificial Sequence
  Synthetic
gcatagtaatatggggaaagactcctaagtttagattacccatacaaaaggaaacatgggacacatggtggacag

SEQ ID NO: 186477 - DNA, 75 bp, Artificial Sequence
  Synthetic
aaacaggagaaagagattggcatttaggtcatggagtctccatagagtggagactgagaagatatagcacacaag

SEQ ID NO: 186478 - DNA, 75 bp, Artificial Sequence
  Synthetic
aggtcagccaaaattaccctatagtgcagaaccttcaggggcaaatggtacatcaggccatatcacctagaactt

SEQ ID NO: 186479 - DNA, 75 bp, Artificial Sequence
  Synthetic
aagcaggagtaaggatgcagaaaagtaacgttaagggcccaagaagaaatgttaaaagttttaaatgtggcaaag

SEQ ID NO: 186480 - DNA, 75 bp, Artificial Sequence
  Synthetic
aagcaggagtaaggatgcagaaaagtaacgttaagggcccaagaagaaatgttaaaagttttaattgtggcaaag

SEQ ID NO: 186481 - DNA, 75 bp, Artificial Sequence
  Synthetic
aagcaggagtaaggatgcagaaaagtaacgttaagggcccaagaagaaatgttaaaagttttaactgtggcaaag

SEQ ID NO: 186482 - DNA, 75 bp, Artificial Sequence
  Synthetic
aagcaggagtaaggatgcagaaaagtaacgttaagggcccaagaagaaatgttaaaagttttaagtgtggcaaag

SEQ ID NO: 186483 - DNA, 75 bp, Artificial Sequence
  Synthetic
aagcaggagtaaggatgcagaaaagtaacgttaagggcccaagaagaaatgttaaatgttttaaatgtggcaaag

SEQ ID NO: 186484 - DNA, 75 bp, Artificial Sequence
  Synthetic
aagcaggagtaaggatgcagaaaagtaacgttaagggcccaagaagaaatgttaaatgttttaattgtggcaaag

SEQ ID NO: 186485 - DNA, 75 bp, Artificial Sequence
  Synthetic
aagcaggagtaaggatgcagaaaagtaacgttaagggcccaagaagaaatgttaaatgttttaactgtggcaaag

SEQ ID NO: 186486 - DNA, 75 bp, Artificial Sequence
  Synthetic
aagcaggagtaaggatgcagaaaagtaacgttaagggcccaagaagaaatgttaaatgttttaagtgtggcaaag

SEQ ID NO: 186487 - DNA, 75 bp, Artificial Sequence
  Synthetic
aagcaggagtaaggatgcagaaaagtaacgttaagggcccaagaagaaatgttaaacgttttaaatgtggcaaag

SEQ ID NO: 186488 - DNA, 75 bp, Artificial Sequence
  Synthetic
aagcaggagtaaggatgcagaaaagtaacgttaagggcccaagaagaaatgttaaacgttttaattgtggcaaag

SEQ ID NO: 186489 - DNA, 75 bp, Artificial Sequence
  Synthetic
aagcaggagtaaggatgcagaaaagtaacgttaagggcccaagaagaaatgttaaacgttttaactgtggcaaag

SEQ ID NO: 186490 - DNA, 75 bp, Artificial Sequence
  Synthetic
aagcaggagtaaggatgcagaaaagtaacgttaagggcccaagaagaaatgttaaacgttttaagtgtggcaaag

SEQ ID NO: 186491 - DNA, 75 bp, Artificial Sequence
  Synthetic
aagcaggagtaaggatgcagaaaagtaacgttaagggcccaagaagaaatgttaaaggttttaaatgtggcaaag

SEQ ID NO: 186492 - DNA, 75 bp, Artificial Sequence
  Synthetic
aagcaggagtaaggatgcagaaaagtaacgttaagggcccaagaagaaatgttaaaggttttaattgtggcaaag

SEQ ID NO: 186493 - DNA, 75 bp, Artificial Sequence
  Synthetic
aagcaggagtaaggatgcagaaaagtaacgttaagggcccaagaagaaatgttaaaggttttaactgtggcaaag

SEQ ID NO: 186494 - DNA, 75 bp, Artificial Sequence
  Synthetic
aagcaggagtaaggatgcagaaaagtaacgttaagggcccaagaagaaatgttaaaggttttaagtgtggcaaag

SEQ ID NO: 186495 - DNA, 75 bp, Artificial Sequence
  Synthetic
aagcaggtgtaaggatgcagaaaagtaacgttaagggcccaagaagaaatgttaaaagttttaaatgtggcaaag

SEQ ID NO: 186496 - DNA, 75 bp, Artificial Sequence
  Synthetic
aagcaggtgtaaggatgcagaaaagtaacgttaagggcccaagaagaaatgttaaaagttttaattgtggcaaag

SEQ ID NO: 186497 - DNA, 75 bp, Artificial Sequence
  Synthetic
aagcaggtgtaaggatgcagaaaagtaacgttaagggcccaagaagaaatgttaaaagttttaactgtggcaaag

SEQ ID NO: 186498 - DNA, 75 bp, Artificial Sequence
  Synthetic
aagcaggtgtaaggatgcagaaaagtaacgttaagggcccaagaagaaatgttaaaagttttaagtgtggcaaag

SEQ ID NO: 186499 - DNA, 75 bp, Artificial Sequence
  Synthetic
aagcaggtgtaaggatgcagaaaagtaacgttaagggcccaagaagaaatgttaaatgttttaaatgtggcaaag

SEQ ID NO: 186500 - DNA, 75 bp, Artificial Sequence
  Synthetic
aagcaggtgtaaggatgcagaaaagtaacgttaagggcccaagaagaaatgttaaatgttttaattgtggcaaag

SEQ ID NO: 186501 - DNA, 75 bp, Artificial Sequence
  Synthetic
aagcaggtgtaaggatgcagaaaagtaacgttaagggcccaagaagaaatgttaaatgttttaactgtggcaaag

SEQ ID NO: 186502 - DNA, 75 bp, Artificial Sequence
  Synthetic
aagcaggtgtaaggatgcagaaaagtaacgttaagggcccaagaagaaatgttaaatgttttaagtgtggcaaag

SEQ ID NO: 186503 - DNA, 75 bp, Artificial Sequence
  Synthetic
aagcaggtgtaaggatgcagaaaagtaacgttaagggcccaagaagaaatgttaaacgttttaaatgtggcaaag

SEQ ID NO: 186504 - DNA, 75 bp, Artificial Sequence
  Synthetic
aagcaggtgtaaggatgcagaaaagtaacgttaagggcccaagaagaaatgttaaacgttttaattgtggcaaag

SEQ ID NO: 186505 - DNA, 75 bp, Artificial Sequence
  Synthetic
aagcaggtgtaaggatgcagaaaagtaacgttaagggcccaagaagaaatgttaaacgttttaactgtggcaaag

SEQ ID NO: 186506 - DNA, 75 bp, Artificial Sequence
  Synthetic
aagcaggtgtaaggatgcagaaaagtaacgttaagggcccaagaagaaatgttaaacgttttaagtgtggcaaag

SEQ ID NO: 186507 - DNA, 75 bp, Artificial Sequence
  Synthetic
aagcaggtgtaaggatgcagaaaagtaacgttaagggcccaagaagaaatgttaaaggttttaaatgtggcaaag

SEQ ID NO: 186508 - DNA, 75 bp, Artificial Sequence
  Synthetic
aagcaggtgtaaggatgcagaaaagtaacgttaagggcccaagaagaaatgttaaaggttttaattgtggcaaag

SEQ ID NO: 186509 - DNA, 75 bp, Artificial Sequence
  Synthetic
aagcaggtgtaaggatgcagaaaagtaacgttaagggcccaagaagaaatgttaaaggttttaactgtggcaaag

SEQ ID NO: 186510 - DNA, 75 bp, Artificial Sequence
  Synthetic
aagcaggtgtaaggatgcagaaaagtaacgttaagggcccaagaagaaatgttaaaggttttaagtgtggcaaag

SEQ ID NO: 186511 - DNA, 75 bp, Artificial Sequence
  Synthetic
aagcaggcgtaaggatgcagaaaagtaacgttaagggcccaagaagaaatgttaaaagttttaaatgtggcaaag

SEQ ID NO: 186512 - DNA, 75 bp, Artificial Sequence
  Synthetic
aagcaggcgtaaggatgcagaaaagtaacgttaagggcccaagaagaaatgttaaaagttttaattgtggcaaag

SEQ ID NO: 186513 - DNA, 75 bp, Artificial Sequence
  Synthetic
aagcaggcgtaaggatgcagaaaagtaacgttaagggcccaagaagaaatgttaaaagttttaactgtggcaaag

SEQ ID NO: 186514 - DNA, 75 bp, Artificial Sequence
  Synthetic
aagcaggcgtaaggatgcagaaaagtaacgttaagggcccaagaagaaatgttaaaagttttaagtgtggcaaag

SEQ ID NO: 186515 - DNA, 75 bp, Artificial Sequence
  Synthetic
aagcaggcgtaaggatgcagaaaagtaacgttaagggcccaagaagaaatgttaaatgttttaaatgtggcaaag

SEQ ID NO: 186516 - DNA, 75 bp, Artificial Sequence
  Synthetic
aagcaggcgtaaggatgcagaaaagtaacgttaagggcccaagaagaaatgttaaatgttttaattgtggcaaag

SEQ ID NO: 186517 - DNA, 75 bp, Artificial Sequence
  Synthetic
aagcaggcgtaaggatgcagaaaagtaacgttaagggcccaagaagaaatgttaaatgttttaactgtggcaaag

SEQ ID NO: 186518 - DNA, 75 bp, Artificial Sequence
  Synthetic
aagcaggcgtaaggatgcagaaaagtaacgttaagggcccaagaagaaatgttaaatgttttaagtgtggcaaag

SEQ ID NO: 186519 - DNA, 75 bp, Artificial Sequence
  Synthetic
aagcaggcgtaaggatgcagaaaagtaacgttaagggcccaagaagaaatgttaaacgttttaaatgtggcaaag

SEQ ID NO: 186520 - DNA, 75 bp, Artificial Sequence
  Synthetic
aagcaggcgtaaggatgcagaaaagtaacgttaagggcccaagaagaaatgttaaacgttttaattgtggcaaag

SEQ ID NO: 186521 - DNA, 75 bp, Artificial Sequence
  Synthetic
aagcaggcgtaaggatgcagaaaagtaacgttaagggcccaagaagaaatgttaaacgttttaactgtggcaaag

SEQ ID NO: 186522 - DNA, 75 bp, Artificial Sequence
  Synthetic
aagcaggcgtaaggatgcagaaaagtaacgttaagggcccaagaagaaatgttaaacgttttaagtgtggcaaag

SEQ ID NO: 186523 - DNA, 75 bp, Artificial Sequence
  Synthetic
aagcaggcgtaaggatgcagaaaagtaacgttaagggcccaagaagaaatgttaaaggttttaaatgtggcaaag

SEQ ID NO: 186524 - DNA, 75 bp, Artificial Sequence
  Synthetic
aagcaggcgtaaggatgcagaaaagtaacgttaagggcccaagaagaaatgttaaaggttttaattgtggcaaag

SEQ ID NO: 186525 - DNA, 75 bp, Artificial Sequence
  Synthetic
aagcaggcgtaaggatgcagaaaagtaacgttaagggcccaagaagaaatgttaaaggttttaactgtggcaaag

SEQ ID NO: 186526 - DNA, 75 bp, Artificial Sequence
  Synthetic
aagcaggcgtaaggatgcagaaaagtaacgttaagggcccaagaagaaatgttaaaggttttaagtgtggcaaag

SEQ ID NO: 186527 - DNA, 75 bp, Artificial Sequence
  Synthetic
aagcaggggtaaggatgcagaaaagtaacgttaagggcccaagaagaaatgttaaaagttttaaatgtggcaaag

SEQ ID NO: 186528 - DNA, 75 bp, Artificial Sequence
  Synthetic
aagcaggggtaaggatgcagaaaagtaacgttaagggcccaagaagaaatgttaaaagttttaattgtggcaaag

SEQ ID NO: 186529 - DNA, 75 bp, Artificial Sequence
  Synthetic
aagcaggggtaaggatgcagaaaagtaacgttaagggcccaagaagaaatgttaaaagttttaactgtggcaaag

SEQ ID NO: 186530 - DNA, 75 bp, Artificial Sequence
  Synthetic
aagcaggggtaaggatgcagaaaagtaacgttaagggcccaagaagaaatgttaaaagttttaagtgtggcaaag

SEQ ID NO: 186531 - DNA, 75 bp, Artificial Sequence
  Synthetic
aagcaggggtaaggatgcagaaaagtaacgttaagggcccaagaagaaatgttaaatgttttaaatgtggcaaag

SEQ ID NO: 186532 - DNA, 75 bp, Artificial Sequence
  Synthetic
aagcaggggtaaggatgcagaaaagtaacgttaagggcccaagaagaaatgttaaatgttttaattgtggcaaag

SEQ ID NO: 186533 - DNA, 75 bp, Artificial Sequence
  Synthetic
aagcaggggtaaggatgcagaaaagtaacgttaagggcccaagaagaaatgttaaatgttttaactgtggcaaag

SEQ ID NO: 186534 - DNA, 75 bp, Artificial Sequence
  Synthetic
aagcaggggtaaggatgcagaaaagtaacgttaagggcccaagaagaaatgttaaatgttttaagtgtggcaaag

SEQ ID NO: 186535 - DNA, 75 bp, Artificial Sequence
  Synthetic
aagcaggggtaaggatgcagaaaagtaacgttaagggcccaagaagaaatgttaaacgttttaaatgtggcaaag

SEQ ID NO: 186536 - DNA, 75 bp, Artificial Sequence
  Synthetic
aagcaggggtaaggatgcagaaaagtaacgttaagggcccaagaagaaatgttaaacgttttaattgtggcaaag

SEQ ID NO: 186537 - DNA, 75 bp, Artificial Sequence
  Synthetic
aagcaggggtaaggatgcagaaaagtaacgttaagggcccaagaagaaatgttaaacgttttaactgtggcaaag

SEQ ID NO: 186538 - DNA, 75 bp, Artificial Sequence
  Synthetic
aagcaggggtaaggatgcagaaaagtaacgttaagggcccaagaagaaatgttaaacgttttaagtgtggcaaag

SEQ ID NO: 186539 - DNA, 75 bp, Artificial Sequence
  Synthetic
aagcaggggtaaggatgcagaaaagtaacgttaagggcccaagaagaaatgttaaaggttttaaatgtggcaaag

SEQ ID NO: 186540 - DNA, 75 bp, Artificial Sequence
  Synthetic
aagcaggggtaaggatgcagaaaagtaacgttaagggcccaagaagaaatgttaaaggttttaattgtggcaaag

SEQ ID NO: 186541 - DNA, 75 bp, Artificial Sequence
  Synthetic
aagcaggggtaaggatgcagaaaagtaacgttaagggcccaagaagaaatgttaaaggttttaactgtggcaaag

SEQ ID NO: 186542 - DNA, 75 bp, Artificial Sequence
  Synthetic
aagcaggggtaaggatgcagaaaagtaacgttaagggcccaagaagaaatgttaaaggttttaagtgtggcaaag

SEQ ID NO: 186543 - DNA, 75 bp, Artificial Sequence
  Synthetic
tgtggaattggtttgacatatcaaattggctgtggtatataaaaatatttataatgatagtaggaggcttgatag

SEQ ID NO: 186544 - DNA, 75 bp, Artificial Sequence
  Synthetic
ctgtctactatggggtacctgtgtggaaagatgcagagaccaccctattttgtgcatcagatgctaaagcatatg

SEQ ID NO: 186545 - DNA, 75 bp, Artificial Sequence
  Synthetic
cggagcctgtgcctcttcagctaccaccgattgagagacttcatattgattgtaacgagagcagtggaacttctg

SEQ ID NO: 186546 - DNA, 75 bp, Artificial Sequence
  Synthetic
gggaccaaagcctaaagccatgtgtaaaattaacccctctctgtgttactttaaactgtacccaggccaacctca

SEQ ID NO: 186547 - DNA, 75 bp, Artificial Sequence
  Synthetic
tggtcaaaaagcaatatatttggatggcctgctgtaagagaaagaatgagacgcactgagccagcagcagaggga

SEQ ID NO: 186548 - DNA, 75 bp, Artificial Sequence
  Synthetic
acgcactgagccagcagcagagggagtaggagcagcgtctcgagacttagagagacatggggcacttacaagcag

SEQ ID NO: 186549 - DNA, 75 bp, Artificial Sequence
  Synthetic
tgtgtaaagttgaccccactctgtgtcactttaaactgtacaaaggcaaattttacaaatgtaaattataccaat

SEQ ID NO: 186550 - DNA, 75 bp, Artificial Sequence
  Synthetic
cacatggaatcaagccagtagtatcaactcaactgctattaaatggcagtctagcaaaagaaggggtacaaatta

SEQ ID NO: 186551 - DNA, 75 bp, Artificial Sequence
  Synthetic
tatacgcataggcccaggacaagcattctatacaacaggtgaaatcataggggatataagacaagcacattgtaa

SEQ ID NO: 186552 - DNA, 75 bp, Artificial Sequence
  Synthetic
tggtagcctagcagaaggggagataataattagatctgaaaatctgacaaacaatgccaaaacaataatagtaca

SEQ ID NO: 186553 - DNA, 75 bp, Artificial Sequence
  Synthetic
tggacagtacagcctataatgctgccagaaaaagacagctggactgtcaatgatatacagaagttagtgggaaaa

SEQ ID NO: 186554 - DNA, 75 bp, Artificial Sequence
  Synthetic
aatagaccctgacctagcagaccaactaattcatctgcaatattttgactgtttttcagaatctgccataaggaa

SEQ ID NO: 186555 - DNA, 75 bp, Artificial Sequence
  Synthetic
tcaaggcagcaagggccatcaaaatcttataccaaagcagtaagtattaagtatatgtaatgttattctgggaaa

SEQ ID NO: 186556 - DNA, 75 bp, Artificial Sequence
  Synthetic
agacagcttgtacaatagaataagagaaagagcagaagacagtggcaatgagagtgatggggatgcagaggaatt

SEQ ID NO: 186557 - DNA, 75 bp, Artificial Sequence
  Synthetic
aagcagaactagaactggcagaaaacagggagattctaaaagaaccagtacatggggtgtattatgacccagcaa

SEQ ID NO: 186558 - DNA, 75 bp, Artificial Sequence
  Synthetic
gagcattaggaccaggagctacattagaagaaatgatgacagcatgtcagggagtgggaggacctagccacaaag

SEQ ID NO: 186559 - DNA, 75 bp, Artificial Sequence
  Synthetic
tctttcgatataaccacagaaataagggataagaagaagaaagaatatgcgcttttctatagaattgatatagtg

SEQ ID NO: 186560 - DNA, 75 bp, Artificial Sequence
  Synthetic
ggaattcttctattgtaatacaacacaactgtttaatagtacttagacgaatagtactgaacagacaaatagcac

SEQ ID NO: 186561 - DNA, 75 bp, Artificial Sequence
  Synthetic
ggaattcttctattgtaatacaacacaactgtttaatagtacttagacgaattgtactgaacagacaaatagcac

SEQ ID NO: 186562 - DNA, 75 bp, Artificial Sequence
  Synthetic
ggaattcttctattgtaatacaacacaactgtttaatagtacttagacgaatcgtactgaacagacaaatagcac

SEQ ID NO: 186563 - DNA, 75 bp, Artificial Sequence
  Synthetic
ggaattcttctattgtaatacaacacaactgtttaatagtacttagacgaatggtactgaacagacaaatagcac

SEQ ID NO: 186564 - DNA, 75 bp, Artificial Sequence
  Synthetic
ggaattcttctattgtaatacaacacaactgtttaatagtacttagtcgaatagtactgaacagacaaatagcac

SEQ ID NO: 186565 - DNA, 75 bp, Artificial Sequence
  Synthetic
ggaattcttctattgtaatacaacacaactgtttaatagtacttagtcgaattgtactgaacagacaaatagcac

SEQ ID NO: 186566 - DNA, 75 bp, Artificial Sequence
  Synthetic
ggaattcttctattgtaatacaacacaactgtttaatagtacttagtcgaatcgtactgaacagacaaatagcac

SEQ ID NO: 186567 - DNA, 75 bp, Artificial Sequence
  Synthetic
ggaattcttctattgtaatacaacacaactgtttaatagtacttagtcgaatggtactgaacagacaaatagcac

SEQ ID NO: 186568 - DNA, 75 bp, Artificial Sequence
  Synthetic
ggaattcttctattgtaatacaacacaactgtttaatagtacttagccgaatagtactgaacagacaaatagcac

SEQ ID NO: 186569 - DNA, 75 bp, Artificial Sequence
  Synthetic
ggaattcttctattgtaatacaacacaactgtttaatagtacttagccgaattgtactgaacagacaaatagcac

SEQ ID NO: 186570 - DNA, 75 bp, Artificial Sequence
  Synthetic
ggaattcttctattgtaatacaacacaactgtttaatagtacttagccgaatcgtactgaacagacaaatagcac

SEQ ID NO: 186571 - DNA, 75 bp, Artificial Sequence
  Synthetic
ggaattcttctattgtaatacaacacaactgtttaatagtacttagccgaatggtactgaacagacaaatagcac

SEQ ID NO: 186572 - DNA, 75 bp, Artificial Sequence
  Synthetic
ggaattcttctattgtaatacaacacaactgtttaatagtacttaggcgaatagtactgaacagacaaatagcac

SEQ ID NO: 186573 - DNA, 75 bp, Artificial Sequence
  Synthetic
ggaattcttctattgtaatacaacacaactgtttaatagtacttaggcgaattgtactgaacagacaaatagcac

SEQ ID NO: 186574 - DNA, 75 bp, Artificial Sequence
  Synthetic
ggaattcttctattgtaatacaacacaactgtttaatagtacttaggcgaatcgtactgaacagacaaatagcac

SEQ ID NO: 186575 - DNA, 75 bp, Artificial Sequence
  Synthetic
ggaattcttctattgtaatacaacacaactgtttaatagtacttaggcgaatggtactgaacagacaaatagcac

SEQ ID NO: 186576 - DNA, 75 bp, Artificial Sequence
  Synthetic
ggaattcttctattgtaatacaacacaactgtttaatagtactttgacgaatagtactgaacagacaaatagcac

SEQ ID NO: 186577 - DNA, 75 bp, Artificial Sequence
  Synthetic
ggaattcttctattgtaatacaacacaactgtttaatagtactttgacgaattgtactgaacagacaaatagcac

SEQ ID NO: 186578 - DNA, 75 bp, Artificial Sequence
  Synthetic
ggaattcttctattgtaatacaacacaactgtttaatagtactttgacgaatcgtactgaacagacaaatagcac

SEQ ID NO: 186579 - DNA, 75 bp, Artificial Sequence
  Synthetic
ggaattcttctattgtaatacaacacaactgtttaatagtactttgacgaatggtactgaacagacaaatagcac

SEQ ID NO: 186580 - DNA, 75 bp, Artificial Sequence
  Synthetic
ggaattcttctattgtaatacaacacaactgtttaatagtactttgtcgaatagtactgaacagacaaatagcac

SEQ ID NO: 186581 - DNA, 75 bp, Artificial Sequence
  Synthetic
ggaattcttctattgtaatacaacacaactgtttaatagtactttgtcgaattgtactgaacagacaaatagcac

SEQ ID NO: 186582 - DNA, 75 bp, Artificial Sequence
  Synthetic
ggaattcttctattgtaatacaacacaactgtttaatagtactttgtcgaatcgtactgaacagacaaatagcac

SEQ ID NO: 186583 - DNA, 75 bp, Artificial Sequence
  Synthetic
ggaattcttctattgtaatacaacacaactgtttaatagtactttgtcgaatggtactgaacagacaaatagcac

SEQ ID NO: 186584 - DNA, 75 bp, Artificial Sequence
  Synthetic
ggaattcttctattgtaatacaacacaactgtttaatagtactttgccgaatagtactgaacagacaaatagcac

SEQ ID NO: 186585 - DNA, 75 bp, Artificial Sequence
  Synthetic
ggaattcttctattgtaatacaacacaactgtttaatagtactttgccgaattgtactgaacagacaaatagcac

SEQ ID NO: 186586 - DNA, 75 bp, Artificial Sequence
  Synthetic
ggaattcttctattgtaatacaacacaactgtttaatagtactttgccgaatcgtactgaacagacaaatagcac

SEQ ID NO: 186587 - DNA, 75 bp, Artificial Sequence
  Synthetic
ggaattcttctattgtaatacaacacaactgtttaatagtactttgccgaatggtactgaacagacaaatagcac

SEQ ID NO: 186588 - DNA, 75 bp, Artificial Sequence
  Synthetic
ggaattcttctattgtaatacaacacaactgtttaatagtactttggcgaatagtactgaacagacaaatagcac

SEQ ID NO: 186589 - DNA, 75 bp, Artificial Sequence
  Synthetic
ggaattcttctattgtaatacaacacaactgtttaatagtactttggcgaattgtactgaacagacaaatagcac

SEQ ID NO: 186590 - DNA, 75 bp, Artificial Sequence
  Synthetic
ggaattcttctattgtaatacaacacaactgtttaatagtactttggcgaatcgtactgaacagacaaatagcac

SEQ ID NO: 186591 - DNA, 75 bp, Artificial Sequence
  Synthetic
ggaattcttctattgtaatacaacacaactgtttaatagtactttggcgaatggtactgaacagacaaatagcac

SEQ ID NO: 186592 - DNA, 75 bp, Artificial Sequence
  Synthetic
ggaattcttctattgtaatacaacacaactgtttaatagtacttcgacgaatagtactgaacagacaaatagcac

SEQ ID NO: 186593 - DNA, 75 bp, Artificial Sequence
  Synthetic
ggaattcttctattgtaatacaacacaactgtttaatagtacttcgacgaattgtactgaacagacaaatagcac

SEQ ID NO: 186594 - DNA, 75 bp, Artificial Sequence
  Synthetic
ggaattcttctattgtaatacaacacaactgtttaatagtacttcgacgaatcgtactgaacagacaaatagcac

SEQ ID NO: 186595 - DNA, 75 bp, Artificial Sequence
  Synthetic
ggaattcttctattgtaatacaacacaactgtttaatagtacttcgacgaatggtactgaacagacaaatagcac

SEQ ID NO: 186596 - DNA, 75 bp, Artificial Sequence
  Synthetic
ggaattcttctattgtaatacaacacaactgtttaatagtacttcgtcgaatagtactgaacagacaaatagcac

SEQ ID NO: 186597 - DNA, 75 bp, Artificial Sequence
  Synthetic
ggaattcttctattgtaatacaacacaactgtttaatagtacttcgtcgaattgtactgaacagacaaatagcac

SEQ ID NO: 186598 - DNA, 75 bp, Artificial Sequence
  Synthetic
ggaattcttctattgtaatacaacacaactgtttaatagtacttcgtcgaatcgtactgaacagacaaatagcac

SEQ ID NO: 186599 - DNA, 75 bp, Artificial Sequence
  Synthetic
ggaattcttctattgtaatacaacacaactgtttaatagtacttcgtcgaatggtactgaacagacaaatagcac

SEQ ID NO: 186600 - DNA, 75 bp, Artificial Sequence
  Synthetic
ggaattcttctattgtaatacaacacaactgtttaatagtacttcgccgaatagtactgaacagacaaatagcac

SEQ ID NO: 186601 - DNA, 75 bp, Artificial Sequence
  Synthetic
ggaattcttctattgtaatacaacacaactgtttaatagtacttcgccgaattgtactgaacagacaaatagcac

SEQ ID NO: 186602 - DNA, 75 bp, Artificial Sequence
  Synthetic
ggaattcttctattgtaatacaacacaactgtttaatagtacttcgccgaatcgtactgaacagacaaatagcac

SEQ ID NO: 186603 - DNA, 75 bp, Artificial Sequence
  Synthetic
ggaattcttctattgtaatacaacacaactgtttaatagtacttcgccgaatggtactgaacagacaaatagcac

SEQ ID NO: 186604 - DNA, 75 bp, Artificial Sequence
  Synthetic
ggaattcttctattgtaatacaacacaactgtttaatagtacttcggcgaatagtactgaacagacaaatagcac

SEQ ID NO: 186605 - DNA, 75 bp, Artificial Sequence
  Synthetic
ggaattcttctattgtaatacaacacaactgtttaatagtacttcggcgaattgtactgaacagacaaatagcac

SEQ ID NO: 186606 - DNA, 75 bp, Artificial Sequence
  Synthetic
ggaattcttctattgtaatacaacacaactgtttaatagtacttcggcgaatcgtactgaacagacaaatagcac

SEQ ID NO: 186607 - DNA, 75 bp, Artificial Sequence
  Synthetic
ggaattcttctattgtaatacaacacaactgtttaatagtacttcggcgaatggtactgaacagacaaatagcac

SEQ ID NO: 186608 - DNA, 75 bp, Artificial Sequence
  Synthetic
ggaattcttctattgtaatacaacacaactgtttaatagtacttggacgaatagtactgaacagacaaatagcac

SEQ ID NO: 186609 - DNA, 75 bp, Artificial Sequence
  Synthetic
ggaattcttctattgtaatacaacacaactgtttaatagtacttggacgaattgtactgaacagacaaatagcac

SEQ ID NO: 186610 - DNA, 75 bp, Artificial Sequence
  Synthetic
ggaattcttctattgtaatacaacacaactgtttaatagtacttggacgaatcgtactgaacagacaaatagcac

SEQ ID NO: 186611 - DNA, 75 bp, Artificial Sequence
  Synthetic
ggaattcttctattgtaatacaacacaactgtttaatagtacttggacgaatggtactgaacagacaaatagcac

SEQ ID NO: 186612 - DNA, 75 bp, Artificial Sequence
  Synthetic
ggaattcttctattgtaatacaacacaactgtttaatagtacttggtcgaatagtactgaacagacaaatagcac

SEQ ID NO: 186613 - DNA, 75 bp, Artificial Sequence
  Synthetic
ggaattcttctattgtaatacaacacaactgtttaatagtacttggtcgaattgtactgaacagacaaatagcac

SEQ ID NO: 186614 - DNA, 75 bp, Artificial Sequence
  Synthetic
ggaattcttctattgtaatacaacacaactgtttaatagtacttggtcgaatcgtactgaacagacaaatagcac

SEQ ID NO: 186615 - DNA, 75 bp, Artificial Sequence
  Synthetic
ggaattcttctattgtaatacaacacaactgtttaatagtacttggtcgaatggtactgaacagacaaatagcac

SEQ ID NO: 186616 - DNA, 75 bp, Artificial Sequence
  Synthetic
ggaattcttctattgtaatacaacacaactgtttaatagtacttggccgaatagtactgaacagacaaatagcac

SEQ ID NO: 186617 - DNA, 75 bp, Artificial Sequence
  Synthetic
ggaattcttctattgtaatacaacacaactgtttaatagtacttggccgaattgtactgaacagacaaatagcac

SEQ ID NO: 186618 - DNA, 75 bp, Artificial Sequence
  Synthetic
ggaattcttctattgtaatacaacacaactgtttaatagtacttggccgaatcgtactgaacagacaaatagcac

SEQ ID NO: 186619 - DNA, 75 bp, Artificial Sequence
  Synthetic
ggaattcttctattgtaatacaacacaactgtttaatagtacttggccgaatggtactgaacagacaaatagcac

SEQ ID NO: 186620 - DNA, 75 bp, Artificial Sequence
  Synthetic
ggaattcttctattgtaatacaacacaactgtttaatagtacttgggcgaatagtactgaacagacaaatagcac

SEQ ID NO: 186621 - DNA, 75 bp, Artificial Sequence
  Synthetic
ggaattcttctattgtaatacaacacaactgtttaatagtacttgggcgaattgtactgaacagacaaatagcac

SEQ ID NO: 186622 - DNA, 75 bp, Artificial Sequence
  Synthetic
ggaattcttctattgtaatacaacacaactgtttaatagtacttgggcgaatcgtactgaacagacaaatagcac

SEQ ID NO: 186623 - DNA, 75 bp, Artificial Sequence
  Synthetic
ggaattcttctattgtaatacaacacaactgtttaatagtacttgggcgaatggtactgaacagacaaatagcac

SEQ ID NO: 186624 - DNA, 75 bp, Artificial Sequence
  Synthetic
tgcactcatggaattaagccagtggtatcaactcaattgctgttaaatggaagcttagcaacggaagaggtagta

SEQ ID NO: 186625 - DNA, 75 bp, Artificial Sequence
  Synthetic
caacaataacagtagcaacagcagtgaaacaacagcagaggacatgggaagagaaataaaaaactgctcttttaa

SEQ ID NO: 186626 - DNA, 75 bp, Artificial Sequence
  Synthetic
accagacctggcaacaatacaagaaaaagtgtacatatagggccaggactaacatggtatgcaacaggtgaaata

SEQ ID NO: 186627 - DNA, 75 bp, Artificial Sequence
  Synthetic
gcagtagtaatacaagataatagtgacataaaagtagtgccaagaagaaaagcaaagatcattagggattatgga

SEQ ID NO: 186628 - DNA, 75 bp, Artificial Sequence
  Synthetic
taagacaaactcctccagcagcaacaggagtaggagcagtatctcaagatttagaaagacatggagcaatcacaa

SEQ ID NO: 186629 - DNA, 75 bp, Artificial Sequence
  Synthetic
atagtacagctgaacgaatctgtagtaattaattgtacaagacccaacaacaatacaagaaaaggtatacatata

SEQ ID NO: 186630 - DNA, 75 bp, Artificial Sequence
  Synthetic
catagctttaattgtaaaggagaatttttctattgcaatacaacaccactgtttaatagtacacacatgcaaaat

SEQ ID NO: 186631 - DNA, 75 bp, Artificial Sequence
  Synthetic
ataacaacacaagaaaaagtatacgtattggaccagggcaatcattctatgcaacaggtgacataataggagaca

SEQ ID NO: 186632 - DNA, 75 bp, Artificial Sequence
  Synthetic
tttaagcaatcctcaggaggggacccagaaattgtaatgcacagttttaattgtggaggggaatttttctactgt

SEQ ID NO: 186633 - DNA, 75 bp, Artificial Sequence
  Synthetic
ctttaatcaatcctcaggaggggacctagaaattacaatgcatagtttcaattgtagaggagaatttttctattg

SEQ ID NO: 186634 - DNA, 75 bp, Artificial Sequence
  Synthetic
ggatagatgtaaaagacaccaaggaagctttagataaaatagaggaaatacaaaataagagcaagcaaaagacac

SEQ ID NO: 186635 - DNA, 75 bp, Artificial Sequence
  Synthetic
cataacactcccatgcaggataaaacaaattgtaaacatgtggcagggagtaggacaagcaatgtatgcccctcc

SEQ ID NO: 186636 - DNA, 75 bp, Artificial Sequence
  Synthetic
actgatttagggaatgttactaataccactaatagtaacggggaaatgatggagaaaggagaagtaaaaaactgt

SEQ ID NO: 186637 - DNA, 75 bp, Artificial Sequence
  Synthetic
gatccgatagatcctaatctagagccctggaatcatccggggagtcagcctaaaactgcttgtaacaaatgctat

SEQ ID NO: 186638 - DNA, 75 bp, Artificial Sequence
  Synthetic
agctttagataaaatagaggaaatacaaaataagagcaagcaaaagacacagcaggcagccgcagcccaggcagc

SEQ ID NO: 186639 - DNA, 75 bp, Artificial Sequence
  Synthetic
acccatgttctcagcattatcagagggagccaccccacaagatttaaatatgatgctgaacatagtggggggaca

SEQ ID NO: 186640 - DNA, 75 bp, Artificial Sequence
  Synthetic
ggaccagggaaagcattttatgcaagaggagacataacaggagacataagaaaagcatattgtgaaattaatgga

SEQ ID NO: 186641 - DNA, 75 bp, Artificial Sequence
  Synthetic
ttcttgccacttatctgggacgacctgcggaacctgtgcctcttcagctaccgccacttgagaaacttactctta

SEQ ID NO: 186642 - DNA, 75 bp, Artificial Sequence
  Synthetic
cagaggagatctctcgacgcaggactcggcttgctgaagcgcgcacagcaagaggcgaggggacggcgactggtg

SEQ ID NO: 186643 - DNA, 75 bp, Artificial Sequence
  Synthetic
cagaggagatctctcgacgcaggactcggcttgctgaagcgcgcacagcaagaggcgaggggtcggcgactggtg

SEQ ID NO: 186644 - DNA, 75 bp, Artificial Sequence
  Synthetic
cagaggagatctctcgacgcaggactcggcttgctgaagcgcgcacagcaagaggcgaggggccggcgactggtg

SEQ ID NO: 186645 - DNA, 75 bp, Artificial Sequence
  Synthetic
cagaggagatctctcgacgcaggactcggcttgctgaagcgcgcacagcaagaggcgagggggcggcgactggtg

SEQ ID NO: 186646 - DNA, 75 bp, Artificial Sequence
  Synthetic
ccgccacttgagaaacttactcttaattgtagcgaggactgtggaacttctggggataagggggtgggaagccct

SEQ ID NO: 186647 - DNA, 75 bp, Artificial Sequence
  Synthetic
tattggggacaggagctaaagaatagtgctattaatttgtttaataccacagcaatagcagtagctgagggaaca

SEQ ID NO: 186648 - DNA, 75 bp, Artificial Sequence
  Synthetic
ccatgcaaaataaaacaaattataaacatgtggcagggagtaggaaaagcaatgtatgcccctcccatcgaagga

SEQ ID NO: 186649 - DNA, 75 bp, Artificial Sequence
  Synthetic
gaaagagctttgctttaaaatgggaggcaaatggtcaaaaagtagcatagttggatggcctgagataagggaaag

SEQ ID NO: 186650 - DNA, 75 bp, Artificial Sequence
  Synthetic
ggcaaatggtcaaaaagtagcatagttggatggcctgagataagggaaagaatgaggcgagctcgagctgagcca

SEQ ID NO: 186651 - DNA, 75 bp, Artificial Sequence
  Synthetic
cagaactagttactacaatagcagcactatggtgggagaaataaaaaactgttctttcaatacgaccacagaaat

SEQ ID NO: 186652 - DNA, 75 bp, Artificial Sequence
  Synthetic
atactaatagtactaatagtggttgggaaaagatggcagaagaaataagaaactgctctttcaatgtcaccacaa

SEQ ID NO: 186653 - DNA, 75 bp, Artificial Sequence
  Synthetic
cagctactaatcctgacaaaacctggctggaagcacaagaagaggaagaagaggtaggttttccagtcaggccac

SEQ ID NO: 186654 - DNA, 75 bp, Artificial Sequence
  Synthetic
gctggaagcacaagaagaggaagaagaggtaggttttccagtcaggccacaggtacctttaaggccaatgacctt

SEQ ID NO: 186655 - DNA, 75 bp, Artificial Sequence
  Synthetic
ggacccgaaaacgaaagtgagaccagagcagctctcttgacgcaggactcggcttgctgaagtgcacacagcaag

SEQ ID NO: 186656 - DNA, 75 bp, Artificial Sequence
  Synthetic
tacaaatagtacaaatagtacccccatagataaggacatgtatggagaaataaaaaattgctctttcaatacaac

SEQ ID NO: 186657 - DNA, 75 bp, Artificial Sequence
  Synthetic
taaagccatgtgtaacgttaactcctcttcccgttactgttatttgtagtagaagtattgttaattttagtagag

SEQ ID NO: 186658 - DNA, 75 bp, Artificial Sequence
  Synthetic
tgtgccttggaatactagttggagtaataaatctctggaacagatttgggataacatgacatggatggagtggga

SEQ ID NO: 186659 - DNA, 75 bp, Artificial Sequence
  Synthetic
caagtggtcaaaaagcagcatagtgggatggcctgaggtcagggaaagaatgagaagggctaggccagccaggga

SEQ ID NO: 186660 - DNA, 75 bp, Artificial Sequence
  Synthetic
tacggccagggggaaggaaaaaatatagactaaaacatttggtatgggcaagcagggagctagaacgatttgcac

SEQ ID NO: 186661 - DNA, 75 bp, Artificial Sequence
  Synthetic
caaatacagccagcccttcaaacagggtcagaagagcttaggtcactatttaatacagtagtaaccctctattgg

SEQ ID NO: 186662 - DNA, 75 bp, Artificial Sequence
  Synthetic
catctaggaccggggaggacagtatatgcaacaggaggcataataggaaatataagacaagcacattgtaacatt

SEQ ID NO: 186663 - DNA, 75 bp, Artificial Sequence
  Synthetic
cctgactgtgcctgggtagcagcacaagaggaggaagaggaggtaggcttcccagtcagaccacaagtgccttta

SEQ ID NO: 186664 - DNA, 75 bp, Artificial Sequence
  Synthetic
aatactaacatgactactattaataatgagacaaaggttggagaaataaaaaattgcactttcaatattaccaca

SEQ ID NO: 186665 - DNA, 75 bp, Artificial Sequence
  Synthetic
aagaggaggaagaggaggtaggcttcccagtcagaccacaagtgcctttaagaccaatgacctataaggcagcct

SEQ ID NO: 186666 - DNA, 75 bp, Artificial Sequence
  Synthetic
aggggacagatagggttatagaagtagtacaaagagcttgtagagctattctccacatacctagaagaataagac

SEQ ID NO: 186667 - DNA, 75 bp, Artificial Sequence
  Synthetic
ttgtgaggttaatggaacaacatggagtaaagttctaaaacaagtagctggaaaactaaaagagcactttaagaa

SEQ ID NO: 186668 - DNA, 75 bp, Artificial Sequence
  Synthetic
aattaagacaggaacagaagagcttaaatcattatataatgcagtagcagtcctctgctgtgtgcatcaaaaaat

SEQ ID NO: 186669 - DNA, 75 bp, Artificial Sequence
  Synthetic
aaatcattatataatgcagtagcagtcctctgctgtgtgcatcaaaaaataaatgtaaaagacaccaaggaagct

SEQ ID NO: 186670 - DNA, 75 bp, Artificial Sequence
  Synthetic
cacaagtatacatatgggaccagggcaagcatatcatgcaataggaagaataataggagatataagacaagcaca

SEQ ID NO: 186671 - DNA, 75 bp, Artificial Sequence
  Synthetic
gccataataggacacaaaattattcatgggtgtgattatcaagcaggacacactaataaggtaggatctctacag

SEQ ID NO: 186672 - DNA, 75 bp, Artificial Sequence
  Synthetic
aagcaatgtatgctcctcccatcagtggagtaattaattgtgtatcaaatattacaggaatactattgacaagag

SEQ ID NO: 186673 - DNA, 75 bp, Artificial Sequence
  Synthetic
tcagacctctaggaggaaatatgaaggataattggagaagtgaattatataaatacaaagtagtaaaagttgaac

SEQ ID NO: 186674 - DNA, 75 bp, Artificial Sequence
  Synthetic
gctgacggtacaggccagacaattattgtctggtatagtgcaacagcaaagcaatttgctgagggctatagaggc

SEQ ID NO: 186675 - DNA, 75 bp, Artificial Sequence
  Synthetic
gctataggtacagtattagtaggacctacacctgtcaacataattggaagaaatatgttgactcagattggttgc

SEQ ID NO: 186676 - DNA, 75 bp, Artificial Sequence
  Synthetic
agacttagataaacatggggcactgacaagcagcaacacacctgccaataatgctgattgtgcctggctggaagc

SEQ ID NO: 186677 - DNA, 75 bp, Artificial Sequence
  Synthetic
gagcctgtgcctcttcagctaccaccgcttgagagacttactcttgattgcagcgaggactgtggaacttctggg

SEQ ID NO: 186678 - DNA, 75 bp, Artificial Sequence
  Synthetic
gaatggagaaataaaaaattgctctttcaatataaccacagagataagagataagaaaaagaaggaatatgcact

SEQ ID NO: 186679 - DNA, 75 bp, Artificial Sequence
  Synthetic
agactctgcacttttttataaacttgatctagtaccacttaatgagaaaaaatctagtaggaattctagaaaccc

SEQ ID NO: 186680 - DNA, 75 bp, Artificial Sequence
  Synthetic
ggaacaggaccatgcaaaaatgtcagcacagtacaatgtacacatggaattaagccagtggtatcaactcaacta

SEQ ID NO: 186681 - DNA, 75 bp, Artificial Sequence
  Synthetic
ggtagtaattagatctagcaatttctcagataatgctaaagtcataatagtacatctgaatgaatctatagaaat

SEQ ID NO: 186682 - DNA, 75 bp, Artificial Sequence
  Synthetic
ggaccaggacaaacattctatgcaacaggagacataataggagatataagacaagcacattgtaacattagtgaa

SEQ ID NO: 186683 - DNA, 75 bp, Artificial Sequence
  Synthetic
acagataataggaggtataagagcagcacattgtaacattagtaccacaaaatggaataacacattaaggctgat

SEQ ID NO: 186684 - DNA, 75 bp, Artificial Sequence
  Synthetic
gggtgcgagagcgtcaatattaagtgggggaaaattagatgcatgggaaaaaattcggttacggccagggggaaa

SEQ ID NO: 186685 - DNA, 75 bp, Artificial Sequence
  Synthetic
gcgaaagagaaaccagagaagttctctcgacgcaggactcggcttgctgaagcgcacagcaagaggcgaggggcg

SEQ ID NO: 186686 - DNA, 75 bp, Artificial Sequence
  Synthetic
tacaggccagacaattgatgtctggtatagtgcaacagcagagaaatttgctgagagctattgaggcgcaacagc

SEQ ID NO: 186687 - DNA, 75 bp, Artificial Sequence
  Synthetic
cacctatcccagtaggagaaatctataaaagatggataatcctaggattaaataaaatagtaagaatgtatagcc

SEQ ID NO: 186688 - DNA, 75 bp, Artificial Sequence
  Synthetic
tgagcggattcttagcacttgcctgggacgatctgaggagcctgtgccttttcagctaccaccgattgagagact

SEQ ID NO: 186689 - DNA, 75 bp, Artificial Sequence
  Synthetic
caagtttgtttcacaacaaaaggcttaggcatctcctatggcaggaagaagcggagacagcgacgaagagctcat

SEQ ID NO: 186690 - DNA, 75 bp, Artificial Sequence
  Synthetic
acatgcagagcgaataaaaaattgctctttcaataccaccacaggaataagaggtaagaaacagcaggtgtatgc

SEQ ID NO: 186691 - DNA, 75 bp, Artificial Sequence
  Synthetic
ttcactaggaatagcaacctcactgatgatactgataacaaccccaataatactattaatatggaaaatgaaata

SEQ ID NO: 186692 - DNA, 75 bp, Artificial Sequence
  Synthetic
aaatgggggccaagtggtcaaaaagctggcctacaataagagacagaatgagaaggactgagccaagaagagctg

SEQ ID NO: 186693 - DNA, 75 bp, Artificial Sequence
  Synthetic
gctggaagcgcaacaggaggacgaagaggtaggctttccagtcaaacctcaggtacctctaaggccaatgactta

SEQ ID NO: 186694 - DNA, 75 bp, Artificial Sequence
  Synthetic
gctgttggaaatgtggaaaggaaggacaccaaatgaaagattgtactgagagacaggctaattttttagggaaaa

SEQ ID NO: 186695 - DNA, 75 bp, Artificial Sequence
  Synthetic
catcaagttcctctaccaaagcagtaagtagtaaatgtaatgcaagctttaaagacagaagcaatagtagcatta

SEQ ID NO: 186696 - DNA, 75 bp, Artificial Sequence
  Synthetic
catcaagttcctctaccaaagcagtaagtagtaaatgtaatgcaagctttaaagacagtagcaatagtagcatta

SEQ ID NO: 186697 - DNA, 75 bp, Artificial Sequence
  Synthetic
catcaagttcctctaccaaagcagtaagtagtaaatgtaatgcaagctttaaagacagcagcaatagtagcatta

SEQ ID NO: 186698 - DNA, 75 bp, Artificial Sequence
  Synthetic
catcaagttcctctaccaaagcagtaagtagtaaatgtaatgcaagctttaaagacaggagcaatagtagcatta

SEQ ID NO: 186699 - DNA, 75 bp, Artificial Sequence
  Synthetic
catcaagttcctctaccaaagcagtaagtagtaaatgtaatgcaagctttatagacagaagcaatagtagcatta

SEQ ID NO: 186700 - DNA, 75 bp, Artificial Sequence
  Synthetic
catcaagttcctctaccaaagcagtaagtagtaaatgtaatgcaagctttatagacagtagcaatagtagcatta

SEQ ID NO: 186701 - DNA, 75 bp, Artificial Sequence
  Synthetic
catcaagttcctctaccaaagcagtaagtagtaaatgtaatgcaagctttatagacagcagcaatagtagcatta

SEQ ID NO: 186702 - DNA, 75 bp, Artificial Sequence
  Synthetic
catcaagttcctctaccaaagcagtaagtagtaaatgtaatgcaagctttatagacaggagcaatagtagcatta

SEQ ID NO: 186703 - DNA, 75 bp, Artificial Sequence
  Synthetic
catcaagttcctctaccaaagcagtaagtagtaaatgtaatgcaagctttacagacagaagcaatagtagcatta

SEQ ID NO: 186704 - DNA, 75 bp, Artificial Sequence
  Synthetic
catcaagttcctctaccaaagcagtaagtagtaaatgtaatgcaagctttacagacagtagcaatagtagcatta

SEQ ID NO: 186705 - DNA, 75 bp, Artificial Sequence
  Synthetic
catcaagttcctctaccaaagcagtaagtagtaaatgtaatgcaagctttacagacagcagcaatagtagcatta

SEQ ID NO: 186706 - DNA, 75 bp, Artificial Sequence
  Synthetic
catcaagttcctctaccaaagcagtaagtagtaaatgtaatgcaagctttacagacaggagcaatagtagcatta

SEQ ID NO: 186707 - DNA, 75 bp, Artificial Sequence
  Synthetic
catcaagttcctctaccaaagcagtaagtagtaaatgtaatgcaagctttagagacagaagcaatagtagcatta

SEQ ID NO: 186708 - DNA, 75 bp, Artificial Sequence
  Synthetic
catcaagttcctctaccaaagcagtaagtagtaaatgtaatgcaagctttagagacagtagcaatagtagcatta

SEQ ID NO: 186709 - DNA, 75 bp, Artificial Sequence
  Synthetic
catcaagttcctctaccaaagcagtaagtagtaaatgtaatgcaagctttagagacagcagcaatagtagcatta

SEQ ID NO: 186710 - DNA, 75 bp, Artificial Sequence
  Synthetic
catcaagttcctctaccaaagcagtaagtagtaaatgtaatgcaagctttagagacaggagcaatagtagcatta

SEQ ID NO: 186711 - DNA, 75 bp, Artificial Sequence
  Synthetic
catcaagttcctctaccaaagcagtaagtagtatatgtaatgcaagctttaaagacagaagcaatagtagcatta

SEQ ID NO: 186712 - DNA, 75 bp, Artificial Sequence
  Synthetic
catcaagttcctctaccaaagcagtaagtagtatatgtaatgcaagctttaaagacagtagcaatagtagcatta

SEQ ID NO: 186713 - DNA, 75 bp, Artificial Sequence
  Synthetic
catcaagttcctctaccaaagcagtaagtagtatatgtaatgcaagctttaaagacagcagcaatagtagcatta

SEQ ID NO: 186714 - DNA, 75 bp, Artificial Sequence
  Synthetic
catcaagttcctctaccaaagcagtaagtagtatatgtaatgcaagctttaaagacaggagcaatagtagcatta

SEQ ID NO: 186715 - DNA, 75 bp, Artificial Sequence
  Synthetic
catcaagttcctctaccaaagcagtaagtagtatatgtaatgcaagctttatagacagaagcaatagtagcatta

SEQ ID NO: 186716 - DNA, 75 bp, Artificial Sequence
  Synthetic
catcaagttcctctaccaaagcagtaagtagtatatgtaatgcaagctttatagacagtagcaatagtagcatta

SEQ ID NO: 186717 - DNA, 75 bp, Artificial Sequence
  Synthetic
catcaagttcctctaccaaagcagtaagtagtatatgtaatgcaagctttatagacagcagcaatagtagcatta

SEQ ID NO: 186718 - DNA, 75 bp, Artificial Sequence
  Synthetic
catcaagttcctctaccaaagcagtaagtagtatatgtaatgcaagctttatagacaggagcaatagtagcatta

SEQ ID NO: 186719 - DNA, 75 bp, Artificial Sequence
  Synthetic
catcaagttcctctaccaaagcagtaagtagtatatgtaatgcaagctttacagacagaagcaatagtagcatta

SEQ ID NO: 186720 - DNA, 75 bp, Artificial Sequence
  Synthetic
catcaagttcctctaccaaagcagtaagtagtatatgtaatgcaagctttacagacagtagcaatagtagcatta

SEQ ID NO: 186721 - DNA, 75 bp, Artificial Sequence
  Synthetic
catcaagttcctctaccaaagcagtaagtagtatatgtaatgcaagctttacagacagcagcaatagtagcatta

SEQ ID NO: 186722 - DNA, 75 bp, Artificial Sequence
  Synthetic
catcaagttcctctaccaaagcagtaagtagtatatgtaatgcaagctttacagacaggagcaatagtagcatta

SEQ ID NO: 186723 - DNA, 75 bp, Artificial Sequence
  Synthetic
catcaagttcctctaccaaagcagtaagtagtatatgtaatgcaagctttagagacagaagcaatagtagcatta

SEQ ID NO: 186724 - DNA, 75 bp, Artificial Sequence
  Synthetic
catcaagttcctctaccaaagcagtaagtagtatatgtaatgcaagctttagagacagtagcaatagtagcatta

SEQ ID NO: 186725 - DNA, 75 bp, Artificial Sequence
  Synthetic
catcaagttcctctaccaaagcagtaagtagtatatgtaatgcaagctttagagacagcagcaatagtagcatta

SEQ ID NO: 186726 - DNA, 75 bp, Artificial Sequence
  Synthetic
catcaagttcctctaccaaagcagtaagtagtatatgtaatgcaagctttagagacaggagcaatagtagcatta

SEQ ID NO: 186727 - DNA, 75 bp, Artificial Sequence
  Synthetic
catcaagttcctctaccaaagcagtaagtagtacatgtaatgcaagctttaaagacagaagcaatagtagcatta

SEQ ID NO: 186728 - DNA, 75 bp, Artificial Sequence
  Synthetic
catcaagttcctctaccaaagcagtaagtagtacatgtaatgcaagctttaaagacagtagcaatagtagcatta

SEQ ID NO: 186729 - DNA, 75 bp, Artificial Sequence
  Synthetic
catcaagttcctctaccaaagcagtaagtagtacatgtaatgcaagctttaaagacagcagcaatagtagcatta

SEQ ID NO: 186730 - DNA, 75 bp, Artificial Sequence
  Synthetic
catcaagttcctctaccaaagcagtaagtagtacatgtaatgcaagctttaaagacaggagcaatagtagcatta

SEQ ID NO: 186731 - DNA, 75 bp, Artificial Sequence
  Synthetic
catcaagttcctctaccaaagcagtaagtagtacatgtaatgcaagctttatagacagaagcaatagtagcatta

SEQ ID NO: 186732 - DNA, 75 bp, Artificial Sequence
  Synthetic
catcaagttcctctaccaaagcagtaagtagtacatgtaatgcaagctttatagacagtagcaatagtagcatta

SEQ ID NO: 186733 - DNA, 75 bp, Artificial Sequence
  Synthetic
catcaagttcctctaccaaagcagtaagtagtacatgtaatgcaagctttatagacagcagcaatagtagcatta

SEQ ID NO: 186734 - DNA, 75 bp, Artificial Sequence
  Synthetic
catcaagttcctctaccaaagcagtaagtagtacatgtaatgcaagctttatagacaggagcaatagtagcatta

SEQ ID NO: 186735 - DNA, 75 bp, Artificial Sequence
  Synthetic
catcaagttcctctaccaaagcagtaagtagtacatgtaatgcaagctttacagacagaagcaatagtagcatta

SEQ ID NO: 186736 - DNA, 75 bp, Artificial Sequence
  Synthetic
catcaagttcctctaccaaagcagtaagtagtacatgtaatgcaagctttacagacagtagcaatagtagcatta

SEQ ID NO: 186737 - DNA, 75 bp, Artificial Sequence
  Synthetic
catcaagttcctctaccaaagcagtaagtagtacatgtaatgcaagctttacagacagcagcaatagtagcatta

SEQ ID NO: 186738 - DNA, 75 bp, Artificial Sequence
  Synthetic
catcaagttcctctaccaaagcagtaagtagtacatgtaatgcaagctttacagacaggagcaatagtagcatta

SEQ ID NO: 186739 - DNA, 75 bp, Artificial Sequence
  Synthetic
catcaagttcctctaccaaagcagtaagtagtacatgtaatgcaagctttagagacagaagcaatagtagcatta

SEQ ID NO: 186740 - DNA, 75 bp, Artificial Sequence
  Synthetic
catcaagttcctctaccaaagcagtaagtagtacatgtaatgcaagctttagagacagtagcaatagtagcatta

SEQ ID NO: 186741 - DNA, 75 bp, Artificial Sequence
  Synthetic
catcaagttcctctaccaaagcagtaagtagtacatgtaatgcaagctttagagacagcagcaatagtagcatta

SEQ ID NO: 186742 - DNA, 75 bp, Artificial Sequence
  Synthetic
catcaagttcctctaccaaagcagtaagtagtacatgtaatgcaagctttagagacaggagcaatagtagcatta

SEQ ID NO: 186743 - DNA, 75 bp, Artificial Sequence
  Synthetic
catcaagttcctctaccaaagcagtaagtagtagatgtaatgcaagctttaaagacagaagcaatagtagcatta

SEQ ID NO: 186744 - DNA, 75 bp, Artificial Sequence
  Synthetic
catcaagttcctctaccaaagcagtaagtagtagatgtaatgcaagctttaaagacagtagcaatagtagcatta

SEQ ID NO: 186745 - DNA, 75 bp, Artificial Sequence
  Synthetic
catcaagttcctctaccaaagcagtaagtagtagatgtaatgcaagctttaaagacagcagcaatagtagcatta

SEQ ID NO: 186746 - DNA, 75 bp, Artificial Sequence
  Synthetic
catcaagttcctctaccaaagcagtaagtagtagatgtaatgcaagctttaaagacaggagcaatagtagcatta

SEQ ID NO: 186747 - DNA, 75 bp, Artificial Sequence
  Synthetic
catcaagttcctctaccaaagcagtaagtagtagatgtaatgcaagctttatagacagaagcaatagtagcatta

SEQ ID NO: 186748 - DNA, 75 bp, Artificial Sequence
  Synthetic
catcaagttcctctaccaaagcagtaagtagtagatgtaatgcaagctttatagacagtagcaatagtagcatta

SEQ ID NO: 186749 - DNA, 75 bp, Artificial Sequence
  Synthetic
catcaagttcctctaccaaagcagtaagtagtagatgtaatgcaagctttatagacagcagcaatagtagcatta

SEQ ID NO: 186750 - DNA, 75 bp, Artificial Sequence
  Synthetic
catcaagttcctctaccaaagcagtaagtagtagatgtaatgcaagctttatagacaggagcaatagtagcatta

SEQ ID NO: 186751 - DNA, 75 bp, Artificial Sequence
  Synthetic
catcaagttcctctaccaaagcagtaagtagtagatgtaatgcaagctttacagacagaagcaatagtagcatta

SEQ ID NO: 186752 - DNA, 75 bp, Artificial Sequence
  Synthetic
catcaagttcctctaccaaagcagtaagtagtagatgtaatgcaagctttacagacagtagcaatagtagcatta

SEQ ID NO: 186753 - DNA, 75 bp, Artificial Sequence
  Synthetic
catcaagttcctctaccaaagcagtaagtagtagatgtaatgcaagctttacagacagcagcaatagtagcatta

SEQ ID NO: 186754 - DNA, 75 bp, Artificial Sequence
  Synthetic
catcaagttcctctaccaaagcagtaagtagtagatgtaatgcaagctttacagacaggagcaatagtagcatta

SEQ ID NO: 186755 - DNA, 75 bp, Artificial Sequence
  Synthetic
catcaagttcctctaccaaagcagtaagtagtagatgtaatgcaagctttagagacagaagcaatagtagcatta

SEQ ID NO: 186756 - DNA, 75 bp, Artificial Sequence
  Synthetic
catcaagttcctctaccaaagcagtaagtagtagatgtaatgcaagctttagagacagtagcaatagtagcatta

SEQ ID NO: 186757 - DNA, 75 bp, Artificial Sequence
  Synthetic
catcaagttcctctaccaaagcagtaagtagtagatgtaatgcaagctttagagacagcagcaatagtagcatta

SEQ ID NO: 186758 - DNA, 75 bp, Artificial Sequence
  Synthetic
catcaagttcctctaccaaagcagtaagtagtagatgtaatgcaagctttagagacaggagcaatagtagcatta

SEQ ID NO: 186759 - DNA, 75 bp, Artificial Sequence
  Synthetic
atgcacacatggaatcaagccagtagtatcaactcaattgtcgttaaatggcagtctagcagaggaagacataat

SEQ ID NO: 186760 - DNA, 75 bp, Artificial Sequence
  Synthetic
aattgtgtgcacaagacccaacaataacacaagaaaaagtgtaaggataggaccaggacaaacattctatgcaac

SEQ ID NO: 186761 - DNA, 75 bp, Artificial Sequence
  Synthetic
aaaagtatacgtatagggccaggacaaacattctttgcaacaggcgacatcattggggatataagacaagcacat

SEQ ID NO: 186762 - DNA, 75 bp, Artificial Sequence
  Synthetic
atccaaaagtaagttcagaagtacatattccaataaatgaggctagattaataataagaacatattggggtctac

SEQ ID NO: 186763 - DNA, 75 bp, Artificial Sequence
  Synthetic
aggaggggatttagaaattacaatgcatagttttaattgtaaaggagagtttttctattgcaatacatcaggcct

SEQ ID NO: 186764 - DNA, 75 bp, Artificial Sequence
  Synthetic
agagagaagctgttagacattttcctagaccatggctccaggaattagggcagtatatctataacacatacgggg

SEQ ID NO: 186765 - DNA, 75 bp, Artificial Sequence
  Synthetic
ggtaagaaaaagggtacatataggaggggggagaacattttatgcaacaggcatagaaggagatataagaaaagc

SEQ ID NO: 186766 - DNA, 75 bp, Artificial Sequence
  Synthetic
tatcaagagccatttaaaaatctaaaaacaggaaaatatgcaagaaaaagatctgctcacactaatgatgtaaga

SEQ ID NO: 186767 - DNA, 75 bp, Artificial Sequence
  Synthetic
caatcctcaggaggggacccagaaattgtaacgcacagttttaattgtggaggggaatttttctactgtaataca

SEQ ID NO: 186768 - DNA, 75 bp, Artificial Sequence
  Synthetic
ttgtaacgcacagttttaattgtggaggggaatttttctactgtaatacaacaaaactgtttaatagtacttgga

SEQ ID NO: 186769 - DNA, 75 bp, Artificial Sequence
  Synthetic
gttatgaactccatcctgataaatggacagtacagcctatagtgctgccagaaaaagacagctggactgtcaatg

SEQ ID NO: 186770 - DNA, 75 bp, Artificial Sequence
  Synthetic
ctagaatataggaaagtgttaaagcaagaaagaataaaccagttatataatagactaatagaaagagcagaagac

SEQ ID NO: 186771 - DNA, 75 bp, Artificial Sequence
  Synthetic
tgcacagttttaattgtggaggggaatttttctattgtaatacatcaaaactgtttaatagtacttggaatgata

SEQ ID NO: 186772 - DNA, 75 bp, Artificial Sequence
  Synthetic
ctagggatttggggatgctctggaaaactcatctgcaccactaatgtgccttagaatgctagttggagtaataaa

SEQ ID NO: 186773 - DNA, 75 bp, Artificial Sequence
  Synthetic
ctagggatttggggatgctctggaaaactcatctgcaccactaatgtgcctttgaatgctagttggagtaataaa

SEQ ID NO: 186774 - DNA, 75 bp, Artificial Sequence
  Synthetic
ctagggatttggggatgctctggaaaactcatctgcaccactaatgtgccttcgaatgctagttggagtaataaa

SEQ ID NO: 186775 - DNA, 75 bp, Artificial Sequence
  Synthetic
ctagggatttggggatgctctggaaaactcatctgcaccactaatgtgccttggaatgctagttggagtaataaa

SEQ ID NO: 186776 - DNA, 75 bp, Artificial Sequence
  Synthetic
ctagggatttggggatgctctggaaaactcatctgctccactaatgtgccttagaatgctagttggagtaataaa

SEQ ID NO: 186777 - DNA, 75 bp, Artificial Sequence
  Synthetic
ctagggatttggggatgctctggaaaactcatctgctccactaatgtgcctttgaatgctagttggagtaataaa

SEQ ID NO: 186778 - DNA, 75 bp, Artificial Sequence
  Synthetic
ctagggatttggggatgctctggaaaactcatctgctccactaatgtgccttcgaatgctagttggagtaataaa

SEQ ID NO: 186779 - DNA, 75 bp, Artificial Sequence
  Synthetic
ctagggatttggggatgctctggaaaactcatctgctccactaatgtgccttggaatgctagttggagtaataaa

SEQ ID NO: 186780 - DNA, 75 bp, Artificial Sequence
  Synthetic
ctagggatttggggatgctctggaaaactcatctgccccactaatgtgccttagaatgctagttggagtaataaa

SEQ ID NO: 186781 - DNA, 75 bp, Artificial Sequence
  Synthetic
ctagggatttggggatgctctggaaaactcatctgccccactaatgtgcctttgaatgctagttggagtaataaa

SEQ ID NO: 186782 - DNA, 75 bp, Artificial Sequence
  Synthetic
ctagggatttggggatgctctggaaaactcatctgccccactaatgtgccttcgaatgctagttggagtaataaa

SEQ ID NO: 186783 - DNA, 75 bp, Artificial Sequence
  Synthetic
ctagggatttggggatgctctggaaaactcatctgccccactaatgtgccttggaatgctagttggagtaataaa

SEQ ID NO: 186784 - DNA, 75 bp, Artificial Sequence
  Synthetic
ctagggatttggggatgctctggaaaactcatctgcgccactaatgtgccttagaatgctagttggagtaataaa

SEQ ID NO: 186785 - DNA, 75 bp, Artificial Sequence
  Synthetic
ctagggatttggggatgctctggaaaactcatctgcgccactaatgtgcctttgaatgctagttggagtaataaa

SEQ ID NO: 186786 - DNA, 75 bp, Artificial Sequence
  Synthetic
ctagggatttggggatgctctggaaaactcatctgcgccactaatgtgccttcgaatgctagttggagtaataaa

SEQ ID NO: 186787 - DNA, 75 bp, Artificial Sequence
  Synthetic
ctagggatttggggatgctctggaaaactcatctgcgccactaatgtgccttggaatgctagttggagtaataaa

SEQ ID NO: 186788 - DNA, 75 bp, Artificial Sequence
  Synthetic
ctagggatttggggttgctctggaaaactcatctgcaccactaatgtgccttagaatgctagttggagtaataaa

SEQ ID NO: 186789 - DNA, 75 bp, Artificial Sequence
  Synthetic
ctagggatttggggttgctctggaaaactcatctgcaccactaatgtgcctttgaatgctagttggagtaataaa

SEQ ID NO: 186790 - DNA, 75 bp, Artificial Sequence
  Synthetic
ctagggatttggggttgctctggaaaactcatctgcaccactaatgtgccttcgaatgctagttggagtaataaa

SEQ ID NO: 186791 - DNA, 75 bp, Artificial Sequence
  Synthetic
ctagggatttggggttgctctggaaaactcatctgcaccactaatgtgccttggaatgctagttggagtaataaa

SEQ ID NO: 186792 - DNA, 75 bp, Artificial Sequence
  Synthetic
ctagggatttggggttgctctggaaaactcatctgctccactaatgtgccttagaatgctagttggagtaataaa

SEQ ID NO: 186793 - DNA, 75 bp, Artificial Sequence
  Synthetic
ctagggatttggggttgctctggaaaactcatctgctccactaatgtgcctttgaatgctagttggagtaataaa

SEQ ID NO: 186794 - DNA, 75 bp, Artificial Sequence
  Synthetic
ctagggatttggggttgctctggaaaactcatctgctccactaatgtgccttcgaatgctagttggagtaataaa

SEQ ID NO: 186795 - DNA, 75 bp, Artificial Sequence
  Synthetic
ctagggatttggggttgctctggaaaactcatctgctccactaatgtgccttggaatgctagttggagtaataaa

SEQ ID NO: 186796 - DNA, 75 bp, Artificial Sequence
  Synthetic
ctagggatttggggttgctctggaaaactcatctgccccactaatgtgccttagaatgctagttggagtaataaa

SEQ ID NO: 186797 - DNA, 75 bp, Artificial Sequence
  Synthetic
ctagggatttggggttgctctggaaaactcatctgccccactaatgtgcctttgaatgctagttggagtaataaa

SEQ ID NO: 186798 - DNA, 75 bp, Artificial Sequence
  Synthetic
ctagggatttggggttgctctggaaaactcatctgccccactaatgtgccttcgaatgctagttggagtaataaa

SEQ ID NO: 186799 - DNA, 75 bp, Artificial Sequence
  Synthetic
ctagggatttggggttgctctggaaaactcatctgccccactaatgtgccttggaatgctagttggagtaataaa

SEQ ID NO: 186800 - DNA, 75 bp, Artificial Sequence
  Synthetic
ctagggatttggggttgctctggaaaactcatctgcgccactaatgtgccttagaatgctagttggagtaataaa

SEQ ID NO: 186801 - DNA, 75 bp, Artificial Sequence
  Synthetic
ctagggatttggggttgctctggaaaactcatctgcgccactaatgtgcctttgaatgctagttggagtaataaa

SEQ ID NO: 186802 - DNA, 75 bp, Artificial Sequence
  Synthetic
ctagggatttggggttgctctggaaaactcatctgcgccactaatgtgccttcgaatgctagttggagtaataaa

SEQ ID NO: 186803 - DNA, 75 bp, Artificial Sequence
  Synthetic
ctagggatttggggttgctctggaaaactcatctgcgccactaatgtgccttggaatgctagttggagtaataaa

SEQ ID NO: 186804 - DNA, 75 bp, Artificial Sequence
  Synthetic
ctagggatttggggctgctctggaaaactcatctgcaccactaatgtgccttagaatgctagttggagtaataaa

SEQ ID NO: 186805 - DNA, 75 bp, Artificial Sequence
  Synthetic
ctagggatttggggctgctctggaaaactcatctgcaccactaatgtgcctttgaatgctagttggagtaataaa

SEQ ID NO: 186806 - DNA, 75 bp, Artificial Sequence
  Synthetic
ctagggatttggggctgctctggaaaactcatctgcaccactaatgtgccttcgaatgctagttggagtaataaa

SEQ ID NO: 186807 - DNA, 75 bp, Artificial Sequence
  Synthetic
ctagggatttggggctgctctggaaaactcatctgcaccactaatgtgccttggaatgctagttggagtaataaa

SEQ ID NO: 186808 - DNA, 75 bp, Artificial Sequence
  Synthetic
ctagggatttggggctgctctggaaaactcatctgctccactaatgtgccttagaatgctagttggagtaataaa

SEQ ID NO: 186809 - DNA, 75 bp, Artificial Sequence
  Synthetic
ctagggatttggggctgctctggaaaactcatctgctccactaatgtgcctttgaatgctagttggagtaataaa

SEQ ID NO: 186810 - DNA, 75 bp, Artificial Sequence
  Synthetic
ctagggatttggggctgctctggaaaactcatctgctccactaatgtgccttcgaatgctagttggagtaataaa

SEQ ID NO: 186811 - DNA, 75 bp, Artificial Sequence
  Synthetic
ctagggatttggggctgctctggaaaactcatctgctccactaatgtgccttggaatgctagttggagtaataaa

SEQ ID NO: 186812 - DNA, 75 bp, Artificial Sequence
  Synthetic
ctagggatttggggctgctctggaaaactcatctgccccactaatgtgccttagaatgctagttggagtaataaa

SEQ ID NO: 186813 - DNA, 75 bp, Artificial Sequence
  Synthetic
ctagggatttggggctgctctggaaaactcatctgccccactaatgtgcctttgaatgctagttggagtaataaa

SEQ ID NO: 186814 - DNA, 75 bp, Artificial Sequence
  Synthetic
ctagggatttggggctgctctggaaaactcatctgccccactaatgtgccttcgaatgctagttggagtaataaa

SEQ ID NO: 186815 - DNA, 75 bp, Artificial Sequence
  Synthetic
ctagggatttggggctgctctggaaaactcatctgccccactaatgtgccttggaatgctagttggagtaataaa

SEQ ID NO: 186816 - DNA, 75 bp, Artificial Sequence
  Synthetic
ctagggatttggggctgctctggaaaactcatctgcgccactaatgtgccttagaatgctagttggagtaataaa

SEQ ID NO: 186817 - DNA, 75 bp, Artificial Sequence
  Synthetic
ctagggatttggggctgctctggaaaactcatctgcgccactaatgtgcctttgaatgctagttggagtaataaa

SEQ ID NO: 186818 - DNA, 75 bp, Artificial Sequence
  Synthetic
ctagggatttggggctgctctggaaaactcatctgcgccactaatgtgccttcgaatgctagttggagtaataaa

SEQ ID NO: 186819 - DNA, 75 bp, Artificial Sequence
  Synthetic
ctagggatttggggctgctctggaaaactcatctgcgccactaatgtgccttggaatgctagttggagtaataaa

SEQ ID NO: 186820 - DNA, 75 bp, Artificial Sequence
  Synthetic
ctagggatttgggggtgctctggaaaactcatctgcaccactaatgtgccttagaatgctagttggagtaataaa

SEQ ID NO: 186821 - DNA, 75 bp, Artificial Sequence
  Synthetic
ctagggatttgggggtgctctggaaaactcatctgcaccactaatgtgcctttgaatgctagttggagtaataaa

SEQ ID NO: 186822 - DNA, 75 bp, Artificial Sequence
  Synthetic
ctagggatttgggggtgctctggaaaactcatctgcaccactaatgtgccttcgaatgctagttggagtaataaa

SEQ ID NO: 186823 - DNA, 75 bp, Artificial Sequence
  Synthetic
ctagggatttgggggtgctctggaaaactcatctgcaccactaatgtgccttggaatgctagttggagtaataaa

SEQ ID NO: 186824 - DNA, 75 bp, Artificial Sequence
  Synthetic
ctagggatttgggggtgctctggaaaactcatctgctccactaatgtgccttagaatgctagttggagtaataaa

SEQ ID NO: 186825 - DNA, 75 bp, Artificial Sequence
  Synthetic
ctagggatttgggggtgctctggaaaactcatctgctccactaatgtgcctttgaatgctagttggagtaataaa

SEQ ID NO: 186826 - DNA, 75 bp, Artificial Sequence
  Synthetic
ctagggatttgggggtgctctggaaaactcatctgctccactaatgtgccttcgaatgctagttggagtaataaa

SEQ ID NO: 186827 - DNA, 75 bp, Artificial Sequence
  Synthetic
ctagggatttgggggtgctctggaaaactcatctgctccactaatgtgccttggaatgctagttggagtaataaa

SEQ ID NO: 186828 - DNA, 75 bp, Artificial Sequence
  Synthetic
ctagggatttgggggtgctctggaaaactcatctgccccactaatgtgccttagaatgctagttggagtaataaa

SEQ ID NO: 186829 - DNA, 75 bp, Artificial Sequence
  Synthetic
ctagggatttgggggtgctctggaaaactcatctgccccactaatgtgcctttgaatgctagttggagtaataaa

SEQ ID NO: 186830 - DNA, 75 bp, Artificial Sequence
  Synthetic
ctagggatttgggggtgctctggaaaactcatctgccccactaatgtgccttcgaatgctagttggagtaataaa

SEQ ID NO: 186831 - DNA, 75 bp, Artificial Sequence
  Synthetic
ctagggatttgggggtgctctggaaaactcatctgccccactaatgtgccttggaatgctagttggagtaataaa

SEQ ID NO: 186832 - DNA, 75 bp, Artificial Sequence
  Synthetic
ctagggatttgggggtgctctggaaaactcatctgcgccactaatgtgccttagaatgctagttggagtaataaa

SEQ ID NO: 186833 - DNA, 75 bp, Artificial Sequence
  Synthetic
ctagggatttgggggtgctctggaaaactcatctgcgccactaatgtgcctttgaatgctagttggagtaataaa

SEQ ID NO: 186834 - DNA, 75 bp, Artificial Sequence
  Synthetic
ctagggatttgggggtgctctggaaaactcatctgcgccactaatgtgccttcgaatgctagttggagtaataaa

SEQ ID NO: 186835 - DNA, 75 bp, Artificial Sequence
  Synthetic
ctagggatttgggggtgctctggaaaactcatctgcgccactaatgtgccttggaatgctagttggagtaataaa

SEQ ID NO: 186836 - DNA, 75 bp, Artificial Sequence
  Synthetic
cttaggcatatcctatggcaggaagaagcggagaccccgacgaggaacttctcagagcagtaaggatcatcaaaa

SEQ ID NO: 186837 - DNA, 75 bp, Artificial Sequence
  Synthetic
aaaattttaacatgtggaaaaataacatggtagagcagatgcatgcagatataattagtttatgggatcaagggc

SEQ ID NO: 186838 - DNA, 75 bp, Artificial Sequence
  Synthetic
tactttctatagtaaaaagaattaggcagggatactcaccattctcgtttcagacccacctcccagtcccacagg

SEQ ID NO: 186839 - DNA, 75 bp, Artificial Sequence
  Synthetic
tactttctatagtaaaaagaattaggcagggatactcaccattctcgtttcagacccacctcccagtcccactgg

SEQ ID NO: 186840 - DNA, 75 bp, Artificial Sequence
  Synthetic
tactttctatagtaaaaagaattaggcagggatactcaccattctcgtttcagacccacctcccagtcccaccgg

SEQ ID NO: 186841 - DNA, 75 bp, Artificial Sequence
  Synthetic
tactttctatagtaaaaagaattaggcagggatactcaccattctcgtttcagacccacctcccagtcccacggg

SEQ ID NO: 186842 - DNA, 75 bp, Artificial Sequence
  Synthetic
tactttctatagtaaatagaattaggcagggatactcaccattctcgtttcagacccacctcccagtcccacagg

SEQ ID NO: 186843 - DNA, 75 bp, Artificial Sequence
  Synthetic
tactttctatagtaaatagaattaggcagggatactcaccattctcgtttcagacccacctcccagtcccactgg

SEQ ID NO: 186844 - DNA, 75 bp, Artificial Sequence
  Synthetic
tactttctatagtaaatagaattaggcagggatactcaccattctcgtttcagacccacctcccagtcccaccgg

SEQ ID NO: 186845 - DNA, 75 bp, Artificial Sequence
  Synthetic
tactttctatagtaaatagaattaggcagggatactcaccattctcgtttcagacccacctcccagtcccacggg

SEQ ID NO: 186846 - DNA, 75 bp, Artificial Sequence
  Synthetic
tactttctatagtaaacagaattaggcagggatactcaccattctcgtttcagacccacctcccagtcccacagg

SEQ ID NO: 186847 - DNA, 75 bp, Artificial Sequence
  Synthetic
tactttctatagtaaacagaattaggcagggatactcaccattctcgtttcagacccacctcccagtcccactgg

SEQ ID NO: 186848 - DNA, 75 bp, Artificial Sequence
  Synthetic
tactttctatagtaaacagaattaggcagggatactcaccattctcgtttcagacccacctcccagtcccaccgg

SEQ ID NO: 186849 - DNA, 75 bp, Artificial Sequence
  Synthetic
tactttctatagtaaacagaattaggcagggatactcaccattctcgtttcagacccacctcccagtcccacggg

SEQ ID NO: 186850 - DNA, 75 bp, Artificial Sequence
  Synthetic
tactttctatagtaaagagaattaggcagggatactcaccattctcgtttcagacccacctcccagtcccacagg

SEQ ID NO: 186851 - DNA, 75 bp, Artificial Sequence
  Synthetic
tactttctatagtaaagagaattaggcagggatactcaccattctcgtttcagacccacctcccagtcccactgg

SEQ ID NO: 186852 - DNA, 75 bp, Artificial Sequence
  Synthetic
tactttctatagtaaagagaattaggcagggatactcaccattctcgtttcagacccacctcccagtcccaccgg

SEQ ID NO: 186853 - DNA, 75 bp, Artificial Sequence
  Synthetic
tactttctatagtaaagagaattaggcagggatactcaccattctcgtttcagacccacctcccagtcccacggg

SEQ ID NO: 186854 - DNA, 75 bp, Artificial Sequence
  Synthetic
tactttctatagttaaaagaattaggcagggatactcaccattctcgtttcagacccacctcccagtcccacagg

SEQ ID NO: 186855 - DNA, 75 bp, Artificial Sequence
  Synthetic
tactttctatagttaaaagaattaggcagggatactcaccattctcgtttcagacccacctcccagtcccactgg

SEQ ID NO: 186856 - DNA, 75 bp, Artificial Sequence
  Synthetic
tactttctatagttaaaagaattaggcagggatactcaccattctcgtttcagacccacctcccagtcccaccgg

SEQ ID NO: 186857 - DNA, 75 bp, Artificial Sequence
  Synthetic
tactttctatagttaaaagaattaggcagggatactcaccattctcgtttcagacccacctcccagtcccacggg

SEQ ID NO: 186858 - DNA, 75 bp, Artificial Sequence
  Synthetic
tactttctatagttaatagaattaggcagggatactcaccattctcgtttcagacccacctcccagtcccacagg

SEQ ID NO: 186859 - DNA, 75 bp, Artificial Sequence
  Synthetic
tactttctatagttaatagaattaggcagggatactcaccattctcgtttcagacccacctcccagtcccactgg

SEQ ID NO: 186860 - DNA, 75 bp, Artificial Sequence
  Synthetic
tactttctatagttaatagaattaggcagggatactcaccattctcgtttcagacccacctcccagtcccaccgg

SEQ ID NO: 186861 - DNA, 75 bp, Artificial Sequence
  Synthetic
tactttctatagttaatagaattaggcagggatactcaccattctcgtttcagacccacctcccagtcccacggg

SEQ ID NO: 186862 - DNA, 75 bp, Artificial Sequence
  Synthetic
tactttctatagttaacagaattaggcagggatactcaccattctcgtttcagacccacctcccagtcccacagg

SEQ ID NO: 186863 - DNA, 75 bp, Artificial Sequence
  Synthetic
tactttctatagttaacagaattaggcagggatactcaccattctcgtttcagacccacctcccagtcccactgg

SEQ ID NO: 186864 - DNA, 75 bp, Artificial Sequence
  Synthetic
tactttctatagttaacagaattaggcagggatactcaccattctcgtttcagacccacctcccagtcccaccgg

SEQ ID NO: 186865 - DNA, 75 bp, Artificial Sequence
  Synthetic
tactttctatagttaacagaattaggcagggatactcaccattctcgtttcagacccacctcccagtcccacggg

SEQ ID NO: 186866 - DNA, 75 bp, Artificial Sequence
  Synthetic
tactttctatagttaagagaattaggcagggatactcaccattctcgtttcagacccacctcccagtcccacagg

SEQ ID NO: 186867 - DNA, 75 bp, Artificial Sequence
  Synthetic
tactttctatagttaagagaattaggcagggatactcaccattctcgtttcagacccacctcccagtcccactgg

SEQ ID NO: 186868 - DNA, 75 bp, Artificial Sequence
  Synthetic
tactttctatagttaagagaattaggcagggatactcaccattctcgtttcagacccacctcccagtcccaccgg

SEQ ID NO: 186869 - DNA, 75 bp, Artificial Sequence
  Synthetic
tactttctatagttaagagaattaggcagggatactcaccattctcgtttcagacccacctcccagtcccacggg

SEQ ID NO: 186870 - DNA, 75 bp, Artificial Sequence
  Synthetic
tactttctatagtcaaaagaattaggcagggatactcaccattctcgtttcagacccacctcccagtcccacagg

SEQ ID NO: 186871 - DNA, 75 bp, Artificial Sequence
  Synthetic
tactttctatagtcaaaagaattaggcagggatactcaccattctcgtttcagacccacctcccagtcccactgg

SEQ ID NO: 186872 - DNA, 75 bp, Artificial Sequence
  Synthetic
tactttctatagtcaaaagaattaggcagggatactcaccattctcgtttcagacccacctcccagtcccaccgg

SEQ ID NO: 186873 - DNA, 75 bp, Artificial Sequence
  Synthetic
tactttctatagtcaaaagaattaggcagggatactcaccattctcgtttcagacccacctcccagtcccacggg

SEQ ID NO: 186874 - DNA, 75 bp, Artificial Sequence
  Synthetic
tactttctatagtcaatagaattaggcagggatactcaccattctcgtttcagacccacctcccagtcccacagg

SEQ ID NO: 186875 - DNA, 75 bp, Artificial Sequence
  Synthetic
tactttctatagtcaatagaattaggcagggatactcaccattctcgtttcagacccacctcccagtcccactgg

SEQ ID NO: 186876 - DNA, 75 bp, Artificial Sequence
  Synthetic
tactttctatagtcaatagaattaggcagggatactcaccattctcgtttcagacccacctcccagtcccaccgg

SEQ ID NO: 186877 - DNA, 75 bp, Artificial Sequence
  Synthetic
tactttctatagtcaatagaattaggcagggatactcaccattctcgtttcagacccacctcccagtcccacggg

SEQ ID NO: 186878 - DNA, 75 bp, Artificial Sequence
  Synthetic
tactttctatagtcaacagaattaggcagggatactcaccattctcgtttcagacccacctcccagtcccacagg

SEQ ID NO: 186879 - DNA, 75 bp, Artificial Sequence
  Synthetic
tactttctatagtcaacagaattaggcagggatactcaccattctcgtttcagacccacctcccagtcccactgg

SEQ ID NO: 186880 - DNA, 75 bp, Artificial Sequence
  Synthetic
tactttctatagtcaacagaattaggcagggatactcaccattctcgtttcagacccacctcccagtcccaccgg

SEQ ID NO: 186881 - DNA, 75 bp, Artificial Sequence
  Synthetic
tactttctatagtcaacagaattaggcagggatactcaccattctcgtttcagacccacctcccagtcccacggg

SEQ ID NO: 186882 - DNA, 75 bp, Artificial Sequence
  Synthetic
tactttctatagtcaagagaattaggcagggatactcaccattctcgtttcagacccacctcccagtcccacagg

SEQ ID NO: 186883 - DNA, 75 bp, Artificial Sequence
  Synthetic
tactttctatagtcaagagaattaggcagggatactcaccattctcgtttcagacccacctcccagtcccactgg

SEQ ID NO: 186884 - DNA, 75 bp, Artificial Sequence
  Synthetic
tactttctatagtcaagagaattaggcagggatactcaccattctcgtttcagacccacctcccagtcccaccgg

SEQ ID NO: 186885 - DNA, 75 bp, Artificial Sequence
  Synthetic
tactttctatagtcaagagaattaggcagggatactcaccattctcgtttcagacccacctcccagtcccacggg

SEQ ID NO: 186886 - DNA, 75 bp, Artificial Sequence
  Synthetic
tactttctatagtgaaaagaattaggcagggatactcaccattctcgtttcagacccacctcccagtcccacagg

SEQ ID NO: 186887 - DNA, 75 bp, Artificial Sequence
  Synthetic
tactttctatagtgaaaagaattaggcagggatactcaccattctcgtttcagacccacctcccagtcccactgg

SEQ ID NO: 186888 - DNA, 75 bp, Artificial Sequence
  Synthetic
tactttctatagtgaaaagaattaggcagggatactcaccattctcgtttcagacccacctcccagtcccaccgg

SEQ ID NO: 186889 - DNA, 75 bp, Artificial Sequence
  Synthetic
tactttctatagtgaaaagaattaggcagggatactcaccattctcgtttcagacccacctcccagtcccacggg

SEQ ID NO: 186890 - DNA, 75 bp, Artificial Sequence
  Synthetic
tactttctatagtgaatagaattaggcagggatactcaccattctcgtttcagacccacctcccagtcccacagg

SEQ ID NO: 186891 - DNA, 75 bp, Artificial Sequence
  Synthetic
tactttctatagtgaatagaattaggcagggatactcaccattctcgtttcagacccacctcccagtcccactgg

SEQ ID NO: 186892 - DNA, 75 bp, Artificial Sequence
  Synthetic
tactttctatagtgaatagaattaggcagggatactcaccattctcgtttcagacccacctcccagtcccaccgg

SEQ ID NO: 186893 - DNA, 75 bp, Artificial Sequence
  Synthetic
tactttctatagtgaatagaattaggcagggatactcaccattctcgtttcagacccacctcccagtcccacggg

SEQ ID NO: 186894 - DNA, 75 bp, Artificial Sequence
  Synthetic
tactttctatagtgaacagaattaggcagggatactcaccattctcgtttcagacccacctcccagtcccacagg

SEQ ID NO: 186895 - DNA, 75 bp, Artificial Sequence
  Synthetic
tactttctatagtgaacagaattaggcagggatactcaccattctcgtttcagacccacctcccagtcccactgg

SEQ ID NO: 186896 - DNA, 75 bp, Artificial Sequence
  Synthetic
tactttctatagtgaacagaattaggcagggatactcaccattctcgtttcagacccacctcccagtcccaccgg

SEQ ID NO: 186897 - DNA, 75 bp, Artificial Sequence
  Synthetic
tactttctatagtgaacagaattaggcagggatactcaccattctcgtttcagacccacctcccagtcccacggg

SEQ ID NO: 186898 - DNA, 75 bp, Artificial Sequence
  Synthetic
tactttctatagtgaagagaattaggcagggatactcaccattctcgtttcagacccacctcccagtcccacagg

SEQ ID NO: 186899 - DNA, 75 bp, Artificial Sequence
  Synthetic
tactttctatagtgaagagaattaggcagggatactcaccattctcgtttcagacccacctcccagtcccactgg

SEQ ID NO: 186900 - DNA, 75 bp, Artificial Sequence
  Synthetic
tactttctatagtgaagagaattaggcagggatactcaccattctcgtttcagacccacctcccagtcccaccgg

SEQ ID NO: 186901 - DNA, 75 bp, Artificial Sequence
  Synthetic
tactttctatagtgaagagaattaggcagggatactcaccattctcgtttcagacccacctcccagtcccacggg

SEQ ID NO: 186902 - DNA, 75 bp, Artificial Sequence
  Synthetic
caacaactgggcaaatgaaaccaccctacttaatattaccacagggatgagaaattgctctttcaatataaccac

SEQ ID NO: 186903 - DNA, 75 bp, Artificial Sequence
  Synthetic
gaaattgctctttcaatataaccacaatgctaaaagataagaaaaagaaacagtatgcacttttctatagagaag

SEQ ID NO: 186904 - DNA, 75 bp, Artificial Sequence
  Synthetic
ctcaagtattggtggaatctcctgcagtattggagtcaggaactaaagaatagtgctgttaacttgcttaatgca

SEQ ID NO: 186905 - DNA, 75 bp, Artificial Sequence
  Synthetic
ctcaagtattggtggaatctcctgcagtattggagtcaggaactaaagaatagtgctgttaacttgcttaatgct

SEQ ID NO: 186906 - DNA, 75 bp, Artificial Sequence
  Synthetic
ctcaagtattggtggaatctcctgcagtattggagtcaggaactaaagaatagtgctgttaacttgcttaatgcc

SEQ ID NO: 186907 - DNA, 75 bp, Artificial Sequence
  Synthetic
ctcaagtattggtggaatctcctgcagtattggagtcaggaactaaagaatagtgctgttaacttgcttaatgcg

SEQ ID NO: 186908 - DNA, 75 bp, Artificial Sequence
  Synthetic
ctcaagtattggtggaatctcctgcagtattggagtcaggaactaaagaatagtgctgttatcttgcttaatgca

SEQ ID NO: 186909 - DNA, 75 bp, Artificial Sequence
  Synthetic
ctcaagtattggtggaatctcctgcagtattggagtcaggaactaaagaatagtgctgttatcttgcttaatgct

SEQ ID NO: 186910 - DNA, 75 bp, Artificial Sequence
  Synthetic
ctcaagtattggtggaatctcctgcagtattggagtcaggaactaaagaatagtgctgttatcttgcttaatgcc

SEQ ID NO: 186911 - DNA, 75 bp, Artificial Sequence
  Synthetic
ctcaagtattggtggaatctcctgcagtattggagtcaggaactaaagaatagtgctgttatcttgcttaatgcg

SEQ ID NO: 186912 - DNA, 75 bp, Artificial Sequence
  Synthetic
ctcaagtattggtggaatctcctgcagtattggagtcaggaactaaagaatagtgctgttaccttgcttaatgca

SEQ ID NO: 186913 - DNA, 75 bp, Artificial Sequence
  Synthetic
ctcaagtattggtggaatctcctgcagtattggagtcaggaactaaagaatagtgctgttaccttgcttaatgct

SEQ ID NO: 186914 - DNA, 75 bp, Artificial Sequence
  Synthetic
ctcaagtattggtggaatctcctgcagtattggagtcaggaactaaagaatagtgctgttaccttgcttaatgcc

SEQ ID NO: 186915 - DNA, 75 bp, Artificial Sequence
  Synthetic
ctcaagtattggtggaatctcctgcagtattggagtcaggaactaaagaatagtgctgttaccttgcttaatgcg

SEQ ID NO: 186916 - DNA, 75 bp, Artificial Sequence
  Synthetic
ctcaagtattggtggaatctcctgcagtattggagtcaggaactaaagaatagtgctgttagcttgcttaatgca

SEQ ID NO: 186917 - DNA, 75 bp, Artificial Sequence
  Synthetic
ctcaagtattggtggaatctcctgcagtattggagtcaggaactaaagaatagtgctgttagcttgcttaatgct

SEQ ID NO: 186918 - DNA, 75 bp, Artificial Sequence
  Synthetic
ctcaagtattggtggaatctcctgcagtattggagtcaggaactaaagaatagtgctgttagcttgcttaatgcc

SEQ ID NO: 186919 - DNA, 75 bp, Artificial Sequence
  Synthetic
ctcaagtattggtggaatctcctgcagtattggagtcaggaactaaagaatagtgctgttagcttgcttaatgcg

SEQ ID NO: 186920 - DNA, 75 bp, Artificial Sequence
  Synthetic
ctcaagtattggtggaatctcctgcagtattggagtcaggaactaatgaatagtgctgttaacttgcttaatgca

SEQ ID NO: 186921 - DNA, 75 bp, Artificial Sequence
  Synthetic
ctcaagtattggtggaatctcctgcagtattggagtcaggaactaatgaatagtgctgttaacttgcttaatgct

SEQ ID NO: 186922 - DNA, 75 bp, Artificial Sequence
  Synthetic
ctcaagtattggtggaatctcctgcagtattggagtcaggaactaatgaatagtgctgttaacttgcttaatgcc

SEQ ID NO: 186923 - DNA, 75 bp, Artificial Sequence
  Synthetic
ctcaagtattggtggaatctcctgcagtattggagtcaggaactaatgaatagtgctgttaacttgcttaatgcg

SEQ ID NO: 186924 - DNA, 75 bp, Artificial Sequence
  Synthetic
ctcaagtattggtggaatctcctgcagtattggagtcaggaactaatgaatagtgctgttatcttgcttaatgca

SEQ ID NO: 186925 - DNA, 75 bp, Artificial Sequence
  Synthetic
ctcaagtattggtggaatctcctgcagtattggagtcaggaactaatgaatagtgctgttatcttgcttaatgct

SEQ ID NO: 186926 - DNA, 75 bp, Artificial Sequence
  Synthetic
ctcaagtattggtggaatctcctgcagtattggagtcaggaactaatgaatagtgctgttatcttgcttaatgcc

SEQ ID NO: 186927 - DNA, 75 bp, Artificial Sequence
  Synthetic
ctcaagtattggtggaatctcctgcagtattggagtcaggaactaatgaatagtgctgttatcttgcttaatgcg

SEQ ID NO: 186928 - DNA, 75 bp, Artificial Sequence
  Synthetic
ctcaagtattggtggaatctcctgcagtattggagtcaggaactaatgaatagtgctgttaccttgcttaatgca

SEQ ID NO: 186929 - DNA, 75 bp, Artificial Sequence
  Synthetic
ctcaagtattggtggaatctcctgcagtattggagtcaggaactaatgaatagtgctgttaccttgcttaatgct

SEQ ID NO: 186930 - DNA, 75 bp, Artificial Sequence
  Synthetic
ctcaagtattggtggaatctcctgcagtattggagtcaggaactaatgaatagtgctgttaccttgcttaatgcc

SEQ ID NO: 186931 - DNA, 75 bp, Artificial Sequence
  Synthetic
ctcaagtattggtggaatctcctgcagtattggagtcaggaactaatgaatagtgctgttaccttgcttaatgcg

SEQ ID NO: 186932 - DNA, 75 bp, Artificial Sequence
  Synthetic
ctcaagtattggtggaatctcctgcagtattggagtcaggaactaatgaatagtgctgttagcttgcttaatgca

SEQ ID NO: 186933 - DNA, 75 bp, Artificial Sequence
  Synthetic
ctcaagtattggtggaatctcctgcagtattggagtcaggaactaatgaatagtgctgttagcttgcttaatgct

SEQ ID NO: 186934 - DNA, 75 bp, Artificial Sequence
  Synthetic
ctcaagtattggtggaatctcctgcagtattggagtcaggaactaatgaatagtgctgttagcttgcttaatgcc

SEQ ID NO: 186935 - DNA, 75 bp, Artificial Sequence
  Synthetic
ctcaagtattggtggaatctcctgcagtattggagtcaggaactaatgaatagtgctgttagcttgcttaatgcg

SEQ ID NO: 186936 - DNA, 75 bp, Artificial Sequence
  Synthetic
ctcaagtattggtggaatctcctgcagtattggagtcaggaactaacgaatagtgctgttaacttgcttaatgca

SEQ ID NO: 186937 - DNA, 75 bp, Artificial Sequence
  Synthetic
ctcaagtattggtggaatctcctgcagtattggagtcaggaactaacgaatagtgctgttaacttgcttaatgct

SEQ ID NO: 186938 - DNA, 75 bp, Artificial Sequence
  Synthetic
ctcaagtattggtggaatctcctgcagtattggagtcaggaactaacgaatagtgctgttaacttgcttaatgcc

SEQ ID NO: 186939 - DNA, 75 bp, Artificial Sequence
  Synthetic
ctcaagtattggtggaatctcctgcagtattggagtcaggaactaacgaatagtgctgttaacttgcttaatgcg

SEQ ID NO: 186940 - DNA, 75 bp, Artificial Sequence
  Synthetic
ctcaagtattggtggaatctcctgcagtattggagtcaggaactaacgaatagtgctgttatcttgcttaatgca

SEQ ID NO: 186941 - DNA, 75 bp, Artificial Sequence
  Synthetic
ctcaagtattggtggaatctcctgcagtattggagtcaggaactaacgaatagtgctgttatcttgcttaatgct

SEQ ID NO: 186942 - DNA, 75 bp, Artificial Sequence
  Synthetic
ctcaagtattggtggaatctcctgcagtattggagtcaggaactaacgaatagtgctgttatcttgcttaatgcc

SEQ ID NO: 186943 - DNA, 75 bp, Artificial Sequence
  Synthetic
ctcaagtattggtggaatctcctgcagtattggagtcaggaactaacgaatagtgctgttatcttgcttaatgcg

SEQ ID NO: 186944 - DNA, 75 bp, Artificial Sequence
  Synthetic
ctcaagtattggtggaatctcctgcagtattggagtcaggaactaacgaatagtgctgttaccttgcttaatgca

SEQ ID NO: 186945 - DNA, 75 bp, Artificial Sequence
  Synthetic
ctcaagtattggtggaatctcctgcagtattggagtcaggaactaacgaatagtgctgttaccttgcttaatgct

SEQ ID NO: 186946 - DNA, 75 bp, Artificial Sequence
  Synthetic
ctcaagtattggtggaatctcctgcagtattggagtcaggaactaacgaatagtgctgttaccttgcttaatgcc

SEQ ID NO: 186947 - DNA, 75 bp, Artificial Sequence
  Synthetic
ctcaagtattggtggaatctcctgcagtattggagtcaggaactaacgaatagtgctgttaccttgcttaatgcg

SEQ ID NO: 186948 - DNA, 75 bp, Artificial Sequence
  Synthetic
ctcaagtattggtggaatctcctgcagtattggagtcaggaactaacgaatagtgctgttagcttgcttaatgca

SEQ ID NO: 186949 - DNA, 75 bp, Artificial Sequence
  Synthetic
ctcaagtattggtggaatctcctgcagtattggagtcaggaactaacgaatagtgctgttagcttgcttaatgct

SEQ ID NO: 186950 - DNA, 75 bp, Artificial Sequence
  Synthetic
ctcaagtattggtggaatctcctgcagtattggagtcaggaactaacgaatagtgctgttagcttgcttaatgcc

SEQ ID NO: 186951 - DNA, 75 bp, Artificial Sequence
  Synthetic
ctcaagtattggtggaatctcctgcagtattggagtcaggaactaacgaatagtgctgttagcttgcttaatgcg

SEQ ID NO: 186952 - DNA, 75 bp, Artificial Sequence
  Synthetic
ctcaagtattggtggaatctcctgcagtattggagtcaggaactaaggaatagtgctgttaacttgcttaatgca

SEQ ID NO: 186953 - DNA, 75 bp, Artificial Sequence
  Synthetic
ctcaagtattggtggaatctcctgcagtattggagtcaggaactaaggaatagtgctgttaacttgcttaatgct

SEQ ID NO: 186954 - DNA, 75 bp, Artificial Sequence
  Synthetic
ctcaagtattggtggaatctcctgcagtattggagtcaggaactaaggaatagtgctgttaacttgcttaatgcc

SEQ ID NO: 186955 - DNA, 75 bp, Artificial Sequence
  Synthetic
ctcaagtattggtggaatctcctgcagtattggagtcaggaactaaggaatagtgctgttaacttgcttaatgcg

SEQ ID NO: 186956 - DNA, 75 bp, Artificial Sequence
  Synthetic
ctcaagtattggtggaatctcctgcagtattggagtcaggaactaaggaatagtgctgttatcttgcttaatgca

SEQ ID NO: 186957 - DNA, 75 bp, Artificial Sequence
  Synthetic
ctcaagtattggtggaatctcctgcagtattggagtcaggaactaaggaatagtgctgttatcttgcttaatgct

SEQ ID NO: 186958 - DNA, 75 bp, Artificial Sequence
  Synthetic
ctcaagtattggtggaatctcctgcagtattggagtcaggaactaaggaatagtgctgttatcttgcttaatgcc

SEQ ID NO: 186959 - DNA, 75 bp, Artificial Sequence
  Synthetic
ctcaagtattggtggaatctcctgcagtattggagtcaggaactaaggaatagtgctgttatcttgcttaatgcg

SEQ ID NO: 186960 - DNA, 75 bp, Artificial Sequence
  Synthetic
ctcaagtattggtggaatctcctgcagtattggagtcaggaactaaggaatagtgctgttaccttgcttaatgca

SEQ ID NO: 186961 - DNA, 75 bp, Artificial Sequence
  Synthetic
ctcaagtattggtggaatctcctgcagtattggagtcaggaactaaggaatagtgctgttaccttgcttaatgct

SEQ ID NO: 186962 - DNA, 75 bp, Artificial Sequence
  Synthetic
ctcaagtattggtggaatctcctgcagtattggagtcaggaactaaggaatagtgctgttaccttgcttaatgcc

SEQ ID NO: 186963 - DNA, 75 bp, Artificial Sequence
  Synthetic
ctcaagtattggtggaatctcctgcagtattggagtcaggaactaaggaatagtgctgttaccttgcttaatgcg

SEQ ID NO: 186964 - DNA, 75 bp, Artificial Sequence
  Synthetic
ctcaagtattggtggaatctcctgcagtattggagtcaggaactaaggaatagtgctgttagcttgcttaatgca

SEQ ID NO: 186965 - DNA, 75 bp, Artificial Sequence
  Synthetic
ctcaagtattggtggaatctcctgcagtattggagtcaggaactaaggaatagtgctgttagcttgcttaatgct

SEQ ID NO: 186966 - DNA, 75 bp, Artificial Sequence
  Synthetic
ctcaagtattggtggaatctcctgcagtattggagtcaggaactaaggaatagtgctgttagcttgcttaatgcc

SEQ ID NO: 186967 - DNA, 75 bp, Artificial Sequence
  Synthetic
ctcaagtattggtggaatctcctgcagtattggagtcaggaactaaggaatagtgctgttagcttgcttaatgcg

SEQ ID NO: 186968 - DNA, 75 bp, Artificial Sequence
  Synthetic
agagacttcatcttgattgtagcgaggactgtggaactgggactgagactggggtggaagggcattcaatacttg

SEQ ID NO: 186969 - DNA, 75 bp, Artificial Sequence
  Synthetic
tagaaagggctctgctataagataggtggcaaatggtcaaaacctagtgtgagaggataggctattaaaaaggaa

SEQ ID NO: 186970 - DNA, 75 bp, Artificial Sequence
  Synthetic
tagaaagggctctgctataagataggtggcaaatggtcaaaacctagtgtgagaggataggctattataaaggaa

SEQ ID NO: 186971 - DNA, 75 bp, Artificial Sequence
  Synthetic
tagaaagggctctgctataagataggtggcaaatggtcaaaacctagtgtgagaggataggctattacaaaggaa

SEQ ID NO: 186972 - DNA, 75 bp, Artificial Sequence
  Synthetic
tagaaagggctctgctataagataggtggcaaatggtcaaaacctagtgtgagaggataggctattagaaaggaa

SEQ ID NO: 186973 - DNA, 75 bp, Artificial Sequence
  Synthetic
ttgaaagggctctgctataagataggtggcaaatggtcaaaacctagtgtgagaggataggctattaaaaaggaa

SEQ ID NO: 186974 - DNA, 75 bp, Artificial Sequence
  Synthetic
ttgaaagggctctgctataagataggtggcaaatggtcaaaacctagtgtgagaggataggctattataaaggaa

SEQ ID NO: 186975 - DNA, 75 bp, Artificial Sequence
  Synthetic
ttgaaagggctctgctataagataggtggcaaatggtcaaaacctagtgtgagaggataggctattacaaaggaa

SEQ ID NO: 186976 - DNA, 75 bp, Artificial Sequence
  Synthetic
ttgaaagggctctgctataagataggtggcaaatggtcaaaacctagtgtgagaggataggctattagaaaggaa

SEQ ID NO: 186977 - DNA, 75 bp, Artificial Sequence
  Synthetic
tcgaaagggctctgctataagataggtggcaaatggtcaaaacctagtgtgagaggataggctattaaaaaggaa

SEQ ID NO: 186978 - DNA, 75 bp, Artificial Sequence
  Synthetic
tcgaaagggctctgctataagataggtggcaaatggtcaaaacctagtgtgagaggataggctattataaaggaa

SEQ ID NO: 186979 - DNA, 75 bp, Artificial Sequence
  Synthetic
tcgaaagggctctgctataagataggtggcaaatggtcaaaacctagtgtgagaggataggctattacaaaggaa

SEQ ID NO: 186980 - DNA, 75 bp, Artificial Sequence
  Synthetic
tcgaaagggctctgctataagataggtggcaaatggtcaaaacctagtgtgagaggataggctattagaaaggaa

SEQ ID NO: 186981 - DNA, 75 bp, Artificial Sequence
  Synthetic
tggaaagggctctgctataagataggtggcaaatggtcaaaacctagtgtgagaggataggctattaaaaaggaa

SEQ ID NO: 186982 - DNA, 75 bp, Artificial Sequence
  Synthetic
tggaaagggctctgctataagataggtggcaaatggtcaaaacctagtgtgagaggataggctattataaaggaa

SEQ ID NO: 186983 - DNA, 75 bp, Artificial Sequence
  Synthetic
tggaaagggctctgctataagataggtggcaaatggtcaaaacctagtgtgagaggataggctattacaaaggaa

SEQ ID NO: 186984 - DNA, 75 bp, Artificial Sequence
  Synthetic
tggaaagggctctgctataagataggtggcaaatggtcaaaacctagtgtgagaggataggctattagaaaggaa

SEQ ID NO: 186985 - DNA, 75 bp, Artificial Sequence
  Synthetic
tgcgacagagaagagcaagaaatggagccagtagatcctaacctagagccctggaatcatccaggaagtcagcct

SEQ ID NO: 186986 - DNA, 75 bp, Artificial Sequence
  Synthetic
taagaatagtttttactgtactttctatagtgaatagagttaggcagggatactcaccattatcgtttcagaccc

SEQ ID NO: 186987 - DNA, 75 bp, Artificial Sequence
  Synthetic
aaaatgagacgagctgagccagcagcagaagaggtaggagcagcttctcgagacctggaaagacgtggagcaatc

SEQ ID NO: 186988 - DNA, 75 bp, Artificial Sequence
  Synthetic
cctttgagccaattcctatacattattgtgccccagctggttttgcgattctaaaatgtaatgaaaaagagttca

SEQ ID NO: 186989 - DNA, 75 bp, Artificial Sequence
  Synthetic
attacacaggcttgtccaaaggtatcctttgagccaattcctatacattattgtgccccagctggttttgcgatt

SEQ ID NO: 186990 - DNA, 75 bp, Artificial Sequence
  Synthetic
aaaagagataataattagatctggaaatatctcagacaatacaaagaacataatagtacagcttaatgaaactgt

SEQ ID NO: 186991 - DNA, 75 bp, Artificial Sequence
  Synthetic
gaactaaagaatagtgctgttagcttgcttaatgccacagctatagcagtagctgaggggacagataggattata

SEQ ID NO: 186992 - DNA, 75 bp, Artificial Sequence
  Synthetic
actcctacagcagcagcagcagaaggagtaggagcagtttctcgagatctagaaagacatggagcaatcacaagc

SEQ ID NO: 186993 - DNA, 75 bp, Artificial Sequence
  Synthetic
agacaggcgcattgtaatattactggagaaaactggaataagactttagaaggagtaaaggcaaaattacatgga

SEQ ID NO: 186994 - DNA, 75 bp, Artificial Sequence
  Synthetic
gaaatgaaaaactgttctttcaatatcaccacaagcataaggaataagatgcacaaagaatatgcacttttgtat

SEQ ID NO: 186995 - DNA, 75 bp, Artificial Sequence
  Synthetic
tagaaggattaatgacactggagaaaatggcacactcaaactcccatgcagtataaaacaaattataaacatggg

SEQ ID NO: 186996 - DNA, 75 bp, Artificial Sequence
  Synthetic
tagaaggattaatgacactggagaaaatggcacactcatactcccatgcagtataaaacaaattataaacatggg

SEQ ID NO: 186997 - DNA, 75 bp, Artificial Sequence
  Synthetic
tagaaggattaatgacactggagaaaatggcacactcacactcccatgcagtataaaacaaattataaacatggg

SEQ ID NO: 186998 - DNA, 75 bp, Artificial Sequence
  Synthetic
tagaaggattaatgacactggagaaaatggcacactcagactcccatgcagtataaaacaaattataaacatggg

SEQ ID NO: 186999 - DNA, 75 bp, Artificial Sequence
  Synthetic
tagaaggattaatgacactggagtaaatggcacactcaaactcccatgcagtataaaacaaattataaacatggg

SEQ ID NO: 187000 - DNA, 75 bp, Artificial Sequence
  Synthetic
tagaaggattaatgacactggagtaaatggcacactcatactcccatgcagtataaaacaaattataaacatggg

SEQ ID NO: 187001 - DNA, 75 bp, Artificial Sequence
  Synthetic
tagaaggattaatgacactggagtaaatggcacactcacactcccatgcagtataaaacaaattataaacatggg

SEQ ID NO: 187002 - DNA, 75 bp, Artificial Sequence
  Synthetic
tagaaggattaatgacactggagtaaatggcacactcagactcccatgcagtataaaacaaattataaacatggg

SEQ ID NO: 187003 - DNA, 75 bp, Artificial Sequence
  Synthetic
tagaaggattaatgacactggagcaaatggcacactcaaactcccatgcagtataaaacaaattataaacatggg

SEQ ID NO: 187004 - DNA, 75 bp, Artificial Sequence
  Synthetic
tagaaggattaatgacactggagcaaatggcacactcatactcccatgcagtataaaacaaattataaacatggg

SEQ ID NO: 187005 - DNA, 75 bp, Artificial Sequence
  Synthetic
tagaaggattaatgacactggagcaaatggcacactcacactcccatgcagtataaaacaaattataaacatggg

SEQ ID NO: 187006 - DNA, 75 bp, Artificial Sequence
  Synthetic
tagaaggattaatgacactggagcaaatggcacactcagactcccatgcagtataaaacaaattataaacatggg

SEQ ID NO: 187007 - DNA, 75 bp, Artificial Sequence
  Synthetic
tagaaggattaatgacactggaggaaatggcacactcaaactcccatgcagtataaaacaaattataaacatggg

SEQ ID NO: 187008 - DNA, 75 bp, Artificial Sequence
  Synthetic
tagaaggattaatgacactggaggaaatggcacactcatactcccatgcagtataaaacaaattataaacatggg

SEQ ID NO: 187009 - DNA, 75 bp, Artificial Sequence
  Synthetic
tagaaggattaatgacactggaggaaatggcacactcacactcccatgcagtataaaacaaattataaacatggg

SEQ ID NO: 187010 - DNA, 75 bp, Artificial Sequence
  Synthetic
tagaaggattaatgacactggaggaaatggcacactcagactcccatgcagtataaaacaaattataaacatggg

SEQ ID NO: 187011 - DNA, 75 bp, Artificial Sequence
  Synthetic
tagatggattaatgacactggagaaaatggcacactcaaactcccatgcagtataaaacaaattataaacatggg

SEQ ID NO: 187012 - DNA, 75 bp, Artificial Sequence
  Synthetic
tagatggattaatgacactggagaaaatggcacactcatactcccatgcagtataaaacaaattataaacatggg

SEQ ID NO: 187013 - DNA, 75 bp, Artificial Sequence
  Synthetic
tagatggattaatgacactggagaaaatggcacactcacactcccatgcagtataaaacaaattataaacatggg

SEQ ID NO: 187014 - DNA, 75 bp, Artificial Sequence
  Synthetic
tagatggattaatgacactggagaaaatggcacactcagactcccatgcagtataaaacaaattataaacatggg

SEQ ID NO: 187015 - DNA, 75 bp, Artificial Sequence
  Synthetic
tagatggattaatgacactggagtaaatggcacactcaaactcccatgcagtataaaacaaattataaacatggg

SEQ ID NO: 187016 - DNA, 75 bp, Artificial Sequence
  Synthetic
tagatggattaatgacactggagtaaatggcacactcatactcccatgcagtataaaacaaattataaacatggg

SEQ ID NO: 187017 - DNA, 75 bp, Artificial Sequence
  Synthetic
tagatggattaatgacactggagtaaatggcacactcacactcccatgcagtataaaacaaattataaacatggg

SEQ ID NO: 187018 - DNA, 75 bp, Artificial Sequence
  Synthetic
tagatggattaatgacactggagtaaatggcacactcagactcccatgcagtataaaacaaattataaacatggg

SEQ ID NO: 187019 - DNA, 75 bp, Artificial Sequence
  Synthetic
tagatggattaatgacactggagcaaatggcacactcaaactcccatgcagtataaaacaaattataaacatggg

SEQ ID NO: 187020 - DNA, 75 bp, Artificial Sequence
  Synthetic
tagatggattaatgacactggagcaaatggcacactcatactcccatgcagtataaaacaaattataaacatggg

SEQ ID NO: 187021 - DNA, 75 bp, Artificial Sequence
  Synthetic
tagatggattaatgacactggagcaaatggcacactcacactcccatgcagtataaaacaaattataaacatggg

SEQ ID NO: 187022 - DNA, 75 bp, Artificial Sequence
  Synthetic
tagatggattaatgacactggagcaaatggcacactcagactcccatgcagtataaaacaaattataaacatggg

SEQ ID NO: 187023 - DNA, 75 bp, Artificial Sequence
  Synthetic
tagatggattaatgacactggaggaaatggcacactcaaactcccatgcagtataaaacaaattataaacatggg

SEQ ID NO: 187024 - DNA, 75 bp, Artificial Sequence
  Synthetic
tagatggattaatgacactggaggaaatggcacactcatactcccatgcagtataaaacaaattataaacatggg

SEQ ID NO: 187025 - DNA, 75 bp, Artificial Sequence
  Synthetic
tagatggattaatgacactggaggaaatggcacactcacactcccatgcagtataaaacaaattataaacatggg

SEQ ID NO: 187026 - DNA, 75 bp, Artificial Sequence
  Synthetic
tagatggattaatgacactggaggaaatggcacactcagactcccatgcagtataaaacaaattataaacatggg

SEQ ID NO: 187027 - DNA, 75 bp, Artificial Sequence
  Synthetic
tagacggattaatgacactggagaaaatggcacactcaaactcccatgcagtataaaacaaattataaacatggg

SEQ ID NO: 187028 - DNA, 75 bp, Artificial Sequence
  Synthetic
tagacggattaatgacactggagaaaatggcacactcatactcccatgcagtataaaacaaattataaacatggg

SEQ ID NO: 187029 - DNA, 75 bp, Artificial Sequence
  Synthetic
tagacggattaatgacactggagaaaatggcacactcacactcccatgcagtataaaacaaattataaacatggg

SEQ ID NO: 187030 - DNA, 75 bp, Artificial Sequence
  Synthetic
tagacggattaatgacactggagaaaatggcacactcagactcccatgcagtataaaacaaattataaacatggg

SEQ ID NO: 187031 - DNA, 75 bp, Artificial Sequence
  Synthetic
tagacggattaatgacactggagtaaatggcacactcaaactcccatgcagtataaaacaaattataaacatggg

SEQ ID NO: 187032 - DNA, 75 bp, Artificial Sequence
  Synthetic
tagacggattaatgacactggagtaaatggcacactcatactcccatgcagtataaaacaaattataaacatggg

SEQ ID NO: 187033 - DNA, 75 bp, Artificial Sequence
  Synthetic
tagacggattaatgacactggagtaaatggcacactcacactcccatgcagtataaaacaaattataaacatggg

SEQ ID NO: 187034 - DNA, 75 bp, Artificial Sequence
  Synthetic
tagacggattaatgacactggagtaaatggcacactcagactcccatgcagtataaaacaaattataaacatggg

SEQ ID NO: 187035 - DNA, 75 bp, Artificial Sequence
  Synthetic
tagacggattaatgacactggagcaaatggcacactcaaactcccatgcagtataaaacaaattataaacatggg

SEQ ID NO: 187036 - DNA, 75 bp, Artificial Sequence
  Synthetic
tagacggattaatgacactggagcaaatggcacactcatactcccatgcagtataaaacaaattataaacatggg

SEQ ID NO: 187037 - DNA, 75 bp, Artificial Sequence
  Synthetic
tagacggattaatgacactggagcaaatggcacactcacactcccatgcagtataaaacaaattataaacatggg

SEQ ID NO: 187038 - DNA, 75 bp, Artificial Sequence
  Synthetic
tagacggattaatgacactggagcaaatggcacactcagactcccatgcagtataaaacaaattataaacatggg

SEQ ID NO: 187039 - DNA, 75 bp, Artificial Sequence
  Synthetic
tagacggattaatgacactggaggaaatggcacactcaaactcccatgcagtataaaacaaattataaacatggg

SEQ ID NO: 187040 - DNA, 75 bp, Artificial Sequence
  Synthetic
tagacggattaatgacactggaggaaatggcacactcatactcccatgcagtataaaacaaattataaacatggg

SEQ ID NO: 187041 - DNA, 75 bp, Artificial Sequence
  Synthetic
tagacggattaatgacactggaggaaatggcacactcacactcccatgcagtataaaacaaattataaacatggg

SEQ ID NO: 187042 - DNA, 75 bp, Artificial Sequence
  Synthetic
tagacggattaatgacactggaggaaatggcacactcagactcccatgcagtataaaacaaattataaacatggg

SEQ ID NO: 187043 - DNA, 75 bp, Artificial Sequence
  Synthetic
tagagggattaatgacactggagaaaatggcacactcaaactcccatgcagtataaaacaaattataaacatggg

SEQ ID NO: 187044 - DNA, 75 bp, Artificial Sequence
  Synthetic
tagagggattaatgacactggagaaaatggcacactcatactcccatgcagtataaaacaaattataaacatggg

SEQ ID NO: 187045 - DNA, 75 bp, Artificial Sequence
  Synthetic
tagagggattaatgacactggagaaaatggcacactcacactcccatgcagtataaaacaaattataaacatggg

SEQ ID NO: 187046 - DNA, 75 bp, Artificial Sequence
  Synthetic
tagagggattaatgacactggagaaaatggcacactcagactcccatgcagtataaaacaaattataaacatggg

SEQ ID NO: 187047 - DNA, 75 bp, Artificial Sequence
  Synthetic
tagagggattaatgacactggagtaaatggcacactcaaactcccatgcagtataaaacaaattataaacatggg

SEQ ID NO: 187048 - DNA, 75 bp, Artificial Sequence
  Synthetic
tagagggattaatgacactggagtaaatggcacactcatactcccatgcagtataaaacaaattataaacatggg

SEQ ID NO: 187049 - DNA, 75 bp, Artificial Sequence
  Synthetic
tagagggattaatgacactggagtaaatggcacactcacactcccatgcagtataaaacaaattataaacatggg

SEQ ID NO: 187050 - DNA, 75 bp, Artificial Sequence
  Synthetic
tagagggattaatgacactggagtaaatggcacactcagactcccatgcagtataaaacaaattataaacatggg

SEQ ID NO: 187051 - DNA, 75 bp, Artificial Sequence
  Synthetic
tagagggattaatgacactggagcaaatggcacactcaaactcccatgcagtataaaacaaattataaacatggg

SEQ ID NO: 187052 - DNA, 75 bp, Artificial Sequence
  Synthetic
tagagggattaatgacactggagcaaatggcacactcatactcccatgcagtataaaacaaattataaacatggg

SEQ ID NO: 187053 - DNA, 75 bp, Artificial Sequence
  Synthetic
tagagggattaatgacactggagcaaatggcacactcacactcccatgcagtataaaacaaattataaacatggg

SEQ ID NO: 187054 - DNA, 75 bp, Artificial Sequence
  Synthetic
tagagggattaatgacactggagcaaatggcacactcagactcccatgcagtataaaacaaattataaacatggg

SEQ ID NO: 187055 - DNA, 75 bp, Artificial Sequence
  Synthetic
tagagggattaatgacactggaggaaatggcacactcaaactcccatgcagtataaaacaaattataaacatggg

SEQ ID NO: 187056 - DNA, 75 bp, Artificial Sequence
  Synthetic
tagagggattaatgacactggaggaaatggcacactcatactcccatgcagtataaaacaaattataaacatggg

SEQ ID NO: 187057 - DNA, 75 bp, Artificial Sequence
  Synthetic
tagagggattaatgacactggaggaaatggcacactcacactcccatgcagtataaaacaaattataaacatggg

SEQ ID NO: 187058 - DNA, 75 bp, Artificial Sequence
  Synthetic
tagagggattaatgacactggaggaaatggcacactcagactcccatgcagtataaaacaaattataaacatggg

SEQ ID NO: 187059 - DNA, 75 bp, Artificial Sequence
  Synthetic
tcctagggatttggggatgctctggaaaactcatctgcaccactaatgtgccttagaatgctagttggagtaata

SEQ ID NO: 187060 - DNA, 75 bp, Artificial Sequence
  Synthetic
tcctagggatttggggatgctctggaaaactcatctgcaccactaatgtgcctttgaatgctagttggagtaata

SEQ ID NO: 187061 - DNA, 75 bp, Artificial Sequence
  Synthetic
tcctagggatttggggatgctctggaaaactcatctgcaccactaatgtgccttcgaatgctagttggagtaata

SEQ ID NO: 187062 - DNA, 75 bp, Artificial Sequence
  Synthetic
tcctagggatttggggatgctctggaaaactcatctgcaccactaatgtgccttggaatgctagttggagtaata

SEQ ID NO: 187063 - DNA, 75 bp, Artificial Sequence
  Synthetic
tcctagggatttggggatgctctggaaaactcatctgctccactaatgtgccttagaatgctagttggagtaata

SEQ ID NO: 187064 - DNA, 75 bp, Artificial Sequence
  Synthetic
tcctagggatttggggatgctctggaaaactcatctgctccactaatgtgcctttgaatgctagttggagtaata

SEQ ID NO: 187065 - DNA, 75 bp, Artificial Sequence
  Synthetic
tcctagggatttggggatgctctggaaaactcatctgctccactaatgtgccttcgaatgctagttggagtaata

SEQ ID NO: 187066 - DNA, 75 bp, Artificial Sequence
  Synthetic
tcctagggatttggggatgctctggaaaactcatctgctccactaatgtgccttggaatgctagttggagtaata

SEQ ID NO: 187067 - DNA, 75 bp, Artificial Sequence
  Synthetic
tcctagggatttggggatgctctggaaaactcatctgccccactaatgtgccttagaatgctagttggagtaata

SEQ ID NO: 187068 - DNA, 75 bp, Artificial Sequence
  Synthetic
tcctagggatttggggatgctctggaaaactcatctgccccactaatgtgcctttgaatgctagttggagtaata

SEQ ID NO: 187069 - DNA, 75 bp, Artificial Sequence
  Synthetic
tcctagggatttggggatgctctggaaaactcatctgccccactaatgtgccttcgaatgctagttggagtaata

SEQ ID NO: 187070 - DNA, 75 bp, Artificial Sequence
  Synthetic
tcctagggatttggggatgctctggaaaactcatctgccccactaatgtgccttggaatgctagttggagtaata

SEQ ID NO: 187071 - DNA, 75 bp, Artificial Sequence
  Synthetic
tcctagggatttggggatgctctggaaaactcatctgcgccactaatgtgccttagaatgctagttggagtaata

SEQ ID NO: 187072 - DNA, 75 bp, Artificial Sequence
  Synthetic
tcctagggatttggggatgctctggaaaactcatctgcgccactaatgtgcctttgaatgctagttggagtaata

SEQ ID NO: 187073 - DNA, 75 bp, Artificial Sequence
  Synthetic
tcctagggatttggggatgctctggaaaactcatctgcgccactaatgtgccttcgaatgctagttggagtaata

SEQ ID NO: 187074 - DNA, 75 bp, Artificial Sequence
  Synthetic
tcctagggatttggggatgctctggaaaactcatctgcgccactaatgtgccttggaatgctagttggagtaata

SEQ ID NO: 187075 - DNA, 75 bp, Artificial Sequence
  Synthetic
tcctagggatttggggttgctctggaaaactcatctgcaccactaatgtgccttagaatgctagttggagtaata

SEQ ID NO: 187076 - DNA, 75 bp, Artificial Sequence
  Synthetic
tcctagggatttggggttgctctggaaaactcatctgcaccactaatgtgcctttgaatgctagttggagtaata

SEQ ID NO: 187077 - DNA, 75 bp, Artificial Sequence
  Synthetic
tcctagggatttggggttgctctggaaaactcatctgcaccactaatgtgccttcgaatgctagttggagtaata

SEQ ID NO: 187078 - DNA, 75 bp, Artificial Sequence
  Synthetic
tcctagggatttggggttgctctggaaaactcatctgcaccactaatgtgccttggaatgctagttggagtaata

SEQ ID NO: 187079 - DNA, 75 bp, Artificial Sequence
  Synthetic
tcctagggatttggggttgctctggaaaactcatctgctccactaatgtgccttagaatgctagttggagtaata

SEQ ID NO: 187080 - DNA, 75 bp, Artificial Sequence
  Synthetic
tcctagggatttggggttgctctggaaaactcatctgctccactaatgtgcctttgaatgctagttggagtaata

SEQ ID NO: 187081 - DNA, 75 bp, Artificial Sequence
  Synthetic
tcctagggatttggggttgctctggaaaactcatctgctccactaatgtgccttcgaatgctagttggagtaata

SEQ ID NO: 187082 - DNA, 75 bp, Artificial Sequence
  Synthetic
tcctagggatttggggttgctctggaaaactcatctgctccactaatgtgccttggaatgctagttggagtaata

SEQ ID NO: 187083 - DNA, 75 bp, Artificial Sequence
  Synthetic
tcctagggatttggggttgctctggaaaactcatctgccccactaatgtgccttagaatgctagttggagtaata

SEQ ID NO: 187084 - DNA, 75 bp, Artificial Sequence
  Synthetic
tcctagggatttggggttgctctggaaaactcatctgccccactaatgtgcctttgaatgctagttggagtaata

SEQ ID NO: 187085 - DNA, 75 bp, Artificial Sequence
  Synthetic
tcctagggatttggggttgctctggaaaactcatctgccccactaatgtgccttcgaatgctagttggagtaata

SEQ ID NO: 187086 - DNA, 75 bp, Artificial Sequence
  Synthetic
tcctagggatttggggttgctctggaaaactcatctgccccactaatgtgccttggaatgctagttggagtaata

SEQ ID NO: 187087 - DNA, 75 bp, Artificial Sequence
  Synthetic
tcctagggatttggggttgctctggaaaactcatctgcgccactaatgtgccttagaatgctagttggagtaata

SEQ ID NO: 187088 - DNA, 75 bp, Artificial Sequence
  Synthetic
tcctagggatttggggttgctctggaaaactcatctgcgccactaatgtgcctttgaatgctagttggagtaata

SEQ ID NO: 187089 - DNA, 75 bp, Artificial Sequence
  Synthetic
tcctagggatttggggttgctctggaaaactcatctgcgccactaatgtgccttcgaatgctagttggagtaata

SEQ ID NO: 187090 - DNA, 75 bp, Artificial Sequence
  Synthetic
tcctagggatttggggttgctctggaaaactcatctgcgccactaatgtgccttggaatgctagttggagtaata

SEQ ID NO: 187091 - DNA, 75 bp, Artificial Sequence
  Synthetic
tcctagggatttggggctgctctggaaaactcatctgcaccactaatgtgccttagaatgctagttggagtaata

SEQ ID NO: 187092 - DNA, 75 bp, Artificial Sequence
  Synthetic
tcctagggatttggggctgctctggaaaactcatctgcaccactaatgtgcctttgaatgctagttggagtaata

SEQ ID NO: 187093 - DNA, 75 bp, Artificial Sequence
  Synthetic
tcctagggatttggggctgctctggaaaactcatctgcaccactaatgtgccttcgaatgctagttggagtaata

SEQ ID NO: 187094 - DNA, 75 bp, Artificial Sequence
  Synthetic
tcctagggatttggggctgctctggaaaactcatctgcaccactaatgtgccttggaatgctagttggagtaata

SEQ ID NO: 187095 - DNA, 75 bp, Artificial Sequence
  Synthetic
tcctagggatttggggctgctctggaaaactcatctgctccactaatgtgccttagaatgctagttggagtaata

SEQ ID NO: 187096 - DNA, 75 bp, Artificial Sequence
  Synthetic
tcctagggatttggggctgctctggaaaactcatctgctccactaatgtgcctttgaatgctagttggagtaata

SEQ ID NO: 187097 - DNA, 75 bp, Artificial Sequence
  Synthetic
tcctagggatttggggctgctctggaaaactcatctgctccactaatgtgccttcgaatgctagttggagtaata

SEQ ID NO: 187098 - DNA, 75 bp, Artificial Sequence
  Synthetic
tcctagggatttggggctgctctggaaaactcatctgctccactaatgtgccttggaatgctagttggagtaata

SEQ ID NO: 187099 - DNA, 75 bp, Artificial Sequence
  Synthetic
tcctagggatttggggctgctctggaaaactcatctgccccactaatgtgccttagaatgctagttggagtaata

SEQ ID NO: 187100 - DNA, 75 bp, Artificial Sequence
  Synthetic
tcctagggatttggggctgctctggaaaactcatctgccccactaatgtgcctttgaatgctagttggagtaata

SEQ ID NO: 187101 - DNA, 75 bp, Artificial Sequence
  Synthetic
tcctagggatttggggctgctctggaaaactcatctgccccactaatgtgccttcgaatgctagttggagtaata

SEQ ID NO: 187102 - DNA, 75 bp, Artificial Sequence
  Synthetic
tcctagggatttggggctgctctggaaaactcatctgccccactaatgtgccttggaatgctagttggagtaata

SEQ ID NO: 187103 - DNA, 75 bp, Artificial Sequence
  Synthetic
tcctagggatttggggctgctctggaaaactcatctgcgccactaatgtgccttagaatgctagttggagtaata

SEQ ID NO: 187104 - DNA, 75 bp, Artificial Sequence
  Synthetic
tcctagggatttggggctgctctggaaaactcatctgcgccactaatgtgcctttgaatgctagttggagtaata

SEQ ID NO: 187105 - DNA, 75 bp, Artificial Sequence
  Synthetic
tcctagggatttggggctgctctggaaaactcatctgcgccactaatgtgccttcgaatgctagttggagtaata

SEQ ID NO: 187106 - DNA, 75 bp, Artificial Sequence
  Synthetic
tcctagggatttggggctgctctggaaaactcatctgcgccactaatgtgccttggaatgctagttggagtaata

SEQ ID NO: 187107 - DNA, 75 bp, Artificial Sequence
  Synthetic
tcctagggatttgggggtgctctggaaaactcatctgcaccactaatgtgccttagaatgctagttggagtaata

SEQ ID NO: 187108 - DNA, 75 bp, Artificial Sequence
  Synthetic
tcctagggatttgggggtgctctggaaaactcatctgcaccactaatgtgcctttgaatgctagttggagtaata

SEQ ID NO: 187109 - DNA, 75 bp, Artificial Sequence
  Synthetic
tcctagggatttgggggtgctctggaaaactcatctgcaccactaatgtgccttcgaatgctagttggagtaata

SEQ ID NO: 187110 - DNA, 75 bp, Artificial Sequence
  Synthetic
tcctagggatttgggggtgctctggaaaactcatctgcaccactaatgtgccttggaatgctagttggagtaata

SEQ ID NO: 187111 - DNA, 75 bp, Artificial Sequence
  Synthetic
tcctagggatttgggggtgctctggaaaactcatctgctccactaatgtgccttagaatgctagttggagtaata

SEQ ID NO: 187112 - DNA, 75 bp, Artificial Sequence
  Synthetic
tcctagggatttgggggtgctctggaaaactcatctgctccactaatgtgcctttgaatgctagttggagtaata

SEQ ID NO: 187113 - DNA, 75 bp, Artificial Sequence
  Synthetic
tcctagggatttgggggtgctctggaaaactcatctgctccactaatgtgccttcgaatgctagttggagtaata

SEQ ID NO: 187114 - DNA, 75 bp, Artificial Sequence
  Synthetic
tcctagggatttgggggtgctctggaaaactcatctgctccactaatgtgccttggaatgctagttggagtaata

SEQ ID NO: 187115 - DNA, 75 bp, Artificial Sequence
  Synthetic
tcctagggatttgggggtgctctggaaaactcatctgccccactaatgtgccttagaatgctagttggagtaata

SEQ ID NO: 187116 - DNA, 75 bp, Artificial Sequence
  Synthetic
tcctagggatttgggggtgctctggaaaactcatctgccccactaatgtgcctttgaatgctagttggagtaata

SEQ ID NO: 187117 - DNA, 75 bp, Artificial Sequence
  Synthetic
tcctagggatttgggggtgctctggaaaactcatctgccccactaatgtgccttcgaatgctagttggagtaata

SEQ ID NO: 187118 - DNA, 75 bp, Artificial Sequence
  Synthetic
tcctagggatttgggggtgctctggaaaactcatctgccccactaatgtgccttggaatgctagttggagtaata

SEQ ID NO: 187119 - DNA, 75 bp, Artificial Sequence
  Synthetic
tcctagggatttgggggtgctctggaaaactcatctgcgccactaatgtgccttagaatgctagttggagtaata

SEQ ID NO: 187120 - DNA, 75 bp, Artificial Sequence
  Synthetic
tcctagggatttgggggtgctctggaaaactcatctgcgccactaatgtgcctttgaatgctagttggagtaata

SEQ ID NO: 187121 - DNA, 75 bp, Artificial Sequence
  Synthetic
tcctagggatttgggggtgctctggaaaactcatctgcgccactaatgtgccttcgaatgctagttggagtaata

SEQ ID NO: 187122 - DNA, 75 bp, Artificial Sequence
  Synthetic
tcctagggatttgggggtgctctggaaaactcatctgcgccactaatgtgccttggaatgctagttggagtaata

SEQ ID NO: 187123 - DNA, 75 bp, Artificial Sequence
  Synthetic
atacaacacgactgtttaatgacacattaaaccacaccatcgaccaaaatatcacactcccatgtaaaataaaac

SEQ ID NO: 187124 - DNA, 75 bp, Artificial Sequence
  Synthetic
gtaccagactcggcaacaacacaagaagaagtatccgtataggaccaggacaatcattccatgcaacaggtgcga

SEQ ID NO: 187125 - DNA, 75 bp, Artificial Sequence
  Synthetic
atcacactcccatgtaaaataaaacagattataaacaggtggcagggagtgggccaagcaatgtatgcccctccc

SEQ ID NO: 187126 - DNA, 75 bp, Artificial Sequence
  Synthetic
aagaagtatccgtataggaccaggacaatcattccatgcaacaggtgcgataataggaaacataaggcaagctca

SEQ ID NO: 187127 - DNA, 75 bp, Artificial Sequence
  Synthetic
attggcagagaacagggaaattctaaaagaaccagtacatggagtatattatgacccatcaaaagacttaatagc

SEQ ID NO: 187128 - DNA, 75 bp, Artificial Sequence
  Synthetic
acatcaagcagccatgcagatgttaaaagataccatcaatgaggaggctgcagaatgggatagactacatccagt

SEQ ID NO: 187129 - DNA, 75 bp, Artificial Sequence
  Synthetic
atagacaggttacttgacaaaataagagaaagagcagaagacagtggaaatgagagtgagggggataaagaggaa

SEQ ID NO: 187130 - DNA, 75 bp, Artificial Sequence
  Synthetic
atgagatttggaacaacatgacctggatggagtgggagaatgagattaacaattacacaggaataatatatcaat

SEQ ID NO: 187131 - DNA, 75 bp, Artificial Sequence
  Synthetic
taagaataatttttgctgtgctttctatagtgaatagagttaggcagggatactcacctctgtcatttcagaccc

SEQ ID NO: 187132 - DNA, 75 bp, Artificial Sequence
  Synthetic
attgccaagtttgtttcatgaaaaaaggcttaggcatctcctatggcaggaagaagcggagacagcgacgaagag

SEQ ID NO: 187133 - DNA, 75 bp, Artificial Sequence
  Synthetic
tacactaaaatcgagggactagagggaaatataacagatgaaataaggaactgttcttttaatatgaccacagag

SEQ ID NO: 187134 - DNA, 75 bp, Artificial Sequence
  Synthetic
cggaggaatcgaagaagaaggtggagagcaaggcagaaccagatcgattcgattagtcaacggattcttagcact

SEQ ID NO: 187135 - DNA, 75 bp, Artificial Sequence
  Synthetic
attaacttgcttaataccacagcaatagcagtagccgaggggacagataggattatagaagttttccaaagggct

SEQ ID NO: 187136 - DNA, 75 bp, Artificial Sequence
  Synthetic
agagaaagaataaggcgaacccctccagcagctccagcagcagatggggtgggagcagtgtctcaagacctagct

SEQ ID NO: 187137 - DNA, 75 bp, Artificial Sequence
  Synthetic
ctcaggtacctttaagaccaatgacctacaagggagcttttgatctcagccactttataaaagaaaaggggggac

SEQ ID NO: 187138 - DNA, 75 bp, Artificial Sequence
  Synthetic
ttctccacatacctagaagaataagacagggctttgaaagggctttgctataaaatgggtggcaagtggtcaaaa

SEQ ID NO: 187139 - DNA, 75 bp, Artificial Sequence
  Synthetic
aaatctgtagaaatcaattgcaccagacccttcaacaatacaagaacaagtttcaggataggaccaggacgagca

SEQ ID NO: 187140 - DNA, 75 bp, Artificial Sequence
  Synthetic
cacaagtagtaatacaccaactaccaatcctgattgtgcctggttggaagcacaagaggaggagaacgaagtagg

SEQ ID NO: 187141 - DNA, 75 bp, Artificial Sequence
  Synthetic
gtgagacagggagaataatggaagaaggagaaataaaaaactgttcttttaatatttccacaaacatagcagaca

SEQ ID NO: 187142 - DNA, 75 bp, Artificial Sequence
  Synthetic
ccatacctagtataaacaatgagacaccaggaattagatatcagtacaatgtgcttccacaaggatggaaaggat

SEQ ID NO: 187143 - DNA, 75 bp, Artificial Sequence
  Synthetic
taagatagaagtaaaagacaccaaggaagctctagacaagatagaggagattcaaaacaaaagcaagaaaaaggc

SEQ ID NO: 187144 - DNA, 75 bp, Artificial Sequence
  Synthetic
aagccatattaggacacgtagttagccctaggtgtgactatcaagcaggacataacaaggtaggatctctacaat

SEQ ID NO: 187145 - DNA, 75 bp, Artificial Sequence
  Synthetic
tgcattcaccatacctagtataaacaatgagacaccagggattagatatcagtacaatgtgcttccacagggatg

SEQ ID NO: 187146 - DNA, 75 bp, Artificial Sequence
  Synthetic
atcaatacatggatgatttgtatgtaggatctgacttagaaatagggcagcatagaataaaaatagaggaactaa

SEQ ID NO: 187147 - DNA, 75 bp, Artificial Sequence
  Synthetic
ttggaataacatgacctggatgcagtgggatagagaaattagtaattacacaaacacaatatacaggttgcttga

SEQ ID NO: 187148 - DNA, 75 bp, Artificial Sequence
  Synthetic
cagatcactatataatacagtagtaaccccctattgtgtacatcagaggatagaggtaaaagacaccatggaagc

SEQ ID NO: 187149 - DNA, 75 bp, Artificial Sequence
  Synthetic
ggagtaataaatctcaagaggatatttggaataacatgacctggatgcagtgggatagagaaattagtaattaca

SEQ ID NO: 187150 - DNA, 75 bp, Artificial Sequence
  Synthetic
aaagcgaaagttccagagaagttctctcgacgcaggactcggcttgctgaggtgcacacagcaagaggcgagagc

SEQ ID NO: 187151 - DNA, 75 bp, Artificial Sequence
  Synthetic
caatcctcaggaggggacccagaaattgtaatgcacagttttaattgtggaggggaatttttctactgtaataca

SEQ ID NO: 187152 - DNA, 75 bp, Artificial Sequence
  Synthetic
cagggctttgaagcagctttgcaataaaatggggaacaaatggtcaaaatgtagtccagtgggatggcctgctat

SEQ ID NO: 187153 - DNA, 75 bp, Artificial Sequence
  Synthetic
tttctatgtagatggggcagctaatagagagactaaattaggaaaagcaggatatgttactgacagaggaagaca

SEQ ID NO: 187154 - DNA, 75 bp, Artificial Sequence
  Synthetic
cttggggaggagatatgagggacaattggagaagtgagttatacaaatataaagtagtgaaaattgaaccattag

SEQ ID NO: 187155 - DNA, 75 bp, Artificial Sequence
  Synthetic
cggagagcttcgggttcggggaggagataaccccctctccgaagcaggagatggaagacaaggaacaggatcctc

SEQ ID NO: 187156 - DNA, 75 bp, Artificial Sequence
  Synthetic
tcaatgcaaccacagaaataaaagataagaaaaagctagaatatgcacttttttataaacttgatgtagtaacac

SEQ ID NO: 187157 - DNA, 75 bp, Artificial Sequence
  Synthetic
acaccaaggaagccttagacaaaataaaggaagaacaaaacaaaagtcagcaaaaaacacagcaggcagaagcgg

SEQ ID NO: 187158 - DNA, 75 bp, Artificial Sequence
  Synthetic
ctctttcaatgtcaccacaacagtaaaagataaggtgcagagagagtatgcacttttttataaacttgatgtagt

SEQ ID NO: 187159 - DNA, 75 bp, Artificial Sequence
  Synthetic
ccagcaatatttcaatgtagcatgacaaaaatcttagaaccctatagagcaaaaaatccagaagtgattatctat

SEQ ID NO: 187160 - DNA, 75 bp, Artificial Sequence
  Synthetic
catcagccccaccagcggagtttgggatgggggaagagatgacctcctctccgaagcaggagagacaggaaaagg

SEQ ID NO: 187161 - DNA, 75 bp, Artificial Sequence
  Synthetic
gtggtcaaaacgtagtggaggtggatggtctgctgtaagggaaagaatgagacgaactgagccaagagaaactga

SEQ ID NO: 187162 - DNA, 75 bp, Artificial Sequence
  Synthetic
agaatgcaacgagctgagccagcagcagaaggggtgggagcagtatctcgagacctggaaaaacatggagcaatc

SEQ ID NO: 187163 - DNA, 75 bp, Artificial Sequence
  Synthetic
tagggattatggaaaacagatggcaggcgataattgtgtggcaggtagacaggatgagaattagagcatggaaaa

SEQ ID NO: 187164 - DNA, 75 bp, Artificial Sequence
  Synthetic
tcaggaggggacccagaaattgtaatgcacagttttaattgtggaggggaatttttctactgtaatacaacaaaa

SEQ ID NO: 187165 - DNA, 75 bp, Artificial Sequence
  Synthetic
taagttcagaagtacacatcccactaggggatgctgaattagtagtaacaacatattgggggctgcatacaggag

SEQ ID NO: 187166 - DNA, 75 bp, Artificial Sequence
  Synthetic
aagccccagaagaccaggggccccagagggagccattcaatgagtgggcattagaactattagaagagcttaaga

SEQ ID NO: 187167 - DNA, 75 bp, Artificial Sequence
  Synthetic
aagccccagaagaccaggggccccagagggagccattcaatgagtgggcattagaactattagaagagcttaagt

SEQ ID NO: 187168 - DNA, 75 bp, Artificial Sequence
  Synthetic
aagccccagaagaccaggggccccagagggagccattcaatgagtgggcattagaactattagaagagcttaagc

SEQ ID NO: 187169 - DNA, 75 bp, Artificial Sequence
  Synthetic
aagccccagaagaccaggggccccagagggagccattcaatgagtgggcattagaactattagaagagcttaagg

SEQ ID NO: 187170 - DNA, 75 bp, Artificial Sequence
  Synthetic
aagccccagaagaccaggggccccagagggagccattcaatgagtgggcattagaacttttagaagagcttaaga

SEQ ID NO: 187171 - DNA, 75 bp, Artificial Sequence
  Synthetic
aagccccagaagaccaggggccccagagggagccattcaatgagtgggcattagaacttttagaagagcttaagt

SEQ ID NO: 187172 - DNA, 75 bp, Artificial Sequence
  Synthetic
aagccccagaagaccaggggccccagagggagccattcaatgagtgggcattagaacttttagaagagcttaagc

SEQ ID NO: 187173 - DNA, 75 bp, Artificial Sequence
  Synthetic
aagccccagaagaccaggggccccagagggagccattcaatgagtgggcattagaacttttagaagagcttaagg

SEQ ID NO: 187174 - DNA, 75 bp, Artificial Sequence
  Synthetic
aagccccagaagaccaggggccccagagggagccattcaatgagtgggcattagaactcttagaagagcttaaga

SEQ ID NO: 187175 - DNA, 75 bp, Artificial Sequence
  Synthetic
aagccccagaagaccaggggccccagagggagccattcaatgagtgggcattagaactcttagaagagcttaagt

SEQ ID NO: 187176 - DNA, 75 bp, Artificial Sequence
  Synthetic
aagccccagaagaccaggggccccagagggagccattcaatgagtgggcattagaactcttagaagagcttaagc

SEQ ID NO: 187177 - DNA, 75 bp, Artificial Sequence
  Synthetic
aagccccagaagaccaggggccccagagggagccattcaatgagtgggcattagaactcttagaagagcttaagg

SEQ ID NO: 187178 - DNA, 75 bp, Artificial Sequence
  Synthetic
aagccccagaagaccaggggccccagagggagccattcaatgagtgggcattagaactgttagaagagcttaaga

SEQ ID NO: 187179 - DNA, 75 bp, Artificial Sequence
  Synthetic
aagccccagaagaccaggggccccagagggagccattcaatgagtgggcattagaactgttagaagagcttaagt

SEQ ID NO: 187180 - DNA, 75 bp, Artificial Sequence
  Synthetic
aagccccagaagaccaggggccccagagggagccattcaatgagtgggcattagaactgttagaagagcttaagc

SEQ ID NO: 187181 - DNA, 75 bp, Artificial Sequence
  Synthetic
aagccccagaagaccaggggccccagagggagccattcaatgagtgggcattagaactgttagaagagcttaagg

SEQ ID NO: 187182 - DNA, 75 bp, Artificial Sequence
  Synthetic
atgttgctatcattgtcaagtttgctttctgaacaaaggcttaggcatctcctatggcaggaagaagcggagaca

SEQ ID NO: 187183 - DNA, 75 bp, Artificial Sequence
  Synthetic
caataattgtgtggactatagtatatatagaatatagaaaattgataaaacaaagaaaaatagactggttaatca

SEQ ID NO: 187184 - DNA, 75 bp, Artificial Sequence
  Synthetic
caataattgtgtggactatagtatatatagaatatagtaaattgataaaacaaagaaaaatagactggttaatca

SEQ ID NO: 187185 - DNA, 75 bp, Artificial Sequence
  Synthetic
caataattgtgtggactatagtatatatagaatatagcaaattgataaaacaaagaaaaatagactggttaatca

SEQ ID NO: 187186 - DNA, 75 bp, Artificial Sequence
  Synthetic
caataattgtgtggactatagtatatatagaatataggaaattgataaaacaaagaaaaatagactggttaatca

SEQ ID NO: 187187 - DNA, 75 bp, Artificial Sequence
  Synthetic
gaatagagttaggcagggatactcaccattatcgtttcagacccgcctcccagccccgaggggacccgacaggcc

SEQ ID NO: 187188 - DNA, 75 bp, Artificial Sequence
  Synthetic
cgacgaagagcttctcaaagcagttcgactcatcaagtttctctatcaaagcagtaagtagtatatgtaatgcaa

SEQ ID NO: 187189 - DNA, 75 bp, Artificial Sequence
  Synthetic
tgatccagcagcagagggagtaggagcagcatctcgagacttagagagacatggggcacttactaccagcaacac

SEQ ID NO: 187190 - DNA, 75 bp, Artificial Sequence
  Synthetic
ctactaatctaaataatagtagtttagaggaaggagaaataaaaaactgctctttcaaggtcaccacaaacataa

SEQ ID NO: 187191 - DNA, 75 bp, Artificial Sequence
  Synthetic
acaaaaacaaattacaaaaattcaaaattttcgggtttattacagggacagcagagacccaatttggaaaggacc

SEQ ID NO: 187192 - DNA, 75 bp, Artificial Sequence
  Synthetic
gtgtggcaagtagacaggatgaggattaatacatggaaaagtttagtaaaataccatatgcatatttcaaagaaa

SEQ ID NO: 187193 - DNA, 75 bp, Artificial Sequence
  Synthetic
gcatcagacatacaaactaaagaattacaaaaacaaattacaaaaattcaaaattttcgggtttattacagggac

SEQ ID NO: 187194 - DNA, 75 bp, Artificial Sequence
  Synthetic
agtctccaatgtcgaataataaaaattgtgaagatgtggcagggagtaggaagagcaatgtatgctgctcctata

SEQ ID NO: 187195 - DNA, 75 bp, Artificial Sequence
  Synthetic
agtctccaatgtcgaataataaaaattgtgaagatgtggcagggagtaggaagagcaatgtatgctgctcctatt

SEQ ID NO: 187196 - DNA, 75 bp, Artificial Sequence
  Synthetic
agtctccaatgtcgaataataaaaattgtgaagatgtggcagggagtaggaagagcaatgtatgctgctcctatc

SEQ ID NO: 187197 - DNA, 75 bp, Artificial Sequence
  Synthetic
agtctccaatgtcgaataataaaaattgtgaagatgtggcagggagtaggaagagcaatgtatgctgctcctatg

SEQ ID NO: 187198 - DNA, 75 bp, Artificial Sequence
  Synthetic
agtctccaatgtcgaataatataaattgtgaagatgtggcagggagtaggaagagcaatgtatgctgctcctata

SEQ ID NO: 187199 - DNA, 75 bp, Artificial Sequence
  Synthetic
agtctccaatgtcgaataatataaattgtgaagatgtggcagggagtaggaagagcaatgtatgctgctcctatt

SEQ ID NO: 187200 - DNA, 75 bp, Artificial Sequence
  Synthetic
agtctccaatgtcgaataatataaattgtgaagatgtggcagggagtaggaagagcaatgtatgctgctcctatc

SEQ ID NO: 187201 - DNA, 75 bp, Artificial Sequence
  Synthetic
agtctccaatgtcgaataatataaattgtgaagatgtggcagggagtaggaagagcaatgtatgctgctcctatg

SEQ ID NO: 187202 - DNA, 75 bp, Artificial Sequence
  Synthetic
agtctccaatgtcgaataatacaaattgtgaagatgtggcagggagtaggaagagcaatgtatgctgctcctata

SEQ ID NO: 187203 - DNA, 75 bp, Artificial Sequence
  Synthetic
agtctccaatgtcgaataatacaaattgtgaagatgtggcagggagtaggaagagcaatgtatgctgctcctatt

SEQ ID NO: 187204 - DNA, 75 bp, Artificial Sequence
  Synthetic
agtctccaatgtcgaataatacaaattgtgaagatgtggcagggagtaggaagagcaatgtatgctgctcctatc

SEQ ID NO: 187205 - DNA, 75 bp, Artificial Sequence
  Synthetic
agtctccaatgtcgaataatacaaattgtgaagatgtggcagggagtaggaagagcaatgtatgctgctcctatg

SEQ ID NO: 187206 - DNA, 75 bp, Artificial Sequence
  Synthetic
agtctccaatgtcgaataatagaaattgtgaagatgtggcagggagtaggaagagcaatgtatgctgctcctata

SEQ ID NO: 187207 - DNA, 75 bp, Artificial Sequence
  Synthetic
agtctccaatgtcgaataatagaaattgtgaagatgtggcagggagtaggaagagcaatgtatgctgctcctatt

SEQ ID NO: 187208 - DNA, 75 bp, Artificial Sequence
  Synthetic
agtctccaatgtcgaataatagaaattgtgaagatgtggcagggagtaggaagagcaatgtatgctgctcctatc

SEQ ID NO: 187209 - DNA, 75 bp, Artificial Sequence
  Synthetic
agtctccaatgtcgaataatagaaattgtgaagatgtggcagggagtaggaagagcaatgtatgctgctcctatg

SEQ ID NO: 187210 - DNA, 75 bp, Artificial Sequence
  Synthetic
agtctcctatgtcgaataataaaaattgtgaagatgtggcagggagtaggaagagcaatgtatgctgctcctata

SEQ ID NO: 187211 - DNA, 75 bp, Artificial Sequence
  Synthetic
agtctcctatgtcgaataataaaaattgtgaagatgtggcagggagtaggaagagcaatgtatgctgctcctatt

SEQ ID NO: 187212 - DNA, 75 bp, Artificial Sequence
  Synthetic
agtctcctatgtcgaataataaaaattgtgaagatgtggcagggagtaggaagagcaatgtatgctgctcctatc

SEQ ID NO: 187213 - DNA, 75 bp, Artificial Sequence
  Synthetic
agtctcctatgtcgaataataaaaattgtgaagatgtggcagggagtaggaagagcaatgtatgctgctcctatg

SEQ ID NO: 187214 - DNA, 75 bp, Artificial Sequence
  Synthetic
agtctcctatgtcgaataatataaattgtgaagatgtggcagggagtaggaagagcaatgtatgctgctcctata

SEQ ID NO: 187215 - DNA, 75 bp, Artificial Sequence
  Synthetic
agtctcctatgtcgaataatataaattgtgaagatgtggcagggagtaggaagagcaatgtatgctgctcctatt

SEQ ID NO: 187216 - DNA, 75 bp, Artificial Sequence
  Synthetic
agtctcctatgtcgaataatataaattgtgaagatgtggcagggagtaggaagagcaatgtatgctgctcctatc

SEQ ID NO: 187217 - DNA, 75 bp, Artificial Sequence
  Synthetic
agtctcctatgtcgaataatataaattgtgaagatgtggcagggagtaggaagagcaatgtatgctgctcctatg

SEQ ID NO: 187218 - DNA, 75 bp, Artificial Sequence
  Synthetic
agtctcctatgtcgaataatacaaattgtgaagatgtggcagggagtaggaagagcaatgtatgctgctcctata

SEQ ID NO: 187219 - DNA, 75 bp, Artificial Sequence
  Synthetic
agtctcctatgtcgaataatacaaattgtgaagatgtggcagggagtaggaagagcaatgtatgctgctcctatt

SEQ ID NO: 187220 - DNA, 75 bp, Artificial Sequence
  Synthetic
agtctcctatgtcgaataatacaaattgtgaagatgtggcagggagtaggaagagcaatgtatgctgctcctatc

SEQ ID NO: 187221 - DNA, 75 bp, Artificial Sequence
  Synthetic
agtctcctatgtcgaataatacaaattgtgaagatgtggcagggagtaggaagagcaatgtatgctgctcctatg

SEQ ID NO: 187222 - DNA, 75 bp, Artificial Sequence
  Synthetic
agtctcctatgtcgaataatagaaattgtgaagatgtggcagggagtaggaagagcaatgtatgctgctcctata

SEQ ID NO: 187223 - DNA, 75 bp, Artificial Sequence
  Synthetic
agtctcctatgtcgaataatagaaattgtgaagatgtggcagggagtaggaagagcaatgtatgctgctcctatt

SEQ ID NO: 187224 - DNA, 75 bp, Artificial Sequence
  Synthetic
agtctcctatgtcgaataatagaaattgtgaagatgtggcagggagtaggaagagcaatgtatgctgctcctatc

SEQ ID NO: 187225 - DNA, 75 bp, Artificial Sequence
  Synthetic
agtctcctatgtcgaataatagaaattgtgaagatgtggcagggagtaggaagagcaatgtatgctgctcctatg

SEQ ID NO: 187226 - DNA, 75 bp, Artificial Sequence
  Synthetic
agtctcccatgtcgaataataaaaattgtgaagatgtggcagggagtaggaagagcaatgtatgctgctcctata

SEQ ID NO: 187227 - DNA, 75 bp, Artificial Sequence
  Synthetic
agtctcccatgtcgaataataaaaattgtgaagatgtggcagggagtaggaagagcaatgtatgctgctcctatt

SEQ ID NO: 187228 - DNA, 75 bp, Artificial Sequence
  Synthetic
agtctcccatgtcgaataataaaaattgtgaagatgtggcagggagtaggaagagcaatgtatgctgctcctatc

SEQ ID NO: 187229 - DNA, 75 bp, Artificial Sequence
  Synthetic
agtctcccatgtcgaataataaaaattgtgaagatgtggcagggagtaggaagagcaatgtatgctgctcctatg

SEQ ID NO: 187230 - DNA, 75 bp, Artificial Sequence
  Synthetic
agtctcccatgtcgaataatataaattgtgaagatgtggcagggagtaggaagagcaatgtatgctgctcctata

SEQ ID NO: 187231 - DNA, 75 bp, Artificial Sequence
  Synthetic
agtctcccatgtcgaataatataaattgtgaagatgtggcagggagtaggaagagcaatgtatgctgctcctatt

SEQ ID NO: 187232 - DNA, 75 bp, Artificial Sequence
  Synthetic
agtctcccatgtcgaataatataaattgtgaagatgtggcagggagtaggaagagcaatgtatgctgctcctatc

SEQ ID NO: 187233 - DNA, 75 bp, Artificial Sequence
  Synthetic
agtctcccatgtcgaataatataaattgtgaagatgtggcagggagtaggaagagcaatgtatgctgctcctatg

SEQ ID NO: 187234 - DNA, 75 bp, Artificial Sequence
  Synthetic
agtctcccatgtcgaataatacaaattgtgaagatgtggcagggagtaggaagagcaatgtatgctgctcctata

SEQ ID NO: 187235 - DNA, 75 bp, Artificial Sequence
  Synthetic
agtctcccatgtcgaataatacaaattgtgaagatgtggcagggagtaggaagagcaatgtatgctgctcctatt

SEQ ID NO: 187236 - DNA, 75 bp, Artificial Sequence
  Synthetic
agtctcccatgtcgaataatacaaattgtgaagatgtggcagggagtaggaagagcaatgtatgctgctcctatc

SEQ ID NO: 187237 - DNA, 75 bp, Artificial Sequence
  Synthetic
agtctcccatgtcgaataatacaaattgtgaagatgtggcagggagtaggaagagcaatgtatgctgctcctatg

SEQ ID NO: 187238 - DNA, 75 bp, Artificial Sequence
  Synthetic
agtctcccatgtcgaataatagaaattgtgaagatgtggcagggagtaggaagagcaatgtatgctgctcctata

SEQ ID NO: 187239 - DNA, 75 bp, Artificial Sequence
  Synthetic
agtctcccatgtcgaataatagaaattgtgaagatgtggcagggagtaggaagagcaatgtatgctgctcctatt

SEQ ID NO: 187240 - DNA, 75 bp, Artificial Sequence
  Synthetic
agtctcccatgtcgaataatagaaattgtgaagatgtggcagggagtaggaagagcaatgtatgctgctcctatc

SEQ ID NO: 187241 - DNA, 75 bp, Artificial Sequence
  Synthetic
agtctcccatgtcgaataatagaaattgtgaagatgtggcagggagtaggaagagcaatgtatgctgctcctatg

SEQ ID NO: 187242 - DNA, 75 bp, Artificial Sequence
  Synthetic
agtctccgatgtcgaataataaaaattgtgaagatgtggcagggagtaggaagagcaatgtatgctgctcctata

SEQ ID NO: 187243 - DNA, 75 bp, Artificial Sequence
  Synthetic
agtctccgatgtcgaataataaaaattgtgaagatgtggcagggagtaggaagagcaatgtatgctgctcctatt

SEQ ID NO: 187244 - DNA, 75 bp, Artificial Sequence
  Synthetic
agtctccgatgtcgaataataaaaattgtgaagatgtggcagggagtaggaagagcaatgtatgctgctcctatc

SEQ ID NO: 187245 - DNA, 75 bp, Artificial Sequence
  Synthetic
agtctccgatgtcgaataataaaaattgtgaagatgtggcagggagtaggaagagcaatgtatgctgctcctatg

SEQ ID NO: 187246 - DNA, 75 bp, Artificial Sequence
  Synthetic
agtctccgatgtcgaataatataaattgtgaagatgtggcagggagtaggaagagcaatgtatgctgctcctata

SEQ ID NO: 187247 - DNA, 75 bp, Artificial Sequence
  Synthetic
agtctccgatgtcgaataatataaattgtgaagatgtggcagggagtaggaagagcaatgtatgctgctcctatt

SEQ ID NO: 187248 - DNA, 75 bp, Artificial Sequence
  Synthetic
agtctccgatgtcgaataatataaattgtgaagatgtggcagggagtaggaagagcaatgtatgctgctcctatc

SEQ ID NO: 187249 - DNA, 75 bp, Artificial Sequence
  Synthetic
agtctccgatgtcgaataatataaattgtgaagatgtggcagggagtaggaagagcaatgtatgctgctcctatg

SEQ ID NO: 187250 - DNA, 75 bp, Artificial Sequence
  Synthetic
agtctccgatgtcgaataatacaaattgtgaagatgtggcagggagtaggaagagcaatgtatgctgctcctata

SEQ ID NO: 187251 - DNA, 75 bp, Artificial Sequence
  Synthetic
agtctccgatgtcgaataatacaaattgtgaagatgtggcagggagtaggaagagcaatgtatgctgctcctatt

SEQ ID NO: 187252 - DNA, 75 bp, Artificial Sequence
  Synthetic
agtctccgatgtcgaataatacaaattgtgaagatgtggcagggagtaggaagagcaatgtatgctgctcctatc

SEQ ID NO: 187253 - DNA, 75 bp, Artificial Sequence
  Synthetic
agtctccgatgtcgaataatacaaattgtgaagatgtggcagggagtaggaagagcaatgtatgctgctcctatg

SEQ ID NO: 187254 - DNA, 75 bp, Artificial Sequence
  Synthetic
agtctccgatgtcgaataatagaaattgtgaagatgtggcagggagtaggaagagcaatgtatgctgctcctata

SEQ ID NO: 187255 - DNA, 75 bp, Artificial Sequence
  Synthetic
agtctccgatgtcgaataatagaaattgtgaagatgtggcagggagtaggaagagcaatgtatgctgctcctatt

SEQ ID NO: 187256 - DNA, 75 bp, Artificial Sequence
  Synthetic
agtctccgatgtcgaataatagaaattgtgaagatgtggcagggagtaggaagagcaatgtatgctgctcctatc

SEQ ID NO: 187257 - DNA, 75 bp, Artificial Sequence
  Synthetic
agtctccgatgtcgaataatagaaattgtgaagatgtggcagggagtaggaagagcaatgtatgctgctcctatg

SEQ ID NO: 187258 - DNA, 75 bp, Artificial Sequence
  Synthetic
taaagcaccacatgtatgtttcaaggagagctagtggatggtattatagacatcattatgaaagcagacatccaa

SEQ ID NO: 187259 - DNA, 75 bp, Artificial Sequence
  Synthetic
gagagctagtggatggtattatagacatcattatgaaagcagacatccaaaaataagttcagaagtacacattcc

SEQ ID NO: 187260 - DNA, 75 bp, Artificial Sequence
  Synthetic
cctcagagcagtgaggatcatcaaaattctataccaaagcagtaagtattagaaaatagtatatggaccccttag

SEQ ID NO: 187261 - DNA, 75 bp, Artificial Sequence
  Synthetic
aatagactggttaattaagagaataagtgaaagagcagaagacagtggcaatgagagtgatggggacgcagagga

SEQ ID NO: 187262 - DNA, 75 bp, Artificial Sequence
  Synthetic
tttgcttgataccatagcaataacagtagctggctggacagatagggttatagaaataggactaagaatttgtag

SEQ ID NO: 187263 - DNA, 75 bp, Artificial Sequence
  Synthetic
tttgcttgataccatagcaataacagtagctggctggacagatagggttatagaaataggactaagattttgtag

SEQ ID NO: 187264 - DNA, 75 bp, Artificial Sequence
  Synthetic
tttgcttgataccatagcaataacagtagctggctggacagatagggttatagaaataggactaagactttgtag

SEQ ID NO: 187265 - DNA, 75 bp, Artificial Sequence
  Synthetic
tttgcttgataccatagcaataacagtagctggctggacagatagggttatagaaataggactaagagtttgtag

SEQ ID NO: 187266 - DNA, 75 bp, Artificial Sequence
  Synthetic
tttgcttgataccatagcaataacagtagctggctggacagatagggttatagaaataggactatgaatttgtag

SEQ ID NO: 187267 - DNA, 75 bp, Artificial Sequence
  Synthetic
tttgcttgataccatagcaataacagtagctggctggacagatagggttatagaaataggactatgattttgtag

SEQ ID NO: 187268 - DNA, 75 bp, Artificial Sequence
  Synthetic
tttgcttgataccatagcaataacagtagctggctggacagatagggttatagaaataggactatgactttgtag

SEQ ID NO: 187269 - DNA, 75 bp, Artificial Sequence
  Synthetic
tttgcttgataccatagcaataacagtagctggctggacagatagggttatagaaataggactatgagtttgtag

SEQ ID NO: 187270 - DNA, 75 bp, Artificial Sequence
  Synthetic
tttgcttgataccatagcaataacagtagctggctggacagatagggttatagaaataggactacgaatttgtag

SEQ ID NO: 187271 - DNA, 75 bp, Artificial Sequence
  Synthetic
tttgcttgataccatagcaataacagtagctggctggacagatagggttatagaaataggactacgattttgtag

SEQ ID NO: 187272 - DNA, 75 bp, Artificial Sequence
  Synthetic
tttgcttgataccatagcaataacagtagctggctggacagatagggttatagaaataggactacgactttgtag

SEQ ID NO: 187273 - DNA, 75 bp, Artificial Sequence
  Synthetic
tttgcttgataccatagcaataacagtagctggctggacagatagggttatagaaataggactacgagtttgtag

SEQ ID NO: 187274 - DNA, 75 bp, Artificial Sequence
  Synthetic
tttgcttgataccatagcaataacagtagctggctggacagatagggttatagaaataggactaggaatttgtag

SEQ ID NO: 187275 - DNA, 75 bp, Artificial Sequence
  Synthetic
tttgcttgataccatagcaataacagtagctggctggacagatagggttatagaaataggactaggattttgtag

SEQ ID NO: 187276 - DNA, 75 bp, Artificial Sequence
  Synthetic
tttgcttgataccatagcaataacagtagctggctggacagatagggttatagaaataggactaggactttgtag

SEQ ID NO: 187277 - DNA, 75 bp, Artificial Sequence
  Synthetic
tttgcttgataccatagcaataacagtagctggctggacagatagggttatagaaataggactaggagtttgtag

SEQ ID NO: 187278 - DNA, 75 bp, Artificial Sequence
  Synthetic
tttgcttgataccatagcaataacagtagctggctggacagatagggttatagaattaggactaagaatttgtag

SEQ ID NO: 187279 - DNA, 75 bp, Artificial Sequence
  Synthetic
tttgcttgataccatagcaataacagtagctggctggacagatagggttatagaattaggactaagattttgtag

SEQ ID NO: 187280 - DNA, 75 bp, Artificial Sequence
  Synthetic
tttgcttgataccatagcaataacagtagctggctggacagatagggttatagaattaggactaagactttgtag

SEQ ID NO: 187281 - DNA, 75 bp, Artificial Sequence
  Synthetic
tttgcttgataccatagcaataacagtagctggctggacagatagggttatagaattaggactaagagtttgtag

SEQ ID NO: 187282 - DNA, 75 bp, Artificial Sequence
  Synthetic
tttgcttgataccatagcaataacagtagctggctggacagatagggttatagaattaggactatgaatttgtag

SEQ ID NO: 187283 - DNA, 75 bp, Artificial Sequence
  Synthetic
tttgcttgataccatagcaataacagtagctggctggacagatagggttatagaattaggactatgattttgtag

SEQ ID NO: 187284 - DNA, 75 bp, Artificial Sequence
  Synthetic
tttgcttgataccatagcaataacagtagctggctggacagatagggttatagaattaggactatgactttgtag

SEQ ID NO: 187285 - DNA, 75 bp, Artificial Sequence
  Synthetic
tttgcttgataccatagcaataacagtagctggctggacagatagggttatagaattaggactatgagtttgtag

SEQ ID NO: 187286 - DNA, 75 bp, Artificial Sequence
  Synthetic
tttgcttgataccatagcaataacagtagctggctggacagatagggttatagaattaggactacgaatttgtag

SEQ ID NO: 187287 - DNA, 75 bp, Artificial Sequence
  Synthetic
tttgcttgataccatagcaataacagtagctggctggacagatagggttatagaattaggactacgattttgtag

SEQ ID NO: 187288 - DNA, 75 bp, Artificial Sequence
  Synthetic
tttgcttgataccatagcaataacagtagctggctggacagatagggttatagaattaggactacgactttgtag

SEQ ID NO: 187289 - DNA, 75 bp, Artificial Sequence
  Synthetic
tttgcttgataccatagcaataacagtagctggctggacagatagggttatagaattaggactacgagtttgtag

SEQ ID NO: 187290 - DNA, 75 bp, Artificial Sequence
  Synthetic
tttgcttgataccatagcaataacagtagctggctggacagatagggttatagaattaggactaggaatttgtag

SEQ ID NO: 187291 - DNA, 75 bp, Artificial Sequence
  Synthetic
tttgcttgataccatagcaataacagtagctggctggacagatagggttatagaattaggactaggattttgtag

SEQ ID NO: 187292 - DNA, 75 bp, Artificial Sequence
  Synthetic
tttgcttgataccatagcaataacagtagctggctggacagatagggttatagaattaggactaggactttgtag

SEQ ID NO: 187293 - DNA, 75 bp, Artificial Sequence
  Synthetic
tttgcttgataccatagcaataacagtagctggctggacagatagggttatagaattaggactaggagtttgtag

SEQ ID NO: 187294 - DNA, 75 bp, Artificial Sequence
  Synthetic
tttgcttgataccatagcaataacagtagctggctggacagatagggttatagaactaggactaagaatttgtag

SEQ ID NO: 187295 - DNA, 75 bp, Artificial Sequence
  Synthetic
tttgcttgataccatagcaataacagtagctggctggacagatagggttatagaactaggactaagattttgtag

SEQ ID NO: 187296 - DNA, 75 bp, Artificial Sequence
  Synthetic
tttgcttgataccatagcaataacagtagctggctggacagatagggttatagaactaggactaagactttgtag

SEQ ID NO: 187297 - DNA, 75 bp, Artificial Sequence
  Synthetic
tttgcttgataccatagcaataacagtagctggctggacagatagggttatagaactaggactaagagtttgtag

SEQ ID NO: 187298 - DNA, 75 bp, Artificial Sequence
  Synthetic
tttgcttgataccatagcaataacagtagctggctggacagatagggttatagaactaggactatgaatttgtag

SEQ ID NO: 187299 - DNA, 75 bp, Artificial Sequence
  Synthetic
tttgcttgataccatagcaataacagtagctggctggacagatagggttatagaactaggactatgattttgtag

SEQ ID NO: 187300 - DNA, 75 bp, Artificial Sequence
  Synthetic
tttgcttgataccatagcaataacagtagctggctggacagatagggttatagaactaggactatgactttgtag

SEQ ID NO: 187301 - DNA, 75 bp, Artificial Sequence
  Synthetic
tttgcttgataccatagcaataacagtagctggctggacagatagggttatagaactaggactatgagtttgtag

SEQ ID NO: 187302 - DNA, 75 bp, Artificial Sequence
  Synthetic
tttgcttgataccatagcaataacagtagctggctggacagatagggttatagaactaggactacgaatttgtag

SEQ ID NO: 187303 - DNA, 75 bp, Artificial Sequence
  Synthetic
tttgcttgataccatagcaataacagtagctggctggacagatagggttatagaactaggactacgattttgtag

SEQ ID NO: 187304 - DNA, 75 bp, Artificial Sequence
  Synthetic
tttgcttgataccatagcaataacagtagctggctggacagatagggttatagaactaggactacgactttgtag

SEQ ID NO: 187305 - DNA, 75 bp, Artificial Sequence
  Synthetic
tttgcttgataccatagcaataacagtagctggctggacagatagggttatagaactaggactacgagtttgtag

SEQ ID NO: 187306 - DNA, 75 bp, Artificial Sequence
  Synthetic
tttgcttgataccatagcaataacagtagctggctggacagatagggttatagaactaggactaggaatttgtag

SEQ ID NO: 187307 - DNA, 75 bp, Artificial Sequence
  Synthetic
tttgcttgataccatagcaataacagtagctggctggacagatagggttatagaactaggactaggattttgtag

SEQ ID NO: 187308 - DNA, 75 bp, Artificial Sequence
  Synthetic
tttgcttgataccatagcaataacagtagctggctggacagatagggttatagaactaggactaggactttgtag

SEQ ID NO: 187309 - DNA, 75 bp, Artificial Sequence
  Synthetic
tttgcttgataccatagcaataacagtagctggctggacagatagggttatagaactaggactaggagtttgtag

SEQ ID NO: 187310 - DNA, 75 bp, Artificial Sequence
  Synthetic
tttgcttgataccatagcaataacagtagctggctggacagatagggttatagaagtaggactaagaatttgtag

SEQ ID NO: 187311 - DNA, 75 bp, Artificial Sequence
  Synthetic
tttgcttgataccatagcaataacagtagctggctggacagatagggttatagaagtaggactaagattttgtag

SEQ ID NO: 187312 - DNA, 75 bp, Artificial Sequence
  Synthetic
tttgcttgataccatagcaataacagtagctggctggacagatagggttatagaagtaggactaagactttgtag

SEQ ID NO: 187313 - DNA, 75 bp, Artificial Sequence
  Synthetic
tttgcttgataccatagcaataacagtagctggctggacagatagggttatagaagtaggactaagagtttgtag

SEQ ID NO: 187314 - DNA, 75 bp, Artificial Sequence
  Synthetic
tttgcttgataccatagcaataacagtagctggctggacagatagggttatagaagtaggactatgaatttgtag

SEQ ID NO: 187315 - DNA, 75 bp, Artificial Sequence
  Synthetic
tttgcttgataccatagcaataacagtagctggctggacagatagggttatagaagtaggactatgattttgtag

SEQ ID NO: 187316 - DNA, 75 bp, Artificial Sequence
  Synthetic
tttgcttgataccatagcaataacagtagctggctggacagatagggttatagaagtaggactatgactttgtag

SEQ ID NO: 187317 - DNA, 75 bp, Artificial Sequence
  Synthetic
tttgcttgataccatagcaataacagtagctggctggacagatagggttatagaagtaggactatgagtttgtag

SEQ ID NO: 187318 - DNA, 75 bp, Artificial Sequence
  Synthetic
tttgcttgataccatagcaataacagtagctggctggacagatagggttatagaagtaggactacgaatttgtag

SEQ ID NO: 187319 - DNA, 75 bp, Artificial Sequence
  Synthetic
tttgcttgataccatagcaataacagtagctggctggacagatagggttatagaagtaggactacgattttgtag

SEQ ID NO: 187320 - DNA, 75 bp, Artificial Sequence
  Synthetic
tttgcttgataccatagcaataacagtagctggctggacagatagggttatagaagtaggactacgactttgtag

SEQ ID NO: 187321 - DNA, 75 bp, Artificial Sequence
  Synthetic
tttgcttgataccatagcaataacagtagctggctggacagatagggttatagaagtaggactacgagtttgtag

SEQ ID NO: 187322 - DNA, 75 bp, Artificial Sequence
  Synthetic
tttgcttgataccatagcaataacagtagctggctggacagatagggttatagaagtaggactaggaatttgtag

SEQ ID NO: 187323 - DNA, 75 bp, Artificial Sequence
  Synthetic
tttgcttgataccatagcaataacagtagctggctggacagatagggttatagaagtaggactaggattttgtag

SEQ ID NO: 187324 - DNA, 75 bp, Artificial Sequence
  Synthetic
tttgcttgataccatagcaataacagtagctggctggacagatagggttatagaagtaggactaggactttgtag

SEQ ID NO: 187325 - DNA, 75 bp, Artificial Sequence
  Synthetic
tttgcttgataccatagcaataacagtagctggctggacagatagggttatagaagtaggactaggagtttgtag

SEQ ID NO: 187326 - DNA, 75 bp, Artificial Sequence
  Synthetic
agctattctccacatacctagaagaatcagacagggcttcgaaagggctttgctataacatgggtggcaagtggt

SEQ ID NO: 187327 - DNA, 75 bp, Artificial Sequence
  Synthetic
tgctataacatgggtggcaagtggtcaaaaagtagcatagtgggatggcctgaggttagggaaagaataagacaa

SEQ ID NO: 187328 - DNA, 75 bp, Artificial Sequence
  Synthetic
cagagaagagcaagaaatggagccagtagatcctaacctagagccctggaaccatccaggaagtcagcctaaaac

SEQ ID NO: 187329 - DNA, 75 bp, Artificial Sequence
  Synthetic
cacatggaattaagccagtggtgtcaacccagttactgctaaatggcagtctagcagaagaagacataatgatta

SEQ ID NO: 187330 - DNA, 75 bp, Artificial Sequence
  Synthetic
ctcaggaggggacttagaaattacaacacatagctttaattgtagaggagagtttttctattgcaatacatcaaa

SEQ ID NO: 187331 - DNA, 75 bp, Artificial Sequence
  Synthetic
tggaaattttaccagtggaaatgttaccaacaatgggcaggaaataaaaaattgctctttcaatgcaaccacagt

SEQ ID NO: 187332 - DNA, 75 bp, Artificial Sequence
  Synthetic
tgttagctcagtacaatgtacacatggaattaggccattggcatcaactcaactgctgctgaatggcagtctagc

SEQ ID NO: 187333 - DNA, 75 bp, Artificial Sequence
  Synthetic
taacagagccacaaactgagccagcagcagtgggggtgggatcggcatctcgagacctagaaatagatggagcaa

SEQ ID NO: 187334 - DNA, 75 bp, Artificial Sequence
  Synthetic
taacagagccacaaactgagccagcagcagtgggggtgggatcggcatctcgagacctagtaatagatggagcaa

SEQ ID NO: 187335 - DNA, 75 bp, Artificial Sequence
  Synthetic
taacagagccacaaactgagccagcagcagtgggggtgggatcggcatctcgagacctagcaatagatggagcaa

SEQ ID NO: 187336 - DNA, 75 bp, Artificial Sequence
  Synthetic
taacagagccacaaactgagccagcagcagtgggggtgggatcggcatctcgagacctaggaatagatggagcaa

SEQ ID NO: 187337 - DNA, 75 bp, Artificial Sequence
  Synthetic
taacagagccacaaactgagccagcagcagtgggggtgggatcggcatctcgagaccttgaaatagatggagcaa

SEQ ID NO: 187338 - DNA, 75 bp, Artificial Sequence
  Synthetic
taacagagccacaaactgagccagcagcagtgggggtgggatcggcatctcgagaccttgtaatagatggagcaa

SEQ ID NO: 187339 - DNA, 75 bp, Artificial Sequence
  Synthetic
taacagagccacaaactgagccagcagcagtgggggtgggatcggcatctcgagaccttgcaatagatggagcaa

SEQ ID NO: 187340 - DNA, 75 bp, Artificial Sequence
  Synthetic
taacagagccacaaactgagccagcagcagtgggggtgggatcggcatctcgagaccttggaatagatggagcaa

SEQ ID NO: 187341 - DNA, 75 bp, Artificial Sequence
  Synthetic
taacagagccacaaactgagccagcagcagtgggggtgggatcggcatctcgagacctcgaaatagatggagcaa

SEQ ID NO: 187342 - DNA, 75 bp, Artificial Sequence
  Synthetic
taacagagccacaaactgagccagcagcagtgggggtgggatcggcatctcgagacctcgtaatagatggagcaa

SEQ ID NO: 187343 - DNA, 75 bp, Artificial Sequence
  Synthetic
taacagagccacaaactgagccagcagcagtgggggtgggatcggcatctcgagacctcgcaatagatggagcaa

SEQ ID NO: 187344 - DNA, 75 bp, Artificial Sequence
  Synthetic
taacagagccacaaactgagccagcagcagtgggggtgggatcggcatctcgagacctcggaatagatggagcaa

SEQ ID NO: 187345 - DNA, 75 bp, Artificial Sequence
  Synthetic
taacagagccacaaactgagccagcagcagtgggggtgggatcggcatctcgagacctggaaatagatggagcaa

SEQ ID NO: 187346 - DNA, 75 bp, Artificial Sequence
  Synthetic
taacagagccacaaactgagccagcagcagtgggggtgggatcggcatctcgagacctggtaatagatggagcaa

SEQ ID NO: 187347 - DNA, 75 bp, Artificial Sequence
  Synthetic
taacagagccacaaactgagccagcagcagtgggggtgggatcggcatctcgagacctggcaatagatggagcaa

SEQ ID NO: 187348 - DNA, 75 bp, Artificial Sequence
  Synthetic
taacagagccacaaactgagccagcagcagtgggggtgggatcggcatctcgagacctgggaatagatggagcaa

SEQ ID NO: 187349 - DNA, 75 bp, Artificial Sequence
  Synthetic
taacagagccacaaactgagccagcagcagtgggggtgggatcggcatctcgtgacctagaaatagatggagcaa

SEQ ID NO: 187350 - DNA, 75 bp, Artificial Sequence
  Synthetic
taacagagccacaaactgagccagcagcagtgggggtgggatcggcatctcgtgacctagtaatagatggagcaa

SEQ ID NO: 187351 - DNA, 75 bp, Artificial Sequence
  Synthetic
taacagagccacaaactgagccagcagcagtgggggtgggatcggcatctcgtgacctagcaatagatggagcaa

SEQ ID NO: 187352 - DNA, 75 bp, Artificial Sequence
  Synthetic
taacagagccacaaactgagccagcagcagtgggggtgggatcggcatctcgtgacctaggaatagatggagcaa

SEQ ID NO: 187353 - DNA, 75 bp, Artificial Sequence
  Synthetic
taacagagccacaaactgagccagcagcagtgggggtgggatcggcatctcgtgaccttgaaatagatggagcaa

SEQ ID NO: 187354 - DNA, 75 bp, Artificial Sequence
  Synthetic
taacagagccacaaactgagccagcagcagtgggggtgggatcggcatctcgtgaccttgtaatagatggagcaa

SEQ ID NO: 187355 - DNA, 75 bp, Artificial Sequence
  Synthetic
taacagagccacaaactgagccagcagcagtgggggtgggatcggcatctcgtgaccttgcaatagatggagcaa

SEQ ID NO: 187356 - DNA, 75 bp, Artificial Sequence
  Synthetic
taacagagccacaaactgagccagcagcagtgggggtgggatcggcatctcgtgaccttggaatagatggagcaa

SEQ ID NO: 187357 - DNA, 75 bp, Artificial Sequence
  Synthetic
taacagagccacaaactgagccagcagcagtgggggtgggatcggcatctcgtgacctcgaaatagatggagcaa

SEQ ID NO: 187358 - DNA, 75 bp, Artificial Sequence
  Synthetic
taacagagccacaaactgagccagcagcagtgggggtgggatcggcatctcgtgacctcgtaatagatggagcaa

SEQ ID NO: 187359 - DNA, 75 bp, Artificial Sequence
  Synthetic
taacagagccacaaactgagccagcagcagtgggggtgggatcggcatctcgtgacctcgcaatagatggagcaa

SEQ ID NO: 187360 - DNA, 75 bp, Artificial Sequence
  Synthetic
taacagagccacaaactgagccagcagcagtgggggtgggatcggcatctcgtgacctcggaatagatggagcaa

SEQ ID NO: 187361 - DNA, 75 bp, Artificial Sequence
  Synthetic
taacagagccacaaactgagccagcagcagtgggggtgggatcggcatctcgtgacctggaaatagatggagcaa

SEQ ID NO: 187362 - DNA, 75 bp, Artificial Sequence
  Synthetic
taacagagccacaaactgagccagcagcagtgggggtgggatcggcatctcgtgacctggtaatagatggagcaa

SEQ ID NO: 187363 - DNA, 75 bp, Artificial Sequence
  Synthetic
taacagagccacaaactgagccagcagcagtgggggtgggatcggcatctcgtgacctggcaatagatggagcaa

SEQ ID NO: 187364 - DNA, 75 bp, Artificial Sequence
  Synthetic
taacagagccacaaactgagccagcagcagtgggggtgggatcggcatctcgtgacctgggaatagatggagcaa

SEQ ID NO: 187365 - DNA, 75 bp, Artificial Sequence
  Synthetic
taacagagccacaaactgagccagcagcagtgggggtgggatcggcatctcgcgacctagaaatagatggagcaa

SEQ ID NO: 187366 - DNA, 75 bp, Artificial Sequence
  Synthetic
taacagagccacaaactgagccagcagcagtgggggtgggatcggcatctcgcgacctagtaatagatggagcaa

SEQ ID NO: 187367 - DNA, 75 bp, Artificial Sequence
  Synthetic
taacagagccacaaactgagccagcagcagtgggggtgggatcggcatctcgcgacctagcaatagatggagcaa

SEQ ID NO: 187368 - DNA, 75 bp, Artificial Sequence
  Synthetic
taacagagccacaaactgagccagcagcagtgggggtgggatcggcatctcgcgacctaggaatagatggagcaa

SEQ ID NO: 187369 - DNA, 75 bp, Artificial Sequence
  Synthetic
taacagagccacaaactgagccagcagcagtgggggtgggatcggcatctcgcgaccttgaaatagatggagcaa

SEQ ID NO: 187370 - DNA, 75 bp, Artificial Sequence
  Synthetic
taacagagccacaaactgagccagcagcagtgggggtgggatcggcatctcgcgaccttgtaatagatggagcaa

SEQ ID NO: 187371 - DNA, 75 bp, Artificial Sequence
  Synthetic
taacagagccacaaactgagccagcagcagtgggggtgggatcggcatctcgcgaccttgcaatagatggagcaa

SEQ ID NO: 187372 - DNA, 75 bp, Artificial Sequence
  Synthetic
taacagagccacaaactgagccagcagcagtgggggtgggatcggcatctcgcgaccttggaatagatggagcaa

SEQ ID NO: 187373 - DNA, 75 bp, Artificial Sequence
  Synthetic
taacagagccacaaactgagccagcagcagtgggggtgggatcggcatctcgcgacctcgaaatagatggagcaa

SEQ ID NO: 187374 - DNA, 75 bp, Artificial Sequence
  Synthetic
taacagagccacaaactgagccagcagcagtgggggtgggatcggcatctcgcgacctcgtaatagatggagcaa

SEQ ID NO: 187375 - DNA, 75 bp, Artificial Sequence
  Synthetic
taacagagccacaaactgagccagcagcagtgggggtgggatcggcatctcgcgacctcgcaatagatggagcaa

SEQ ID NO: 187376 - DNA, 75 bp, Artificial Sequence
  Synthetic
taacagagccacaaactgagccagcagcagtgggggtgggatcggcatctcgcgacctcggaatagatggagcaa

SEQ ID NO: 187377 - DNA, 75 bp, Artificial Sequence
  Synthetic
taacagagccacaaactgagccagcagcagtgggggtgggatcggcatctcgcgacctggaaatagatggagcaa

SEQ ID NO: 187378 - DNA, 75 bp, Artificial Sequence
  Synthetic
taacagagccacaaactgagccagcagcagtgggggtgggatcggcatctcgcgacctggtaatagatggagcaa

SEQ ID NO: 187379 - DNA, 75 bp, Artificial Sequence
  Synthetic
taacagagccacaaactgagccagcagcagtgggggtgggatcggcatctcgcgacctggcaatagatggagcaa

SEQ ID NO: 187380 - DNA, 75 bp, Artificial Sequence
  Synthetic
taacagagccacaaactgagccagcagcagtgggggtgggatcggcatctcgcgacctgggaatagatggagcaa

SEQ ID NO: 187381 - DNA, 75 bp, Artificial Sequence
  Synthetic
taacagagccacaaactgagccagcagcagtgggggtgggatcggcatctcgggacctagaaatagatggagcaa

SEQ ID NO: 187382 - DNA, 75 bp, Artificial Sequence
  Synthetic
taacagagccacaaactgagccagcagcagtgggggtgggatcggcatctcgggacctagtaatagatggagcaa

SEQ ID NO: 187383 - DNA, 75 bp, Artificial Sequence
  Synthetic
taacagagccacaaactgagccagcagcagtgggggtgggatcggcatctcgggacctagcaatagatggagcaa

SEQ ID NO: 187384 - DNA, 75 bp, Artificial Sequence
  Synthetic
taacagagccacaaactgagccagcagcagtgggggtgggatcggcatctcgggacctaggaatagatggagcaa

SEQ ID NO: 187385 - DNA, 75 bp, Artificial Sequence
  Synthetic
taacagagccacaaactgagccagcagcagtgggggtgggatcggcatctcgggaccttgaaatagatggagcaa

SEQ ID NO: 187386 - DNA, 75 bp, Artificial Sequence
  Synthetic
taacagagccacaaactgagccagcagcagtgggggtgggatcggcatctcgggaccttgtaatagatggagcaa

SEQ ID NO: 187387 - DNA, 75 bp, Artificial Sequence
  Synthetic
taacagagccacaaactgagccagcagcagtgggggtgggatcggcatctcgggaccttgcaatagatggagcaa

SEQ ID NO: 187388 - DNA, 75 bp, Artificial Sequence
  Synthetic
taacagagccacaaactgagccagcagcagtgggggtgggatcggcatctcgggaccttggaatagatggagcaa

SEQ ID NO: 187389 - DNA, 75 bp, Artificial Sequence
  Synthetic
taacagagccacaaactgagccagcagcagtgggggtgggatcggcatctcgggacctcgaaatagatggagcaa

SEQ ID NO: 187390 - DNA, 75 bp, Artificial Sequence
  Synthetic
taacagagccacaaactgagccagcagcagtgggggtgggatcggcatctcgggacctcgtaatagatggagcaa

SEQ ID NO: 187391 - DNA, 75 bp, Artificial Sequence
  Synthetic
taacagagccacaaactgagccagcagcagtgggggtgggatcggcatctcgggacctcgcaatagatggagcaa

SEQ ID NO: 187392 - DNA, 75 bp, Artificial Sequence
  Synthetic
taacagagccacaaactgagccagcagcagtgggggtgggatcggcatctcgggacctcggaatagatggagcaa

SEQ ID NO: 187393 - DNA, 75 bp, Artificial Sequence
  Synthetic
taacagagccacaaactgagccagcagcagtgggggtgggatcggcatctcgggacctggaaatagatggagcaa

SEQ ID NO: 187394 - DNA, 75 bp, Artificial Sequence
  Synthetic
taacagagccacaaactgagccagcagcagtgggggtgggatcggcatctcgggacctggtaatagatggagcaa

SEQ ID NO: 187395 - DNA, 75 bp, Artificial Sequence
  Synthetic
taacagagccacaaactgagccagcagcagtgggggtgggatcggcatctcgggacctggcaatagatggagcaa

SEQ ID NO: 187396 - DNA, 75 bp, Artificial Sequence
  Synthetic
taacagagccacaaactgagccagcagcagtgggggtgggatcggcatctcgggacctgggaatagatggagcaa

SEQ ID NO: 187397 - DNA, 75 bp, Artificial Sequence
  Synthetic
cccaacaacaatacaagggagagtgtacgcattggaccaggacaggtcttctttacaactggaataataggggat

SEQ ID NO: 187398 - DNA, 75 bp, Artificial Sequence
  Synthetic
gagcttgctataaaatgggtggaaagtggtcaaaacgtagtacagctggatggactgctgtaagggaaaaaatga

SEQ ID NO: 187399 - DNA, 75 bp, Artificial Sequence
  Synthetic
gagcttgctataaaatgggtggaaagtggtcaaaacgtagtacagctggatggactgctgtaagggaaataatga

SEQ ID NO: 187400 - DNA, 75 bp, Artificial Sequence
  Synthetic
gagcttgctataaaatgggtggaaagtggtcaaaacgtagtacagctggatggactgctgtaagggaaacaatga

SEQ ID NO: 187401 - DNA, 75 bp, Artificial Sequence
  Synthetic
gagcttgctataaaatgggtggaaagtggtcaaaacgtagtacagctggatggactgctgtaagggaaagaatga

SEQ ID NO: 187402 - DNA, 75 bp, Artificial Sequence
  Synthetic
gagcttgctataaaatgggtggaaagtggtcaaaacgtagtacagctggatggactgctgtaagggataaaatga

SEQ ID NO: 187403 - DNA, 75 bp, Artificial Sequence
  Synthetic
gagcttgctataaaatgggtggaaagtggtcaaaacgtagtacagctggatggactgctgtaagggatataatga

SEQ ID NO: 187404 - DNA, 75 bp, Artificial Sequence
  Synthetic
gagcttgctataaaatgggtggaaagtggtcaaaacgtagtacagctggatggactgctgtaagggatacaatga

SEQ ID NO: 187405 - DNA, 75 bp, Artificial Sequence
  Synthetic
gagcttgctataaaatgggtggaaagtggtcaaaacgtagtacagctggatggactgctgtaagggatagaatga

SEQ ID NO: 187406 - DNA, 75 bp, Artificial Sequence
  Synthetic
gagcttgctataaaatgggtggaaagtggtcaaaacgtagtacagctggatggactgctgtaagggacaaaatga

SEQ ID NO: 187407 - DNA, 75 bp, Artificial Sequence
  Synthetic
gagcttgctataaaatgggtggaaagtggtcaaaacgtagtacagctggatggactgctgtaagggacataatga

SEQ ID NO: 187408 - DNA, 75 bp, Artificial Sequence
  Synthetic
gagcttgctataaaatgggtggaaagtggtcaaaacgtagtacagctggatggactgctgtaagggacacaatga

SEQ ID NO: 187409 - DNA, 75 bp, Artificial Sequence
  Synthetic
gagcttgctataaaatgggtggaaagtggtcaaaacgtagtacagctggatggactgctgtaagggacagaatga

SEQ ID NO: 187410 - DNA, 75 bp, Artificial Sequence
  Synthetic
gagcttgctataaaatgggtggaaagtggtcaaaacgtagtacagctggatggactgctgtaagggagaaaatga

SEQ ID NO: 187411 - DNA, 75 bp, Artificial Sequence
  Synthetic
gagcttgctataaaatgggtggaaagtggtcaaaacgtagtacagctggatggactgctgtaagggagataatga

SEQ ID NO: 187412 - DNA, 75 bp, Artificial Sequence
  Synthetic
gagcttgctataaaatgggtggaaagtggtcaaaacgtagtacagctggatggactgctgtaagggagacaatga

SEQ ID NO: 187413 - DNA, 75 bp, Artificial Sequence
  Synthetic
gagcttgctataaaatgggtggaaagtggtcaaaacgtagtacagctggatggactgctgtaagggagagaatga

SEQ ID NO: 187414 - DNA, 75 bp, Artificial Sequence
  Synthetic
gagcttgctataaaatgggtggaaagtggtcaaaacgtagtacagctggatggtctgctgtaagggaaaaaatga

SEQ ID NO: 187415 - DNA, 75 bp, Artificial Sequence
  Synthetic
gagcttgctataaaatgggtggaaagtggtcaaaacgtagtacagctggatggtctgctgtaagggaaataatga

SEQ ID NO: 187416 - DNA, 75 bp, Artificial Sequence
  Synthetic
gagcttgctataaaatgggtggaaagtggtcaaaacgtagtacagctggatggtctgctgtaagggaaacaatga

SEQ ID NO: 187417 - DNA, 75 bp, Artificial Sequence
  Synthetic
gagcttgctataaaatgggtggaaagtggtcaaaacgtagtacagctggatggtctgctgtaagggaaagaatga

SEQ ID NO: 187418 - DNA, 75 bp, Artificial Sequence
  Synthetic
gagcttgctataaaatgggtggaaagtggtcaaaacgtagtacagctggatggtctgctgtaagggataaaatga

SEQ ID NO: 187419 - DNA, 75 bp, Artificial Sequence
  Synthetic
gagcttgctataaaatgggtggaaagtggtcaaaacgtagtacagctggatggtctgctgtaagggatataatga

SEQ ID NO: 187420 - DNA, 75 bp, Artificial Sequence
  Synthetic
gagcttgctataaaatgggtggaaagtggtcaaaacgtagtacagctggatggtctgctgtaagggatacaatga

SEQ ID NO: 187421 - DNA, 75 bp, Artificial Sequence
  Synthetic
gagcttgctataaaatgggtggaaagtggtcaaaacgtagtacagctggatggtctgctgtaagggatagaatga

SEQ ID NO: 187422 - DNA, 75 bp, Artificial Sequence
  Synthetic
gagcttgctataaaatgggtggaaagtggtcaaaacgtagtacagctggatggtctgctgtaagggacaaaatga

SEQ ID NO: 187423 - DNA, 75 bp, Artificial Sequence
  Synthetic
gagcttgctataaaatgggtggaaagtggtcaaaacgtagtacagctggatggtctgctgtaagggacataatga

SEQ ID NO: 187424 - DNA, 75 bp, Artificial Sequence
  Synthetic
gagcttgctataaaatgggtggaaagtggtcaaaacgtagtacagctggatggtctgctgtaagggacacaatga

SEQ ID NO: 187425 - DNA, 75 bp, Artificial Sequence
  Synthetic
gagcttgctataaaatgggtggaaagtggtcaaaacgtagtacagctggatggtctgctgtaagggacagaatga

SEQ ID NO: 187426 - DNA, 75 bp, Artificial Sequence
  Synthetic
gagcttgctataaaatgggtggaaagtggtcaaaacgtagtacagctggatggtctgctgtaagggagaaaatga

SEQ ID NO: 187427 - DNA, 75 bp, Artificial Sequence
  Synthetic
gagcttgctataaaatgggtggaaagtggtcaaaacgtagtacagctggatggtctgctgtaagggagataatga

SEQ ID NO: 187428 - DNA, 75 bp, Artificial Sequence
  Synthetic
gagcttgctataaaatgggtggaaagtggtcaaaacgtagtacagctggatggtctgctgtaagggagacaatga

SEQ ID NO: 187429 - DNA, 75 bp, Artificial Sequence
  Synthetic
gagcttgctataaaatgggtggaaagtggtcaaaacgtagtacagctggatggtctgctgtaagggagagaatga

SEQ ID NO: 187430 - DNA, 75 bp, Artificial Sequence
  Synthetic
gagcttgctataaaatgggtggaaagtggtcaaaacgtagtacagctggatggcctgctgtaagggaaaaaatga

SEQ ID NO: 187431 - DNA, 75 bp, Artificial Sequence
  Synthetic
gagcttgctataaaatgggtggaaagtggtcaaaacgtagtacagctggatggcctgctgtaagggaaataatga

SEQ ID NO: 187432 - DNA, 75 bp, Artificial Sequence
  Synthetic
gagcttgctataaaatgggtggaaagtggtcaaaacgtagtacagctggatggcctgctgtaagggaaacaatga

SEQ ID NO: 187433 - DNA, 75 bp, Artificial Sequence
  Synthetic
gagcttgctataaaatgggtggaaagtggtcaaaacgtagtacagctggatggcctgctgtaagggaaagaatga

SEQ ID NO: 187434 - DNA, 75 bp, Artificial Sequence
  Synthetic
gagcttgctataaaatgggtggaaagtggtcaaaacgtagtacagctggatggcctgctgtaagggataaaatga

SEQ ID NO: 187435 - DNA, 75 bp, Artificial Sequence
  Synthetic
gagcttgctataaaatgggtggaaagtggtcaaaacgtagtacagctggatggcctgctgtaagggatataatga

SEQ ID NO: 187436 - DNA, 75 bp, Artificial Sequence
  Synthetic
gagcttgctataaaatgggtggaaagtggtcaaaacgtagtacagctggatggcctgctgtaagggatacaatga

SEQ ID NO: 187437 - DNA, 75 bp, Artificial Sequence
  Synthetic
gagcttgctataaaatgggtggaaagtggtcaaaacgtagtacagctggatggcctgctgtaagggatagaatga

SEQ ID NO: 187438 - DNA, 75 bp, Artificial Sequence
  Synthetic
gagcttgctataaaatgggtggaaagtggtcaaaacgtagtacagctggatggcctgctgtaagggacaaaatga

SEQ ID NO: 187439 - DNA, 75 bp, Artificial Sequence
  Synthetic
gagcttgctataaaatgggtggaaagtggtcaaaacgtagtacagctggatggcctgctgtaagggacataatga

SEQ ID NO: 187440 - DNA, 75 bp, Artificial Sequence
  Synthetic
gagcttgctataaaatgggtggaaagtggtcaaaacgtagtacagctggatggcctgctgtaagggacacaatga

SEQ ID NO: 187441 - DNA, 75 bp, Artificial Sequence
  Synthetic
gagcttgctataaaatgggtggaaagtggtcaaaacgtagtacagctggatggcctgctgtaagggacagaatga

SEQ ID NO: 187442 - DNA, 75 bp, Artificial Sequence
  Synthetic
gagcttgctataaaatgggtggaaagtggtcaaaacgtagtacagctggatggcctgctgtaagggagaaaatga

SEQ ID NO: 187443 - DNA, 75 bp, Artificial Sequence
  Synthetic
gagcttgctataaaatgggtggaaagtggtcaaaacgtagtacagctggatggcctgctgtaagggagataatga

SEQ ID NO: 187444 - DNA, 75 bp, Artificial Sequence
  Synthetic
gagcttgctataaaatgggtggaaagtggtcaaaacgtagtacagctggatggcctgctgtaagggagacaatga

SEQ ID NO: 187445 - DNA, 75 bp, Artificial Sequence
  Synthetic
gagcttgctataaaatgggtggaaagtggtcaaaacgtagtacagctggatggcctgctgtaagggagagaatga

SEQ ID NO: 187446 - DNA, 75 bp, Artificial Sequence
  Synthetic
gagcttgctataaaatgggtggaaagtggtcaaaacgtagtacagctggatgggctgctgtaagggaaaaaatga

SEQ ID NO: 187447 - DNA, 75 bp, Artificial Sequence
  Synthetic
gagcttgctataaaatgggtggaaagtggtcaaaacgtagtacagctggatgggctgctgtaagggaaataatga

SEQ ID NO: 187448 - DNA, 75 bp, Artificial Sequence
  Synthetic
gagcttgctataaaatgggtggaaagtggtcaaaacgtagtacagctggatgggctgctgtaagggaaacaatga

SEQ ID NO: 187449 - DNA, 75 bp, Artificial Sequence
  Synthetic
gagcttgctataaaatgggtggaaagtggtcaaaacgtagtacagctggatgggctgctgtaagggaaagaatga

SEQ ID NO: 187450 - DNA, 75 bp, Artificial Sequence
  Synthetic
gagcttgctataaaatgggtggaaagtggtcaaaacgtagtacagctggatgggctgctgtaagggataaaatga

SEQ ID NO: 187451 - DNA, 75 bp, Artificial Sequence
  Synthetic
gagcttgctataaaatgggtggaaagtggtcaaaacgtagtacagctggatgggctgctgtaagggatataatga

SEQ ID NO: 187452 - DNA, 75 bp, Artificial Sequence
  Synthetic
gagcttgctataaaatgggtggaaagtggtcaaaacgtagtacagctggatgggctgctgtaagggatacaatga

SEQ ID NO: 187453 - DNA, 75 bp, Artificial Sequence
  Synthetic
gagcttgctataaaatgggtggaaagtggtcaaaacgtagtacagctggatgggctgctgtaagggatagaatga

SEQ ID NO: 187454 - DNA, 75 bp, Artificial Sequence
  Synthetic
gagcttgctataaaatgggtggaaagtggtcaaaacgtagtacagctggatgggctgctgtaagggacaaaatga

SEQ ID NO: 187455 - DNA, 75 bp, Artificial Sequence
  Synthetic
gagcttgctataaaatgggtggaaagtggtcaaaacgtagtacagctggatgggctgctgtaagggacataatga

SEQ ID NO: 187456 - DNA, 75 bp, Artificial Sequence
  Synthetic
gagcttgctataaaatgggtggaaagtggtcaaaacgtagtacagctggatgggctgctgtaagggacacaatga

SEQ ID NO: 187457 - DNA, 75 bp, Artificial Sequence
  Synthetic
gagcttgctataaaatgggtggaaagtggtcaaaacgtagtacagctggatgggctgctgtaagggacagaatga

SEQ ID NO: 187458 - DNA, 75 bp, Artificial Sequence
  Synthetic
gagcttgctataaaatgggtggaaagtggtcaaaacgtagtacagctggatgggctgctgtaagggagaaaatga

SEQ ID NO: 187459 - DNA, 75 bp, Artificial Sequence
  Synthetic
gagcttgctataaaatgggtggaaagtggtcaaaacgtagtacagctggatgggctgctgtaagggagataatga

SEQ ID NO: 187460 - DNA, 75 bp, Artificial Sequence
  Synthetic
gagcttgctataaaatgggtggaaagtggtcaaaacgtagtacagctggatgggctgctgtaagggagacaatga

SEQ ID NO: 187461 - DNA, 75 bp, Artificial Sequence
  Synthetic
gagcttgctataaaatgggtggaaagtggtcaaaacgtagtacagctggatgggctgctgtaagggagagaatga

SEQ ID NO: 187462 - DNA, 75 bp, Artificial Sequence
  Synthetic
caaaacaataatctttaattcatctgcaggaggggacctagaaattacaacacatagttttaattgtatgggaga

SEQ ID NO: 187463 - DNA, 75 bp, Artificial Sequence
  Synthetic
agcacagtacaatgtacacatggaattaagccagtggtatcaactcaactactgttaaatggtagcctagcagaa

SEQ ID NO: 187464 - DNA, 75 bp, Artificial Sequence
  Synthetic
ggaatgataccaaggataatgaactgaaggatgcagtaagaaactgttcctttaaggtgaccacagaattaagag

SEQ ID NO: 187465 - DNA, 75 bp, Artificial Sequence
  Synthetic
caaaaaagataaagccacctttgcctagtgttaagaaactgacagaggatagatggaacaagccccagaagacca

SEQ ID NO: 187466 - DNA, 75 bp, Artificial Sequence
  Synthetic
ccatgtcacataaaacaaattgtgagaatgtggcaaagagtagaataagcaatgtatgccccccccatcgcagga

SEQ ID NO: 187467 - DNA, 75 bp, Artificial Sequence
  Synthetic
aggaccaggacaaacattctatgcaacaggagatataataggagatataagacaagcacattgtaacattagtaa

SEQ ID NO: 187468 - DNA, 75 bp, Artificial Sequence
  Synthetic
aacagaactattgactacaataacagaactgataacatggggggagaaataaaaaattgttctttcaatatgacc

SEQ ID NO: 187469 - DNA, 75 bp, Artificial Sequence
  Synthetic
agctataataagaattctgcaacaactgctgtttattcatttcagaattgggtgtcaacatagcagaataggcat

SEQ ID NO: 187470 - DNA, 75 bp, Artificial Sequence
  Synthetic
ccctggaagcatccaggaagtcagcctaagactgcttgtaacaattgctattgtaaaaagtgttgctatcattgc

SEQ ID NO: 187471 - DNA, 75 bp, Artificial Sequence
  Synthetic
agaaaaagtatacgtataggaccaggacaagccttctttgcaagaggtgatataacaggggatataagacgagca

SEQ ID NO: 187472 - DNA, 75 bp, Artificial Sequence
  Synthetic
gccatggaactctagctggagtaataaatctcaggaggagatttgggacaatatgacctggatagagtgggaaaa

SEQ ID NO: 187473 - DNA, 75 bp, Artificial Sequence
  Synthetic
ataggaccaggacaagcattctatgcaacaggagaaataataggagatataagacaagcacattgtaacattagt

SEQ ID NO: 187474 - DNA, 75 bp, Artificial Sequence
  Synthetic
caggctaattttttagggaaaatttggccttccagcaaggggaggccaggaaattttcctcagaacagattggag

SEQ ID NO: 187475 - DNA, 75 bp, Artificial Sequence
  Synthetic
atcacaatcccatgcagaataaaacaaattataaatatgtggcagggggtcggacgagcaatgtatgcccctccc

SEQ ID NO: 187476 - DNA, 75 bp, Artificial Sequence
  Synthetic
agccctggaaacatccaggaagtcagcctaagactccttgtaccaaatgctattgtaaaaagtgttgctttcatt

SEQ ID NO: 187477 - DNA, 75 bp, Artificial Sequence
  Synthetic
ttgaccaatgtcactataggaaatctaacagatgaagtaaaaaactgctcttttaatatgaccacagaaataaaa

SEQ ID NO: 187478 - DNA, 75 bp, Artificial Sequence
  Synthetic
taccagtaaaattaaagccaggaatggatgggccaaaggttaaacaatggccattgacagaagaaaaaataaaag

SEQ ID NO: 187479 - DNA, 75 bp, Artificial Sequence
  Synthetic
ttggatggcctaatgtaagggaaagaataaggcgaactgatccagcagcagagggagtaggagcagcatctcgag

SEQ ID NO: 187480 - DNA, 75 bp, Artificial Sequence
  Synthetic
ttaccacaagtagaagagataagacgcagaaaaaatatgcacttttttataaacttgatgtggtaccaatagaga

SEQ ID NO: 187481 - DNA, 75 bp, Artificial Sequence
  Synthetic
ctgctctttcaatatcaccacaaacataagagataaggtacagaaagaatatgcacttttttataaacttgatgt

SEQ ID NO: 187482 - DNA, 75 bp, Artificial Sequence
  Synthetic
gcttgataccatagcaatagcagtagctggctggacagacagggttatagaaataggacaaagaattggtagagc

SEQ ID NO: 187483 - DNA, 75 bp, Artificial Sequence
  Synthetic
gggaagccctcaaatatctgggaagtcttgtgcagtattgggttctggagctcaagagtagtgctattagtctgc

SEQ ID NO: 187484 - DNA, 75 bp, Artificial Sequence
  Synthetic
gggatgaaagcctaaaaccatgtgtgaaattaaccccactctgtgttactttaaattgcagtaatgctaatttca

SEQ ID NO: 187485 - DNA, 75 bp, Artificial Sequence
  Synthetic
tgcgcctggctggaggcacaagaagagagtgaggaagtaggcttcccagtcaggccacaggtgcctttaagaccc

SEQ ID NO: 187486 - DNA, 75 bp, Artificial Sequence
  Synthetic
taaaaccataatagtacagctgaatgaatctgtagaaattaattgtacaagacccaacaacaatacaagaaaaag

SEQ ID NO: 187487 - DNA, 75 bp, Artificial Sequence
  Synthetic
agagtgaggaagtaggcttcccagtcaggccacaggtgcctttaagacccatgacctacaggggagcttttgatc

SEQ ID NO: 187488 - DNA, 75 bp, Artificial Sequence
  Synthetic
agaacatgcacttttttatagtcttgatgtaatgtcaatagataatacaagctatgcattgagacagtgtaacac

SEQ ID NO: 187489 - DNA, 75 bp, Artificial Sequence
  Synthetic
aatctttaatcaatcctcaggaggggacccagaaattgtaatgcacacttttaattgtggaggggaatttttcta

SEQ ID NO: 187490 - DNA, 75 bp, Artificial Sequence
  Synthetic
gtactggatgtgggggatgcatatttttcagttcccttagataaagaattcaggaagtacactgcattcaccata

SEQ ID NO: 187491 - DNA, 75 bp, Artificial Sequence
  Synthetic
aggagaaataaaaaactgcactttcaaaatcaccacaagcttaaatgataaagtgaaagactctgcactttttta

SEQ ID NO: 187492 - DNA, 75 bp, Artificial Sequence
  Synthetic
aagaataagacgaacccctgcagcagaaggagtaggagcagtatctaaagatttagataaacatggagcagtcac

SEQ ID NO: 187493 - DNA, 75 bp, Artificial Sequence
  Synthetic
gaattccacttggagtaataaatcttatgaagagatttgggataacatgacatggatacaatgggagagagaaat

SEQ ID NO: 187494 - DNA, 75 bp, Artificial Sequence
  Synthetic
catggatacaatgggagagagaaattagcaattacacaaaccaaatatatgatatacttacagaatcgcagaacc

SEQ ID NO: 187495 - DNA, 75 bp, Artificial Sequence
  Synthetic
agaagtaaatatagtaacagactcacagtatgcattaggaatcattcaagcacaaccagataagagtgaatcaga

SEQ ID NO: 187496 - DNA, 75 bp, Artificial Sequence
  Synthetic
accaaggaagccttagacaagatagaggaagaacaaaacaaaagtcagcaaaaaatacagcaggcaaaagaggct

SEQ ID NO: 187497 - DNA, 75 bp, Artificial Sequence
  Synthetic
caccaatggccccatggaaaaaatgaaaaactgctcttacaacatgtcaacagaagtaaaagataagaaaaagca

SEQ ID NO: 187498 - DNA, 75 bp, Artificial Sequence
  Synthetic
agatctctcgacgcaggactcggcttgctgaagtgcactcggcaagaggcgagagcggcgactggtgagtacgcc

SEQ ID NO: 187499 - DNA, 75 bp, Artificial Sequence
  Synthetic
tgttgactcagattggttgtactttaaattttccaattagtcctattgaaactgtaccagtaaaattaaagccag

SEQ ID NO: 187500 - DNA, 75 bp, Artificial Sequence
  Synthetic
atgtatgctcctcccatcccaggagtaataaggtgtgtatcaaacattacaggactaatattaacaagagatggt

SEQ ID NO: 187501 - DNA, 75 bp, Artificial Sequence
  Synthetic
atgggtgcgagagcgtcagtattaagcggcggaaaattagatcaatgggaaagaattcggttgaggccaggggga

SEQ ID NO: 187502 - DNA, 75 bp, Artificial Sequence
  Synthetic
tgaaagcagacatccaaaaataagttcagaagtacacatcccattaggggaagcaagattagtaataaaaacata

SEQ ID NO: 187503 - DNA, 75 bp, Artificial Sequence
  Synthetic
gatctctacaatatttagcactgaaagcattagtaacaccaaaaaagacaaagccacctttgcctagtgttagga

SEQ ID NO: 187504 - DNA, 75 bp, Artificial Sequence
  Synthetic
ccaacaggaaaagaatgaacaagacttattggcattggataaatggacaagcttgtggtcttggtttgacataac

SEQ ID NO: 187505 - DNA, 75 bp, Artificial Sequence
  Synthetic
aaacagatggcaggtgatgattgtgtggcaagtagacaggatgaggattaaaacatggaaaagtttagtaaaaca

SEQ ID NO: 187506 - DNA, 75 bp, Artificial Sequence
  Synthetic
agcaatagttgtgtgaaccatagtatttataaaatatagaaaaatattaagacaaaaaaaaatagacaggttaat

SEQ ID NO: 187507 - DNA, 75 bp, Artificial Sequence
  Synthetic
agcaatagttgtgtgaaccatagtatttataaaatatagaaaaatattaagacaaataaaaatagacaggttaat

SEQ ID NO: 187508 - DNA, 75 bp, Artificial Sequence
  Synthetic
agcaatagttgtgtgaaccatagtatttataaaatatagaaaaatattaagacaaacaaaaatagacaggttaat

SEQ ID NO: 187509 - DNA, 75 bp, Artificial Sequence
  Synthetic
agcaatagttgtgtgaaccatagtatttataaaatatagaaaaatattaagacaaagaaaaatagacaggttaat

SEQ ID NO: 187510 - DNA, 75 bp, Artificial Sequence
  Synthetic
agcaatagttgtgtgaaccatagtatttatataatatagaaaaatattaagacaaaaaaaaatagacaggttaat

SEQ ID NO: 187511 - DNA, 75 bp, Artificial Sequence
  Synthetic
agcaatagttgtgtgaaccatagtatttatataatatagaaaaatattaagacaaataaaaatagacaggttaat

SEQ ID NO: 187512 - DNA, 75 bp, Artificial Sequence
  Synthetic
agcaatagttgtgtgaaccatagtatttatataatatagaaaaatattaagacaaacaaaaatagacaggttaat

SEQ ID NO: 187513 - DNA, 75 bp, Artificial Sequence
  Synthetic
agcaatagttgtgtgaaccatagtatttatataatatagaaaaatattaagacaaagaaaaatagacaggttaat

SEQ ID NO: 187514 - DNA, 75 bp, Artificial Sequence
  Synthetic
agcaatagttgtgtgaaccatagtatttatacaatatagaaaaatattaagacaaaaaaaaatagacaggttaat

SEQ ID NO: 187515 - DNA, 75 bp, Artificial Sequence
  Synthetic
agcaatagttgtgtgaaccatagtatttatacaatatagaaaaatattaagacaaataaaaatagacaggttaat

SEQ ID NO: 187516 - DNA, 75 bp, Artificial Sequence
  Synthetic
agcaatagttgtgtgaaccatagtatttatacaatatagaaaaatattaagacaaacaaaaatagacaggttaat

SEQ ID NO: 187517 - DNA, 75 bp, Artificial Sequence
  Synthetic
agcaatagttgtgtgaaccatagtatttatacaatatagaaaaatattaagacaaagaaaaatagacaggttaat

SEQ ID NO: 187518 - DNA, 75 bp, Artificial Sequence
  Synthetic
agcaatagttgtgtgaaccatagtatttatagaatatagaaaaatattaagacaaaaaaaaatagacaggttaat

SEQ ID NO: 187519 - DNA, 75 bp, Artificial Sequence
  Synthetic
agcaatagttgtgtgaaccatagtatttatagaatatagaaaaatattaagacaaataaaaatagacaggttaat

SEQ ID NO: 187520 - DNA, 75 bp, Artificial Sequence
  Synthetic
agcaatagttgtgtgaaccatagtatttatagaatatagaaaaatattaagacaaacaaaaatagacaggttaat

SEQ ID NO: 187521 - DNA, 75 bp, Artificial Sequence
  Synthetic
agcaatagttgtgtgaaccatagtatttatagaatatagaaaaatattaagacaaagaaaaatagacaggttaat

SEQ ID NO: 187522 - DNA, 75 bp, Artificial Sequence
  Synthetic
agcaatagttgtgtgtaccatagtatttataaaatatagaaaaatattaagacaaaaaaaaatagacaggttaat

SEQ ID NO: 187523 - DNA, 75 bp, Artificial Sequence
  Synthetic
agcaatagttgtgtgtaccatagtatttataaaatatagaaaaatattaagacaaataaaaatagacaggttaat

SEQ ID NO: 187524 - DNA, 75 bp, Artificial Sequence
  Synthetic
agcaatagttgtgtgtaccatagtatttataaaatatagaaaaatattaagacaaacaaaaatagacaggttaat

SEQ ID NO: 187525 - DNA, 75 bp, Artificial Sequence
  Synthetic
agcaatagttgtgtgtaccatagtatttataaaatatagaaaaatattaagacaaagaaaaatagacaggttaat

SEQ ID NO: 187526 - DNA, 75 bp, Artificial Sequence
  Synthetic
agcaatagttgtgtgtaccatagtatttatataatatagaaaaatattaagacaaaaaaaaatagacaggttaat

SEQ ID NO: 187527 - DNA, 75 bp, Artificial Sequence
  Synthetic
agcaatagttgtgtgtaccatagtatttatataatatagaaaaatattaagacaaataaaaatagacaggttaat

SEQ ID NO: 187528 - DNA, 75 bp, Artificial Sequence
  Synthetic
agcaatagttgtgtgtaccatagtatttatataatatagaaaaatattaagacaaacaaaaatagacaggttaat

SEQ ID NO: 187529 - DNA, 75 bp, Artificial Sequence
  Synthetic
agcaatagttgtgtgtaccatagtatttatataatatagaaaaatattaagacaaagaaaaatagacaggttaat

SEQ ID NO: 187530 - DNA, 75 bp, Artificial Sequence
  Synthetic
agcaatagttgtgtgtaccatagtatttatacaatatagaaaaatattaagacaaaaaaaaatagacaggttaat

SEQ ID NO: 187531 - DNA, 75 bp, Artificial Sequence
  Synthetic
agcaatagttgtgtgtaccatagtatttatacaatatagaaaaatattaagacaaataaaaatagacaggttaat

SEQ ID NO: 187532 - DNA, 75 bp, Artificial Sequence
  Synthetic
agcaatagttgtgtgtaccatagtatttatacaatatagaaaaatattaagacaaacaaaaatagacaggttaat

SEQ ID NO: 187533 - DNA, 75 bp, Artificial Sequence
  Synthetic
agcaatagttgtgtgtaccatagtatttatacaatatagaaaaatattaagacaaagaaaaatagacaggttaat

SEQ ID NO: 187534 - DNA, 75 bp, Artificial Sequence
  Synthetic
agcaatagttgtgtgtaccatagtatttatagaatatagaaaaatattaagacaaaaaaaaatagacaggttaat

SEQ ID NO: 187535 - DNA, 75 bp, Artificial Sequence
  Synthetic
agcaatagttgtgtgtaccatagtatttatagaatatagaaaaatattaagacaaataaaaatagacaggttaat

SEQ ID NO: 187536 - DNA, 75 bp, Artificial Sequence
  Synthetic
agcaatagttgtgtgtaccatagtatttatagaatatagaaaaatattaagacaaacaaaaatagacaggttaat

SEQ ID NO: 187537 - DNA, 75 bp, Artificial Sequence
  Synthetic
agcaatagttgtgtgtaccatagtatttatagaatatagaaaaatattaagacaaagaaaaatagacaggttaat

SEQ ID NO: 187538 - DNA, 75 bp, Artificial Sequence
  Synthetic
agcaatagttgtgtgcaccatagtatttataaaatatagaaaaatattaagacaaaaaaaaatagacaggttaat

SEQ ID NO: 187539 - DNA, 75 bp, Artificial Sequence
  Synthetic
agcaatagttgtgtgcaccatagtatttataaaatatagaaaaatattaagacaaataaaaatagacaggttaat

SEQ ID NO: 187540 - DNA, 75 bp, Artificial Sequence
  Synthetic
agcaatagttgtgtgcaccatagtatttataaaatatagaaaaatattaagacaaacaaaaatagacaggttaat

SEQ ID NO: 187541 - DNA, 75 bp, Artificial Sequence
  Synthetic
agcaatagttgtgtgcaccatagtatttataaaatatagaaaaatattaagacaaagaaaaatagacaggttaat

SEQ ID NO: 187542 - DNA, 75 bp, Artificial Sequence
  Synthetic
agcaatagttgtgtgcaccatagtatttatataatatagaaaaatattaagacaaaaaaaaatagacaggttaat

SEQ ID NO: 187543 - DNA, 75 bp, Artificial Sequence
  Synthetic
agcaatagttgtgtgcaccatagtatttatataatatagaaaaatattaagacaaataaaaatagacaggttaat

SEQ ID NO: 187544 - DNA, 75 bp, Artificial Sequence
  Synthetic
agcaatagttgtgtgcaccatagtatttatataatatagaaaaatattaagacaaacaaaaatagacaggttaat

SEQ ID NO: 187545 - DNA, 75 bp, Artificial Sequence
  Synthetic
agcaatagttgtgtgcaccatagtatttatataatatagaaaaatattaagacaaagaaaaatagacaggttaat

SEQ ID NO: 187546 - DNA, 75 bp, Artificial Sequence
  Synthetic
agcaatagttgtgtgcaccatagtatttatacaatatagaaaaatattaagacaaaaaaaaatagacaggttaat

SEQ ID NO: 187547 - DNA, 75 bp, Artificial Sequence
  Synthetic
agcaatagttgtgtgcaccatagtatttatacaatatagaaaaatattaagacaaataaaaatagacaggttaat

SEQ ID NO: 187548 - DNA, 75 bp, Artificial Sequence
  Synthetic
agcaatagttgtgtgcaccatagtatttatacaatatagaaaaatattaagacaaacaaaaatagacaggttaat

SEQ ID NO: 187549 - DNA, 75 bp, Artificial Sequence
  Synthetic
agcaatagttgtgtgcaccatagtatttatacaatatagaaaaatattaagacaaagaaaaatagacaggttaat

SEQ ID NO: 187550 - DNA, 75 bp, Artificial Sequence
  Synthetic
agcaatagttgtgtgcaccatagtatttatagaatatagaaaaatattaagacaaaaaaaaatagacaggttaat

SEQ ID NO: 187551 - DNA, 75 bp, Artificial Sequence
  Synthetic
agcaatagttgtgtgcaccatagtatttatagaatatagaaaaatattaagacaaataaaaatagacaggttaat

SEQ ID NO: 187552 - DNA, 75 bp, Artificial Sequence
  Synthetic
agcaatagttgtgtgcaccatagtatttatagaatatagaaaaatattaagacaaacaaaaatagacaggttaat

SEQ ID NO: 187553 - DNA, 75 bp, Artificial Sequence
  Synthetic
agcaatagttgtgtgcaccatagtatttatagaatatagaaaaatattaagacaaagaaaaatagacaggttaat

SEQ ID NO: 187554 - DNA, 75 bp, Artificial Sequence
  Synthetic
agcaatagttgtgtggaccatagtatttataaaatatagaaaaatattaagacaaaaaaaaatagacaggttaat

SEQ ID NO: 187555 - DNA, 75 bp, Artificial Sequence
  Synthetic
agcaatagttgtgtggaccatagtatttataaaatatagaaaaatattaagacaaataaaaatagacaggttaat

SEQ ID NO: 187556 - DNA, 75 bp, Artificial Sequence
  Synthetic
agcaatagttgtgtggaccatagtatttataaaatatagaaaaatattaagacaaacaaaaatagacaggttaat

SEQ ID NO: 187557 - DNA, 75 bp, Artificial Sequence
  Synthetic
agcaatagttgtgtggaccatagtatttataaaatatagaaaaatattaagacaaagaaaaatagacaggttaat

SEQ ID NO: 187558 - DNA, 75 bp, Artificial Sequence
  Synthetic
agcaatagttgtgtggaccatagtatttatataatatagaaaaatattaagacaaaaaaaaatagacaggttaat

SEQ ID NO: 187559 - DNA, 75 bp, Artificial Sequence
  Synthetic
agcaatagttgtgtggaccatagtatttatataatatagaaaaatattaagacaaataaaaatagacaggttaat

SEQ ID NO: 187560 - DNA, 75 bp, Artificial Sequence
  Synthetic
agcaatagttgtgtggaccatagtatttatataatatagaaaaatattaagacaaacaaaaatagacaggttaat

SEQ ID NO: 187561 - DNA, 75 bp, Artificial Sequence
  Synthetic
agcaatagttgtgtggaccatagtatttatataatatagaaaaatattaagacaaagaaaaatagacaggttaat

SEQ ID NO: 187562 - DNA, 75 bp, Artificial Sequence
  Synthetic
agcaatagttgtgtggaccatagtatttatacaatatagaaaaatattaagacaaaaaaaaatagacaggttaat

SEQ ID NO: 187563 - DNA, 75 bp, Artificial Sequence
  Synthetic
agcaatagttgtgtggaccatagtatttatacaatatagaaaaatattaagacaaataaaaatagacaggttaat

SEQ ID NO: 187564 - DNA, 75 bp, Artificial Sequence
  Synthetic
agcaatagttgtgtggaccatagtatttatacaatatagaaaaatattaagacaaacaaaaatagacaggttaat

SEQ ID NO: 187565 - DNA, 75 bp, Artificial Sequence
  Synthetic
agcaatagttgtgtggaccatagtatttatacaatatagaaaaatattaagacaaagaaaaatagacaggttaat

SEQ ID NO: 187566 - DNA, 75 bp, Artificial Sequence
  Synthetic
agcaatagttgtgtggaccatagtatttatagaatatagaaaaatattaagacaaaaaaaaatagacaggttaat

SEQ ID NO: 187567 - DNA, 75 bp, Artificial Sequence
  Synthetic
agcaatagttgtgtggaccatagtatttatagaatatagaaaaatattaagacaaataaaaatagacaggttaat

SEQ ID NO: 187568 - DNA, 75 bp, Artificial Sequence
  Synthetic
agcaatagttgtgtggaccatagtatttatagaatatagaaaaatattaagacaaacaaaaatagacaggttaat

SEQ ID NO: 187569 - DNA, 75 bp, Artificial Sequence
  Synthetic
agcaatagttgtgtggaccatagtatttatagaatatagaaaaatattaagacaaagaaaaatagacaggttaat

SEQ ID NO: 187570 - DNA, 75 bp, Artificial Sequence
  Synthetic
ggaaaaggaaggaaaaatttcaaaaattgggcctgaaaatccatacaatactccagtatttgccataaagaaaaa

SEQ ID NO: 187571 - DNA, 75 bp, Artificial Sequence
  Synthetic
cccatacaaaaagaaacatgggagacatggtggacagactattggcaagccacctggattcctgagtgggagttt

SEQ ID NO: 187572 - DNA, 75 bp, Artificial Sequence
  Synthetic
caagcaggacataacaaggtaggatctctacagtacttggcactaacagcattaataaagccaaaaaagataaag

SEQ ID NO: 187573 - DNA, 75 bp, Artificial Sequence
  Synthetic
acatacagacaatggccctaatttcaccagtgctgcggttaaggcagcctgttggtgggcaggtatcaagcagga

SEQ ID NO: 187574 - DNA, 75 bp, Artificial Sequence
  Synthetic
actgattgggtggagaagaatactaccactgctactcctcccactttgaagcttgagaaaggagaagtaaaaaac

SEQ ID NO: 187575 - DNA, 75 bp, Artificial Sequence
  Synthetic
tgggaaaaaattaggttaaggccagggggaaagaaacattatatgctaaaacatctagtatgggcaagcagggag

SEQ ID NO: 187576 - DNA, 75 bp, Artificial Sequence
  Synthetic
gctgttagacattttcctaggccatggcttcataacttaggacaatatatctatgaaacttatggggatacttgg

SEQ ID NO: 187577 - DNA, 75 bp, Artificial Sequence
  Synthetic
gtagcaaaagaaatagtagccagctgtgataaatgtcagctaaaaggagaagccatgcatggacaagtagactgt

SEQ ID NO: 187578 - DNA, 75 bp, Artificial Sequence
  Synthetic
gctctttcaatgtaaccacagaagtaagagataagaagaagaaagaatatgcacttttttataaacttgatgtgg

SEQ ID NO: 187579 - DNA, 75 bp, Artificial Sequence
  Synthetic
cagatcattatttaatacagtagtagtcctctattatgtacatcaaaagatagatataaaagataccaaggaagc

SEQ ID NO: 187580 - DNA, 75 bp, Artificial Sequence
  Synthetic
aatctgtacaaattaattgtacaaggcccagcaacaatacaagaaaaggtatacctataggaccagggagagcat

SEQ ID NO: 187581 - DNA, 75 bp, Artificial Sequence
  Synthetic
ctcaactgttgttgaatggcagtctagcagaagaagagataataattagatctgaaaacctcacaaataatgcta

SEQ ID NO: 187582 - DNA, 75 bp, Artificial Sequence
  Synthetic
ttttaattgtggaggggaattcttctactgtaatacagcacaactgtttaatagtacttggaatactaatgatac

SEQ ID NO: 187583 - DNA, 75 bp, Artificial Sequence
  Synthetic
ctttacaaatgaaataataggaaatataagacaagcacattgtaatgttagtagagcagcttggaataaaacttt

SEQ ID NO: 187584 - DNA, 75 bp, Artificial Sequence
  Synthetic
tggatggttttacagacatcattatgaaagcagacatccaaaaataagttcagaagtacacatcccattagggga

SEQ ID NO: 187585 - DNA, 75 bp, Artificial Sequence
  Synthetic
aacctccattcctttggatgggatatgaactccatcctgacaaatggacagtccagcctatagaactgccagaaa

SEQ ID NO: 187586 - DNA, 75 bp, Artificial Sequence
  Synthetic
aaactgctctttcaatatcaccacaagcataagaaataaggtacagaaagaatatgcacttttttataaacttga

SEQ ID NO: 187587 - DNA, 75 bp, Artificial Sequence
  Synthetic
gctgaaaaagcaagaaagaatagataagataattaaaagaataagagaaagagcagaagacagtggcaatgagag

SEQ ID NO: 187588 - DNA, 75 bp, Artificial Sequence
  Synthetic
aatatgcacttttttataaacttgatgtagtaccaatagataatgataatacaagctatacgttgataaattgta

SEQ ID NO: 187589 - DNA, 75 bp, Artificial Sequence
  Synthetic
aggaggggaccaagaaattacaacacatagctttaattgtggaggagaatttttctattgcaatacatcaggact

SEQ ID NO: 187590 - DNA, 75 bp, Artificial Sequence
  Synthetic
aaaagaaacatgggaaacatggtggacagagtattggcaagccacctggattcctgagtgggagtttgtcaatac

SEQ ID NO: 187591 - DNA, 75 bp, Artificial Sequence
  Synthetic
aattaagagaacaatttgggaataaaacaataatctttaatcaatcctcaggaggggacccagaaattgtaatgc

SEQ ID NO: 187592 - DNA, 75 bp, Artificial Sequence
  Synthetic
aacaataatctttaatcaatcctcaggaggggacccagaaattgtaatgcacagttttaattgtggaggggaatt

SEQ ID NO: 187593 - DNA, 75 bp, Artificial Sequence
  Synthetic
atgtaaaataaaacagatgataaacatgtggcaggaagtaggacgagcaatgtatgctgcccccgtggcaggaaa

SEQ ID NO: 187594 - DNA, 75 bp, Artificial Sequence
  Synthetic
atagactggttaattgaaagaattagagaaagagcagaagacagtggcaatgagagtgatggggatcaagaggaa

SEQ ID NO: 187595 - DNA, 75 bp, Artificial Sequence
  Synthetic
acacaagtagaccctggcctggcagaccaactaattcatatacattattttgattgttttgcagactctgccata

SEQ ID NO: 187596 - DNA, 75 bp, Artificial Sequence
  Synthetic
cataaggaaagccatattaggagaaatagttagacctaggtgtgaatatcaagcaggacataataaggtaggatc

SEQ ID NO: 187597 - DNA, 75 bp, Artificial Sequence
  Synthetic
attgcagcgaggattgtggaacttctgggacgcagggggtgggaagccctcaaatatctgtggaatctcctgcag

SEQ ID NO: 187598 - DNA, 75 bp, Artificial Sequence
  Synthetic
tgggacgcagggggtgggaagccctcaaatatctgtggaatctcctgcagtattggagtcaggaactaaagaata

SEQ ID NO: 187599 - DNA, 75 bp, Artificial Sequence
  Synthetic
agaatgtggcaaagagtagaacaagcaatgtatgcccctcccatcgcaggaaaaattcaatgtatatcaaatatt

SEQ ID NO: 187600 - DNA, 75 bp, Artificial Sequence
  Synthetic
tttctttggatggggtatgaactccatcctgacaaatggacagtacagcctatagagctgccagaaaaggatagc

SEQ ID NO: 187601 - DNA, 75 bp, Artificial Sequence
  Synthetic
gaccttcagacctgcaggaggaaacatgaaggacaattggagaagtgaactatacaaatataaagtagtaaagat

SEQ ID NO: 187602 - DNA, 75 bp, Artificial Sequence
  Synthetic
tgctctggaaaactcatctgcaccactaatgtgccttggaataagaattggagtagtacttggaggactaaatct

SEQ ID NO: 187603 - DNA, 75 bp, Artificial Sequence
  Synthetic
atagagagagaaatggagggagaaataaaaaattgctctttcaatgtaatcacagaaataagagacaagagacga

SEQ ID NO: 187604 - DNA, 75 bp, Artificial Sequence
  Synthetic
ttcagaatcgggtgccatcatagcagaataggcattacaccacagagaagagggagaaatggagccagtagatcc

SEQ ID NO: 187605 - DNA, 75 bp, Artificial Sequence
  Synthetic
gcaagaggatgaagaagtaggctttccagtcagacctcaggtgcctttaagaccaatgacttttaagggagcatt

SEQ ID NO: 187606 - DNA, 75 bp, Artificial Sequence
  Synthetic
cacaagtacctctaaggccaatgacttacaagggagcttttgatctcagccactttttaaaagaaaaggggggac

SEQ ID NO: 187607 - DNA, 75 bp, Artificial Sequence
  Synthetic
agcagctcctcctagcagcaagaatcatcagaatcctgtaccaaagcagtgagtaataacaattagtacatgtaa

SEQ ID NO: 187608 - DNA, 75 bp, Artificial Sequence
  Synthetic
atacctagaagaataagacagggcttggaaagggctttgctataagatgggtggcaaatggtcaaaacgtagtgg

SEQ ID NO: 187609 - DNA, 75 bp, Artificial Sequence
  Synthetic
ggttaccaataatgctacttacaataatactgatgatataaaaaattgctcttttaatgcaaccacagaaataag

SEQ ID NO: 187610 - DNA, 75 bp, Artificial Sequence
  Synthetic
atcaactcaactactgttaaatggtagtctagctgagcaggaaataataattaaatctgaaaatataacaaacaa

SEQ ID NO: 187611 - DNA, 75 bp, Artificial Sequence
  Synthetic
atggggaaagattcctaaatttagattacccatacaaaaagaaacatgggagacatggtggacggagtattggca

SEQ ID NO: 187612 - DNA, 75 bp, Artificial Sequence
  Synthetic
gggacgcagggggtgggaactcctcaagtatttgtggagcctcctgcagtactggagtcaggaactgaagaatag

SEQ ID NO: 187613 - DNA, 75 bp, Artificial Sequence
  Synthetic
cttagggcaatatatctatgaaacttatggggatacttgggcaggagtggaagccataataagaattctgcaaca

SEQ ID NO: 187614 - DNA, 75 bp, Artificial Sequence
  Synthetic
cttaataggtttaagaatagtttttactgtgctttctataataaatagagttaggcagggatactcacctttgtc

SEQ ID NO: 187615 - DNA, 75 bp, Artificial Sequence
  Synthetic
ctagaacgatttgcagttaatcctggcctattagaaacatcagaaggctgtagacaaatactgggacagctacaa

SEQ ID NO: 187616 - DNA, 75 bp, Artificial Sequence
  Synthetic
cctagaagaataagacaaggctttgaaaggagtttgctataagatgggtggcaagtggtcaaaaggtcgtgtgcc

SEQ ID NO: 187617 - DNA, 75 bp, Artificial Sequence
  Synthetic
gcaagtggtcaaaaggtcgtgtgcccggatggcctgagataagggaaagaatgagaagagctgagccagcagctg

SEQ ID NO: 187618 - DNA, 75 bp, Artificial Sequence
  Synthetic
ggtttcgaaagggctttgctataaaatgggtaacaagtggtcaaaaagtagtatagttggatggcctgctataag

SEQ ID NO: 187619 - DNA, 75 bp, Artificial Sequence
  Synthetic
ctacaaccatcccttcagacaggatcagaagaacttaaatcattatttaatacagtagcaaccctctattgtgta

SEQ ID NO: 187620 - DNA, 75 bp, Artificial Sequence
  Synthetic
ctagacccagtaacaatacaagaaaaagtatacccattggaccagggcaagcgttctatgcaacaggtgaaataa

SEQ ID NO: 187621 - DNA, 75 bp, Artificial Sequence
  Synthetic
ggattcttagcgcttgcctgggacgatctgcggagcctgtgccttttcagctaccaccgattgagagacttcata

SEQ ID NO: 187622 - DNA, 75 bp, Artificial Sequence
  Synthetic
ggaccaggggctacactagaagaaatgatgacagcatgtcagggagtgggaggacctggccataaggcaagagtt

SEQ ID NO: 187623 - DNA, 75 bp, Artificial Sequence
  Synthetic
aatgtgacagaaaattttaacatgtggaaaaataacatggtagaacagatgcatgaagatataatcagtttatgg

SEQ ID NO: 187624 - DNA, 75 bp, Artificial Sequence
  Synthetic
aggaggggacccagaaattgtaatgcacacttttaattgtggaggggaatttttctactgtaatacaacacaact

SEQ ID NO: 187625 - DNA, 75 bp, Artificial Sequence
  Synthetic
ttaaatggcagcctagcagaagaagagataataatcagatctaaaaatatttcagacaataccaatatcataata

SEQ ID NO: 187626 - DNA, 75 bp, Artificial Sequence
  Synthetic
ctcaggtacctttaagaccaatgacttataaaggagcagttgatctcagcttctttttaaaagaaaaggggggac

SEQ ID NO: 187627 - DNA, 75 bp, Artificial Sequence
  Synthetic
aataacagtacagagaataataacagtactatagacttggaagaggtaagaaactgctctttcaatataacaaga

SEQ ID NO: 187628 - DNA, 75 bp, Artificial Sequence
  Synthetic
ggaatttggggctgctctggaaaactcatctgccccactaatgtgccctggaacactagttggagtaataagact

SEQ ID NO: 187629 - DNA, 75 bp, Artificial Sequence
  Synthetic
aacctacttgaagaatcgcaaactcagcaggaaaagaatgaacaagacttattggcattggacaaatgggcaagt

SEQ ID NO: 187630 - DNA, 75 bp, Artificial Sequence
  Synthetic
aacttagatcattatttaacacagtagcaactctctattgtgtacatgcaggaatagaggtacgagacaccaagg

SEQ ID NO: 187631 - DNA, 75 bp, Artificial Sequence
  Synthetic
gggcaagtcagatttatccagggattaaagtaaggcaattatgtaaactccttaggggagccaaagcactaacag

SEQ ID NO: 187632 - DNA, 75 bp, Artificial Sequence
  Synthetic
aagggctgttggaaatgtggaaaggaaggacaccaaatgaaagactgcactgagagacaggctaattttttaggg

SEQ ID NO: 187633 - DNA, 75 bp, Artificial Sequence
  Synthetic
agaactagaactggcagaaaacagggaaattttaaaagaaccagtacatggagtgtattatgacccatcaaaaga

SEQ ID NO: 187634 - DNA, 75 bp, Artificial Sequence
  Synthetic
aagtcagtcaaaattatcctatagtgcaaaatcttcaagggcaaatggtacaccaagccatatcacctagaactt

SEQ ID NO: 187635 - DNA, 75 bp, Artificial Sequence
  Synthetic
taataggagatataagacaagcacattgtaacattagttttacaaaatggaataacactttaaaacagatagtta

SEQ ID NO: 187636 - DNA, 75 bp, Artificial Sequence
  Synthetic
agaagacagtggcaatgagagtgatggggatacagaagaattatcaacacttatggagatggggaatcttgattt

SEQ ID NO: 187637 - DNA, 75 bp, Artificial Sequence
  Synthetic
aacaataatctttaattcatcctcaggaggagacctagaaattgtaatgcacacttttaattgcggaggggaatt

SEQ ID NO: 187638 - DNA, 75 bp, Artificial Sequence
  Synthetic
tattgtaaaaaatgtagctaccattgtctagtttgctttcagacaaaaggcttaggcatttcctatggcaggaag

SEQ ID NO: 187639 - DNA, 75 bp, Artificial Sequence
  Synthetic
actgctcttacaatactaaaacagaactaagagacaagtctcagaaagtttattcactgttttatagccttgata

SEQ ID NO: 187640 - DNA, 75 bp, Artificial Sequence
  Synthetic
atatattattgtgccccagctggttttgcgattctaaagtgtaatgaaaagaaattcaatggaaaagggtcatgc

SEQ ID NO: 187641 - DNA, 75 bp, Artificial Sequence
  Synthetic
gtgctgttagcttgctcaacgccacagccatagcagtagctgaggggacagataggattatagaagtattacaaa

SEQ ID NO: 187642 - DNA, 75 bp, Artificial Sequence
  Synthetic
ctgcaccactgctgtgccttggaatactagttggagtaataagtcttataatcagatttggaataacatgacctg

SEQ ID NO: 187643 - DNA, 75 bp, Artificial Sequence
  Synthetic
ttagatctgaaaacattacagacaataccaaaaacataatagtacagttcactgagcctgtaccaattacttgta

SEQ ID NO: 187644 - DNA, 75 bp, Artificial Sequence
  Synthetic
cctcactagatcacaatggaataagactttagaaaaagtagctagacaattagaaattcactttaagaacaaaac

SEQ ID NO: 187645 - DNA, 75 bp, Artificial Sequence
  Synthetic
agtaccagtaatggtaatgataccacccaggagggcatagaagagataaaaaattgctctttcaatgcaaccaca

SEQ ID NO: 187646 - DNA, 75 bp, Artificial Sequence
  Synthetic
tctttaatcaatcctcaggaggggacccagagattgtaatgcacagttttaattgtggaggagaatttttctact

SEQ ID NO: 187647 - DNA, 75 bp, Artificial Sequence
  Synthetic
cagagaccttcagacctgcaggaggagatatgagggacaattggagaagtgaattatataaatataaagtagtaa

SEQ ID NO: 187648 - DNA, 75 bp, Artificial Sequence
  Synthetic
atttaatagcagaaatacagaaacaagggcaagaccaatggacatatcaaatatatcaagagccatataaaaatc

SEQ ID NO: 187649 - DNA, 75 bp, Artificial Sequence
  Synthetic
atgggtgcgagagcgtcagtattaagcgggggaaaattagataaatgggaaaaaattcggttaaggccaggggga

SEQ ID NO: 187650 - DNA, 75 bp, Artificial Sequence
  Synthetic
ggctccatggcttagggcaatatatctatgaaacttatggggatacttggacaggagtggaagccataataagaa

SEQ ID NO: 187651 - DNA, 75 bp, Artificial Sequence
  Synthetic
gctggcattgccaactttgctttatgacaaaaggcttaagcatttcctatggcaggaagaagcggaaacgccgac

SEQ ID NO: 187652 - DNA, 75 bp, Artificial Sequence
  Synthetic
caacatacctagcagaataagacagggcctagaaatagctttgcaataaaatggggggcaagtggtcaaaatgta

SEQ ID NO: 187653 - DNA, 75 bp, Artificial Sequence
  Synthetic
atggaattaggccagtagtgtcaactcaactgctgttaaatggcagtctagcagaaaaagaggtagtaattagat

SEQ ID NO: 187654 - DNA, 75 bp, Artificial Sequence
  Synthetic
tgtagagctattcgtaacatacctagaagaatcagacaaggcacagaaagggctttgctataacatggggggcaa

SEQ ID NO: 187655 - DNA, 75 bp, Artificial Sequence
  Synthetic
tagtagcactgatagtggcgctaatcttagcaatagttgtgtgggctatagtattcatagagtgtagaaaattaa

SEQ ID NO: 187656 - DNA, 75 bp, Artificial Sequence
  Synthetic
tatgaaagcagacatccaagagtaagttcagaagtacacatcccactaaaggacgctaaattagtaataacaaca

SEQ ID NO: 187657 - DNA, 75 bp, Artificial Sequence
  Synthetic
ggctaatttaactagtagcagagaaagttcagaaataaaaaactgctctttcaatatcacctcaagcataagaga

SEQ ID NO: 187658 - DNA, 75 bp, Artificial Sequence
  Synthetic
ttcaatataaccacagaaataagagataagaagaagcaagtatatgcacttttttataaacttgatgtggtacca

SEQ ID NO: 187659 - DNA, 75 bp, Artificial Sequence
  Synthetic
attacatgtaatgcaatccttacaaatagcagcaatagtaggattagtagtagcagcaatagtagcaataattgt

SEQ ID NO: 187660 - DNA, 75 bp, Artificial Sequence
  Synthetic
caaaggacacctataggacgagggcaagcactctttacaacaagaaaaaaaggaataaaaggacaagcacattgt

SEQ ID NO: 187661 - DNA, 75 bp, Artificial Sequence
  Synthetic
acaataatttttaaaccatcctcgggaggggacccagaaattacaacacacagctttaattgtggaggggaattt

SEQ ID NO: 187662 - DNA, 75 bp, Artificial Sequence
  Synthetic
gaggggacccagaaattacaacacacagctttaattgtggaggggaatttttctactgcaatacatcaggactgt

SEQ ID NO: 187663 - DNA, 75 bp, Artificial Sequence
  Synthetic
cagctttaattgtggaggggaatttttctactgcaatacatcaggactgtttaataatagtgtatggaggaatga

SEQ ID NO: 187664 - DNA, 75 bp, Artificial Sequence
  Synthetic
ataagaaaagccatattaggacatatagttattcctaggtgtgactatcaagcaggacatactaaggtaggatct

SEQ ID NO: 187665 - DNA, 75 bp, Artificial Sequence
  Synthetic
acactctaaaggacacccagcaaaacaacactctagaggaagagtcaggggcaatacaaaactgttctttcaatg

SEQ ID NO: 187666 - DNA, 75 bp, Artificial Sequence
  Synthetic
tatggggtacctgtgtggcaagatgcaaataccactttattttgtgcatctgatgctaaatcatatagtaatgaa

SEQ ID NO: 187667 - DNA, 75 bp, Artificial Sequence
  Synthetic
gctagaagcacaagaggaggaggaggaggtgggttttccagtcaaacctcaggtacctttaagaccaatgactta

SEQ ID NO: 187668 - DNA, 75 bp, Artificial Sequence
  Synthetic
cctggggatttggggttgctctggaaaactcatttgcaccactactgtgccttggaataatagttggagtaataa

SEQ ID NO: 187669 - DNA, 75 bp, Artificial Sequence
  Synthetic
aaaggtgctatttttagatgggatagataaagctcaagaagaacatgaaagatatcacagcaattggagagcaat

SEQ ID NO: 187670 - DNA, 75 bp, Artificial Sequence
  Synthetic
tcgcaaaaccagcaagaaaagaatgaacaagaattattggaattggataaatgggcaaatttgtggaattggttt

SEQ ID NO: 187671 - DNA, 75 bp, Artificial Sequence
  Synthetic
tttcagacccttatcccaaacccgaggggacccgacaggctcggaggaatcgaagaagaaggtggagagcaagac

SEQ ID NO: 187672 - DNA, 75 bp, Artificial Sequence
  Synthetic
ttgggatcccctacaatccccaaagtcaaggagtagtagaatctatgaataaggaattaaagaaaatcatagggc

SEQ ID NO: 187673 - DNA, 75 bp, Artificial Sequence
  Synthetic
ggacgagcgttctatgcaacaggtgacataataggagatataagaaaagcatattgtgaggttaatagaacaaaa

SEQ ID NO: 187674 - DNA, 75 bp, Artificial Sequence
  Synthetic
taataataacacctgcatcaatactacctatgctgataacatgaaggaagaaataaaaaattgctctttcaatat

SEQ ID NO: 187675 - DNA, 75 bp, Artificial Sequence
  Synthetic
caagaggaagaaggagaagtaggctttccagtcagacctcaggtgcctttaagaccaatgacttataagggagca

SEQ ID NO: 187676 - DNA, 75 bp, Artificial Sequence
  Synthetic
gagcgtcagtattaagcgggggacaattagataaatgggagaaaattcggctaaggccagggggaaagaaaaaat

SEQ ID NO: 187677 - DNA, 75 bp, Artificial Sequence
  Synthetic
aatagtttttactgtaatttctatagtgaatagagttaggcagggatactcaccattatcgttccagacccgcct

SEQ ID NO: 187678 - DNA, 75 bp, Artificial Sequence
  Synthetic
gtacaccaggccatatcacctagaactttaaatgcatgggtaaaagtaatagaggagaaggcttttagcccagag

SEQ ID NO: 187679 - DNA, 75 bp, Artificial Sequence
  Synthetic
gacaagcaatccacctatcccagtgggagacatctataaaagatggataatcctgggattaaataaaatagtaag

SEQ ID NO: 187680 - DNA, 75 bp, Artificial Sequence
  Synthetic
ggacatcaagcagccatgcaaatgttaaaagagaccatcaatgaggaagctgcagaatgggatagattgcatcca

SEQ ID NO: 187681 - DNA, 75 bp, Artificial Sequence
  Synthetic
tcaaaaagtcgtgtgcccggatggaatgaaataagggaaagaatgagacgagctgggccacgagctgagccagca

SEQ ID NO: 187682 - DNA, 75 bp, Artificial Sequence
  Synthetic
taataggtttaagaatagtttttactgtgctttctataataaatagagttaggcagggatactcacctttgtcat

SEQ ID NO: 187683 - DNA, 75 bp, Artificial Sequence
  Synthetic
ggacctagaaattacaacacatagctttaattgtagaggagaatttttctattgcaatacatcaaaactgtttaa

SEQ ID NO: 187684 - DNA, 75 bp, Artificial Sequence
  Synthetic
cggattcttagcacttgcctgggacgatctgcggaacctgtgcctcttcagctaccgccacttgagagacttact

SEQ ID NO: 187685 - DNA, 75 bp, Artificial Sequence
  Synthetic
cacaggtacctttaagaccaatgacttataaggcagctatagatctcagccactttttaaaagaaaaggggggac

SEQ ID NO: 187686 - DNA, 75 bp, Artificial Sequence
  Synthetic
aggggactgagggggagttgggaagccctcaaatacctgtggagccttgtgcagtattggagtcaggaactaaag

SEQ ID NO: 187687 - DNA, 75 bp, Artificial Sequence
  Synthetic
ctcgacgcaggactcggcttgctgaaagcgcgcgcagcaagaggcgaggggcggcgactggtgagtacgccaaaa

SEQ ID NO: 187688 - DNA, 75 bp, Artificial Sequence
  Synthetic
tgtaatcagtttatgggatcaaagtctaaagccatgtgtaaagttaactcctctctgcgttactttaaattgtac

SEQ ID NO: 187689 - DNA, 75 bp, Artificial Sequence
  Synthetic
gaaatatcacagatgaagtaggaaacttaggaaatatatcagaggaagtaagaaactgttcttttaatataacca

SEQ ID NO: 187690 - DNA, 75 bp, Artificial Sequence
  Synthetic
ataaagccacctttacctagtgttaagaagttgacagaggacagatggaacgagccccagaagaccaggggccac

SEQ ID NO: 187691 - DNA, 75 bp, Artificial Sequence
  Synthetic
tggaagcatccaggaagtcagcctaggactgcttgtaacaattgctattgtaaaaagtgttgctttcattgccaa

SEQ ID NO: 187692 - DNA, 75 bp, Artificial Sequence
  Synthetic
atcaaaagatagaggtaaaagacaccaaggaagctttagacaagatagaggaagagcaaaacaaaagtaagaaaa

SEQ ID NO: 187693 - DNA, 75 bp, Artificial Sequence
  Synthetic
tccctcagatcactctttggcaacgaccccttgtcacaataaagataggggggcaactaaaggaagctctattag

SEQ ID NO: 187694 - DNA, 75 bp, Artificial Sequence
  Synthetic
ttaagacaaagaaaaatagacaggttaattgatagaataagagaaagagcagaagacagtggcaatgaaagtgaa

SEQ ID NO: 187695 - DNA, 75 bp, Artificial Sequence
  Synthetic
agacaatgctaaagtcataatagtacatctgaatgaatctgtagaaattaattgtacaagaccccacaacaatac

SEQ ID NO: 187696 - DNA, 75 bp, Artificial Sequence
  Synthetic
tatgtaatgcaggcattagaaatatctgcaatagtaggactagtagtagcattcttagcagccatagttgtgtgg

SEQ ID NO: 187697 - DNA, 75 bp, Artificial Sequence
  Synthetic
aaataagaaaacagaaaaaaataggaaagttacttgatagaataagagaaagagcagaagacagtggaaatgaga

SEQ ID NO: 187698 - DNA, 75 bp, Artificial Sequence
  Synthetic
taatggagaaaggagaaataaaaaactgctctttcaatatcaccacaagcataagagataaggtgcagaaagaat

SEQ ID NO: 187699 - DNA, 75 bp, Artificial Sequence
  Synthetic
ctgctctttcaatatcaccacaagcataagagataaggtgcagaaagaatatgcacttttttataaacttgatgt

SEQ ID NO: 187700 - DNA, 75 bp, Artificial Sequence
  Synthetic
agctataggttgataaattgtaatacctcagtcattacacaggcctgtccaaaggtatcctttgagccaattccc

SEQ ID NO: 187701 - DNA, 75 bp, Artificial Sequence
  Synthetic
atacatggatgacttgtatgtaggatctgatttagaaataggacagcatagagcaaaaatagaggaattaagggc

SEQ ID NO: 187702 - DNA, 75 bp, Artificial Sequence
  Synthetic
gattcagtggagaaagaaatgaaaaattgctcttttaatatcaccacaagcatgcaagataagaagcagaaagta

SEQ ID NO: 187703 - DNA, 75 bp, Artificial Sequence
  Synthetic
cccaaacccgaggggaccagacaggctcggaggaatcgaagaagaaggtggagagcaagacagaagcagatccat

SEQ ID NO: 187704 - DNA, 75 bp, Artificial Sequence
  Synthetic
gtgaatctgataaaaaactgctctagcaatagcaccaccaaggtaaccgatgagataagaaatgaaatcgcgctt

SEQ ID NO: 187705 - DNA, 75 bp, Artificial Sequence
  Synthetic
cagagcagtaaggatcatcaaaaccctataccaaagcagtaagtagtgtaattaatatctgtaatgcaaccttta

SEQ ID NO: 187706 - DNA, 75 bp, Artificial Sequence
  Synthetic
atggaattaggccagtagtatcaactcaactgttgttaaatggcagtctagcagaaaaagagatagtaattagat

SEQ ID NO: 187707 - DNA, 75 bp, Artificial Sequence
  Synthetic
atagtgcagaatctccaagggcaaatggtacatcaggccatatcacctagaactttaaatgcatgggtaaaagta

SEQ ID NO: 187708 - DNA, 75 bp, Artificial Sequence
  Synthetic
tatcaactcaattactgctaaatggcagtttagcagaaaaggatatagtaattagatctgaaaacttcacaaaca

SEQ ID NO: 187709 - DNA, 75 bp, Artificial Sequence
  Synthetic
aaatgggcaagcctgtggaattggtttgacataacaaaatggctgtggtatataaaaatattcataatgatagta

SEQ ID NO: 187710 - DNA, 75 bp, Artificial Sequence
  Synthetic
aactaagccagcagcagagccagcagtagagccagcagcagtgggagtagggccagcgtctcaagacctagataa

SEQ ID NO: 187711 - DNA, 75 bp, Artificial Sequence
  Synthetic
agcgttctgggcaacaggtgacataataggagatataagacaagctcattgtaatgttaatagaacaaattggac

SEQ ID NO: 187712 - DNA, 75 bp, Artificial Sequence
  Synthetic
agaataaaacaaattataaacatgtggcaggaagtaggaaaagcaatgtatgcccctcccatcagtggactaatt

SEQ ID NO: 187713 - DNA, 75 bp, Artificial Sequence
  Synthetic
atgccaccattgccccaaacatgaaagaagaaataaaaaactgttcttacaatatgaccacagcatttaaggata

SEQ ID NO: 187714 - DNA, 75 bp, Artificial Sequence
  Synthetic
catctaataatactgcaatcacactccgatgtagaataatacgaattataaggatgtggcagagagtgggacaag

SEQ ID NO: 187715 - DNA, 75 bp, Artificial Sequence
  Synthetic
gaaagagaaattgacaattacacaagcttaatatacaccttaattgaagaatcgcagaaccaacaagaaaagaat

SEQ ID NO: 187716 - DNA, 75 bp, Artificial Sequence
  Synthetic
gaagccttagacaagatagaggaagaacaaaacaaatgtcagcaaaaaacacagcaagcagaagcggctgacaaa

SEQ ID NO: 187717 - DNA, 75 bp, Artificial Sequence
  Synthetic
aggaaggacaccaaatgaaagactgtactaatgagagacaggctaattttttagggaaaatttggccttcccaca

SEQ ID NO: 187718 - DNA, 75 bp, Artificial Sequence
  Synthetic
agtgaacggattcttagcacttatctgggacgatctgcggagcctgtgcctcttcagctaccaccgcttgagaga

SEQ ID NO: 187719 - DNA, 75 bp, Artificial Sequence
  Synthetic
ctaaagaatagtgctgttagcttgctcaatgccacagctatagcagtagctgaggggacagataggattatagaa

SEQ ID NO: 187720 - DNA, 75 bp, Artificial Sequence
  Synthetic
aagtacacatcccactaggggatgctagattggtaataaaaacatattggggtctgcatacaggagaaagagact

SEQ ID NO: 187721 - DNA, 75 bp, Artificial Sequence
  Synthetic
gcgaaagtgagaccagagaagctctctcgacgcaggactcggcttgctgaagcgcgcacagcaagaggcgagggg

SEQ ID NO: 187722 - DNA, 75 bp, Artificial Sequence
  Synthetic
gacaggagttgaagctatagtaagaatccttcaacaactactgtttatccatttcagaattgggtgtcaacatag

SEQ ID NO: 187723 - DNA, 75 bp, Artificial Sequence
  Synthetic
ggcacatagccagaaattgcagggcccctaggaaaaggggctgttggaaatgtggaaaggaaggacaccaaatga

SEQ ID NO: 187724 - DNA, 75 bp, Artificial Sequence
  Synthetic
tggcaggaagaagcggagacagcgacgaagaactcctcagagcaataaggatcatcaaaatcctataccaaagca

SEQ ID NO: 187725 - DNA, 75 bp, Artificial Sequence
  Synthetic
ttgcaaatctgggcaatagtaggactgatagtagcgctaatcctagcaatagttgtatggactatagtaggtata

SEQ ID NO: 187726 - DNA, 75 bp, Artificial Sequence
  Synthetic
ggtagtgctatcagtttgtttaatgccatagcaatagcagtagctgaggggacagacagagttatagaagttgga

SEQ ID NO: 187727 - DNA, 75 bp, Artificial Sequence
  Synthetic
gaatataagaaaataagaaaacaaagaaaaatagacagattaattaagagaataggagacagagcagaagacagt

SEQ ID NO: 187728 - DNA, 75 bp, Artificial Sequence
  Synthetic
ggggaacgtcttcagcagcagaaggaataggagaagagcctcagagggagtaggagcagtgtctcgagatttaga

SEQ ID NO: 187729 - DNA, 75 bp, Artificial Sequence
  Synthetic
cagcagctgccacaggaagcagcagccaaaattaccctatagtgcaaaatgcacaagggcaaatgatacatcagc

SEQ ID NO: 187730 - DNA, 75 bp, Artificial Sequence
  Synthetic
ccatgtcacctaggactttgaatgcatgggtgaaagtaatagaagaaaaggctttcagcccagaagtaataccca

SEQ ID NO: 187731 - DNA, 75 bp, Artificial Sequence
  Synthetic
gggaataataatactaatatcactgggaaggctaataccactattgatgatatagaaatgaaaaattgctctttc

SEQ ID NO: 187732 - DNA, 75 bp, Artificial Sequence
  Synthetic
atcagcttatgggatcaaagcttaaaaccatgtgtaaaattaaccccactctgtgttactttaaactgtactgat

SEQ ID NO: 187733 - DNA, 75 bp, Artificial Sequence
  Synthetic
acctatcccagtgggagaaatctataaaagatggataattctggggttaaataaaatagtaagaatgtatagccc

SEQ ID NO: 187734 - DNA, 75 bp, Artificial Sequence
  Synthetic
taatactcctagtacccttattaatgtcactatgaatgctactgacacagatatgaaaaactgctctttcaatat

SEQ ID NO: 187735 - DNA, 75 bp, Artificial Sequence
  Synthetic
caagtcattatataatacagtagcaaccctctattgtgtccatcaaaggatagacataaaggacaccaaggaagc

SEQ ID NO: 187736 - DNA, 75 bp, Artificial Sequence
  Synthetic
agcagctacactagaagaaatgatgacagcatgtcagggagtgggaggacctggccataaagcaagagttttggc

SEQ ID NO: 187737 - DNA, 75 bp, Artificial Sequence
  Synthetic
aaactttctatgtagatggagcagctaatagggaaactaaaataggaaaagcagggtatgttactgacagaggaa

SEQ ID NO: 187738 - DNA, 75 bp, Artificial Sequence
  Synthetic
aatccagaaatagttatctatcaatacatggatgacttgtatgtaggatctgatttagaaatagggcagcataga

SEQ ID NO: 187739 - DNA, 75 bp, Artificial Sequence
  Synthetic
tagagttagtcctaggtgtgaatatcaagcaggacataataaggtaggatccttacaatatctggcactaacagc

SEQ ID NO: 187740 - DNA, 75 bp, Artificial Sequence
  Synthetic
caagaacaggtatccctataggaccagggcgagcattctatgcaacaggagacatagtaggagacataagacagg

SEQ ID NO: 187741 - DNA, 75 bp, Artificial Sequence
  Synthetic
tattttgtgcatcagatgctaaagcatatgacacagaggtacataatgtttgggccacacatgcctgtgtaccca

SEQ ID NO: 187742 - DNA, 75 bp, Artificial Sequence
  Synthetic
gaacaactccttacggcagtaagaatcatcaagatcctataccagagcagtaagtattgttaaacagtatatgta

SEQ ID NO: 187743 - DNA, 75 bp, Artificial Sequence
  Synthetic
aaatggagaaaattagtagatttcagagaactcaataaaagaactcaagacttttgggaagttcaattaggaata

SEQ ID NO: 187744 - DNA, 75 bp, Artificial Sequence
  Synthetic
aggatcaacagctcctaggaatttggggctgctctggaaaactcatctgcaccactgatgtgccttggaactcta

SEQ ID NO: 187745 - DNA, 75 bp, Artificial Sequence
  Synthetic
acagtaaaaatagagggacagctaagagaagctctattagatacaggagcagatgatacagtgttagaagacata

SEQ ID NO: 187746 - DNA, 75 bp, Artificial Sequence
  Synthetic
aataccactagtagtggcggggaaatgatgggggaaggagaaatgaaaaactgctctttcaacatcaccacaagc

SEQ ID NO: 187747 - DNA, 75 bp, Artificial Sequence
  Synthetic
tgaaaaatcgcaaaaccagcaggaacaaaatgaaaaggatttattagcattggacaagtggcaaaatctgtggaa

SEQ ID NO: 187748 - DNA, 75 bp, Artificial Sequence
  Synthetic
catatggcaggaagaagcggagtcagcgacgaagcgctcctccaagcaacaaggatcatcaggatcttgtatcaa

SEQ ID NO: 187749 - DNA, 75 bp, Artificial Sequence
  Synthetic
aaacatcagaaagaacctccatttctttggatgggatatgaactccatcctgacaaatggacagtccagcctata

SEQ ID NO: 187750 - DNA, 75 bp, Artificial Sequence
  Synthetic
ataaatagagttaggcagggatactcacctttgtcgtttcagacccttaccccaaacccgaggggacccgacagg

SEQ ID NO: 187751 - DNA, 75 bp, Artificial Sequence
  Synthetic
ttcaatataaccacagtattacaagataagaagacaaaagaatatgcgcttttttatagatttgatgtagtacca

SEQ ID NO: 187752 - DNA, 75 bp, Artificial Sequence
  Synthetic
aattgtatggaccatagcctatctagaatatagaaaattggtaagacaaaggaaaatagactggttaattaaaag

SEQ ID NO: 187753 - DNA, 75 bp, Artificial Sequence
  Synthetic
cctagtgtgcagaaattagtagaggatagatggaacaacccccagaagaccaggggccacagagggagccataca

SEQ ID NO: 187754 - DNA, 75 bp, Artificial Sequence
  Synthetic
taataaaacaataaaatttaattcatcctcaggaggggacctagaaattacaatgcatagttttaattgtagagg

SEQ ID NO: 187755 - DNA, 75 bp, Artificial Sequence
  Synthetic
tcctcaggaggggacctagaaattacaatgcatagttttaattgtagaggagaatttttctactgcaatacatca

SEQ ID NO: 187756 - DNA, 75 bp, Artificial Sequence
  Synthetic
ttctgggacacagcagtctcaaggggttgagactggggtgggagggcctcaaatatctgtggaatctcctgctgt

SEQ ID NO: 187757 - DNA, 75 bp, Artificial Sequence
  Synthetic
cccatgtaaaataaaacaaatagtaaatatgtggcaagaagtaggacgagcaatgtatgccgcccccattgcagg

SEQ ID NO: 187758 - DNA, 75 bp, Artificial Sequence
  Synthetic
taaaacaatagtttttaatcaatcctcaggaggggacatagaaattgtaatgcacagttttaattgtggagggga

SEQ ID NO: 187759 - DNA, 75 bp, Artificial Sequence
  Synthetic
actctgtgtcgctttaaactgtactgatgtttccagtgaagatcacaatatgactggagaaataaaaaattgctc

SEQ ID NO: 187760 - DNA, 75 bp, Artificial Sequence
  Synthetic
gtggtcagaataatgagactaataatactgagaccttcagacctgggggaggaaatatgaaggacaattggagaa

SEQ ID NO: 187761 - DNA, 75 bp, Artificial Sequence
  Synthetic
aaagggctttgctataacatgggtggcaagtggtcaaaaagtagcatagtgggatggcctgaggttagggaaaga

SEQ ID NO: 187762 - DNA, 75 bp, Artificial Sequence
  Synthetic
gaaatgagtaattgctctttcaatgtaaccacagaactaagagataagaaaaagcaggaatatgcacttttttat

SEQ ID NO: 187763 - DNA, 75 bp, Artificial Sequence
  Synthetic
ctgttagacattttcctaggccctggctccatggcttaggacagtatatctataacacttatggggatacttggg

SEQ ID NO: 187764 - DNA, 75 bp, Artificial Sequence
  Synthetic
agcacagatgaaatgaaaaattgctctttcaatgcaaccacagaagtaagagataagataagaaaagaatatgca

SEQ ID NO: 187765 - DNA, 75 bp, Artificial Sequence
  Synthetic
ccttttcagctaccaccgcttgagagacttactcttgattgcagcgaggattgtggaacttctgggacgcagggg

SEQ ID NO: 187766 - DNA, 75 bp, Artificial Sequence
  Synthetic
gacttactcttgattgcagcgaggattgtggaacttctgggacgcagggggtgggaagccctcaagtattggtgg

SEQ ID NO: 187767 - DNA, 75 bp, Artificial Sequence
  Synthetic
acataagacaaggaccaaaggaaccctttagagactatgtagaccggttctataaaactctaagagccgagcaag

SEQ ID NO: 187768 - DNA, 75 bp, Artificial Sequence
  Synthetic
tatcctccacatacctagaagaataagacaaggcttagaaagaagtttgctataagatgggtggcaagtggtcaa

SEQ ID NO: 187769 - DNA, 75 bp, Artificial Sequence
  Synthetic
actagaagaaatgatgacagcatgtcagggagtgggaggacccggccataaagcaagagttttggctgaagcaat

SEQ ID NO: 187770 - DNA, 75 bp, Artificial Sequence
  Synthetic
attggagtcaggaactaaagaatagtgctattagcttgctcaatgccacagccatagcagtagctgaggggacag

SEQ ID NO: 187771 - DNA, 75 bp, Artificial Sequence
  Synthetic
tgacctggatgcagtgggatagagaaattagtaattacacagacacaatatacaagttgcttgaagactcgcaaa

SEQ ID NO: 187772 - DNA, 75 bp, Artificial Sequence
  Synthetic
cagaaattgcagggcccctaggaaaaagggctgttggaaatgtggaaaggagggacaccaaatgaaagactgtac

SEQ ID NO: 187773 - DNA, 75 bp, Artificial Sequence
  Synthetic
acagggttttgaaagggctttgctataaaatgggtggcaagtggtcaaaaagtagtatagttggatggcctgctg

SEQ ID NO: 187774 - DNA, 75 bp, Artificial Sequence
  Synthetic
ggataagaagcaggaggtccatgcacttttttatgtgcctgatatagtacgaattggagaaaagaataaaaatag

SEQ ID NO: 187775 - DNA, 75 bp, Artificial Sequence
  Synthetic
aatcacaagcagcaatacagcagctacgaatgcagactgtgcctggctggaagcacaaacagaggaagaagtagg

SEQ ID NO: 187776 - DNA, 75 bp, Artificial Sequence
  Synthetic
ttaggacaacatatctatgaaacatatggggatacttgggaaggagttgaagctataataagaattttgcaacaa

SEQ ID NO: 187777 - DNA, 75 bp, Artificial Sequence
  Synthetic
gtggcgcccgaatagggactcgaaagcgaaagttccagagaagatctctcgacgcagggactcggcttgctgaag

SEQ ID NO: 187778 - DNA, 75 bp, Artificial Sequence
  Synthetic
gtaagaacatattggggtctgcacccaggagaaaaagactggcaattgggtcatggggtctccatagagtggagg

SEQ ID NO: 187779 - DNA, 75 bp, Artificial Sequence
  Synthetic
acagctcctagggatttggggttgctctggaaaactcatttgcaccactgctgtgccttggaatgctagttggag

SEQ ID NO: 187780 - DNA, 75 bp, Artificial Sequence
  Synthetic
gaaattacaatgcatcattttaattgtagaggggaatttttctattgcaatacaacaaaactgtttaatagtact

SEQ ID NO: 187781 - DNA, 75 bp, Artificial Sequence
  Synthetic
aggcagcagctgccacaggaagcagcagccaaaatttccctatagtgcaaaatgcacaagggcaaatggtacatc

SEQ ID NO: 187782 - DNA, 75 bp, Artificial Sequence
  Synthetic
tatcacacttccatgcaggataaagcaagttgtaaacatgtggcaggaagtaggaaaagcaatgtatgctcctcc

SEQ ID NO: 187783 - DNA, 75 bp, Artificial Sequence
  Synthetic
aatgcacaagggcaaatggtacatcaggctctatcgcctagaactttgaatgcatgggtaaaagtagtagaagaa

SEQ ID NO: 187784 - DNA, 75 bp, Artificial Sequence
  Synthetic
gacgcaacagttgggaagcccttaaatatctgggaagtcttgtgcagtattggggtctagaactaaaaaagagtg

SEQ ID NO: 187785 - DNA, 75 bp, Artificial Sequence
  Synthetic
attgggaaggaaaggaagaagtaaaaaactgctctttcaatgtcactgcaggaataaaggataaggtacagaaag

SEQ ID NO: 187786 - DNA, 75 bp, Artificial Sequence
  Synthetic
gtcaacatcacgggtaacacagaaaatttagcaaactgctctttcaatataacgacagaaataagagataataaa

SEQ ID NO: 187787 - DNA, 75 bp, Artificial Sequence
  Synthetic
gcagtacagaccatcaaaatcctataccgaagcagtaagtagtggtaattaatgtatgtaatgtttcctttgcac

SEQ ID NO: 187788 - DNA, 75 bp, Artificial Sequence
  Synthetic
gatggcctgcaataagggatagaatgagaagagctaatgcagcagcagcagagggagtagaaaggagaagaactg

SEQ ID NO: 187789 - DNA, 75 bp, Artificial Sequence
  Synthetic
cagaattagaattggcagaaaacagggagattctaaaaaaccctgtgcatggggtatattatgacccatcaaaag

SEQ ID NO: 187790 - DNA, 75 bp, Artificial Sequence
  Synthetic
aagacccagtaacaatacaagaaaaggtatacatataggaccagggagagcattttatgcaacagacataatagg

SEQ ID NO: 187791 - DNA, 75 bp, Artificial Sequence
  Synthetic
gaaaaagtatacacattgggccaggacaagcgttctatgcaacaggttctgtaataggagatataagacaagcct

SEQ ID NO: 187792 - DNA, 75 bp, Artificial Sequence
  Synthetic
cttcagctaccaccgcttgagagacttcatattgattgcagcgaggactgtggaacttctgggacacagcagtct

SEQ ID NO: 187793 - DNA, 75 bp, Artificial Sequence
  Synthetic
cctgtcatgggtaccagcacacaaggggattggaggaaatgaacaagtagataaattagtcagttctggaatcag

SEQ ID NO: 187794 - DNA, 75 bp, Artificial Sequence
  Synthetic
atgggaaaaaattcggttaaggccagggggaaagaaaaaatataaattaaaacatctagtatgggcaagcaggga

SEQ ID NO: 187795 - DNA, 75 bp, Artificial Sequence
  Synthetic
atttcctatggcaggaagaagcggagacaacgacgaagcactcctcctagcagtgaggaccatcaaaatcttgta

SEQ ID NO: 187796 - DNA, 75 bp, Artificial Sequence
  Synthetic
ttgatacaacagcaatagcagtagctaactggacagatagggttatagaagtagtacaaagagcttttagagctt

SEQ ID NO: 187797 - DNA, 75 bp, Artificial Sequence
  Synthetic
gccataaggaaagccttattaggacaagtagttagccctaggtgtgattatcaaacaggacataacaaggtagga

SEQ ID NO: 187798 - DNA, 75 bp, Artificial Sequence
  Synthetic
acctcaggtacctttgagaccaatgacttttaaaggtgcttttgatctcagcttctttttaaaagaaaagggggg

SEQ ID NO: 187799 - DNA, 75 bp, Artificial Sequence
  Synthetic
agctgttagacattttcctaggccatggcttcatggattaggacaacatatctataacacctatggggatacttg

SEQ ID NO: 187800 - DNA, 75 bp, Artificial Sequence
  Synthetic
gcaggaagaagcggagacagcgacgaagagctcctgacagcagtcagaatcatcaagcttctctatcaaagcagt

SEQ ID NO: 187801 - DNA, 75 bp, Artificial Sequence
  Synthetic
caaaggaaggcagaaagtggttaccctaactgaaacaacaaatcaaaagactgaactagaagcaatttatctagc

SEQ ID NO: 187802 - DNA, 75 bp, Artificial Sequence
  Synthetic
cagaataggcattattcgagggagaagaggcaggaatggatccggtagatcctaacctagagccctggaaccacc

SEQ ID NO: 187803 - DNA, 75 bp, Artificial Sequence
  Synthetic
aagtaaaaaattgctctttcaacacaaccacagaactaagagataaaaaacagaaagtgtatgcacttttttata

SEQ ID NO: 187804 - DNA, 75 bp, Artificial Sequence
  Synthetic
tcagctaccaccgcttgagagattgcatcttgattgtggcgaggactgtggaacttctgggacacagcagtctca

SEQ ID NO: 187805 - DNA, 75 bp, Artificial Sequence
  Synthetic
agataagagtgagtcagaattagtcagtcaaataatagagcagttaataaaaaaggaaaaggtttacctgtcatg

SEQ ID NO: 187806 - DNA, 75 bp, Artificial Sequence
  Synthetic
atcatcaaaatcctgtacaaaagcagtaagtattagtaatgtaatgttgtctattttgcaaatttgtgcaatagt

SEQ ID NO: 187807 - DNA, 75 bp, Artificial Sequence
  Synthetic
tatccctagaagaatcagacagggtttagaaagggctttaatataaaatggggaacaagtggtcaaaaggatggc

SEQ ID NO: 187808 - DNA, 75 bp, Artificial Sequence
  Synthetic
aatgtcaactaaaaggggaagccatgcatggacaagtagactgtagtccaggaatatggcaattagattgtacac

SEQ ID NO: 187809 - DNA, 75 bp, Artificial Sequence
  Synthetic
ctgctattagggaaagaataagaagaactccagcaatagaaagagtaggagcagcagaaggagtaggagcagcat

SEQ ID NO: 187810 - DNA, 75 bp, Artificial Sequence
  Synthetic
caacctaaaagataaggtacagacagcatatgcaaatttttataagcttgatgtagtacaaatagataatgataa

SEQ ID NO: 187811 - DNA, 75 bp, Artificial Sequence
  Synthetic
aggcttcccagtcaggccacaggtacctttaagaccaatgacctacaagggagcttttgatctcagccacctttt

SEQ ID NO: 187812 - DNA, 75 bp, Artificial Sequence
  Synthetic
acaggaaagtatgcaagaacgaggggtgcccacactaatgatgtaaaacaattaacagaggcagtgcaaaaaata

SEQ ID NO: 187813 - DNA, 75 bp, Artificial Sequence
  Synthetic
gggaatgaaactgacatgagaaactgctctttcaatatgaccacagaattaagagataaaaagagaaaagtagag

SEQ ID NO: 187814 - DNA, 75 bp, Artificial Sequence
  Synthetic
aggtaggatctctacaatacttggcactgacagcattgataaaaccaaaaaagagaaagccacctctgcctagtg

SEQ ID NO: 187815 - DNA, 75 bp, Artificial Sequence
  Synthetic
aggggaggccagggaattttcttcagaacaggccagagccaacagcccggacagagccaacagccccaccagcag

SEQ ID NO: 187816 - DNA, 75 bp, Artificial Sequence
  Synthetic
attagatctgaaaatctcacaaataatgctaaaatcataatagtgcagcttaatgagtcagtaccaatcgagtgc

SEQ ID NO: 187817 - DNA, 75 bp, Artificial Sequence
  Synthetic
agtttctgtatcaaagcagtaagtaatacatgtaatgcaatccttacaaatagcagcaatagtaggattagtagt

SEQ ID NO: 187818 - DNA, 75 bp, Artificial Sequence
  Synthetic
atgttagtagagaaaaatggaataaaactttacaacaggtagataaaaaactaagagaccttcttaacctgacaa

SEQ ID NO: 187819 - DNA, 75 bp, Artificial Sequence
  Synthetic
gcctagtgttaggaaattaacagaggatagatggaacaagccccagaagaccaagggccacagagggagccatac

SEQ ID NO: 187820 - DNA, 75 bp, Artificial Sequence
  Synthetic
gcaggataaaacaaattataaacatgtggcagggagtaggaaaagcaatgtatgcccctcccattgaaggactaa

SEQ ID NO: 187821 - DNA, 75 bp, Artificial Sequence
  Synthetic
accatagtatatatagaatataggaaattggtaagacaaagaaaaatagactggttaattaaaagaattagggaa

SEQ ID NO: 187822 - DNA, 75 bp, Artificial Sequence
  Synthetic
tgtgcatcagatgctaaagcatatgagagagaagtgcataatgtctgggctacacatgcctgtgtacccacagac

SEQ ID NO: 187823 - DNA, 75 bp, Artificial Sequence
  Synthetic
tggaattggtttagcataacaaattggctgtggtatataaaaatattcataatgatagtaggaggcttgataggt

SEQ ID NO: 187824 - DNA, 75 bp, Artificial Sequence
  Synthetic
actaaaaaagagtgctattagtctgcttgataccatagcaataacagtagctgagggaacagataggattataga

SEQ ID NO: 187825 - DNA, 75 bp, Artificial Sequence
  Synthetic
gaagcggagacagcgacgaccagcttctcacagcagtaagactcatcaagatcctataccagagcagtaagtata

SEQ ID NO: 187826 - DNA, 75 bp, Artificial Sequence
  Synthetic
gagccaggggcaatacaaaactgttctttcaatatgaccacagaagtaagagataagcagcagaaagtacatgca

SEQ ID NO: 187827 - DNA, 75 bp, Artificial Sequence
  Synthetic
tctcacagcagtaagactcatcaagatcctataccagagcagtaagtataattgcttaatcttgtaatgatacct

SEQ ID NO: 187828 - DNA, 75 bp, Artificial Sequence
  Synthetic
catgaaggaagaaatgagaaattgcactttcaatacaaccacagaaataagagataaggaaaagcagatgtatgc

SEQ ID NO: 187829 - DNA, 75 bp, Artificial Sequence
  Synthetic
ttgctctggaaggcacatttgcaccactactgtgccctggaactcaagctggagtaataaatctctagaggagat

SEQ ID NO: 187830 - DNA, 75 bp, Artificial Sequence
  Synthetic
cctgcaatttccctcaaatcactctttggcaacgaccccttgttacagtaaaaatagaaggacagctaagagaag

SEQ ID NO: 187831 - DNA, 75 bp, Artificial Sequence
  Synthetic
ataggattatagaagtattacaaagaatttgtagagctattatccacatacctgtacgaataagacagggcttgg

SEQ ID NO: 187832 - DNA, 75 bp, Artificial Sequence
  Synthetic
tggtagagctattctccacatacctagaagaataagacagggcttggaaagggctttgctataagatgggtggca

SEQ ID NO: 187833 - DNA, 75 bp, Artificial Sequence
  Synthetic
aacaataatacaagaaaaagtataaggatagggccaggacaaacattctatgcaacaggagaaataataggaaac

SEQ ID NO: 187834 - DNA, 75 bp, Artificial Sequence
  Synthetic
caatgtcaatctcaacaacattaaggaaggaggaataaaaaactgttctttcaatgccactacagtaataaaaga

SEQ ID NO: 187835 - DNA, 75 bp, Artificial Sequence
  Synthetic
aaaggcttaggcatctcctatggcaggaagaagcggagacagcgacgaagagctcctcaagacagtcagactcat

SEQ ID NO: 187836 - DNA, 75 bp, Artificial Sequence
  Synthetic
cctagaaattacaacacatagttttaattgtagaggagaattcttctattgtaatacatcaaaactgtttaatag

SEQ ID NO: 187837 - DNA, 75 bp, Artificial Sequence
  Synthetic
tctagctttgcaagattcaggattagaagtaaacatagtaacagattcacagtatgcattaggaatcattcaagc

SEQ ID NO: 187838 - DNA, 75 bp, Artificial Sequence
  Synthetic
tgcactgaatatacccctaatgccactaatatcactaacgaggacataggaatgaaaaactgctctttcaatgta

SEQ ID NO: 187839 - DNA, 75 bp, Artificial Sequence
  Synthetic
gtgttattgtaaaaattgcagctatcattgtctagtttgctttcagacaaaaggcttaggcatttcctatggcag

SEQ ID NO: 187840 - DNA, 75 bp, Artificial Sequence
  Synthetic
cattgtctagtttgctttcagacaaaaggcttaggcatttcctatggcaggaagaagcggagacagcgacgaagc

SEQ ID NO: 187841 - DNA, 75 bp, Artificial Sequence
  Synthetic
atcagacctggcaataatacaagaagaagtgtgcgtataggaccagggcaaacattctatgcaacagatgacata

SEQ ID NO: 187842 - DNA, 75 bp, Artificial Sequence
  Synthetic
caataatctttagtaactcctcaggaggggatttagagattacaacacatagttttaattgtggaggagaatttt

SEQ ID NO: 187843 - DNA, 75 bp, Artificial Sequence
  Synthetic
gattaggccagtagtgtcaactcagctgttgttgaatggcagtctagcagaggaagagataataattagaactga

SEQ ID NO: 187844 - DNA, 75 bp, Artificial Sequence
  Synthetic
tcctggtagcagtccatgtagccagtggctatatagaagcagaagttatcccagcagaaacaggacaggaaacag

SEQ ID NO: 187845 - DNA, 75 bp, Artificial Sequence
  Synthetic
ctaataccaatagtagtagcacgagattaacgacggaggcagaagaaatgaaaaactgctctttaaatataacca

SEQ ID NO: 187846 - DNA, 75 bp, Artificial Sequence
  Synthetic
ctaataccaatagtagtagcacgagattaacgacggaggcagaagaaatgaaaaactgctctttaaatattacca

SEQ ID NO: 187847 - DNA, 75 bp, Artificial Sequence
  Synthetic
ctaataccaatagtagtagcacgagattaacgacggaggcagaagaaatgaaaaactgctctttaaatatcacca

SEQ ID NO: 187848 - DNA, 75 bp, Artificial Sequence
  Synthetic
ctaataccaatagtagtagcacgagattaacgacggaggcagaagaaatgaaaaactgctctttaaatatgacca

SEQ ID NO: 187849 - DNA, 75 bp, Artificial Sequence
  Synthetic
ctaataccaatagtagtagcacgagattaacgacggaggcagaagaaatgaaaaactgctcttttaatataacca

SEQ ID NO: 187850 - DNA, 75 bp, Artificial Sequence
  Synthetic
ctaataccaatagtagtagcacgagattaacgacggaggcagaagaaatgaaaaactgctcttttaatattacca

SEQ ID NO: 187851 - DNA, 75 bp, Artificial Sequence
  Synthetic
ctaataccaatagtagtagcacgagattaacgacggaggcagaagaaatgaaaaactgctcttttaatatcacca

SEQ ID NO: 187852 - DNA, 75 bp, Artificial Sequence
  Synthetic
ctaataccaatagtagtagcacgagattaacgacggaggcagaagaaatgaaaaactgctcttttaatatgacca

SEQ ID NO: 187853 - DNA, 75 bp, Artificial Sequence
  Synthetic
ctaataccaatagtagtagcacgagattaacgacggaggcagaagaaatgaaaaactgctctttcaatataacca

SEQ ID NO: 187854 - DNA, 75 bp, Artificial Sequence
  Synthetic
ctaataccaatagtagtagcacgagattaacgacggaggcagaagaaatgaaaaactgctctttcaatattacca

SEQ ID NO: 187855 - DNA, 75 bp, Artificial Sequence
  Synthetic
ctaataccaatagtagtagcacgagattaacgacggaggcagaagaaatgaaaaactgctctttcaatatcacca

SEQ ID NO: 187856 - DNA, 75 bp, Artificial Sequence
  Synthetic
ctaataccaatagtagtagcacgagattaacgacggaggcagaagaaatgaaaaactgctctttcaatatgacca

SEQ ID NO: 187857 - DNA, 75 bp, Artificial Sequence
  Synthetic
ctaataccaatagtagtagcacgagattaacgacggaggcagaagaaatgaaaaactgctctttgaatataacca

SEQ ID NO: 187858 - DNA, 75 bp, Artificial Sequence
  Synthetic
ctaataccaatagtagtagcacgagattaacgacggaggcagaagaaatgaaaaactgctctttgaatattacca

SEQ ID NO: 187859 - DNA, 75 bp, Artificial Sequence
  Synthetic
ctaataccaatagtagtagcacgagattaacgacggaggcagaagaaatgaaaaactgctctttgaatatcacca

SEQ ID NO: 187860 - DNA, 75 bp, Artificial Sequence
  Synthetic
ctaataccaatagtagtagcacgagattaacgacggaggcagaagaaatgaaaaactgctctttgaatatgacca

SEQ ID NO: 187861 - DNA, 75 bp, Artificial Sequence
  Synthetic
ataggactagggcaagcattatatacaacaagaataataggagatataagacaagcacattgtaacattagtaga

SEQ ID NO: 187862 - DNA, 75 bp, Artificial Sequence
  Synthetic
gatggaaagatttgcacttaaccctagcctgttagaaacagcagaaggatgtcaacaaataatagaacaaataca

SEQ ID NO: 187863 - DNA, 75 bp, Artificial Sequence
  Synthetic
gtgggcaaatatcacacaagaatttggaattccctacaatccccaaagtcaaggagtagtggaatctatgaataa

SEQ ID NO: 187864 - DNA, 75 bp, Artificial Sequence
  Synthetic
tttaaactgtacagatgcgggtgctactaatgctactaatgctactattacacctgaagaaataaaaaattgtac

SEQ ID NO: 187865 - DNA, 75 bp, Artificial Sequence
  Synthetic
caaatcagaagactgaattacatgcaatctatttggctttacaggattcaggattagaagtaaacatagtaacag

SEQ ID NO: 187866 - DNA, 75 bp, Artificial Sequence
  Synthetic
tgagccagcagcagatggggtgggagcagcatctcgagacttggagagacatggagcactcacaagtagcaatac

SEQ ID NO: 187867 - DNA, 75 bp, Artificial Sequence
  Synthetic
aaccagcaggaaaagaatgaacaagaattattggcattggacaagtgggcaagtctgtggaattggtttgacata

SEQ ID NO: 187868 - DNA, 75 bp, Artificial Sequence
  Synthetic
agtaagaaactgttcttttaatatgaccacagaactacaagataaaaagcaggaggtccatgcacttttttatac

SEQ ID NO: 187869 - DNA, 75 bp, Artificial Sequence
  Synthetic
gctgcaacaactactgtttattcatttcagaatcgggtgtaaacatagcagaataggcattatgccacagagaag

SEQ ID NO: 187870 - DNA, 75 bp, Artificial Sequence
  Synthetic
tggattgtagcgaggactgtggaacttctggggagaagggggtgggaagccctcaaatatctgtggaatcttctg

SEQ ID NO: 187871 - DNA, 75 bp, Artificial Sequence
  Synthetic
agctggcacaggaaacagcagccaggtcagccaaaattaccctatagtgcagaaccttcaggggcaaatggtaca

SEQ ID NO: 187872 - DNA, 75 bp, Artificial Sequence
  Synthetic
aaggagctggtagagctattctcaacgtacctgtaagaatcagacagggcttagaaagagctttgctataaaatg

SEQ ID NO: 187873 - DNA, 75 bp, Artificial Sequence
  Synthetic
aagaataaggcgaacgcaacctgagccagcagcagtaggagtaggagcagtatctcaagatctggctaaacatgg

SEQ ID NO: 187874 - DNA, 75 bp, Artificial Sequence
  Synthetic
agacaaacatggagcaattacaagcagcaacacagccgccactaatgctgattgtgcctggctggaagcacaaga

SEQ ID NO: 187875 - DNA, 75 bp, Artificial Sequence
  Synthetic
gtgcaaggataggaccaggacgagtattccatacaacaggaaacataaatggtgatataagaaaagcatattgtg

SEQ ID NO: 187876 - DNA, 75 bp, Artificial Sequence
  Synthetic
caagcaacttgtgggtcacagtctattatggggtgcctgcgtgggaagatgcagatacaatcctattctgtgcat

SEQ ID NO: 187877 - DNA, 75 bp, Artificial Sequence
  Synthetic
cttgacacttatctgggtcgacctgcggagcctgtgcctcttcagctaccgccacttgagagacttactcttgat

SEQ ID NO: 187878 - DNA, 75 bp, Artificial Sequence
  Synthetic
aaactaacaatatcactgtaaaagaggtagaagacatgagaaactgttctttcaatgtaaccacagaaataagag

SEQ ID NO: 187879 - DNA, 75 bp, Artificial Sequence
  Synthetic
tgtacaaatgtcagcacagtacaatgtacacatggaattaggccagtggtatcaactcaactgctattaaatggc

SEQ ID NO: 187880 - DNA, 75 bp, Artificial Sequence
  Synthetic
gtaacaataatactagaatggttaatagtacttgggaaaatatggagggagaaataaaaaactgctctttcaatg

SEQ ID NO: 187881 - DNA, 75 bp, Artificial Sequence
  Synthetic
aatgcacaagggcaaatggtacaccaagccatatcacctagaaccttgaatgcatgggtaaaagtagtagaagaa

SEQ ID NO: 187882 - DNA, 75 bp, Artificial Sequence
  Synthetic
aaggtgacttttgaaccaattcccatacattattgtgctccagctggttttgcgattttaaagtgtagggataag

SEQ ID NO: 187883 - DNA, 75 bp, Artificial Sequence
  Synthetic
tgctatcattgtccagtgtgcttcctaaacaaaggcttaggcatctcctatggcaggaagaagcggagaccccga

SEQ ID NO: 187884 - DNA, 75 bp, Artificial Sequence
  Synthetic
gtgggaaaattaaactgggcaagtcagatttacccagggattaaagtaaagcaactttgtaaactccttaggggg

SEQ ID NO: 187885 - DNA, 75 bp, Artificial Sequence
  Synthetic
actcaattactgctgaatggtagtttagcagaaaaagagataataattagatctgaaaatctcacagacaatacc

SEQ ID NO: 187886 - DNA, 75 bp, Artificial Sequence
  Synthetic
atagtaggtctgatagtagcattcatcttagcagtagttgtatggactatagtattcatagaatataagaaaatt

SEQ ID NO: 187887 - DNA, 75 bp, Artificial Sequence
  Synthetic
gcaaatggtcaaaaagtagtttggtgggatggcctgagataagagaaagactaagacgaactgcgccagcagcag

SEQ ID NO: 187888 - DNA, 75 bp, Artificial Sequence
  Synthetic
tggggagatggagatcactttatgtaacaggagacataataggagatataagacaagcacattgtaaccttagca

SEQ ID NO: 187889 - DNA, 75 bp, Artificial Sequence
  Synthetic
gagatcttcagacctggaggaggagatatgagggacaattggagaagtgaattatataaatataaagtaataaaa

SEQ ID NO: 187890 - DNA, 75 bp, Artificial Sequence
  Synthetic
aaatgatgacagcatgccagggagtgggaggacccgcccataaagcaagagttttggctgaggcaatgagccaag

SEQ ID NO: 187891 - DNA, 75 bp, Artificial Sequence
  Synthetic
aaattgcagggcccctaggaaaaagggctgttggaaatgtgggaaggagggacaccaaatgaaagactgcactga

SEQ ID NO: 187892 - DNA, 75 bp, Artificial Sequence
  Synthetic
ataacaccatgaactgctcttttgagactaccacagaactaagagataagaaacagaaagtccaagcactatttt

SEQ ID NO: 187893 - DNA, 75 bp, Artificial Sequence
  Synthetic
tggctccatagcttaggacaatatatctatgaaacatatggggatacttgggcaggagtcgaagctataataaga

SEQ ID NO: 187894 - DNA, 75 bp, Artificial Sequence
  Synthetic
agtaataaatctctgaatgagatttggaataacatgacctggatggagtgggaaagagaaattaacaattacaca

SEQ ID NO: 187895 - DNA, 75 bp, Artificial Sequence
  Synthetic
aaatacagaaacaggggcatgaccaatggacatatcaaatttaccaagaaccattcaaaaatctgaaaacaggaa

SEQ ID NO: 187896 - DNA, 75 bp, Artificial Sequence
  Synthetic
tgaacaagaattattggaattagataagtgggcaagtttgtggaattggtttagcataacaaactggctgtggta

SEQ ID NO: 187897 - DNA, 75 bp, Artificial Sequence
  Synthetic
cagaagttagtaagaaaattgaactaggcaagtcagatttatccagagattaaaataaagcaattatgtaaactc

SEQ ID NO: 187898 - DNA, 75 bp, Artificial Sequence
  Synthetic
gaaagatacctaaaggatcaacagctcctaggaatttggggctgctctggaaaactcatctgccccactaatgtg

SEQ ID NO: 187899 - DNA, 75 bp, Artificial Sequence
  Synthetic
aatgtacacatggaattaggccagtggcatctactcaattgctgctgaatggcagtctagcagaaggaaataaaa

SEQ ID NO: 187900 - DNA, 75 bp, Artificial Sequence
  Synthetic
aagaaggagtgtacgcattggaccaggacgagccttctatacaaggcaaacatatacaaggcaagcaaaagggga

SEQ ID NO: 187901 - DNA, 75 bp, Artificial Sequence
  Synthetic
tgtggaacttctgggacgcagggggtgggaagtcctcaaatattggtggaatctcctacagtattggagtcagga

SEQ ID NO: 187902 - DNA, 75 bp, Artificial Sequence
  Synthetic
tgagcaagacttattgcaattggattcatgggcaagtttatggagctggtttagcttatcaaaatggctgtggta

SEQ ID NO: 187903 - DNA, 75 bp, Artificial Sequence
  Synthetic
actaaagaatagtgctgttagcttgctcaacgccacagccatagcagtagctgaggggacagatagggttataga

SEQ ID NO: 187904 - DNA, 75 bp, Artificial Sequence
  Synthetic
atctttaccaactcctcgggaggggacatagaaattacaacacatagtgtcaattgtggaggagaatttttctat

SEQ ID NO: 187905 - DNA, 75 bp, Artificial Sequence
  Synthetic
gccacctagattcctgaataagagtttgtcaatacccctcccttagtaaagttgtagtaccagttagaaaaagaa

SEQ ID NO: 187906 - DNA, 75 bp, Artificial Sequence
  Synthetic
ggcagcagctgacacaggaagcagcagcaaagtcagccaaaattaccctatagtgcaaaatgcacaagggcaaat

SEQ ID NO: 187907 - DNA, 75 bp, Artificial Sequence
  Synthetic
aagacaaggaccaaaggaaccctttagagactatgtagatcggttctttaaaactttaagagctgaacaagctac

SEQ ID NO: 187908 - DNA, 75 bp, Artificial Sequence
  Synthetic
ttgtcaatacccctcccttagtaaagttgtagtaccagttagaaaaagaacccataatagaggcagaaacttttt

SEQ ID NO: 187909 - DNA, 75 bp, Artificial Sequence
  Synthetic
atttcagagtagcatgacaaaaatcttagaaccatttagaacacaaaacccagaaatagttatctatcaatacat

SEQ ID NO: 187910 - DNA, 75 bp, Artificial Sequence
  Synthetic
caaagagctgttagagctgtgcttaacatacctagaagaataagacaaggatttgaaagagctttgctgtaaaat

SEQ ID NO: 187911 - DNA, 75 bp, Artificial Sequence
  Synthetic
gataaaaagcatcagaaagaacctccattcctttggatgggatatgagctccatcctgacaaatggacggtgcag

SEQ ID NO: 187912 - DNA, 75 bp, Artificial Sequence
  Synthetic
ataatgtcagcacagtacaatgtacacatggaattaaaccagtggtatcaactcaactactgttaaatggtagcc

SEQ ID NO: 187913 - DNA, 75 bp, Artificial Sequence
  Synthetic
acatggaattaaaccagtggtatcaactcaactactgttaaatggtagcctagcagaaggggagataataattag

SEQ ID NO: 187914 - DNA, 75 bp, Artificial Sequence
  Synthetic
tctaaaagaaccagtacatggggtatattatgacccatcaaaagatttaatagcagaagtacagaaacaagggct

SEQ ID NO: 187915 - DNA, 75 bp, Artificial Sequence
  Synthetic
ctagaaggagagagatgggtgcgagagcgtcagtattgactccgggagaattagataaatttgaaaaaattcgat

SEQ ID NO: 187916 - DNA, 75 bp, Artificial Sequence
  Synthetic
gggacctagagattacaacacatagctttaattgtagaggagaatttttctattgcaatacaacaaaactgttta

SEQ ID NO: 187917 - DNA, 75 bp, Artificial Sequence
  Synthetic
cagtagaccctaatatagagccctggaaccatccgggaagtcagcctacaactgcctgtagctcatgttactgta

SEQ ID NO: 187918 - DNA, 75 bp, Artificial Sequence
  Synthetic
tctgggcaataataggactggtagtggcactaatcttagcaataattgtgtggactatagtaggtatagaatata

SEQ ID NO: 187919 - DNA, 75 bp, Artificial Sequence
  Synthetic
tgccttggaactctagctggagtaatagatctcaagaggagatttggaacaacatgacctggatgcaatgggata

SEQ ID NO: 187920 - DNA, 75 bp, Artificial Sequence
  Synthetic
gaaagagcagaagacagtggcaatgagagtgatggggacacagatgaattatcaaaactggtggagatggggaac

SEQ ID NO: 187921 - DNA, 75 bp, Artificial Sequence
  Synthetic
acagggcttagagagagctttactataaaatggggggcaagtggtcaaaaagaagcttaccaggatggcctgcta

SEQ ID NO: 187922 - DNA, 75 bp, Artificial Sequence
  Synthetic
tccagcagcagaacgaacccctccagcagcagcagcagaaggagtaggagcagtatctcaagatttagctacacg

SEQ ID NO: 187923 - DNA, 75 bp, Artificial Sequence
  Synthetic
cttaataggtttaagaataatttttgctgtgctttctatagtaaatagagttaggcagggatactcacctttgtc

SEQ ID NO: 187924 - DNA, 75 bp, Artificial Sequence
  Synthetic
agtagactgtagtccagggatatggcaattagattgtacacatttagaaggaaaagtcatcctggtagcagtcca

SEQ ID NO: 187925 - DNA, 75 bp, Artificial Sequence
  Synthetic
gttgtgtggatcatagtatatagagaatataggaaattgttaagacaaaagaaaatagacagggtgcttgaaaaa

SEQ ID NO: 187926 - DNA, 75 bp, Artificial Sequence
  Synthetic
caatattccagtgtagcatgacaaaaatcttagagccctttagagcaaaaaatccagaaatagttatctatcaat

SEQ ID NO: 187927 - DNA, 75 bp, Artificial Sequence
  Synthetic
tatgggatcaaagtctaaagccatgtgtaaagttaacccctctctgtgttaccttaaattgtagcaacatcaaca

SEQ ID NO: 187928 - DNA, 75 bp, Artificial Sequence
  Synthetic
ttataagcttgatatagtaccaattagtgaaggtaatagtacaagtaataacagccagtatatattaataaattg

SEQ ID NO: 187929 - DNA, 75 bp, Artificial Sequence
  Synthetic
aagtcaaggagtagtggaatctatgaataaagaattaaagaaaattataggacaggtaagagatcaagctgaaca

SEQ ID NO: 187930 - DNA, 75 bp, Artificial Sequence
  Synthetic
cttaaatcattatataatacagtagtagtcctctactgggtacatcaaagggtagatgtaaaagacaccaaggaa

SEQ ID NO: 187931 - DNA, 75 bp, Artificial Sequence
  Synthetic
agcagacatccaagagtaagttcagaagtgcacatcccactagaggatgattctaaattagtaatagtaacctat

SEQ ID NO: 187932 - DNA, 75 bp, Artificial Sequence
  Synthetic
aaaacaataaaattcaatagctccgcaggaggggatttagaaatcacaacacatagttttaattgtggaggagaa

SEQ ID NO: 187933 - DNA, 75 bp, Artificial Sequence
  Synthetic
aggataggaccaggacaaacattctatgcaacaggggacataataggagacataagacaagcacattgtaacatt

SEQ ID NO: 187934 - DNA, 75 bp, Artificial Sequence
  Synthetic
tagtcacagtaagaataggggaacagctaatagaagccctattagatacaggagcagatgatacagtattagaag

SEQ ID NO: 187935 - DNA, 75 bp, Artificial Sequence
  Synthetic
attataatgctactaagaccaataatgctactaataatagtagttaggaagaggtaaggacagaaataaaaaact

SEQ ID NO: 187936 - DNA, 75 bp, Artificial Sequence
  Synthetic
atcacactcccatgcagaataaaacaaattataaacatgtggcagaaggtaggacgagcaatgtatgcccctccc

SEQ ID NO: 187937 - DNA, 75 bp, Artificial Sequence
  Synthetic
atgcaacctttggaaatagcaagcatagtagcattagtagtgacatttgttatagcagtagtagtgtggactata

SEQ ID NO: 187938 - DNA, 75 bp, Artificial Sequence
  Synthetic
atctgtagtaattaattgtacaagacccaacaacaatacaagaaaaggcatacatataggatgaagaagaacatt

SEQ ID NO: 187939 - DNA, 75 bp, Artificial Sequence
  Synthetic
aagcagacatccaagagtaagttcagaagtacacataccattaggggatgctagattagtaataaaaacatattg

SEQ ID NO: 187940 - DNA, 75 bp, Artificial Sequence
  Synthetic
gaggaacaatttaataaaacaatatattttaagcaacaagcccaggaggagacccagaaatcacaatgcacagtt

SEQ ID NO: 187941 - DNA, 75 bp, Artificial Sequence
  Synthetic
atgtaaaataaaacaaattataaacagatggcaagaagtaagaaaagcaatgtacgcccctcccatcccaagata

SEQ ID NO: 187942 - DNA, 75 bp, Artificial Sequence
  Synthetic
aggcaggctaattttttagggagaatctggccttcccacaaggggaggccagggaatttccttcagaacagacca

SEQ ID NO: 187943 - DNA, 75 bp, Artificial Sequence
  Synthetic
caactgcgaggggctcagaaatgaagaactgctctttcaatataaccacagaaataaaagataagaagaagaaag

SEQ ID NO: 187944 - DNA, 75 bp, Artificial Sequence
  Synthetic
gaaaggagaaataaaaaactgctctttcaatatcaccacaagcccaagagataagatacagaaagaatatgcact

SEQ ID NO: 187945 - DNA, 75 bp, Artificial Sequence
  Synthetic
aattagaaaagtgaattatataaatataaaatagtaaaaattgagccactaggactagcacccaccaaggcaaga

SEQ ID NO: 187946 - DNA, 75 bp, Artificial Sequence
  Synthetic
agcggtagctggctggacagataggattatagaagtaggacagagaattggtagagctataatccatatacctgt

SEQ ID NO: 187947 - DNA, 75 bp, Artificial Sequence
  Synthetic
ctgcttgtgcctggctagaagcacaagaggaggaggaagtgggttttccagtcagacctcaggtacctttaagac

SEQ ID NO: 187948 - DNA, 75 bp, Artificial Sequence
  Synthetic
agaggaggaggaagtgggttttccagtcagacctcaggtacctttaagaccaatgacttacaagggagctttaga

SEQ ID NO: 187949 - DNA, 75 bp, Artificial Sequence
  Synthetic
taggcattattcgaagaagaagagtaagggatggaggtggtagaccctaaactagagccctggaaccatccggga

SEQ ID NO: 187950 - DNA, 75 bp, Artificial Sequence
  Synthetic
aacagaagatagatggaacaagccccagaagaccaggggccacagagagaaccccacaatgagtggacattagaa

SEQ ID NO: 187951 - DNA, 75 bp, Artificial Sequence
  Synthetic
aatcaagccagtagtatcaactcaactactgttaaatggcagtctagcagaagaagaggtaaggattagatctga

SEQ ID NO: 187952 - DNA, 75 bp, Artificial Sequence
  Synthetic
tataacacttatggggatacttgggaaggggttgaagctataataagaattttgcaacaactactgtttgttcat

SEQ ID NO: 187953 - DNA, 75 bp, Artificial Sequence
  Synthetic
gcgcaagaggacgaggaagtaggctttccagtcaagccacaggtacctgtaaggccaatgacttataaagcagct

SEQ ID NO: 187954 - DNA, 75 bp, Artificial Sequence
  Synthetic
ttatatagaatataggaaattgttaagacaaagaaaaatagacagattaattaaaagaattagagaaagagcaga

SEQ ID NO: 187955 - DNA, 75 bp, Artificial Sequence
  Synthetic
gagctttagcaacaaaacaataatttttgctaaccactcaggaggggatttagaagttacaacacatagctttaa

SEQ ID NO: 187956 - DNA, 75 bp, Artificial Sequence
  Synthetic
gaactcctcagggcagcaagggccatcaagatcctatttcaaagcagtaagtataaagtataggtaatgttacct

SEQ ID NO: 187957 - DNA, 75 bp, Artificial Sequence
  Synthetic
tttaagaatagttttttctgtactttctatagtgaatagagctaggcaaggatactcaccgttgtcattccagac

SEQ ID NO: 187958 - DNA, 75 bp, Artificial Sequence
  Synthetic
tatctatcaatatatggatgacttgtatgtaggatctgatttagaaatagggcaacacagagcaaaaatagagga

SEQ ID NO: 187959 - DNA, 75 bp, Artificial Sequence
  Synthetic
gacgcagaaggtaggaagctctcaaatatctgtagaatctcctacagtattagagtcaggaactaaagaatagtg

SEQ ID NO: 187960 - DNA, 75 bp, Artificial Sequence
  Synthetic
aaattgcaccaacgccaatgccactgtcactgacactgacatgcaaggagaaataaaaaactgttcttacaatgt

SEQ ID NO: 187961 - DNA, 75 bp, Artificial Sequence
  Synthetic
aagtacacatcccattaggggaggctagattggtaataacaacatattggggtctgcatacaggggagaaagaat

SEQ ID NO: 187962 - DNA, 75 bp, Artificial Sequence
  Synthetic
aagtacacatcccattaggggaggctagattggtaataacaacatattggggtctgcatacaggggagatagaat

SEQ ID NO: 187963 - DNA, 75 bp, Artificial Sequence
  Synthetic
aagtacacatcccattaggggaggctagattggtaataacaacatattggggtctgcatacaggggagacagaat

SEQ ID NO: 187964 - DNA, 75 bp, Artificial Sequence
  Synthetic
aagtacacatcccattaggggaggctagattggtaataacaacatattggggtctgcatacaggggagagagaat

SEQ ID NO: 187965 - DNA, 75 bp, Artificial Sequence
  Synthetic
aagtacacatcccattaggggaggctagattggtaataacaacatattggggtctgcttacaggggagaaagaat

SEQ ID NO: 187966 - DNA, 75 bp, Artificial Sequence
  Synthetic
aagtacacatcccattaggggaggctagattggtaataacaacatattggggtctgcttacaggggagatagaat

SEQ ID NO: 187967 - DNA, 75 bp, Artificial Sequence
  Synthetic
aagtacacatcccattaggggaggctagattggtaataacaacatattggggtctgcttacaggggagacagaat

SEQ ID NO: 187968 - DNA, 75 bp, Artificial Sequence
  Synthetic
aagtacacatcccattaggggaggctagattggtaataacaacatattggggtctgcttacaggggagagagaat

SEQ ID NO: 187969 - DNA, 75 bp, Artificial Sequence
  Synthetic
aagtacacatcccattaggggaggctagattggtaataacaacatattggggtctgcctacaggggagaaagaat

SEQ ID NO: 187970 - DNA, 75 bp, Artificial Sequence
  Synthetic
aagtacacatcccattaggggaggctagattggtaataacaacatattggggtctgcctacaggggagatagaat

SEQ ID NO: 187971 - DNA, 75 bp, Artificial Sequence
  Synthetic
aagtacacatcccattaggggaggctagattggtaataacaacatattggggtctgcctacaggggagacagaat

SEQ ID NO: 187972 - DNA, 75 bp, Artificial Sequence
  Synthetic
aagtacacatcccattaggggaggctagattggtaataacaacatattggggtctgcctacaggggagagagaat

SEQ ID NO: 187973 - DNA, 75 bp, Artificial Sequence
  Synthetic
aagtacacatcccattaggggaggctagattggtaataacaacatattggggtctgcgtacaggggagaaagaat

SEQ ID NO: 187974 - DNA, 75 bp, Artificial Sequence
  Synthetic
aagtacacatcccattaggggaggctagattggtaataacaacatattggggtctgcgtacaggggagatagaat

SEQ ID NO: 187975 - DNA, 75 bp, Artificial Sequence
  Synthetic
aagtacacatcccattaggggaggctagattggtaataacaacatattggggtctgcgtacaggggagacagaat

SEQ ID NO: 187976 - DNA, 75 bp, Artificial Sequence
  Synthetic
aagtacacatcccattaggggaggctagattggtaataacaacatattggggtctgcgtacaggggagagagaat

SEQ ID NO: 187977 - DNA, 75 bp, Artificial Sequence
  Synthetic
taattgtttttcagactctgatataaaaaatgccctattaggacatagcagtgtagtccttaggtgtgaatatca

SEQ ID NO: 187978 - DNA, 75 bp, Artificial Sequence
  Synthetic
taattgtttttcagactctgatataataaatgccctattaggacatagcagtgtagtccttaggtgtgaatatca

SEQ ID NO: 187979 - DNA, 75 bp, Artificial Sequence
  Synthetic
taattgtttttcagactctgatataacaaatgccctattaggacatagcagtgtagtccttaggtgtgaatatca

SEQ ID NO: 187980 - DNA, 75 bp, Artificial Sequence
  Synthetic
taattgtttttcagactctgatataagaaatgccctattaggacatagcagtgtagtccttaggtgtgaatatca

SEQ ID NO: 187981 - DNA, 75 bp, Artificial Sequence
  Synthetic
taattgtttttcagactctgttataaaaaatgccctattaggacatagcagtgtagtccttaggtgtgaatatca

SEQ ID NO: 187982 - DNA, 75 bp, Artificial Sequence
  Synthetic
taattgtttttcagactctgttataataaatgccctattaggacatagcagtgtagtccttaggtgtgaatatca

SEQ ID NO: 187983 - DNA, 75 bp, Artificial Sequence
  Synthetic
taattgtttttcagactctgttataacaaatgccctattaggacatagcagtgtagtccttaggtgtgaatatca

SEQ ID NO: 187984 - DNA, 75 bp, Artificial Sequence
  Synthetic
taattgtttttcagactctgttataagaaatgccctattaggacatagcagtgtagtccttaggtgtgaatatca

SEQ ID NO: 187985 - DNA, 75 bp, Artificial Sequence
  Synthetic
taattgtttttcagactctgctataaaaaatgccctattaggacatagcagtgtagtccttaggtgtgaatatca

SEQ ID NO: 187986 - DNA, 75 bp, Artificial Sequence
  Synthetic
taattgtttttcagactctgctataataaatgccctattaggacatagcagtgtagtccttaggtgtgaatatca

SEQ ID NO: 187987 - DNA, 75 bp, Artificial Sequence
  Synthetic
taattgtttttcagactctgctataacaaatgccctattaggacatagcagtgtagtccttaggtgtgaatatca

SEQ ID NO: 187988 - DNA, 75 bp, Artificial Sequence
  Synthetic
taattgtttttcagactctgctataagaaatgccctattaggacatagcagtgtagtccttaggtgtgaatatca

SEQ ID NO: 187989 - DNA, 75 bp, Artificial Sequence
  Synthetic
taattgtttttcagactctggtataaaaaatgccctattaggacatagcagtgtagtccttaggtgtgaatatca

SEQ ID NO: 187990 - DNA, 75 bp, Artificial Sequence
  Synthetic
taattgtttttcagactctggtataataaatgccctattaggacatagcagtgtagtccttaggtgtgaatatca

SEQ ID NO: 187991 - DNA, 75 bp, Artificial Sequence
  Synthetic
taattgtttttcagactctggtataacaaatgccctattaggacatagcagtgtagtccttaggtgtgaatatca

SEQ ID NO: 187992 - DNA, 75 bp, Artificial Sequence
  Synthetic
taattgtttttcagactctggtataagaaatgccctattaggacatagcagtgtagtccttaggtgtgaatatca

SEQ ID NO: 187993 - DNA, 75 bp, Artificial Sequence
  Synthetic
aaggatcaacagttcctagggatttggggctgctctggaaaactcatctgcaccactaatgtgccatggaacaat

SEQ ID NO: 187994 - DNA, 75 bp, Artificial Sequence
  Synthetic
gaactaagagataaggagcaggaggtctatgcacttttttataggtctgatctagtaccaattgagagaaatagt

SEQ ID NO: 187995 - DNA, 75 bp, Artificial Sequence
  Synthetic
atacaaggagaagtgtgcgtataggaccaggacaagcattctatacaagtgacataattggggatataagggaag

SEQ ID NO: 187996 - DNA, 75 bp, Artificial Sequence
  Synthetic
ttgaagaatcacagaaccagcaggaaaagaatgaacaagacttattggcattagacaaatgggcaagtctgtgga

SEQ ID NO: 187997 - DNA, 75 bp, Artificial Sequence
  Synthetic
atcctcaggaggagacctagaaattacaacgcatagttttaattgtgcaggagagtttttctactgcaatacatc

SEQ ID NO: 187998 - DNA, 75 bp, Artificial Sequence
  Synthetic
acaacgcatagttttaattgtgcaggagagtttttctactgcaatacatcaagactgtttaatagcacatttgat

SEQ ID NO: 187999 - DNA, 75 bp, Artificial Sequence
  Synthetic
aattaaagaaaatcatagggcaggtaagagatcaagctgaacaccttaagacagcagtacaaatggcagtattca

SEQ ID NO: 188000 - DNA, 75 bp, Artificial Sequence
  Synthetic
tagtaataacaacatattggggtctaaatacaggagaaagagaatggcacttgggccagggagtctccatagaat

SEQ ID NO: 188001 - DNA, 75 bp, Artificial Sequence
  Synthetic
gaatcttgcacagtattggggccaggaactgaagaatagtgctattagtttgcttaatgcgacagcaatagcagt

SEQ ID NO: 188002 - DNA, 75 bp, Artificial Sequence
  Synthetic
aaacgcagcatagttggatggcctgatgtaagagaaaggctaagacaagctcagacagccgcagtgggagtagga

SEQ ID NO: 188003 - DNA, 75 bp, Artificial Sequence
  Synthetic
ggaaaggagtttgctataagatgggtggcaagtggtcaaaaagtagtatagttggatggcctgctataagggaaa

SEQ ID NO: 188004 - DNA, 75 bp, Artificial Sequence
  Synthetic
ccagcagcagagggggtgggagcagcatctcgagacctggaaaaacatggagcaatcacaagtagcaatacagca

SEQ ID NO: 188005 - DNA, 75 bp, Artificial Sequence
  Synthetic
tctctcgacgcaggactcggcttgctgaaagtgcacgcagcaagaggcgagagcggcgactggtgagtacgccat

SEQ ID NO: 188006 - DNA, 75 bp, Artificial Sequence
  Synthetic
gtctggggcattaaacagctccaggcaagagtcctggctgtggaaagatacctaaaggatcaacagttcctagga

SEQ ID NO: 188007 - DNA, 75 bp, Artificial Sequence
  Synthetic
ccagggggaaagaaaaaatataggttaaaacatttggtatgggcaagcagggagctggaaagattcgcacttaac

SEQ ID NO: 188008 - DNA, 75 bp, Artificial Sequence
  Synthetic
tctgcaccacttctgtgccctggaactccagttggagtaataaatcttataacgaaatttggaacaacatgacat

SEQ ID NO: 188009 - DNA, 75 bp, Artificial Sequence
  Synthetic
agatagatgtaaaagacaccaaggaagctttagagaaggtagaggaagagcaaaacaaaagtaagaaaaaagcac

SEQ ID NO: 188010 - DNA, 75 bp, Artificial Sequence
  Synthetic
cctgaatcaaagcagtaagtaacaatagttattgtgtgtaatgcaggcattagaaatatctgcaatagtaggact

SEQ ID NO: 188011 - DNA, 75 bp, Artificial Sequence
  Synthetic
agaaggtggagagcaaggcagagacagatcgattcgattagtgagcggattcttagcacttgcctgggacgacct

SEQ ID NO: 188012 - DNA, 75 bp, Artificial Sequence
  Synthetic
tcttagcacttgcctgggacgacctgaggagcctgtgcctcttcagctaccaccgcttgagagacttcatcttga

SEQ ID NO: 188013 - DNA, 75 bp, Artificial Sequence
  Synthetic
aaaaatagaaaaattacttgatagaataagagaaagagcagaagacagtggaaatgagagtgagggggacacaga

SEQ ID NO: 188014 - DNA, 75 bp, Artificial Sequence
  Synthetic
ttaagaatagtttttgctgtgctttctatagtaaatagagttaggcagggatactcacctttgtcatttcagacc

SEQ ID NO: 188015 - DNA, 75 bp, Artificial Sequence
  Synthetic
gagcctgtgcctcttcagctaccaccgcttgagagacttcatcttgattgcagcgaggactgtggaacttctggg

SEQ ID NO: 188016 - DNA, 75 bp, Artificial Sequence
  Synthetic
tcaattactgctaaatggcagtttagcaggagaaagtataataattagatctgaaaacatcacagacaataccaa

SEQ ID NO: 188017 - DNA, 75 bp, Artificial Sequence
  Synthetic
agaacttagatcattatataatgcagtagcagtcctctattgtgtgcatcgaagaatagatgtaaaagacaccaa

SEQ ID NO: 188018 - DNA, 75 bp, Artificial Sequence
  Synthetic
taatgaagaaataaaaaactgctcttacaatactaccacaatactaagagataagacacaaaaagtttattcact

SEQ ID NO: 188019 - DNA, 75 bp, Artificial Sequence
  Synthetic
aggggtgcccatactaatgatgtaaaacaattaacagaggcagtgcaaaaaataaccacagaaagcatagtaata

SEQ ID NO: 188020 - DNA, 75 bp, Artificial Sequence
  Synthetic
acacattggaccagggcaagcgttttttgcaacaggtgacataataggagatataagacaagctcattgtaacat

SEQ ID NO: 188021 - DNA, 75 bp, Artificial Sequence
  Synthetic
caaggggaggccagggaattttctccagagcaggccagagccaacagccccaccagcagagagcttcgggttcgg

SEQ ID NO: 188022 - DNA, 75 bp, Artificial Sequence
  Synthetic
caggagcagagcttcgggatcggggagaacgtagccccctccccgaaacaggagccgaagaaggaggagctatat

SEQ ID NO: 188023 - DNA, 75 bp, Artificial Sequence
  Synthetic
aactataataatgaaactgacatgagaaattgctctttcaatataaccacagaattaagagataagaggaggcaa

SEQ ID NO: 188024 - DNA, 75 bp, Artificial Sequence
  Synthetic
accaggattggtaatgaaagcatgcagggagaaataaaaaattgctctttcaatataaccacagaaataagagat

SEQ ID NO: 188025 - DNA, 75 bp, Artificial Sequence
  Synthetic
gctaataaaaaaggaaaaggtctacctggcatgggtaccagcacacaaaggaattggaggaaatgaacaagtaga

SEQ ID NO: 188026 - DNA, 75 bp, Artificial Sequence
  Synthetic
agaataaaacaaattataaacaggtggcaggaagtaggaaaagcaatgtatgcccctcccatcagtggacaaatt

SEQ ID NO: 188027 - DNA, 75 bp, Artificial Sequence
  Synthetic
gctttggaccaggacaagccttctatacaaatgaaataataggggacataagacaagcacattgtaatatcaaca

SEQ ID NO: 188028 - DNA, 75 bp, Artificial Sequence
  Synthetic
taatgaatctgtagaaattgtgtgtacaagacccaacaataatacaaggaaaagtgtgaggataggaccaggaca

SEQ ID NO: 188029 - DNA, 75 bp, Artificial Sequence
  Synthetic
tgtttaatgccatagccatagcagtagctgaggggacagataggattatagaaatagtacaaagaactggtagag

SEQ ID NO: 188030 - DNA, 75 bp, Artificial Sequence
  Synthetic
aaagtgtgaggataggaccaggacaaacattctatgcaacaggagaaataataggaaatataagacaagcatatt

SEQ ID NO: 188031 - DNA, 75 bp, Artificial Sequence
  Synthetic
tcctcaggaggggacctagaaattacaacacatagttttaattgtggaggagaatttttctattgcaatacatca

SEQ ID NO: 188032 - DNA, 75 bp, Artificial Sequence
  Synthetic
catcacatatatacaccctaattgaagaatcgcaaaatcagcaggaaaagaatgaacaagaattactagcattgg

SEQ ID NO: 188033 - DNA, 75 bp, Artificial Sequence
  Synthetic
acatgacctggatggagtgggagagagaaattgacaattacacaggcttaatatacaccttaattgaagaatcgc

SEQ ID NO: 188034 - DNA, 75 bp, Artificial Sequence
  Synthetic
tatacaaaaattagtgggaaaactaaattgggcaagtcagatttatccagggattaaagtaaaacaactatgtaa

SEQ ID NO: 188035 - DNA, 75 bp, Artificial Sequence
  Synthetic
gagagaaaaaagagcagtgggactaggagctgtgttccttgggttcttgggagcagcaggaagcactatgggcgc

SEQ ID NO: 188036 - DNA, 75 bp, Artificial Sequence
  Synthetic
acttgaagaatcgcaaaaccagcaggaaaagaatgagcaagacttattggcattagacaaatgggcagatttgtg

SEQ ID NO: 188037 - DNA, 75 bp, Artificial Sequence
  Synthetic
tactttaaatgtttttcagactctgctataagaaaggccatagtaggacatataatttttcctatttgtgaatat

SEQ ID NO: 188038 - DNA, 75 bp, Artificial Sequence
  Synthetic
tactttaaatgtttttcagactctgctataagaaaggccatagtaggacatatattttttcctatttgtgaatat

SEQ ID NO: 188039 - DNA, 75 bp, Artificial Sequence
  Synthetic
tactttaaatgtttttcagactctgctataagaaaggccatagtaggacatatactttttcctatttgtgaatat

SEQ ID NO: 188040 - DNA, 75 bp, Artificial Sequence
  Synthetic
tactttaaatgtttttcagactctgctataagaaaggccatagtaggacatatagtttttcctatttgtgaatat

SEQ ID NO: 188041 - DNA, 75 bp, Artificial Sequence
  Synthetic
tactttaaatgtttttcagactctgctataagaatggccatagtaggacatataatttttcctatttgtgaatat

SEQ ID NO: 188042 - DNA, 75 bp, Artificial Sequence
  Synthetic
tactttaaatgtttttcagactctgctataagaatggccatagtaggacatatattttttcctatttgtgaatat

SEQ ID NO: 188043 - DNA, 75 bp, Artificial Sequence
  Synthetic
tactttaaatgtttttcagactctgctataagaatggccatagtaggacatatactttttcctatttgtgaatat

SEQ ID NO: 188044 - DNA, 75 bp, Artificial Sequence
  Synthetic
tactttaaatgtttttcagactctgctataagaatggccatagtaggacatatagtttttcctatttgtgaatat

SEQ ID NO: 188045 - DNA, 75 bp, Artificial Sequence
  Synthetic
tactttaaatgtttttcagactctgctataagaacggccatagtaggacatataatttttcctatttgtgaatat

SEQ ID NO: 188046 - DNA, 75 bp, Artificial Sequence
  Synthetic
tactttaaatgtttttcagactctgctataagaacggccatagtaggacatatattttttcctatttgtgaatat

SEQ ID NO: 188047 - DNA, 75 bp, Artificial Sequence
  Synthetic
tactttaaatgtttttcagactctgctataagaacggccatagtaggacatatactttttcctatttgtgaatat

SEQ ID NO: 188048 - DNA, 75 bp, Artificial Sequence
  Synthetic
tactttaaatgtttttcagactctgctataagaacggccatagtaggacatatagtttttcctatttgtgaatat

SEQ ID NO: 188049 - DNA, 75 bp, Artificial Sequence
  Synthetic
tactttaaatgtttttcagactctgctataagaagggccatagtaggacatataatttttcctatttgtgaatat

SEQ ID NO: 188050 - DNA, 75 bp, Artificial Sequence
  Synthetic
tactttaaatgtttttcagactctgctataagaagggccatagtaggacatatattttttcctatttgtgaatat

SEQ ID NO: 188051 - DNA, 75 bp, Artificial Sequence
  Synthetic
tactttaaatgtttttcagactctgctataagaagggccatagtaggacatatactttttcctatttgtgaatat

SEQ ID NO: 188052 - DNA, 75 bp, Artificial Sequence
  Synthetic
tactttaaatgtttttcagactctgctataagaagggccatagtaggacatatagtttttcctatttgtgaatat

SEQ ID NO: 188053 - DNA, 75 bp, Artificial Sequence
  Synthetic
acctgaaaacagggaaatatgcaaaaaggaggactgcccacactaatgatgtaaggcaattggcagaagtggtgc

SEQ ID NO: 188054 - DNA, 75 bp, Artificial Sequence
  Synthetic
cttttcttaatatacctagaagaataagacaaggattagaaatagctttgctataaaatgggaggcaagtggtca

SEQ ID NO: 188055 - DNA, 75 bp, Artificial Sequence
  Synthetic
tccatataacactccaatatttgccataaaaaagaaggacagtactaaatggagaaaattagtagatttcaggga

SEQ ID NO: 188056 - DNA, 75 bp, Artificial Sequence
  Synthetic
tggatgcagtgggatagagaaattaataattacacagaaacaatatataggttgcttgaagtctcgcaaaaccag

SEQ ID NO: 188057 - DNA, 75 bp, Artificial Sequence
  Synthetic
gcagtgtctcaagatttagacaagcatggagcaatcacaagcagccatacaccaactacaaatgctgcttgtgcc

SEQ ID NO: 188058 - DNA, 75 bp, Artificial Sequence
  Synthetic
gacgagggactccttacagcagtaaggatcatcaaaatcctttaccagagcagtaagtaatagtaattagtgtat

SEQ ID NO: 188059 - DNA, 75 bp, Artificial Sequence
  Synthetic
ggatcatcaaaatcctttaccagagcagtaagtaatagtaattagtgtatgtaatgctttctttggggatctggg

SEQ ID NO: 188060 - DNA, 75 bp, Artificial Sequence
  Synthetic
aggtaggctttccagtcagacctcaggtgcctttaagaccaatgacctataaaggtgcttttgatctcggcttct

SEQ ID NO: 188061 - DNA, 75 bp, Artificial Sequence
  Synthetic
aatagataagataattgctagaataagagaaagagcagaggacagtggcaatgagagtgatggggacacagatga

SEQ ID NO: 188062 - DNA, 75 bp, Artificial Sequence
  Synthetic
agctattctcaacatacctagaagaatcagacagggcttagaaagggctttactataaaatggggggcaagtggt

SEQ ID NO: 188063 - DNA, 75 bp, Artificial Sequence
  Synthetic
tactataaaatggggggcaagtggtcaaaaaggagcataccaggatggcctgctattagggagagaatgagaaga

SEQ ID NO: 188064 - DNA, 75 bp, Artificial Sequence
  Synthetic
ggagcctgtgccttttcagctaccaccgcttgagagacttcatattgattgcagcgaggggactacagagggggt

SEQ ID NO: 188065 - DNA, 75 bp, Artificial Sequence
  Synthetic
aatgttaatgctaccaacaatattaatagcatgattgataacagtaataagggagaaatgaaaaattgctctttc

SEQ ID NO: 188066 - DNA, 75 bp, Artificial Sequence
  Synthetic
tgtgtggagagacgcagagaccaccttattttgcgcctcagatgctaaagcatatgatacagaaatgcataatgt

SEQ ID NO: 188067 - DNA, 75 bp, Artificial Sequence
  Synthetic
gtaatacagcagctactaatcctgattgcgcctgggtggaagcgcaagaagaggagagtgaagtaggcttcccag

SEQ ID NO: 188068 - DNA, 75 bp, Artificial Sequence
  Synthetic
tcgaagcgaagtaccagggaagttctctcgacgcaagactcggcttgctgaggtgcacacggcaagaggcgagaa

SEQ ID NO: 188069 - DNA, 75 bp, Artificial Sequence
  Synthetic
tcaccaatagcactgtcaatgagactagacaaggaatgagaaactgctctttcaatacaaccacagcattaaggg

SEQ ID NO: 188070 - DNA, 75 bp, Artificial Sequence
  Synthetic
gtaatacatcaaatctgtttattagtacttagaataatactgaagggtcaaataaccacacccacaaccacacta

SEQ ID NO: 188071 - DNA, 75 bp, Artificial Sequence
  Synthetic
gtaatacatcaaatctgtttattagtacttagaataatactgaagggtcaaataaccacacccacaacctcacta

SEQ ID NO: 188072 - DNA, 75 bp, Artificial Sequence
  Synthetic
gtaatacatcaaatctgtttattagtacttagaataatactgaagggtcaaataaccacacccacaaccccacta

SEQ ID NO: 188073 - DNA, 75 bp, Artificial Sequence
  Synthetic
gtaatacatcaaatctgtttattagtacttagaataatactgaagggtcaaataaccacacccacaaccgcacta

SEQ ID NO: 188074 - DNA, 75 bp, Artificial Sequence
  Synthetic
gtaatacatcaaatctgtttattagtacttagaataatactgaagggtcaattaaccacacccacaaccacacta

SEQ ID NO: 188075 - DNA, 75 bp, Artificial Sequence
  Synthetic
gtaatacatcaaatctgtttattagtacttagaataatactgaagggtcaattaaccacacccacaacctcacta

SEQ ID NO: 188076 - DNA, 75 bp, Artificial Sequence
  Synthetic
gtaatacatcaaatctgtttattagtacttagaataatactgaagggtcaattaaccacacccacaaccccacta

SEQ ID NO: 188077 - DNA, 75 bp, Artificial Sequence
  Synthetic
gtaatacatcaaatctgtttattagtacttagaataatactgaagggtcaattaaccacacccacaaccgcacta

SEQ ID NO: 188078 - DNA, 75 bp, Artificial Sequence
  Synthetic
gtaatacatcaaatctgtttattagtacttagaataatactgaagggtcaactaaccacacccacaaccacacta

SEQ ID NO: 188079 - DNA, 75 bp, Artificial Sequence
  Synthetic
gtaatacatcaaatctgtttattagtacttagaataatactgaagggtcaactaaccacacccacaacctcacta

SEQ ID NO: 188080 - DNA, 75 bp, Artificial Sequence
  Synthetic
gtaatacatcaaatctgtttattagtacttagaataatactgaagggtcaactaaccacacccacaaccccacta

SEQ ID NO: 188081 - DNA, 75 bp, Artificial Sequence
  Synthetic
gtaatacatcaaatctgtttattagtacttagaataatactgaagggtcaactaaccacacccacaaccgcacta

SEQ ID NO: 188082 - DNA, 75 bp, Artificial Sequence
  Synthetic
gtaatacatcaaatctgtttattagtacttagaataatactgaagggtcaagtaaccacacccacaaccacacta

SEQ ID NO: 188083 - DNA, 75 bp, Artificial Sequence
  Synthetic
gtaatacatcaaatctgtttattagtacttagaataatactgaagggtcaagtaaccacacccacaacctcacta

SEQ ID NO: 188084 - DNA, 75 bp, Artificial Sequence
  Synthetic
gtaatacatcaaatctgtttattagtacttagaataatactgaagggtcaagtaaccacacccacaaccccacta

SEQ ID NO: 188085 - DNA, 75 bp, Artificial Sequence
  Synthetic
gtaatacatcaaatctgtttattagtacttagaataatactgaagggtcaagtaaccacacccacaaccgcacta

SEQ ID NO: 188086 - DNA, 75 bp, Artificial Sequence
  Synthetic
gtaatacatcaaatctgtttattagtactttgaataatactgaagggtcaaataaccacacccacaaccacacta

SEQ ID NO: 188087 - DNA, 75 bp, Artificial Sequence
  Synthetic
gtaatacatcaaatctgtttattagtactttgaataatactgaagggtcaaataaccacacccacaacctcacta

SEQ ID NO: 188088 - DNA, 75 bp, Artificial Sequence
  Synthetic
gtaatacatcaaatctgtttattagtactttgaataatactgaagggtcaaataaccacacccacaaccccacta

SEQ ID NO: 188089 - DNA, 75 bp, Artificial Sequence
  Synthetic
gtaatacatcaaatctgtttattagtactttgaataatactgaagggtcaaataaccacacccacaaccgcacta

SEQ ID NO: 188090 - DNA, 75 bp, Artificial Sequence
  Synthetic
gtaatacatcaaatctgtttattagtactttgaataatactgaagggtcaattaaccacacccacaaccacacta

SEQ ID NO: 188091 - DNA, 75 bp, Artificial Sequence
  Synthetic
gtaatacatcaaatctgtttattagtactttgaataatactgaagggtcaattaaccacacccacaacctcacta

SEQ ID NO: 188092 - DNA, 75 bp, Artificial Sequence
  Synthetic
gtaatacatcaaatctgtttattagtactttgaataatactgaagggtcaattaaccacacccacaaccccacta

SEQ ID NO: 188093 - DNA, 75 bp, Artificial Sequence
  Synthetic
gtaatacatcaaatctgtttattagtactttgaataatactgaagggtcaattaaccacacccacaaccgcacta

SEQ ID NO: 188094 - DNA, 75 bp, Artificial Sequence
  Synthetic
gtaatacatcaaatctgtttattagtactttgaataatactgaagggtcaactaaccacacccacaaccacacta

SEQ ID NO: 188095 - DNA, 75 bp, Artificial Sequence
  Synthetic
gtaatacatcaaatctgtttattagtactttgaataatactgaagggtcaactaaccacacccacaacctcacta

SEQ ID NO: 188096 - DNA, 75 bp, Artificial Sequence
  Synthetic
gtaatacatcaaatctgtttattagtactttgaataatactgaagggtcaactaaccacacccacaaccccacta

SEQ ID NO: 188097 - DNA, 75 bp, Artificial Sequence
  Synthetic
gtaatacatcaaatctgtttattagtactttgaataatactgaagggtcaactaaccacacccacaaccgcacta

SEQ ID NO: 188098 - DNA, 75 bp, Artificial Sequence
  Synthetic
gtaatacatcaaatctgtttattagtactttgaataatactgaagggtcaagtaaccacacccacaaccacacta

SEQ ID NO: 188099 - DNA, 75 bp, Artificial Sequence
  Synthetic
gtaatacatcaaatctgtttattagtactttgaataatactgaagggtcaagtaaccacacccacaacctcacta

SEQ ID NO: 188100 - DNA, 75 bp, Artificial Sequence
  Synthetic
gtaatacatcaaatctgtttattagtactttgaataatactgaagggtcaagtaaccacacccacaaccccacta

SEQ ID NO: 188101 - DNA, 75 bp, Artificial Sequence
  Synthetic
gtaatacatcaaatctgtttattagtactttgaataatactgaagggtcaagtaaccacacccacaaccgcacta

SEQ ID NO: 188102 - DNA, 75 bp, Artificial Sequence
  Synthetic
gtaatacatcaaatctgtttattagtacttcgaataatactgaagggtcaaataaccacacccacaaccacacta

SEQ ID NO: 188103 - DNA, 75 bp, Artificial Sequence
  Synthetic
gtaatacatcaaatctgtttattagtacttcgaataatactgaagggtcaaataaccacacccacaacctcacta

SEQ ID NO: 188104 - DNA, 75 bp, Artificial Sequence
  Synthetic
gtaatacatcaaatctgtttattagtacttcgaataatactgaagggtcaaataaccacacccacaaccccacta

SEQ ID NO: 188105 - DNA, 75 bp, Artificial Sequence
  Synthetic
gtaatacatcaaatctgtttattagtacttcgaataatactgaagggtcaaataaccacacccacaaccgcacta

SEQ ID NO: 188106 - DNA, 75 bp, Artificial Sequence
  Synthetic
gtaatacatcaaatctgtttattagtacttcgaataatactgaagggtcaattaaccacacccacaaccacacta

SEQ ID NO: 188107 - DNA, 75 bp, Artificial Sequence
  Synthetic
gtaatacatcaaatctgtttattagtacttcgaataatactgaagggtcaattaaccacacccacaacctcacta

SEQ ID NO: 188108 - DNA, 75 bp, Artificial Sequence
  Synthetic
gtaatacatcaaatctgtttattagtacttcgaataatactgaagggtcaattaaccacacccacaaccccacta

SEQ ID NO: 188109 - DNA, 75 bp, Artificial Sequence
  Synthetic
gtaatacatcaaatctgtttattagtacttcgaataatactgaagggtcaattaaccacacccacaaccgcacta

SEQ ID NO: 188110 - DNA, 75 bp, Artificial Sequence
  Synthetic
gtaatacatcaaatctgtttattagtacttcgaataatactgaagggtcaactaaccacacccacaaccacacta

SEQ ID NO: 188111 - DNA, 75 bp, Artificial Sequence
  Synthetic
gtaatacatcaaatctgtttattagtacttcgaataatactgaagggtcaactaaccacacccacaacctcacta

SEQ ID NO: 188112 - DNA, 75 bp, Artificial Sequence
  Synthetic
gtaatacatcaaatctgtttattagtacttcgaataatactgaagggtcaactaaccacacccacaaccccacta

SEQ ID NO: 188113 - DNA, 75 bp, Artificial Sequence
  Synthetic
gtaatacatcaaatctgtttattagtacttcgaataatactgaagggtcaactaaccacacccacaaccgcacta

SEQ ID NO: 188114 - DNA, 75 bp, Artificial Sequence
  Synthetic
gtaatacatcaaatctgtttattagtacttcgaataatactgaagggtcaagtaaccacacccacaaccacacta

SEQ ID NO: 188115 - DNA, 75 bp, Artificial Sequence
  Synthetic
gtaatacatcaaatctgtttattagtacttcgaataatactgaagggtcaagtaaccacacccacaacctcacta

SEQ ID NO: 188116 - DNA, 75 bp, Artificial Sequence
  Synthetic
gtaatacatcaaatctgtttattagtacttcgaataatactgaagggtcaagtaaccacacccacaaccccacta

SEQ ID NO: 188117 - DNA, 75 bp, Artificial Sequence
  Synthetic
gtaatacatcaaatctgtttattagtacttcgaataatactgaagggtcaagtaaccacacccacaaccgcacta

SEQ ID NO: 188118 - DNA, 75 bp, Artificial Sequence
  Synthetic
gtaatacatcaaatctgtttattagtacttggaataatactgaagggtcaaataaccacacccacaaccacacta

SEQ ID NO: 188119 - DNA, 75 bp, Artificial Sequence
  Synthetic
gtaatacatcaaatctgtttattagtacttggaataatactgaagggtcaaataaccacacccacaacctcacta

SEQ ID NO: 188120 - DNA, 75 bp, Artificial Sequence
  Synthetic
gtaatacatcaaatctgtttattagtacttggaataatactgaagggtcaaataaccacacccacaaccccacta

SEQ ID NO: 188121 - DNA, 75 bp, Artificial Sequence
  Synthetic
gtaatacatcaaatctgtttattagtacttggaataatactgaagggtcaaataaccacacccacaaccgcacta

SEQ ID NO: 188122 - DNA, 75 bp, Artificial Sequence
  Synthetic
gtaatacatcaaatctgtttattagtacttggaataatactgaagggtcaattaaccacacccacaaccacacta

SEQ ID NO: 188123 - DNA, 75 bp, Artificial Sequence
  Synthetic
gtaatacatcaaatctgtttattagtacttggaataatactgaagggtcaattaaccacacccacaacctcacta

SEQ ID NO: 188124 - DNA, 75 bp, Artificial Sequence
  Synthetic
gtaatacatcaaatctgtttattagtacttggaataatactgaagggtcaattaaccacacccacaaccccacta

SEQ ID NO: 188125 - DNA, 75 bp, Artificial Sequence
  Synthetic
gtaatacatcaaatctgtttattagtacttggaataatactgaagggtcaattaaccacacccacaaccgcacta

SEQ ID NO: 188126 - DNA, 75 bp, Artificial Sequence
  Synthetic
gtaatacatcaaatctgtttattagtacttggaataatactgaagggtcaactaaccacacccacaaccacacta

SEQ ID NO: 188127 - DNA, 75 bp, Artificial Sequence
  Synthetic
gtaatacatcaaatctgtttattagtacttggaataatactgaagggtcaactaaccacacccacaacctcacta

SEQ ID NO: 188128 - DNA, 75 bp, Artificial Sequence
  Synthetic
gtaatacatcaaatctgtttattagtacttggaataatactgaagggtcaactaaccacacccacaaccccacta

SEQ ID NO: 188129 - DNA, 75 bp, Artificial Sequence
  Synthetic
gtaatacatcaaatctgtttattagtacttggaataatactgaagggtcaactaaccacacccacaaccgcacta

SEQ ID NO: 188130 - DNA, 75 bp, Artificial Sequence
  Synthetic
gtaatacatcaaatctgtttattagtacttggaataatactgaagggtcaagtaaccacacccacaaccacacta

SEQ ID NO: 188131 - DNA, 75 bp, Artificial Sequence
  Synthetic
gtaatacatcaaatctgtttattagtacttggaataatactgaagggtcaagtaaccacacccacaacctcacta

SEQ ID NO: 188132 - DNA, 75 bp, Artificial Sequence
  Synthetic
gtaatacatcaaatctgtttattagtacttggaataatactgaagggtcaagtaaccacacccacaaccccacta

SEQ ID NO: 188133 - DNA, 75 bp, Artificial Sequence
  Synthetic
gtaatacatcaaatctgtttattagtacttggaataatactgaagggtcaagtaaccacacccacaaccgcacta

SEQ ID NO: 188134 - DNA, 75 bp, Artificial Sequence
  Synthetic
tggacagtccagcctatagaactgccagaaaaagacagctggactgtcaatgatatacagaaattagtgggaaaa

SEQ ID NO: 188135 - DNA, 75 bp, Artificial Sequence
  Synthetic
tatcaaatttatcaagagccatttaaaaatctaaaaacaggaaaatatgcaagaaaaaggtctgctcacactaat

SEQ ID NO: 188136 - DNA, 75 bp, Artificial Sequence
  Synthetic
gaaatgaatttgccaggaagatggaaaccaaaaataatagggggaattggaggttttctcaaagtaagacagtat

SEQ ID NO: 188137 - DNA, 75 bp, Artificial Sequence
  Synthetic
ctgtagtagcaaaagaaatagtagcctgctgtgataaatgtcagctaaaaggagaagccatgcatggacaagtag

SEQ ID NO: 188138 - DNA, 75 bp, Artificial Sequence
  Synthetic
ataactctcccatgcaggataaagcagattataaatctatggcagagagtagggcaagcaatgtatgcccctcct

SEQ ID NO: 188139 - DNA, 75 bp, Artificial Sequence
  Synthetic
ctttctatagtaaatagagttaggcagggatactcaccattgtcatttcagacccaccccccagctccgagggga

SEQ ID NO: 188140 - DNA, 75 bp, Artificial Sequence
  Synthetic
tatatcccttagcttccctcaaatcactctttggcagcgacccctagtcacagtaagaataggggaacagctaat

SEQ ID NO: 188141 - DNA, 75 bp, Artificial Sequence
  Synthetic
tgtaagaccattttaagagcattaggaccaggggctacattagaagaaatgatgacagcatgtcagggagtggga

SEQ ID NO: 188142 - DNA, 75 bp, Artificial Sequence
  Synthetic
gaaagggctttgctataagatggggggcaagtggtcaaaacgtagtgaggataaatggcctgctgtaagggaaag

SEQ ID NO: 188143 - DNA, 75 bp, Artificial Sequence
  Synthetic
gctcttttaactcaaccacagaactaagagataagaaaaggaaagaatatgcacttttttatagacttgatatag

SEQ ID NO: 188144 - DNA, 75 bp, Artificial Sequence
  Synthetic
cagaggcagtgcaaaaaatagccacagaaagcatagtgatatggggaaagactcctaaatttaaactacccatac

SEQ ID NO: 188145 - DNA, 75 bp, Artificial Sequence
  Synthetic
agaaagcatagtgatatggggaaagactcctaaatttaaactacccatacaaaaagaaacatgggaaacatggtg

SEQ ID NO: 188146 - DNA, 75 bp, Artificial Sequence
  Synthetic
ctgcttgataccatagcaatagcagtagctgaaggaacagataggattatagaattcatacaaagaatttgtaga

SEQ ID NO: 188147 - DNA, 75 bp, Artificial Sequence
  Synthetic
tcatatgcattattttgattgttttgcagactctgccataagacaagccatattaggacatatagttattcctag

SEQ ID NO: 188148 - DNA, 75 bp, Artificial Sequence
  Synthetic
aatgatgtaaaacagttaacagaggcagtgcaaaaaatagccacagaaagcatagtaatatggggaaagactcct

SEQ ID NO: 188149 - DNA, 75 bp, Artificial Sequence
  Synthetic
ccgcagagggaaccatacaatgaatgggcactagagattctagaggaactcaagcaggaagctgtcagacacttt

SEQ ID NO: 188150 - DNA, 75 bp, Artificial Sequence
  Synthetic
caataatgctgattgtgcctggctggaagcgcaagaggaggaaggagatgtaggctttccagtcagacctcaggt

SEQ ID NO: 188151 - DNA, 75 bp, Artificial Sequence
  Synthetic
aaaaatgggataaagctttaaaacagatagtttcaaaattaaaatatcaatttgggaaaaataagacaatagcct

SEQ ID NO: 188152 - DNA, 75 bp, Artificial Sequence
  Synthetic
aaaaatgggataaagctttaaaacagatagtttcaaaattaaaatatcaatttgggaaaaataagacattagcct

SEQ ID NO: 188153 - DNA, 75 bp, Artificial Sequence
  Synthetic
aaaaatgggataaagctttaaaacagatagtttcaaaattaaaatatcaatttgggaaaaataagacactagcct

SEQ ID NO: 188154 - DNA, 75 bp, Artificial Sequence
  Synthetic
aaaaatgggataaagctttaaaacagatagtttcaaaattaaaatatcaatttgggaaaaataagacagtagcct

SEQ ID NO: 188155 - DNA, 75 bp, Artificial Sequence
  Synthetic
aaaaatgggataaagctttaaaacagatagtttcaaaattaatatatcaatttgggaaaaataagacaatagcct

SEQ ID NO: 188156 - DNA, 75 bp, Artificial Sequence
  Synthetic
aaaaatgggataaagctttaaaacagatagtttcaaaattaatatatcaatttgggaaaaataagacattagcct

SEQ ID NO: 188157 - DNA, 75 bp, Artificial Sequence
  Synthetic
aaaaatgggataaagctttaaaacagatagtttcaaaattaatatatcaatttgggaaaaataagacactagcct

SEQ ID NO: 188158 - DNA, 75 bp, Artificial Sequence
  Synthetic
aaaaatgggataaagctttaaaacagatagtttcaaaattaatatatcaatttgggaaaaataagacagtagcct

SEQ ID NO: 188159 - DNA, 75 bp, Artificial Sequence
  Synthetic
aaaaatgggataaagctttaaaacagatagtttcaaaattaacatatcaatttgggaaaaataagacaatagcct

SEQ ID NO: 188160 - DNA, 75 bp, Artificial Sequence
  Synthetic
aaaaatgggataaagctttaaaacagatagtttcaaaattaacatatcaatttgggaaaaataagacattagcct

SEQ ID NO: 188161 - DNA, 75 bp, Artificial Sequence
  Synthetic
aaaaatgggataaagctttaaaacagatagtttcaaaattaacatatcaatttgggaaaaataagacactagcct

SEQ ID NO: 188162 - DNA, 75 bp, Artificial Sequence
  Synthetic
aaaaatgggataaagctttaaaacagatagtttcaaaattaacatatcaatttgggaaaaataagacagtagcct

SEQ ID NO: 188163 - DNA, 75 bp, Artificial Sequence
  Synthetic
aaaaatgggataaagctttaaaacagatagtttcaaaattaagatatcaatttgggaaaaataagacaatagcct

SEQ ID NO: 188164 - DNA, 75 bp, Artificial Sequence
  Synthetic
aaaaatgggataaagctttaaaacagatagtttcaaaattaagatatcaatttgggaaaaataagacattagcct

SEQ ID NO: 188165 - DNA, 75 bp, Artificial Sequence
  Synthetic
aaaaatgggataaagctttaaaacagatagtttcaaaattaagatatcaatttgggaaaaataagacactagcct

SEQ ID NO: 188166 - DNA, 75 bp, Artificial Sequence
  Synthetic
aaaaatgggataaagctttaaaacagatagtttcaaaattaagatatcaatttgggaaaaataagacagtagcct

SEQ ID NO: 188167 - DNA, 75 bp, Artificial Sequence
  Synthetic
aaaattgggataaagctttaaaacagatagtttcaaaattaaaatatcaatttgggaaaaataagacaatagcct

SEQ ID NO: 188168 - DNA, 75 bp, Artificial Sequence
  Synthetic
aaaattgggataaagctttaaaacagatagtttcaaaattaaaatatcaatttgggaaaaataagacattagcct

SEQ ID NO: 188169 - DNA, 75 bp, Artificial Sequence
  Synthetic
aaaattgggataaagctttaaaacagatagtttcaaaattaaaatatcaatttgggaaaaataagacactagcct

SEQ ID NO: 188170 - DNA, 75 bp, Artificial Sequence
  Synthetic
aaaattgggataaagctttaaaacagatagtttcaaaattaaaatatcaatttgggaaaaataagacagtagcct

SEQ ID NO: 188171 - DNA, 75 bp, Artificial Sequence
  Synthetic
aaaattgggataaagctttaaaacagatagtttcaaaattaatatatcaatttgggaaaaataagacaatagcct

SEQ ID NO: 188172 - DNA, 75 bp, Artificial Sequence
  Synthetic
aaaattgggataaagctttaaaacagatagtttcaaaattaatatatcaatttgggaaaaataagacattagcct

SEQ ID NO: 188173 - DNA, 75 bp, Artificial Sequence
  Synthetic
aaaattgggataaagctttaaaacagatagtttcaaaattaatatatcaatttgggaaaaataagacactagcct

SEQ ID NO: 188174 - DNA, 75 bp, Artificial Sequence
  Synthetic
aaaattgggataaagctttaaaacagatagtttcaaaattaatatatcaatttgggaaaaataagacagtagcct

SEQ ID NO: 188175 - DNA, 75 bp, Artificial Sequence
  Synthetic
aaaattgggataaagctttaaaacagatagtttcaaaattaacatatcaatttgggaaaaataagacaatagcct

SEQ ID NO: 188176 - DNA, 75 bp, Artificial Sequence
  Synthetic
aaaattgggataaagctttaaaacagatagtttcaaaattaacatatcaatttgggaaaaataagacattagcct

SEQ ID NO: 188177 - DNA, 75 bp, Artificial Sequence
  Synthetic
aaaattgggataaagctttaaaacagatagtttcaaaattaacatatcaatttgggaaaaataagacactagcct

SEQ ID NO: 188178 - DNA, 75 bp, Artificial Sequence
  Synthetic
aaaattgggataaagctttaaaacagatagtttcaaaattaacatatcaatttgggaaaaataagacagtagcct

SEQ ID NO: 188179 - DNA, 75 bp, Artificial Sequence
  Synthetic
aaaattgggataaagctttaaaacagatagtttcaaaattaagatatcaatttgggaaaaataagacaatagcct

SEQ ID NO: 188180 - DNA, 75 bp, Artificial Sequence
  Synthetic
aaaattgggataaagctttaaaacagatagtttcaaaattaagatatcaatttgggaaaaataagacattagcct

SEQ ID NO: 188181 - DNA, 75 bp, Artificial Sequence
  Synthetic
aaaattgggataaagctttaaaacagatagtttcaaaattaagatatcaatttgggaaaaataagacactagcct

SEQ ID NO: 188182 - DNA, 75 bp, Artificial Sequence
  Synthetic
aaaattgggataaagctttaaaacagatagtttcaaaattaagatatcaatttgggaaaaataagacagtagcct

SEQ ID NO: 188183 - DNA, 75 bp, Artificial Sequence
  Synthetic
aaaactgggataaagctttaaaacagatagtttcaaaattaaaatatcaatttgggaaaaataagacaatagcct

SEQ ID NO: 188184 - DNA, 75 bp, Artificial Sequence
  Synthetic
aaaactgggataaagctttaaaacagatagtttcaaaattaaaatatcaatttgggaaaaataagacattagcct

SEQ ID NO: 188185 - DNA, 75 bp, Artificial Sequence
  Synthetic
aaaactgggataaagctttaaaacagatagtttcaaaattaaaatatcaatttgggaaaaataagacactagcct

SEQ ID NO: 188186 - DNA, 75 bp, Artificial Sequence
  Synthetic
aaaactgggataaagctttaaaacagatagtttcaaaattaaaatatcaatttgggaaaaataagacagtagcct

SEQ ID NO: 188187 - DNA, 75 bp, Artificial Sequence
  Synthetic
aaaactgggataaagctttaaaacagatagtttcaaaattaatatatcaatttgggaaaaataagacaatagcct

SEQ ID NO: 188188 - DNA, 75 bp, Artificial Sequence
  Synthetic
aaaactgggataaagctttaaaacagatagtttcaaaattaatatatcaatttgggaaaaataagacattagcct

SEQ ID NO: 188189 - DNA, 75 bp, Artificial Sequence
  Synthetic
aaaactgggataaagctttaaaacagatagtttcaaaattaatatatcaatttgggaaaaataagacactagcct

SEQ ID NO: 188190 - DNA, 75 bp, Artificial Sequence
  Synthetic
aaaactgggataaagctttaaaacagatagtttcaaaattaatatatcaatttgggaaaaataagacagtagcct

SEQ ID NO: 188191 - DNA, 75 bp, Artificial Sequence
  Synthetic
aaaactgggataaagctttaaaacagatagtttcaaaattaacatatcaatttgggaaaaataagacaatagcct

SEQ ID NO: 188192 - DNA, 75 bp, Artificial Sequence
  Synthetic
aaaactgggataaagctttaaaacagatagtttcaaaattaacatatcaatttgggaaaaataagacattagcct

SEQ ID NO: 188193 - DNA, 75 bp, Artificial Sequence
  Synthetic
aaaactgggataaagctttaaaacagatagtttcaaaattaacatatcaatttgggaaaaataagacactagcct

SEQ ID NO: 188194 - DNA, 75 bp, Artificial Sequence
  Synthetic
aaaactgggataaagctttaaaacagatagtttcaaaattaacatatcaatttgggaaaaataagacagtagcct

SEQ ID NO: 188195 - DNA, 75 bp, Artificial Sequence
  Synthetic
aaaactgggataaagctttaaaacagatagtttcaaaattaagatatcaatttgggaaaaataagacaatagcct

SEQ ID NO: 188196 - DNA, 75 bp, Artificial Sequence
  Synthetic
aaaactgggataaagctttaaaacagatagtttcaaaattaagatatcaatttgggaaaaataagacattagcct

SEQ ID NO: 188197 - DNA, 75 bp, Artificial Sequence
  Synthetic
aaaactgggataaagctttaaaacagatagtttcaaaattaagatatcaatttgggaaaaataagacactagcct

SEQ ID NO: 188198 - DNA, 75 bp, Artificial Sequence
  Synthetic
aaaactgggataaagctttaaaacagatagtttcaaaattaagatatcaatttgggaaaaataagacagtagcct

SEQ ID NO: 188199 - DNA, 75 bp, Artificial Sequence
  Synthetic
aaaagtgggataaagctttaaaacagatagtttcaaaattaaaatatcaatttgggaaaaataagacaatagcct

SEQ ID NO: 188200 - DNA, 75 bp, Artificial Sequence
  Synthetic
aaaagtgggataaagctttaaaacagatagtttcaaaattaaaatatcaatttgggaaaaataagacattagcct

SEQ ID NO: 188201 - DNA, 75 bp, Artificial Sequence
  Synthetic
aaaagtgggataaagctttaaaacagatagtttcaaaattaaaatatcaatttgggaaaaataagacactagcct

SEQ ID NO: 188202 - DNA, 75 bp, Artificial Sequence
  Synthetic
aaaagtgggataaagctttaaaacagatagtttcaaaattaaaatatcaatttgggaaaaataagacagtagcct

SEQ ID NO: 188203 - DNA, 75 bp, Artificial Sequence
  Synthetic
aaaagtgggataaagctttaaaacagatagtttcaaaattaatatatcaatttgggaaaaataagacaatagcct

SEQ ID NO: 188204 - DNA, 75 bp, Artificial Sequence
  Synthetic
aaaagtgggataaagctttaaaacagatagtttcaaaattaatatatcaatttgggaaaaataagacattagcct

SEQ ID NO: 188205 - DNA, 75 bp, Artificial Sequence
  Synthetic
aaaagtgggataaagctttaaaacagatagtttcaaaattaatatatcaatttgggaaaaataagacactagcct

SEQ ID NO: 188206 - DNA, 75 bp, Artificial Sequence
  Synthetic
aaaagtgggataaagctttaaaacagatagtttcaaaattaatatatcaatttgggaaaaataagacagtagcct

SEQ ID NO: 188207 - DNA, 75 bp, Artificial Sequence
  Synthetic
aaaagtgggataaagctttaaaacagatagtttcaaaattaacatatcaatttgggaaaaataagacaatagcct

SEQ ID NO: 188208 - DNA, 75 bp, Artificial Sequence
  Synthetic
aaaagtgggataaagctttaaaacagatagtttcaaaattaacatatcaatttgggaaaaataagacattagcct

SEQ ID NO: 188209 - DNA, 75 bp, Artificial Sequence
  Synthetic
aaaagtgggataaagctttaaaacagatagtttcaaaattaacatatcaatttgggaaaaataagacactagcct

SEQ ID NO: 188210 - DNA, 75 bp, Artificial Sequence
  Synthetic
aaaagtgggataaagctttaaaacagatagtttcaaaattaacatatcaatttgggaaaaataagacagtagcct

SEQ ID NO: 188211 - DNA, 75 bp, Artificial Sequence
  Synthetic
aaaagtgggataaagctttaaaacagatagtttcaaaattaagatatcaatttgggaaaaataagacaatagcct

SEQ ID NO: 188212 - DNA, 75 bp, Artificial Sequence
  Synthetic
aaaagtgggataaagctttaaaacagatagtttcaaaattaagatatcaatttgggaaaaataagacattagcct

SEQ ID NO: 188213 - DNA, 75 bp, Artificial Sequence
  Synthetic
aaaagtgggataaagctttaaaacagatagtttcaaaattaagatatcaatttgggaaaaataagacactagcct

SEQ ID NO: 188214 - DNA, 75 bp, Artificial Sequence
  Synthetic
aaaagtgggataaagctttaaaacagatagtttcaaaattaagatatcaatttgggaaaaataagacagtagcct

SEQ ID NO: 188215 - DNA, 75 bp, Artificial Sequence
  Synthetic
agatatactattagaaaatgtaacagaaaattttaacatgtggaagaataacatggtagaacagatgcatgagga

SEQ ID NO: 188216 - DNA, 75 bp, Artificial Sequence
  Synthetic
agatatactatttgaaaatgtaacagaaaattttaacatgtggaagaataacatggtagaacagatgcatgagga

SEQ ID NO: 188217 - DNA, 75 bp, Artificial Sequence
  Synthetic
agatatactattcgaaaatgtaacagaaaattttaacatgtggaagaataacatggtagaacagatgcatgagga

SEQ ID NO: 188218 - DNA, 75 bp, Artificial Sequence
  Synthetic
agatatactattggaaaatgtaacagaaaattttaacatgtggaagaataacatggtagaacagatgcatgagga

SEQ ID NO: 188219 - DNA, 75 bp, Artificial Sequence
  Synthetic
aaagtctaaaaccatgtgtaaagctaacccctctctgtgttactttaaaatgtgctaatgttacttctaatagta

SEQ ID NO: 188220 - DNA, 75 bp, Artificial Sequence
  Synthetic
agtagtatagtgggatggcctcagatcagggaaaggctaagacaagcttctccagcagcagaaggagtaggaaaa

SEQ ID NO: 188221 - DNA, 75 bp, Artificial Sequence
  Synthetic
tttcaaagtacttattaaggtaaatattaaggtaaatgattataatataaataaatgtaatatcgtaacaattaa

SEQ ID NO: 188222 - DNA, 75 bp, Artificial Sequence
  Synthetic
gcacaaaaggaagaggacgtaggctttccagtcagaccacaggtacccttaaggccaatgacttacaaagcagct

SEQ ID NO: 188223 - DNA, 75 bp, Artificial Sequence
  Synthetic
acaggaccgtgcaacaatgtcagcacagtacaatgcacacatgggattaaaccagtagtatcaactaaactactg

SEQ ID NO: 188224 - DNA, 75 bp, Artificial Sequence
  Synthetic
acatagcagaataggcattataccagggagaagaggcaggaatggagccagtagatcctaacctagagccctgga

SEQ ID NO: 188225 - DNA, 75 bp, Artificial Sequence
  Synthetic
gtggactatagtatttatagaatataagaaaataaggaagcaaaagaaaatagataggctaatcaataggataag

SEQ ID NO: 188226 - DNA, 75 bp, Artificial Sequence
  Synthetic
caatacaagaaaaggtatacatacaggaccaggacaagctctctatacaacaggtgctataataggagatataag

SEQ ID NO: 188227 - DNA, 75 bp, Artificial Sequence
  Synthetic
taccaacacttgtggagatgtgggattatgatcattggattaatgataatttgtagggctaaagaagacttgtgg

SEQ ID NO: 188228 - DNA, 75 bp, Artificial Sequence
  Synthetic
agcagcaaggtcagccaaaattaccctatagtgcaaaatgcacaagggcaaatggtacatcagtccatatcacct

SEQ ID NO: 188229 - DNA, 75 bp, Artificial Sequence
  Synthetic
atagcactgtcaatatttctaaggacatgcaagaagacataaaaaactgctcttataatattactacagaattaa

SEQ ID NO: 188230 - DNA, 75 bp, Artificial Sequence
  Synthetic
gtggtggagattaaaccactaggagtagcacctaccagggcaaaaagaagagtggtggagagagaaaaaagagca

SEQ ID NO: 188231 - DNA, 75 bp, Artificial Sequence
  Synthetic
ggggagcaagtggtcaaaaggcagcatagttgggtggcctgaaataagagacagaatgagaagaactagaaatag

SEQ ID NO: 188232 - DNA, 75 bp, Artificial Sequence
  Synthetic
aaatgatccagcagcagaaggagatccagcagcagaaggagtaggagcagcatctcgagacttagagtgacatgg

SEQ ID NO: 188233 - DNA, 75 bp, Artificial Sequence
  Synthetic
atacgtataggaccaggacaagcactctatacaaataaaataattggggatataagaaaagcacattgtaatatc

SEQ ID NO: 188234 - DNA, 75 bp, Artificial Sequence
  Synthetic
taaaacaaattataaacatgtggcagagagtaggacaagcaatgtatgcccctcccattgcaggagtaataaaat

SEQ ID NO: 188235 - DNA, 75 bp, Artificial Sequence
  Synthetic
aaatattaaaacaaagaagaatagacaggattcttgagagaataagagaaagagcagaagacagtggcaatgaga

SEQ ID NO: 188236 - DNA, 75 bp, Artificial Sequence
  Synthetic
gggccaagaactgaagaatagtgctattagtttgtttaatgccacagcaatagcagtagctgaaggaacagatag

SEQ ID NO: 188237 - DNA, 75 bp, Artificial Sequence
  Synthetic
attagtttgtttaatgccacagcaatagcagtagctgaaggaacagataggattatagaaatagtacagagagtg

SEQ ID NO: 188238 - DNA, 75 bp, Artificial Sequence
  Synthetic
agaccctggcctggcagaccagctaattcatatgcattattttgattgttttacagactctgccataagaaaagc

SEQ ID NO: 188239 - DNA, 75 bp, Artificial Sequence
  Synthetic
cagaaggagtaggagcagcatctaaagatttagaaaaatttggagcactcacaaccagtaatacagcacagacta

SEQ ID NO: 188240 - DNA, 75 bp, Artificial Sequence
  Synthetic
cagtagatcctaaaatagaaccctggaatcagccaggaagtcggcctaagactccgtgtaccccatgctattgta

SEQ ID NO: 188241 - DNA, 75 bp, Artificial Sequence
  Synthetic
ttggaacaacatgacatggacacaatgggagagagaaattagcaattacacagaccaaatatatgctatacttac

SEQ ID NO: 188242 - DNA, 75 bp, Artificial Sequence
  Synthetic
agctggaaagatttgcacttaaccctagccttttagaaacaacagaaggatgtcaacagatcttgggacagttac

SEQ ID NO: 188243 - DNA, 75 bp, Artificial Sequence
  Synthetic
caagaccaatggacatatcaaatttatcaagagccatttaaaaatctaaagacagggaaatatgcaaaaaagagg

SEQ ID NO: 188244 - DNA, 75 bp, Artificial Sequence
  Synthetic
aatagcactaatcatagcaatagttgtatggaccatagtatatatagaatataggaaattgagaagacaaagaaa

SEQ ID NO: 188245 - DNA, 75 bp, Artificial Sequence
  Synthetic
ctattagtttgcttgataccacagcaatagcagtagctaattggacagatagggttatagaattaggacaaagaa

SEQ ID NO: 188246 - DNA, 75 bp, Artificial Sequence
  Synthetic
tttgtagagctatccgcaacgtacctagaagaataagacagggctttgaagtagctttgctataagatggggggc

SEQ ID NO: 188247 - DNA, 75 bp, Artificial Sequence
  Synthetic
tacggatcatcaaaatcctgtaccaaagcagtaagtagtagtaatcaatataggtaatgtcacctttagcaatac

SEQ ID NO: 188248 - DNA, 75 bp, Artificial Sequence
  Synthetic
taacaaactgctctttcaatataaccacagaaataagagataagaaaaagacagaatacgcgcttttctataaac

SEQ ID NO: 188249 - DNA, 75 bp, Artificial Sequence
  Synthetic
atgcatgaggatataatcagtttatgggatcaaagcctaaagccatgtgtaaagttgaccccactctgtgtcact

SEQ ID NO: 188250 - DNA, 75 bp, Artificial Sequence
  Synthetic
gtggcgcccgaacagggacgcgaaagcgaaagtaaaaccagaggagctctctcgacgcaggactcggcttgctga

SEQ ID NO: 188251 - DNA, 75 bp, Artificial Sequence
  Synthetic
atactactgttactgttaccaataataataccatggatactgtaatgaaaaattgctctttcaatgtaaccacag

SEQ ID NO: 188252 - DNA, 75 bp, Artificial Sequence
  Synthetic
acaccaatagcactgaagaaataaaaaactgctcttacaatatgcccacagaactaaaagataaaacacagaaag

SEQ ID NO: 188253 - DNA, 75 bp, Artificial Sequence
  Synthetic
gaaaaatcgcaaacccaacaggaaataaatgaaaaggaattattggaattggataaatgggcaagtttgtggagt

SEQ ID NO: 188254 - DNA, 75 bp, Artificial Sequence
  Synthetic
aggtcagtcaaaattatcctatagtacagaatcttcaagggcaaatggtacatcagcccctatcacctagaactt

SEQ ID NO: 188255 - DNA, 75 bp, Artificial Sequence
  Synthetic
ctggactgtcaatgatatacagaagttagtgggaaaattgaattgggcaagtcaaatttacccagggattaaagt

SEQ ID NO: 188256 - DNA, 75 bp, Artificial Sequence
  Synthetic
gcagcgaccagttgtcacagtaaaagtagcggggcagctgaaggaagctctattagatacaggagcagatgatac

SEQ ID NO: 188257 - DNA, 75 bp, Artificial Sequence
  Synthetic
caattaattgtaccagacccaacaacaatacaagaaaaagtatacgctttggaccaggacaggccttctatacaa

SEQ ID NO: 188258 - DNA, 75 bp, Artificial Sequence
  Synthetic
cttccctaataaaacaataatctttaatagctcctcaggaggggacctagaaattacaacacatagttttaattg

SEQ ID NO: 188259 - DNA, 75 bp, Artificial Sequence
  Synthetic
ttgtgtggcaggtagacaggatgaggattagcaaatggaaaagtttagtaaaataccatatacatacttcaaaga

SEQ ID NO: 188260 - DNA, 75 bp, Artificial Sequence
  Synthetic
gagaccttcagacctggaggaggagatatgagggacaattggagaagtgaattatataagtataaagtagtaaaa

SEQ ID NO: 188261 - DNA, 75 bp, Artificial Sequence
  Synthetic
gcaggacataacaaggtaggatctctacaatatttagcactgaaagcattagtaacaccaacaaagagaaagcca

SEQ ID NO: 188262 - DNA, 75 bp, Artificial Sequence
  Synthetic
agcggagagcttcaggttcgaagaagagatagctccctctcagaaacaggggatgaaagacaaggaacctgctcc

SEQ ID NO: 188263 - DNA, 75 bp, Artificial Sequence
  Synthetic
acagagagagccatacaatgaatggacactagaacttttagaggagcttaaaaatgaagctgtcagacatttccc

SEQ ID NO: 188264 - DNA, 75 bp, Artificial Sequence
  Synthetic
gtttgacataacaaactggctgtggtatataaaaatattcataatgatagtaggaggcttgataggtttaagaat

SEQ ID NO: 188265 - DNA, 75 bp, Artificial Sequence
  Synthetic
tgcaacaactgctgtttattcatttcagaatcgggtgccaacacagcagaataggcattattcctgggagaaggg

SEQ ID NO: 188266 - DNA, 75 bp, Artificial Sequence
  Synthetic
ttggggtaacatgacctggatgcagtgggatagggaaattagcaattacacaaacacaatatacaggttacttga

SEQ ID NO: 188267 - DNA, 75 bp, Artificial Sequence
  Synthetic
tgcttcataacaaaaggcttaggcatctcctatggcaggaagaagcggagacagcgacgaagacctcctcaaggc

SEQ ID NO: 188268 - DNA, 75 bp, Artificial Sequence
  Synthetic
tatcacctagaactttaaatgcatgggtaaaagtagtagaagagaaggcttttagcccagaagtaatacccatgt

SEQ ID NO: 188269 - DNA, 75 bp, Artificial Sequence
  Synthetic
aatcgaagaagaaggtggagagcaaggcagagacagatcgattcgattagtgagcggattcttagcacttgcctg

SEQ ID NO: 188270 - DNA, 75 bp, Artificial Sequence
  Synthetic
atcacactcccatgcagaataaaacaatttataaacatgtggcaggaagtaggaaaagcaatgtatgcccctccc

SEQ ID NO: 188271 - DNA, 75 bp, Artificial Sequence
  Synthetic
aaattggtaataacaacatattggggtctacatacaggagaaagagactggcatttgggtcagggagtctccata

SEQ ID NO: 188272 - DNA, 75 bp, Artificial Sequence
  Synthetic
ccagcagccacactagaagaaatgatgacagcatgtcagggagtaggaggacccggccataaagcaagagttttg

SEQ ID NO: 188273 - DNA, 75 bp, Artificial Sequence
  Synthetic
agcagaaggagtaagaccaactcctccagctgcagaaggagtaggagcagtgtctcaagatttagccagacatgg

SEQ ID NO: 188274 - DNA, 75 bp, Artificial Sequence
  Synthetic
aactgctctttcaatacaaccacagaactaagggataaaagaaagaaagtatattcacttttttataaacttgat

SEQ ID NO: 188275 - DNA, 75 bp, Artificial Sequence
  Synthetic
acaatagcagcagtaatagtagtgggaagggaacaatagaaggaggagagatgaaaaattgttctttcaatatca

SEQ ID NO: 188276 - DNA, 75 bp, Artificial Sequence
  Synthetic
tgcaatgagaaggagttcaatggaacagggccatgcaaaaatgtcagctcagtacaatgcacacatggaatcagg

SEQ ID NO: 188277 - DNA, 75 bp, Artificial Sequence
  Synthetic
acagcaagcagaagcggctgacaaaggaaaggtcagtcaaaattatccaatagtgcagaatctccaagggcaaat

SEQ ID NO: 188278 - DNA, 75 bp, Artificial Sequence
  Synthetic
agcatatatagaatatagaaaattgttaagacaaaggaaaatagactggttaattaaaagaattagggaaagagc

SEQ ID NO: 188279 - DNA, 75 bp, Artificial Sequence
  Synthetic
taattaaaagaattagggaaagagcagaagacagtggcaatgagagtgatggggatactgaggaattgtcaacca

SEQ ID NO: 188280 - DNA, 75 bp, Artificial Sequence
  Synthetic
acaagaagaagtatacatataggaccaggacaagcattctatgcagcaacaaatataataggggatataagacaa

SEQ ID NO: 188281 - DNA, 75 bp, Artificial Sequence
  Synthetic
ctactgttactgctaccagaaatggtagtgatattatgaatactaccagtaatgatggagaaatgaaaaattgct

SEQ ID NO: 188282 - DNA, 75 bp, Artificial Sequence
  Synthetic
gaagctctagataaaatagaggaagaacaaaacaaacacaagcagaagacacagcatgcagcagctgacacagga

SEQ ID NO: 188283 - DNA, 75 bp, Artificial Sequence
  Synthetic
acagcatgcagcagctgacacaggaagcagcagcagtcagaattaccccatagtgcaaaatgcacaagggcaaat

SEQ ID NO: 188284 - DNA, 75 bp, Artificial Sequence
  Synthetic
gaaaaggaaggaaaaatttcaaagattgggcctgaaaatccatacaatactccaatatttgccataaagaaaaag

SEQ ID NO: 188285 - DNA, 75 bp, Artificial Sequence
  Synthetic
gggacatcaagcagctatgcaaatgttaaaagatactatcaatgaggaagctgcagaatgggacagggtacatcc

SEQ ID NO: 188286 - DNA, 75 bp, Artificial Sequence
  Synthetic
aaaaagtagtgtggttggatggcctgctgtaagggaaagaatgagacgagctgagccagcagcagatggggtggg

SEQ ID NO: 188287 - DNA, 75 bp, Artificial Sequence
  Synthetic
agaacatggaatagtttagtaaaacatcatatgtatgtctcaaagaaagctgacaggtggaggtatagacaccac

SEQ ID NO: 188288 - DNA, 75 bp, Artificial Sequence
  Synthetic
atataatcagtttatgggatcaaagcctaaagccatgtgtaaaattaaccccactctgtgttactttaaattgca

SEQ ID NO: 188289 - DNA, 75 bp, Artificial Sequence
  Synthetic
atcaaattggctgtggtatataagaatatttataatgatagtaggaggcttaataggattaagaatagtttttgc

SEQ ID NO: 188290 - DNA, 75 bp, Artificial Sequence
  Synthetic
agaggcagaaatggatccagtagaccctaacatagagccctggaaccagccaggaagccagcctaaaactgcttg

SEQ ID NO: 188291 - DNA, 75 bp, Artificial Sequence
  Synthetic
attttcgggtttattacagagacagcagagaccctatttggaaaggaccagccaaactactctggaaaggtgaag

SEQ ID NO: 188292 - DNA, 75 bp, Artificial Sequence
  Synthetic
ctactctggaaaggtgaaggggcagtagtaatacaggacaatagtgatataaaagtagtaccaagaagaaaagca

SEQ ID NO: 188293 - DNA, 75 bp, Artificial Sequence
  Synthetic
cgaagcgctcctccaagcagtaagaatcatcaagatcctataccagagcagtaagtataatcaattagttctgta

SEQ ID NO: 188294 - DNA, 75 bp, Artificial Sequence
  Synthetic
taaagcaaaagaaaataaataagttaattgatagaataagagaaagagcagaggacagtggcaatgagagtgaag

SEQ ID NO: 188295 - DNA, 75 bp, Artificial Sequence
  Synthetic
cccagtagcagaaggggtgggagcagtctctcgagacctaggaaggcatggagcaatcacaagtagcaacacagc

SEQ ID NO: 188296 - DNA, 75 bp, Artificial Sequence
  Synthetic
gctggaagcacaagaagaagaggagataggctttccagtcaggccacaagtgccactaaggccaatgaattacaa

SEQ ID NO: 188297 - DNA, 75 bp, Artificial Sequence
  Synthetic
agcagacatgaaaaactgctctttcaatataaccacagaaataaaagataaaaagaagaaagaatacgcactctt

SEQ ID NO: 188298 - DNA, 75 bp, Artificial Sequence
  Synthetic
agtgggaaaattgaattgggcaagtcagatttatgcagggattaaagtaaagcaattatgtaaactccttagggg

SEQ ID NO: 188299 - DNA, 75 bp, Artificial Sequence
  Synthetic
acaagaagaagtatacgtataggaccaggacaagttttctatgcaacagatgtaatagggaatatcagaaaagca

SEQ ID NO: 188300 - DNA, 75 bp, Artificial Sequence
  Synthetic
caggacaagttttctatgcaacagatgtaatagggaatatcagaaaagcatactgtacagttaatgaaacaaaat

SEQ ID NO: 188301 - DNA, 75 bp, Artificial Sequence
  Synthetic
agtaggagcagtgtctcaagacttggatagatttggagcagtcacaagcagcaatacagcagccactaatgctga

SEQ ID NO: 188302 - DNA, 75 bp, Artificial Sequence
  Synthetic
acatggaaaagtttagtaaaacaccatatgtatatttcaaagaaagctaaaggatggttttatagacatcactat

SEQ ID NO: 188303 - DNA, 75 bp, Artificial Sequence
  Synthetic
taatgttacctacaacgatactacgaatggagcaataagaaattgctctttcaatataaccacagaactaagaga

SEQ ID NO: 188304 - DNA, 75 bp, Artificial Sequence
  Synthetic
agtcaatgtctctagtgaaatagcaaatttaggaaatataacagaggaagtaagaaactgttcttttaatataac

SEQ ID NO: 188305 - DNA, 75 bp, Artificial Sequence
  Synthetic
aattgtaatacttcagtcattaagcaggcttgtccaaaggtatcctttgatccaattcctatacattattgtact

SEQ ID NO: 188306 - DNA, 75 bp, Artificial Sequence
  Synthetic
atacattattgtgctccagctggttatgcgattctaaagtgtaataataagacattcaatgggacaggaccatgc

SEQ ID NO: 188307 - DNA, 75 bp, Artificial Sequence
  Synthetic
gacccaacaataatacaagaaaatatgtaaggatggggataggacgaggacaaacattccaggcaataggagcca

SEQ ID NO: 188308 - DNA, 75 bp, Artificial Sequence
  Synthetic
cagcaggaaaagaatgaacaagacttattggcattagacaaatgggcaagtttgtggaactggtttgacatatca

SEQ ID NO: 188309 - DNA, 75 bp, Artificial Sequence
  Synthetic
gtaatattagcaatagtagcattagtagtagcagcaataatagcaatagttgtgtggtccatagtactcatagaa

SEQ ID NO: 188310 - DNA, 75 bp, Artificial Sequence
  Synthetic
ttcatatgcattactttgattgtttttcagaatctgccataaggaaagccatattaggacatatagttagcccta

SEQ ID NO: 188311 - DNA, 75 bp, Artificial Sequence
  Synthetic
agggatactcacccttgtcttttcagacccttatcccaagccaaagggaagccgacaggcccggaggaatcgaag

SEQ ID NO: 188312 - DNA, 75 bp, Artificial Sequence
  Synthetic
accctccaatgcaggataagacaaattgtaaacatgtggcaagaggtaggaaaagcaatgtatgctgctcccatt

SEQ ID NO: 188313 - DNA, 75 bp, Artificial Sequence
  Synthetic
ttcttagcacttgcctgggacgatctgaggaacctgtgtctcttcagctaccaccgattgagagacttcatcttg

SEQ ID NO: 188314 - DNA, 75 bp, Artificial Sequence
  Synthetic
ccaccgattgagagacttcatcttgattgtaacgaggattgtggagactctgggacacagggggtgggaaattct

SEQ ID NO: 188315 - DNA, 75 bp, Artificial Sequence
  Synthetic
gtgctattagcttgttaaatgccatagcaatagcagtagctgaaggaacagataggataatagaaatagtacaga

SEQ ID NO: 188316 - DNA, 75 bp, Artificial Sequence
  Synthetic
taggatggcctgaggtaagagaaagaataagaagaacttcgccaacagaagcagcaataggagtaggagcagcat

SEQ ID NO: 188317 - DNA, 75 bp, Artificial Sequence
  Synthetic
aactgctctttcaatgttaccacaggcataagagataagatgcaaagagaatatgcacttttttataaacttgat

SEQ ID NO: 188318 - DNA, 75 bp, Artificial Sequence
  Synthetic
tggagtaataaatctctagacaatatttgggagaacatgacatggatggagtgggatagagaaattaacaattac

SEQ ID NO: 188319 - DNA, 75 bp, Artificial Sequence
  Synthetic
gtggcgcccgaacagggacttgaaagcgaaagtaagaccagagaaagttctctcgacgcaggactcggcttgctg

SEQ ID NO: 188320 - DNA, 75 bp, Artificial Sequence
  Synthetic
caatattagcaatagttgtgtggaccatagtattcatagaatataggaaaatattaagacaaaggaaaatagaca

SEQ ID NO: 188321 - DNA, 75 bp, Artificial Sequence
  Synthetic
agacccggaagaatcgaagaagaaggtggcgagcaagacagagacagatcggtgcgattagtgagcggattctta

SEQ ID NO: 188322 - DNA, 75 bp, Artificial Sequence
  Synthetic
tgttattgtaaaaagtgttgctatcattgcccagtgtgctttctaaacaaaggcttaggcatctcctatggcagg

SEQ ID NO: 188323 - DNA, 75 bp, Artificial Sequence
  Synthetic
tgtaacgaggattgtggaacttctgggacgcagggggtgggaagccctcaaatattggtggaacctcctacaata

SEQ ID NO: 188324 - DNA, 75 bp, Artificial Sequence
  Synthetic
gaacaatataaaaataaaacaatagaatttaaacaatcctcaggaggggacctagaacttgtaatgcacagtgtt

SEQ ID NO: 188325 - DNA, 75 bp, Artificial Sequence
  Synthetic
gtagtaattaatatatgtaatgttacccttagcaacattgtcaatagtaggactgatagtagcgttaatcttagc

SEQ ID NO: 188326 - DNA, 75 bp, Artificial Sequence
  Synthetic
ggatggcctgctgtaagggaaagaatgagacgagctgagccagcagcagatggggtgggagcagtatctcgagac

SEQ ID NO: 188327 - DNA, 75 bp, Artificial Sequence
  Synthetic
agaagtagtacaaaggcttggtagagctatcctcaacatacctagaagaataagacagggtcttgaaagagcttt

SEQ ID NO: 188328 - DNA, 75 bp, Artificial Sequence
  Synthetic
actactagtaatgatactactaataccactagtagtagcatggaaacagaaatgaaaaactgctctttcaatatt

SEQ ID NO: 188329 - DNA, 75 bp, Artificial Sequence
  Synthetic
aagttcttctgatcctgtctgaagggatggttgtagctgtcccagtatttgtctacagccttctgatgtctctaa

SEQ ID NO: 188330 - DNA, 75 bp, Artificial Sequence
  Synthetic
ccactgaagaaataaaaaactgctcttacaggactaccacagaactaaaagataagacgcagagagtctattcac

SEQ ID NO: 188331 - DNA, 75 bp, Artificial Sequence
  Synthetic
aatttttgactagcggaggctagaaggagagagatgggtgcgagagcgtcagtattaagtgggggaaaattagat

SEQ ID NO: 188332 - DNA, 75 bp, Artificial Sequence
  Synthetic
agacccggcaataatacaagaaaaagtataaggataggaccaggacaaacattctatgcaacaaatgacataata

SEQ ID NO: 188333 - DNA, 75 bp, Artificial Sequence
  Synthetic
gagttggaaagattcgcacttaaccctggccttttagaaacagcagaaggatgtcaacaaataatagaacagtta

SEQ ID NO: 188334 - DNA, 75 bp, Artificial Sequence
  Synthetic
attgtacaagacccaacaacaatacaagaaaaggtatacatataggaccagggagagcattttatgcaacaggag

SEQ ID NO: 188335 - DNA, 75 bp, Artificial Sequence
  Synthetic
ggggacctagaaattacaacacatagttttaattgtggaggagaatttttctattgtaatacatcagaactgttt

SEQ ID NO: 188336 - DNA, 75 bp, Artificial Sequence
  Synthetic
ccggcaacaatacaagaagaagtatccgctttggaccaggacaagccttctatacaaatgacataataggggata

SEQ ID NO: 188337 - DNA, 75 bp, Artificial Sequence
  Synthetic
aagcaatgtatgcccctcccattgcaggaaacattacatgtaaatcaaacattacaggactactattaacaagag

SEQ ID NO: 188338 - DNA, 75 bp, Artificial Sequence
  Synthetic
agagcaggccagagccaacagccccaccagcagagagcttcgggttcggggaggagatagccccctccccgaagc

SEQ ID NO: 188339 - DNA, 75 bp, Artificial Sequence
  Synthetic
gcgaaagtaatagggactcgaaagcgaaagttccagagaagttctctcgacgcaggactcggcttgctgaagtgc

SEQ ID NO: 188340 - DNA, 75 bp, Artificial Sequence
  Synthetic
atagttggagtaataaatctcaagattatatttggggaaacatgacctggatgcaatgggataaagaaattagca

SEQ ID NO: 188341 - DNA, 75 bp, Artificial Sequence
  Synthetic
tgggtgcgagagcgtcaatattaagaggggaaaaattagataaatgggaaaaaattaggttaaggccagggggaa

SEQ ID NO: 188342 - DNA, 75 bp, Artificial Sequence
  Synthetic
aaattgcaataatactgtcaccactaatgctagcatgaataatagtggagaaatgaaaaattgctctttcaatat

SEQ ID NO: 188343 - DNA, 75 bp, Artificial Sequence
  Synthetic
tggtcaaaaagcagcatagttggatggcctgatgtaagagaaagaatgagaagaactgagccagcagcagaggga

SEQ ID NO: 188344 - DNA, 75 bp, Artificial Sequence
  Synthetic
gatatcagtacaatgtgcttccacagggatggaaaggatcaccagcaatattccagtgtagcatgacaaaaatct

SEQ ID NO: 188345 - DNA, 75 bp, Artificial Sequence
  Synthetic
agcaatagttgtgtggactatagtaggtatagaaattaagagattgctgaggcaaagaaaaatagataggataat

SEQ ID NO: 188346 - DNA, 75 bp, Artificial Sequence
  Synthetic
gtggaacttctgggacgcagggggtgggaagccctcaaatatctgtggaatctcctacagtattggagtcaggaa

SEQ ID NO: 188347 - DNA, 75 bp, Artificial Sequence
  Synthetic
acagtacaatgtacacatggaattaggccagtagtatcaactcaattgctgttaaatggcagcctagcagaagaa

SEQ ID NO: 188348 - DNA, 75 bp, Artificial Sequence
  Synthetic
caaaaagctggcctgctgtaagagaaagaatatggaaaactaggccagcagcagcagaagcagctaggccagcag

SEQ ID NO: 188349 - DNA, 75 bp, Artificial Sequence
  Synthetic
ctcgatgatggaatgaagggagaaataaaaaattgctctttcaatgcaaccacagaaataaaagataaaaaacgg

SEQ ID NO: 188350 - DNA, 75 bp, Artificial Sequence
  Synthetic
cttgataccatagcaatagcagtagctgagtggacagataggattatagaaataggacaaagagcttgcagagct

SEQ ID NO: 188351 - DNA, 75 bp, Artificial Sequence
  Synthetic
ctccagcagcagaaggagtaggagcagtgtctcaagatttagctgcacgtggagcagtcacaagcagtaatacag

SEQ ID NO: 188352 - DNA, 75 bp, Artificial Sequence
  Synthetic
accaacataaccaataccaacataacggaggacatgaaagaagaaataaaaaactgctcttacaatgtgaccaca

SEQ ID NO: 188353 - DNA, 75 bp, Artificial Sequence
  Synthetic
accaacataaccaataccaacataacggtggacatgaaagaagaaataaaaaactgctcttacaatgtgaccaca

SEQ ID NO: 188354 - DNA, 75 bp, Artificial Sequence
  Synthetic
accaacataaccaataccaacataacggcggacatgaaagaagaaataaaaaactgctcttacaatgtgaccaca

SEQ ID NO: 188355 - DNA, 75 bp, Artificial Sequence
  Synthetic
accaacataaccaataccaacataacgggggacatgaaagaagaaataaaaaactgctcttacaatgtgaccaca

SEQ ID NO: 188356 - DNA, 75 bp, Artificial Sequence
  Synthetic
accaacataaccaattccaacataacggaggacatgaaagaagaaataaaaaactgctcttacaatgtgaccaca

SEQ ID NO: 188357 - DNA, 75 bp, Artificial Sequence
  Synthetic
accaacataaccaattccaacataacggtggacatgaaagaagaaataaaaaactgctcttacaatgtgaccaca

SEQ ID NO: 188358 - DNA, 75 bp, Artificial Sequence
  Synthetic
accaacataaccaattccaacataacggcggacatgaaagaagaaataaaaaactgctcttacaatgtgaccaca

SEQ ID NO: 188359 - DNA, 75 bp, Artificial Sequence
  Synthetic
accaacataaccaattccaacataacgggggacatgaaagaagaaataaaaaactgctcttacaatgtgaccaca

SEQ ID NO: 188360 - DNA, 75 bp, Artificial Sequence
  Synthetic
accaacataaccaatcccaacataacggaggacatgaaagaagaaataaaaaactgctcttacaatgtgaccaca

SEQ ID NO: 188361 - DNA, 75 bp, Artificial Sequence
  Synthetic
accaacataaccaatcccaacataacggtggacatgaaagaagaaataaaaaactgctcttacaatgtgaccaca

SEQ ID NO: 188362 - DNA, 75 bp, Artificial Sequence
  Synthetic
accaacataaccaatcccaacataacggcggacatgaaagaagaaataaaaaactgctcttacaatgtgaccaca

SEQ ID NO: 188363 - DNA, 75 bp, Artificial Sequence
  Synthetic
accaacataaccaatcccaacataacgggggacatgaaagaagaaataaaaaactgctcttacaatgtgaccaca

SEQ ID NO: 188364 - DNA, 75 bp, Artificial Sequence
  Synthetic
accaacataaccaatgccaacataacggaggacatgaaagaagaaataaaaaactgctcttacaatgtgaccaca

SEQ ID NO: 188365 - DNA, 75 bp, Artificial Sequence
  Synthetic
accaacataaccaatgccaacataacggtggacatgaaagaagaaataaaaaactgctcttacaatgtgaccaca

SEQ ID NO: 188366 - DNA, 75 bp, Artificial Sequence
  Synthetic
accaacataaccaatgccaacataacggcggacatgaaagaagaaataaaaaactgctcttacaatgtgaccaca

SEQ ID NO: 188367 - DNA, 75 bp, Artificial Sequence
  Synthetic
accaacataaccaatgccaacataacgggggacatgaaagaagaaataaaaaactgctcttacaatgtgaccaca

SEQ ID NO: 188368 - DNA, 75 bp, Artificial Sequence
  Synthetic
cacaggtacctttaagaccaatgacctacaagggagctgtggatctcagccactttttaaaagaaaaggggggac

SEQ ID NO: 188369 - DNA, 75 bp, Artificial Sequence
  Synthetic
gataggaccaggacaaacattctatgcaacaggagacataataggagacataagacaagcacattgtaacattag

SEQ ID NO: 188370 - DNA, 75 bp, Artificial Sequence
  Synthetic
tagtaattagatctgaaaatatctcaaacaatgctaaaaccataatagtacagcttaatgagtctgtaacaatta

SEQ ID NO: 188371 - DNA, 75 bp, Artificial Sequence
  Synthetic
aagaaaaagtatacgtataggaccaggacaagcattttatgcaacagatataatagggaatataagacaagcaca

SEQ ID NO: 188372 - DNA, 75 bp, Artificial Sequence
  Synthetic
ctatttttagatggaatagataaggcccaagaagaacatgagaaatatcacagtaattggagagcaatggctagt

SEQ ID NO: 188373 - DNA, 75 bp, Artificial Sequence
  Synthetic
gaaaaggaattattggaattggatcaatgggcaagtctgtggagttggtttgacatatcaaattggctgtggtat

SEQ ID NO: 188374 - DNA, 75 bp, Artificial Sequence
  Synthetic
taacttccctcaaatcactctttggcagcgaccccttgtcacaataaaagtagggggccagataaaggaggctct

SEQ ID NO: 188375 - DNA, 75 bp, Artificial Sequence
  Synthetic
ctacagagggggtgggaagcccttaaatatctgggaagccttgtgcagtattggggtctggaactaaaaaagagt

SEQ ID NO: 188376 - DNA, 75 bp, Artificial Sequence
  Synthetic
ttggggtctggaactaaaaaagagtgctattagtctgcttgataccatagcaatagcagtagctgaaggaacaga

SEQ ID NO: 188377 - DNA, 75 bp, Artificial Sequence
  Synthetic
aggacagtactaagtggagaaaattagtagatttcagggaactcaataaaagaactcaagacttttgggaagttc

SEQ ID NO: 188378 - DNA, 75 bp, Artificial Sequence
  Synthetic
aagaattttgcaacaactactgtttgtccatttcaggattgggtgccaacatagcagaataggcattattcgagg

SEQ ID NO: 188379 - DNA, 75 bp, Artificial Sequence
  Synthetic
gagaagaggcagaaatggagccagtagaccctaaaatagagccctggaaccatccaggaagtcagcctaagactg

SEQ ID NO: 188380 - DNA, 75 bp, Artificial Sequence
  Synthetic
tgggaaaaaattcggttaaggccaggaggaaagaaaaaatataaattaaaacatatagtatgggcaagcagggag

SEQ ID NO: 188381 - DNA, 75 bp, Artificial Sequence
  Synthetic
aaaaggagtaggagcagtatctcaagatttagaaaaacatggagcaatcacaagcagtaatataaatcatcctag

SEQ ID NO: 188382 - DNA, 75 bp, Artificial Sequence
  Synthetic
gaatgagaaaagctcctgcagcagcaaaaggagtaggagcagtatctcaagatttagaaaaacatggagcaatca

SEQ ID NO: 188383 - DNA, 75 bp, Artificial Sequence
  Synthetic
gaatgagataagctcctgcagcagcaaaaggagtaggagcagtatctcaagatttagaaaaacatggagcaatca

SEQ ID NO: 188384 - DNA, 75 bp, Artificial Sequence
  Synthetic
gaatgagacaagctcctgcagcagcaaaaggagtaggagcagtatctcaagatttagaaaaacatggagcaatca

SEQ ID NO: 188385 - DNA, 75 bp, Artificial Sequence
  Synthetic
gaatgagagaagctcctgcagcagcaaaaggagtaggagcagtatctcaagatttagaaaaacatggagcaatca

SEQ ID NO: 188386 - DNA, 75 bp, Artificial Sequence
  Synthetic
cctatggcaggaagaagcggagacaacgacgaacagcttatcacgacagtaagaatcatcaagatcctctaccag

SEQ ID NO: 188387 - DNA, 75 bp, Artificial Sequence
  Synthetic
aagaatcatcaagatcctctaccagagcagtaagtatacttaattaagttctgtaatggtatctctacaaatagt

SEQ ID NO: 188388 - DNA, 75 bp, Artificial Sequence
  Synthetic
gaaatgatgacagcatgtcagggagtagggggacccagccataaagcaagagtcttggctgaagcaatgagccaa

SEQ ID NO: 188389 - DNA, 75 bp, Artificial Sequence
  Synthetic
gtaaccaacagcatgattgaagaaaagggagaaatagaaaactgctctttcagggtaaccacagaggtaacatat

SEQ ID NO: 188390 - DNA, 75 bp, Artificial Sequence
  Synthetic
acagtacaatgcacacatggaatcaagccaatagtatcaactcaactactgataaatggcagtctagcaaaaggg

SEQ ID NO: 188391 - DNA, 75 bp, Artificial Sequence
  Synthetic
tatcatgggtaccagcacacaaagggattggaggaaatgaacaagtagataaattagtcagtagtggaatcagga

SEQ ID NO: 188392 - DNA, 75 bp, Artificial Sequence
  Synthetic
atacaagaaaagggatacagataggaccaggacgaactgtctatgcaacaggggctataataggggacataagga

SEQ ID NO: 188393 - DNA, 75 bp, Artificial Sequence
  Synthetic
attttttagggaaaatttggccttcccacaaggggaggccagggaatttcctccagagcaggccagagccaacag

SEQ ID NO: 188394 - DNA, 75 bp, Artificial Sequence
  Synthetic
tgattgtgtggcaggtagacaggatgaagattagaacatggaatagtttagtaaagcaccatatgtatatttcaa

SEQ ID NO: 188395 - DNA, 75 bp, Artificial Sequence
  Synthetic
gcagtccatgtagccagtggctatatagaagcagaagtcatcccagcagaaacaggacaggaaacagcatacttt

SEQ ID NO: 188396 - DNA, 75 bp, Artificial Sequence
  Synthetic
tggaacaggaccatgtaaaaatgtcagcacagtacaatgtacacatggaattaggccagtagtatcaactcaact

SEQ ID NO: 188397 - DNA, 75 bp, Artificial Sequence
  Synthetic
ctcctcaaagcagtaaggatcatcaaaatcctctaccagagcagtaagtaataagtatatgtaatgacaccttta

SEQ ID NO: 188398 - DNA, 75 bp, Artificial Sequence
  Synthetic
ataagtatatgtaatgacacctttagaaattagtgcaatagtaggactgatagtagcgataatcttagcaataat

SEQ ID NO: 188399 - DNA, 75 bp, Artificial Sequence
  Synthetic
ggactttgatccttgggttggtgataacttgtagtgcctcagacaacttgtgggttacagtttattatggggttc

SEQ ID NO: 188400 - DNA, 75 bp, Artificial Sequence
  Synthetic
cacctttgcctagtgttcaaaaactagtagaggatagatggaacaagccccagaagaccaaggaccacagagaga

SEQ ID NO: 188401 - DNA, 75 bp, Artificial Sequence
  Synthetic
tataagatgggtggcaagtggtcaaaaagtagtgtgattggatggcctgctgtaagggaaagaatgagacgagct

SEQ ID NO: 188402 - DNA, 75 bp, Artificial Sequence
  Synthetic
gggaaagattaagacgcactcgtccagtgccagcagcagaaggagtaggagcagtatctaaagatttagaaaaac

SEQ ID NO: 188403 - DNA, 75 bp, Artificial Sequence
  Synthetic
aatagcattaatcatagcaatagttgtgtggaccatagtatatatagaatataggaaattggtaagacaaagaaa

SEQ ID NO: 188404 - DNA, 75 bp, Artificial Sequence
  Synthetic
tacggatcgtcaaaatcctataccagagcagtaagtagtagtaatcaatatatgtaatgacacctttacaaatag

SEQ ID NO: 188405 - DNA, 75 bp, Artificial Sequence
  Synthetic
ggatacagaggaattggcaacacttatggaaatggggaactttgatccttgggttggtgataatttgtagtgcct

SEQ ID NO: 188406 - DNA, 75 bp, Artificial Sequence
  Synthetic
ccaaaactaataatgctacccttaataataccatgtatgaggaaatgagaaattgctctttcaatataaccacag

SEQ ID NO: 188407 - DNA, 75 bp, Artificial Sequence
  Synthetic
cttccatgcaggataaagcaaattgtaaacatgtggcagggagcaggacaagcaatgtatgctcctcccatcagg

SEQ ID NO: 188408 - DNA, 75 bp, Artificial Sequence
  Synthetic
aagcagggagctggaaagattcgcacttaaccctagccttttagaaacaggagaaggatgtcaacaaataatggg

SEQ ID NO: 188409 - DNA, 75 bp, Artificial Sequence
  Synthetic
atattaccaacagtactgccttcaatagtactcttttcaatactaccataaaggaagaaatgaaaaattgctctt

SEQ ID NO: 188410 - DNA, 75 bp, Artificial Sequence
  Synthetic
ttaactgtgaaggacagagaagaaataaaaaactgctctttcaatataaccacagaagtaagagatcagaaaaag

SEQ ID NO: 188411 - DNA, 75 bp, Artificial Sequence
  Synthetic
tgtacatcaagggatagaggtaaaggacaccaaggaggctttagataaaatagaggaaatacaaaataagagcaa

SEQ ID NO: 188412 - DNA, 75 bp, Artificial Sequence
  Synthetic
gacaccaaggaggctttagataaaatagaggaaatacaaaataagagcaagcaaaagaaacagcaggcagaagct

SEQ ID NO: 188413 - DNA, 75 bp, Artificial Sequence
  Synthetic
gttactttaaattgcactgatttgaagaatgttactagtaacagcactgataatagtagtatgacaaattgctct

SEQ ID NO: 188414 - DNA, 75 bp, Artificial Sequence
  Synthetic
ataaaactaaagaagaaatattaaaaacctgctcttacaatatgtctacagaactaagagataagccacagaaag

SEQ ID NO: 188415 - DNA, 75 bp, Artificial Sequence
  Synthetic
ttaggacatatagttagacctaggtgtgaatatcaagcaggacataacaaggtagggtctctacagtacttggca

SEQ ID NO: 188416 - DNA, 75 bp, Artificial Sequence
  Synthetic
aagaacacttccctaataaaacaataaaatttacatcaccctcaggaggggacctagaaattatacaacatacct

SEQ ID NO: 188417 - DNA, 75 bp, Artificial Sequence
  Synthetic
aagtgtacgctttggaccaggacaagtcttctatacaaatgacataataggggatataagagaggcacattgtga

SEQ ID NO: 188418 - DNA, 75 bp, Artificial Sequence
  Synthetic
actccaatgcagaataaaacaaattataaacatgtggcagggggtaggacaagcaatatatgcccctcccattgc

SEQ ID NO: 188419 - DNA, 75 bp, Artificial Sequence
  Synthetic
aaattgtaatgcacagttttaattgtggaggggaatttttctactgtaatacaacacagctgtttaatagtactt

SEQ ID NO: 188420 - DNA, 75 bp, Artificial Sequence
  Synthetic
attggaagaaatctgttgactcagattggttgcactttaaattttcccattagtcctattgaaactgtaccagta

SEQ ID NO: 188421 - DNA, 75 bp, Artificial Sequence
  Synthetic
ttcaaatgacactataacaatcctatgcagaataaaacaaattgtaaatatgtggcaaagagtaggaagagcaat

SEQ ID NO: 188422 - DNA, 75 bp, Artificial Sequence
  Synthetic
attggggtctgcatacaggagaaaaagactggcatttgggtcatggggtctccatagaatggaggctaaaaagat

SEQ ID NO: 188423 - DNA, 75 bp, Artificial Sequence
  Synthetic
acagcgacgaagacctcctcaagacagtcagactcatcaagtttctctatcaaagcagtaagtaatatatgtaat

SEQ ID NO: 188424 - DNA, 75 bp, Artificial Sequence
  Synthetic
agacctggaggaggaaatatgagggacaattggagaagtgaattatataagtataaagtagtaaaaattgaacca

SEQ ID NO: 188425 - DNA, 75 bp, Artificial Sequence
  Synthetic
acatgggaggcaagtggtcaaaaagtagcatagtgggatggcctcaggtcagggaaagaataaagcaaactcctc

SEQ ID NO: 188426 - DNA, 75 bp, Artificial Sequence
  Synthetic
agggaaagaataaagcaaactcctccagcagcagaaggagtaggagcagtatctcaagatctagataaacatgga

SEQ ID NO: 188427 - DNA, 75 bp, Artificial Sequence
  Synthetic
aaataaaagtagcggggcagatgagggaagctctattagatacaggagcagatgatacagtattagaagaaatag

SEQ ID NO: 188428 - DNA, 75 bp, Artificial Sequence
  Synthetic
gtattggggtctggagctaaaaaagagtgctattagtctgcttgataccatagcaatagcagtagctgaaggaac

SEQ ID NO: 188429 - DNA, 75 bp, Artificial Sequence
  Synthetic
ttggataaatgggcaagtctgtggaattggtttgacataacaaattggctgtggtatataaaaatattcataatg

SEQ ID NO: 188430 - DNA, 75 bp, Artificial Sequence
  Synthetic
aaaataacatggtagaacagatgcatgaagatgtaatcagtttatgggatgaaagcctaaaaccatgtgtaaagt

SEQ ID NO: 188431 - DNA, 75 bp, Artificial Sequence
  Synthetic
accagctcttcagacaggaacagaggaacttagatcattatataacacagtagcaactctctattgtgtacatag

SEQ ID NO: 188432 - DNA, 75 bp, Artificial Sequence
  Synthetic
gtggaaactctgggacacagggggtgggagatcctcaaatacctggggaacctggtgtgttattggggacaggaa

SEQ ID NO: 188433 - DNA, 75 bp, Artificial Sequence
  Synthetic
caatgagagaaggcgggaaatgaaaaattgctctttcaatgcaaccacagaattaaatgataggaagcaaaaggt

SEQ ID NO: 188434 - DNA, 75 bp, Artificial Sequence
  Synthetic
agtagagaatacaggctaataaattgtaatacctcaaccattacacaggcttgtccaaaggtatcttgggatcca

SEQ ID NO: 188435 - DNA, 75 bp, Artificial Sequence
  Synthetic
aatcagtttatgggatcaaagcctaaagccatgtgtaaagttgaccccactctgtgtcactttaaattgtacaaa

SEQ ID NO: 188436 - DNA, 75 bp, Artificial Sequence
  Synthetic
tagtaggactggtagtggcgctaatcctagcaatagttgtgtggactatagtaggtatacaaattaagggattgc

SEQ ID NO: 188437 - DNA, 75 bp, Artificial Sequence
  Synthetic
aagccatgtgtaaagttgaccccactctgtgtcactttaaattgtacaaatgctactaggccagttactaggaca

SEQ ID NO: 188438 - DNA, 75 bp, Artificial Sequence
  Synthetic
agcatacctagaagaataagacagggctttgaagcagctttgcaataaaatggggaacaagtggtcaaaaagctg

SEQ ID NO: 188439 - DNA, 75 bp, Artificial Sequence
  Synthetic
gctctttcaatataaccacagaactaagggataagaaaaagaaagagtatgcacttttttatagacttgatatag

SEQ ID NO: 188440 - DNA, 75 bp, Artificial Sequence
  Synthetic
aattataggaataatacaaagaatttgtagggctatcctccacatacctacaagaatcagacagggcctcgaaag

SEQ ID NO: 188441 - DNA, 75 bp, Artificial Sequence
  Synthetic
aacatctagtatgggcaagcagggagctggaaagatttgcacttaaccctggccttttagaaacatcagaaggat

SEQ ID NO: 188442 - DNA, 75 bp, Artificial Sequence
  Synthetic
gagaagtagggataggaccaggacagacattctatacaacaggacaaataataggagacataagacaagcacatt

SEQ ID NO: 188443 - DNA, 75 bp, Artificial Sequence
  Synthetic
gacattctatacaacaggacaaataataggagacataagacaagcacattgcaacattacaggaaaagaatggaa

SEQ ID NO: 188444 - DNA, 75 bp, Artificial Sequence
  Synthetic
agtatgggcaagcagggagctggaaagattcgcacttaaccctggccttttagaaacagcagaaggatgtcaaca

SEQ ID NO: 188445 - DNA, 75 bp, Artificial Sequence
  Synthetic
aacgatttgcacttaatcctggcctattagagacagcagaaggctgtaggcaaataatggaacagttacaaccag

SEQ ID NO: 188446 - DNA, 75 bp, Artificial Sequence
  Synthetic
acaccaaggaagctttagataagatagaggaagagcaaaacaaaagtaagaaaaaggcacagcaagcagcagctg

SEQ ID NO: 188447 - DNA, 75 bp, Artificial Sequence
  Synthetic
tattggcaggccacctggattcctgaatgggagtttgtcaataccccccctctagtaaaattatggtaccagtta

SEQ ID NO: 188448 - DNA, 75 bp, Artificial Sequence
  Synthetic
gaaaaagcatacgtataggaccaggacaagtattctatgcaagggagataataggggatataagacaagcatatt

SEQ ID NO: 188449 - DNA, 75 bp, Artificial Sequence
  Synthetic
gtactaagtggagaaaattagtagatttcagagaacttaataaaagaactcaagacttctgggaagttcaattag

SEQ ID NO: 188450 - DNA, 75 bp, Artificial Sequence
  Synthetic
tggagaagtgaattatacaaatataaagtagtaaaaattgaaccactaggagtagcacccaccaaggcaaagaga

SEQ ID NO: 188451 - DNA, 75 bp, Artificial Sequence
  Synthetic
gcattaggaccaggggctacattagaagaaatgatgacagcatgtcagggagtgggaggacccggccataaagca

SEQ ID NO: 188452 - DNA, 75 bp, Artificial Sequence
  Synthetic
aatttcaccagtgctgcagttaaagcagcctgttggtgggcagatatccaacaggaatttgggattccctacaat

SEQ ID NO: 188453 - DNA, 75 bp, Artificial Sequence
  Synthetic
tgagagacaggctaattttttagggaaaatctggccttccagcaaagggaggccagggaactttcctcagagcag

SEQ ID NO: 188454 - DNA, 75 bp, Artificial Sequence
  Synthetic
tgagatatgggataatatgacctggctgcaatgggataaggaaattagcaattacacaaacacaatatacactct

SEQ ID NO: 188455 - DNA, 75 bp, Artificial Sequence
  Synthetic
aagggaaagaatgaggcgaactgagccagcaactgagccagcagcagatggggtgggagcagtatctcgagactt

SEQ ID NO: 188456 - DNA, 75 bp, Artificial Sequence
  Synthetic
agacctcaggtacctttaagaccaatgacctataaggcagctttagatctcagccactttttaaaagaaaagggg

SEQ ID NO: 188457 - DNA, 75 bp, Artificial Sequence
  Synthetic
cctagaagaataagacagggctttgaagcagctttgctataaaatggggaacaagtggtcaaaaagctggcctgc

SEQ ID NO: 188458 - DNA, 75 bp, Artificial Sequence
  Synthetic
gaccaatggacatatcaaatttaccaagaaccattcaaaaatctgaaaacaggaaagtatgcaaaaatgaggact

SEQ ID NO: 188459 - DNA, 75 bp, Artificial Sequence
  Synthetic
agttatctatcaatatatggatgacttgtatgtaggatctgatttagaaatagggcaacatagagcaaaaataga

SEQ ID NO: 188460 - DNA, 75 bp, Artificial Sequence
  Synthetic
acagcagtctcaaggggttgagactggggtgggaaggcctcaagtatctgtggaatctcctggtgtattggggtc

SEQ ID NO: 188461 - DNA, 75 bp, Artificial Sequence
  Synthetic
aggacaaagccacctttgcctagtgttaagaaattagcagaggatagatggaacaagccccagaagaccaggggc

SEQ ID NO: 188462 - DNA, 75 bp, Artificial Sequence
  Synthetic
aaaattgctctttcaatatcaccacaaacataagagataaggtaaagaaagaatatgcactttttaataaacttg

SEQ ID NO: 188463 - DNA, 75 bp, Artificial Sequence
  Synthetic
caccatagcagaataggcattattcgagggagaagaggcagaaatggagccagtagaccctaacatagagccctg

SEQ ID NO: 188464 - DNA, 75 bp, Artificial Sequence
  Synthetic
gcaagaagaagatgaagatggggtgggctttccagtcaggccacaagtaccattgaggcctatgacttacaaggg

SEQ ID NO: 188465 - DNA, 75 bp, Artificial Sequence
  Synthetic
gaaatagggcagcatagaacaaaaatagaggaattaagagaacatctattgaaatggggatttaccacaccagac

SEQ ID NO: 188466 - DNA, 75 bp, Artificial Sequence
  Synthetic
aacatctattgaaatggggatttaccacaccagataaaaaacatcagaaagaacccccatttctttggatggggt

SEQ ID NO: 188467 - DNA, 75 bp, Artificial Sequence
  Synthetic
ggactgtcaatgatatacagaagttagtaggaaaattaaattgggcaagtcagatttatgcagggattaaagtaa

SEQ ID NO: 188468 - DNA, 75 bp, Artificial Sequence
  Synthetic
ccagcagcagatggggtgggagcagtatctcgagacctagaaaaacatggagcaatcacaagtagcaatacagca

SEQ ID NO: 188469 - DNA, 75 bp, Artificial Sequence
  Synthetic
agtaagcatagtagcattaatagtagcatttattatagtagtaattgtgtggactatagtaggtatagaatatag

SEQ ID NO: 188470 - DNA, 75 bp, Artificial Sequence
  Synthetic
acagatagagataaaagacaccaaggaagctctagataaaatagaggaaatacaaaagaaaagcaagcaaaaagc

SEQ ID NO: 188471 - DNA, 75 bp, Artificial Sequence
  Synthetic
acagatagtgataaaagacaccaaggaagctctagataaaatagaggaaatacaaaagaaaagcaagcaaaaagc

SEQ ID NO: 188472 - DNA, 75 bp, Artificial Sequence
  Synthetic
acagatagcgataaaagacaccaaggaagctctagataaaatagaggaaatacaaaagaaaagcaagcaaaaagc

SEQ ID NO: 188473 - DNA, 75 bp, Artificial Sequence
  Synthetic
acagatagggataaaagacaccaaggaagctctagataaaatagaggaaatacaaaagaaaagcaagcaaaaagc

SEQ ID NO: 188474 - DNA, 75 bp, Artificial Sequence
  Synthetic
atcctcaggaggggacccagaaattgtaatgcacagttttaattgtggaggggaattcttctactgtaatacaac

SEQ ID NO: 188475 - DNA, 75 bp, Artificial Sequence
  Synthetic
atgacaggcaacccacctattccagtgggagacatctacaaaagatggataatcctggggttaaataaaatagta

SEQ ID NO: 188476 - DNA, 75 bp, Artificial Sequence
  Synthetic
ttcatctagctttgcaggattcaggatcagaagtaaatatagtaacagactcacagtatgcattaggaatcattc

SEQ ID NO: 188477 - DNA, 75 bp, Artificial Sequence
  Synthetic
aatgtcagcacagtacaatgtacacatggaatcaggccagtagtatcaactcaactgctgttaaatggcagtcta

SEQ ID NO: 188478 - DNA, 75 bp, Artificial Sequence
  Synthetic
actgctctttcaatataaccacagaaataaaagataggaagagggaagaatacgcgcttttctataaacttgata

SEQ ID NO: 188479 - DNA, 75 bp, Artificial Sequence
  Synthetic
agggccatgtaagaatgtcagcacagtacaatgcacacatggaatcaagccagtagtatcaactcaactactgtt

SEQ ID NO: 188480 - DNA, 75 bp, Artificial Sequence
  Synthetic
gtacaatgcacacatggaatcaagccagtagtatcaactcaactactgttaaatggcagtctagcagaaggagag

SEQ ID NO: 188481 - DNA, 75 bp, Artificial Sequence
  Synthetic
ttgattgttttgcagaatctgccataagacaagccatattaggacatatagtttttcctaggtgtgattatcaag

SEQ ID NO: 188482 - DNA, 75 bp, Artificial Sequence
  Synthetic
acaacacatagctttaattgtagaggagaatttttctattgcaatacatcacaactgtttaatagcacttgggat

SEQ ID NO: 188483 - DNA, 75 bp, Artificial Sequence
  Synthetic
tactgtttgttcatttcagaattgggtgtcagcatagcagaataggcattatgcgacagagaagagcaagaaatg

SEQ ID NO: 188484 - DNA, 75 bp, Artificial Sequence
  Synthetic
gaacttttggaggagcttaaaagtgaagctgttagacattttcctagaccatggctccataacataggacagtat

SEQ ID NO: 188485 - DNA, 75 bp, Artificial Sequence
  Synthetic
catttcagcatcgggtgccatcatagcagaataggcatcataaggcagagaagagggagaaatggagccaataga

SEQ ID NO: 188486 - DNA, 75 bp, Artificial Sequence
  Synthetic
agaaatgaaaaattgctctttcaatataaccacagaaataagagataagaaaaaggaggaatatgcactttttta

SEQ ID NO: 188487 - DNA, 75 bp, Artificial Sequence
  Synthetic
gcaaggcaggaccagatcgattcgattggtcaacgggttcttagcgcttgcctgggacgatctgaggaacctgtg

SEQ ID NO: 188488 - DNA, 75 bp, Artificial Sequence
  Synthetic
ttggtcaacgggttcttagcgcttgcctgggacgatctgaggaacctgtgcctttggagctaccacagattgaga

SEQ ID NO: 188489 - DNA, 75 bp, Artificial Sequence
  Synthetic
aattaatatatgtaatgttacctttagctatagtagcaatagtagcactgatagcagctggcatcttagcagtag

SEQ ID NO: 188490 - DNA, 75 bp, Artificial Sequence
  Synthetic
aataaaacaatagacgaaggaatgggaaatgaaataaaaaattgctctttcaatacaaccacagaactgagggat

SEQ ID NO: 188491 - DNA, 75 bp, Artificial Sequence
  Synthetic
aataatatgtacacttgtcataatgatacttacaagaatgaactaatgacaaattgcgctttcaatgtaactgaa

SEQ ID NO: 188492 - DNA, 75 bp, Artificial Sequence
  Synthetic
ggtgggaaatggtcaaaaagtagcatagtgggatggcctgagattagggaaagaataagacagactccttcagca

SEQ ID NO: 188493 - DNA, 75 bp, Artificial Sequence
  Synthetic
gtgggtcacagtatactatggagtacctgtgtggaaagatgcagagaccaccctattttgtgcctcagatgctaa

SEQ ID NO: 188494 - DNA, 75 bp, Artificial Sequence
  Synthetic
ctattttgtgcatctgatgctaaagcatatagtactgaaaagcataatgtctgggctacacatgcttgtgtaccc

SEQ ID NO: 188495 - DNA, 75 bp, Artificial Sequence
  Synthetic
tgctctttcaatacaaccacagaaataagagataagaaacaaaaggagtatgcacttttttataaacctgatata

SEQ ID NO: 188496 - DNA, 75 bp, Artificial Sequence
  Synthetic
ccgcctgctggtgggcagggatcaagcaggaatttggcattccctacaatccccaaagtcaaggagtagtagaat

SEQ ID NO: 188497 - DNA, 75 bp, Artificial Sequence
  Synthetic
agacatgaaaaactgctctttcaatgtcacctcaaacataagagataaagtacagaaagaatatgcactttttta

SEQ ID NO: 188498 - DNA, 75 bp, Artificial Sequence
  Synthetic
gggacctagaaattactacacatagctttaattgtagaggggaatttttctattgcaatacatcaggcctgttta

SEQ ID NO: 188499 - DNA, 75 bp, Artificial Sequence
  Synthetic
gtttatgggatgaaagcctaaagccatgtgtaaagctaacccctctctgtgttactttaaactgtgttaacatca

SEQ ID NO: 188500 - DNA, 75 bp, Artificial Sequence
  Synthetic
acactcccatgcagaataaaacaaattataaacatgtggcagggggtaggacgagcaatgtatgcccctcccatt

SEQ ID NO: 188501 - DNA, 75 bp, Artificial Sequence
  Synthetic
ccgcaccaataccaatggcagcaccactttcaatgataccattggagaaataaaaaactgctctttcaatatgac

SEQ ID NO: 188502 - DNA, 75 bp, Artificial Sequence
  Synthetic
aaataaaatagtaaggatgtatagtcctaccagcattttggacataaaacaaggaccaaaggaaccctttagaga

SEQ ID NO: 188503 - DNA, 75 bp, Artificial Sequence
  Synthetic
ggacaagcattctatgcaacaggagatataataggagatataagaaaagcatattgtaccattaatgaaagtaaa

SEQ ID NO: 188504 - DNA, 75 bp, Artificial Sequence
  Synthetic
ctataaacttgatgtactccaaatgaatagtaatgataataatagtacttttaggctaataaattgtaactcctc

SEQ ID NO: 188505 - DNA, 75 bp, Artificial Sequence
  Synthetic
ggtgatgattgtgtggcaagtagacaggatgaggattagaacatggaacagtttagtaaaacaccataagtatat
